United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 2

SEQ ID NO: 37259 - RNA, 22 nt, Human
ggccucaucacagugcauuagu

SEQ ID NO: 37260 - RNA, 22 nt, Human
ggccuccaggccuacucagggc

SEQ ID NO: 37261 - RNA, 22 nt, Human
ggccuccaucuuaucuuacucu

SEQ ID NO: 37262 - RNA, 20 nt, Human
ggccucggacuucaucguag

SEQ ID NO: 37263 - RNA, 22 nt, Human
ggccucucauucucccuggucc

SEQ ID NO: 37264 - RNA, 22 nt, Human
ggccucucgaagcuucagucca

SEQ ID NO: 37265 - RNA, 22 nt, Human
ggccucucucccuggcuugcag

SEQ ID NO: 37266 - RNA, 22 nt, Human
ggccucucuccuuggcuugcag

SEQ ID NO: 37267 - RNA, 22 nt, Human
ggccucucugagagcagacguu

SEQ ID NO: 37268 - RNA, 22 nt, Human
ggccucugccccagccacaccu

SEQ ID NO: 37269 - RNA, 22 nt, Human
ggccucugccccgcggggcucg

SEQ ID NO: 37270 - RNA, 18 nt, Human
ggccucuggacuggcagc

SEQ ID NO: 37271 - RNA, 22 nt, Human
ggccucuggugccugaagcgcc

SEQ ID NO: 37272 - RNA, 21 nt, Human
ggccugaaaaagugaaugcuu

SEQ ID NO: 37273 - RNA, 22 nt, Human
ggccugacaagugggaagaggc

SEQ ID NO: 37274 - RNA, 22 nt, Human
ggccugacuugaucggcucucu

SEQ ID NO: 37275 - RNA, 21 nt, Human
ggccugaguauaggacaggcc

SEQ ID NO: 37276 - RNA, 22 nt, Human
ggccugagucacaucaggagag

SEQ ID NO: 37277 - RNA, 22 nt, Human
ggccugagucccaccuggcugu

SEQ ID NO: 37278 - RNA, 22 nt, Human
ggccugccucacagucagcacc

SEQ ID NO: 37279 - RNA, 22 nt, Human
ggccugcucugcagccucuaca

SEQ ID NO: 37280 - RNA, 22 nt, Human
ggccugcucuggcuguggucag

SEQ ID NO: 37281 - RNA, 22 nt, Human
ggccugcugcuaugacuuccug

SEQ ID NO: 37282 - RNA, 22 nt, Human
ggccuggaagaggacagagaaa

SEQ ID NO: 37283 - RNA, 19 nt, Human
ggccuggauuuagggcucc

SEQ ID NO: 37284 - RNA, 22 nt, Human
ggccuggcccucccggguucaa

SEQ ID NO: 37285 - RNA, 22 nt, Human
ggccuggcugguucaguacccu

SEQ ID NO: 37286 - RNA, 22 nt, Human
ggccugugguuucuaguagguu

SEQ ID NO: 37287 - RNA, 22 nt, Human
ggccugugucggccccggguuc

SEQ ID NO: 37288 - RNA, 22 nt, Human
ggccuuagagaccaccuagucu

SEQ ID NO: 37289 - RNA, 18 nt, Human
ggccuuaguaugugccuu

SEQ ID NO: 37290 - RNA, 22 nt, Human
ggccuuccaucugccucuguuu

SEQ ID NO: 37291 - RNA, 22 nt, Human
ggccuuccuggcggcucagggu

SEQ ID NO: 37292 - RNA, 22 nt, Human
ggccuuccuguuguguccaccg

SEQ ID NO: 37293 - RNA, 22 nt, Human
ggccuuccuucccagccuacug

SEQ ID NO: 37294 - RNA, 22 nt, Human
ggccuugacaguuaagagaccu

SEQ ID NO: 37295 - RNA, 22 nt, Human
ggccuugauccuccagagcacu

SEQ ID NO: 37296 - RNA, 19 nt, Human
ggccuugaugaguggggag

SEQ ID NO: 37297 - RNA, 22 nt, Human
ggccuugcggaacgcucaggcg

SEQ ID NO: 37298 - RNA, 22 nt, Human
ggccuugcugcuuccagaaggu

SEQ ID NO: 37299 - RNA, 22 nt, Human
ggccuuggauuuuacccuaaag

SEQ ID NO: 37300 - RNA, 22 nt, Human
ggccuuggcuccugcagggagu

SEQ ID NO: 37301 - RNA, 17 nt, Human
ggccuugggcugcucuu

SEQ ID NO: 37302 - RNA, 22 nt, Human
ggccuugggcuggcugcaguau

SEQ ID NO: 37303 - RNA, 22 nt, Human
ggccuugggguggccuuguccc

SEQ ID NO: 37304 - RNA, 22 nt, Human
ggccuuggugcucuguguugca

SEQ ID NO: 37305 - RNA, 22 nt, Human
ggccuugguucugucacagccg

SEQ ID NO: 37306 - RNA, 20 nt, Human
ggcgccuggccucauggcug

SEQ ID NO: 37307 - RNA, 22 nt, Human
ggcgcucaguguugccccagag

SEQ ID NO: 37308 - RNA, 22 nt, Human
ggcggagguugcaguaagccga

SEQ ID NO: 37309 - RNA, 22 nt, Human
ggcggcgcguagccggagacuu

SEQ ID NO: 37310 - RNA, 19 nt, Human
ggcggguggacuggagccc

SEQ ID NO: 37311 - RNA, 22 nt, Human
ggcggguguaaguaggacagcg

SEQ ID NO: 37312 - RNA, 22 nt, Human
ggcguugcucuccccaggcuca

SEQ ID NO: 37313 - RNA, 22 nt, Human
ggcuaaggacgggcaaguccca

SEQ ID NO: 37314 - RNA, 22 nt, Human
ggcuacugugauggucugcaag

SEQ ID NO: 37315 - RNA, 22 nt, Human
ggcuagaauaauugacuucauu

SEQ ID NO: 37316 - RNA, 21 nt, Human
ggcuaggaugcugggguuucc

SEQ ID NO: 37317 - RNA, 22 nt, Human
ggcuaggcaggcucagagccua

SEQ ID NO: 37318 - RNA, 22 nt, Human
ggcuagggaaauccugauccaa

SEQ ID NO: 37319 - RNA, 22 nt, Human
ggcuagggagacagagggcaug

SEQ ID NO: 37320 - RNA, 22 nt, Human
ucaagcaacugaauucuaaaag

SEQ ID NO: 37321 - RNA, 22 nt, Human
ucaagcaaguugcauauugcua

SEQ ID NO: 37322 - RNA, 22 nt, Human
ucaagcagagucaaaaguacca

SEQ ID NO: 37323 - RNA, 20 nt, Human
ucaagcuaguuuccaaaguu

SEQ ID NO: 37324 - RNA, 22 nt, Human
ucaagcugcaucagugcaguga

SEQ ID NO: 37325 - RNA, 22 nt, Human
ucaaggaagauagcuauuauga

SEQ ID NO: 37326 - RNA, 22 nt, Human
ucaaggaaggucuguugcucca

SEQ ID NO: 37327 - RNA, 22 nt, Human
ucaaggaauuuaguuuaguaaa

SEQ ID NO: 37328 - RNA, 20 nt, Human
ucaaggacucccugggaaga

SEQ ID NO: 37329 - RNA, 22 nt, Human
ucaaggagcccacagucuaaug

SEQ ID NO: 37330 - RNA, 22 nt, Human
ucaaggcacuucaugucucagu

SEQ ID NO: 37331 - RNA, 22 nt, Human
ucaaggcuaaacuuucagagua

SEQ ID NO: 37332 - RNA, 22 nt, Human
ucaagggaggagacacagcccu

SEQ ID NO: 37333 - RNA, 22 nt, Human
ucaaggugacugaacuauaaac

SEQ ID NO: 37334 - RNA, 22 nt, Human
ucaaguauaucuagucauuagg

SEQ ID NO: 37335 - RNA, 22 nt, Human
ucaaguaugacaucaaguuucu

SEQ ID NO: 37336 - RNA, 22 nt, Human
ucaagucauuugacuguguguu

SEQ ID NO: 37337 - RNA, 22 nt, Human
ucaaguccugcuguggaccaca

SEQ ID NO: 37338 - RNA, 22 nt, Human
ucaagucucaauguauuauggu

SEQ ID NO: 37339 - RNA, 22 nt, Human
ucaagucuggagaucuggaacu

SEQ ID NO: 37340 - RNA, 22 nt, Human
ucaagucuugagggacagcauu

SEQ ID NO: 37341 - RNA, 22 nt, Human
ucacaucuuauuagaguaucuc

SEQ ID NO: 37342 - RNA, 22 nt, Human
ucacaugaguauuauuuuccaa

SEQ ID NO: 37343 - RNA, 20 nt, Human
ucacaugcauauucguuucu

SEQ ID NO: 37344 - RNA, 22 nt, Human
ucacaugccacagaugaggcaa

SEQ ID NO: 37345 - RNA, 21 nt, Human
ucacaugcuuauuccuggaau

SEQ ID NO: 37346 - RNA, 22 nt, Human
ucacaugucaagaagauaauuu

SEQ ID NO: 37347 - RNA, 22 nt, Human
ucacaugucacaaaacacugcc

SEQ ID NO: 37348 - RNA, 22 nt, Human
ucacauucuagaauguuaucgu

SEQ ID NO: 37349 - RNA, 22 nt, Human
ucacauuguucuuaguuuaccu

SEQ ID NO: 37350 - RNA, 22 nt, Human
ucacauuuauacuccauuugca

SEQ ID NO: 37351 - RNA, 22 nt, Human
ucacauuuauuucaaaguuacu

SEQ ID NO: 37352 - RNA, 22 nt, Human
ucacauuugcaauugcauuguu

SEQ ID NO: 37353 - RNA, 22 nt, Human
ucacauuugcuaucccacuccu

SEQ ID NO: 37354 - RNA, 22 nt, Human
ucacauuuguguuuuauuagag

SEQ ID NO: 37355 - RNA, 22 nt, Human
ucacauuuguuccucugcacuu

SEQ ID NO: 37356 - RNA, 22 nt, Human
ucacauuuguucuugaaucuaa

SEQ ID NO: 37357 - RNA, 22 nt, Human
ucacauuuucuacuacuguacg

SEQ ID NO: 37358 - RNA, 22 nt, Human
ucaccaguuaaaauaacaguaa

SEQ ID NO: 37359 - RNA, 22 nt, Human
ucacccagacugucugacucuu

SEQ ID NO: 37360 - RNA, 22 nt, Human
ucacccagccuuggcggguuug

SEQ ID NO: 37361 - RNA, 22 nt, Human
ucaccgccuugcccggccgggc

SEQ ID NO: 37362 - RNA, 22 nt, Human
ucaccgucgggggucgcugucu

SEQ ID NO: 37363 - RNA, 20 nt, Human
ucaccuaaaccagcaguuuc

SEQ ID NO: 37364 - RNA, 21 nt, Human
ucaccuggcuucugaccuggc

SEQ ID NO: 37365 - RNA, 22 nt, Human
ucaccuguucaacagcaauaau

SEQ ID NO: 37366 - RNA, 22 nt, Human
ucaccuuagcuagaggaagaga

SEQ ID NO: 37367 - RNA, 20 nt, Human
ucaccuuuguugguauucau

SEQ ID NO: 37368 - RNA, 22 nt, Human
ucacgagggcccugggcagcug

SEQ ID NO: 37369 - RNA, 22 nt, Human
ucacgugagggaccugugucug

SEQ ID NO: 37370 - RNA, 22 nt, Human
ucacguuuuacugagugagaua

SEQ ID NO: 37371 - RNA, 22 nt, Human
ucacuaaguuacauuuaguauu

SEQ ID NO: 37372 - RNA, 22 nt, Human
ucacuaaugagcuaaggaaaag

SEQ ID NO: 37373 - RNA, 22 nt, Human
ucacuaaugauuuugaaagaag

SEQ ID NO: 37374 - RNA, 22 nt, Human
ucacuacaaaagucucccuuuc

SEQ ID NO: 37375 - RNA, 22 nt, Human
ucacuacaaccgcuaccugaca

SEQ ID NO: 37376 - RNA, 20 nt, Human
ucacuaguaaccaucugcuu

SEQ ID NO: 37377 - RNA, 22 nt, Human
ucacuagucaucaacuuccauu

SEQ ID NO: 37378 - RNA, 22 nt, Human
ucacuagucgcggggggaggua

SEQ ID NO: 37379 - RNA, 22 nt, Human
ucacucagcuagcuucaggagc

SEQ ID NO: 37380 - RNA, 22 nt, Human
ucacuccaucuuugcuacuggu

SEQ ID NO: 37381 - RNA, 22 nt, Human
ucacucugacuuggccuccaac

SEQ ID NO: 37382 - RNA, 22 nt, Human
ucacucuggccucugcagcagu

SEQ ID NO: 37383 - RNA, 22 nt, Human
ucacucugggccagcgcaggua

SEQ ID NO: 37384 - RNA, 22 nt, Human
ucacucugucccccauugagau

SEQ ID NO: 37385 - RNA, 22 nt, Human
ucacucuguuagaggaaagugc

SEQ ID NO: 37386 - RNA, 22 nt, Human
ucacugaaaaccauacuucuuu

SEQ ID NO: 37387 - RNA, 22 nt, Human
ucacugaagacugggcucuaaa

SEQ ID NO: 37388 - RNA, 21 nt, Human
ucacugaagccuaagauguuu

SEQ ID NO: 37389 - RNA, 22 nt, Human
ucacugaauacuugucucaucc

SEQ ID NO: 37390 - RNA, 22 nt, Human
ucacugaaugcagauacgugac

SEQ ID NO: 37391 - RNA, 22 nt, Human
ucacugauuaugaaaaugaagg

SEQ ID NO: 37392 - RNA, 22 nt, Human
ucacugcaaucucugccuucca

SEQ ID NO: 37393 - RNA, 21 nt, Human
ucacugcaaugcuaggagaaa

SEQ ID NO: 37394 - RNA, 22 nt, Human
ucacugcgcugacugcuacgau

SEQ ID NO: 37395 - RNA, 22 nt, Human
ucacugcucgauaacaugauua

SEQ ID NO: 37396 - RNA, 22 nt, Human
ucacugcuuuguuuacaacuau

SEQ ID NO: 37397 - RNA, 22 nt, Human
ucacuggaaaugcacagcugua

SEQ ID NO: 37398 - RNA, 21 nt, Human
ucacuggaauacaauugauuu

SEQ ID NO: 37399 - RNA, 22 nt, Human
ucacugggcaucggagcugaaa

SEQ ID NO: 37400 - RNA, 22 nt, Human
ucacuggguaggacaugcugau

SEQ ID NO: 37401 - RNA, 22 nt, Human
ucacuggucuuuggcuucucag

SEQ ID NO: 37402 - RNA, 22 nt, Human
ucacuguaaacuaggucagucc

SEQ ID NO: 37403 - RNA, 22 nt, Human
ucacuguauuuggaagggaugg

SEQ ID NO: 37404 - RNA, 22 nt, Human
ucacugucugaaagaaauggcc

SEQ ID NO: 37405 - RNA, 22 nt, Human
ucacugucuuuuaaggugguua

SEQ ID NO: 37406 - RNA, 21 nt, Human
ucacugugcaaauguugaugg

SEQ ID NO: 37407 - RNA, 19 nt, Human
ucacuucuguuagcaugga

SEQ ID NO: 37408 - RNA, 22 nt, Human
ucacuucuucccuugcacauau

SEQ ID NO: 37409 - RNA, 20 nt, Human
ucacuucuuccuuuugucua

SEQ ID NO: 37410 - RNA, 22 nt, Human
ucacuugaccucuugaacuccu

SEQ ID NO: 37411 - RNA, 22 nt, Human
ucacuugagagauauuagaagu

SEQ ID NO: 37412 - RNA, 22 nt, Human
ucacuuuaccucauucaggcag

SEQ ID NO: 37413 - RNA, 22 nt, Human
ucacuuuuugauaucauucugc

SEQ ID NO: 37414 - RNA, 22 nt, Human
ucagaaaagguagcugugacaa

SEQ ID NO: 37415 - RNA, 22 nt, Human
ucagaaacacucuucuucuguc

SEQ ID NO: 37416 - RNA, 22 nt, Human
ucagaaaccagcucucucaauu

SEQ ID NO: 37417 - RNA, 22 nt, Human
ucagaaagguucuauguuuuac

SEQ ID NO: 37418 - RNA, 22 nt, Human
ucagaaagugaacuguugacau

SEQ ID NO: 37419 - RNA, 22 nt, Human
ucagaaauacaaaacacuuacu

SEQ ID NO: 37420 - RNA, 22 nt, Human
ucagaaauacuaucagcuuuug

SEQ ID NO: 37421 - RNA, 22 nt, Human
ucagaaauagucuuuaaaauga

SEQ ID NO: 37422 - RNA, 22 nt, Human
ucagaaauguaagcugaugacu

SEQ ID NO: 37423 - RNA, 22 nt, Human
ucagaaauuuaggcuggacuug

SEQ ID NO: 37424 - RNA, 22 nt, Human
ucagaacagaagcuggcuauaa

SEQ ID NO: 37425 - RNA, 20 nt, Human
ucagaacaguagaggagcua

SEQ ID NO: 37426 - RNA, 22 nt, Human
ucagaacagugccuggcacuaa

SEQ ID NO: 37427 - RNA, 22 nt, Human
ucagaacauggcauguuccauc

SEQ ID NO: 37428 - RNA, 22 nt, Human
ucagaacauuaaggauuugaag

SEQ ID NO: 37429 - RNA, 22 nt, Human
ucagaacauugacauucuuauu

SEQ ID NO: 37430 - RNA, 22 nt, Human
ucagaacauuugggacuuuggg

SEQ ID NO: 37431 - RNA, 22 nt, Human
ucagaagaguaauagggugaga

SEQ ID NO: 37432 - RNA, 22 nt, Human
ucagaagcaaacaucacucuag

SEQ ID NO: 37433 - RNA, 22 nt, Human
ucagaagcagauauuucaaaau

SEQ ID NO: 37434 - RNA, 22 nt, Human
ucagaagcauguggggagccug

SEQ ID NO: 37435 - RNA, 22 nt, Human
ucagaagccaccuuuuguuggg

SEQ ID NO: 37436 - RNA, 22 nt, Human
ucagaagcugggucucagaagc

SEQ ID NO: 37437 - RNA, 22 nt, Human
ucagaaggaaacgaugccagcu

SEQ ID NO: 37438 - RNA, 22 nt, Human
ggcuauccauggaucugaacuc

SEQ ID NO: 37439 - RNA, 22 nt, Human
ggcuauggcaaagaacucagau

SEQ ID NO: 37440 - RNA, 22 nt, Human
ggcuauguggucauauaagaua

SEQ ID NO: 37441 - RNA, 22 nt, Human
ggcucagaccucccagcuccag

SEQ ID NO: 37442 - RNA, 22 nt, Human
ggcucagcaaugaugagccccu

SEQ ID NO: 37443 - RNA, 22 nt, Human
ggcucaggccuguaauccuagc

SEQ ID NO: 37444 - RNA, 22 nt, Human
ggcucaggggccaggccugucc

SEQ ID NO: 37445 - RNA, 22 nt, Human
ggcucagguugggucacaugac

SEQ ID NO: 37446 - RNA, 20 nt, Human
ggcucaucuugucugcugac

SEQ ID NO: 37447 - RNA, 22 nt, Human
ggcuccacaauuacacacugga

SEQ ID NO: 37448 - RNA, 22 nt, Human
ggcuccagauguccccuggcaa

SEQ ID NO: 37449 - RNA, 22 nt, Human
ggcuccagcccuggcucuucac

SEQ ID NO: 37450 - RNA, 22 nt, Human
gcagguggggcugcuaccagaa

SEQ ID NO: 37451 - RNA, 22 nt, Human
gcaggugguccccguggagugg

SEQ ID NO: 37452 - RNA, 22 nt, Human
gcaggugguuaaggucccaugu

SEQ ID NO: 37453 - RNA, 23 nt, Human
gcaggugguucgaacagaaguuu

SEQ ID NO: 37454 - RNA, 22 nt, Human
gcagguguccugggcuggcagu

SEQ ID NO: 37455 - RNA, 22 nt, Human
gcaggugucuucauggaacucu

SEQ ID NO: 37456 - RNA, 18 nt, Human
gcagguguggagaagggg

SEQ ID NO: 37457 - RNA, 22 nt, Human
gcagguguggaguggggugagc

SEQ ID NO: 37458 - RNA, 22 nt, Human
gcagguguuuuaagacauugaa

SEQ ID NO: 37459 - RNA, 22 nt, Human
gcaguaggagaagaggaugcuu

SEQ ID NO: 37460 - RNA, 18 nt, Human
gcaguaggcgcgcaggac

SEQ ID NO: 37461 - RNA, 22 nt, Human
gcaguaguucgucuguguuccc

SEQ ID NO: 37462 - RNA, 22 nt, Human
gcaguaguuuauggcuaaaccu

SEQ ID NO: 37463 - RNA, 22 nt, Human
gcaguaucuaugugauggguug

SEQ ID NO: 37464 - RNA, 21 nt, Human
gcagucacucgguuggcuacc

SEQ ID NO: 37465 - RNA, 22 nt, Human
gcagucagacaggaggagcucc

SEQ ID NO: 37466 - RNA, 22 nt, Human
gcaguccucauccuuuagcagu

SEQ ID NO: 37467 - RNA, 22 nt, Human
gcaguccucguaaaggucgaag

SEQ ID NO: 37468 - RNA, 22 nt, Human
gcaguccugggauucuguccuu

SEQ ID NO: 37469 - RNA, 22 nt, Human
gcagucuccauauacauuuaca

SEQ ID NO: 37470 - RNA, 20 nt, Human
gcagucugucacagagcaug

SEQ ID NO: 37471 - RNA, 19 nt, Human
gcagucuguugaagggcag

SEQ ID NO: 37472 - RNA, 22 nt, Human
gcagucuuuuucuucuagcuaa

SEQ ID NO: 37473 - RNA, 22 nt, Human
gcagugaaacaauaggaucaaa

SEQ ID NO: 37474 - RNA, 22 nt, Human
gcagugaacauaacacagaagg

SEQ ID NO: 37475 - RNA, 22 nt, Human
gcagugaaucuggcaagaauuu

SEQ ID NO: 37476 - RNA, 22 nt, Human
gcagugaauuuaacacucagau

SEQ ID NO: 37477 - RNA, 22 nt, Human
gcagugacagggcugcugccuu

SEQ ID NO: 37478 - RNA, 22 nt, Human
gcagugauaacuuuacucuuuu

SEQ ID NO: 37479 - RNA, 22 nt, Human
gcagugauggggaucucacugg

SEQ ID NO: 37480 - RNA, 20 nt, Human
gcagugauuugucuauguuu

SEQ ID NO: 37481 - RNA, 22 nt, Human
gcagugauuuugcucagauaaa

SEQ ID NO: 37482 - RNA, 18 nt, Human
gcagugcaggaagaagag

SEQ ID NO: 37483 - RNA, 22 nt, Human
gcagugcucugccuauaaugga

SEQ ID NO: 37484 - RNA, 23 nt, Human
gcagugcuuggcacagcuggguc

SEQ ID NO: 37485 - RNA, 22 nt, Human
gcaguggaagccucuuuaagca

SEQ ID NO: 37486 - RNA, 22 nt, Human
gcaguggauggccagcaggggc

SEQ ID NO: 37487 - RNA, 22 nt, Human
gcaguggcagagacagcaccaa

SEQ ID NO: 37488 - RNA, 22 nt, Human
gcaguggcagcugaggggguau

SEQ ID NO: 37489 - RNA, 22 nt, Human
gcaguggcaugaugugggcuca

SEQ ID NO: 37490 - RNA, 22 nt, Human
gcagugggcaacaagagcugga

SEQ ID NO: 37491 - RNA, 22 nt, Human
gcagugggccugaggaagggug

SEQ ID NO: 37492 - RNA, 22 nt, Human
gcaguggggaaugcuggggaga

SEQ ID NO: 37493 - RNA, 21 nt, Human
gcagugucaugguuucaaguu

SEQ ID NO: 37494 - RNA, 22 nt, Human
gcaguguccaggguggucugca

SEQ ID NO: 37495 - RNA, 23 nt, Human
gcagugugaauccaguguuucag

SEQ ID NO: 37496 - RNA, 22 nt, Human
gcagugugaccgagcuugcuuc

SEQ ID NO: 37497 - RNA, 22 nt, Human
gcaguguguagaguuuaggaaa

SEQ ID NO: 37498 - RNA, 22 nt, Human
gcaguguguuuggauaacacac

SEQ ID NO: 37499 - RNA, 22 nt, Human
gcaguguuacuugguuugcaga

SEQ ID NO: 37500 - RNA, 22 nt, Human
gcaguguucuuguugcuuuuau

SEQ ID NO: 37501 - RNA, 22 nt, Human
gcaguguuguuaaaagauuaga

SEQ ID NO: 37502 - RNA, 22 nt, Human
gcaguguuuacauauuagaaac

SEQ ID NO: 37503 - RNA, 22 nt, Human
gcaguguuucaaaucaaaggca

SEQ ID NO: 37504 - RNA, 22 nt, Human
gcaguguuuggauccauagcga

SEQ ID NO: 37505 - RNA, 22 nt, Human
gcaguucacccaagugcagaga

SEQ ID NO: 37506 - RNA, 22 nt, Human
gcaguucuccagaauaaagggu

SEQ ID NO: 37507 - RNA, 21 nt, Human
gcaguuuauguaauaugcacu

SEQ ID NO: 37508 - RNA, 22 nt, Human
gcaguuugaaaguaugagucca

SEQ ID NO: 37509 - RNA, 22 nt, Human
gcaguuugagguuuucugaugu

SEQ ID NO: 37510 - RNA, 22 nt, Human
gcaguuuuaguggaucuggggc

SEQ ID NO: 37511 - RNA, 19 nt, Human
gcauaaaaugucaaugugu

SEQ ID NO: 37512 - RNA, 22 nt, Human
gcauacaguccuuguauucuuc

SEQ ID NO: 37513 - RNA, 22 nt, Human
gcauacauugcacccugguagu

SEQ ID NO: 37514 - RNA, 22 nt, Human
gugaggcauugaagaccggaau

SEQ ID NO: 37515 - RNA, 16 nt, Human
gugagggacauagcuu

SEQ ID NO: 37516 - RNA, 22 nt, Human
gugagggcaaauuagaaucaaa

SEQ ID NO: 37517 - RNA, 17 nt, Human
gugagggcagaggaugg

SEQ ID NO: 37518 - RNA, 21 nt, Human
gugagguauuaggaccuacau

SEQ ID NO: 37519 - RNA, 22 nt, Human
gugaggugaguagugagaagcc

SEQ ID NO: 37520 - RNA, 22 nt, Human
gugaggugccuaauaccgugac

SEQ ID NO: 37521 - RNA, 22 nt, Human
gugagucugccuagcacaucac

SEQ ID NO: 37522 - RNA, 23 nt, Human
gugagucuugccuuugcugugga

SEQ ID NO: 37523 - RNA, 22 nt, Human
gugagugucagucaaagguuuu

SEQ ID NO: 37524 - RNA, 22 nt, Human
gugauaaaauagaaacaguggu

SEQ ID NO: 37525 - RNA, 22 nt, Human
gugauaaagacgugucauaauu

SEQ ID NO: 37526 - RNA, 22 nt, Human
gugauaagacaguaggcacaag

SEQ ID NO: 37527 - RNA, 22 nt, Human
gugauacaggauggugauaaau

SEQ ID NO: 37528 - RNA, 22 nt, Human
gugauauuuuuaaagauuaagg

SEQ ID NO: 37529 - RNA, 22 nt, Human
gugaucuuguaauugggcaaug

SEQ ID NO: 37530 - RNA, 22 nt, Human
gugauucugaaauauuagaaaa

SEQ ID NO: 37531 - RNA, 22 nt, Human
gugauucugauauagcuaaagu

SEQ ID NO: 37532 - RNA, 22 nt, Human
gugauucuguguguaaauuuua

SEQ ID NO: 37533 - RNA, 18 nt, Human
gugauucuuauuuguaca

SEQ ID NO: 37534 - RNA, 22 nt, Human
gugauugugaaaacauuaagaa

SEQ ID NO: 37535 - RNA, 22 nt, Human
gugauuuaguguuaaguauguu

SEQ ID NO: 37536 - RNA, 23 nt, Human
gugauuucagggaacagaaucag

SEQ ID NO: 37537 - RNA, 22 nt, Human
gugauuucuaaucaucugaaug

SEQ ID NO: 37538 - RNA, 22 nt, Human
gugauuuugagaccuauauagu

SEQ ID NO: 37539 - RNA, 22 nt, Human
gugcaaaaaucuaucaccagca

SEQ ID NO: 37540 - RNA, 22 nt, Human
gugcaaaagcaauugcaguuuu

SEQ ID NO: 37541 - RNA, 22 nt, Human
gugcaaaagcaguuggauuuuu

SEQ ID NO: 37542 - RNA, 22 nt, Human
gugcaaaaguaaaugugguuuu

SEQ ID NO: 37543 - RNA, 22 nt, Human
gugcaaaaguaauggcaguuuu

SEQ ID NO: 37544 - RNA, 22 nt, Human
gugcaaaauuuggccaauaaca

SEQ ID NO: 37545 - RNA, 22 nt, Human
gugcaaauguaauugcaguuuu

SEQ ID NO: 37546 - RNA, 22 nt, Human
gugcaaauuccacuggaaagcu

SEQ ID NO: 37547 - RNA, 22 nt, Human
gugcaauccaguugauuuuuac

SEQ ID NO: 37548 - RNA, 22 nt, Human
gugcaaucugguuaauacgacu

SEQ ID NO: 37549 - RNA, 22 nt, Human
gugcaauggggcaauaucagcu

SEQ ID NO: 37550 - RNA, 22 nt, Human
gugcaaugucugugauaugaaa

SEQ ID NO: 37551 - RNA, 22 nt, Human
gugcaaugugcuucgugccaug

SEQ ID NO: 37552 - RNA, 22 nt, Human
gugcacacauacaugaacgcug

SEQ ID NO: 37553 - RNA, 22 nt, Human
gugcacacucuuggggcacuuu

SEQ ID NO: 37554 - RNA, 22 nt, Human
gugcacagaaacauacaaugug

SEQ ID NO: 37555 - RNA, 22 nt, Human
gugcacagaaauugguaagacu

SEQ ID NO: 37556 - RNA, 22 nt, Human
gugcacaggugggaaaaugagu

SEQ ID NO: 37557 - RNA, 22 nt, Human
gugcacuugaucuagacagauu

SEQ ID NO: 37558 - RNA, 22 nt, Human
gugcacuuugggagucucagug

SEQ ID NO: 37559 - RNA, 20 nt, Human
gcucuaaaccacaaagccca

SEQ ID NO: 37560 - RNA, 22 nt, Human
gcucuaacuauuaagaggucau

SEQ ID NO: 37561 - RNA, 22 nt, Human
gcucuagaucauaggucauuau

SEQ ID NO: 37562 - RNA, 22 nt, Human
gcucuagcccauuuccugcuug

SEQ ID NO: 37563 - RNA, 22 nt, Human
gcucuagcuggcgcugaccugg

SEQ ID NO: 37564 - RNA, 22 nt, Human
gcucuaggaggugugcuuagaa

SEQ ID NO: 37565 - RNA, 22 nt, Human
gcucuaugggcacagccagugu

SEQ ID NO: 37566 - RNA, 23 nt, Human
gcucuauguguuauagcuguuuu

SEQ ID NO: 37567 - RNA, 22 nt, Human
gcucuauguugaccuucagugg

SEQ ID NO: 37568 - RNA, 22 nt, Human
gcucucagaagagccaggcuac

SEQ ID NO: 37569 - RNA, 22 nt, Human
gcucucagaaguaacuugucca

SEQ ID NO: 37570 - RNA, 22 nt, Human
gcucucagcccacugaggggaa

SEQ ID NO: 37571 - RNA, 21 nt, Human
gcucucagcugccugcugguu

SEQ ID NO: 37572 - RNA, 22 nt, Human
gcucuccaggggcucccaggau

SEQ ID NO: 37573 - RNA, 22 nt, Human
gcucucucccuaggcaagugag

SEQ ID NO: 37574 - RNA, 22 nt, Human
gcucucugcaagucagcagccu

SEQ ID NO: 37575 - RNA, 21 nt, Human
gcucucugcaugguggcucag

SEQ ID NO: 37576 - RNA, 22 nt, Human
gcucucugggugugucuagaua

SEQ ID NO: 37577 - RNA, 22 nt, Human
gcucucugguuccagucaggaa

SEQ ID NO: 37578 - RNA, 22 nt, Human
gcucugagaaccaggaacacag

SEQ ID NO: 37579 - RNA, 22 nt, Human
gcucugagacacaaagggugca

SEQ ID NO: 37580 - RNA, 22 nt, Human
gcucugagacaguagagauggc

SEQ ID NO: 37581 - RNA, 22 nt, Human
gcucugagagcuacacagggua

SEQ ID NO: 37582 - RNA, 22 nt, Human
gcucugagaggugcagcaguaa

SEQ ID NO: 37583 - RNA, 22 nt, Human
gcucugagauugagccuuuggu

SEQ ID NO: 37584 - RNA, 22 nt, Human
gcucugagcacugugcggcugg

SEQ ID NO: 37585 - RNA, 22 nt, Human
gcucugaggagccaagaaugug

SEQ ID NO: 37586 - RNA, 22 nt, Human
gcucugagucucagcuaccaca

SEQ ID NO: 37587 - RNA, 18 nt, Human
gcucugcaggugcucggu

SEQ ID NO: 37588 - RNA, 23 nt, Human
gcucugccacuuaauagcugugu

SEQ ID NO: 37589 - RNA, 22 nt, Human
gcucugccagacacuguggcca

SEQ ID NO: 37590 - RNA, 18 nt, Human
gcucugcccaggcugccc

SEQ ID NO: 37591 - RNA, 22 nt, Human
gcucugcccugggccguuguaa

SEQ ID NO: 37592 - RNA, 17 nt, Human
gcucugccucucccacc

SEQ ID NO: 37593 - RNA, 22 nt, Human
gcucugcucuaacauuccugac

SEQ ID NO: 37594 - RNA, 22 nt, Human
gcucugcugaagccccuugcau

SEQ ID NO: 37595 - RNA, 22 nt, Human
gcucugcugagauaucugggag

SEQ ID NO: 37596 - RNA, 22 nt, Human
gcucugcuggaaguucucugga

SEQ ID NO: 37597 - RNA, 22 nt, Human
gcucugcuguggaauccucucc

SEQ ID NO: 37598 - RNA, 22 nt, Human
gcucugcuguguuuguucagca

SEQ ID NO: 37599 - RNA, 22 nt, Human
gcucugcuuucuggggggaucc

SEQ ID NO: 37600 - RNA, 22 nt, Human
gcucuggaagcaucugagagga

SEQ ID NO: 37601 - RNA, 22 nt, Human
gcucuggauccggcugggucug

SEQ ID NO: 37602 - RNA, 22 nt, Human
gcucuggggaugcuucugccgu

SEQ ID NO: 37603 - RNA, 22 nt, Human
gcucuggggcccagggaucaca

SEQ ID NO: 37604 - RNA, 15 nt, Human
gcucuggguauuuga

SEQ ID NO: 37605 - RNA, 22 nt, Human
gcucugggugaaggguaccauu

SEQ ID NO: 37606 - RNA, 22 nt, Human
gcucugggugaauggcagauug

SEQ ID NO: 37607 - RNA, 22 nt, Human
gcucuggugaguguaguucagg

SEQ ID NO: 37608 - RNA, 22 nt, Human
gcucuguaugagggugagagau

SEQ ID NO: 37609 - RNA, 22 nt, Human
gcucuguauguaguucuugcuu

SEQ ID NO: 37610 - RNA, 22 nt, Human
gcucugucaacagcuagcugug

SEQ ID NO: 37611 - RNA, 22 nt, Human
gcucuguccagcgugcacagaa

SEQ ID NO: 37612 - RNA, 22 nt, Human
gcucugugagccacuugaugua

SEQ ID NO: 37613 - RNA, 19 nt, Human
gcucugugaugcugagggg

SEQ ID NO: 37614 - RNA, 22 nt, Human
gcucugugccccugccguggac

SEQ ID NO: 37615 - RNA, 22 nt, Human
gcucuguggcauucaugggcag

SEQ ID NO: 37616 - RNA, 22 nt, Human
gcucugugggggaaauccuggg

SEQ ID NO: 37617 - RNA, 22 nt, Human
gcucugugggugaguagaaucu

SEQ ID NO: 37618 - RNA, 22 nt, Human
gcucuguguuccucuggauugc

SEQ ID NO: 37619 - RNA, 22 nt, Human
gcucuguuaacaguccagcuuu

SEQ ID NO: 37620 - RNA, 22 nt, Human
gcucuguucaucaguuuguugg

SEQ ID NO: 37621 - RNA, 22 nt, Human
gcucuguuucuccaugcugugg

SEQ ID NO: 37622 - RNA, 22 nt, Human
gcucuuauagucccagcauguu

SEQ ID NO: 37623 - RNA, 22 nt, Human
gcucuucucagauuguacacuc

SEQ ID NO: 37624 - RNA, 22 nt, Human
gcucuugaaauaauggcuaaug

SEQ ID NO: 37625 - RNA, 22 nt, Human
gcucuugacagcuacaucuggc

SEQ ID NO: 37626 - RNA, 22 nt, Human
gcucuugacucccaguucugug

SEQ ID NO: 37627 - RNA, 22 nt, Human
gcucuuggccaaguggaagggu

SEQ ID NO: 37628 - RNA, 22 nt, Human
gcucuugggggacagauggagu

SEQ ID NO: 37629 - RNA, 22 nt, Human
gcucuuggucucagccucugaa

SEQ ID NO: 37630 - RNA, 22 nt, Human
gcucuugucagagaggccagcu

SEQ ID NO: 37631 - RNA, 18 nt, Human
gcucuuucugucuccagc

SEQ ID NO: 37632 - RNA, 22 nt, Human
gcucuuuucacaguccaaaaug

SEQ ID NO: 37633 - RNA, 22 nt, Human
gcugaaaugccuuguaaauauu

SEQ ID NO: 37634 - RNA, 22 nt, Human
gcugaaauuagacugcagaagu

SEQ ID NO: 37635 - RNA, 22 nt, Human
gcugaagagcaaggcugggucu

SEQ ID NO: 37636 - RNA, 22 nt, Human
gcugaagcugcagcaggaggaa

SEQ ID NO: 37637 - RNA, 19 nt, Human
gcugaaggaggugccugca

SEQ ID NO: 37638 - RNA, 22 nt, Human
gcugaaggucucuggagagguc

SEQ ID NO: 37639 - RNA, 22 nt, Human
gcugaaguaacucacaucguua

SEQ ID NO: 37640 - RNA, 22 nt, Human
gcugaagugcuuuugaauuugg

SEQ ID NO: 37641 - RNA, 22 nt, Human
gcugaaguggcgugaucagaau

SEQ ID NO: 37642 - RNA, 22 nt, Human
gcugaaguguggagugacaguu

SEQ ID NO: 37643 - RNA, 22 nt, Human
gcugaauagaagucuucaaagg

SEQ ID NO: 37644 - RNA, 22 nt, Human
gcugaaugaauguauuuuaaaa

SEQ ID NO: 37645 - RNA, 22 nt, Human
gcugacaguuacugcuguaaca

SEQ ID NO: 37646 - RNA, 22 nt, Human
gcugacaguuguaccugccccu

SEQ ID NO: 37647 - RNA, 22 nt, Human
gcugaccauuaggaggacgaua

SEQ ID NO: 37648 - RNA, 22 nt, Human
gcugacucuuugacaaaaugca

SEQ ID NO: 37649 - RNA, 22 nt, Human
gcugagaaaugcagacaugcug

SEQ ID NO: 37650 - RNA, 17 nt, Human
gcugagaaggggaagag

SEQ ID NO: 37651 - RNA, 22 nt, Human
gcugagaaucaagauggagagg

SEQ ID NO: 37652 - RNA, 22 nt, Human
gcugagagcaaggacaaagcau

SEQ ID NO: 37653 - RNA, 22 nt, Human
gcugagaguccaggaaaacauc

SEQ ID NO: 37654 - RNA, 22 nt, Human
gcugagagugagcacuggauau

SEQ ID NO: 37655 - RNA, 22 nt, Human
gcugagcacagccuguguccuc

SEQ ID NO: 37656 - RNA, 22 nt, Human
gcugagcagccuaagcaaauuu

SEQ ID NO: 37657 - RNA, 22 nt, Human
gccuggcagauugacauagcca

SEQ ID NO: 37658 - RNA, 22 nt, Human
gccuggcagccuccaaccuuca

SEQ ID NO: 37659 - RNA, 22 nt, Human
gccuggcaggccugggccagca

SEQ ID NO: 37660 - RNA, 22 nt, Human
gccuggcagggcccggacggca

SEQ ID NO: 37661 - RNA, 22 nt, Human
gccuggcaguggggcccuggga

SEQ ID NO: 37662 - RNA, 19 nt, Human
gccuggcaguguacaaggc

SEQ ID NO: 37663 - RNA, 22 nt, Human
gccuggccugaacuaggaggug

SEQ ID NO: 37664 - RNA, 22 nt, Human
gccuggcgccgggcugccuguc

SEQ ID NO: 37665 - RNA, 22 nt, Human
gccuggcuaauuuugguauuuu

SEQ ID NO: 37666 - RNA, 22 nt, Human
gccuggcuacccacugaaauau

SEQ ID NO: 37667 - RNA, 22 nt, Human
gccuggcuaguuagugucaggu

SEQ ID NO: 37668 - RNA, 22 nt, Human
gcugaggaggugugguuaggug

SEQ ID NO: 37669 - RNA, 22 nt, Human
gcugaggauuacuugaagucag

SEQ ID NO: 37670 - RNA, 22 nt, Human
gcugaggcucaagucauggguc

SEQ ID NO: 37671 - RNA, 22 nt, Human
gcugagggccgcauagggucau

SEQ ID NO: 37672 - RNA, 20 nt, Human
gcugaggggucuauggcaua

SEQ ID NO: 37673 - RNA, 22 nt, Human
gcugaggucaggagcugugggg

SEQ ID NO: 37674 - RNA, 20 nt, Human
gcugaggucauuaugccuca

SEQ ID NO: 37675 - RNA, 22 nt, Human
gcugaggugucaccuugcuggg

SEQ ID NO: 37676 - RNA, 22 nt, Human
gcugagguuucaggaguggcag

SEQ ID NO: 37677 - RNA, 22 nt, Human
gcugagugaggcugucaaaaug

SEQ ID NO: 37678 - RNA, 22 nt, Human
gcugauaaauaguugauguacc

SEQ ID NO: 37679 - RNA, 23 nt, Human
gcugauaaugcauucuguuuaau

SEQ ID NO: 37680 - RNA, 22 nt, Human
gcugauggcuugcuggcugaca

SEQ ID NO: 37681 - RNA, 22 nt, Human
gcugauguaagacuuuugguuu

SEQ ID NO: 37682 - RNA, 22 nt, Human
gcugauuuugagaagcacaguc

SEQ ID NO: 37683 - RNA, 21 nt, Human
gcugcaaauucuaacaauuau

SEQ ID NO: 37684 - RNA, 22 nt, Human
gcugcaagucauggcuuuugca

SEQ ID NO: 37685 - RNA, 22 nt, Human
gcugcacauggcagaggccuuu

SEQ ID NO: 37686 - RNA, 22 nt, Human
gcugcaccagcuccaccagggc

SEQ ID NO: 37687 - RNA, 22 nt, Human
gcugcaccagcugcacccagua

SEQ ID NO: 37688 - RNA, 22 nt, Human
gcugcagagccuggagcccugg

SEQ ID NO: 37689 - RNA, 22 nt, Human
gcugcagagggaggggcucgca

SEQ ID NO: 37690 - RNA, 19 nt, Human
gcugcagaggugaagaaga

SEQ ID NO: 37691 - RNA, 22 nt, Human
gcugcagagugaugaagugggg

SEQ ID NO: 37692 - RNA, 22 nt, Human
gcugcagcaagcccuccagggg

SEQ ID NO: 37693 - RNA, 22 nt, Human
gcugcagcagaaguucucagag

SEQ ID NO: 37694 - RNA, 22 nt, Human
gcugcagcagcugcaggguugu

SEQ ID NO: 37695 - RNA, 22 nt, Human
gcugcagcuguaggacacaauu

SEQ ID NO: 37696 - RNA, 22 nt, Human
gcugcagggaauguauggauuu

SEQ ID NO: 37697 - RNA, 22 nt, Human
gcugcaggggggucuggacuug

SEQ ID NO: 37698 - RNA, 22 nt, Human
gcugcaguguuggaccucaggg

SEQ ID NO: 37699 - RNA, 22 nt, Human
gcugcaugacagacaggccugg

SEQ ID NO: 37700 - RNA, 22 nt, Human
gcugccacgaucucugcuguag

SEQ ID NO: 37701 - RNA, 22 nt, Human
gcugccagccagggugggaucc

SEQ ID NO: 37702 - RNA, 22 nt, Human
gcugccagcccucggggucuga

SEQ ID NO: 37703 - RNA, 22 nt, Human
gcugccagcuuuccuuggcuga

SEQ ID NO: 37704 - RNA, 22 nt, Human
gcugccaggcccuggggcuaug

SEQ ID NO: 37705 - RNA, 22 nt, Human
gcugccaggggcagcugucuca

SEQ ID NO: 37706 - RNA, 20 nt, Human
gcugccagugccugaugcuu

SEQ ID NO: 37707 - RNA, 22 nt, Human
gcugccaguguggcaugaugca

SEQ ID NO: 37708 - RNA, 22 nt, Human
gcugccaucagaguucaggaau

SEQ ID NO: 37709 - RNA, 22 nt, Human
gcugcccaaugguagugucuuu

SEQ ID NO: 37710 - RNA, 22 nt, Human
gcugcccagcaggccccagggg

SEQ ID NO: 37711 - RNA, 22 nt, Human
gcugcccagugugcucaugcag

SEQ ID NO: 37712 - RNA, 22 nt, Human
gcugcccuaauaucacauguua

SEQ ID NO: 37713 - RNA, 22 nt, Human
gcugcccugcaucugugccuuc

SEQ ID NO: 37714 - RNA, 22 nt, Human
gcugcccugugguccagcaggu

SEQ ID NO: 37715 - RNA, 22 nt, Human
gcugccucacuccagcccaaua

SEQ ID NO: 37716 - RNA, 22 nt, Human
gcugccuccugagauuugggca

SEQ ID NO: 37717 - RNA, 23 nt, Human
gcugccucuguuggucuucaguu

SEQ ID NO: 37718 - RNA, 22 nt, Human
gcugccugcacagagcugcuuu

SEQ ID NO: 37719 - RNA, 22 nt, Human
gcugccugccuaguuccacagu

SEQ ID NO: 37720 - RNA, 22 nt, Human
gcugccugcuucaugugggaga

SEQ ID NO: 37721 - RNA, 22 nt, Human
gcugccuggcugaugaaaauuc

SEQ ID NO: 37722 - RNA, 22 nt, Human
gcugccuggcuuuaguccacuu

SEQ ID NO: 37723 - RNA, 22 nt, Human
gcugccugguuucucagcugca

SEQ ID NO: 37724 - RNA, 22 nt, Human
gcugccugucuguuucuuuuau

SEQ ID NO: 37725 - RNA, 20 nt, Human
gcugccuguuucuguaagua

SEQ ID NO: 37726 - RNA, 22 nt, Human
gcugccuuaacuucuucgcugu

SEQ ID NO: 37727 - RNA, 22 nt, Human
gcugccuuaugucuauuaguau

SEQ ID NO: 37728 - RNA, 22 nt, Human
gcugccuuccauaauguacgua

SEQ ID NO: 37729 - RNA, 22 nt, Human
gcugccuucccaggccuuugcu

SEQ ID NO: 37730 - RNA, 22 nt, Human
gcugccuucccggaaugucauc

SEQ ID NO: 37731 - RNA, 20 nt, Human
gcugccuuguccugcuuggu

SEQ ID NO: 37732 - RNA, 22 nt, Human
gcugccuuuagggggugcucag

SEQ ID NO: 37733 - RNA, 22 nt, Human
gcugccuuuugcuccucccacc

SEQ ID NO: 37734 - RNA, 22 nt, Human
gcugcgccggaucccacguucc

SEQ ID NO: 37735 - RNA, 22 nt, Human
gcugcggucacugcgggggcug

SEQ ID NO: 37736 - RNA, 22 nt, Human
gcugcgguggcuggcgauggga

SEQ ID NO: 37737 - RNA, 22 nt, Human
gcugcuccagcugugcugcaga

SEQ ID NO: 37738 - RNA, 22 nt, Human
gcugcuccaguguucugucuag

SEQ ID NO: 37739 - RNA, 20 nt, Human
gcugcucgcugcagucacuc

SEQ ID NO: 37740 - RNA, 22 nt, Human
gcugcucucagagcucaugcug

SEQ ID NO: 37741 - RNA, 22 nt, Human
gcugcucugaaaaugacuguug

SEQ ID NO: 37742 - RNA, 22 nt, Human
gcugcucugcuguguaagcagg

SEQ ID NO: 37743 - RNA, 22 nt, Human
gcugcucuggcucugcaguguc

SEQ ID NO: 37744 - RNA, 22 nt, Human
gcugcucugggucugcccagcu

SEQ ID NO: 37745 - RNA, 21 nt, Human
gcugcugccccuagugaggcc

SEQ ID NO: 37746 - RNA, 22 nt, Human
gcugcugccgcggccgcuggga

SEQ ID NO: 37747 - RNA, 19 nt, Human
gcugcugcuccucccucgc

SEQ ID NO: 37748 - RNA, 22 nt, Human
gcugcugcugaggaugcaccug

SEQ ID NO: 37749 - RNA, 22 nt, Human
gcugcugcuugaaggcucggag

SEQ ID NO: 37750 - RNA, 22 nt, Human
gcugcuggaagcaugcgaugaa

SEQ ID NO: 37751 - RNA, 22 nt, Human
gcugcuggagcuuugcagaagg

SEQ ID NO: 37752 - RNA, 22 nt, Human
gcugcugggagggaucguaaau

SEQ ID NO: 37753 - RNA, 22 nt, Human
gcugcugggcacccccugagcu

SEQ ID NO: 37754 - RNA, 22 nt, Human
gcugcuggggccuucccucggg

SEQ ID NO: 37755 - RNA, 22 nt, Human
gcugcugggucccucugugcca

SEQ ID NO: 37756 - RNA, 22 nt, Human
gcugcuguccuuagggaguucu

SEQ ID NO: 37757 - RNA, 22 nt, Human
gcugcugucucaugcgaugcgg

SEQ ID NO: 37758 - RNA, 22 nt, Human
gcugcugugugggagacaggcg

SEQ ID NO: 37759 - RNA, 22 nt, Human
gcugcuguguuggagagggacu

SEQ ID NO: 37760 - RNA, 22 nt, Human
gcugcuuccuuuccugcugacc

SEQ ID NO: 37761 - RNA, 22 nt, Human
gcugcuucucugauggagucca

SEQ ID NO: 37762 - RNA, 22 nt, Human
gcugcuuuacugaagagauaug

SEQ ID NO: 37763 - RNA, 22 nt, Human
gcugcuuuauaaucucggcaga

SEQ ID NO: 37764 - RNA, 20 nt, Human
gcugcuuucaaaugacacgu

SEQ ID NO: 37765 - RNA, 22 nt, Human
gcugcuuugacagugggaacag

SEQ ID NO: 37766 - RNA, 22 nt, Human
gcugcuuugcaguagaguaaua

SEQ ID NO: 37767 - RNA, 22 nt, Human
gcugcuuuggggaugaaugaga

SEQ ID NO: 37768 - RNA, 22 nt, Human
gcugcuuugucuguaaaaugga

SEQ ID NO: 37769 - RNA, 22 nt, Human
gcuggaaaucaaagaaguggau

SEQ ID NO: 37770 - RNA, 22 nt, Human
gcuggaaaucauauuuuguugu

SEQ ID NO: 37771 - RNA, 22 nt, Human
gcuggaaggcuaggcucaguug

SEQ ID NO: 37772 - RNA, 22 nt, Human
gcuggacccggccccucaccuc

SEQ ID NO: 37773 - RNA, 22 nt, Human
gcuggacuagaagcagggcuca

SEQ ID NO: 37774 - RNA, 22 nt, Human
uaaagugcuggauuugaguaaa

SEQ ID NO: 37775 - RNA, 22 nt, Human
uaaaguggaaggauccacuaag

SEQ ID NO: 37776 - RNA, 22 nt, Human
uaaaguguaugccaucucucau

SEQ ID NO: 37777 - RNA, 22 nt, Human
ggcauugaugggagauggugga

SEQ ID NO: 37778 - RNA, 22 nt, Human
ggcauugucuauuugcauucau

SEQ ID NO: 37779 - RNA, 22 nt, Human
ggcauuuaauccaucugauuga

SEQ ID NO: 37780 - RNA, 22 nt, Human
ggcauuugagccauuggccugu

SEQ ID NO: 37781 - RNA, 22 nt, Human
ggcauuuuugacaaagagcaau

SEQ ID NO: 37782 - RNA, 22 nt, Human
ggccaaauccuccaugguggcu

SEQ ID NO: 37783 - RNA, 22 nt, Human
ggccaagaucccauuauacaaa

SEQ ID NO: 37784 - RNA, 22 nt, Human
ggccaaggaugguggcucuggu

SEQ ID NO: 37785 - RNA, 23 nt, Human
ggccacaaauagucuccccuggc

SEQ ID NO: 37786 - RNA, 22 nt, Human
ggccacagaacagcuacaggac

SEQ ID NO: 37787 - RNA, 17 nt, Human
ggccacagagcuugggg

SEQ ID NO: 37788 - RNA, 22 nt, Human
ggccacagucucuggaaggaug

SEQ ID NO: 37789 - RNA, 22 nt, Human
ggccaccaaaguccuguggcuu

SEQ ID NO: 37790 - RNA, 20 nt, Human
ggccaccugcuucagacccc

SEQ ID NO: 37791 - RNA, 22 nt, Human
ggccacucggccaccccugccg

SEQ ID NO: 37792 - RNA, 23 nt, Human
ggccacugaauuuucugcaucuu

SEQ ID NO: 37793 - RNA, 22 nt, Human
ggccagacugagugaggucaag

SEQ ID NO: 37794 - RNA, 22 nt, Human
ggccagagcugaccuaucaaug

SEQ ID NO: 37795 - RNA, 22 nt, Human
ggccagaggaccucucauagcc

SEQ ID NO: 37796 - RNA, 22 nt, Human
ggccagaggugguacauagcuu

SEQ ID NO: 37797 - RNA, 21 nt, Human
ggccagcagcguccacugugg

SEQ ID NO: 37798 - RNA, 22 nt, Human
ggccagcaggcccugugauccu

SEQ ID NO: 37799 - RNA, 22 nt, Human
ggccagcucagacuccacuugc

SEQ ID NO: 37800 - RNA, 18 nt, Human
ggccagcuccugaggcag

SEQ ID NO: 37801 - RNA, 22 nt, Human
ggccagcuccuuggcagugccu

SEQ ID NO: 37802 - RNA, 21 nt, Human
ggccagcucggaaggucccau

SEQ ID NO: 37803 - RNA, 22 nt, Human
ggccagcucuuguccacggagg

SEQ ID NO: 37804 - RNA, 22 nt, Human
ggccagcugagcugcugcacag

SEQ ID NO: 37805 - RNA, 22 nt, Human
ggccagcugcucagugucucug

SEQ ID NO: 37806 - RNA, 20 nt, Human
ggccagcuggaggcgccggg

SEQ ID NO: 37807 - RNA, 22 nt, Human
ggccagcuguaagcugcugaau

SEQ ID NO: 37808 - RNA, 22 nt, Human
ggccagcugugggauuuucugc

SEQ ID NO: 37809 - RNA, 22 nt, Human
ggccagcuucuggacaaagucc

SEQ ID NO: 37810 - RNA, 22 nt, Human
ggccagcuuucugucuucuagg

SEQ ID NO: 37811 - RNA, 22 nt, Human
ggccaggagauggacaccacau

SEQ ID NO: 37812 - RNA, 22 nt, Human
ggccaggaucuguuuguccacc

SEQ ID NO: 37813 - RNA, 22 nt, Human
ggccaggccaagaggguuggaa

SEQ ID NO: 37814 - RNA, 22 nt, Human
ggccaggcugguuccuugaccu

SEQ ID NO: 37815 - RNA, 22 nt, Human
ggccagggggcuucagacucca

SEQ ID NO: 37816 - RNA, 22 nt, Human
ggccagucugggccacggucgg

SEQ ID NO: 37817 - RNA, 22 nt, Human
ggccagugugcaggucagagau

SEQ ID NO: 37818 - RNA, 22 nt, Human
ggccaucugccucaaugugugc

SEQ ID NO: 37819 - RNA, 22 nt, Human
ggccaugcaggucagagguggg

SEQ ID NO: 37820 - RNA, 22 nt, Human
ggccaugccaggcugccuggga

SEQ ID NO: 37821 - RNA, 22 nt, Human
ggccaugcuguugccugcuggu

SEQ ID NO: 37822 - RNA, 23 nt, Human
ggccauggagacuuagaaugggc

SEQ ID NO: 37823 - RNA, 22 nt, Human
ggccauggggacagagggugaa

SEQ ID NO: 37824 - RNA, 17 nt, Human
ggccauggugcaagguu

SEQ ID NO: 37825 - RNA, 22 nt, Human
ggcccaaggcccaggucgagcu

SEQ ID NO: 37826 - RNA, 22 nt, Human
ggcccacuugaaauggagcuca

SEQ ID NO: 37827 - RNA, 22 nt, Human
ggcccagcacagugcuuggggg

SEQ ID NO: 37828 - RNA, 22 nt, Human
ggcccagccucagacaugcccu

SEQ ID NO: 37829 - RNA, 22 nt, Human
ggcccagcugggcggggacacg

SEQ ID NO: 37830 - RNA, 22 nt, Human
ggcccaguguggguggauguug

SEQ ID NO: 37831 - RNA, 22 nt, Human
ggcccaugacccuagccaacug

SEQ ID NO: 37832 - RNA, 22 nt, Human
ggccccagcagugcuuguuuau

SEQ ID NO: 37833 - RNA, 22 nt, Human
ggccccaggccuuuggucuggc

SEQ ID NO: 37834 - RNA, 22 nt, Human
ggccccagggauuaggccaacc

SEQ ID NO: 37835 - RNA, 22 nt, Human
ggccccuguaaaauguacaugu

SEQ ID NO: 37836 - RNA, 22 nt, Human
ggcccucccugagccagguggg

SEQ ID NO: 37837 - RNA, 22 nt, Human
ggcccucugaguagcugcaaac

SEQ ID NO: 37838 - RNA, 22 nt, Human
ggcccucuggcuuccgcauggg

SEQ ID NO: 37839 - RNA, 22 nt, Human
ggcccugagucuagcugcucuu

SEQ ID NO: 37840 - RNA, 22 nt, Human
ggcccugcaugagauuaagguu

SEQ ID NO: 37841 - RNA, 22 nt, Human
ggcccugggaugcucagcagug

SEQ ID NO: 37842 - RNA, 22 nt, Human
ggcccugggcagaggagugggc

SEQ ID NO: 37843 - RNA, 22 nt, Human
ggcccugggcccucuagcuugu

SEQ ID NO: 37844 - RNA, 22 nt, Human
ggcccugugauggauguauuag

SEQ ID NO: 37845 - RNA, 22 nt, Human
ggcccugugguuuugcaaaguc

SEQ ID NO: 37846 - RNA, 22 nt, Human
ggcccuguuagagcucccacaa

SEQ ID NO: 37847 - RNA, 21 nt, Human
ggccuaggggcagauggugcu

SEQ ID NO: 37848 - RNA, 23 nt, Human
ggccuaugggcaggcaaggaagc

SEQ ID NO: 37849 - RNA, 22 nt, Human
ggccucagaccggagcuggcca

SEQ ID NO: 37850 - RNA, 22 nt, Human
ggccucagggucacucuguaga

SEQ ID NO: 37851 - RNA, 22 nt, Human
ggccucagugggccgcugcagg

SEQ ID NO: 37852 - RNA, 22 nt, Human
ggccucaguuucuccauggguu

SEQ ID NO: 37853 - RNA, 23 nt, Human
ggccuccuggucuaggcuagacu

SEQ ID NO: 37854 - RNA, 22 nt, Human
ggccucucuagcauccagccug

SEQ ID NO: 37855 - RNA, 22 nt, Human
ggccucucuccagucagugcag

SEQ ID NO: 37856 - RNA, 22 nt, Human
ggccucugcaacuggcuguggc

SEQ ID NO: 37857 - RNA, 19 nt, Human
ggccucugcaggccgcccc

SEQ ID NO: 37858 - RNA, 21 nt, Human
ggccucugccuugccccacuc

SEQ ID NO: 37859 - RNA, 22 nt, Human
ggccucuggucaagacaagcau

SEQ ID NO: 37860 - RNA, 22 nt, Human
ggccucugguucguggugaccu

SEQ ID NO: 37861 - RNA, 21 nt, Human
ggccucugucauccugggaag

SEQ ID NO: 37862 - RNA, 22 nt, Human
ggccucuucugcucauacuuuc

SEQ ID NO: 37863 - RNA, 22 nt, Human
ggccugacugaccugauucuaa

SEQ ID NO: 37864 - RNA, 22 nt, Human
ggccugagaaccauggggccaa

SEQ ID NO: 37865 - RNA, 22 nt, Human
ggccugagaauguaccagaucu

SEQ ID NO: 37866 - RNA, 22 nt, Human
ggccugagcagacagcaugaug

SEQ ID NO: 37867 - RNA, 22 nt, Human
ggccugagcuugggcagcguau

SEQ ID NO: 37868 - RNA, 18 nt, Human
ggccugaggauuucagca

SEQ ID NO: 37869 - RNA, 22 nt, Human
ggccugagggugggcucucagu

SEQ ID NO: 37870 - RNA, 17 nt, Human
ggccugcaagaacgaga

SEQ ID NO: 37871 - RNA, 22 nt, Human
ggccugcacagagguggcucua

SEQ ID NO: 37872 - RNA, 18 nt, Human
ggccugcagugaagcaag

SEQ ID NO: 37873 - RNA, 22 nt, Human
ggccugcuccgggggcugagcu

SEQ ID NO: 37874 - RNA, 22 nt, Human
ggccugcugggccccacagucc

SEQ ID NO: 37875 - RNA, 22 nt, Human
ggccugcuggggccucagacac

SEQ ID NO: 37876 - RNA, 22 nt, Human
ggccugcuuuccgagccugcag

SEQ ID NO: 37877 - RNA, 23 nt, Human
ggccuggcccagggcccugauga

SEQ ID NO: 37878 - RNA, 22 nt, Human
ggccugugcacaugugcaggaa

SEQ ID NO: 37879 - RNA, 22 nt, Human
ucagaaggaagaagucauggga

SEQ ID NO: 37880 - RNA, 22 nt, Human
ucagaaggaaguuagaguaugg

SEQ ID NO: 37881 - RNA, 22 nt, Human
ucagaaggcccguugcuaagag

SEQ ID NO: 37882 - RNA, 22 nt, Human
ucagaagguacagaagggaggu

SEQ ID NO: 37883 - RNA, 22 nt, Human
ucagaagguggagguugcagug

SEQ ID NO: 37884 - RNA, 20 nt, Human
ucagaagugcagcugccccu

SEQ ID NO: 37885 - RNA, 23 nt, Human
ucagaagugggauacaaagcuga

SEQ ID NO: 37886 - RNA, 22 nt, Human
uccagcaugaaggggcuuuuau

SEQ ID NO: 37887 - RNA, 22 nt, Human
uccagcauuuuucaauagaauu

SEQ ID NO: 37888 - RNA, 22 nt, Human
uccagccaagggagguuacuag

SEQ ID NO: 37889 - RNA, 22 nt, Human
uccagccaaucagagcugaggc

SEQ ID NO: 37890 - RNA, 22 nt, Human
uccagccacguauuaucucacu

SEQ ID NO: 37891 - RNA, 22 nt, Human
uccagccacuugcacaguuaaa

SEQ ID NO: 37892 - RNA, 22 nt, Human
uccagccaggauggcccaggga

SEQ ID NO: 37893 - RNA, 22 nt, Human
uccagccauaucuuguagcccu

SEQ ID NO: 37894 - RNA, 22 nt, Human
uccagccauucauuaugacacc

SEQ ID NO: 37895 - RNA, 20 nt, Human
uccagcccagcagccugaca

SEQ ID NO: 37896 - RNA, 22 nt, Human
uccagcccaggcuggaguguag

SEQ ID NO: 37897 - RNA, 22 nt, Human
uccagcccaguuuggugaauug

SEQ ID NO: 37898 - RNA, 22 nt, Human
uccagccccuccugagccaagc

SEQ ID NO: 37899 - RNA, 22 nt, Human
uccagcccgggggcaggugacc

SEQ ID NO: 37900 - RNA, 22 nt, Human
uccagcccugcacugauuagau

SEQ ID NO: 37901 - RNA, 17 nt, Human
uccagcccugcccgacg

SEQ ID NO: 37902 - RNA, 22 nt, Human
uccagcccugcuuccugccuca

SEQ ID NO: 37903 - RNA, 22 nt, Human
uccagcccugugucugggagag

SEQ ID NO: 37904 - RNA, 22 nt, Human
uccagccucauuucuccugcuu

SEQ ID NO: 37905 - RNA, 23 nt, Human
uccagccucuugcucucacaugc

SEQ ID NO: 37906 - RNA, 19 nt, Human
uccagccugcuguuucucu

SEQ ID NO: 37907 - RNA, 22 nt, Human
uccagccuucucaaggcuggcu

SEQ ID NO: 37908 - RNA, 22 nt, Human
uccagccuugccacuuuucugu

SEQ ID NO: 37909 - RNA, 22 nt, Human
uccagcuaacaccuacuggcca

SEQ ID NO: 37910 - RNA, 22 nt, Human
uccagcucaaauucagcuucca

SEQ ID NO: 37911 - RNA, 22 nt, Human
uccagcucacagauagcguggg

SEQ ID NO: 37912 - RNA, 17 nt, Human
uccagcuccucauuguu

SEQ ID NO: 37913 - RNA, 22 nt, Human
uccagcuccucuacccgaugcg

SEQ ID NO: 37914 - RNA, 21 nt, Human
uccagcuccugccacuccuua

SEQ ID NO: 37915 - RNA, 22 nt, Human
uccagcucuggcuuggcuagcu

SEQ ID NO: 37916 - RNA, 22 nt, Human
gggaaguuuguuuggacuggga

SEQ ID NO: 37917 - RNA, 22 nt, Human
gggaaucuuccuuuuuuguaag

SEQ ID NO: 37918 - RNA, 22 nt, Human
gggaauguaaucauggaaugcu

SEQ ID NO: 37919 - RNA, 22 nt, Human
gggaaugugaaacaguaaggga

SEQ ID NO: 37920 - RNA, 22 nt, Human
gggaauuauagcugucacaggc

SEQ ID NO: 37921 - RNA, 22 nt, Human
gggacaaccaacuuagcauuac

SEQ ID NO: 37922 - RNA, 22 nt, Human
gggacacagccaucuguguuuu

SEQ ID NO: 37923 - RNA, 21 nt, Human
gggacaccaacuccagggcuu

SEQ ID NO: 37924 - RNA, 22 nt, Human
gggacacucaaugagaccugca

SEQ ID NO: 37925 - RNA, 22 nt, Human
gggacacuggacccagugucca

SEQ ID NO: 37926 - RNA, 22 nt, Human
gggacaggcugagacuugagcu

SEQ ID NO: 37927 - RNA, 22 nt, Human
gggacaucuuucuagucagggu

SEQ ID NO: 37928 - RNA, 22 nt, Human
gggaccagaagaaggaugguga

SEQ ID NO: 37929 - RNA, 23 nt, Human
gggaccagcuagggcugugaccu

SEQ ID NO: 37930 - RNA, 22 nt, Human
gggacccucaacaucugcuucu

SEQ ID NO: 37931 - RNA, 22 nt, Human
gggaccucuggagucggccuua

SEQ ID NO: 37932 - RNA, 22 nt, Human
gggaccuggcaccuuugcucug

SEQ ID NO: 37933 - RNA, 22 nt, Human
gggaccuggggacuccuuguuc

SEQ ID NO: 37934 - RNA, 23 nt, Human
gggaccugguaggaggugauugg

SEQ ID NO: 37935 - RNA, 22 nt, Human
gggacgggcacggagggcccuc

SEQ ID NO: 37936 - RNA, 22 nt, Human
gggacgggcaguccaagggguc

SEQ ID NO: 37937 - RNA, 17 nt, Human
gggacucaagauggggu

SEQ ID NO: 37938 - RNA, 22 nt, Human
gggacuccauaagcacauggau

SEQ ID NO: 37939 - RNA, 22 nt, Human
gggacucugagagccugagggu

SEQ ID NO: 37940 - RNA, 19 nt, Human
gggacuggaggauguggag

SEQ ID NO: 37941 - RNA, 22 nt, Human
gggacuggaguagaggccggug

SEQ ID NO: 37942 - RNA, 22 nt, Human
gggacugggagauccuccuggc

SEQ ID NO: 37943 - RNA, 22 nt, Human
gggacuguaaauucauauggcc

SEQ ID NO: 37944 - RNA, 22 nt, Human
gggacuguccggcagaagguac

SEQ ID NO: 37945 - RNA, 22 nt, Human
gggagaaggagcuaguucuuga

SEQ ID NO: 37946 - RNA, 20 nt, Human
gggagaagggcugaugagag

SEQ ID NO: 37947 - RNA, 22 nt, Human
gggagacaaggagaaccaaaga

SEQ ID NO: 37948 - RNA, 19 nt, Human
gggagacagcucugggcug

SEQ ID NO: 37949 - RNA, 22 nt, Human
gggagacaguucagauaguuuc

SEQ ID NO: 37950 - RNA, 22 nt, Human
gggagacccccaaugccagguc

SEQ ID NO: 37951 - RNA, 22 nt, Human
gggagacuagugcuauguuuuc

SEQ ID NO: 37952 - RNA, 22 nt, Human
gggagagaaauuauagcaauga

SEQ ID NO: 37953 - RNA, 19 nt, Human
gggagagccaggcucaccc

SEQ ID NO: 37954 - RNA, 22 nt, Human
gggagauggcucagaggccgcg

SEQ ID NO: 37955 - RNA, 22 nt, Human
gggagcacugagaggcagguag

SEQ ID NO: 37956 - RNA, 19 nt, Human
gggagcaggaaagcugugg

SEQ ID NO: 37957 - RNA, 22 nt, Human
gggagcaggacauaauagcaau

SEQ ID NO: 37958 - RNA, 22 nt, Human
gggagcaggagccugccugcca

SEQ ID NO: 37959 - RNA, 23 nt, Human
gggagccaggaccucgcgcccca

SEQ ID NO: 37960 - RNA, 22 nt, Human
gggagccuugggagugccagcc

SEQ ID NO: 37961 - RNA, 22 nt, Human
gggagcucgugcgcccaggugc

SEQ ID NO: 37962 - RNA, 22 nt, Human
gggagcugaacugcugaaguug

SEQ ID NO: 37963 - RNA, 22 nt, Human
gggagcugaggagccccgucgg

SEQ ID NO: 37964 - RNA, 22 nt, Human
gggagcugaucagguggauuca

SEQ ID NO: 37965 - RNA, 22 nt, Human
gggagcugaugauguaaguccc

SEQ ID NO: 37966 - RNA, 22 nt, Human
gggagcugccuuagaccggagg

SEQ ID NO: 37967 - RNA, 22 nt, Human
gggagcuggagcuggaagacuc

SEQ ID NO: 37968 - RNA, 22 nt, Human
gggagcuggaguuguguugccu

SEQ ID NO: 37969 - RNA, 22 nt, Human
gggagcuguaagggacagguag

SEQ ID NO: 37970 - RNA, 22 nt, Human
gggagcuucuggaaggcaggaa

SEQ ID NO: 37971 - RNA, 22 nt, Human
gggaggaaaugugcagcgaauu

SEQ ID NO: 37972 - RNA, 22 nt, Human
gggaggaggaauguuuugugua

SEQ ID NO: 37973 - RNA, 20 nt, Human
gggaggcgagggcugagcag

SEQ ID NO: 37974 - RNA, 22 nt, Human
gggaggcucugcucagcccccg

SEQ ID NO: 37975 - RNA, 22 nt, Human
gggaggcugccauccuucagga

SEQ ID NO: 37976 - RNA, 22 nt, Human
gggagggaaagcuugaucuguc

SEQ ID NO: 37977 - RNA, 22 nt, Human
gggagggaaggaccuuaugaau

SEQ ID NO: 37978 - RNA, 22 nt, Human
gggagggaagguaccuguguga

SEQ ID NO: 37979 - RNA, 21 nt, Human
gggagggauggaaaugauguu

SEQ ID NO: 37980 - RNA, 22 nt, Human
gggagggccaggcucacccagg

SEQ ID NO: 37981 - RNA, 22 nt, Human
gggagggucugccaugcucccu

SEQ ID NO: 37982 - RNA, 22 nt, Human
gggaggucagggugccugcugg

SEQ ID NO: 37983 - RNA, 22 nt, Human
gggagguccuaaaggggaccag

SEQ ID NO: 37984 - RNA, 22 nt, Human
gggagguguuccaguguuggua

SEQ ID NO: 37985 - RNA, 22 nt, Human
gggagguucuguucgcacuuga

SEQ ID NO: 37986 - RNA, 22 nt, Human
gggaguaaacuauggugaggau

SEQ ID NO: 37987 - RNA, 20 nt, Human
gggagucuggaugaaagaug

SEQ ID NO: 37988 - RNA, 22 nt, Human
gggagucugggcuagacuccuu

SEQ ID NO: 37989 - RNA, 22 nt, Human
gggaguggagagcaauggauga

SEQ ID NO: 37990 - RNA, 22 nt, Human
gggaguggauuauguggaccca

SEQ ID NO: 37991 - RNA, 22 nt, Human
gggaucugacuugcuggugggu

SEQ ID NO: 37992 - RNA, 22 nt, Human
gggaucugaugcacugcugaaa

SEQ ID NO: 37993 - RNA, 22 nt, Human
gggaucuguguugcgauggauu

SEQ ID NO: 37994 - RNA, 21 nt, Human
gggaucuuguacuggcgugga

SEQ ID NO: 37995 - RNA, 21 nt, Human
gguggcucaccugauuggaua

SEQ ID NO: 37996 - RNA, 22 nt, Human
gguggcucagggcuccaagcau

SEQ ID NO: 37997 - RNA, 22 nt, Human
gguggcucucugucagugacag

SEQ ID NO: 37998 - RNA, 22 nt, Human
gguggcucucuuaagggcagcg

SEQ ID NO: 37999 - RNA, 22 nt, Human
gguggcugaagcagucuucggg

SEQ ID NO: 38000 - RNA, 22 nt, Human
gguggcugaaucaaaucaggcc

SEQ ID NO: 38001 - RNA, 22 nt, Human
gguggcugcuuccucaagagga

SEQ ID NO: 38002 - RNA, 22 nt, Human
gguggcugggauuaguagccca

SEQ ID NO: 38003 - RNA, 22 nt, Human
ggugggaaggccacugaagguu

SEQ ID NO: 38004 - RNA, 22 nt, Human
ggugggagagcuugcuuugaug

SEQ ID NO: 38005 - RNA, 23 nt, Human
ggugggagauuauccagaauuau

SEQ ID NO: 38006 - RNA, 22 nt, Human
ggugggaggcaggcugcuccca

SEQ ID NO: 38007 - RNA, 22 nt, Human
ggugggaucaaagagucauucg

SEQ ID NO: 38008 - RNA, 22 nt, Human
ggugggaugccucuggagaagu

SEQ ID NO: 38009 - RNA, 22 nt, Human
ggugggauggaggaucuuagac

SEQ ID NO: 38010 - RNA, 21 nt, Human
ggugggcacaggagagcagag

SEQ ID NO: 38011 - RNA, 22 nt, Human
ggugggccaggaaggccgccag

SEQ ID NO: 38012 - RNA, 22 nt, Human
gguggggauuccugaucacugu

SEQ ID NO: 38013 - RNA, 22 nt, Human
gguggggcccuggcacugguau

SEQ ID NO: 38014 - RNA, 22 nt, Human
gguggggccugcuccagcggcc

SEQ ID NO: 38015 - RNA, 22 nt, Human
ggugggggagacuuggucaaga

SEQ ID NO: 38016 - RNA, 22 nt, Human
ggugggguauuugguacuugua

SEQ ID NO: 38017 - RNA, 22 nt, Human
gguggguauugaauacaggugu

SEQ ID NO: 38018 - RNA, 22 nt, Human
ggugggucuugcggggcagcuu

SEQ ID NO: 38019 - RNA, 22 nt, Human
ggugggucuuguggggcagcuu

SEQ ID NO: 38020 - RNA, 22 nt, Human
ggugggugaaaucuaggugugu

SEQ ID NO: 38021 - RNA, 22 nt, Human
gguggguggaaacagcauguac

SEQ ID NO: 38022 - RNA, 19 nt, Human
gguggguuggugguucccu

SEQ ID NO: 38023 - RNA, 22 nt, Human
gguggugaagacaaguggaagu

SEQ ID NO: 38024 - RNA, 23 nt, Human
ggugguggugagucacgggcuca

SEQ ID NO: 38025 - RNA, 22 nt, Human
gguguagcucugugucccacug

SEQ ID NO: 38026 - RNA, 22 nt, Human
ggugucaaauuauugaguuuca

SEQ ID NO: 38027 - RNA, 22 nt, Human
ggugucagauacauaggaagua

SEQ ID NO: 38028 - RNA, 22 nt, Human
gguguccucaugauuuucuaga

SEQ ID NO: 38029 - RNA, 21 nt, Human
gguguccugagggauagguag

SEQ ID NO: 38030 - RNA, 22 nt, Human
gguguccugggcaggcagcuga

SEQ ID NO: 38031 - RNA, 22 nt, Human
ggugucuaugauucaguuuaug

SEQ ID NO: 38032 - RNA, 21 nt, Human
uccagcucuuauguucaugaa

SEQ ID NO: 38033 - RNA, 19 nt, Human
uccagcugguaugcccaga

SEQ ID NO: 38034 - RNA, 20 nt, Human
uccagcuguugagaucugag

SEQ ID NO: 38035 - RNA, 22 nt, Human
uccagcuguuguuuuaucucag

SEQ ID NO: 38036 - RNA, 22 nt, Human
uccagcuuauagguagauuuaa

SEQ ID NO: 38037 - RNA, 22 nt, Human
uccagcuuggcagagcuaccug

SEQ ID NO: 38038 - RNA, 22 nt, Human
uccagcuugggugggaggaggu

SEQ ID NO: 38039 - RNA, 22 nt, Human
uccagcuuugccugaucauaua

SEQ ID NO: 38040 - RNA, 22 nt, Human
uccaggaaaaggcuugcagggg

SEQ ID NO: 38041 - RNA, 22 nt, Human
uccaggaaagcacugggcuggg

SEQ ID NO: 38042 - RNA, 22 nt, Human
uccaggaaagugggaugugugu

SEQ ID NO: 38043 - RNA, 21 nt, Human
uccaggaaaguuuuaagagug

SEQ ID NO: 38044 - RNA, 22 nt, Human
uccaggaaaucagaagugguaa

SEQ ID NO: 38045 - RNA, 22 nt, Human
uccaggaacgagaggcugggca

SEQ ID NO: 38046 - RNA, 22 nt, Human
uccaggaaggacuaaugguuug

SEQ ID NO: 38047 - RNA, 22 nt, Human
uccaggaaucugugccuagccc

SEQ ID NO: 38048 - RNA, 21 nt, Human
uccaggaaugucuguucaucu

SEQ ID NO: 38049 - RNA, 22 nt, Human
uccaggacuagcauuucugaua

SEQ ID NO: 38050 - RNA, 22 nt, Human
uccaggacuauaggaaagacac

SEQ ID NO: 38051 - RNA, 22 nt, Human
uccaggacuuucuuaaggcacu

SEQ ID NO: 38052 - RNA, 23 nt, Human
uccaggagaaccccugucugucc

SEQ ID NO: 38053 - RNA, 20 nt, Human
uccaggagaacugggagccg

SEQ ID NO: 38054 - RNA, 23 nt, Human
uccaggagaauuccagggcccgg

SEQ ID NO: 38055 - RNA, 22 nt, Human
uccaggagacacaagguacaua

SEQ ID NO: 38056 - RNA, 22 nt, Human
uccaggagacacccuugugugu

SEQ ID NO: 38057 - RNA, 22 nt, Human
uccaggagaggccugaccaggu

SEQ ID NO: 38058 - RNA, 22 nt, Human
uccaggagagguagaggguucc

SEQ ID NO: 38059 - RNA, 22 nt, Human
uccaggagauacacugcaccag

SEQ ID NO: 38060 - RNA, 19 nt, Human
uccaggagcaaagccaguu

SEQ ID NO: 38061 - RNA, 22 nt, Human
uccaggaggcaccuuuggacca

SEQ ID NO: 38062 - RNA, 22 nt, Human
uccaggaggcagggcugugccc

SEQ ID NO: 38063 - RNA, 22 nt, Human
uccaggagggggagccgugccg

SEQ ID NO: 38064 - RNA, 22 nt, Human
uccaggagguaugaguggcccc

SEQ ID NO: 38065 - RNA, 22 nt, Human
uccaggagguugagugaguucc

SEQ ID NO: 38066 - RNA, 22 nt, Human
uccaggagucagacagauggug

SEQ ID NO: 38067 - RNA, 22 nt, Human
uccaggagugcugguuagagua

SEQ ID NO: 38068 - RNA, 21 nt, Human
uccaggaguggcugggcaggg

SEQ ID NO: 38069 - RNA, 21 nt, Human
uccaggaguucuaauaggugu

SEQ ID NO: 38070 - RNA, 22 nt, Human
uccaggaguuugagacugcagu

SEQ ID NO: 38071 - RNA, 22 nt, Human
uccaggauggugacgguggcca

SEQ ID NO: 38072 - RNA, 22 nt, Human
uccaggauugucagccagaagg

SEQ ID NO: 38073 - RNA, 22 nt, Human
uccaggcaaaaaccaacuacag

SEQ ID NO: 38074 - RNA, 22 nt, Human
uccaggcaaaaggaacugcuug

SEQ ID NO: 38075 - RNA, 17 nt, Human
uccaggcagcaacugag

SEQ ID NO: 38076 - RNA, 20 nt, Human
uccaggcagcucagaguguc

SEQ ID NO: 38077 - RNA, 22 nt, Human
uccaggcagggcagccaucaag

SEQ ID NO: 38078 - RNA, 22 nt, Human
uccaggcaucccccaggacaga

SEQ ID NO: 38079 - RNA, 22 nt, Human
uccaggcaugguguaauuuugc

SEQ ID NO: 38080 - RNA, 22 nt, Human
uccaggcaugucccaagccgga

SEQ ID NO: 38081 - RNA, 22 nt, Human
uccaggcauguggccaguacuc

SEQ ID NO: 38082 - RNA, 15 nt, Human
uccaggcauucauuc

SEQ ID NO: 38083 - RNA, 22 nt, Human
uccaggcauuccagccauucca

SEQ ID NO: 38084 - RNA, 22 nt, Human
uccaggcauuggagagauaaug

SEQ ID NO: 38085 - RNA, 22 nt, Human
uccaggccacauggauggcgau

SEQ ID NO: 38086 - RNA, 19 nt, Human
uccaggccauucccagagc

SEQ ID NO: 38087 - RNA, 22 nt, Human
uccaggcccacucagcugaaau

SEQ ID NO: 38088 - RNA, 22 nt, Human
uccaggcccacucgguggggcu

SEQ ID NO: 38089 - RNA, 22 nt, Human
uccaggcccauagacacuucuc

SEQ ID NO: 38090 - RNA, 22 nt, Human
uccaggccccagcaccuuggga

SEQ ID NO: 38091 - RNA, 22 nt, Human
uccaggccucuagccccuaucu

SEQ ID NO: 38092 - RNA, 22 nt, Human
uccaggcuaauuuugcauuguu

SEQ ID NO: 38093 - RNA, 22 nt, Human
uccaggcuacuuggauuccugg

SEQ ID NO: 38094 - RNA, 22 nt, Human
uccaggcuagaagucacaggcc

SEQ ID NO: 38095 - RNA, 22 nt, Human
uccaggcuagccugguagagaa

SEQ ID NO: 38096 - RNA, 22 nt, Human
uccaggcuccccugcgugcucc

SEQ ID NO: 38097 - RNA, 20 nt, Human
uccaggcuccuccacuuagu

SEQ ID NO: 38098 - RNA, 22 nt, Human
uccaggcuccugacuuuuuggg

SEQ ID NO: 38099 - RNA, 22 nt, Human
uccaggcugauccaugaagaau

SEQ ID NO: 38100 - RNA, 22 nt, Human
uccaggcuggacaugaggcggg

SEQ ID NO: 38101 - RNA, 18 nt, Human
uccaggcuggauugauga

SEQ ID NO: 38102 - RNA, 22 nt, Human
uccaggcuggccucgcgugaca

SEQ ID NO: 38103 - RNA, 22 nt, Human
uccaggcugggcugaagggugc

SEQ ID NO: 38104 - RNA, 22 nt, Human
guaacaaaguuucuaggugcug

SEQ ID NO: 38105 - RNA, 22 nt, Human
guaacacuuggcugcaaccugg

SEQ ID NO: 38106 - RNA, 22 nt, Human
guaacagaaagucaugcucauu

SEQ ID NO: 38107 - RNA, 22 nt, Human
guaacagagaacucagguguua

SEQ ID NO: 38108 - RNA, 22 nt, Human
guaacauaguuugugcuucauc

SEQ ID NO: 38109 - RNA, 16 nt, Human
guaacauucuguagcc

SEQ ID NO: 38110 - RNA, 22 nt, Human
guaacauuuugagcaguaggcu

SEQ ID NO: 38111 - RNA, 22 nt, Human
guaaccugggauguagcacaga

SEQ ID NO: 38112 - RNA, 22 nt, Human
guaaccugucggaaagccuugu

SEQ ID NO: 38113 - RNA, 22 nt, Human
guaacucuggguagaacucaug

SEQ ID NO: 38114 - RNA, 22 nt, Human
guaacugaggcagcuuuuaaga

SEQ ID NO: 38115 - RNA, 23 nt, Human
guaacuggggaauuugagcuaug

SEQ ID NO: 38116 - RNA, 22 nt, Human
guaagacauagauuucucauga

SEQ ID NO: 38117 - RNA, 22 nt, Human
guaagagcacugucuccugcug

SEQ ID NO: 38118 - RNA, 22 nt, Human
guaagaggagugggaagccuca

SEQ ID NO: 38119 - RNA, 22 nt, Human
guaagcaaacagcaaaugauuu

SEQ ID NO: 38120 - RNA, 17 nt, Human
guaaggcuugcagaugc

SEQ ID NO: 38121 - RNA, 22 nt, Human
guaagggauuugaacauagguu

SEQ ID NO: 38122 - RNA, 22 nt, Human
guaagucugaguguaauucaca

SEQ ID NO: 38123 - RNA, 22 nt, Human
guaaguuauauuaaaauuucag

SEQ ID NO: 38124 - RNA, 22 nt, Human
guaauaauacuagucagccuug

SEQ ID NO: 38125 - RNA, 22 nt, Human
guaauaaugguccccaaacacu

SEQ ID NO: 38126 - RNA, 22 nt, Human
guaauagaacacucagcaugga

SEQ ID NO: 38127 - RNA, 22 nt, Human
guaaucguggugguuaauucca

SEQ ID NO: 38128 - RNA, 22 nt, Human
guaaucuguaguaaagcaccau

SEQ ID NO: 38129 - RNA, 22 nt, Human
guaaugaaucaacauuaaugau

SEQ ID NO: 38130 - RNA, 22 nt, Human
guaaugaaugaaagaaacuggg

SEQ ID NO: 38131 - RNA, 22 nt, Human
guacaaaguggaccugauagua

SEQ ID NO: 38132 - RNA, 22 nt, Human
guacaaauugauacagauuuga

SEQ ID NO: 38133 - RNA, 22 nt, Human
guacaaggcauuuaucuguuca

SEQ ID NO: 38134 - RNA, 22 nt, Human
guacaaguugccuaccuuaagu

SEQ ID NO: 38135 - RNA, 22 nt, Human
guacaauagcaguuuucccuuu

SEQ ID NO: 38136 - RNA, 18 nt, Human
guacacaaagucaaagua

SEQ ID NO: 38137 - RNA, 22 nt, Human
guacacaaauaauaaaguuaca

SEQ ID NO: 38138 - RNA, 22 nt, Human
guacacacaaucucuggucagu

SEQ ID NO: 38139 - RNA, 22 nt, Human
guacacagaugcuugagaaucu

SEQ ID NO: 38140 - RNA, 22 nt, Human
guacacaggcagcccagugcug

SEQ ID NO: 38141 - RNA, 21 nt, Human
guacacagugguucugaggga

SEQ ID NO: 38142 - RNA, 20 nt, Human
guacacauauauguaugugu

SEQ ID NO: 38143 - RNA, 22 nt, Human
guacacauauuuccaaggguaa

SEQ ID NO: 38144 - RNA, 22 nt, Human
guacacauuaugcuucucuaaa

SEQ ID NO: 38145 - RNA, 20 nt, Human
guacacuucauguuucaccu

SEQ ID NO: 38146 - RNA, 22 nt, Human
guacacuugacucauaggaaau

SEQ ID NO: 38147 - RNA, 22 nt, Human
guacagaaauggggccccaggu

SEQ ID NO: 38148 - RNA, 22 nt, Human
guacagaaggagcuuuggauuc

SEQ ID NO: 38149 - RNA, 22 nt, Human
guacagaauuaugccaugaggg

SEQ ID NO: 38150 - RNA, 22 nt, Human
guacagcuaagaauuucaucuu

SEQ ID NO: 38151 - RNA, 22 nt, Human
guacaggaccgcggcccccugg

SEQ ID NO: 38152 - RNA, 22 nt, Human
guacaggcagcaaacaccauaa

SEQ ID NO: 38153 - RNA, 22 nt, Human
guacagggccccucagcagggc

SEQ ID NO: 38154 - RNA, 22 nt, Human
guacaguaaauguaaauggauu

SEQ ID NO: 38155 - RNA, 22 nt, Human
guacaguaaucccguucuucug

SEQ ID NO: 38156 - RNA, 22 nt, Human
guacaguagagccagguucagu

SEQ ID NO: 38157 - RNA, 22 nt, Human
guacagugccagacuucuaggu

SEQ ID NO: 38158 - RNA, 19 nt, Human
guacagugguaagcuauga

SEQ ID NO: 38159 - RNA, 22 nt, Human
guacagugugacuuuggaguga

SEQ ID NO: 38160 - RNA, 22 nt, Human
guacauauccuuuacguuuugu

SEQ ID NO: 38161 - RNA, 22 nt, Human
guacauauuaaaggucuauaaa

SEQ ID NO: 38162 - RNA, 22 nt, Human
guacauauuauaaaauacagcu

SEQ ID NO: 38163 - RNA, 22 nt, Human
guacaucuuuaaauuguucagu

SEQ ID NO: 38164 - RNA, 22 nt, Human
guacauuucauuuaaaugaugu

SEQ ID NO: 38165 - RNA, 20 nt, Human
guacauuuucaggaggggau

SEQ ID NO: 38166 - RNA, 22 nt, Human
guacccagaggcaugaucccag

SEQ ID NO: 38167 - RNA, 22 nt, Human
guacccaggcacgccuugcuga

SEQ ID NO: 38168 - RNA, 22 nt, Human
guacccuguggccagccagcca

SEQ ID NO: 38169 - RNA, 22 nt, Human
guacuaaaaaaugaucaguuug

SEQ ID NO: 38170 - RNA, 22 nt, Human
guacuaaacagagaaccaauau

SEQ ID NO: 38171 - RNA, 22 nt, Human
guacuaagucaggagaagaauu

SEQ ID NO: 38172 - RNA, 22 nt, Human
guacuagaugagacagcguggg

SEQ ID NO: 38173 - RNA, 22 nt, Human
guacucaguaauauaacauauu

SEQ ID NO: 38174 - RNA, 20 nt, Human
guacuucagguguggucuga

SEQ ID NO: 38175 - RNA, 22 nt, Human
guacuuccagccaagugagaca

SEQ ID NO: 38176 - RNA, 22 nt, Human
guacuucccugggaggcaagca

SEQ ID NO: 38177 - RNA, 22 nt, Human
guacuuccguggacuaauuguu

SEQ ID NO: 38178 - RNA, 22 nt, Human
guacuuucaggcuuucccuuaa

SEQ ID NO: 38179 - RNA, 22 nt, Human
guagaaauagugguugacagga

SEQ ID NO: 38180 - RNA, 22 nt, Human
guagaacuaggacuucagguau

SEQ ID NO: 38181 - RNA, 22 nt, Human
guagaauuuuaauaauggagau

SEQ ID NO: 38182 - RNA, 22 nt, Human
guagacaagcacaggacucaga

SEQ ID NO: 38183 - RNA, 22 nt, Human
guagaggacauuugacaugaug

SEQ ID NO: 38184 - RNA, 21 nt, Human
guagauaaagcauuuucauua

SEQ ID NO: 38185 - RNA, 18 nt, Human
guagauccuugagcuacc

SEQ ID NO: 38186 - RNA, 22 nt, Human
guagaucucagacuuugaaauu

SEQ ID NO: 38187 - RNA, 22 nt, Human
guagaugagcucacaugaccuu

SEQ ID NO: 38188 - RNA, 22 nt, Human
guagcagaaucagugcuacaga

SEQ ID NO: 38189 - RNA, 22 nt, Human
guagcagagcugagaguggaac

SEQ ID NO: 38190 - RNA, 22 nt, Human
guagcagagggcccagguaacu

SEQ ID NO: 38191 - RNA, 22 nt, Human
guagcaucuguuggcugcuccu

SEQ ID NO: 38192 - RNA, 16 nt, Human
guagccguggccgcug

SEQ ID NO: 38193 - RNA, 22 nt, Human
guagccuagaggucacgucuuc

SEQ ID NO: 38194 - RNA, 22 nt, Human
guagcuauuuaugauacucaug

SEQ ID NO: 38195 - RNA, 22 nt, Human
guagcuucaaguacucucccug

SEQ ID NO: 38196 - RNA, 22 nt, Human
guaggcagauaggagugcagcc

SEQ ID NO: 38197 - RNA, 22 nt, Human
guaggcagugcuugauuuucca

SEQ ID NO: 38198 - RNA, 20 nt, Human
guaggcauaugaccaauuac

SEQ ID NO: 38199 - RNA, 22 nt, Human
guagggacccacagucuauauu

SEQ ID NO: 38200 - RNA, 22 nt, Human
guagggcagaaguucaaugugg

SEQ ID NO: 38201 - RNA, 22 nt, Human
guaggggccagaaagacuuaga

SEQ ID NO: 38202 - RNA, 22 nt, Human
guaggucagacauaagaggaca

SEQ ID NO: 38203 - RNA, 22 nt, Human
guaguacaugaagcacuuggca

SEQ ID NO: 38204 - RNA, 22 nt, Human
guagugcgcauggccuguuugu

SEQ ID NO: 38205 - RNA, 22 nt, Human
guagugggugaggaaggaagga

SEQ ID NO: 38206 - RNA, 22 nt, Human
guaguuagaguugugcuggaga

SEQ ID NO: 38207 - RNA, 22 nt, Human
guaguuuucugaaaauuacuuu

SEQ ID NO: 38208 - RNA, 22 nt, Human
guauaaacauggagugcauucu

SEQ ID NO: 38209 - RNA, 22 nt, Human
guauaaaggcacagguuuucug

SEQ ID NO: 38210 - RNA, 19 nt, Human
guauaacuuacaccagcaa

SEQ ID NO: 38211 - RNA, 22 nt, Human
guauaagcccauucucagagac

SEQ ID NO: 38212 - RNA, 22 nt, Human
guauacauagaugaugaacaag

SEQ ID NO: 38213 - RNA, 22 nt, Human
gucaugugaauaaguguggggu

SEQ ID NO: 38214 - RNA, 22 nt, Human
gucauuccuuauguugauucag

SEQ ID NO: 38215 - RNA, 17 nt, Human
gucauucucagaaaaug

SEQ ID NO: 38216 - RNA, 22 nt, Human
gucauugauuuucaguuugucc

SEQ ID NO: 38217 - RNA, 22 nt, Human
gucauuuaaagaccauuguggg

SEQ ID NO: 38218 - RNA, 22 nt, Human
gucauuuaggucugucagaaau

SEQ ID NO: 38219 - RNA, 22 nt, Human
gucauuuaucuucagaauuucu

SEQ ID NO: 38220 - RNA, 22 nt, Human
gucauuuuaugggaacagauuu

SEQ ID NO: 38221 - RNA, 22 nt, Human
gucauuuuucacugcauauaga

SEQ ID NO: 38222 - RNA, 22 nt, Human
guccaagagauguaacgaagaa

SEQ ID NO: 38223 - RNA, 22 nt, Human
guccaaugguaaauccaaauaa

SEQ ID NO: 38224 - RNA, 22 nt, Human
guccacagcuggccagggccuc

SEQ ID NO: 38225 - RNA, 22 nt, Human
guccacagggauggccacacau

SEQ ID NO: 38226 - RNA, 21 nt, Human
guccacagggguuuguccugg

SEQ ID NO: 38227 - RNA, 22 nt, Human
guccaccauagggagggcgugg

SEQ ID NO: 38228 - RNA, 22 nt, Human
guccacccaugacaccugccug

SEQ ID NO: 38229 - RNA, 22 nt, Human
guccacucacucuuagucacuc

SEQ ID NO: 38230 - RNA, 22 nt, Human
guccacucuagggcagcucucg

SEQ ID NO: 38231 - RNA, 22 nt, Human
guccagaagcucaaguugaacu

SEQ ID NO: 38232 - RNA, 22 nt, Human
guccagagauggacgagcagau

SEQ ID NO: 38233 - RNA, 22 nt, Human
guccagagcuggcacacuguca

SEQ ID NO: 38234 - RNA, 22 nt, Human
guccagagggcugcaggaugcu

SEQ ID NO: 38235 - RNA, 22 nt, Human
guccagccagcugguccuugcc

SEQ ID NO: 38236 - RNA, 22 nt, Human
guccagcuccagggaggcaggc

SEQ ID NO: 38237 - RNA, 22 nt, Human
guccagcugcagcugggcagaa

SEQ ID NO: 38238 - RNA, 22 nt, Human
guccagcugggccagggcacuc

SEQ ID NO: 38239 - RNA, 20 nt, Human
guccaggacccagcaggagg

SEQ ID NO: 38240 - RNA, 22 nt, Human
guccaggcaccucccuugugcu

SEQ ID NO: 38241 - RNA, 22 nt, Human
guccaggccaugguggacacag

SEQ ID NO: 38242 - RNA, 22 nt, Human
guccaggccccagggauucuug

SEQ ID NO: 38243 - RNA, 22 nt, Human
guccaggccugccucugaggag

SEQ ID NO: 38244 - RNA, 22 nt, Human
guccaggcucaaaagguuguua

SEQ ID NO: 38245 - RNA, 22 nt, Human
guccagggggcuuaagcaaacu

SEQ ID NO: 38246 - RNA, 22 nt, Human
guccagucacugucaauguucc

SEQ ID NO: 38247 - RNA, 22 nt, Human
guccagugcuaacagguugagg

SEQ ID NO: 38248 - RNA, 22 nt, Human
guccagugcuuauagaaucagu

SEQ ID NO: 38249 - RNA, 22 nt, Human
guccaguggucaauuaucugga

SEQ ID NO: 38250 - RNA, 22 nt, Human
guccaguuucagggucugcgcu

SEQ ID NO: 38251 - RNA, 22 nt, Human
guccauacaguggcacacaucu

SEQ ID NO: 38252 - RNA, 22 nt, Human
guccauccgugguagcauggau

SEQ ID NO: 38253 - RNA, 22 nt, Human
guccaugauucuguguaguaga

SEQ ID NO: 38254 - RNA, 22 nt, Human
guccaugcuuaaauaccuuaaa

SEQ ID NO: 38255 - RNA, 22 nt, Human
guccauggcauuuccgucacau

SEQ ID NO: 38256 - RNA, 22 nt, Human
guccaugguugcuuucauguaa

SEQ ID NO: 38257 - RNA, 22 nt, Human
gucccacugggcaacuagaaaa

SEQ ID NO: 38258 - RNA, 22 nt, Human
gucccaggaguugcugggccuu

SEQ ID NO: 38259 - RNA, 22 nt, Human
gucccaggugggcuccaccucu

SEQ ID NO: 38260 - RNA, 22 nt, Human
gucccauaaguagugcaacuug

SEQ ID NO: 38261 - RNA, 22 nt, Human
gucccauuuucuacuauggaau

SEQ ID NO: 38262 - RNA, 22 nt, Human
guccccagagcugguggugguu

SEQ ID NO: 38263 - RNA, 22 nt, Human
guccccagcuaaucucuuugcc

SEQ ID NO: 38264 - RNA, 22 nt, Human
gucccccugaaagcagccgcag

SEQ ID NO: 38265 - RNA, 22 nt, Human
gucccucugugucccugcaguc

SEQ ID NO: 38266 - RNA, 22 nt, Human
gggcugugccucaggugggguc

SEQ ID NO: 38267 - RNA, 18 nt, Human
gggcuguguucaugccca

SEQ ID NO: 38268 - RNA, 22 nt, Human
gggcuuauggagggcuuuguac

SEQ ID NO: 38269 - RNA, 22 nt, Human
gggcuucaauagcagaggcgug

SEQ ID NO: 38270 - RNA, 22 nt, Human
gggcuucagcuggggauggagc

SEQ ID NO: 38271 - RNA, 22 nt, Human
gggcuucaggagggucagccca

SEQ ID NO: 38272 - RNA, 22 nt, Human
gggcuucaguaccaaaguuuga

SEQ ID NO: 38273 - RNA, 23 nt, Human
gggcuucauuuuaauucagcugc

SEQ ID NO: 38274 - RNA, 22 nt, Human
gggcuucuagaauuucugauau

SEQ ID NO: 38275 - RNA, 22 nt, Human
gggcuucuagaccagcagugag

SEQ ID NO: 38276 - RNA, 22 nt, Human
gggcuucuauucuggcacaaga

SEQ ID NO: 38277 - RNA, 22 nt, Human
gggcuucucucagaaacuauca

SEQ ID NO: 38278 - RNA, 22 nt, Human
gggcuucucugggaguccuggu

SEQ ID NO: 38279 - RNA, 22 nt, Human
gggcuucuguaccuaccuggaa

SEQ ID NO: 38280 - RNA, 22 nt, Human
gggcuugaggugaagguaggga

SEQ ID NO: 38281 - RNA, 22 nt, Human
gggcuugcugauuugggcagga

SEQ ID NO: 38282 - RNA, 22 nt, Human
gggcuuuaaucuuguuaacuag

SEQ ID NO: 38283 - RNA, 18 nt, Human
gggcuuuacagaguggag

SEQ ID NO: 38284 - RNA, 17 nt, Human
gggcuuuagguggugua

SEQ ID NO: 38285 - RNA, 22 nt, Human
ggggaaacugaggcacagacag

SEQ ID NO: 38286 - RNA, 22 nt, Human
ggggaaagugaauuguguagug

SEQ ID NO: 38287 - RNA, 22 nt, Human
ggggaagaaauagaacauuuug

SEQ ID NO: 38288 - RNA, 22 nt, Human
ggggaagaccuggcacuacagc

SEQ ID NO: 38289 - RNA, 22 nt, Human
ggggaagagcauugcacggugu

SEQ ID NO: 38290 - RNA, 22 nt, Human
ggggaagaggcgugauggaucc

SEQ ID NO: 38291 - RNA, 22 nt, Human
ggggaagauggcccuccaugug

SEQ ID NO: 38292 - RNA, 23 nt, Human
ggggacagagggcagcccgcauc

SEQ ID NO: 38293 - RNA, 20 nt, Human
ggggacccagaaucacagcu

SEQ ID NO: 38294 - RNA, 22 nt, Human
ggggaccuaggcucugucucuu

SEQ ID NO: 38295 - RNA, 22 nt, Human
ggggagaauaaaucagauuuua

SEQ ID NO: 38296 - RNA, 22 nt, Human
ggggagaccaucugaaggugau

SEQ ID NO: 38297 - RNA, 22 nt, Human
ggggagaguauuuuauucaagu

SEQ ID NO: 38298 - RNA, 18 nt, Human
ggggagcagacugaacuc

SEQ ID NO: 38299 - RNA, 22 nt, Human
ggggaggaccuuuccaaggcuu

SEQ ID NO: 38300 - RNA, 22 nt, Human
ggggagugguugccugugaucc

SEQ ID NO: 38301 - RNA, 22 nt, Human
ggggaucuaggauauuucauga

SEQ ID NO: 38302 - RNA, 22 nt, Human
ggggaugagacuagagcuaaag

SEQ ID NO: 38303 - RNA, 22 nt, Human
ggggaugguagaccggugacgu

SEQ ID NO: 38304 - RNA, 22 nt, Human
ggggaugguggcauuuguaaaa

SEQ ID NO: 38305 - RNA, 22 nt, Human
ggggcagaaguagugccccuga

SEQ ID NO: 38306 - RNA, 22 nt, Human
ggggcagccuccaggaaagcug

SEQ ID NO: 38307 - RNA, 22 nt, Human
ggggcagcucccgagggcagga

SEQ ID NO: 38308 - RNA, 22 nt, Human
ggggcaggagcccuucuucagc

SEQ ID NO: 38309 - RNA, 22 nt, Human
ggggccagauaucacuaagguu

SEQ ID NO: 38310 - RNA, 22 nt, Human
ggggccagcaauguugaggaau

SEQ ID NO: 38311 - RNA, 22 nt, Human
ggggccagcacugugccuuugu

SEQ ID NO: 38312 - RNA, 22 nt, Human
ggggccaguaggagugauguac

SEQ ID NO: 38313 - RNA, 22 nt, Human
ggggccccuguggcuugaugcc

SEQ ID NO: 38314 - RNA, 22 nt, Human
ggggccucugcagucacgcugg

SEQ ID NO: 38315 - RNA, 19 nt, Human
ggggccugugauggucaca

SEQ ID NO: 38316 - RNA, 22 nt, Human
ggggcucaggggaaguguccag

SEQ ID NO: 38317 - RNA, 22 nt, Human
ggggcugacgggcauguggcuu

SEQ ID NO: 38318 - RNA, 22 nt, Human
ggggcugcucgccgcgcguuuc

SEQ ID NO: 38319 - RNA, 22 nt, Human
ggggcugggauuugaacccagg

SEQ ID NO: 38320 - RNA, 22 nt, Human
ggggcuucuuucugccaccgac

SEQ ID NO: 38321 - RNA, 22 nt, Human
gggggaagaggcaugaaguccu

SEQ ID NO: 38322 - RNA, 22 nt, Human
ucccuggguucccguggaagug

SEQ ID NO: 38323 - RNA, 22 nt, Human
ucccuguaaaccucaaguugau

SEQ ID NO: 38324 - RNA, 22 nt, Human
ucccuguaguucguggucuuug

SEQ ID NO: 38325 - RNA, 22 nt, Human
ucccuguauaucacaagggcua

SEQ ID NO: 38326 - RNA, 22 nt, Human
ucccugucuaauaugccaugaa

SEQ ID NO: 38327 - RNA, 22 nt, Human
ucccugucucccuugagacuag

SEQ ID NO: 38328 - RNA, 22 nt, Human
ucccugugacaagucugaguuc

SEQ ID NO: 38329 - RNA, 22 nt, Human
ucccugugagaaaugaagcagg

SEQ ID NO: 38330 - RNA, 22 nt, Human
ucccuguggauaucugcagcug

SEQ ID NO: 38331 - RNA, 22 nt, Human
ucccuguggcuaagacaugaca

SEQ ID NO: 38332 - RNA, 22 nt, Human
ucccuucaucagugagcaagcc

SEQ ID NO: 38333 - RNA, 22 nt, Human
ucccuuccucauaggcagaagg

SEQ ID NO: 38334 - RNA, 19 nt, Human
ucccuuccugucgggcucc

SEQ ID NO: 38335 - RNA, 22 nt, Human
ucccuucuggcagcagugugag

SEQ ID NO: 38336 - RNA, 22 nt, Human
ucccuugagaguuggccaauug

SEQ ID NO: 38337 - RNA, 22 nt, Human
ucccuugugagaacauguguug

SEQ ID NO: 38338 - RNA, 22 nt, Human
uccgagaagcauaaagcaggaa

SEQ ID NO: 38339 - RNA, 22 nt, Human
uccgaggcgcaccggcgcuccu

SEQ ID NO: 38340 - RNA, 22 nt, Human
uccgcuggagagggggcugcca

SEQ ID NO: 38341 - RNA, 22 nt, Human
uccggacucaccugacaauggc

SEQ ID NO: 38342 - RNA, 22 nt, Human
uccggcggccggccugagcccg

SEQ ID NO: 38343 - RNA, 22 nt, Human
uccguggagauuuugugcaggg

SEQ ID NO: 38344 - RNA, 22 nt, Human
uccguugacacugcauggagau

SEQ ID NO: 38345 - RNA, 22 nt, Human
uccuaaaggcugcuuuuauauu

SEQ ID NO: 38346 - RNA, 22 nt, Human
uccuaaaugauucagaaauuuc

SEQ ID NO: 38347 - RNA, 23 nt, Human
uccuaacugauucugcagucucu

SEQ ID NO: 38348 - RNA, 16 nt, Human
uccuaacuggcaguuc

SEQ ID NO: 38349 - RNA, 22 nt, Human
uccuacaaugcacagaauagcc

SEQ ID NO: 38350 - RNA, 22 nt, Human
uccuagaaagaugucuuuucac

SEQ ID NO: 38351 - RNA, 22 nt, Human
uccuagaagauggaucagagaa

SEQ ID NO: 38352 - RNA, 22 nt, Human
uccuagaauaaguaacaggaca

SEQ ID NO: 38353 - RNA, 22 nt, Human
uccuagaauaaucuuugacugc

SEQ ID NO: 38354 - RNA, 22 nt, Human
uccuagaauagugugucuggag

SEQ ID NO: 38355 - RNA, 19 nt, Human
uccuagaaugaggguguug

SEQ ID NO: 38356 - RNA, 22 nt, Human
uccuagagaguaauacaguuuu

SEQ ID NO: 38357 - RNA, 22 nt, Human
uccuagagccuccagagggaga

SEQ ID NO: 38358 - RNA, 22 nt, Human
uccuagaggaugguaggaagcu

SEQ ID NO: 38359 - RNA, 19 nt, Human
uccuagcaccuggcacaua

SEQ ID NO: 38360 - RNA, 20 nt, Human
uccuagcuucucucuguaca

SEQ ID NO: 38361 - RNA, 22 nt, Human
uccuagcuugucaguucucuaa

SEQ ID NO: 38362 - RNA, 22 nt, Human
uccuaggcaguuggugcuccau

SEQ ID NO: 38363 - RNA, 22 nt, Human
uccuaguucucugccagucgcu

SEQ ID NO: 38364 - RNA, 22 nt, Human
uccucacacuauagaugaggau

SEQ ID NO: 38365 - RNA, 22 nt, Human
uccucacagaugggugcauagc

SEQ ID NO: 38366 - RNA, 22 nt, Human
uccucacagcugguucauucag

SEQ ID NO: 38367 - RNA, 22 nt, Human
uccucacagggcaggaaggagg

SEQ ID NO: 38368 - RNA, 22 nt, Human
uccucagaauggauggcagggg

SEQ ID NO: 38369 - RNA, 22 nt, Human
uccucagagaugggcaucuaag

SEQ ID NO: 38370 - RNA, 22 nt, Human
uccucagagcagcccuccgcau

SEQ ID NO: 38371 - RNA, 22 nt, Human
uccucagagcauagcgcugucu

SEQ ID NO: 38372 - RNA, 22 nt, Human
uccucagcaaacacuucacucu

SEQ ID NO: 38373 - RNA, 22 nt, Human
uccucagcaggucuguguacca

SEQ ID NO: 38374 - RNA, 22 nt, Human
uccucagcauggaaucuggacu

SEQ ID NO: 38375 - RNA, 21 nt, Human
uccucagggccccagagcacu

SEQ ID NO: 38376 - RNA, 19 nt, Human
uccucaggggcucacagac

SEQ ID NO: 38377 - RNA, 23 nt, Human
uccucaguauauaaaggcagaug

SEQ ID NO: 38378 - RNA, 22 nt, Human
uccucaguuauaaauaggaaac

SEQ ID NO: 38379 - RNA, 22 nt, Human
gucccugacacccggguggagg

SEQ ID NO: 38380 - RNA, 22 nt, Human
gucccugcaucaccacgggacu

SEQ ID NO: 38381 - RNA, 22 nt, Human
gucccugcaucugcaggccaug

SEQ ID NO: 38382 - RNA, 22 nt, Human
gucccuggagcugagcagugcu

SEQ ID NO: 38383 - RNA, 22 nt, Human
gucccugggaaaggagagggca

SEQ ID NO: 38384 - RNA, 22 nt, Human
gucccugggaugcccuucuggg

SEQ ID NO: 38385 - RNA, 19 nt, Human
gucccugggcagaggcacc

SEQ ID NO: 38386 - RNA, 22 nt, Human
gucccuggggguuuaggacuca

SEQ ID NO: 38387 - RNA, 22 nt, Human
gucccuuggcucacaaacagcu

SEQ ID NO: 38388 - RNA, 20 nt, Human
guccuagguuugaagguaaa

SEQ ID NO: 38389 - RNA, 22 nt, Human
guccucagagugggcagguccu

SEQ ID NO: 38390 - RNA, 22 nt, Human
guccucaggcuugaguguuuau

SEQ ID NO: 38391 - RNA, 22 nt, Human
guccucagggagucccagucau

SEQ ID NO: 38392 - RNA, 19 nt, Human
guccucauguuguucucca

SEQ ID NO: 38393 - RNA, 22 nt, Human
guccucugaaguugugcaaugc

SEQ ID NO: 38394 - RNA, 22 nt, Human
guccucugauuucuagguauau

SEQ ID NO: 38395 - RNA, 22 nt, Human
guccucugggagccuugagccu

SEQ ID NO: 38396 - RNA, 22 nt, Human
guccucuggugaaagcauuccc

SEQ ID NO: 38397 - RNA, 22 nt, Human
guccucuguagggcugggccac

SEQ ID NO: 38398 - RNA, 22 nt, Human
guccucugucccuggggcacgg

SEQ ID NO: 38399 - RNA, 22 nt, Human
guccucuguuagaaaugugcuu

SEQ ID NO: 38400 - RNA, 22 nt, Human
guccugaaugccuucauagucc

SEQ ID NO: 38401 - RNA, 22 nt, Human
guccugagggcccaggcauucu

SEQ ID NO: 38402 - RNA, 19 nt, Human
guccugcaacuggcucucc

SEQ ID NO: 38403 - RNA, 22 nt, Human
guccugcacauggagggcaaug

SEQ ID NO: 38404 - RNA, 22 nt, Human
guccuggaauccuagaacagug

SEQ ID NO: 38405 - RNA, 22 nt, Human
guccuggauugaacauaggcag

SEQ ID NO: 38406 - RNA, 22 nt, Human
guccuggcccaggaguacacau

SEQ ID NO: 38407 - RNA, 19 nt, Human
guccuggcgccgccacacc

SEQ ID NO: 38408 - RNA, 22 nt, Human
guccuggcuuaguucgcuguaa

SEQ ID NO: 38409 - RNA, 22 nt, Human
guccugggagaugggacccuga

SEQ ID NO: 38410 - RNA, 22 nt, Human
guccugguccugccuccccaug

SEQ ID NO: 38411 - RNA, 22 nt, Human
guccuggugcuggucauugucg

SEQ ID NO: 38412 - RNA, 22 nt, Human
guccugugagauucaugcucaa

SEQ ID NO: 38413 - RNA, 22 nt, Human
guccugugucccagagaaagag

SEQ ID NO: 38414 - RNA, 22 nt, Human
guccuguguguugccggcugaa

SEQ ID NO: 38415 - RNA, 22 nt, Human
guccuguuaagaugcagagucc

SEQ ID NO: 38416 - RNA, 22 nt, Human
guccuguugggguguugcaguc

SEQ ID NO: 38417 - RNA, 22 nt, Human
guccuucaagaguccccuacug

SEQ ID NO: 38418 - RNA, 22 nt, Human
guccuucaaguaaccugggacc

SEQ ID NO: 38419 - RNA, 22 nt, Human
guccuucagcaccucccucggc

SEQ ID NO: 38420 - RNA, 22 nt, Human
guccuucauaucauggauuaua

SEQ ID NO: 38421 - RNA, 21 nt, Human
guccuucauuaucaagucaaa

SEQ ID NO: 38422 - RNA, 22 nt, Human
guccuuccugcagggauggaug

SEQ ID NO: 38423 - RNA, 22 nt, Human
guccuuggagcuccccucugua

SEQ ID NO: 38424 - RNA, 22 nt, Human
guccuuggagucaggcaaggcu

SEQ ID NO: 38425 - RNA, 22 nt, Human
guccuuggcagcaguccacccc

SEQ ID NO: 38426 - RNA, 22 nt, Human
guccuuggcaucaugauuuggu

SEQ ID NO: 38427 - RNA, 22 nt, Human
guccuuggccuggguagagugg

SEQ ID NO: 38428 - RNA, 22 nt, Human
guccuuggccuucuuguaggca

SEQ ID NO: 38429 - RNA, 22 nt, Human
guccuuggcugggcuugccucg

SEQ ID NO: 38430 - RNA, 22 nt, Human
guccuuggcuucuuguugacug

SEQ ID NO: 38431 - RNA, 22 nt, Human
gugcacaucgugcagguuuguu

SEQ ID NO: 38432 - RNA, 22 nt, Human
gugcaccagucacaugggcaga

SEQ ID NO: 38433 - RNA, 22 nt, Human
gugcagaaguaacaauuaaaga

SEQ ID NO: 38434 - RNA, 22 nt, Human
gugcagacccacguccagggcc

SEQ ID NO: 38435 - RNA, 22 nt, Human
gugcagacuuacagauuauccc

SEQ ID NO: 38436 - RNA, 20 nt, Human
gugcagaggcagccuguggg

SEQ ID NO: 38437 - RNA, 22 nt, Human
gugcagauccugauugcaguuc

SEQ ID NO: 38438 - RNA, 18 nt, Human
gugcagauugcggagccc

SEQ ID NO: 38439 - RNA, 22 nt, Human
gugcagcaaacuagugcgaggg

SEQ ID NO: 38440 - RNA, 22 nt, Human
gugcagcagggggaagacagug

SEQ ID NO: 38441 - RNA, 20 nt, Human
gugcagccaagcugagccgc

SEQ ID NO: 38442 - RNA, 22 nt, Human
gugcagccugucgccaguggau

SEQ ID NO: 38443 - RNA, 22 nt, Human
gugcagcugcccaagccugagc

SEQ ID NO: 38444 - RNA, 22 nt, Human
gugcagcugccgaucagauagg

SEQ ID NO: 38445 - RNA, 22 nt, Human
gugcaggagcucccgcaguggu

SEQ ID NO: 38446 - RNA, 22 nt, Human
gugcaggcaaaagggccaggcc

SEQ ID NO: 38447 - RNA, 22 nt, Human
gugcaggcucucguucuugaca

SEQ ID NO: 38448 - RNA, 22 nt, Human
gugcagguggcuucuagcuucu

SEQ ID NO: 38449 - RNA, 22 nt, Human
gugcagguguuuuggcugccag

SEQ ID NO: 38450 - RNA, 22 nt, Human
gugcagugaaaaaagaaugucc

SEQ ID NO: 38451 - RNA, 22 nt, Human
gugcagugacccuggagagcug

SEQ ID NO: 38452 - RNA, 22 nt, Human
gugcaguggcagauccuagcuc

SEQ ID NO: 38453 - RNA, 22 nt, Human
gugcauauaugugcagcaucaa

SEQ ID NO: 38454 - RNA, 22 nt, Human
gugcauauguaccugugaucau

SEQ ID NO: 38455 - RNA, 21 nt, Human
gugcaugcgccgcugagaugc

SEQ ID NO: 38456 - RNA, 22 nt, Human
gugcaugucggggugcauguca

SEQ ID NO: 38457 - RNA, 22 nt, Human
gugcaugugcauccauguguac

SEQ ID NO: 38458 - RNA, 23 nt, Human
gugcaugugucuuuacaguagca

SEQ ID NO: 38459 - RNA, 22 nt, Human
gugcaugugucuuuauaguaga

SEQ ID NO: 38460 - RNA, 22 nt, Human
gugcauguuaaugguguacaaa

SEQ ID NO: 38461 - RNA, 22 nt, Human
gugcauuaacaacccagaacuc

SEQ ID NO: 38462 - RNA, 22 nt, Human
gugcauuaguuuccuauugcug

SEQ ID NO: 38463 - RNA, 19 nt, Human
gugcauuccaaagcaccau

SEQ ID NO: 38464 - RNA, 20 nt, Human
gugcauuucaccuguacugu

SEQ ID NO: 38465 - RNA, 22 nt, Human
gugccaccagaugcuguugcua

SEQ ID NO: 38466 - RNA, 22 nt, Human
gugccaccucugccccagaggg

SEQ ID NO: 38467 - RNA, 22 nt, Human
gugccacugcacucuagccuag

SEQ ID NO: 38468 - RNA, 22 nt, Human
gugccagagcaaucaggcucug

SEQ ID NO: 38469 - RNA, 22 nt, Human
gugccagcaguuauggugauuu

SEQ ID NO: 38470 - RNA, 22 nt, Human
gugccaggugcuaagcugugcu

SEQ ID NO: 38471 - RNA, 22 nt, Human
gugcccaggcccaaggcaccac

SEQ ID NO: 38472 - RNA, 22 nt, Human
gugcccaguugaggccaggacu

SEQ ID NO: 38473 - RNA, 20 nt, Human
gugcccaguuggugacagac

SEQ ID NO: 38474 - RNA, 22 nt, Human
gugcccuccguguucauagagc

SEQ ID NO: 38475 - RNA, 22 nt, Human
gugcccugaaagaguuaauuca

SEQ ID NO: 38476 - RNA, 22 nt, Human
gugcccugaggucuucacuuug

SEQ ID NO: 38477 - RNA, 22 nt, Human
gugcccugaguggguaggagag

SEQ ID NO: 38478 - RNA, 22 nt, Human
gugcccugcaugccccggguau

SEQ ID NO: 38479 - RNA, 22 nt, Human
gugcccuggggugaaccccugg

SEQ ID NO: 38480 - RNA, 22 nt, Human
gugccuccaggcucgacuaguc

SEQ ID NO: 38481 - RNA, 22 nt, Human
gugccuccaucagugccuccaa

SEQ ID NO: 38482 - RNA, 22 nt, Human
gugccugcagcaauccauggca

SEQ ID NO: 38483 - RNA, 22 nt, Human
gugccugcugcagagucgcugu

SEQ ID NO: 38484 - RNA, 22 nt, Human
gugccugcugcagcugagcagu

SEQ ID NO: 38485 - RNA, 22 nt, Human
gugccuggaacuggguaggcug

SEQ ID NO: 38486 - RNA, 22 nt, Human
gugccuggcaugcgccggugcu

SEQ ID NO: 38487 - RNA, 22 nt, Human
gugccugggacuugcuccggau

SEQ ID NO: 38488 - RNA, 22 nt, Human
gugccugggcaugagcuuguug

SEQ ID NO: 38489 - RNA, 22 nt, Human
gugccuggggguaauguaggau

SEQ ID NO: 38490 - RNA, 22 nt, Human
gugccugggguugagcuaugaa

SEQ ID NO: 38491 - RNA, 22 nt, Human
gugccugguuuggggaguguuc

SEQ ID NO: 38492 - RNA, 22 nt, Human
gugccuuugagaaguuucucug

SEQ ID NO: 38493 - RNA, 22 nt, Human
gugcgcuucuuccugagccagg

SEQ ID NO: 38494 - RNA, 20 nt, Human
gugcuaaguacugugaaggg

SEQ ID NO: 38495 - RNA, 22 nt, Human
gugcuacagacugaguacacuu

SEQ ID NO: 38496 - RNA, 22 nt, Human
gugcuacaugguaguguaguua

SEQ ID NO: 38497 - RNA, 22 nt, Human
gugcuaggauuacaggcauggg

SEQ ID NO: 38498 - RNA, 22 nt, Human
gugcuagggacaaagcagugaa

SEQ ID NO: 38499 - RNA, 22 nt, Human
gugcucagcccggaugagauca

SEQ ID NO: 38500 - RNA, 22 nt, Human
gugcucaggaagcuguuccugc

SEQ ID NO: 38501 - RNA, 22 nt, Human
gugcucaggggcaauccuggga

SEQ ID NO: 38502 - RNA, 22 nt, Human
gugcuccaggucgcucagagag

SEQ ID NO: 38503 - RNA, 22 nt, Human
gugcuccuggccacaugaagcu

SEQ ID NO: 38504 - RNA, 22 nt, Human
gugcucuaauaaagccugacau

SEQ ID NO: 38505 - RNA, 22 nt, Human
gugcucuagaaauagucagugg

SEQ ID NO: 38506 - RNA, 22 nt, Human
gugcucuaggaccuuagaagug

SEQ ID NO: 38507 - RNA, 22 nt, Human
gugcucuaggggucagugguua

SEQ ID NO: 38508 - RNA, 23 nt, Human
gugcucugcggucugcuagucug

SEQ ID NO: 38509 - RNA, 22 nt, Human
gugcucuggcuggucucccggu

SEQ ID NO: 38510 - RNA, 22 nt, Human
gguugacagauauacauuguag

SEQ ID NO: 38511 - RNA, 22 nt, Human
gguugcaaacuccugggaucaa

SEQ ID NO: 38512 - RNA, 22 nt, Human
gguugccggggcaggacuggaa

SEQ ID NO: 38513 - RNA, 22 nt, Human
gguugcuggggguggcagagcu

SEQ ID NO: 38514 - RNA, 21 nt, Human
gguugguguguccaguggcca

SEQ ID NO: 38515 - RNA, 22 nt, Human
gguuuaauugguccaggauggg

SEQ ID NO: 38516 - RNA, 22 nt, Human
gguuuauugaaggccaccccac

SEQ ID NO: 38517 - RNA, 22 nt, Human
gguuucaacucagcuaguaagg

SEQ ID NO: 38518 - RNA, 22 nt, Human
gguuucaaugagaagugcuugu

SEQ ID NO: 38519 - RNA, 22 nt, Human
gguuucacaauuuagagcagug

SEQ ID NO: 38520 - RNA, 22 nt, Human
gguuucagcccugcuguuccug

SEQ ID NO: 38521 - RNA, 22 nt, Human
gguuuccaaagauagaguagua

SEQ ID NO: 38522 - RNA, 22 nt, Human
gguuuccacuugcugaagaaag

SEQ ID NO: 38523 - RNA, 22 nt, Human
gguuucuagcagagucucuuua

SEQ ID NO: 38524 - RNA, 22 nt, Human
gguuucucaccuucagcacuac

SEQ ID NO: 38525 - RNA, 19 nt, Human
gguuugaagaaaaucuugc

SEQ ID NO: 38526 - RNA, 22 nt, Human
gguuugacagcuuggggcuguc

SEQ ID NO: 38527 - RNA, 22 nt, Human
gguuugcaugugauguugggca

SEQ ID NO: 38528 - RNA, 22 nt, Human
gguuuguggagcuggaaacacu

SEQ ID NO: 38529 - RNA, 22 nt, Human
gguuuuaacuacagaauugcaa

SEQ ID NO: 38530 - RNA, 22 nt, Human
gguuuuauuaccccuuaaacac

SEQ ID NO: 38531 - RNA, 23 nt, Human
gguuuucauggcauuccuugccu

SEQ ID NO: 38532 - RNA, 22 nt, Human
gguuuucucccccucuucucag

SEQ ID NO: 38533 - RNA, 22 nt, Human
guaaaacaagcuuuaugguucc

SEQ ID NO: 38534 - RNA, 22 nt, Human
guaaaacugucuaaugguauau

SEQ ID NO: 38535 - RNA, 22 nt, Human
guaaaauagaauaacguggcua

SEQ ID NO: 38536 - RNA, 22 nt, Human
guaaacaacacaaaucauuuga

SEQ ID NO: 38537 - RNA, 22 nt, Human
guaaacauuacugugcuguaua

SEQ ID NO: 38538 - RNA, 22 nt, Human
guaaagaaggcaaccugguuau

SEQ ID NO: 38539 - RNA, 22 nt, Human
guaaaggcccauucaaacagcu

SEQ ID NO: 38540 - RNA, 22 nt, Human
ucuaaacacgucucuuugaaua

SEQ ID NO: 38541 - RNA, 22 nt, Human
ucuaaacauaacuuugugugau

SEQ ID NO: 38542 - RNA, 19 nt, Human
ucuaaacuagucccauaac

SEQ ID NO: 38543 - RNA, 19 nt, Human
ucuaaacucuauacuggua

SEQ ID NO: 38544 - RNA, 22 nt, Human
ucuaaagauguuuauugacaua

SEQ ID NO: 38545 - RNA, 22 nt, Human
ucuaaagauuuggauucauuug

SEQ ID NO: 38546 - RNA, 22 nt, Human
ucuaaauuacuuugggcaguau

SEQ ID NO: 38547 - RNA, 19 nt, Human
ucuaacagaagugucgucc

SEQ ID NO: 38548 - RNA, 22 nt, Human
ucuaacauuuauggccacugga

SEQ ID NO: 38549 - RNA, 22 nt, Human
ucuaacucugccaggacacaga

SEQ ID NO: 38550 - RNA, 22 nt, Human
ucuaagaauacucauaucuucu

SEQ ID NO: 38551 - RNA, 22 nt, Human
ucuaagaggcaucaagacaagc

SEQ ID NO: 38552 - RNA, 22 nt, Human
ucuaagccaggacugagagacg

SEQ ID NO: 38553 - RNA, 21 nt, Human
ucuaagccuugcagauggguu

SEQ ID NO: 38554 - RNA, 22 nt, Human
ucuaaggacauuggcuuuggag

SEQ ID NO: 38555 - RNA, 23 nt, Human
ucuaauacaugaaaccuagaugu

SEQ ID NO: 38556 - RNA, 22 nt, Human
ucuaaugaaagauguaggaacu

SEQ ID NO: 38557 - RNA, 22 nt, Human
ucuaaugaggacuuuauagaga

SEQ ID NO: 38558 - RNA, 22 nt, Human
ucuaaugaguuagauaauuuug

SEQ ID NO: 38559 - RNA, 22 nt, Human
ucuaaugcuugacugggggcuu

SEQ ID NO: 38560 - RNA, 22 nt, Human
ucuaauuuuaggcauuuguuca

SEQ ID NO: 38561 - RNA, 22 nt, Human
ucuaauuuuggcauuuuaaccu

SEQ ID NO: 38562 - RNA, 22 nt, Human
ucuacaaagguugaggugcccu

SEQ ID NO: 38563 - RNA, 22 nt, Human
ucuacaaauaaauuacuaugua

SEQ ID NO: 38564 - RNA, 22 nt, Human
ucuacaagucaagucuaucaag

SEQ ID NO: 38565 - RNA, 22 nt, Human
ucuacaaguuuaauuccacuua

SEQ ID NO: 38566 - RNA, 22 nt, Human
ucuacacaagugaguggcacaa

SEQ ID NO: 38567 - RNA, 22 nt, Human
ucuacacauuuguaaaggcauu

SEQ ID NO: 38568 - RNA, 22 nt, Human
ucuacagaaacuggcuacucuc

SEQ ID NO: 38569 - RNA, 22 nt, Human
ucuacagacagagcagguggga

SEQ ID NO: 38570 - RNA, 22 nt, Human
ucuacagccauuuugagcagug

SEQ ID NO: 38571 - RNA, 22 nt, Human
ucuacagguggggccuggcaau

SEQ ID NO: 38572 - RNA, 21 nt, Human
ucuacauaucaauauguaauu

SEQ ID NO: 38573 - RNA, 22 nt, Human
ucuacauuccuuuuauaauauc

SEQ ID NO: 38574 - RNA, 22 nt, Human
ucuacauuuuaacaagaugccc

SEQ ID NO: 38575 - RNA, 22 nt, Human
ucuaccacuaagugugcuuuga

SEQ ID NO: 38576 - RNA, 22 nt, Human
ucuaccacucaugcuacuuacu

SEQ ID NO: 38577 - RNA, 22 nt, Human
ucuaccaugugcugugcauugg

SEQ ID NO: 38578 - RNA, 22 nt, Human
ucuacccagagcuaugaccuga

SEQ ID NO: 38579 - RNA, 18 nt, Human
ucuacccucucagagucu

SEQ ID NO: 38580 - RNA, 22 nt, Human
ucuacugccacuuaagacauuu

SEQ ID NO: 38581 - RNA, 22 nt, Human
ucuacugugguccuuguaacca

SEQ ID NO: 38582 - RNA, 22 nt, Human
ucuacuuuauaaguauauaagu

SEQ ID NO: 38583 - RNA, 22 nt, Human
ucuacuuuucccuauacaguuu

SEQ ID NO: 38584 - RNA, 18 nt, Human
ucuagaaacuucucuccu

SEQ ID NO: 38585 - RNA, 22 nt, Human
ucuagaaagccaaauuaggaau

SEQ ID NO: 38586 - RNA, 22 nt, Human
ucuagaacuccaguuaggcaau

SEQ ID NO: 38587 - RNA, 22 nt, Human
ucuagaaucacuguuuccaucu

SEQ ID NO: 38588 - RNA, 22 nt, Human
ucuagaauuuugccauauagcu

SEQ ID NO: 38589 - RNA, 22 nt, Human
ucuagacaaugcacuguaagga

SEQ ID NO: 38590 - RNA, 19 nt, Human
ucuagacaccaaaguuguc

SEQ ID NO: 38591 - RNA, 20 nt, Human
ucuagacagggcacaggaau

SEQ ID NO: 38592 - RNA, 22 nt, Human
ucuagagccaaagucuuggggg

SEQ ID NO: 38593 - RNA, 22 nt, Human
ucuagagcuggaguagaaugug

SEQ ID NO: 38594 - RNA, 22 nt, Human
ucuagagcuuuuuccucuugua

SEQ ID NO: 38595 - RNA, 22 nt, Human
ucuagauuccuccugcauccug

SEQ ID NO: 38596 - RNA, 19 nt, Human
ucuagcaacccacugcaug

SEQ ID NO: 38597 - RNA, 22 nt, Human
ucuagcaagcucgugcucaagg

SEQ ID NO: 38598 - RNA, 22 nt, Human
ucuagcaggcaaaagcucggca

SEQ ID NO: 38599 - RNA, 22 nt, Human
ucuagcagggaaagcagagaau

SEQ ID NO: 38600 - RNA, 22 nt, Human
ucuagcugaggguaggagaccu

SEQ ID NO: 38601 - RNA, 22 nt, Human
ucuagcugccccgaggcagggu

SEQ ID NO: 38602 - RNA, 22 nt, Human
ucuagcuguggucgagugagga

SEQ ID NO: 38603 - RNA, 22 nt, Human
ucuaggaaccugacaucucuca

SEQ ID NO: 38604 - RNA, 22 nt, Human
ucuaggaauguucuuagggauu

SEQ ID NO: 38605 - RNA, 22 nt, Human
ucuaggagcaugaagggaaggc

SEQ ID NO: 38606 - RNA, 22 nt, Human
ucuaggagcuuaaaggaggcca

SEQ ID NO: 38607 - RNA, 22 nt, Human
ucuaggcccaggccugcggcug

SEQ ID NO: 38608 - RNA, 22 nt, Human
ucuaggccguaggauacagagc

SEQ ID NO: 38609 - RNA, 22 nt, Human
ucuagggagcucuagcaguggu

SEQ ID NO: 38610 - RNA, 22 nt, Human
ucuaggggugcagaagggaucc

SEQ ID NO: 38611 - RNA, 22 nt, Human
ucuagguuagaacccagaaaag

SEQ ID NO: 38612 - RNA, 22 nt, Human
ucuagucauucaugcuaugauu

SEQ ID NO: 38613 - RNA, 22 nt, Human
ucuaguuuugguaugagaugca

SEQ ID NO: 38614 - RNA, 21 nt, Human
ucuauaacuauagugacagau

SEQ ID NO: 38615 - RNA, 23 nt, Human
ucuauacauacugcagccucugg

SEQ ID NO: 38616 - RNA, 22 nt, Human
ucuauauaaccuccacuucuac

SEQ ID NO: 38617 - RNA, 22 nt, Human
ucuaucugaggaggugacauuu

SEQ ID NO: 38618 - RNA, 22 nt, Human
ucuaugaaucaauuuuaacauc

SEQ ID NO: 38619 - RNA, 21 nt, Human
ucuaugcaagacccuaguccu

SEQ ID NO: 38620 - RNA, 22 nt, Human
ucuauguaaagccauauugaua

SEQ ID NO: 38621 - RNA, 22 nt, Human
ucuauguagugccagcuaguau

SEQ ID NO: 38622 - RNA, 22 nt, Human
ucuauguauaucuuuccauuca

SEQ ID NO: 38623 - RNA, 22 nt, Human
ucuaugucacucuuuggaaaga

SEQ ID NO: 38624 - RNA, 22 nt, Human
ucuaugucagcaucuuucuacc

SEQ ID NO: 38625 - RNA, 22 nt, Human
ucuaugucucgacccaagacaa

SEQ ID NO: 38626 - RNA, 22 nt, Human
ucuaugucucuggaaggagugu

SEQ ID NO: 38627 - RNA, 22 nt, Human
gugcugaagugaaauucaucaa

SEQ ID NO: 38628 - RNA, 22 nt, Human
gugcugaauaacaguagaaauu

SEQ ID NO: 38629 - RNA, 22 nt, Human
gugcugaauuggagaugcuccu

SEQ ID NO: 38630 - RNA, 22 nt, Human
gugcugagaguuuauuaugaua

SEQ ID NO: 38631 - RNA, 19 nt, Human
gugcugagaugugguacua

SEQ ID NO: 38632 - RNA, 22 nt, Human
gugcugagcugcagaugcgcuc

SEQ ID NO: 38633 - RNA, 22 nt, Human
gugcugaguagaaugaaugccu

SEQ ID NO: 38634 - RNA, 22 nt, Human
gugcugcugccagcaggauccu

SEQ ID NO: 38635 - RNA, 22 nt, Human
gugcuggaacugugcuaagaga

SEQ ID NO: 38636 - RNA, 22 nt, Human
gugcuggacccuggaagguggu

SEQ ID NO: 38637 - RNA, 22 nt, Human
gugcuggcaccccucuccaguu

SEQ ID NO: 38638 - RNA, 17 nt, Human
gugcuggccuggggcuc

SEQ ID NO: 38639 - RNA, 22 nt, Human
gugcuggcuggggcaucaggca

SEQ ID NO: 38640 - RNA, 22 nt, Human
gugcugggauuacaggugugag

SEQ ID NO: 38641 - RNA, 22 nt, Human
gugcuggggguuucuguagguc

SEQ ID NO: 38642 - RNA, 22 nt, Human
gugcugggugcugcagacaggu

SEQ ID NO: 38643 - RNA, 22 nt, Human
gugcuguacuucuguguugaag

SEQ ID NO: 38644 - RNA, 22 nt, Human
gugcuguauaugcaagaggaag

SEQ ID NO: 38645 - RNA, 23 nt, Human
gugcugugagccccuuggccucc

SEQ ID NO: 38646 - RNA, 22 nt, Human
gugcugugcgcuuuuucuguau

SEQ ID NO: 38647 - RNA, 22 nt, Human
gugcuguuuugagugcuacccc

SEQ ID NO: 38648 - RNA, 22 nt, Human
gugcuuaaggcagucugucaaa

SEQ ID NO: 38649 - RNA, 22 nt, Human
aaagucauacauggugcuuacu

SEQ ID NO: 38650 - RNA, 22 nt, Human
aaagucaucuguccuaggcucu

SEQ ID NO: 38651 - RNA, 22 nt, Human
aaagucauugcuguuaucaaug

SEQ ID NO: 38652 - RNA, 22 nt, Human
aaaguccagggaaagagcgucu

SEQ ID NO: 38653 - RNA, 20 nt, Human
aaagucccuuagugggagca

SEQ ID NO: 38654 - RNA, 22 nt, Human
aaaguccuagcgauccacagaa

SEQ ID NO: 38655 - RNA, 22 nt, Human
aaaguccugacugcaggggaug

SEQ ID NO: 38656 - RNA, 22 nt, Human
aaagucuaaauuauucaauaag

SEQ ID NO: 38657 - RNA, 22 nt, Human
aaagucucaggcaaaccaggac

SEQ ID NO: 38658 - RNA, 22 nt, Human
aaagucuuucucauuggccaug

SEQ ID NO: 38659 - RNA, 22 nt, Human
aaagugacaaccauuuauuaag

SEQ ID NO: 38660 - RNA, 22 nt, Human
aaagugauuuaaguaccucagg

SEQ ID NO: 38661 - RNA, 20 nt, Human
aaagugcacagauacagcuc

SEQ ID NO: 38662 - RNA, 22 nt, Human
aaagugcagaacuguucucacu

SEQ ID NO: 38663 - RNA, 22 nt, Human
aaagugcagggugcucugguau

SEQ ID NO: 38664 - RNA, 22 nt, Human
aaagugcaguccaugaaauuaa

SEQ ID NO: 38665 - RNA, 22 nt, Human
aaagugcauucgaaaguccauc

SEQ ID NO: 38666 - RNA, 22 nt, Human
aaagugccacaacuggacaacc

SEQ ID NO: 38667 - RNA, 22 nt, Human
aaagugccuucuauuuuaguga

SEQ ID NO: 38668 - RNA, 22 nt, Human
aaagugcuaaauaagcccugaa

SEQ ID NO: 38669 - RNA, 22 nt, Human
aaagugcucggauuacagguau

SEQ ID NO: 38670 - RNA, 22 nt, Human
aaagugcugaaauuacaggggu

SEQ ID NO: 38671 - RNA, 22 nt, Human
aaagugcugggauuacaggccu

SEQ ID NO: 38672 - RNA, 22 nt, Human
aaagugcugggauuacaggugu

SEQ ID NO: 38673 - RNA, 22 nt, Human
aaaguggggucuagagggccug

SEQ ID NO: 38674 - RNA, 22 nt, Human
aaaguguaaaagcauguuaggg

SEQ ID NO: 38675 - RNA, 22 nt, Human
aaaguguugggaagaaagugca

SEQ ID NO: 38676 - RNA, 22 nt, Human
aaaguguugggauuacaggcau

SEQ ID NO: 38677 - RNA, 19 nt, Human
aaaguguuuuaaagaggau

SEQ ID NO: 38678 - RNA, 22 nt, Human
aaaguuagguguggauuucuca

SEQ ID NO: 38679 - RNA, 22 nt, Human
aaaguucacugaccagcacugg

SEQ ID NO: 38680 - RNA, 18 nt, Human
aaaguucagggagaguug

SEQ ID NO: 38681 - RNA, 22 nt, Human
aaaguucagugccuucuauaca

SEQ ID NO: 38682 - RNA, 21 nt, Human
aaaguucaugcuuuaauauuc

SEQ ID NO: 38683 - RNA, 20 nt, Human
aaaguucauguuugcacuuu

SEQ ID NO: 38684 - RNA, 22 nt, Human
aaaguucuaaaacucuuuguga

SEQ ID NO: 38685 - RNA, 22 nt, Human
aaaguucuagaguugcaagaga

SEQ ID NO: 38686 - RNA, 23 nt, Human
aaaguucucuugcgugugggaaa

SEQ ID NO: 38687 - RNA, 22 nt, Human
aaaguucugagaagcaguuuac

SEQ ID NO: 38688 - RNA, 22 nt, Human
aaaguucuuugcaucuuugcuc

SEQ ID NO: 38689 - RNA, 22 nt, Human
aaaguugaguuuuauguguuac

SEQ ID NO: 38690 - RNA, 15 nt, Human
aaaguugauggcucu

SEQ ID NO: 38691 - RNA, 23 nt, Human
aaaguugauuugcaguuuaagag

SEQ ID NO: 38692 - RNA, 22 nt, Human
aaaguugauuuggagggauauu

SEQ ID NO: 38693 - RNA, 22 nt, Human
aaaguugcuggcuuugguucau

SEQ ID NO: 38694 - RNA, 22 nt, Human
aaaguuguaauggaagaaaugc

SEQ ID NO: 38695 - RNA, 22 nt, Human
aaaguugugaaaccgaacaugu

SEQ ID NO: 38696 - RNA, 22 nt, Human
aaaguuuacagugcacaugggu

SEQ ID NO: 38697 - RNA, 22 nt, Human
aaaguuuaucauagccggggac

SEQ ID NO: 38698 - RNA, 22 nt, Human
aaaguuucaauagaggaagugg

SEQ ID NO: 38699 - RNA, 22 nt, Human
aaaguuuccugcuaagugcuau

SEQ ID NO: 38700 - RNA, 22 nt, Human
aaaguuugagugauuugacaca

SEQ ID NO: 38701 - RNA, 22 nt, Human
aaaguuuguugcuuacaaagaa

SEQ ID NO: 38702 - RNA, 22 nt, Human
aaauaacuuucuguguauaguc

SEQ ID NO: 38703 - RNA, 22 nt, Human
aaauaaguaaugucuuccuuuu

SEQ ID NO: 38704 - RNA, 22 nt, Human
aaauaaguuaaacuagaaugau

SEQ ID NO: 38705 - RNA, 22 nt, Human
aaagacaguggauucaaaaucc

SEQ ID NO: 38706 - RNA, 22 nt, Human
aaagacauauuucuaaguuuau

SEQ ID NO: 38707 - RNA, 22 nt, Human
aaagacaucagaaccagcugag

SEQ ID NO: 38708 - RNA, 22 nt, Human
aaagaccauguuuacagcuagg

SEQ ID NO: 38709 - RNA, 23 nt, Human
aaagaccuaggaugagggagacg

SEQ ID NO: 38710 - RNA, 22 nt, Human
aaagaccugaaauauaaucuag

SEQ ID NO: 38711 - RNA, 22 nt, Human
aaagacuaagaagaguauuauu

SEQ ID NO: 38712 - RNA, 22 nt, Human
aaagacuacacgggaaagagcu

SEQ ID NO: 38713 - RNA, 23 nt, Human
aaagacucuccagagggaaguag

SEQ ID NO: 38714 - RNA, 23 nt, Human
aaagacugaggaaagucucuguc

SEQ ID NO: 38715 - RNA, 22 nt, Human
aaagacugcaaaaacgcacaga

SEQ ID NO: 38716 - RNA, 22 nt, Human
aaagacuugggagcaguaugcu

SEQ ID NO: 38717 - RNA, 22 nt, Human
aaagagaaaaagaucccggcuc

SEQ ID NO: 38718 - RNA, 22 nt, Human
aaagagcauggaaaguucagga

SEQ ID NO: 38719 - RNA, 22 nt, Human
aaagagcccuuccaugacucuu

SEQ ID NO: 38720 - RNA, 22 nt, Human
aaagagcucggaaaguguugaa

SEQ ID NO: 38721 - RNA, 22 nt, Human
aaagagcugagaccugguggag

SEQ ID NO: 38722 - RNA, 22 nt, Human
aaagagcuggcauuuauagucu

SEQ ID NO: 38723 - RNA, 22 nt, Human
aaagagcuucauuuccauuuau

SEQ ID NO: 38724 - RNA, 17 nt, Human
aaagagcuuggaguguu

SEQ ID NO: 38725 - RNA, 22 nt, Human
aaagaggcagguguuacuggaa

SEQ ID NO: 38726 - RNA, 22 nt, Human
aaagaggcucaaggugggccag

SEQ ID NO: 38727 - RNA, 22 nt, Human
aaagaguuaagagucuuaagcu

SEQ ID NO: 38728 - RNA, 22 nt, Human
aaagaguucuguuugagcugaa

SEQ ID NO: 38729 - RNA, 22 nt, Human
aaagaguuggacuuucucaggc

SEQ ID NO: 38730 - RNA, 22 nt, Human
aaagaguuuacaaauuagguaa

SEQ ID NO: 38731 - RNA, 22 nt, Human
aaagaucaaguaggcauggccu

SEQ ID NO: 38732 - RNA, 22 nt, Human
aaagaucaauagauaaagcuac

SEQ ID NO: 38733 - RNA, 21 nt, Human
aaagaugagaacuggauggcu

SEQ ID NO: 38734 - RNA, 22 nt, Human
aaagaugucagucagauaggau

SEQ ID NO: 38735 - RNA, 22 nt, Human
aaagaugucaguuugaaauaac

SEQ ID NO: 38736 - RNA, 22 nt, Human
aaagaugucauacacauuaaga

SEQ ID NO: 38737 - RNA, 22 nt, Human
aaagaugugccuguuucauagu

SEQ ID NO: 38738 - RNA, 22 nt, Human
aaagauguuuuacauagcaccu

SEQ ID NO: 38739 - RNA, 22 nt, Human
aaagauuagauaagauagauuu

SEQ ID NO: 38740 - RNA, 22 nt, Human
aaagauuauggaacacacauga

SEQ ID NO: 38741 - RNA, 22 nt, Human
aaagauugaaagagaauuuguc

SEQ ID NO: 38742 - RNA, 22 nt, Human
aaagauugaucaugaauugaca

SEQ ID NO: 38743 - RNA, 22 nt, Human
aaagauuucagaagccugugcc

SEQ ID NO: 38744 - RNA, 22 nt, Human
aaagauuugaaauuaggcauca

SEQ ID NO: 38745 - RNA, 22 nt, Human
aaagcaauagguuaggucaaga

SEQ ID NO: 38746 - RNA, 22 nt, Human
aaagcaaugggucuaagguaaa

SEQ ID NO: 38747 - RNA, 22 nt, Human
aaagcaaugucucugccugguu

SEQ ID NO: 38748 - RNA, 22 nt, Human
aaagcacaggagaguucaguaa

SEQ ID NO: 38749 - RNA, 22 nt, Human
aaagcacagggugcuagagagu

SEQ ID NO: 38750 - RNA, 22 nt, Human
aaagcacauaguagaaggauuu

SEQ ID NO: 38751 - RNA, 22 nt, Human
aaagcacaugaguaguguagua

SEQ ID NO: 38752 - RNA, 22 nt, Human
aaagcaccuagcauagugcuua

SEQ ID NO: 38753 - RNA, 22 nt, Human
aaagcacucuauccuuuguaga

SEQ ID NO: 38754 - RNA, 22 nt, Human
aaagcacugcacauauauuugc

SEQ ID NO: 38755 - RNA, 22 nt, Human
aaagcagagaucauggcuugua

SEQ ID NO: 38756 - RNA, 19 nt, Human
aaagcagaggagcaucuga

SEQ ID NO: 38757 - RNA, 22 nt, Human
aaagcagcaacgugcauauaac

SEQ ID NO: 38758 - RNA, 22 nt, Human
aaagcaauugugguuuuugcca

SEQ ID NO: 38759 - RNA, 22 nt, Human
aaagcaauuuaauggaccauga

SEQ ID NO: 38760 - RNA, 22 nt, Human
aaagcacuugaaaucuggcagu

SEQ ID NO: 38761 - RNA, 22 nt, Human
aaagcacuuugagacugacagg

SEQ ID NO: 38762 - RNA, 22 nt, Human
aaagcagacugauuugcaucac

SEQ ID NO: 38763 - RNA, 22 nt, Human
aaagcagagcagggcacuuaug

SEQ ID NO: 38764 - RNA, 22 nt, Human
aaagcagauucugaugcaguag

SEQ ID NO: 38765 - RNA, 22 nt, Human
aaagcagcacauggauaucagu

SEQ ID NO: 38766 - RNA, 22 nt, Human
aaagcagcagcacguggaagag

SEQ ID NO: 38767 - RNA, 22 nt, Human
aaagcagccacucucucugccu

SEQ ID NO: 38768 - RNA, 21 nt, Human
aaagcagcccauggcacaguc

SEQ ID NO: 38769 - RNA, 22 nt, Human
aaagcagcuuucggcccucggg

SEQ ID NO: 38770 - RNA, 22 nt, Human
aaagcagggaaaucuauuugca

SEQ ID NO: 38771 - RNA, 22 nt, Human
aaagcagguugcaauuacagug

SEQ ID NO: 38772 - RNA, 22 nt, Human
aaagcaguauaguggaagggcu

SEQ ID NO: 38773 - RNA, 22 nt, Human
aaagcaguauauugguaguugu

SEQ ID NO: 38774 - RNA, 22 nt, Human
aaagcagucucagacuuaagca

SEQ ID NO: 38775 - RNA, 21 nt, Human
aaagcaguucuuccugccucu

SEQ ID NO: 38776 - RNA, 22 nt, Human
aaagcauagaauuagaguuagg

SEQ ID NO: 38777 - RNA, 22 nt, Human
aaagcauaguucaucuguccau

SEQ ID NO: 38778 - RNA, 22 nt, Human
aaagcauauuaggacugaauua

SEQ ID NO: 38779 - RNA, 22 nt, Human
aaagcauuauucuguggaaaaa

SEQ ID NO: 38780 - RNA, 22 nt, Human
aaagccaaaugaaagaugguuc

SEQ ID NO: 38781 - RNA, 22 nt, Human
aaagccaagcugggaaggcagg

SEQ ID NO: 38782 - RNA, 23 nt, Human
aaagccaagucagucuacuggaa

SEQ ID NO: 38783 - RNA, 22 nt, Human
aaagccacguggccuggggagc

SEQ ID NO: 38784 - RNA, 22 nt, Human
aaagccaggaggagggcgcucg

SEQ ID NO: 38785 - RNA, 22 nt, Human
aaagccaggcuggccugggguu

SEQ ID NO: 38786 - RNA, 22 nt, Human
aaagccaggguccaggccugcc

SEQ ID NO: 38787 - RNA, 22 nt, Human
aaagccagguugugugcaggaa

SEQ ID NO: 38788 - RNA, 22 nt, Human
aaagccaucuguauuaagugaa

SEQ ID NO: 38789 - RNA, 22 nt, Human
aaagccauugaacuguacuuua

SEQ ID NO: 38790 - RNA, 22 nt, Human
aaagccugucuggucauagcua

SEQ ID NO: 38791 - RNA, 22 nt, Human
aaagccuucuuguaucgagcca

SEQ ID NO: 38792 - RNA, 22 nt, Human
aaagccuugggauuugugauca

SEQ ID NO: 38793 - RNA, 22 nt, Human
aaagccuuuuaugaucaguuaa

SEQ ID NO: 38794 - RNA, 22 nt, Human
aaagcgcuauauaaauguuaac

SEQ ID NO: 38795 - RNA, 22 nt, Human
aaagcuaucaucaaugcaacuu

SEQ ID NO: 38796 - RNA, 22 nt, Human
aaagcucacaguaauacaaggc

SEQ ID NO: 38797 - RNA, 22 nt, Human
aaagcucagucagugguguaug

SEQ ID NO: 38798 - RNA, 22 nt, Human
aaagcucugagaagcacugcaa

SEQ ID NO: 38799 - RNA, 22 nt, Human
aaagcucuuaaauugaccugcu

SEQ ID NO: 38800 - RNA, 22 nt, Human
aaagcucuuauagcagagugug

SEQ ID NO: 38801 - RNA, 22 nt, Human
aaagcugaugucuacuagagaa

SEQ ID NO: 38802 - RNA, 22 nt, Human
aaagcugcaagcuccugaggaa

SEQ ID NO: 38803 - RNA, 22 nt, Human
aaagcugcuaugaacauucuau

SEQ ID NO: 38804 - RNA, 22 nt, Human
aaagcugcuuugguuucuggaa

SEQ ID NO: 38805 - RNA, 22 nt, Human
aaagcugucaaggcaggaggcu

SEQ ID NO: 38806 - RNA, 22 nt, Human
aaagcuguuaaaugcauaaugc

SEQ ID NO: 38807 - RNA, 23 nt, Human
aaagcuuaacuggguaauaaagc

SEQ ID NO: 38808 - RNA, 22 nt, Human
aaagcuuagaggccaguggagg

SEQ ID NO: 38809 - RNA, 22 nt, Human
aaagcuuagcauuuucaaaaug

SEQ ID NO: 38810 - RNA, 22 nt, Human
aaagcuuauuuguaugcauguu

SEQ ID NO: 38811 - RNA, 22 nt, Human
aaagcuuuggguaggaauggga

SEQ ID NO: 38812 - RNA, 22 nt, Human
aaaggaagauugagcuuuucca

SEQ ID NO: 38813 - RNA, 22 nt, Human
aaaggacacacaggaggugucu

SEQ ID NO: 38814 - RNA, 22 nt, Human
aaaggacaugucaauaucaggc

SEQ ID NO: 38815 - RNA, 22 nt, Human
aaaggauggcucugcauauuug

SEQ ID NO: 38816 - RNA, 22 nt, Human
aaaggauuagagauaccaugcc

SEQ ID NO: 38817 - RNA, 22 nt, Human
aaaggcaaaauucuuagcagga

SEQ ID NO: 38818 - RNA, 22 nt, Human
aaauaguucagccacggugacu

SEQ ID NO: 38819 - RNA, 22 nt, Human
aaauauaauuucugccucaaua

SEQ ID NO: 38820 - RNA, 22 nt, Human
aaauauacggucccuaacaguc

SEQ ID NO: 38821 - RNA, 22 nt, Human
aaauauacuagaugaugaccca

SEQ ID NO: 38822 - RNA, 22 nt, Human
aaauaucauucuggugcacaga

SEQ ID NO: 38823 - RNA, 22 nt, Human
aaauauccauaagcacaucuau

SEQ ID NO: 38824 - RNA, 22 nt, Human
aaauaugacuagaaugccaggu

SEQ ID NO: 38825 - RNA, 22 nt, Human
aaauaugagggugaugcccaga

SEQ ID NO: 38826 - RNA, 22 nt, Human
aaauauguaaccaaggugaagu

SEQ ID NO: 38827 - RNA, 22 nt, Human
aaauauguuuuccaguugucau

SEQ ID NO: 38828 - RNA, 23 nt, Human
aaauauucuuuuuuaguaagugc

SEQ ID NO: 38829 - RNA, 22 nt, Human
aaauauugguaggaugcuuguu

SEQ ID NO: 38830 - RNA, 22 nt, Human
aaauauuugucugaggcgguug

SEQ ID NO: 38831 - RNA, 22 nt, Human
aaaucacuaaguuauagugugg

SEQ ID NO: 38832 - RNA, 22 nt, Human
aaaucacugauuaaaguuagaa

SEQ ID NO: 38833 - RNA, 17 nt, Human
aaaucacugucaguuca

SEQ ID NO: 38834 - RNA, 19 nt, Human
aaaucagaaucugcauuuu

SEQ ID NO: 38835 - RNA, 22 nt, Human
aaaucagacuugaauuuucauc

SEQ ID NO: 38836 - RNA, 22 nt, Human
aaaucagagaauauauuuagaa

SEQ ID NO: 38837 - RNA, 22 nt, Human
aaaucagaguagaauugagcca

SEQ ID NO: 38838 - RNA, 22 nt, Human
aaaucagagugguuggucaucc

SEQ ID NO: 38839 - RNA, 22 nt, Human
aaaucagaugcuuccuaguugg

SEQ ID NO: 38840 - RNA, 22 nt, Human
aaaucagugcucauuugaaagg

SEQ ID NO: 38841 - RNA, 22 nt, Human
aaaucaugaggacauuaugcca

SEQ ID NO: 38842 - RNA, 21 nt, Human
aaauccaaacacuaguccaca

SEQ ID NO: 38843 - RNA, 22 nt, Human
aaauccaacgacagguguacuu

SEQ ID NO: 38844 - RNA, 19 nt, Human
aaauccaagcucaggccuc

SEQ ID NO: 38845 - RNA, 22 nt, Human
aaauccagcuacggggcaacau

SEQ ID NO: 38846 - RNA, 22 nt, Human
aaauccaggagaauuuccacuu

SEQ ID NO: 38847 - RNA, 22 nt, Human
aaauccagguaguuugguuuga

SEQ ID NO: 38848 - RNA, 22 nt, Human
aaauccaguggguccucaugag

SEQ ID NO: 38849 - RNA, 22 nt, Human
aaauccaucaaaucuucuagaa

SEQ ID NO: 38850 - RNA, 22 nt, Human
aaauccaugguaaucuguuaca

SEQ ID NO: 38851 - RNA, 22 nt, Human
aaauccuaaaaguuugacuuaa

SEQ ID NO: 38852 - RNA, 22 nt, Human
aaauccuaagcagaggaauuua

SEQ ID NO: 38853 - RNA, 22 nt, Human
aaauccuaaggagaauaugauu

SEQ ID NO: 38854 - RNA, 22 nt, Human
aaauccuaccaagaaauucccu

SEQ ID NO: 38855 - RNA, 22 nt, Human
aaaucucugcaggcaaauguga

SEQ ID NO: 38856 - RNA, 22 nt, Human
aaaucugggagcagcucggcca

SEQ ID NO: 38857 - RNA, 22 nt, Human
aaaugaaaugagugccuggagg

SEQ ID NO: 38858 - RNA, 22 nt, Human
aaaugaacaucaagaauagccu

SEQ ID NO: 38859 - RNA, 22 nt, Human
aaaugaacucuuccugcauccc

SEQ ID NO: 38860 - RNA, 22 nt, Human
aaaugacaauaaaaguccaugc

SEQ ID NO: 38861 - RNA, 22 nt, Human
aaaugacacuaggcuuuuugca

SEQ ID NO: 38862 - RNA, 22 nt, Human
aaaugaccagaauacaggcuuc

SEQ ID NO: 38863 - RNA, 23 nt, Human
aaaugacuaaauguucuuauaga

SEQ ID NO: 38864 - RNA, 22 nt, Human
aaaugaguuuccucaauguccu

SEQ ID NO: 38865 - RNA, 22 nt, Human
aaaugaugauuaaaaugaggua

SEQ ID NO: 38866 - RNA, 22 nt, Human
aaaugaugcuacaguuuuccca

SEQ ID NO: 38867 - RNA, 20 nt, Human
aaagucuuaugguuaauuuu

SEQ ID NO: 38868 - RNA, 22 nt, Human
aaagugaauugauuuaagggga

SEQ ID NO: 38869 - RNA, 22 nt, Human
aaagugaugaacucugugaccu

SEQ ID NO: 38870 - RNA, 22 nt, Human
aaagugauuaugcugucaaaga

SEQ ID NO: 38871 - RNA, 22 nt, Human
aaagugcaaggauuacaggcau

SEQ ID NO: 38872 - RNA, 22 nt, Human
aaagugcaaucaguuagaccau

SEQ ID NO: 38873 - RNA, 22 nt, Human
aaagugcacuagaauccagauu

SEQ ID NO: 38874 - RNA, 22 nt, Human
aaagugcuaagucacccagcua

SEQ ID NO: 38875 - RNA, 22 nt, Human
aaagugcucggcgcugguccca

SEQ ID NO: 38876 - RNA, 22 nt, Human
aaagugcugaagaccuagcugu

SEQ ID NO: 38877 - RNA, 22 nt, Human
aaagugcugggauuacaagcgu

SEQ ID NO: 38878 - RNA, 22 nt, Human
aaaguggucaccuucucauuuc

SEQ ID NO: 38879 - RNA, 22 nt, Human
aaagugguucuuacauccgugg

SEQ ID NO: 38880 - RNA, 22 nt, Human
aaagugguuuaugauauuccaa

SEQ ID NO: 38881 - RNA, 20 nt, Human
aaaguguaagcauauaauua

SEQ ID NO: 38882 - RNA, 22 nt, Human
aaaguguaaggaauuuaaguaa

SEQ ID NO: 38883 - RNA, 20 nt, Human
aaaguguaaggcaaaguugu

SEQ ID NO: 38884 - RNA, 22 nt, Human
aaagugucuuacccagggagaa

SEQ ID NO: 38885 - RNA, 22 nt, Human
aaaguguggucguucauuuugu

SEQ ID NO: 38886 - RNA, 22 nt, Human
aaaguguuaugcaaaacucugu

SEQ ID NO: 38887 - RNA, 22 nt, Human
aaaguguugauuuuauagugca

SEQ ID NO: 38888 - RNA, 22 nt, Human
aaaguguuuacauugcuauaag

SEQ ID NO: 38889 - RNA, 22 nt, Human
aaaguguuuucugauguguucu

SEQ ID NO: 38890 - RNA, 22 nt, Human
aaaguguuuugugagcagucug

SEQ ID NO: 38891 - RNA, 22 nt, Human
aaaguuagucagaaccagccau

SEQ ID NO: 38892 - RNA, 22 nt, Human
aaaguucagauuagacucaaga

SEQ ID NO: 38893 - RNA, 22 nt, Human
aaaguucaugguguuauagaaa

SEQ ID NO: 38894 - RNA, 22 nt, Human
aaaguucuauguaauguuuuuu

SEQ ID NO: 38895 - RNA, 19 nt, Human
aaaguucugacuguagagc

SEQ ID NO: 38896 - RNA, 22 nt, Human
aaaguucugggggagaagaacg

SEQ ID NO: 38897 - RNA, 22 nt, Human
aaaguucuggggguguuucugg

SEQ ID NO: 38898 - RNA, 22 nt, Human
aaaguucuuagauuaaucacug

SEQ ID NO: 38899 - RNA, 22 nt, Human
aaaguugaccgaaagauuuuga

SEQ ID NO: 38900 - RNA, 22 nt, Human
aaaguugacuacuaaggaaugu

SEQ ID NO: 38901 - RNA, 22 nt, Human
aaaguugagugcugaucugauu

SEQ ID NO: 38902 - RNA, 22 nt, Human
aaaguugauaagguaucguagu

SEQ ID NO: 38903 - RNA, 21 nt, Human
aaaguugauuuagauugguga

SEQ ID NO: 38904 - RNA, 22 nt, Human
aaaguugcacaacuuuguauac

SEQ ID NO: 38905 - RNA, 22 nt, Human
aaaguugugguuugaugcaguu

SEQ ID NO: 38906 - RNA, 22 nt, Human
aaaguuguuguucacagguuau

SEQ ID NO: 38907 - RNA, 22 nt, Human
aaaguuuauuuucccugguuag

SEQ ID NO: 38908 - RNA, 22 nt, Human
aaaguuucccaaaguaauguga

SEQ ID NO: 38909 - RNA, 22 nt, Human
aaaguuuggauuagcaguuaga

SEQ ID NO: 38910 - RNA, 22 nt, Human
aaaguuuuauaugcugcagcga

SEQ ID NO: 38911 - RNA, 22 nt, Human
aaaguuuuauucaagcauuagu

SEQ ID NO: 38912 - RNA, 22 nt, Human
aaaguuuuguugauuguggaau

SEQ ID NO: 38913 - RNA, 22 nt, Human
aaauaaacugaagcacagagag

SEQ ID NO: 38914 - RNA, 22 nt, Human
aaauaacagucagggacaacau

SEQ ID NO: 38915 - RNA, 22 nt, Human
aaauaacuuaugaucgucuggc

SEQ ID NO: 38916 - RNA, 22 nt, Human
aaauaaucaauuuuuguagaua

SEQ ID NO: 38917 - RNA, 22 nt, Human
aaauacaaaaauuagccaggca

SEQ ID NO: 38918 - RNA, 22 nt, Human
aaauacaauuucaggcuguaau

SEQ ID NO: 38919 - RNA, 22 nt, Human
aaauacacguacauguguaaaa

SEQ ID NO: 38920 - RNA, 22 nt, Human
aaauacagauagauuuaaccca

SEQ ID NO: 38921 - RNA, 21 nt, Human
aaauacagaugcaaaucuguu

SEQ ID NO: 38922 - RNA, 19 nt, Human
aaauacagcagcuguuucc

SEQ ID NO: 38923 - RNA, 22 nt, Human
aaauacaguguguguucuuuga

SEQ ID NO: 38924 - RNA, 22 nt, Human
aaauacauacacuguacguggc

SEQ ID NO: 38925 - RNA, 19 nt, Human
aaauacugaaguuguucau

SEQ ID NO: 38926 - RNA, 22 nt, Human
aaauacugcugcuauuccuuuu

SEQ ID NO: 38927 - RNA, 22 nt, Human
aaauacuggcaagugcuaauuc

SEQ ID NO: 38928 - RNA, 22 nt, Human
aaauacugggcucaaaaggguu

SEQ ID NO: 38929 - RNA, 22 nt, Human
aaauacuguccaccauggagca

SEQ ID NO: 38930 - RNA, 22 nt, Human
aaauacugucucugagagagcc

SEQ ID NO: 38931 - RNA, 22 nt, Human
aaauacuguugaaugaaguaag

SEQ ID NO: 38932 - RNA, 22 nt, Human
aaauagaaaccaacaaggucag

SEQ ID NO: 38933 - RNA, 23 nt, Human
aaauucaguccuucaacucugag

SEQ ID NO: 38934 - RNA, 22 nt, Human
aaauuccaccagaaucaguaau

SEQ ID NO: 38935 - RNA, 22 nt, Human
aaauuccauuaggaaacuucca

SEQ ID NO: 38936 - RNA, 22 nt, Human
aaauuccugucauuugcacuuu

SEQ ID NO: 38937 - RNA, 22 nt, Human
aaauucucuucagaggaaccag

SEQ ID NO: 38938 - RNA, 22 nt, Human
aaauucugauuuaauaagugua

SEQ ID NO: 38939 - RNA, 22 nt, Human
aaauucuuuugugcggugaagu

SEQ ID NO: 38940 - RNA, 22 nt, Human
aaauugaauuugggaaacauug

SEQ ID NO: 38941 - RNA, 22 nt, Human
aaauugagacuuuuuuccucca

SEQ ID NO: 38942 - RNA, 22 nt, Human
aaauugauguucccaguugaaa

SEQ ID NO: 38943 - RNA, 22 nt, Human
aaauugcaaaaguacuuuuagg

SEQ ID NO: 38944 - RNA, 22 nt, Human
aaauugcagaugcuaaaugacu

SEQ ID NO: 38945 - RNA, 22 nt, Human
aaauugcauucuugucuugaua

SEQ ID NO: 38946 - RNA, 22 nt, Human
aaauugccaaauuguuuuccag

SEQ ID NO: 38947 - RNA, 21 nt, Human
aaauugccacacauuucuucc

SEQ ID NO: 38948 - RNA, 22 nt, Human
aaauugcuaaauuguaagaggg

SEQ ID NO: 38949 - RNA, 22 nt, Human
aaauugcuauaugugaauguga

SEQ ID NO: 38950 - RNA, 22 nt, Human
aaauugcugaccaaguauauuc

SEQ ID NO: 38951 - RNA, 22 nt, Human
aaauugcuggauccuacuccca

SEQ ID NO: 38952 - RNA, 22 nt, Human
aaauugcuggcagccuuuauuc

SEQ ID NO: 38953 - RNA, 22 nt, Human
aaauugcugggucccacccaag

SEQ ID NO: 38954 - RNA, 22 nt, Human
aaauugcugugaggugguagua

SEQ ID NO: 38955 - RNA, 22 nt, Human
aaauugcuugagauuagucucc

SEQ ID NO: 38956 - RNA, 22 nt, Human
aaauuggauuuuaaacuguugg

SEQ ID NO: 38957 - RNA, 22 nt, Human
aaauuguaaugacuucacuuga

SEQ ID NO: 38958 - RNA, 22 nt, Human
aaauugucuuuaaucaggucau

SEQ ID NO: 38959 - RNA, 22 nt, Human
aaauugugagcuauagaucuag

SEQ ID NO: 38960 - RNA, 22 nt, Human
aaauugugcucacacugauauu

SEQ ID NO: 38961 - RNA, 22 nt, Human
aaauuguggcgucuguaagagu

SEQ ID NO: 38962 - RNA, 22 nt, Human
aaauuuaaaaagcagcauugca

SEQ ID NO: 38963 - RNA, 22 nt, Human
aaauuucaguuaccuuuacguu

SEQ ID NO: 38964 - RNA, 22 nt, Human
aaauuugauaagccauuguuac

SEQ ID NO: 38965 - RNA, 22 nt, Human
aaauuuuaaggcuggaacuuaa

SEQ ID NO: 38966 - RNA, 22 nt, Human
aaauuuuagacuccugggucua

SEQ ID NO: 38967 - RNA, 20 nt, Human
aacaaacuacaaaauuaugu

SEQ ID NO: 38968 - RNA, 22 nt, Human
aacaaagcaccacugagucagu

SEQ ID NO: 38969 - RNA, 22 nt, Human
aacaaauuuagcucugagugcu

SEQ ID NO: 38970 - RNA, 22 nt, Human
aacaacagcugcuaaagaguug

SEQ ID NO: 38971 - RNA, 22 nt, Human
aacaacugaaaagcuuuuucug

SEQ ID NO: 38972 - RNA, 22 nt, Human
aacaacugcuaagguguguccu

SEQ ID NO: 38973 - RNA, 22 nt, Human
aacaagauguuuugauauaugu

SEQ ID NO: 38974 - RNA, 22 nt, Human
aacaagugauauauaauggaag

SEQ ID NO: 38975 - RNA, 22 nt, Human
aacaaguguauuaauggaaaua

SEQ ID NO: 38976 - RNA, 22 nt, Human
aacaagaagggaaggcaugauu

SEQ ID NO: 38977 - RNA, 22 nt, Human
aacaagauagauaucacuuagg

SEQ ID NO: 38978 - RNA, 22 nt, Human
aacaagcagaugcaaugcacuu

SEQ ID NO: 38979 - RNA, 22 nt, Human
aacaaggcaagucugugagcau

SEQ ID NO: 38980 - RNA, 22 nt, Human
aacaaggcacaagcuggcuguu

SEQ ID NO: 38981 - RNA, 22 nt, Human
aacaagucauuccauuugacag

SEQ ID NO: 38982 - RNA, 22 nt, Human
aacaaguuacucuuaaaguaua

SEQ ID NO: 38983 - RNA, 22 nt, Human
aacaaguuagggucuuuuacuu

SEQ ID NO: 38984 - RNA, 22 nt, Human
aacaaguuguugaaaauaauua

SEQ ID NO: 38985 - RNA, 22 nt, Human
aacaaugaggaucuguucugag

SEQ ID NO: 38986 - RNA, 22 nt, Human
aacaaugaguccucugagguua

SEQ ID NO: 38987 - RNA, 22 nt, Human
aacaaugauauagggauuggca

SEQ ID NO: 38988 - RNA, 22 nt, Human
aacaaugucucauccuaugugg

SEQ ID NO: 38989 - RNA, 22 nt, Human
aacaauguguucagcacugugg

SEQ ID NO: 38990 - RNA, 22 nt, Human
aacaauuaucauauacauugca

SEQ ID NO: 38991 - RNA, 23 nt, Human
aacacaaagcugauuccaguggc

SEQ ID NO: 38992 - RNA, 22 nt, Human
aacacacgccuccuccaugggg

SEQ ID NO: 38993 - RNA, 22 nt, Human
aacacagaucaaaauauuuccu

SEQ ID NO: 38994 - RNA, 22 nt, Human
aacacagcuaauuucugucaau

SEQ ID NO: 38995 - RNA, 22 nt, Human
aacacaggccagccugugcagu

SEQ ID NO: 38996 - RNA, 22 nt, Human
aacacaggggguuacaaauugu

SEQ ID NO: 38997 - RNA, 22 nt, Human
aacacagucauuagaggcagcc

SEQ ID NO: 38998 - RNA, 22 nt, Human
aacacaguuucugcauugguag

SEQ ID NO: 38999 - RNA, 22 nt, Human
aacacaguuuuccaaaauagag

SEQ ID NO: 39000 - RNA, 22 nt, Human
aacaccuaaaaaucauuguuga

SEQ ID NO: 39001 - RNA, 22 nt, Human
aacacucuacgugcagcuccua

SEQ ID NO: 39002 - RNA, 22 nt, Human
aacacucucuguugguaaggcu

SEQ ID NO: 39003 - RNA, 22 nt, Human
aacacugaaacauugauugaca

SEQ ID NO: 39004 - RNA, 22 nt, Human
aacacugaccucuacccucagu

SEQ ID NO: 39005 - RNA, 22 nt, Human
aacacugagaacuguugguggu

SEQ ID NO: 39006 - RNA, 20 nt, Human
aacacugaggccuacucuuc

SEQ ID NO: 39007 - RNA, 22 nt, Human
aacacugucuuauacuucaaug

SEQ ID NO: 39008 - RNA, 22 nt, Human
aacacuuugggcauggccuucc

SEQ ID NO: 39009 - RNA, 22 nt, Human
aacacuuuuuauauauuguauc

SEQ ID NO: 39010 - RNA, 22 nt, Human
aacagaacccgagugugaaucu

SEQ ID NO: 39011 - RNA, 22 nt, Human
aacagaauauuuugccuuucuc

SEQ ID NO: 39012 - RNA, 22 nt, Human
aacagaaucuuggguucuuuuc

SEQ ID NO: 39013 - RNA, 22 nt, Human
aacagaaugcaggggaugcugc

SEQ ID NO: 39014 - RNA, 22 nt, Human
aacagaauuguacaccagggag

SEQ ID NO: 39015 - RNA, 22 nt, Human
aacagacaacuccuguggcuca

SEQ ID NO: 39016 - RNA, 22 nt, Human
aacagacuuagagcaucccaau

SEQ ID NO: 39017 - RNA, 22 nt, Human
aacagagaucuuaauuccugua

SEQ ID NO: 39018 - RNA, 22 nt, Human
aacagagcauucugcacuacaa

SEQ ID NO: 39019 - RNA, 22 nt, Human
aacagaggcucccugcacuugu

SEQ ID NO: 39020 - RNA, 22 nt, Human
aacagauauaggcagaacuuug

SEQ ID NO: 39021 - RNA, 22 nt, Human
aacagcaauagcacuauucauu

SEQ ID NO: 39022 - RNA, 22 nt, Human
aacagcaccgaagucgucuaag

SEQ ID NO: 39023 - RNA, 22 nt, Human
aacagcagcaaguaagcagguc

SEQ ID NO: 39024 - RNA, 22 nt, Human
aacagcagcugaggagcugggc

SEQ ID NO: 39025 - RNA, 22 nt, Human
aacagcagcuuucaggaucauc

SEQ ID NO: 39026 - RNA, 22 nt, Human
aacagcaggcauuucuuagcuc

SEQ ID NO: 39027 - RNA, 22 nt, Human
aacagcagggaugggguggcca

SEQ ID NO: 39028 - RNA, 22 nt, Human
aacagcaguuacuuuugcauca

SEQ ID NO: 39029 - RNA, 22 nt, Human
aacagcauaaguauuuauuuca

SEQ ID NO: 39030 - RNA, 22 nt, Human
aacagcauaccaauguacauau

SEQ ID NO: 39031 - RNA, 23 nt, Human
aacagccaacuuuagcggguggc

SEQ ID NO: 39032 - RNA, 22 nt, Human
aacagccucagugagauuagga

SEQ ID NO: 39033 - RNA, 22 nt, Human
aacagcuaguggucuagacuuu

SEQ ID NO: 39034 - RNA, 22 nt, Human
aacagcuauucacuacuauggg

SEQ ID NO: 39035 - RNA, 22 nt, Human
aacagcuuuagaggauaauagu

SEQ ID NO: 39036 - RNA, 22 nt, Human
aacagcuuugcuucuggagaca

SEQ ID NO: 39037 - RNA, 22 nt, Human
aacagcuuuuuuggucagcauu

SEQ ID NO: 39038 - RNA, 22 nt, Human
aacaggaaaacagcacaauagc

SEQ ID NO: 39039 - RNA, 22 nt, Human
aacaggaauugaugggaguccu

SEQ ID NO: 39040 - RNA, 22 nt, Human
aacaggaccccgcguggugucu

SEQ ID NO: 39041 - RNA, 22 nt, Human
aacaggaccuuccaauccauca

SEQ ID NO: 39042 - RNA, 22 nt, Human
aacaggaugucauuucucaugu

SEQ ID NO: 39043 - RNA, 15 nt, Human
aacaggcauuuauau

SEQ ID NO: 39044 - RNA, 22 nt, Human
aacaggcuaaauuguccauuuc

SEQ ID NO: 39045 - RNA, 22 nt, Human
aacaggcuucuucugggcuccu

SEQ ID NO: 39046 - RNA, 22 nt, Human
aacaggggauuagauagcaggc

SEQ ID NO: 39047 - RNA, 22 nt, Human
aacagguagggacucuaacuug

SEQ ID NO: 39048 - RNA, 22 nt, Human
aacaggagaguaaauauaugau

SEQ ID NO: 39049 - RNA, 23 nt, Human
aacaggaugugcuucaucuuuug

SEQ ID NO: 39050 - RNA, 22 nt, Human
aacaggcaacaguugacucuga

SEQ ID NO: 39051 - RNA, 22 nt, Human
aacaggcaauuuaggacucuuu

SEQ ID NO: 39052 - RNA, 22 nt, Human
aacaggcaggagaauucugccu

SEQ ID NO: 39053 - RNA, 22 nt, Human
aacaggcuaaguauuugguagc

SEQ ID NO: 39054 - RNA, 22 nt, Human
aacaggcuaguuuuaaagcaua

SEQ ID NO: 39055 - RNA, 22 nt, Human
aacagggcuuuggaagucuccg

SEQ ID NO: 39056 - RNA, 22 nt, Human
aacaggggugggugcuacugga

SEQ ID NO: 39057 - RNA, 22 nt, Human
aacagguacaguuucccucugg

SEQ ID NO: 39058 - RNA, 22 nt, Human
aacaguaaagacagaauuuauc

SEQ ID NO: 39059 - RNA, 20 nt, Human
aacaguaccauuuaucucag

SEQ ID NO: 39060 - RNA, 20 nt, Human
aacaguaccccccuuguucu

SEQ ID NO: 39061 - RNA, 22 nt, Human
aacaguagguguaaccaaacaa

SEQ ID NO: 39062 - RNA, 22 nt, Human
aacaguaguggucaauaugcca

SEQ ID NO: 39063 - RNA, 22 nt, Human
aacaguauggaagccauuagga

SEQ ID NO: 39064 - RNA, 22 nt, Human
aacaguauugguugaacucaag

SEQ ID NO: 39065 - RNA, 22 nt, Human
aacagucaaaguuugguuccuu

SEQ ID NO: 39066 - RNA, 19 nt, Human
aacagucugggaagcacag

SEQ ID NO: 39067 - RNA, 19 nt, Human
aacagugaggcccagccug

SEQ ID NO: 39068 - RNA, 22 nt, Human
aacagugaguugaugacugaau

SEQ ID NO: 39069 - RNA, 22 nt, Human
aacagugcuucauucacacauu

SEQ ID NO: 39070 - RNA, 22 nt, Human
aacaguuaaugaagaggaagcc

SEQ ID NO: 39071 - RNA, 22 nt, Human
aacaguuaucucacauauggaa

SEQ ID NO: 39072 - RNA, 22 nt, Human
aacaguuuauguaaauguccag

SEQ ID NO: 39073 - RNA, 22 nt, Human
aacaguuucaguuacugaugag

SEQ ID NO: 39074 - RNA, 18 nt, Human
aacaguuuccagauucuc

SEQ ID NO: 39075 - RNA, 22 nt, Human
aacaguuuccugacuccuauga

SEQ ID NO: 39076 - RNA, 22 nt, Human
aacaguuugagcuuugaauuuc

SEQ ID NO: 39077 - RNA, 22 nt, Human
aacauaaauuugaaguggcaaa

SEQ ID NO: 39078 - RNA, 23 nt, Human
aacauacuguuuaauauucacag

SEQ ID NO: 39079 - RNA, 22 nt, Human
aacauauaaacucuuaaguuca

SEQ ID NO: 39080 - RNA, 22 nt, Human
aacauaucauuuaacccucacc

SEQ ID NO: 39081 - RNA, 22 nt, Human
aacauauucagaugccaagucc

SEQ ID NO: 39082 - RNA, 22 nt, Human
aacaucacaauuucauuuaugc

SEQ ID NO: 39083 - RNA, 15 nt, Human
aacaucacuauuuug

SEQ ID NO: 39084 - RNA, 22 nt, Human
aacaucaggaucuuguuacagu

SEQ ID NO: 39085 - RNA, 22 nt, Human
aaauacagcagacuccuguugu

SEQ ID NO: 39086 - RNA, 22 nt, Human
aaauacauaaagguuguaccag

SEQ ID NO: 39087 - RNA, 22 nt, Human
aaauacauuuacagucguggcu

SEQ ID NO: 39088 - RNA, 21 nt, Human
aaauacugggcagugacuuga

SEQ ID NO: 39089 - RNA, 22 nt, Human
aaauacuguuuuauuccaugau

SEQ ID NO: 39090 - RNA, 22 nt, Human
aaauagaauuaacuagcuacug

SEQ ID NO: 39091 - RNA, 23 nt, Human
aaauagagauaggccagcuuugc

SEQ ID NO: 39092 - RNA, 22 nt, Human
aaauagauuuaacauccauccc

SEQ ID NO: 39093 - RNA, 22 nt, Human
aaauagauuucucuggguuugu

SEQ ID NO: 39094 - RNA, 22 nt, Human
aaauagcaaugugaaaagagga

SEQ ID NO: 39095 - RNA, 22 nt, Human
aaauagcagaagcagagggggu

SEQ ID NO: 39096 - RNA, 22 nt, Human
aaauagcuguauuuacccugua

SEQ ID NO: 39097 - RNA, 22 nt, Human
aaauaggagcuuaagcacuucu

SEQ ID NO: 39098 - RNA, 22 nt, Human
aaauaguccugggaauaguacu

SEQ ID NO: 39099 - RNA, 22 nt, Human
aaauaguucagcuuguaaaccc

SEQ ID NO: 39100 - RNA, 22 nt, Human
aaauaguuuagcucucauuuca

SEQ ID NO: 39101 - RNA, 22 nt, Human
aaauauaccaguugccugcauc

SEQ ID NO: 39102 - RNA, 19 nt, Human
aaauaucagagagaugaua

SEQ ID NO: 39103 - RNA, 22 nt, Human
aaauaucauuuauaacuuuuaa

SEQ ID NO: 39104 - RNA, 22 nt, Human
aaauaugaaugauaagaguuau

SEQ ID NO: 39105 - RNA, 17 nt, Human
aaauaugaccucaaagu

SEQ ID NO: 39106 - RNA, 22 nt, Human
aaauaugagauguucucuuucg

SEQ ID NO: 39107 - RNA, 23 nt, Human
aaauaugucugagggcaaagaau

SEQ ID NO: 39108 - RNA, 22 nt, Human
aaauauuauugcuuaaggggag

SEQ ID NO: 39109 - RNA, 22 nt, Human
aaaucacuguuauugaucuuaa

SEQ ID NO: 39110 - RNA, 22 nt, Human
aaaucagacacagugaaaguua

SEQ ID NO: 39111 - RNA, 22 nt, Human
aaaucagaggcaacaacuacuu

SEQ ID NO: 39112 - RNA, 22 nt, Human
aaaucagaucuuacacaauugu

SEQ ID NO: 39113 - RNA, 22 nt, Human
aaaucagauuauuugauuggca

SEQ ID NO: 39114 - RNA, 22 nt, Human
aaaucagucccucuuggaauuu

SEQ ID NO: 39115 - RNA, 22 nt, Human
aaaucaguucacguucugaggu

SEQ ID NO: 39116 - RNA, 22 nt, Human
aaaucaguuguuauauuaaaga

SEQ ID NO: 39117 - RNA, 22 nt, Human
aaaucaucucugcauccuuagc

SEQ ID NO: 39118 - RNA, 22 nt, Human
aaaucauguuggcacaauaaaa

SEQ ID NO: 39119 - RNA, 20 nt, Human
aaauccaguguguauuuuac

SEQ ID NO: 39120 - RNA, 22 nt, Human
aaauccaguguucaaaguuuga

SEQ ID NO: 39121 - RNA, 22 nt, Human
aaaucccaaugcuagacccggu

SEQ ID NO: 39122 - RNA, 22 nt, Human
aaaucccacucacgaguuuugc

SEQ ID NO: 39123 - RNA, 22 nt, Human
aaaucccuugcucucucagacc

SEQ ID NO: 39124 - RNA, 22 nt, Human
aaauccgucauuggccugguug

SEQ ID NO: 39125 - RNA, 22 nt, Human
aaauccuaauaaugcacuagug

SEQ ID NO: 39126 - RNA, 22 nt, Human
aaauccuaaugacaaguuuagu

SEQ ID NO: 39127 - RNA, 22 nt, Human
aaauccuggccucaaguggucc

SEQ ID NO: 39128 - RNA, 22 nt, Human
aaaucgguugguucaagguaau

SEQ ID NO: 39129 - RNA, 22 nt, Human
aaaucguggaagacaccagugg

SEQ ID NO: 39130 - RNA, 22 nt, Human
aaaucuaggcucauccuggucc

SEQ ID NO: 39131 - RNA, 22 nt, Human
aaaucuaguaccuuuuugauua

SEQ ID NO: 39132 - RNA, 22 nt, Human
aaaucucaaaggcuuagcaucu

SEQ ID NO: 39133 - RNA, 22 nt, Human
aaaucucaauuugaauuguagc

SEQ ID NO: 39134 - RNA, 22 nt, Human
aaaucucaguguucuaagcauu

SEQ ID NO: 39135 - RNA, 22 nt, Human
aaaucucuggcagaaauaaacu

SEQ ID NO: 39136 - RNA, 22 nt, Human
aaaucucuggucacagaacuua

SEQ ID NO: 39137 - RNA, 22 nt, Human
aaaucugggucaagguggagug

SEQ ID NO: 39138 - RNA, 22 nt, Human
aaaucuguaagcaauugcucag

SEQ ID NO: 39139 - RNA, 22 nt, Human
aaaucuguuucagguauauuug

SEQ ID NO: 39140 - RNA, 22 nt, Human
aaaucuuucccuuuacuaucca

SEQ ID NO: 39141 - RNA, 22 nt, Human
aaaugaacaguugcauucucug

SEQ ID NO: 39142 - RNA, 22 nt, Human
aaaugacagaguaagcuguuua

SEQ ID NO: 39143 - RNA, 22 nt, Human
aaaugaguuugccucuagauag

SEQ ID NO: 39144 - RNA, 22 nt, Human
aaaugauaguauggaacuagga

SEQ ID NO: 39145 - RNA, 22 nt, Human
aaaugaucauguaauuucagaa

SEQ ID NO: 39146 - RNA, 22 nt, Human
aaaugauggaaaugaggcugaa

SEQ ID NO: 39147 - RNA, 22 nt, Human
aaaugauguuauaagaccagga

SEQ ID NO: 39148 - RNA, 22 nt, Human
aaaugcaaggauuuuguuaggc

SEQ ID NO: 39149 - RNA, 22 nt, Human
aaaugcaauuguauguacucca

SEQ ID NO: 39150 - RNA, 22 nt, Human
aaaugcacagaggccagagagg

SEQ ID NO: 39151 - RNA, 22 nt, Human
aaaugcacaggagaaccaauuc

SEQ ID NO: 39152 - RNA, 23 nt, Human
aaaugcacaguauugauuuuuaa

SEQ ID NO: 39153 - RNA, 22 nt, Human
aaaugcaccuugcugugagacu

SEQ ID NO: 39154 - RNA, 22 nt, Human
aaaugcacugaacacauguugu

SEQ ID NO: 39155 - RNA, 22 nt, Human
aaaugcagauucaugagcccca

SEQ ID NO: 39156 - RNA, 22 nt, Human
aaaugcagauuccuaggcccca

SEQ ID NO: 39157 - RNA, 22 nt, Human
aaaugcagauugucauucagga

SEQ ID NO: 39158 - RNA, 22 nt, Human
aaaugcagcugggcaugagagg

SEQ ID NO: 39159 - RNA, 21 nt, Human
aaaugcagucucugagaucug

SEQ ID NO: 39160 - RNA, 20 nt, Human
aaaugcaguucugccuuggc

SEQ ID NO: 39161 - RNA, 22 nt, Human
aaaugcauguagaauaauagag

SEQ ID NO: 39162 - RNA, 22 nt, Human
aaaugcauguauguaauaugcu

SEQ ID NO: 39163 - RNA, 22 nt, Human
aaaugcauugguuucuacuugu

SEQ ID NO: 39164 - RNA, 20 nt, Human
aaaugccagugauucugcuu

SEQ ID NO: 39165 - RNA, 21 nt, Human
aacaggucccccacgggcuuu

SEQ ID NO: 39166 - RNA, 22 nt, Human
aacagguugaggucaaaugcaa

SEQ ID NO: 39167 - RNA, 22 nt, Human
aacaguaaaaaucauuuaguug

SEQ ID NO: 39168 - RNA, 22 nt, Human
aacaguaagagauguuuuaucu

SEQ ID NO: 39169 - RNA, 17 nt, Human
aacaguaagcccuguuu

SEQ ID NO: 39170 - RNA, 22 nt, Human
aacaguaauuugcgguuuuugc

SEQ ID NO: 39171 - RNA, 22 nt, Human
aacaguaggcaucacauaauga

SEQ ID NO: 39172 - RNA, 22 nt, Human
aacaguaucuacgggaacuauu

SEQ ID NO: 39173 - RNA, 22 nt, Human
aacaguaucuuuuaucagaaau

SEQ ID NO: 39174 - RNA, 22 nt, Human
aacagucuuccuacggccauua

SEQ ID NO: 39175 - RNA, 22 nt, Human
aacagugauaucaagacagaca

SEQ ID NO: 39176 - RNA, 22 nt, Human
aacagugcugcauucauugagc

SEQ ID NO: 39177 - RNA, 21 nt, Human
aacagugcuuaguagauguuc

SEQ ID NO: 39178 - RNA, 22 nt, Human
aacagugucugugguuaaaggu

SEQ ID NO: 39179 - RNA, 22 nt, Human
aacaguguucuaggguguggcu

SEQ ID NO: 39180 - RNA, 22 nt, Human
aacaguguuuugcucuuugccc

SEQ ID NO: 39181 - RNA, 22 nt, Human
aacaguguuuuucuucagcacu

SEQ ID NO: 39182 - RNA, 22 nt, Human
aacaguuauuaucacauuagug

SEQ ID NO: 39183 - RNA, 22 nt, Human
aacaguuuaugauaaauucuua

SEQ ID NO: 39184 - RNA, 22 nt, Human
aacaguuucuauguuagugguu

SEQ ID NO: 39185 - RNA, 22 nt, Human
aacauaagggagcuucaaaacu

SEQ ID NO: 39186 - RNA, 22 nt, Human
aacauaaguggcacuuugccca

SEQ ID NO: 39187 - RNA, 22 nt, Human
aacauacauauuucagugucca

SEQ ID NO: 39188 - RNA, 22 nt, Human
aacauagcuuuacucaaaugac

SEQ ID NO: 39189 - RNA, 22 nt, Human
aacaucagaauauccauguugg

SEQ ID NO: 39190 - RNA, 22 nt, Human
aacaucaucagaugggugcuug

SEQ ID NO: 39191 - RNA, 19 nt, Human
aacaucauggcucuuucca

SEQ ID NO: 39192 - RNA, 22 nt, Human
aacaucauuauguccauuaaug

SEQ ID NO: 39193 - RNA, 22 nt, Human
aacaucuacagugagauguuag

SEQ ID NO: 39194 - RNA, 22 nt, Human
aacugcuucuuacugcugggca

SEQ ID NO: 39195 - RNA, 22 nt, Human
aacugcuugagauauguuuguc

SEQ ID NO: 39196 - RNA, 22 nt, Human
aacugcuuguaaauaauguuga

SEQ ID NO: 39197 - RNA, 17 nt, Human
aacugcuuuuuuuagcc

SEQ ID NO: 39198 - RNA, 22 nt, Human
aacuggaaagaucaguaggaag

SEQ ID NO: 39199 - RNA, 22 nt, Human
aacuggagccccucugccacug

SEQ ID NO: 39200 - RNA, 22 nt, Human
aacuggauuuaggaacagagaa

SEQ ID NO: 39201 - RNA, 22 nt, Human
aacugggcccagucugaguugg

SEQ ID NO: 39202 - RNA, 22 nt, Human
aacugguaucucuucaguguaa

SEQ ID NO: 39203 - RNA, 22 nt, Human
aacuggugagauaaauuauuua

SEQ ID NO: 39204 - RNA, 22 nt, Human
aacugguucuggaggcugcagg

SEQ ID NO: 39205 - RNA, 19 nt, Human
aacuguaaagaucuguagc

SEQ ID NO: 39206 - RNA, 22 nt, Human
aacuguaaagguugagugguaa

SEQ ID NO: 39207 - RNA, 22 nt, Human
aacuguaaggcuuagaacagca

SEQ ID NO: 39208 - RNA, 22 nt, Human
aacuguaaugaauuguucauga

SEQ ID NO: 39209 - RNA, 22 nt, Human
aacuguagaagggacacaaaag

SEQ ID NO: 39210 - RNA, 22 nt, Human
aacuguagggaucugucuuagu

SEQ ID NO: 39211 - RNA, 22 nt, Human
aacuguagugcuuauagacucu

SEQ ID NO: 39212 - RNA, 22 nt, Human
aacugucuaaggagaauaugaa

SEQ ID NO: 39213 - RNA, 22 nt, Human
aacugucugaaacugggguuuc

SEQ ID NO: 39214 - RNA, 22 nt, Human
aacugucuuauuuauauuucug

SEQ ID NO: 39215 - RNA, 22 nt, Human
aacuguucacacugaugugacg

SEQ ID NO: 39216 - RNA, 18 nt, Human
aacuguugaaauagcuug

SEQ ID NO: 39217 - RNA, 22 nt, Human
aacuuaaugauuucaugcaugu

SEQ ID NO: 39218 - RNA, 22 nt, Human
aacuuagagcucuccuaaauga

SEQ ID NO: 39219 - RNA, 22 nt, Human
aacuuaggaaaauaaggcauga

SEQ ID NO: 39220 - RNA, 22 nt, Human
aacuuagucuuucaauuugaua

SEQ ID NO: 39221 - RNA, 22 nt, Human
aacuuagugagccacucuugca

SEQ ID NO: 39222 - RNA, 22 nt, Human
aacuuaguuaagauuaagucuc

SEQ ID NO: 39223 - RNA, 22 nt, Human
aacuuaguucaauaucagugcu

SEQ ID NO: 39224 - RNA, 22 nt, Human
aacuuaguuggggacaccaugg

SEQ ID NO: 39225 - RNA, 22 nt, Human
aacuucaguugagaaaggcaug

SEQ ID NO: 39226 - RNA, 22 nt, Human
aacuucauguaauuuaaaacag

SEQ ID NO: 39227 - RNA, 22 nt, Human
aacuuccuuggguaugaaaaca

SEQ ID NO: 39228 - RNA, 22 nt, Human
aacuucugccaaacagcuguua

SEQ ID NO: 39229 - RNA, 22 nt, Human
aacuucuggauguuucaaaugu

SEQ ID NO: 39230 - RNA, 22 nt, Human
aacuugauccugcuggguacua

SEQ ID NO: 39231 - RNA, 23 nt, Human
aacuugcuguaaaguucuaggca

SEQ ID NO: 39232 - RNA, 22 nt, Human
aacuugguuguuggcaauuugc

SEQ ID NO: 39233 - RNA, 22 nt, Human
aacuuguauauguuauucagag

SEQ ID NO: 39234 - RNA, 21 nt, Human
aacuuguauuucuccuuauuc

SEQ ID NO: 39235 - RNA, 20 nt, Human
aacuugucuuccuguuuggc

SEQ ID NO: 39236 - RNA, 22 nt, Human
aacuuuagcuauuuaaucugau

SEQ ID NO: 39237 - RNA, 22 nt, Human
aacuuucagcaaguaauucugg

SEQ ID NO: 39238 - RNA, 22 nt, Human
aacuuucaggcaaugaauauuu

SEQ ID NO: 39239 - RNA, 22 nt, Human
aacuuucuaaagucaaauuggu

SEQ ID NO: 39240 - RNA, 22 nt, Human
aacuuucugaaaagcuugauca

SEQ ID NO: 39241 - RNA, 22 nt, Human
aacuuucugucugagcugcaga

SEQ ID NO: 39242 - RNA, 22 nt, Human
aacuuugcaagggggcccugcg

SEQ ID NO: 39243 - RNA, 19 nt, Human
aacuuugcuacccuauccu

SEQ ID NO: 39244 - RNA, 22 nt, Human
aacuuugcuggaaaauuggagc

SEQ ID NO: 39245 - RNA, 22 nt, Human
aacuuugcuuuuguggguaaag

SEQ ID NO: 39246 - RNA, 22 nt, Human
aacuuuggcaagucagacuucu

SEQ ID NO: 39247 - RNA, 22 nt, Human
aacuuuggguaaugcuucaauu

SEQ ID NO: 39248 - RNA, 22 nt, Human
aacuuugucuuuuaugcuuaca

SEQ ID NO: 39249 - RNA, 22 nt, Human
aacuuuuagacuuggguauaaa

SEQ ID NO: 39250 - RNA, 23 nt, Human
aacuuuuagaguuuaacaguguu

SEQ ID NO: 39251 - RNA, 22 nt, Human
aacuuuucauaagggcaaauuu

SEQ ID NO: 39252 - RNA, 22 nt, Human
aacuuuucauugaaucauguca

SEQ ID NO: 39253 - RNA, 22 nt, Human
aagaaaaucaguucuggucagu

SEQ ID NO: 39254 - RNA, 22 nt, Human
aagaaacguuugagcuuugacu

SEQ ID NO: 39255 - RNA, 20 nt, Human
aagaaacuugaaaguacaag

SEQ ID NO: 39256 - RNA, 21 nt, Human
aagaaagauaauuaaggaccc

SEQ ID NO: 39257 - RNA, 22 nt, Human
aagaaagguguguuugcagaug

SEQ ID NO: 39258 - RNA, 22 nt, Human
aagaaaguggguaauaugauuu

SEQ ID NO: 39259 - RNA, 22 nt, Human
aagaaauggaagauccauggug

SEQ ID NO: 39260 - RNA, 22 nt, Human
aagaaauuaaugugccauuacu

SEQ ID NO: 39261 - RNA, 22 nt, Human
aagaacaguugggaggugagcc

SEQ ID NO: 39262 - RNA, 22 nt, Human
aagaacaugaguuaugaugauu

SEQ ID NO: 39263 - RNA, 22 nt, Human
aagaacaugauggccaugugca

SEQ ID NO: 39264 - RNA, 22 nt, Human
aagaacaugcuauaauuaucuu

SEQ ID NO: 39265 - RNA, 22 nt, Human
aagaacauguuaaaagauucac

SEQ ID NO: 39266 - RNA, 22 nt, Human
aagaacauucgaacuauuuucu

SEQ ID NO: 39267 - RNA, 22 nt, Human
aagaacauugacuaagaggggc

SEQ ID NO: 39268 - RNA, 22 nt, Human
aagaacauuuuguagaaugaca

SEQ ID NO: 39269 - RNA, 22 nt, Human
aagaaccuauaugcugaugaau

SEQ ID NO: 39270 - RNA, 22 nt, Human
aagaacugaguacguuaauaaa

SEQ ID NO: 39271 - RNA, 22 nt, Human
aagaacuguaucaagauguagu

SEQ ID NO: 39272 - RNA, 22 nt, Human
aagaacuuugauuucauugcau

SEQ ID NO: 39273 - RNA, 19 nt, Human
aagaagcaauaagcuguga

SEQ ID NO: 39274 - RNA, 22 nt, Human
aagaagcagagcuguggguguu

SEQ ID NO: 39275 - RNA, 22 nt, Human
aagaagcagcugccaggccagu

SEQ ID NO: 39276 - RNA, 22 nt, Human
aagaagcaggucacagacaggg

SEQ ID NO: 39277 - RNA, 20 nt, Human
aagaagccgggaaggcaggc

SEQ ID NO: 39278 - RNA, 22 nt, Human
aagaagcuguagggauuaacuc

SEQ ID NO: 39279 - RNA, 22 nt, Human
aagaaggaaguguggacaucac

SEQ ID NO: 39280 - RNA, 22 nt, Human
aagaagguguggaaagaugcuc

SEQ ID NO: 39281 - RNA, 22 nt, Human
aagaaguuaauaauggugagaa

SEQ ID NO: 39282 - RNA, 20 nt, Human
aagaaguugguaagcagugc

SEQ ID NO: 39283 - RNA, 21 nt, Human
aagaaguuuggauuuuguccu

SEQ ID NO: 39284 - RNA, 22 nt, Human
aagaauauagauuuuuugaagu

SEQ ID NO: 39285 - RNA, 17 nt, Human
aagaaucauuagagaag

SEQ ID NO: 39286 - RNA, 22 nt, Human
aagaaucucucuacuuuauuac

SEQ ID NO: 39287 - RNA, 22 nt, Human
aagaaucuguugauuccccacu

SEQ ID NO: 39288 - RNA, 22 nt, Human
aagaaugucguugguauuuuaa

SEQ ID NO: 39289 - RNA, 22 nt, Human
aagaauguucuuguagucauga

SEQ ID NO: 39290 - RNA, 22 nt, Human
aagacaauaauuuuugggcagg

SEQ ID NO: 39291 - RNA, 22 nt, Human
aagacaauccuggacagucagc

SEQ ID NO: 39292 - RNA, 22 nt, Human
aagacacacacauaugcugagu

SEQ ID NO: 39293 - RNA, 22 nt, Human
aagacacugauacucugugauu

SEQ ID NO: 39294 - RNA, 22 nt, Human
aagacagaagugauuugaugug

SEQ ID NO: 39295 - RNA, 22 nt, Human
aagacagcauugcugagggcuu

SEQ ID NO: 39296 - RNA, 22 nt, Human
aagacagccagcuccaugggau

SEQ ID NO: 39297 - RNA, 22 nt, Human
aagacaggaaaagcuccaggcc

SEQ ID NO: 39298 - RNA, 22 nt, Human
aagacaugacugcacagccaaa

SEQ ID NO: 39299 - RNA, 22 nt, Human
aagauacaccaagagccuagua

SEQ ID NO: 39300 - RNA, 23 nt, Human
aagauacagguguggaaugguuu

SEQ ID NO: 39301 - RNA, 22 nt, Human
aagauacagugaaagggcauug

SEQ ID NO: 39302 - RNA, 22 nt, Human
aagauacaucaaagcaaauugg

SEQ ID NO: 39303 - RNA, 22 nt, Human
aaggaaacagaggaugaccuug

SEQ ID NO: 39304 - RNA, 22 nt, Human
aaggaaagauucucucucuaga

SEQ ID NO: 39305 - RNA, 22 nt, Human
aagacauuagaaucagccuguu

SEQ ID NO: 39306 - RNA, 22 nt, Human
aagacauucaugaagaagggau

SEQ ID NO: 39307 - RNA, 22 nt, Human
aagacauuggacaauccagagg

SEQ ID NO: 39308 - RNA, 22 nt, Human
aagacauuguggagauguugcu

SEQ ID NO: 39309 - RNA, 22 nt, Human
aagaccauaauguaagaugaau

SEQ ID NO: 39310 - RNA, 22 nt, Human
aagaccauugcuguauuuguag

SEQ ID NO: 39311 - RNA, 22 nt, Human
aagacccacaaggcugaauguu

SEQ ID NO: 39312 - RNA, 22 nt, Human
aagacccuucucugaggaggaa

SEQ ID NO: 39313 - RNA, 22 nt, Human
aagaccugcguuauccugccug

SEQ ID NO: 39314 - RNA, 23 nt, Human
aagacuaauucuuaauugcuuag

SEQ ID NO: 39315 - RNA, 22 nt, Human
aagacuacuuuuggcagugugu

SEQ ID NO: 39316 - RNA, 22 nt, Human
aagacuagaccagugaauagga

SEQ ID NO: 39317 - RNA, 22 nt, Human
aagacugaauuugcauaguugg

SEQ ID NO: 39318 - RNA, 22 nt, Human
aagacugauguccagucccaug

SEQ ID NO: 39319 - RNA, 22 nt, Human
aagacugugucuauggcuacuc

SEQ ID NO: 39320 - RNA, 22 nt, Human
aagacuuucaaaccuauguuug

SEQ ID NO: 39321 - RNA, 22 nt, Human
aagacuuucuguaaagcuacag

SEQ ID NO: 39322 - RNA, 22 nt, Human
aagagaaggugaggaagccggu

SEQ ID NO: 39323 - RNA, 22 nt, Human
aagagacaugaauacucgaagg

SEQ ID NO: 39324 - RNA, 21 nt, Human
aagagacauuucucaucagca

SEQ ID NO: 39325 - RNA, 22 nt, Human
aagagacuggaaacuaggguca

SEQ ID NO: 39326 - RNA, 22 nt, Human
aagagacuguaaaggcgugagu

SEQ ID NO: 39327 - RNA, 22 nt, Human
aagagagaguuccuaggcaaaa

SEQ ID NO: 39328 - RNA, 22 nt, Human
aagagagggguugcauggaaau

SEQ ID NO: 39329 - RNA, 22 nt, Human
aagagauguugaaguuuauuag

SEQ ID NO: 39330 - RNA, 22 nt, Human
aagagauugguuauaagagauu

SEQ ID NO: 39331 - RNA, 22 nt, Human
aagagcaaguggguagugaagc

SEQ ID NO: 39332 - RNA, 22 nt, Human
aagagcagaaguccuuggaucc

SEQ ID NO: 39333 - RNA, 22 nt, Human
aagagcaggacagaaucagaac

SEQ ID NO: 39334 - RNA, 19 nt, Human
aagagcagggaaagaauug

SEQ ID NO: 39335 - RNA, 22 nt, Human
aagagcauaugguucucaaagc

SEQ ID NO: 39336 - RNA, 22 nt, Human
aagagcaucgguggagccccca

SEQ ID NO: 39337 - RNA, 22 nt, Human
aagagcauuuccacuggcacug

SEQ ID NO: 39338 - RNA, 22 nt, Human
aagagcauuuggugagauuuga

SEQ ID NO: 39339 - RNA, 22 nt, Human
aagagcauuuuguaaaauccuu

SEQ ID NO: 39340 - RNA, 22 nt, Human
aagagccagugggaaagucuug

SEQ ID NO: 39341 - RNA, 20 nt, Human
aagagcccgcagggcagugc

SEQ ID NO: 39342 - RNA, 20 nt, Human
aagagcuacuuagccuuucc

SEQ ID NO: 39343 - RNA, 22 nt, Human
aagagcuccaggcaaugcgguc

SEQ ID NO: 39344 - RNA, 22 nt, Human
aagagcugcccaaggugaacag

SEQ ID NO: 39345 - RNA, 22 nt, Human
aagagcuggcucuugcagcagc

SEQ ID NO: 39346 - RNA, 22 nt, Human
aagagcuggucacagguccauu

SEQ ID NO: 39347 - RNA, 22 nt, Human
aagagcuguaugccauaugauu

SEQ ID NO: 39348 - RNA, 21 nt, Human
aagagcugucaggaaggcugc

SEQ ID NO: 39349 - RNA, 22 nt, Human
aagagcugugggugguaguccu

SEQ ID NO: 39350 - RNA, 18 nt, Human
aagagcuucgcauauaca

SEQ ID NO: 39351 - RNA, 22 nt, Human
aagaggaagucuccauggagag

SEQ ID NO: 39352 - RNA, 22 nt, Human
aagaggaccaguagauaaauuu

SEQ ID NO: 39353 - RNA, 22 nt, Human
aagaggagaaaggcuggcuuug

SEQ ID NO: 39354 - RNA, 22 nt, Human
aagaggcagcccgcugaggcug

SEQ ID NO: 39355 - RNA, 22 nt, Human
aagaggcaguggugaugaaugg

SEQ ID NO: 39356 - RNA, 22 nt, Human
aagaggcgccggguacguggcg

SEQ ID NO: 39357 - RNA, 22 nt, Human
aagaggcuagccggcucacuaa

SEQ ID NO: 39358 - RNA, 20 nt, Human
aagaggcuguggauccuacu

SEQ ID NO: 39359 - RNA, 22 nt, Human
aagaggcuuucagugaacuugu

SEQ ID NO: 39360 - RNA, 22 nt, Human
aagagggcucgauuuggcaaaa

SEQ ID NO: 39361 - RNA, 22 nt, Human
aagagggcugcaaucuuauugc

SEQ ID NO: 39362 - RNA, 22 nt, Human
aagaggucauaccagauaaggg

SEQ ID NO: 39363 - RNA, 22 nt, Human
aagaguauuugguauagaacac

SEQ ID NO: 39364 - RNA, 22 nt, Human
aagagucuauuggaacuagaca

SEQ ID NO: 39365 - RNA, 22 nt, Human
aagagugacuuuucagcuguga

SEQ ID NO: 39366 - RNA, 22 nt, Human
aagaguggagaauaaaauagga

SEQ ID NO: 39367 - RNA, 22 nt, Human
aagaguuaagcaacagauacca

SEQ ID NO: 39368 - RNA, 22 nt, Human
aagaguuauaccuauuucuaac

SEQ ID NO: 39369 - RNA, 22 nt, Human
aagaguuauaguugguaugugg

SEQ ID NO: 39370 - RNA, 22 nt, Human
aagaguuaugaaagcaaggcau

SEQ ID NO: 39371 - RNA, 22 nt, Human
aagaguuucuuacuggcaucua

SEQ ID NO: 39372 - RNA, 22 nt, Human
aagaguuugaccugugccaucc

SEQ ID NO: 39373 - RNA, 22 nt, Human
aagaguuuuuaauggguacugg

SEQ ID NO: 39374 - RNA, 22 nt, Human
aagaguuuuuggagugugaguu

SEQ ID NO: 39375 - RNA, 22 nt, Human
aagauaaacucuugauuucuga

SEQ ID NO: 39376 - RNA, 22 nt, Human
aagauaacaggaggaguuugua

SEQ ID NO: 39377 - RNA, 22 nt, Human
aagauaauauucauuaacuaga

SEQ ID NO: 39378 - RNA, 22 nt, Human
aagauaauguucuagcugucag

SEQ ID NO: 39379 - RNA, 22 nt, Human
aagauacaaaugucaauauugg

SEQ ID NO: 39380 - RNA, 22 nt, Human
aagauacagacagagccaaaau

SEQ ID NO: 39381 - RNA, 22 nt, Human
aagauacauuaugucucucuga

SEQ ID NO: 39382 - RNA, 20 nt, Human
aagauagaauccuaacuuug

SEQ ID NO: 39383 - RNA, 22 nt, Human
aagaucaggcguggaaaacacu

SEQ ID NO: 39384 - RNA, 22 nt, Human
aagaucauaauauuuaucucau

SEQ ID NO: 39385 - RNA, 21 nt, Human
aagauccaagcaggcacuugu

SEQ ID NO: 39386 - RNA, 22 nt, Human
aagaugaacugucuucacccau

SEQ ID NO: 39387 - RNA, 22 nt, Human
aagaugaagaacaugagcacac

SEQ ID NO: 39388 - RNA, 22 nt, Human
aagaugacccugagggcaauug

SEQ ID NO: 39389 - RNA, 22 nt, Human
aagaugauguuguguuuucacu

SEQ ID NO: 39390 - RNA, 22 nt, Human
aagaugauuauguagauuggga

SEQ ID NO: 39391 - RNA, 22 nt, Human
aagaugcagcaaacuacuuuuu

SEQ ID NO: 39392 - RNA, 22 nt, Human
aagaugcagcuuccacuuuugc

SEQ ID NO: 39393 - RNA, 22 nt, Human
aagaugcagcuuuacaauaagg

SEQ ID NO: 39394 - RNA, 22 nt, Human
aagaugcaugcugaagcuggcu

SEQ ID NO: 39395 - RNA, 22 nt, Human
aagaugcgguugaccauggugu

SEQ ID NO: 39396 - RNA, 22 nt, Human
aagaugcuuauugcuccugcag

SEQ ID NO: 39397 - RNA, 22 nt, Human
aagaugcuugagaacuguuuga

SEQ ID NO: 39398 - RNA, 22 nt, Human
aagauggagcacgagcagaagc

SEQ ID NO: 39399 - RNA, 22 nt, Human
aagauggcaggaaucauaagcu

SEQ ID NO: 39400 - RNA, 22 nt, Human
aagauggucuugagauauuaua

SEQ ID NO: 39401 - RNA, 22 nt, Human
aagaugguggccagaguggaaa

SEQ ID NO: 39402 - RNA, 21 nt, Human
aagaugguuaugugcuaaaga

SEQ ID NO: 39403 - RNA, 22 nt, Human
aagauguguccauucuuugcuc

SEQ ID NO: 39404 - RNA, 22 nt, Human
aagauguugacuccuuugaugu

SEQ ID NO: 39405 - RNA, 22 nt, Human
aagauguugcaagggacucuuc

SEQ ID NO: 39406 - RNA, 22 nt, Human
aagauguuuuaauauuucgagg

SEQ ID NO: 39407 - RNA, 20 nt, Human
aagauucauuguaauuaggg

SEQ ID NO: 39408 - RNA, 22 nt, Human
aagauucugucaguuaggagga

SEQ ID NO: 39409 - RNA, 22 nt, Human
aagauucuugacuagaaugauu

SEQ ID NO: 39410 - RNA, 22 nt, Human
aagauugucaggcuugcuguau

SEQ ID NO: 39411 - RNA, 22 nt, Human
aagauuucagaguuugggggaa

SEQ ID NO: 39412 - RNA, 22 nt, Human
agcuugaauuauucugcucuua

SEQ ID NO: 39413 - RNA, 22 nt, Human
agcuugcuguauuuucuggagg

SEQ ID NO: 39414 - RNA, 17 nt, Human
agcuuggagcagcauga

SEQ ID NO: 39415 - RNA, 17 nt, Human
agcuuguuuuugaaagc

SEQ ID NO: 39416 - RNA, 22 nt, Human
agcuuuacaucgaaguucaguc

SEQ ID NO: 39417 - RNA, 22 nt, Human
agcuuuaccugccuuggggcac

SEQ ID NO: 39418 - RNA, 22 nt, Human
agcuuuaucacaauauuggcua

SEQ ID NO: 39419 - RNA, 22 nt, Human
agcuuuaucuucaccugggaau

SEQ ID NO: 39420 - RNA, 22 nt, Human
agcuuuauuaacucuccaggug

SEQ ID NO: 39421 - RNA, 22 nt, Human
agcuuucacgauuuggaacagg

SEQ ID NO: 39422 - RNA, 22 nt, Human
agcuuucguuccuuagacacau

SEQ ID NO: 39423 - RNA, 22 nt, Human
agcuuucuaguuuagccaucuu

SEQ ID NO: 39424 - RNA, 22 nt, Human
agcuuucugucaccugugcuug

SEQ ID NO: 39425 - RNA, 22 nt, Human
agcuuugaaaauccaaauuaca

SEQ ID NO: 39426 - RNA, 22 nt, Human
agcuuugaaucugguguuugca

SEQ ID NO: 39427 - RNA, 22 nt, Human
agcuuugcacugagacagcuca

SEQ ID NO: 39428 - RNA, 21 nt, Human
agcuuugcuuuguacucauuu

SEQ ID NO: 39429 - RNA, 22 nt, Human
agcuuuggcaucugacuagccg

SEQ ID NO: 39430 - RNA, 22 nt, Human
agcuuuggcccuggagguuacu

SEQ ID NO: 39431 - RNA, 22 nt, Human
agcuuuguuugcucacccgccg

SEQ ID NO: 39432 - RNA, 23 nt, Human
agcuuuuagguggaaauggcacu

SEQ ID NO: 39433 - RNA, 22 nt, Human
agcuuuuaguacguuaaaauug

SEQ ID NO: 39434 - RNA, 21 nt, Human
agcuuuucuguuuuauaucua

SEQ ID NO: 39435 - RNA, 22 nt, Human
aggaaaaucaaugucuuuuuaa

SEQ ID NO: 39436 - RNA, 22 nt, Human
aggaaacggcaaaacugcuuag

SEQ ID NO: 39437 - RNA, 22 nt, Human
aggaaacuaaggcucagugaag

SEQ ID NO: 39438 - RNA, 22 nt, Human
aggaaacucugagcggaccagc

SEQ ID NO: 39439 - RNA, 22 nt, Human
aggaaacugagguuacgggacu

SEQ ID NO: 39440 - RNA, 22 nt, Human
aggaaacugauguuuuuuacaa

SEQ ID NO: 39441 - RNA, 22 nt, Human
aggaaagacuggggccccagaa

SEQ ID NO: 39442 - RNA, 22 nt, Human
aggaaagauggaaggaggauaa

SEQ ID NO: 39443 - RNA, 22 nt, Human
aggaaagcaauggcugagaaca

SEQ ID NO: 39444 - RNA, 21 nt, Human
aggaaaggaaguccccagggu

SEQ ID NO: 39445 - RNA, 21 nt, Human
aggaaaggccagcacguaggg

SEQ ID NO: 39446 - RNA, 22 nt, Human
aggaaagguucagugauugaaa

SEQ ID NO: 39447 - RNA, 22 nt, Human
aggaaauaagggacaagacaaa

SEQ ID NO: 39448 - RNA, 22 nt, Human
aggaaauaggaccagacaaagc

SEQ ID NO: 39449 - RNA, 22 nt, Human
aggaaaugcaggcaaauacucu

SEQ ID NO: 39450 - RNA, 22 nt, Human
aggaaauugucuuuuuccuugu

SEQ ID NO: 39451 - RNA, 22 nt, Human
aggaacacaacuuccugagagc

SEQ ID NO: 39452 - RNA, 22 nt, Human
aggaacauucucauuuccugcc

SEQ ID NO: 39453 - RNA, 22 nt, Human
aggaaccagacagaacugaaug

SEQ ID NO: 39454 - RNA, 22 nt, Human
aggaaccagagguugagcaacu

SEQ ID NO: 39455 - RNA, 22 nt, Human
aggaagaaaugugacuucaaac

SEQ ID NO: 39456 - RNA, 22 nt, Human
aggaagaacagauaauggacgc

SEQ ID NO: 39457 - RNA, 22 nt, Human
aggaagagcaucuuugggucug

SEQ ID NO: 39458 - RNA, 22 nt, Human
aggaagagcccgggugacauaa

SEQ ID NO: 39459 - RNA, 21 nt, Human
aggaagaucuggaggucggcg

SEQ ID NO: 39460 - RNA, 22 nt, Human
aggaagaugggagagcucugga

SEQ ID NO: 39461 - RNA, 22 nt, Human
aggaagcauguuggauccacuu

SEQ ID NO: 39462 - RNA, 23 nt, Human
aggaagcccauuuuagucuaccu

SEQ ID NO: 39463 - RNA, 22 nt, Human
aggaagcccuugucauuucugu

SEQ ID NO: 39464 - RNA, 22 nt, Human
aggaagccuggcauuaaaaagc

SEQ ID NO: 39465 - RNA, 22 nt, Human
aggaagcucagagaagucuuuu

SEQ ID NO: 39466 - RNA, 20 nt, Human
aggaagcugagauguagagg

SEQ ID NO: 39467 - RNA, 21 nt, Human
aggaagcugcccagauaguag

SEQ ID NO: 39468 - RNA, 22 nt, Human
aggaagcugccugggaugggaa

SEQ ID NO: 39469 - RNA, 22 nt, Human
aggaagcugcuggaguagugug

SEQ ID NO: 39470 - RNA, 22 nt, Human
aggaagcugggaaacugacauu

SEQ ID NO: 39471 - RNA, 22 nt, Human
aggaagcuuagugaaaggacca

SEQ ID NO: 39472 - RNA, 23 nt, Human
aggaagcuuggcaauaagguuug

SEQ ID NO: 39473 - RNA, 19 nt, Human
aggaaggaaccugagucug

SEQ ID NO: 39474 - RNA, 20 nt, Human
aggaaggagaaucugagcaa

SEQ ID NO: 39475 - RNA, 22 nt, Human
aggaagggagcaguuuguuguu

SEQ ID NO: 39476 - RNA, 17 nt, Human
aggaagggcaaguuucu

SEQ ID NO: 39477 - RNA, 22 nt, Human
aggaagguaaugaacugaggag

SEQ ID NO: 39478 - RNA, 22 nt, Human
aggaaggugcaguagggugugc

SEQ ID NO: 39479 - RNA, 20 nt, Human
aggaaguauugucaugaagg

SEQ ID NO: 39480 - RNA, 22 nt, Human
aggaagugacuagguaacccaa

SEQ ID NO: 39481 - RNA, 22 nt, Human
aggaagugcuaagagaacauca

SEQ ID NO: 39482 - RNA, 23 nt, Human
aggaaguuaaggcagacagacag

SEQ ID NO: 39483 - RNA, 22 nt, Human
aggaaguuaguaaauuaugugc

SEQ ID NO: 39484 - RNA, 22 nt, Human
aggaauagaccacuucacugag

SEQ ID NO: 39485 - RNA, 22 nt, Human
aggaauauggauuugcucagcu

SEQ ID NO: 39486 - RNA, 22 nt, Human
aggaauauuacuuugcuuuuau

SEQ ID NO: 39487 - RNA, 22 nt, Human
aggaaucugugguuuuaacagg

SEQ ID NO: 39488 - RNA, 22 nt, Human
aggaaugacuuguagcucugag

SEQ ID NO: 39489 - RNA, 21 nt, Human
aggaaugcugaggcucacuuu

SEQ ID NO: 39490 - RNA, 22 nt, Human
aggaauguaauaguguggcuca

SEQ ID NO: 39491 - RNA, 22 nt, Human
aggaauguauugaccuguugca

SEQ ID NO: 39492 - RNA, 22 nt, Human
aggaaugucauagaauaaucau

SEQ ID NO: 39493 - RNA, 22 nt, Human
aggaaugugaggcaaguuguga

SEQ ID NO: 39494 - RNA, 22 nt, Human
aggaauguguguccaccgggga

SEQ ID NO: 39495 - RNA, 22 nt, Human
aggaauguguuucuaggcuguu

SEQ ID NO: 39496 - RNA, 22 nt, Human
aggaauguuaagaaggucuacc

SEQ ID NO: 39497 - RNA, 22 nt, Human
aggaauguuaggagaugagucu

SEQ ID NO: 39498 - RNA, 22 nt, Human
aggaauuggcacggccuucuca

SEQ ID NO: 39499 - RNA, 22 nt, Human
aggaauugguucaagguuuauc

SEQ ID NO: 39500 - RNA, 22 nt, Human
aggaauuguguuguaguggaga

SEQ ID NO: 39501 - RNA, 19 nt, Human
aggaauuucucagggaggc

SEQ ID NO: 39502 - RNA, 22 nt, Human
aggaauuugagugcuguaggaa

SEQ ID NO: 39503 - RNA, 22 nt, Human
aggaauuuuaauaugcuugucu

SEQ ID NO: 39504 - RNA, 22 nt, Human
aggaauuuuacaagcugguugc

SEQ ID NO: 39505 - RNA, 22 nt, Human
aggacaaaggaccagaucugga

SEQ ID NO: 39506 - RNA, 22 nt, Human
aggacaaucucuccuuuaucag

SEQ ID NO: 39507 - RNA, 22 nt, Human
aggacaauuagacucuuuguuu

SEQ ID NO: 39508 - RNA, 22 nt, Human
aggacaauuagucuggcuuggc

SEQ ID NO: 39509 - RNA, 22 nt, Human
aggacaauuuuggcauaguucu

SEQ ID NO: 39510 - RNA, 22 nt, Human
aggacacaacaucauuucugug

SEQ ID NO: 39511 - RNA, 22 nt, Human
aggacacacuucugaggucuuu

SEQ ID NO: 39512 - RNA, 21 nt, Human
aggacacagagacaccuauug

SEQ ID NO: 39513 - RNA, 22 nt, Human
aggacacagcucuucaguaaga

SEQ ID NO: 39514 - RNA, 23 nt, Human
aggacagcaaaccccgccucccc

SEQ ID NO: 39515 - RNA, 22 nt, Human
aggacagcagugcuggcacuug

SEQ ID NO: 39516 - RNA, 22 nt, Human
aggacagcccccaacagcaaca

SEQ ID NO: 39517 - RNA, 22 nt, Human
aguuuauuucuccauuuaccua

SEQ ID NO: 39518 - RNA, 22 nt, Human
aguuuauuuuugauaagucuug

SEQ ID NO: 39519 - RNA, 22 nt, Human
aguuucacauagcucagugcuc

SEQ ID NO: 39520 - RNA, 22 nt, Human
aguuucaguucugucauuuaua

SEQ ID NO: 39521 - RNA, 22 nt, Human
auagacacagaucuauauaugu

SEQ ID NO: 39522 - RNA, 22 nt, Human
auagacagcgcauuaaaaaugu

SEQ ID NO: 39523 - RNA, 22 nt, Human
aggaucaggcccucuaggguag

SEQ ID NO: 39524 - RNA, 22 nt, Human
aggaucauauaagcuccagcua

SEQ ID NO: 39525 - RNA, 22 nt, Human
aggaucauguggucauuccuga

SEQ ID NO: 39526 - RNA, 22 nt, Human
aggauccuuuggccacuucuua

SEQ ID NO: 39527 - RNA, 22 nt, Human
aggauccuuuuucugcuguuug

SEQ ID NO: 39528 - RNA, 22 nt, Human
aggaucugugagugcugcagac

SEQ ID NO: 39529 - RNA, 22 nt, Human
aggaugaauauuuagugggaua

SEQ ID NO: 39530 - RNA, 22 nt, Human
aggaugagagauacauggagca

SEQ ID NO: 39531 - RNA, 22 nt, Human
aggaugccuucauugcauggcc

SEQ ID NO: 39532 - RNA, 22 nt, Human
aggauggauucuguauguggga

SEQ ID NO: 39533 - RNA, 22 nt, Human
aggauggcuugcaggaggcugu

SEQ ID NO: 39534 - RNA, 22 nt, Human
aggauggggucugcagccuggu

SEQ ID NO: 39535 - RNA, 22 nt, Human
aggaugggucagcuagagucca

SEQ ID NO: 39536 - RNA, 23 nt, Human
aggauggguggcaauagaaagac

SEQ ID NO: 39537 - RNA, 23 nt, Human
aggaugugcauaugaccuaauca

SEQ ID NO: 39538 - RNA, 17 nt, Human
aggauguggagaaaauu

SEQ ID NO: 39539 - RNA, 22 nt, Human
aggauguguguaggcugguuaa

SEQ ID NO: 39540 - RNA, 22 nt, Human
aggauguugcuauuggcagucu

SEQ ID NO: 39541 - RNA, 22 nt, Human
aggauucauggugcagacaaag

SEQ ID NO: 39542 - RNA, 22 nt, Human
aggauuuacaaugauucuaggu

SEQ ID NO: 39543 - RNA, 22 nt, Human
aggauuuacuagcaaggauucu

SEQ ID NO: 39544 - RNA, 22 nt, Human
aggauuucugugccuggaaaau

SEQ ID NO: 39545 - RNA, 22 nt, Human
aggauuuuagauaagacagcaa

SEQ ID NO: 39546 - RNA, 21 nt, Human
aggauuuuguugaaguuucug

SEQ ID NO: 39547 - RNA, 22 nt, Human
aggcaaauagauaguccauaca

SEQ ID NO: 39548 - RNA, 22 nt, Human
aggcaacucaucaugaaagacu

SEQ ID NO: 39549 - RNA, 22 nt, Human
aggcaacugacagcauauccug

SEQ ID NO: 39550 - RNA, 22 nt, Human
aggcaagagugacuacgugaaa

SEQ ID NO: 39551 - RNA, 22 nt, Human
aggcaagcagucagucuaugag

SEQ ID NO: 39552 - RNA, 22 nt, Human
aggcaagcccccagugaggcuc

SEQ ID NO: 39553 - RNA, 22 nt, Human
aggcaagcugcagagaguccuu

SEQ ID NO: 39554 - RNA, 20 nt, Human
aggcaagguagaugucugcu

SEQ ID NO: 39555 - RNA, 22 nt, Human
aggcaaggugcuacagacagug

SEQ ID NO: 39556 - RNA, 22 nt, Human
aggcaaggugcucuugcucuau

SEQ ID NO: 39557 - RNA, 22 nt, Human
aggcaauacacagcauuucaca

SEQ ID NO: 39558 - RNA, 22 nt, Human
aggcaauauuccauguggaacu

SEQ ID NO: 39559 - RNA, 17 nt, Human
aggcaaugacugugguu

SEQ ID NO: 39560 - RNA, 22 nt, Human
aggcacagagaaguaaaguauc

SEQ ID NO: 39561 - RNA, 18 nt, Human
aggcacagagcauacaua

SEQ ID NO: 39562 - RNA, 22 nt, Human
aggcacagauuuggggaaagca

SEQ ID NO: 39563 - RNA, 22 nt, Human
aggcacagccucccccaacucc

SEQ ID NO: 39564 - RNA, 22 nt, Human
aggcacaggaggugguaagaag

SEQ ID NO: 39565 - RNA, 22 nt, Human
aggcacagguggacuucacagu

SEQ ID NO: 39566 - RNA, 22 nt, Human
aggcaccuugagagcaggagcu

SEQ ID NO: 39567 - RNA, 22 nt, Human
aggcacugaagugguaaaugua

SEQ ID NO: 39568 - RNA, 23 nt, Human
aggcacugaaugugucagugagu

SEQ ID NO: 39569 - RNA, 22 nt, Human
aggcacugacagauucuguguc

SEQ ID NO: 39570 - RNA, 22 nt, Human
aggcacugaccugcuuccuuga

SEQ ID NO: 39571 - RNA, 22 nt, Human
aggcacugagaggcuguguugc

SEQ ID NO: 39572 - RNA, 22 nt, Human
aggcacugcuucuaaguaggaa

SEQ ID NO: 39573 - RNA, 20 nt, Human
aggcacuggggauagguaag

SEQ ID NO: 39574 - RNA, 22 nt, Human
aggcacugggggaugagcaagg

SEQ ID NO: 39575 - RNA, 22 nt, Human
aggcacuggguaauuaguagcu

SEQ ID NO: 39576 - RNA, 22 nt, Human
aggcacugugcugaugucuuau

SEQ ID NO: 39577 - RNA, 22 nt, Human
aggcacugugcuucuuauaugu

SEQ ID NO: 39578 - RNA, 15 nt, Human
aggcacugugggacc

SEQ ID NO: 39579 - RNA, 22 nt, Human
aggcacuuaauaaggauucaau

SEQ ID NO: 39580 - RNA, 22 nt, Human
aggcacuucauggguucaagga

SEQ ID NO: 39581 - RNA, 22 nt, Human
aggcacuugcauugaugagguc

SEQ ID NO: 39582 - RNA, 22 nt, Human
aggcagaaccagcugggacuuu

SEQ ID NO: 39583 - RNA, 22 nt, Human
aggcagaauguuggaaaggaag

SEQ ID NO: 39584 - RNA, 22 nt, Human
aggcagacaaggucccuggucu

SEQ ID NO: 39585 - RNA, 18 nt, Human
aggcagacacuagagguc

SEQ ID NO: 39586 - RNA, 22 nt, Human
aggcagaccaugaaucaugacc

SEQ ID NO: 39587 - RNA, 16 nt, Human
aggcagagauuuaccc

SEQ ID NO: 39588 - RNA, 23 nt, Human
aggcagagccaaggucaaaaccc

SEQ ID NO: 39589 - RNA, 22 nt, Human
aggcagagcuaggaagaauugu

SEQ ID NO: 39590 - RNA, 22 nt, Human
aggcagaucacaggagggccug

SEQ ID NO: 39591 - RNA, 22 nt, Human
aggcagaucacuugaggccagg

SEQ ID NO: 39592 - RNA, 22 nt, Human
aggcagaugguaacugugauau

SEQ ID NO: 39593 - RNA, 17 nt, Human
aggcagauguuuuauuu

SEQ ID NO: 39594 - RNA, 22 nt, Human
aggcagauuuucuuuacucagu

SEQ ID NO: 39595 - RNA, 22 nt, Human
aggcagcaagauuauuuaaucc

SEQ ID NO: 39596 - RNA, 19 nt, Human
aggcagcacccaguccuug

SEQ ID NO: 39597 - RNA, 22 nt, Human
aggcagcagaaaacaaaugguu

SEQ ID NO: 39598 - RNA, 22 nt, Human
aggcagcagacuguuaaucaga

SEQ ID NO: 39599 - RNA, 22 nt, Human
aggcagcagcuugcugguugcc

SEQ ID NO: 39600 - RNA, 21 nt, Human
aggcagcaggauccagggaca

SEQ ID NO: 39601 - RNA, 22 nt, Human
aggcagcagugauaagauagga

SEQ ID NO: 39602 - RNA, 22 nt, Human
aggcagcauccagaggagaaug

SEQ ID NO: 39603 - RNA, 22 nt, Human
aggcagcauucaggggugauga

SEQ ID NO: 39604 - RNA, 22 nt, Human
aggcagccuauggggagcucag

SEQ ID NO: 39605 - RNA, 22 nt, Human
aggcagccuuuagacagucugc

SEQ ID NO: 39606 - RNA, 22 nt, Human
aggcagccuuuuuggaaacaua

SEQ ID NO: 39607 - RNA, 22 nt, Human
aggcagcugaccacaguaugau

SEQ ID NO: 39608 - RNA, 22 nt, Human
aggcagcuuaagcccuggccca

SEQ ID NO: 39609 - RNA, 22 nt, Human
aggcagcuucugauuagcagcg

SEQ ID NO: 39610 - RNA, 22 nt, Human
aggcagcuuuaacugguaguag

SEQ ID NO: 39611 - RNA, 22 nt, Human
aggcagcuuucuggugcaccau

SEQ ID NO: 39612 - RNA, 22 nt, Human
aggcagcuuuguaguaaagcua

SEQ ID NO: 39613 - RNA, 22 nt, Human
aggcaggagcaagcccuacaag

SEQ ID NO: 39614 - RNA, 22 nt, Human
aggcaggagugacccugacagg

SEQ ID NO: 39615 - RNA, 17 nt, Human
aggcaggcagagcggga

SEQ ID NO: 39616 - RNA, 22 nt, Human
aggcaggcagggcucacugucu

SEQ ID NO: 39617 - RNA, 23 nt, Human
aggcaggcaguucagcuguuguu

SEQ ID NO: 39618 - RNA, 22 nt, Human
aggcaggccuacacaaugggag

SEQ ID NO: 39619 - RNA, 22 nt, Human
aggcagguccccuggaaggcac

SEQ ID NO: 39620 - RNA, 19 nt, Human
aggcaggugcagagguccc

SEQ ID NO: 39621 - RNA, 22 nt, Human
aggcaggugcuuaugacuugcu

SEQ ID NO: 39622 - RNA, 22 nt, Human
aggcaggugggucacuugaguc

SEQ ID NO: 39623 - RNA, 22 nt, Human
aggcagguguugggagacacca

SEQ ID NO: 39624 - RNA, 22 nt, Human
aggcagguuggugagaagacug

SEQ ID NO: 39625 - RNA, 22 nt, Human
aggcagguuucccggcugucaa

SEQ ID NO: 39626 - RNA, 23 nt, Human
aggcagguuugggcucuucuugu

SEQ ID NO: 39627 - RNA, 22 nt, Human
aggcagucuaucucuggagccu

SEQ ID NO: 39628 - RNA, 22 nt, Human
aggcagugagaaauagcaagau

SEQ ID NO: 39629 - RNA, 22 nt, Human
aggcagugaugagucaugaaua

SEQ ID NO: 39630 - RNA, 22 nt, Human
aggcagugcagaguccucuucu

SEQ ID NO: 39631 - RNA, 22 nt, Human
auggcccagaaguuuggaaagg

SEQ ID NO: 39632 - RNA, 22 nt, Human
auggcccaggccaggauccagc

SEQ ID NO: 39633 - RNA, 22 nt, Human
auggcccugccaggaggaacaa

SEQ ID NO: 39634 - RNA, 22 nt, Human
auggcccuguuuaugguaaggc

SEQ ID NO: 39635 - RNA, 20 nt, Human
auggccugcuagaagucugu

SEQ ID NO: 39636 - RNA, 22 nt, Human
auggccugggcccgcuucagau

SEQ ID NO: 39637 - RNA, 22 nt, Human
auggcuaaaccugaacuggucu

SEQ ID NO: 39638 - RNA, 22 nt, Human
auggcuauuuuagagaucaagg

SEQ ID NO: 39639 - RNA, 22 nt, Human
auggcuccagcuuggcuucacc

SEQ ID NO: 39640 - RNA, 22 nt, Human
auggcuccauagcuucguuuag

SEQ ID NO: 39641 - RNA, 22 nt, Human
auggcucugagaaccugagcua

SEQ ID NO: 39642 - RNA, 22 nt, Human
auggcugaggcuggagguggca

SEQ ID NO: 39643 - RNA, 22 nt, Human
auggcugcuuacaaaaacugug

SEQ ID NO: 39644 - RNA, 22 nt, Human
auggcuggcaugugcauaacgg

SEQ ID NO: 39645 - RNA, 22 nt, Human
auggcugggaugggguagagaa

SEQ ID NO: 39646 - RNA, 22 nt, Human
auggcugggucaccaucagggu

SEQ ID NO: 39647 - RNA, 22 nt, Human
auggcugucacgccacugugag

SEQ ID NO: 39648 - RNA, 22 nt, Human
auggcuguccaguuucuagaga

SEQ ID NO: 39649 - RNA, 22 nt, Human
auggcugugaaaugguaggugg

SEQ ID NO: 39650 - RNA, 22 nt, Human
auggcuguuggcaggaggccuc

SEQ ID NO: 39651 - RNA, 22 nt, Human
auggcuucaucuuuuaguccuu

SEQ ID NO: 39652 - RNA, 17 nt, Human
auggcuuccauugacca

SEQ ID NO: 39653 - RNA, 22 nt, Human
auggcuuguucauugguaccug

SEQ ID NO: 39654 - RNA, 22 nt, Human
auggcuuucucuaaugugguau

SEQ ID NO: 39655 - RNA, 17 nt, Human
auggcuuugucacacag

SEQ ID NO: 39656 - RNA, 21 nt, Human
auggcuuuuuuaaagcuugug

SEQ ID NO: 39657 - RNA, 22 nt, Human
augggaagugaagucagggagg

SEQ ID NO: 39658 - RNA, 22 nt, Human
augggaaguguuagaagauuuu

SEQ ID NO: 39659 - RNA, 22 nt, Human
augggacaggcaugggacuuag

SEQ ID NO: 39660 - RNA, 22 nt, Human
augggaggaagagaagaugucu

SEQ ID NO: 39661 - RNA, 18 nt, Human
augggaggggccaagaga

SEQ ID NO: 39662 - RNA, 22 nt, Human
augggagugacagggccacugg

SEQ ID NO: 39663 - RNA, 22 nt, Human
augggagugugcuugaggaguu

SEQ ID NO: 39664 - RNA, 22 nt, Human
augggaugaacuugaucugcuu

SEQ ID NO: 39665 - RNA, 22 nt, Human
augggcaacagcagucacaaug

SEQ ID NO: 39666 - RNA, 22 nt, Human
augggcaggcaagguggcgagu

SEQ ID NO: 39667 - RNA, 22 nt, Human
augggcaguguauuggaaggaa

SEQ ID NO: 39668 - RNA, 23 nt, Human
augggccaagcaagacccaugac

SEQ ID NO: 39669 - RNA, 22 nt, Human
augggcuaaacuuagaggauau

SEQ ID NO: 39670 - RNA, 22 nt, Human
augggcuaucaaauggagguau

SEQ ID NO: 39671 - RNA, 19 nt, Human
augggcuauggugcuguuu

SEQ ID NO: 39672 - RNA, 22 nt, Human
augggcucuaugucuaggagau

SEQ ID NO: 39673 - RNA, 22 nt, Human
augggcugcuuggcuuccaccc

SEQ ID NO: 39674 - RNA, 22 nt, Human
augggcuggcagccugaacagc

SEQ ID NO: 39675 - RNA, 22 nt, Human
augggcuugacccuacagaaag

SEQ ID NO: 39676 - RNA, 22 nt, Human
aggucacuugguguuauucagc

SEQ ID NO: 39677 - RNA, 22 nt, Human
aggucagaaaaggagagcauug

SEQ ID NO: 39678 - RNA, 22 nt, Human
aggucagaagugccagggaauu

SEQ ID NO: 39679 - RNA, 22 nt, Human
aggucagcaugaguagaaggua

SEQ ID NO: 39680 - RNA, 22 nt, Human
aggucagcuagacagcucucug

SEQ ID NO: 39681 - RNA, 22 nt, Human
aggucagcugugugugcaugag

SEQ ID NO: 39682 - RNA, 22 nt, Human
aggucaggaggccucugccauu

SEQ ID NO: 39683 - RNA, 22 nt, Human
aggucagguaucagcagguauu

SEQ ID NO: 39684 - RNA, 22 nt, Human
aggucauuccagccauuccccu

SEQ ID NO: 39685 - RNA, 19 nt, Human
aggucauugauagugcagg

SEQ ID NO: 39686 - RNA, 22 nt, Human
agguccagaacgugccuacucu

SEQ ID NO: 39687 - RNA, 22 nt, Human
agguccagaggcuccuuauuac

SEQ ID NO: 39688 - RNA, 22 nt, Human
agguccagagguugaacggugg

SEQ ID NO: 39689 - RNA, 22 nt, Human
agguccaggagauuuggcaauu

SEQ ID NO: 39690 - RNA, 22 nt, Human
agguccaggauuuguggggucu

SEQ ID NO: 39691 - RNA, 22 nt, Human
agguccaggcauuuggguuggg

SEQ ID NO: 39692 - RNA, 22 nt, Human
agguccagguuccguuucugcg

SEQ ID NO: 39693 - RNA, 22 nt, Human
agguccagugcucuuggugguu

SEQ ID NO: 39694 - RNA, 21 nt, Human
agguccaguucugucuuggac

SEQ ID NO: 39695 - RNA, 22 nt, Human
agguccaguuuucugacaaggg

SEQ ID NO: 39696 - RNA, 22 nt, Human
aggucccaguguuagggugaca

SEQ ID NO: 39697 - RNA, 19 nt, Human
aggucccucccucgaggcu

SEQ ID NO: 39698 - RNA, 22 nt, Human
aggucccugcagcagacugcca

SEQ ID NO: 39699 - RNA, 22 nt, Human
agguccugaagauuuuacuaga

SEQ ID NO: 39700 - RNA, 22 nt, Human
agguccugacgcccuuugaaau

SEQ ID NO: 39701 - RNA, 22 nt, Human
agguccugacuccacguucuag

SEQ ID NO: 39702 - RNA, 23 nt, Human
agguccuggacauaugugcauca

SEQ ID NO: 39703 - RNA, 22 nt, Human
agguccuggugaccauggaguu

SEQ ID NO: 39704 - RNA, 20 nt, Human
agguccugguucucugggau

SEQ ID NO: 39705 - RNA, 22 nt, Human
agguccuguccuuggucucuga

SEQ ID NO: 39706 - RNA, 22 nt, Human
agguccuguguccaggggccug

SEQ ID NO: 39707 - RNA, 20 nt, Human
agguccuguuccuugucucc

SEQ ID NO: 39708 - RNA, 22 nt, Human
agguccuuaacauagugauauc

SEQ ID NO: 39709 - RNA, 22 nt, Human
aggucucaagagaaaaguggug

SEQ ID NO: 39710 - RNA, 22 nt, Human
aggucucaauuccugcuccugu

SEQ ID NO: 39711 - RNA, 22 nt, Human
aggucuccucauauucugccuc

SEQ ID NO: 39712 - RNA, 22 nt, Human
aggucucugaguacugcuggac

SEQ ID NO: 39713 - RNA, 22 nt, Human
aggucucugcccacacaggcuu

SEQ ID NO: 39714 - RNA, 22 nt, Human
aggucugagaacuaccuauagg

SEQ ID NO: 39715 - RNA, 22 nt, Human
aggucugagagccgcuuucccc

SEQ ID NO: 39716 - RNA, 17 nt, Human
aggucugagaguaucug

SEQ ID NO: 39717 - RNA, 22 nt, Human
aggucugaguagagaaaaggca

SEQ ID NO: 39718 - RNA, 19 nt, Human
aggucugcagcugcaguuu

SEQ ID NO: 39719 - RNA, 23 nt, Human
aggucuggacccuuggccccugc

SEQ ID NO: 39720 - RNA, 22 nt, Human
aggucuggcucuucuccacaga

SEQ ID NO: 39721 - RNA, 22 nt, Human
aggucugguauuuuucuauacu

SEQ ID NO: 39722 - RNA, 22 nt, Human
aggucugguguugggccugaaa

SEQ ID NO: 39723 - RNA, 20 nt, Human
aggucuuccaaucagcuccu

SEQ ID NO: 39724 - RNA, 19 nt, Human
aggucuugacucuguucuu

SEQ ID NO: 39725 - RNA, 22 nt, Human
aggucuugugaaggacugugcc

SEQ ID NO: 39726 - RNA, 22 nt, Human
aggugacuacuauuuuaaaaua

SEQ ID NO: 39727 - RNA, 22 nt, Human
aggugagggugccagugcaugg

SEQ ID NO: 39728 - RNA, 22 nt, Human
aggugaguccugggcacaggua

SEQ ID NO: 39729 - RNA, 19 nt, Human
aggugagugugggaaaggg

SEQ ID NO: 39730 - RNA, 21 nt, Human
aggugcagagccagggaccag

SEQ ID NO: 39731 - RNA, 19 nt, Human
aggugcaggucacagggga

SEQ ID NO: 39732 - RNA, 22 nt, Human
aggugcagugaaggaaaaggaa

SEQ ID NO: 39733 - RNA, 22 nt, Human
aggugcaguguuuaaaaguagc

SEQ ID NO: 39734 - RNA, 23 nt, Human
aggugccaacugagagcugagag

SEQ ID NO: 39735 - RNA, 22 nt, Human
aggugccugggagcucccugag

SEQ ID NO: 39736 - RNA, 22 nt, Human
aggugcuagguguguaguggag

SEQ ID NO: 39737 - RNA, 17 nt, Human
aggugcuggagcaucag

SEQ ID NO: 39738 - RNA, 21 nt, Human
aggugcuggcgccccaggaga

SEQ ID NO: 39739 - RNA, 22 nt, Human
agguggagugaaggaaaggcag

SEQ ID NO: 39740 - RNA, 21 nt, Human
agguggagugcuuagcaucca

SEQ ID NO: 39741 - RNA, 22 nt, Human
agggccagggaaacgaucagca

SEQ ID NO: 39742 - RNA, 22 nt, Human
agggccaguaccaggugggugg

SEQ ID NO: 39743 - RNA, 22 nt, Human
agggccaguucagaggacaugg

SEQ ID NO: 39744 - RNA, 22 nt, Human
agggccaguucuaccucugaau

SEQ ID NO: 39745 - RNA, 23 nt, Human
agggcccaagccuggacagcagg

SEQ ID NO: 39746 - RNA, 22 nt, Human
agggcccagcccuugcuggucu

SEQ ID NO: 39747 - RNA, 22 nt, Human
agggccccaguaagauuacaug

SEQ ID NO: 39748 - RNA, 22 nt, Human
agggccccauagucacugcccg

SEQ ID NO: 39749 - RNA, 22 nt, Human
agggcccucuggcaggccaggc

SEQ ID NO: 39750 - RNA, 22 nt, Human
agggcccuggggugcacugaca

SEQ ID NO: 39751 - RNA, 18 nt, Human
agggcccugguggccauu

SEQ ID NO: 39752 - RNA, 23 nt, Human
agggccucaggagggcugcaugg

SEQ ID NO: 39753 - RNA, 22 nt, Human
agggccucuaccauccaagguu

SEQ ID NO: 39754 - RNA, 22 nt, Human
agggccucucugggccuuuccu

SEQ ID NO: 39755 - RNA, 22 nt, Human
agggccucuggaacacugaggg

SEQ ID NO: 39756 - RNA, 21 nt, Human
agggccucuguguacuggggg

SEQ ID NO: 39757 - RNA, 22 nt, Human
agggccugagaccguggcuuga

SEQ ID NO: 39758 - RNA, 19 nt, Human
agggccugagcagauguug

SEQ ID NO: 39759 - RNA, 22 nt, Human
agggccugcucuaucacucuca

SEQ ID NO: 39760 - RNA, 20 nt, Human
agggccugcucugugguguc

SEQ ID NO: 39761 - RNA, 22 nt, Human
agggccuggaacugugggcagg

SEQ ID NO: 39762 - RNA, 22 nt, Human
agggccuggcuucacuuucuca

SEQ ID NO: 39763 - RNA, 22 nt, Human
agggccugucuguagaacugaa

SEQ ID NO: 39764 - RNA, 22 nt, Human
agggccugugaauucucccugc

SEQ ID NO: 39765 - RNA, 22 nt, Human
agggccugugcuuccugagaua

SEQ ID NO: 39766 - RNA, 20 nt, Human
agggccuguugcaagcguuu

SEQ ID NO: 39767 - RNA, 22 nt, Human
agggccuugcugucugaagcug

SEQ ID NO: 39768 - RNA, 22 nt, Human
agggcgaggagacggaggcaca

SEQ ID NO: 39769 - RNA, 22 nt, Human
agggcgccugcuguggccaccg

SEQ ID NO: 39770 - RNA, 22 nt, Human
agggcgcugaaauacuaacaug

SEQ ID NO: 39771 - RNA, 22 nt, Human
agggcgcugucuggccagcggu

SEQ ID NO: 39772 - RNA, 22 nt, Human
agggcuacugccugccuucagg

SEQ ID NO: 39773 - RNA, 22 nt, Human
agggcuagaguugagaugggga

SEQ ID NO: 39774 - RNA, 22 nt, Human
agggcuaggaauggaacuggag

SEQ ID NO: 39775 - RNA, 19 nt, Human
agggcuaggcacauagggc

SEQ ID NO: 39776 - RNA, 22 nt, Human
agggcucaagggcaugcuacgu

SEQ ID NO: 39777 - RNA, 22 nt, Human
agggcucaauggugggcaugua

SEQ ID NO: 39778 - RNA, 22 nt, Human
agggcucagaacaaugagugua

SEQ ID NO: 39779 - RNA, 22 nt, Human
agggcucagccuccuccucagc

SEQ ID NO: 39780 - RNA, 22 nt, Human
agggcucaggggccccaagcug

SEQ ID NO: 39781 - RNA, 22 nt, Human
agggcucaguaaacgguggauu

SEQ ID NO: 39782 - RNA, 22 nt, Human
agggcucauaauuccugacuuc

SEQ ID NO: 39783 - RNA, 22 nt, Human
agggcuccaggggcugggugac

SEQ ID NO: 39784 - RNA, 22 nt, Human
agggcuccgggcaggcgaugga

SEQ ID NO: 39785 - RNA, 22 nt, Human
agggcuccuccccggccuccac

SEQ ID NO: 39786 - RNA, 22 nt, Human
agggcucugagcuggaccaccu

SEQ ID NO: 39787 - RNA, 22 nt, Human
agggcucugggguggcagagau

SEQ ID NO: 39788 - RNA, 22 nt, Human
agggcucuguccccagaggccc

SEQ ID NO: 39789 - RNA, 22 nt, Human
agggcucuguuggggucagcac

SEQ ID NO: 39790 - RNA, 22 nt, Human
agggcugaaacauaauccuucu

SEQ ID NO: 39791 - RNA, 22 nt, Human
agggcugaaguuauggcugagc

SEQ ID NO: 39792 - RNA, 22 nt, Human
agggcugacagugaggagucaa

SEQ ID NO: 39793 - RNA, 22 nt, Human
agggcugacaguggcguggcgu

SEQ ID NO: 39794 - RNA, 22 nt, Human
agggcugagugggagagaguug

SEQ ID NO: 39795 - RNA, 22 nt, Human
agggcugaugcaccauguagcc

SEQ ID NO: 39796 - RNA, 19 nt, Human
agucacagggaagaggaac

SEQ ID NO: 39797 - RNA, 22 nt, Human
agucacauagcucugguuucuu

SEQ ID NO: 39798 - RNA, 22 nt, Human
agucacauaguguuuuggaauc

SEQ ID NO: 39799 - RNA, 22 nt, Human
agucacauggacucaggaugac

SEQ ID NO: 39800 - RNA, 22 nt, Human
agucacaugggauuagaaccca

SEQ ID NO: 39801 - RNA, 20 nt, Human
agucacauugagcuuuugga

SEQ ID NO: 39802 - RNA, 22 nt, Human
agucaccaggguuugcuggguu

SEQ ID NO: 39803 - RNA, 22 nt, Human
agucaccagguuuuagagaccu

SEQ ID NO: 39804 - RNA, 22 nt, Human
agucaccaucuguggcagccug

SEQ ID NO: 39805 - RNA, 22 nt, Human
agucaccuugaaaugucuugaa

SEQ ID NO: 39806 - RNA, 22 nt, Human
agucacuguuuaaucuagcuaa

SEQ ID NO: 39807 - RNA, 22 nt, Human
agucacuguuucagaacugagu

SEQ ID NO: 39808 - RNA, 22 nt, Human
agucacuuccagacaccugccu

SEQ ID NO: 39809 - RNA, 22 nt, Human
agucagaagggcccuuccuucc

SEQ ID NO: 39810 - RNA, 22 nt, Human
agucagagaauaaagaaugcau

SEQ ID NO: 39811 - RNA, 22 nt, Human
agucagagcuauguuguuauau

SEQ ID NO: 39812 - RNA, 22 nt, Human
agucagaggaaugggccaggcu

SEQ ID NO: 39813 - RNA, 22 nt, Human
agucagaguuuugaggugugac

SEQ ID NO: 39814 - RNA, 22 nt, Human
agucagcagugaaagcacagcc

SEQ ID NO: 39815 - RNA, 22 nt, Human
agucagcauauauggaguaagg

SEQ ID NO: 39816 - RNA, 22 nt, Human
agucagcauuuucacugagcua

SEQ ID NO: 39817 - RNA, 22 nt, Human
agucagcugcugcacacagcag

SEQ ID NO: 39818 - RNA, 22 nt, Human
agucagcuuggcuccucccaug

SEQ ID NO: 39819 - RNA, 22 nt, Human
agucaggagauauuuugauaug

SEQ ID NO: 39820 - RNA, 22 nt, Human
agucaggagcugcugcauugua

SEQ ID NO: 39821 - RNA, 22 nt, Human
agucagggguuggacggggcca

SEQ ID NO: 39822 - RNA, 22 nt, Human
agucaggguuguaggcucaccc

SEQ ID NO: 39823 - RNA, 22 nt, Human
agucagguacuccgagggcaug

SEQ ID NO: 39824 - RNA, 22 nt, Human
agucaggugguucugcuccacu

SEQ ID NO: 39825 - RNA, 22 nt, Human
agucaguagauccaaacuuuug

SEQ ID NO: 39826 - RNA, 22 nt, Human
agucaguauuuauuacuuagcu

SEQ ID NO: 39827 - RNA, 22 nt, Human
agucagugaaggcauugcucaa

SEQ ID NO: 39828 - RNA, 22 nt, Human
agucagugaaugguguaugcua

SEQ ID NO: 39829 - RNA, 23 nt, Human
agucagugcgggauggucagggg

SEQ ID NO: 39830 - RNA, 22 nt, Human
agucaguuaaccucacagcauc

SEQ ID NO: 39831 - RNA, 22 nt, Human
agucaguucauggcucuguccu

SEQ ID NO: 39832 - RNA, 19 nt, Human
agucaguucugaggaggaa

SEQ ID NO: 39833 - RNA, 22 nt, Human
agucaguugcaaacaucaggca

SEQ ID NO: 39834 - RNA, 22 nt, Human
agucaguuguggagauuuaacu

SEQ ID NO: 39835 - RNA, 22 nt, Human
agucauaaagccagugggaggc

SEQ ID NO: 39836 - RNA, 22 nt, Human
agucauauggcuauuuaguggg

SEQ ID NO: 39837 - RNA, 22 nt, Human
agucauauguggcauuuucuaa

SEQ ID NO: 39838 - RNA, 22 nt, Human
agucaucaucugcccucacugg

SEQ ID NO: 39839 - RNA, 22 nt, Human
agucauccaagagccugggcag

SEQ ID NO: 39840 - RNA, 19 nt, Human
agucaucucacugugccca

SEQ ID NO: 39841 - RNA, 22 nt, Human
agucaugacuccauuggucaag

SEQ ID NO: 39842 - RNA, 22 nt, Human
agucauguaaucacaaugaccu

SEQ ID NO: 39843 - RNA, 23 nt, Human
agucauuaagaaguucaggaacu

SEQ ID NO: 39844 - RNA, 22 nt, Human
agucauuuaucuuagccauuau

SEQ ID NO: 39845 - RNA, 22 nt, Human
agucauuucccauucuucauau

SEQ ID NO: 39846 - RNA, 22 nt, Human
aguccaagaucaaggugucaac

SEQ ID NO: 39847 - RNA, 22 nt, Human
aguccagaacuucagcuaguuu

SEQ ID NO: 39848 - RNA, 22 nt, Human
aguccagaucaugcagcaaacc

SEQ ID NO: 39849 - RNA, 22 nt, Human
aguccaggaagcaucauggucu

SEQ ID NO: 39850 - RNA, 22 nt, Human
agugggagggccauauggugaa

SEQ ID NO: 39851 - RNA, 19 nt, Human
agugggcaaggaagaugac

SEQ ID NO: 39852 - RNA, 22 nt, Human
agugggcaugaucuggugucug

SEQ ID NO: 39853 - RNA, 22 nt, Human
agugggcccuugucacacugau

SEQ ID NO: 39854 - RNA, 22 nt, Human
aguggggaagauuuugcaguca

SEQ ID NO: 39855 - RNA, 23 nt, Human
aguggggaaucaacagauucuuu

SEQ ID NO: 39856 - RNA, 22 nt, Human
aguggggacuuaugccagcauu

SEQ ID NO: 39857 - RNA, 22 nt, Human
aguggggccggugaggccgagg

SEQ ID NO: 39858 - RNA, 22 nt, Human
agugggguccaucccuucccuc

SEQ ID NO: 39859 - RNA, 22 nt, Human
aguggguguagucuuccuccug

SEQ ID NO: 39860 - RNA, 19 nt, Human
agugguagaugagcaggag

SEQ ID NO: 39861 - RNA, 22 nt, Human
aguggucaaagacuagauuuca

SEQ ID NO: 39862 - RNA, 22 nt, Human
agugguccugcaaacccgugug

SEQ ID NO: 39863 - RNA, 22 nt, Human
aguggucuagucugaggauuau

SEQ ID NO: 39864 - RNA, 22 nt, Human
aguggucugggcuaaaugaggu

SEQ ID NO: 39865 - RNA, 22 nt, Human
aguggugagaccuggugcuuuc

SEQ ID NO: 39866 - RNA, 22 nt, Human
aguggugcccaccugagccuga

SEQ ID NO: 39867 - RNA, 22 nt, Human
aguguacaaaaugauagauaaa

SEQ ID NO: 39868 - RNA, 22 nt, Human
aguguacauguuuacagcaucu

SEQ ID NO: 39869 - RNA, 22 nt, Human
aguguagaugaaauuaaaccca

SEQ ID NO: 39870 - RNA, 22 nt, Human
aguguaggguggucagagcaga

SEQ ID NO: 39871 - RNA, 22 nt, Human
aguguaucaugguuggcagaca

SEQ ID NO: 39872 - RNA, 22 nt, Human
aguguauguccugaggggagaa

SEQ ID NO: 39873 - RNA, 22 nt, Human
aguguauuaaaaugcuccuaag

SEQ ID NO: 39874 - RNA, 22 nt, Human
aguguauuaaguuaugaaguua

SEQ ID NO: 39875 - RNA, 22 nt, Human
aguguauuacagaacugacauu

SEQ ID NO: 39876 - RNA, 22 nt, Human
aguguauucagaauguagcaaa

SEQ ID NO: 39877 - RNA, 22 nt, Human
agugucaaaucagcaucugggu

SEQ ID NO: 39878 - RNA, 22 nt, Human
agugucaauaauuucuuuuugg

SEQ ID NO: 39879 - RNA, 22 nt, Human
agugucaauucucaaaucucgg

SEQ ID NO: 39880 - RNA, 17 nt, Human
agugucagaagacaguu

SEQ ID NO: 39881 - RNA, 22 nt, Human
agugucagcuaauuauucauga

SEQ ID NO: 39882 - RNA, 22 nt, Human
agugucauaaggagaaauuaca

SEQ ID NO: 39883 - RNA, 22 nt, Human
agugucauuccagggacccucg

SEQ ID NO: 39884 - RNA, 21 nt, Human
agugucauucccaagcuguga

SEQ ID NO: 39885 - RNA, 22 nt, Human
aguguccuacagcuccugccug

SEQ ID NO: 39886 - RNA, 19 nt, Human
aguguccuagucauuugcc

SEQ ID NO: 39887 - RNA, 22 nt, Human
aguguccugugucccagacugu

SEQ ID NO: 39888 - RNA, 22 nt, Human
aguguccuuucuguuccagcca

SEQ ID NO: 39889 - RNA, 22 nt, Human
agugucucagccccaacuagag

SEQ ID NO: 39890 - RNA, 22 nt, Human
agugucugagcuaucauuaggg

SEQ ID NO: 39891 - RNA, 22 nt, Human
agugucugaguaaauuucucau

SEQ ID NO: 39892 - RNA, 23 nt, Human
agugucugagugcaggcugugca

SEQ ID NO: 39893 - RNA, 22 nt, Human
agugucugcaaaaugaaagagc

SEQ ID NO: 39894 - RNA, 22 nt, Human
agugucugccugggaggagcau

SEQ ID NO: 39895 - RNA, 22 nt, Human
agugucugcgggcagaggagcg

SEQ ID NO: 39896 - RNA, 22 nt, Human
agugucugcuuaucaguucuug

SEQ ID NO: 39897 - RNA, 22 nt, Human
agugucugugcuuugcagcaaa

SEQ ID NO: 39898 - RNA, 22 nt, Human
agugucuuucauauccuccauc

SEQ ID NO: 39899 - RNA, 22 nt, Human
agugucuuugucucucaagcac

SEQ ID NO: 39900 - RNA, 22 nt, Human
agugugacauuuucaugaauuu

SEQ ID NO: 39901 - RNA, 22 nt, Human
agugugacuacauuacaagagu

SEQ ID NO: 39902 - RNA, 23 nt, Human
agugugacuuuuuugacugucac

SEQ ID NO: 39903 - RNA, 22 nt, Human
agugugagaugauugaggagca

SEQ ID NO: 39904 - RNA, 22 nt, Human
agugugaguaauucagggaggg

SEQ ID NO: 39905 - RNA, 19 nt, Human
agugugaguaauuggaguu

SEQ ID NO: 39906 - RNA, 22 nt, Human
agugugaguuacaaagugugaa

SEQ ID NO: 39907 - RNA, 22 nt, Human
agugugaguuugguugagacuu

SEQ ID NO: 39908 - RNA, 22 nt, Human
agugugcugcuuaaacaguugu

SEQ ID NO: 39909 - RNA, 22 nt, Human
agugugcuguuuccagaagggc

SEQ ID NO: 39910 - RNA, 22 nt, Human
agugugcuuaaguuuaucagga

SEQ ID NO: 39911 - RNA, 22 nt, Human
aguguggacuuuuccuaggagg

SEQ ID NO: 39912 - RNA, 22 nt, Human
aguguggauuggcuggagcuau

SEQ ID NO: 39913 - RNA, 22 nt, Human
aguguggcaggaaugacuagaa

SEQ ID NO: 39914 - RNA, 22 nt, Human
aguguguaagggaucaaagagu

SEQ ID NO: 39915 - RNA, 22 nt, Human
aguguguacauaauuguacgcc

SEQ ID NO: 39916 - RNA, 22 nt, Human
aguguguacauuuggugcaguu

SEQ ID NO: 39917 - RNA, 22 nt, Human
aguguguagcauuuggcaggca

SEQ ID NO: 39918 - RNA, 22 nt, Human
aguguguccagaaaucuguauu

SEQ ID NO: 39919 - RNA, 22 nt, Human
aguguguccaggaagcagaugg

SEQ ID NO: 39920 - RNA, 22 nt, Human
agugugucgagggaggguccag

SEQ ID NO: 39921 - RNA, 20 nt, Human
agugugucucggagguaagu

SEQ ID NO: 39922 - RNA, 22 nt, Human
agugugugccuuuggauaccug

SEQ ID NO: 39923 - RNA, 21 nt, Human
aguguguucuuggcauuaccu

SEQ ID NO: 39924 - RNA, 19 nt, Human
aguguuaacccaguguugg

SEQ ID NO: 39925 - RNA, 21 nt, Human
aguguuaauggaaauuauauu

SEQ ID NO: 39926 - RNA, 22 nt, Human
aguguuacugguucaugaaucu

SEQ ID NO: 39927 - RNA, 23 nt, Human
aguguucagcauguaguaaauac

SEQ ID NO: 39928 - RNA, 22 nt, Human
aguguucaggaucugaggccag

SEQ ID NO: 39929 - RNA, 23 nt, Human
aguguuccaguugguugagagug

SEQ ID NO: 39930 - RNA, 22 nt, Human
aguguuccugcucucaggaagc

SEQ ID NO: 39931 - RNA, 22 nt, Human
aguguucuaacaacugcuuuca

SEQ ID NO: 39932 - RNA, 19 nt, Human
aguguucugaguacuccuc

SEQ ID NO: 39933 - RNA, 22 nt, Human
aguguucuuguuucuaagcaaa

SEQ ID NO: 39934 - RNA, 22 nt, Human
aguguuguaauaaauaucaucu

SEQ ID NO: 39935 - RNA, 22 nt, Human
aguguuuaaguuacacacauau

SEQ ID NO: 39936 - RNA, 22 nt, Human
aguguuuacagaguaguggaaa

SEQ ID NO: 39937 - RNA, 22 nt, Human
aguguuuagaggaggaaagaug

SEQ ID NO: 39938 - RNA, 22 nt, Human
aguguuuaguuaagauuucaaa

SEQ ID NO: 39939 - RNA, 22 nt, Human
aguguuuauauuauggaaauau

SEQ ID NO: 39940 - RNA, 22 nt, Human
aguguuuauggaacccuggugg

SEQ ID NO: 39941 - RNA, 19 nt, Human
aguguuuauguagugccua

SEQ ID NO: 39942 - RNA, 23 nt, Human
aguguuuauguucagugacccuc

SEQ ID NO: 39943 - RNA, 18 nt, Human
aguguuuauuuaggugaa

SEQ ID NO: 39944 - RNA, 19 nt, Human
aguguuucaugugcuuuua

SEQ ID NO: 39945 - RNA, 22 nt, Human
aguguuuccugaguguuaucau

SEQ ID NO: 39946 - RNA, 17 nt, Human
aguguuuccuuaucauu

SEQ ID NO: 39947 - RNA, 22 nt, Human
aguguuucuaaguagaugugaa

SEQ ID NO: 39948 - RNA, 20 nt, Human
aguguuugcucacagucucc

SEQ ID NO: 39949 - RNA, 22 nt, Human
auuugcuugacuauggcuugca

SEQ ID NO: 39950 - RNA, 22 nt, Human
auuugcuuucagguauaaaagg

SEQ ID NO: 39951 - RNA, 22 nt, Human
auuugcuuuuacuauguuaaaa

SEQ ID NO: 39952 - RNA, 22 nt, Human
auuuggaaaaucugguuauaga

SEQ ID NO: 39953 - RNA, 22 nt, Human
auuuggaagcuugaagauuauu

SEQ ID NO: 39954 - RNA, 22 nt, Human
auuuggaaguuuggagugaagg

SEQ ID NO: 39955 - RNA, 22 nt, Human
auuuggacauuuacaauaguga

SEQ ID NO: 39956 - RNA, 21 nt, Human
auuuggauauugcuggcaaau

SEQ ID NO: 39957 - RNA, 22 nt, Human
auuuggaugcacuaaauaaaau

SEQ ID NO: 39958 - RNA, 22 nt, Human
auuuggcaacauuaauugaauc

SEQ ID NO: 39959 - RNA, 22 nt, Human
caaagguuguugagagugcagg

SEQ ID NO: 39960 - RNA, 22 nt, Human
caaaguaaacuaccacuguuuc

SEQ ID NO: 39961 - RNA, 22 nt, Human
caaaguaauauggucccaguga

SEQ ID NO: 39962 - RNA, 22 nt, Human
caaaguauauuucauagucuca

SEQ ID NO: 39963 - RNA, 22 nt, Human
caaaguaugaaccaguuucucu

SEQ ID NO: 39964 - RNA, 22 nt, Human
caaagucauggggaugcagguc

SEQ ID NO: 39965 - RNA, 22 nt, Human
caaagugccuguaccacuuugc

SEQ ID NO: 39966 - RNA, 22 nt, Human
caaagugcuaggauuacaggcc

SEQ ID NO: 39967 - RNA, 22 nt, Human
caaagugcuggaauuauagggg

SEQ ID NO: 39968 - RNA, 22 nt, Human
caaagugcugggauuagugcug

SEQ ID NO: 39969 - RNA, 22 nt, Human
caaaguggagagccugugguug

SEQ ID NO: 39970 - RNA, 22 nt, Human
caaaguuaugaaugauaagauu

SEQ ID NO: 39971 - RNA, 22 nt, Human
caaaguucucggcucaaguccu

SEQ ID NO: 39972 - RNA, 22 nt, Human
caaaguuuaaaguagauuucag

SEQ ID NO: 39973 - RNA, 22 nt, Human
caaaguuuuaguaaacauauau

SEQ ID NO: 39974 - RNA, 22 nt, Human
caaauaagcaauuccauucuuc

SEQ ID NO: 39975 - RNA, 22 nt, Human
caaauacucuggauguguuugu

SEQ ID NO: 39976 - RNA, 22 nt, Human
caaauacugaguuuauuuucaa

SEQ ID NO: 39977 - RNA, 22 nt, Human
caaauacuguacugaacacugu

SEQ ID NO: 39978 - RNA, 21 nt, Human
caaauacuuagaaacuuaaga

SEQ ID NO: 39979 - RNA, 22 nt, Human
caaauacuuuauauacuucaaa

SEQ ID NO: 39980 - RNA, 22 nt, Human
caaauagaacucacagacaaga

SEQ ID NO: 39981 - RNA, 22 nt, Human
caaauagaagguacucagagaa

SEQ ID NO: 39982 - RNA, 22 nt, Human
caaauagacaagauggcaggaa

SEQ ID NO: 39983 - RNA, 22 nt, Human
caaauagacuuaagcaucugua

SEQ ID NO: 39984 - RNA, 22 nt, Human
caaauagauuguucaauccuga

SEQ ID NO: 39985 - RNA, 22 nt, Human
caaaucaccacuuaauggguua

SEQ ID NO: 39986 - RNA, 22 nt, Human
caaaugaauagggagugugaug

SEQ ID NO: 39987 - RNA, 22 nt, Human
caaaugaauauuuccauggguu

SEQ ID NO: 39988 - RNA, 22 nt, Human
caaaugauaccuauuacuaggc

SEQ ID NO: 39989 - RNA, 22 nt, Human
caaaugauacuguuuuuagucu

SEQ ID NO: 39990 - RNA, 22 nt, Human
caaaugauagagccgauuauca

SEQ ID NO: 39991 - RNA, 22 nt, Human
caaaugauccuugcaagcugug

SEQ ID NO: 39992 - RNA, 22 nt, Human
caaaugcagauucaggaguucu

SEQ ID NO: 39993 - RNA, 22 nt, Human
caaaugcaggucagcagguguc

SEQ ID NO: 39994 - RNA, 22 nt, Human
caaaugccaggaaucucugaag

SEQ ID NO: 39995 - RNA, 22 nt, Human
caaaugcuggcccugcuacuua

SEQ ID NO: 39996 - RNA, 21 nt, Human
caaaugcuggcuggaugagga

SEQ ID NO: 39997 - RNA, 22 nt, Human
caaauggcaacaagaacacugg

SEQ ID NO: 39998 - RNA, 20 nt, Human
caaauggcuuuuauuuccuu

SEQ ID NO: 39999 - RNA, 22 nt, Human
caaauguaaauucuuuugaagc

SEQ ID NO: 40000 - RNA, 22 nt, Human
caaauguauguuuuccuaugua

SEQ ID NO: 40001 - RNA, 22 nt, Human
caaaugugguuucucagcauuc

SEQ ID NO: 40002 - RNA, 22 nt, Human
caaauguguaaggaaguguuag

SEQ ID NO: 40003 - RNA, 22 nt, Human
caaauguuaaauguguuaagac

SEQ ID NO: 40004 - RNA, 22 nt, Human
caaauguuucuugaacaccaac

SEQ ID NO: 40005 - RNA, 22 nt, Human
caaauguuugcaucacagggca

SEQ ID NO: 40006 - RNA, 22 nt, Human
caaauguuuuuauucuacaaca

SEQ ID NO: 40007 - RNA, 22 nt, Human
caaauguuuuuuaguauaagua

SEQ ID NO: 40008 - RNA, 22 nt, Human
caaauucagaaaauugguagag

SEQ ID NO: 40009 - RNA, 23 nt, Human
caaauucuaggcaggcucuuuug

SEQ ID NO: 40010 - RNA, 22 nt, Human
caaauucucaagguuuauccca

SEQ ID NO: 40011 - RNA, 20 nt, Human
caaauucuguugaauacacc

SEQ ID NO: 40012 - RNA, 22 nt, Human
caaauugcuaacugucagacua

SEQ ID NO: 40013 - RNA, 22 nt, Human
caaauuuuguguguucucuagu

SEQ ID NO: 40014 - RNA, 22 nt, Human
caacaagcgcucagagcaaagc

SEQ ID NO: 40015 - RNA, 22 nt, Human
caacaaguggguacuuuacagg

SEQ ID NO: 40016 - RNA, 22 nt, Human
caacaauaugccagacucaauu

SEQ ID NO: 40017 - RNA, 22 nt, Human
caacaccuugaucuuggacuuc

SEQ ID NO: 40018 - RNA, 20 nt, Human
caacacugcccauuguuugc

SEQ ID NO: 40019 - RNA, 23 nt, Human
caacacugccuucaggugaagaa

SEQ ID NO: 40020 - RNA, 22 nt, Human
caacagaaggaagcagggucag

SEQ ID NO: 40021 - RNA, 22 nt, Human
caacagcuggaggcuuggcccg

SEQ ID NO: 40022 - RNA, 23 nt, Human
caacagcuguuagauaugggcuu

SEQ ID NO: 40023 - RNA, 22 nt, Human
caacagcuuuagaaacacuuuc

SEQ ID NO: 40024 - RNA, 19 nt, Human
caacaguacugguuugucc

SEQ ID NO: 40025 - RNA, 22 nt, Human
caacagucagaaugaagcugag

SEQ ID NO: 40026 - RNA, 22 nt, Human
caacauaugauuuuguauauaa

SEQ ID NO: 40027 - RNA, 22 nt, Human
caacauggcgaaaccccaucuc

SEQ ID NO: 40028 - RNA, 22 nt, Human
caacauucuuaucacuauaagc

SEQ ID NO: 40029 - RNA, 22 nt, Human
caacauuuucauggccagggag

SEQ ID NO: 40030 - RNA, 22 nt, Human
caacccaaaagcguuuccauuu

SEQ ID NO: 40031 - RNA, 22 nt, Human
caacccucucgccucaauucug

SEQ ID NO: 40032 - RNA, 22 nt, Human
caaccucuguaauguucuagga

SEQ ID NO: 40033 - RNA, 22 nt, Human
caaccucuuugggccuugguuu

SEQ ID NO: 40034 - RNA, 22 nt, Human
caacuaauccuuugaaaagaag

SEQ ID NO: 40035 - RNA, 22 nt, Human
caacuacuggugcucaggaaau

SEQ ID NO: 40036 - RNA, 22 nt, Human
caacuauauagaaauugauugu

SEQ ID NO: 40037 - RNA, 22 nt, Human
caacucagacuggauuaaauaa

SEQ ID NO: 40038 - RNA, 22 nt, Human
caacucauguccaacuuucuuu

SEQ ID NO: 40039 - RNA, 22 nt, Human
caacuccuccccagcaugccaa

SEQ ID NO: 40040 - RNA, 22 nt, Human
caacugaacugauaucaacuau

SEQ ID NO: 40041 - RNA, 22 nt, Human
caacugagcaguagcgucugga

SEQ ID NO: 40042 - RNA, 22 nt, Human
caacugcugacaccaucacucc

SEQ ID NO: 40043 - RNA, 22 nt, Human
caacugcuuggaggaauacugc

SEQ ID NO: 40044 - RNA, 17 nt, Human
caacuucacaaacuguc

SEQ ID NO: 40045 - RNA, 22 nt, Human
caacuuuaauuugggugucaga

SEQ ID NO: 40046 - RNA, 22 nt, Human
caacuuuugacacgugugcuaa

SEQ ID NO: 40047 - RNA, 22 nt, Human
caagaaaugggauuugacugcc

SEQ ID NO: 40048 - RNA, 22 nt, Human
caagaaauuucuuaagaacuaa

SEQ ID NO: 40049 - RNA, 22 nt, Human
caagaagcccuuccugggugga

SEQ ID NO: 40050 - RNA, 22 nt, Human
caagaagccgagcuacaggcuc

SEQ ID NO: 40051 - RNA, 22 nt, Human
caagaaggcauccccagucccu

SEQ ID NO: 40052 - RNA, 22 nt, Human
caagaaggcuauaugggccagg

SEQ ID NO: 40053 - RNA, 22 nt, Human
caagaaguugacagccagguga

SEQ ID NO: 40054 - RNA, 22 nt, Human
caagaauagcuaccucccauau

SEQ ID NO: 40055 - RNA, 22 nt, Human
caagaaucaacauuauuuagug

SEQ ID NO: 40056 - RNA, 22 nt, Human
caagaauuguacaaacugggug

SEQ ID NO: 40057 - RNA, 22 nt, Human
caagacauugauuuuguacaga

SEQ ID NO: 40058 - RNA, 22 nt, Human
caagagcucuccacuagguugg

SEQ ID NO: 40059 - RNA, 22 nt, Human
caagaggcaaauugucuagaag

SEQ ID NO: 40060 - RNA, 22 nt, Human
caagaggcuaaacugggcuauu

SEQ ID NO: 40061 - RNA, 22 nt, Human
caagaucaaguguaguaucaaa

SEQ ID NO: 40062 - RNA, 22 nt, Human
caagaugccccugguagggauc

SEQ ID NO: 40063 - RNA, 22 nt, Human
caagauucagcccuccugaccu

SEQ ID NO: 40064 - RNA, 22 nt, Human
caagauucauuuuguccuuguc

SEQ ID NO: 40065 - RNA, 22 nt, Human
caagauuuaagagucagccuug

SEQ ID NO: 40066 - RNA, 22 nt, Human
auaaugguagauguccacgcag

SEQ ID NO: 40067 - RNA, 22 nt, Human
auaauguaaggcucccuacagu

SEQ ID NO: 40068 - RNA, 22 nt, Human
aucagagcuaguacuugcaggu

SEQ ID NO: 40069 - RNA, 22 nt, Human
aucagagcugcauuuuagagcc

SEQ ID NO: 40070 - RNA, 22 nt, Human
aucagagcugugauucccacuc

SEQ ID NO: 40071 - RNA, 22 nt, Human
aucagaggaccuaguugggcag

SEQ ID NO: 40072 - RNA, 22 nt, Human
aucagaguggguuuuaaaagug

SEQ ID NO: 40073 - RNA, 22 nt, Human
aucagaguguaaguucuuuccu

SEQ ID NO: 40074 - RNA, 22 nt, Human
aucagcaagauguaauuucuau

SEQ ID NO: 40075 - RNA, 22 nt, Human
aucagcaaucucguguauuagg

SEQ ID NO: 40076 - RNA, 22 nt, Human
aucagcaucuuuaacaauuacc

SEQ ID NO: 40077 - RNA, 22 nt, Human
aucaggaagaagaauguguugg

SEQ ID NO: 40078 - RNA, 20 nt, Human
aucaggaagagagacugacc

SEQ ID NO: 40079 - RNA, 22 nt, Human
aucaggaucaugcuggguggga

SEQ ID NO: 40080 - RNA, 22 nt, Human
aucaggccagcaaucccugggc

SEQ ID NO: 40081 - RNA, 19 nt, Human
aucaggcuucuauuuucuc

SEQ ID NO: 40082 - RNA, 22 nt, Human
aucaguauacaggggacauuca

SEQ ID NO: 40083 - RNA, 22 nt, Human
aucaguauauuccuuggucuuu

SEQ ID NO: 40084 - RNA, 22 nt, Human
aucagugcuaaagcaaaugccc

SEQ ID NO: 40085 - RNA, 22 nt, Human
aucaguggggacgagaaguuua

SEQ ID NO: 40086 - RNA, 22 nt, Human
aucaguguuucaaauguaaucu

SEQ ID NO: 40087 - RNA, 22 nt, Human
aucaguuugauaauaaggcuug

SEQ ID NO: 40088 - RNA, 22 nt, Human
aucaguuuguauaugaaacacu

SEQ ID NO: 40089 - RNA, 22 nt, Human
aucauaaagugcuaucugauug

SEQ ID NO: 40090 - RNA, 22 nt, Human
aucauaacuguaauucaucuac

SEQ ID NO: 40091 - RNA, 19 nt, Human
aucauacauguuacacucu

SEQ ID NO: 40092 - RNA, 22 nt, Human
aucauagaggaaaauccacguu

SEQ ID NO: 40093 - RNA, 23 nt, Human
aucauagucuuugugacuggccc

SEQ ID NO: 40094 - RNA, 22 nt, Human
aucaucaucuaaauugugucgc

SEQ ID NO: 40095 - RNA, 22 nt, Human
aucaucauucuuggauaaagca

SEQ ID NO: 40096 - RNA, 22 nt, Human
aucaucuuaucugacucauuuu

SEQ ID NO: 40097 - RNA, 22 nt, Human
aucaucuucgaaaaaagucaga

SEQ ID NO: 40098 - RNA, 22 nt, Human
aucaugaaucuuguguucuaug

SEQ ID NO: 40099 - RNA, 22 nt, Human
aucaugacagagucugccaucc

SEQ ID NO: 40100 - RNA, 22 nt, Human
aucaugacaucugaguuuaagu

SEQ ID NO: 40101 - RNA, 22 nt, Human
aucaugcagagucugggcuuca

SEQ ID NO: 40102 - RNA, 22 nt, Human
aucauguuguauguaaucuuuu

SEQ ID NO: 40103 - RNA, 22 nt, Human
aucauuagcaauuuucaauaag

SEQ ID NO: 40104 - RNA, 22 nt, Human
auauuuacugcuguggugaagg

SEQ ID NO: 40105 - RNA, 21 nt, Human
auauuucagauuuccguaauc

SEQ ID NO: 40106 - RNA, 22 nt, Human
auauuucucucagacauggaag

SEQ ID NO: 40107 - RNA, 22 nt, Human
auauuucuggggguguguuucu

SEQ ID NO: 40108 - RNA, 22 nt, Human
auauuugagggcaauagggugg

SEQ ID NO: 40109 - RNA, 22 nt, Human
auauuugcaggaaacuaguuuu

SEQ ID NO: 40110 - RNA, 22 nt, Human
auauuugucaauucacuguuca

SEQ ID NO: 40111 - RNA, 22 nt, Human
auauuugugguaaagguaagaa

SEQ ID NO: 40112 - RNA, 22 nt, Human
auauuuguuuggcagaguucag

SEQ ID NO: 40113 - RNA, 22 nt, Human
auauuuucacagaacuugcaaa

SEQ ID NO: 40114 - RNA, 22 nt, Human
auauuuugaaguuaauaaugug

SEQ ID NO: 40115 - RNA, 22 nt, Human
auauuuugguagcucucaauga

SEQ ID NO: 40116 - RNA, 22 nt, Human
auauuuuguaacuuggaauagg

SEQ ID NO: 40117 - RNA, 22 nt, Human
auauuuuuccaugugggacucu

SEQ ID NO: 40118 - RNA, 21 nt, Human
auauuuuuguuuggacuguca

SEQ ID NO: 40119 - RNA, 22 nt, Human
aucaaaauggaagaauuuggcu

SEQ ID NO: 40120 - RNA, 22 nt, Human
aucaaagaaugugacugaaaua

SEQ ID NO: 40121 - RNA, 22 nt, Human
aucaaagagugagauuuuuacu

SEQ ID NO: 40122 - RNA, 22 nt, Human
aucaaagguaucuaugcugucu

SEQ ID NO: 40123 - RNA, 22 nt, Human
aucaaaguaauuaacacugaga

SEQ ID NO: 40124 - RNA, 22 nt, Human
aucaaaguccaucagaagguag

SEQ ID NO: 40125 - RNA, 22 nt, Human
aucaaaguggaaguuuacuagg

SEQ ID NO: 40126 - RNA, 22 nt, Human
aucaaagugguuuucugugcuu

SEQ ID NO: 40127 - RNA, 22 nt, Human
aucaaauacaaagggcauaagg

SEQ ID NO: 40128 - RNA, 22 nt, Human
aucaaaucauugcauuaauguu

SEQ ID NO: 40129 - RNA, 22 nt, Human
aucaacauacugcucaggcauu

SEQ ID NO: 40130 - RNA, 22 nt, Human
aucaacauaugcaugggaaagu

SEQ ID NO: 40131 - RNA, 22 nt, Human
aucaacauggcaaugcccaucu

SEQ ID NO: 40132 - RNA, 21 nt, Human
aucaacauugaaagagcugga

SEQ ID NO: 40133 - RNA, 22 nt, Human
aucaagaaaagugcuuucggcu

SEQ ID NO: 40134 - RNA, 22 nt, Human
aucaagaguuauauuucauagu

SEQ ID NO: 40135 - RNA, 23 nt, Human
aucaagauaauccagaugaccua

SEQ ID NO: 40136 - RNA, 22 nt, Human
aucaagcuacuugucuucguuu

SEQ ID NO: 40137 - RNA, 18 nt, Human
aucaaggaggggaagguc

SEQ ID NO: 40138 - RNA, 22 nt, Human
aucaagugaagggcucuugaag

SEQ ID NO: 40139 - RNA, 22 nt, Human
aucaaugcucuguacccagaau

SEQ ID NO: 40140 - RNA, 22 nt, Human
aucacaaaggcugcuucaugau

SEQ ID NO: 40141 - RNA, 22 nt, Human
aucacaaucccucucucugaua

SEQ ID NO: 40142 - RNA, 22 nt, Human
aucacacuuuuguaaccaucag

SEQ ID NO: 40143 - RNA, 22 nt, Human
aucacagagcucccuuccacug

SEQ ID NO: 40144 - RNA, 22 nt, Human
aucacagauuugauacuuuugu

SEQ ID NO: 40145 - RNA, 22 nt, Human
aucacagggugaggauuagacc

SEQ ID NO: 40146 - RNA, 22 nt, Human
aucacaguggcagggauuuggg

SEQ ID NO: 40147 - RNA, 22 nt, Human
aucacaucgaggagcaaucaga

SEQ ID NO: 40148 - RNA, 19 nt, Human
aucacaugucaagagcagg

SEQ ID NO: 40149 - RNA, 22 nt, Human
aucacauuacaaaggacuccag

SEQ ID NO: 40150 - RNA, 22 nt, Human
aucacauuauguagugaaaagg

SEQ ID NO: 40151 - RNA, 22 nt, Human
aucacauuuauaguggcacgca

SEQ ID NO: 40152 - RNA, 22 nt, Human
aucaccacuacaaacaucauug

SEQ ID NO: 40153 - RNA, 21 nt, Human
aucaccagcagaagcugcaga

SEQ ID NO: 40154 - RNA, 23 nt, Human
aucaccagcggaagcugcagacc

SEQ ID NO: 40155 - RNA, 22 nt, Human
aucaccugcacaaauguguucc

SEQ ID NO: 40156 - RNA, 19 nt, Human
aucaccugguguuuccuug

SEQ ID NO: 40157 - RNA, 22 nt, Human
aucacuagaguuacauugccag

SEQ ID NO: 40158 - RNA, 22 nt, Human
aucacugaaugcaaagcuggga

SEQ ID NO: 40159 - RNA, 22 nt, Human
aucacuuugguaccaauucagc

SEQ ID NO: 40160 - RNA, 22 nt, Human
aucagaaaaacauaauguuauu

SEQ ID NO: 40161 - RNA, 22 nt, Human
aucagaaaguucaucauguuug

SEQ ID NO: 40162 - RNA, 22 nt, Human
aucagaaauugcuaccagugga

SEQ ID NO: 40163 - RNA, 20 nt, Human
aucagaagugauauuaacca

SEQ ID NO: 40164 - RNA, 22 nt, Human
aucagaaucauuucaucccuau

SEQ ID NO: 40165 - RNA, 22 nt, Human
aucagaaucuucugaacagugg

SEQ ID NO: 40166 - RNA, 22 nt, Human
aucagacagggaguucuguguc

SEQ ID NO: 40167 - RNA, 22 nt, Human
aucagacucugcauugcagucu

SEQ ID NO: 40168 - RNA, 20 nt, Human
aucagacuugcauuucagga

SEQ ID NO: 40169 - RNA, 20 nt, Human
aucagacuuuuaggaacaua

SEQ ID NO: 40170 - RNA, 22 nt, Human
aucagagcacugagcaggacac

SEQ ID NO: 40171 - RNA, 22 nt, Human
aucagagcccugaugacagacu

SEQ ID NO: 40172 - RNA, 22 nt, Human
aucagagggugagauggagaaa

SEQ ID NO: 40173 - RNA, 22 nt, Human
aucagagguuauguggagggga

SEQ ID NO: 40174 - RNA, 22 nt, Human
aucagagugggucuggcaugag

SEQ ID NO: 40175 - RNA, 22 nt, Human
aucagauauuuaaguuaucaac

SEQ ID NO: 40176 - RNA, 22 nt, Human
aucagcaaaaaugccuucagaa

SEQ ID NO: 40177 - RNA, 22 nt, Human
auccuugaacuuagacacuagg

SEQ ID NO: 40178 - RNA, 22 nt, Human
auccuugagccaaugacugauu

SEQ ID NO: 40179 - RNA, 22 nt, Human
auccuugggaagagaggaauau

SEQ ID NO: 40180 - RNA, 18 nt, Human
auccuuggggcugcugcu

SEQ ID NO: 40181 - RNA, 22 nt, Human
auccuugguaagagaguuggau

SEQ ID NO: 40182 - RNA, 22 nt, Human
auccuuuaaguuaauaaaauuc

SEQ ID NO: 40183 - RNA, 22 nt, Human
auccuuucaucugguaauauau

SEQ ID NO: 40184 - RNA, 22 nt, Human
aucgaggaaaggacaguuccuu

SEQ ID NO: 40185 - RNA, 22 nt, Human
aucgaggagaguugguuuguuu

SEQ ID NO: 40186 - RNA, 22 nt, Human
aucgaugcugacuucuuguuau

SEQ ID NO: 40187 - RNA, 22 nt, Human
aucgcauuugagcaaucuuuuc

SEQ ID NO: 40188 - RNA, 22 nt, Human
aucgccaauggggaggaaagaa

SEQ ID NO: 40189 - RNA, 22 nt, Human
aucguaaagcccuauggcuuca

SEQ ID NO: 40190 - RNA, 22 nt, Human
aucuaaacccuacuuucuuucu

SEQ ID NO: 40191 - RNA, 23 nt, Human
aucuaaaguguuaaauagcuggg

SEQ ID NO: 40192 - RNA, 22 nt, Human
aucuaaaguguuucaugaaaga

SEQ ID NO: 40193 - RNA, 22 nt, Human
aucuaacacuguaaacugucuu

SEQ ID NO: 40194 - RNA, 22 nt, Human
aucuaacugggcuauuuuauug

SEQ ID NO: 40195 - RNA, 16 nt, Human
aucuaagaugugcauu

SEQ ID NO: 40196 - RNA, 22 nt, Human
aucuacaaccccucaaacugug

SEQ ID NO: 40197 - RNA, 22 nt, Human
aucuacaagagguucuccucuc

SEQ ID NO: 40198 - RNA, 19 nt, Human
aucuacaauuauucucagu

SEQ ID NO: 40199 - RNA, 22 nt, Human
aucuacagcagugccagguagc

SEQ ID NO: 40200 - RNA, 22 nt, Human
aucuacucaguaacugcuuagg

SEQ ID NO: 40201 - RNA, 22 nt, Human
aucuagaaaaggugacuaaaau

SEQ ID NO: 40202 - RNA, 23 nt, Human
aucuagaaaccugaugacucugu

SEQ ID NO: 40203 - RNA, 22 nt, Human
aucuagaaaguguugaagauca

SEQ ID NO: 40204 - RNA, 22 nt, Human
aucuagaagccugagccaagau

SEQ ID NO: 40205 - RNA, 22 nt, Human
aucuagacaucugaaacauuua

SEQ ID NO: 40206 - RNA, 22 nt, Human
aucuagaggcaaugaaggaggu

SEQ ID NO: 40207 - RNA, 22 nt, Human
aucuagauuagguauaagagcu

SEQ ID NO: 40208 - RNA, 19 nt, Human
aucuagauuauugagaagg

SEQ ID NO: 40209 - RNA, 22 nt, Human
aucuagcaguguuauaauugga

SEQ ID NO: 40210 - RNA, 22 nt, Human
aucuagcaguucauugugcuau

SEQ ID NO: 40211 - RNA, 22 nt, Human
aucuauaucaugggguaaggua

SEQ ID NO: 40212 - RNA, 22 nt, Human
aucuaucccaguuuaacucauu

SEQ ID NO: 40213 - RNA, 22 nt, Human
aucuauuaugcugagaaacugu

SEQ ID NO: 40214 - RNA, 22 nt, Human
aucuauuucugcuaauaacaau

SEQ ID NO: 40215 - RNA, 22 nt, Human
aucucaaacaucuuugaccaua

SEQ ID NO: 40216 - RNA, 22 nt, Human
aucucaaagcauggagcagaau

SEQ ID NO: 40217 - RNA, 22 nt, Human
aucucaacaucccuauggagug

SEQ ID NO: 40218 - RNA, 19 nt, Human
aucucaacccuacucucug

SEQ ID NO: 40219 - RNA, 21 nt, Human
aucucacagcccagagaagcc

SEQ ID NO: 40220 - RNA, 22 nt, Human
aucucacauccucaguagugca

SEQ ID NO: 40221 - RNA, 22 nt, Human
cagacauccagguacgagcuuu

SEQ ID NO: 40222 - RNA, 22 nt, Human
cagacaucuguacccagccugu

SEQ ID NO: 40223 - RNA, 22 nt, Human
cagacaucuuuuaucuucagga

SEQ ID NO: 40224 - RNA, 22 nt, Human
cagacaugauguaagcagaggc

SEQ ID NO: 40225 - RNA, 22 nt, Human
cagacccaggauccaaauguug

SEQ ID NO: 40226 - RNA, 21 nt, Human
cagacccucuagaggccaccu

SEQ ID NO: 40227 - RNA, 20 nt, Human
cagaccugcacccacuucga

SEQ ID NO: 40228 - RNA, 22 nt, Human
cagaccugggucccuggccugu

SEQ ID NO: 40229 - RNA, 22 nt, Human
cagacucugaugcagccuugug

SEQ ID NO: 40230 - RNA, 22 nt, Human
cagacugagggcaucacauacg

SEQ ID NO: 40231 - RNA, 22 nt, Human
cagacuguagaguuugagaagu

SEQ ID NO: 40232 - RNA, 22 nt, Human
cagacugugucugaaccugguc

SEQ ID NO: 40233 - RNA, 22 nt, Human
cagacuuaccuaaggucacaca

SEQ ID NO: 40234 - RNA, 22 nt, Human
cagacuuuugacauuaauacag

SEQ ID NO: 40235 - RNA, 22 nt, Human
cagagaacauucagagcuguag

SEQ ID NO: 40236 - RNA, 22 nt, Human
cagagaacuuagcuaguuuucc

SEQ ID NO: 40237 - RNA, 22 nt, Human
cagagaagagucuggccucucu

SEQ ID NO: 40238 - RNA, 22 nt, Human
cagagacaacaaguuuaacuau

SEQ ID NO: 40239 - RNA, 22 nt, Human
cagagacaaugucucugcuugu

SEQ ID NO: 40240 - RNA, 22 nt, Human
cagagacagccugggagggaca

SEQ ID NO: 40241 - RNA, 22 nt, Human
cagagacauccauuuuauaugc

SEQ ID NO: 40242 - RNA, 22 nt, Human
cagagacauucuccccauugga

SEQ ID NO: 40243 - RNA, 20 nt, Human
cagagacccaggcuucagcu

SEQ ID NO: 40244 - RNA, 22 nt, Human
cagagaccccuggcaugguggu

SEQ ID NO: 40245 - RNA, 22 nt, Human
cagagacuggagugcaguggcg

SEQ ID NO: 40246 - RNA, 22 nt, Human
cagagagaggccacugcuauua

SEQ ID NO: 40247 - RNA, 22 nt, Human
cagagagagugggguguggauu

SEQ ID NO: 40248 - RNA, 22 nt, Human
cagagagcaugggaggcccgag

SEQ ID NO: 40249 - RNA, 21 nt, Human
cagagagcuagaacuucauga

SEQ ID NO: 40250 - RNA, 22 nt, Human
cagagagcuugcccuuguauau

SEQ ID NO: 40251 - RNA, 22 nt, Human
cagagaggauggauuccauagc

SEQ ID NO: 40252 - RNA, 22 nt, Human
cagagaugugauccagcugucu

SEQ ID NO: 40253 - RNA, 22 nt, Human
cagagauuauuauaacuaauua

SEQ ID NO: 40254 - RNA, 20 nt, Human
cagagauuuuacuuccucac

SEQ ID NO: 40255 - RNA, 22 nt, Human
cagagauuuuuaugcacaccaa

SEQ ID NO: 40256 - RNA, 22 nt, Human
cagagcaacacccuuuacaucg

SEQ ID NO: 40257 - RNA, 22 nt, Human
cagagcacacaugcauagagug

SEQ ID NO: 40258 - RNA, 22 nt, Human
cagagcacccaaggagcauuug

SEQ ID NO: 40259 - RNA, 22 nt, Human
cagagcagaaaccugggugauu

SEQ ID NO: 40260 - RNA, 22 nt, Human
cagagcagaagguccaagccug

SEQ ID NO: 40261 - RNA, 22 nt, Human
cagagcagccuccagggggagc

SEQ ID NO: 40262 - RNA, 21 nt, Human
cagagcagcguucugcugugg

SEQ ID NO: 40263 - RNA, 22 nt, Human
cagagcaggaauaggguguuga

SEQ ID NO: 40264 - RNA, 22 nt, Human
cagagcagguaucuuuggugaa

SEQ ID NO: 40265 - RNA, 22 nt, Human
cagagcaguaaaucuggggcac

SEQ ID NO: 40266 - RNA, 22 nt, Human
cagagcaguccuugucaaucag

SEQ ID NO: 40267 - RNA, 22 nt, Human
cagagcaucgcgcagagagccu

SEQ ID NO: 40268 - RNA, 22 nt, Human
cagagcauuaaaaccagcucug

SEQ ID NO: 40269 - RNA, 22 nt, Human
cagagccaaaccucagggcccg

SEQ ID NO: 40270 - RNA, 22 nt, Human
cagagccaaaugcugugguuau

SEQ ID NO: 40271 - RNA, 21 nt, Human
cagagccagacugcugaauuu

SEQ ID NO: 40272 - RNA, 22 nt, Human
cagagccagcaguggggacagg

SEQ ID NO: 40273 - RNA, 20 nt, Human
cagagccaggguuuuguuuu

SEQ ID NO: 40274 - RNA, 22 nt, Human
cagagccaucaugauauggagu

SEQ ID NO: 40275 - RNA, 22 nt, Human
cagagcccagggccuacguccc

SEQ ID NO: 40276 - RNA, 22 nt, Human
cagagcccauccuauacucucc

SEQ ID NO: 40277 - RNA, 22 nt, Human
cagagcccucaaggccgaugca

SEQ ID NO: 40278 - RNA, 22 nt, Human
cagagcccugugugccauguga

SEQ ID NO: 40279 - RNA, 22 nt, Human
cagagccuaaaacgacuccacu

SEQ ID NO: 40280 - RNA, 22 nt, Human
cagagccucuaaaauuucuauc

SEQ ID NO: 40281 - RNA, 22 nt, Human
cagagccucucagccccuuggg

SEQ ID NO: 40282 - RNA, 22 nt, Human
cagagccugccaccuuucuccc

SEQ ID NO: 40283 - RNA, 22 nt, Human
cagagccugccucuggcugugg

SEQ ID NO: 40284 - RNA, 22 nt, Human
cagagccuuaguucuccuagaa

SEQ ID NO: 40285 - RNA, 19 nt, Human
cagagccuucagugacucc

SEQ ID NO: 40286 - RNA, 22 nt, Human
aagcccauaaaaagaggucccu

SEQ ID NO: 40287 - RNA, 22 nt, Human
aagcccuggauagagagaacug

SEQ ID NO: 40288 - RNA, 22 nt, Human
aagcccugucacccugacuuca

SEQ ID NO: 40289 - RNA, 22 nt, Human
aagcccuuggcgcacaccgggc

SEQ ID NO: 40290 - RNA, 22 nt, Human
aagccgggccugagaaaugaca

SEQ ID NO: 40291 - RNA, 22 nt, Human
aagccuggacuaucgcgugugc

SEQ ID NO: 40292 - RNA, 22 nt, Human
aagccuuaaauguuucuaauau

SEQ ID NO: 40293 - RNA, 22 nt, Human
aagccuuauggggacaguuuug

SEQ ID NO: 40294 - RNA, 22 nt, Human
aagccuucagaguuggcugguc

SEQ ID NO: 40295 - RNA, 22 nt, Human
aagccuucccuuuuugagcuca

SEQ ID NO: 40296 - RNA, 22 nt, Human
aagccuuggggcuccucuguau

SEQ ID NO: 40297 - RNA, 22 nt, Human
aagccuuuuccaccuaauagag

SEQ ID NO: 40298 - RNA, 22 nt, Human
aagcaggagagccugggugagc

SEQ ID NO: 40299 - RNA, 22 nt, Human
aagcaggagaugggugcuuuuc

SEQ ID NO: 40300 - RNA, 22 nt, Human
aagcaggcaagguuguggggca

SEQ ID NO: 40301 - RNA, 22 nt, Human
aagcaggcccugggccagggga

SEQ ID NO: 40302 - RNA, 22 nt, Human
aagcaggcuagauugaagggcu

SEQ ID NO: 40303 - RNA, 23 nt, Human
aagcagggagauucuuagcugag

SEQ ID NO: 40304 - RNA, 22 nt, Human
aagcagggcucccuggggacuc

SEQ ID NO: 40305 - RNA, 22 nt, Human
aagcaguagaaugcauugcuuu

SEQ ID NO: 40306 - RNA, 20 nt, Human
aagcagugaggugaggagug

SEQ ID NO: 40307 - RNA, 22 nt, Human
aagcaguuacuauuuacuauua

SEQ ID NO: 40308 - RNA, 22 nt, Human
aagcauaaaacguuacaacaug

SEQ ID NO: 40309 - RNA, 22 nt, Human
aagcauagagacacaaauuugg

SEQ ID NO: 40310 - RNA, 22 nt, Human
aagcaucuaggugacugacaua

SEQ ID NO: 40311 - RNA, 22 nt, Human
aagcaucuauagguucuaggag

SEQ ID NO: 40312 - RNA, 22 nt, Human
aagcaucucauucuugccuguc

SEQ ID NO: 40313 - RNA, 22 nt, Human
aagcaucucuauguggagagug

SEQ ID NO: 40314 - RNA, 19 nt, Human
aagcauggugccucaccuc

SEQ ID NO: 40315 - RNA, 22 nt, Human
aagcaugguggaugauacagug

SEQ ID NO: 40316 - RNA, 22 nt, Human
aagcaugguuucugacgucaug

SEQ ID NO: 40317 - RNA, 22 nt, Human
aagcaugucccuugugauucaa

SEQ ID NO: 40318 - RNA, 22 nt, Human
aagcauucugcauuuucaaaga

SEQ ID NO: 40319 - RNA, 16 nt, Human
aagcauuggaauuagg

SEQ ID NO: 40320 - RNA, 22 nt, Human
aagcauuguaagcagaagaugc

SEQ ID NO: 40321 - RNA, 22 nt, Human
aagcauuuauagauaagaauuu

SEQ ID NO: 40322 - RNA, 22 nt, Human
aagcauuucaauauaauauuca

SEQ ID NO: 40323 - RNA, 22 nt, Human
aagcauuuuagauaaagcauca

SEQ ID NO: 40324 - RNA, 22 nt, Human
aagccaaggccugucuggggcu

SEQ ID NO: 40325 - RNA, 22 nt, Human
aagccaaucgugugaacuuagu

SEQ ID NO: 40326 - RNA, 22 nt, Human
aagccacuauuaaauaaugauu

SEQ ID NO: 40327 - RNA, 22 nt, Human
aagccacugagauuucacugca

SEQ ID NO: 40328 - RNA, 22 nt, Human
aagccagaucaaaguguccagg

SEQ ID NO: 40329 - RNA, 21 nt, Human
aagccagcccacagugguuug

SEQ ID NO: 40330 - RNA, 22 nt, Human
aagccaggaauggagucuucgc

SEQ ID NO: 40331 - RNA, 22 nt, Human
aagccaggaccaaacucauccu

SEQ ID NO: 40332 - RNA, 22 nt, Human
aagccaggauaaaguuguuuua

SEQ ID NO: 40333 - RNA, 22 nt, Human
aagccaggcugcacuugcuggg

SEQ ID NO: 40334 - RNA, 22 nt, Human
aagccagggauggaaugauagg

SEQ ID NO: 40335 - RNA, 22 nt, Human
aagccagggauuccugagggag

SEQ ID NO: 40336 - RNA, 22 nt, Human
aagccaggggcugcuuaggaga

SEQ ID NO: 40337 - RNA, 22 nt, Human
aagccaguaaguuuuugucauu

SEQ ID NO: 40338 - RNA, 22 nt, Human
aagccaguguccagaaugggca

SEQ ID NO: 40339 - RNA, 22 nt, Human
aagccagugugacaggaaacuu

SEQ ID NO: 40340 - RNA, 22 nt, Human
aagccaguguuuuugagaguug

SEQ ID NO: 40341 - RNA, 22 nt, Human
aagccauggcaugccaggauca

SEQ ID NO: 40342 - RNA, 22 nt, Human
aagccauucaucuaauguccug

SEQ ID NO: 40343 - RNA, 22 nt, Human
aagcccagaugagaucccugga

SEQ ID NO: 40344 - RNA, 22 nt, Human
aagcccagaugugagaacugag

SEQ ID NO: 40345 - RNA, 22 nt, Human
aagcccagcaucccugcaccag

SEQ ID NO: 40346 - RNA, 22 nt, Human
aagcccagcugaaagcauuuuu

SEQ ID NO: 40347 - RNA, 20 nt, Human
aagcccauuaccaugcuugg

SEQ ID NO: 40348 - RNA, 22 nt, Human
aagcccuccguacgugcuagcu

SEQ ID NO: 40349 - RNA, 23 nt, Human
aagcccugaagguuucaggcccu

SEQ ID NO: 40350 - RNA, 22 nt, Human
aagcccugagcacugcagagaa

SEQ ID NO: 40351 - RNA, 22 nt, Human
aagcccugcagucucugccaca

SEQ ID NO: 40352 - RNA, 22 nt, Human
aagcccuggcaaugucagauga

SEQ ID NO: 40353 - RNA, 22 nt, Human
aagcccugggauguucagcagu

SEQ ID NO: 40354 - RNA, 22 nt, Human
aagcccuguaaauugcccuuaa

SEQ ID NO: 40355 - RNA, 22 nt, Human
aagcccuguccggggggaagaa

SEQ ID NO: 40356 - RNA, 22 nt, Human
aagcccuguucuuucucucacc

SEQ ID NO: 40357 - RNA, 22 nt, Human
aagcccuuuucaagauacaaca

SEQ ID NO: 40358 - RNA, 21 nt, Human
aagccucaagcagaagacaga

SEQ ID NO: 40359 - RNA, 22 nt, Human
aagccuccuuauuaaaggauau

SEQ ID NO: 40360 - RNA, 22 nt, Human
aagccucuggggccucaucugu

SEQ ID NO: 40361 - RNA, 22 nt, Human
aagccuggcacauuggagucug

SEQ ID NO: 40362 - RNA, 22 nt, Human
aagccuugccuauuugaugaca

SEQ ID NO: 40363 - RNA, 22 nt, Human
aagccuugcucuugaaaaaguu

SEQ ID NO: 40364 - RNA, 22 nt, Human
aagcgacugcagguuaaaacaa

SEQ ID NO: 40365 - RNA, 22 nt, Human
aagcgccaugguuccugcgcag

SEQ ID NO: 40366 - RNA, 22 nt, Human
aagcggagcauuugaacuugaa

SEQ ID NO: 40367 - RNA, 22 nt, Human
aagcuaagauuacagauuuggg

SEQ ID NO: 40368 - RNA, 22 nt, Human
aagcuaaguauaggugaauccu

SEQ ID NO: 40369 - RNA, 22 nt, Human
aagcuaauagccaguuuucuuc

SEQ ID NO: 40370 - RNA, 22 nt, Human
aagcuacaauguguuuuugaaa

SEQ ID NO: 40371 - RNA, 19 nt, Human
aagcuacagcccaggucug

SEQ ID NO: 40372 - RNA, 22 nt, Human
aagcuagauuggcauucauuuc

SEQ ID NO: 40373 - RNA, 22 nt, Human
aagcuauacaaugcacaaauga

SEQ ID NO: 40374 - RNA, 22 nt, Human
aagcuauugaauuuauagcaua

SEQ ID NO: 40375 - RNA, 22 nt, Human
aagcuccuuuggcucgagaucu

SEQ ID NO: 40376 - RNA, 22 nt, Human
aagcucucuguccccuggacug

SEQ ID NO: 40377 - RNA, 22 nt, Human
aagcucugaggugagcaaucgg

SEQ ID NO: 40378 - RNA, 22 nt, Human
aagcucugguuaaaaggccugg

SEQ ID NO: 40379 - RNA, 22 nt, Human
aagcucuuguugaaucuuguca

SEQ ID NO: 40380 - RNA, 22 nt, Human
aagcugaaaaugagacucuaca

SEQ ID NO: 40381 - RNA, 22 nt, Human
aagcugaaauaauaucuauguu

SEQ ID NO: 40382 - RNA, 22 nt, Human
aagcugaagccggaucaaaaag

SEQ ID NO: 40383 - RNA, 22 nt, Human
aagcugagccaguggcaagugc

SEQ ID NO: 40384 - RNA, 22 nt, Human
aagcugcaaggaagugugccag

SEQ ID NO: 40385 - RNA, 22 nt, Human
aagcugcacuacuugagggacc

SEQ ID NO: 40386 - RNA, 22 nt, Human
aagcugcagaugugccugugga

SEQ ID NO: 40387 - RNA, 22 nt, Human
aagcugccaaugguaagcugcu

SEQ ID NO: 40388 - RNA, 22 nt, Human
aagcugccagauucagucugcu

SEQ ID NO: 40389 - RNA, 22 nt, Human
aagcugccauagaacgagaggu

SEQ ID NO: 40390 - RNA, 22 nt, Human
aagcugcccaagacugaagcau

SEQ ID NO: 40391 - RNA, 23 nt, Human
aagcugccuucgcaguuggucug

SEQ ID NO: 40392 - RNA, 22 nt, Human
aagcuggccuguaccugcugag

SEQ ID NO: 40393 - RNA, 18 nt, Human
aagcugggaaggagacag

SEQ ID NO: 40394 - RNA, 22 nt, Human
aagcugucaggagguuaccuuu

SEQ ID NO: 40395 - RNA, 22 nt, Human
aaggaguggggcauaucacaga

SEQ ID NO: 40396 - RNA, 22 nt, Human
aaggauacuuuuagagccugag

SEQ ID NO: 40397 - RNA, 17 nt, Human
aaggauauuauaguucu

SEQ ID NO: 40398 - RNA, 22 nt, Human
aaggauauuuggcuacagaagc

SEQ ID NO: 40399 - RNA, 22 nt, Human
aaggaugauugguaaugacacu

SEQ ID NO: 40400 - RNA, 22 nt, Human
aaggaugcagggacccaaggcu

SEQ ID NO: 40401 - RNA, 22 nt, Human
aaggaugucagucauuuuggau

SEQ ID NO: 40402 - RNA, 22 nt, Human
aaggauguggcauuuuucauau

SEQ ID NO: 40403 - RNA, 22 nt, Human
aaggauucaagaaaugguguag

SEQ ID NO: 40404 - RNA, 22 nt, Human
aaggauuuuuggaaugagaugg

SEQ ID NO: 40405 - RNA, 22 nt, Human
aaggcaagguucaccgugcuau

SEQ ID NO: 40406 - RNA, 22 nt, Human
aaggcaauaguauuaaacugga

SEQ ID NO: 40407 - RNA, 22 nt, Human
aaggcaauaucaagagaauucg

SEQ ID NO: 40408 - RNA, 22 nt, Human
aaggcaauggcaagagaaagca

SEQ ID NO: 40409 - RNA, 22 nt, Human
aaggcaaugguuucugugccuu

SEQ ID NO: 40410 - RNA, 22 nt, Human
aaggcaauguaaauuacagcuu

SEQ ID NO: 40411 - RNA, 22 nt, Human
aaggcaauugagaagaaacaga

SEQ ID NO: 40412 - RNA, 22 nt, Human
aaggcacaacacaagaggguga

SEQ ID NO: 40413 - RNA, 18 nt, Human
aaggcacaggagaacauu

SEQ ID NO: 40414 - RNA, 22 nt, Human
aaggcacauuccugaaaacaau

SEQ ID NO: 40415 - RNA, 22 nt, Human
aaggcugacguuuguguuuauu

SEQ ID NO: 40416 - RNA, 22 nt, Human
aaggcugaggagggccugcagg

SEQ ID NO: 40417 - RNA, 22 nt, Human
aaggcugagggcuguaccuggc

SEQ ID NO: 40418 - RNA, 16 nt, Human
aaggcugauuuucccu

SEQ ID NO: 40419 - RNA, 22 nt, Human
aaggcugccucugccagaggag

SEQ ID NO: 40420 - RNA, 22 nt, Human
aaggcuggaccuggaugaaucu

SEQ ID NO: 40421 - RNA, 22 nt, Human
aaggcuggcaauauauuuguua

SEQ ID NO: 40422 - RNA, 22 nt, Human
aaggcuggguaaccuguccacu

SEQ ID NO: 40423 - RNA, 22 nt, Human
aaggcugguggauuaugagguc

SEQ ID NO: 40424 - RNA, 22 nt, Human
aaggcuguuugagcacuggagc

SEQ ID NO: 40425 - RNA, 18 nt, Human
aaggcuucaaagaguaga

SEQ ID NO: 40426 - RNA, 22 nt, Human
aaggcuuccacuuuguuggguc

SEQ ID NO: 40427 - RNA, 19 nt, Human
aaggcuuggcugagcuggg

SEQ ID NO: 40428 - RNA, 22 nt, Human
aaggcuuguugucacgcucuug

SEQ ID NO: 40429 - RNA, 19 nt, Human
aaggcuuucugagugaaaa

SEQ ID NO: 40430 - RNA, 22 nt, Human
aaggcuuugauuccauugcccu

SEQ ID NO: 40431 - RNA, 22 nt, Human
aaggcuuugugcugaguugucg

SEQ ID NO: 40432 - RNA, 22 nt, Human
aaggcuuuuguuccuauuuagu

SEQ ID NO: 40433 - RNA, 22 nt, Human
aagggaaaauaguugaugacca

SEQ ID NO: 40434 - RNA, 22 nt, Human
aagggaaaucauauggugcagu

SEQ ID NO: 40435 - RNA, 22 nt, Human
aagggacuuugucagcuuucca

SEQ ID NO: 40436 - RNA, 22 nt, Human
aagggagaaagaaugaguuuag

SEQ ID NO: 40437 - RNA, 21 nt, Human
aagggagauaggaaucaggcc

SEQ ID NO: 40438 - RNA, 22 nt, Human
aagggagcaaauggacagacgg

SEQ ID NO: 40439 - RNA, 22 nt, Human
aagggauguaaacaugaauaag

SEQ ID NO: 40440 - RNA, 22 nt, Human
aagggcagaaagggacgcuuug

SEQ ID NO: 40441 - RNA, 22 nt, Human
aagggcagaauagagaagaugg

SEQ ID NO: 40442 - RNA, 22 nt, Human
aagggcagccugacucacgguc

SEQ ID NO: 40443 - RNA, 22 nt, Human
aagggcagcuuaaauugguagc

SEQ ID NO: 40444 - RNA, 22 nt, Human
aagggcagggaguuugugucua

SEQ ID NO: 40445 - RNA, 22 nt, Human
aagggcaggugggcauuucugg

SEQ ID NO: 40446 - RNA, 22 nt, Human
aagggccagggcucuagagaua

SEQ ID NO: 40447 - RNA, 22 nt, Human
aagggccauaacuugcaguguu

SEQ ID NO: 40448 - RNA, 22 nt, Human
aagggcuccacuugaaucacac

SEQ ID NO: 40449 - RNA, 22 nt, Human
aagggcuccauccuuauaaaug

SEQ ID NO: 40450 - RNA, 22 nt, Human
aagggcucucugcauugaaauu

SEQ ID NO: 40451 - RNA, 22 nt, Human
aagggcucugugcuugucccau

SEQ ID NO: 40452 - RNA, 22 nt, Human
aagggcucugugugccucccca

SEQ ID NO: 40453 - RNA, 18 nt, Human
aagggcuggccuuuggag

SEQ ID NO: 40454 - RNA, 19 nt, Human
aagggcugggcaccucacu

SEQ ID NO: 40455 - RNA, 22 nt, Human
aagggcuguaagccaaguaaag

SEQ ID NO: 40456 - RNA, 22 nt, Human
aagggcuguuauguuuuuauac

SEQ ID NO: 40457 - RNA, 22 nt, Human
aagggcuuuuaagauuuauccu

SEQ ID NO: 40458 - RNA, 22 nt, Human
aaggggaagagaccgcagaguc

SEQ ID NO: 40459 - RNA, 22 nt, Human
aaggggaauagaguggguugug

SEQ ID NO: 40460 - RNA, 22 nt, Human
aaggggagaugucaugggcccu

SEQ ID NO: 40461 - RNA, 23 nt, Human
aaggggauacuuccacuuucuuu

SEQ ID NO: 40462 - RNA, 22 nt, Human
aaggggauagagcagacacucc

SEQ ID NO: 40463 - RNA, 22 nt, Human
aaggggcacaauuguacccaag

SEQ ID NO: 40464 - RNA, 22 nt, Human
aaggggcucuugucaggcgcag

SEQ ID NO: 40465 - RNA, 22 nt, Human
aagggggaaauccuagcgccgc

SEQ ID NO: 40466 - RNA, 22 nt, Human
aagggggcacagucacuguaau

SEQ ID NO: 40467 - RNA, 22 nt, Human
aaggggggcaccugcaugcccg

SEQ ID NO: 40468 - RNA, 22 nt, Human
aaggggucaagcggcagcuaca

SEQ ID NO: 40469 - RNA, 22 nt, Human
aaggggugagcagaggcuucgc

SEQ ID NO: 40470 - RNA, 22 nt, Human
aaggggugcaaguuaaucagca

SEQ ID NO: 40471 - RNA, 22 nt, Human
aaggggugggcauuagagcagu

SEQ ID NO: 40472 - RNA, 22 nt, Human
aaggguccagcaccucggcucc

SEQ ID NO: 40473 - RNA, 22 nt, Human
aagggugguguaggagaucaaa

SEQ ID NO: 40474 - RNA, 22 nt, Human
aaggguuugucucccucaaggc

SEQ ID NO: 40475 - RNA, 22 nt, Human
aagguaauauuuuucucucuaa

SEQ ID NO: 40476 - RNA, 22 nt, Human
aagguaauccauaauaguuacu

SEQ ID NO: 40477 - RNA, 22 nt, Human
aagguacaccaaaguucaaguu

SEQ ID NO: 40478 - RNA, 22 nt, Human
aagguaggcucaggguuguucu

SEQ ID NO: 40479 - RNA, 22 nt, Human
aagguagguuaaccugcaggag

SEQ ID NO: 40480 - RNA, 22 nt, Human
aagguauuggcagggcugaguu

SEQ ID NO: 40481 - RNA, 22 nt, Human
aaggucacacucccagagcuga

SEQ ID NO: 40482 - RNA, 22 nt, Human
aaggucauuuuuuccucuguug

SEQ ID NO: 40483 - RNA, 22 nt, Human
aagguccacaacugguaaaugg

SEQ ID NO: 40484 - RNA, 22 nt, Human
aagguccuguagccacagagcc

SEQ ID NO: 40485 - RNA, 18 nt, Human
aaggucugucugguaggu

SEQ ID NO: 40486 - RNA, 22 nt, Human
aaggucuguggccaccucuggg

SEQ ID NO: 40487 - RNA, 22 nt, Human
aaggucuguucuaggugagggu

SEQ ID NO: 40488 - RNA, 22 nt, Human
aaggugaacugguaaugacaga

SEQ ID NO: 40489 - RNA, 22 nt, Human
aaggugcucguuauggccagug

SEQ ID NO: 40490 - RNA, 22 nt, Human
aagguggcccugagcaugacaa

SEQ ID NO: 40491 - RNA, 22 nt, Human
aagguggcgcuggagcuggucc

SEQ ID NO: 40492 - RNA, 22 nt, Human
aaggugggcagaucacaagguc

SEQ ID NO: 40493 - RNA, 22 nt, Human
aaggugguaauagugcaggauu

SEQ ID NO: 40494 - RNA, 22 nt, Human
aaggugguuugauuaucccacu

SEQ ID NO: 40495 - RNA, 22 nt, Human
aaggugguuugcagacagaaua

SEQ ID NO: 40496 - RNA, 22 nt, Human
aaggugguuugcuaaucccaac

SEQ ID NO: 40497 - RNA, 19 nt, Human
aaggugguuugucucugua

SEQ ID NO: 40498 - RNA, 22 nt, Human
aaggugucacugggacaggaaa

SEQ ID NO: 40499 - RNA, 22 nt, Human
aaggugucacuguuucuggccu

SEQ ID NO: 40500 - RNA, 19 nt, Human
aaggugucccaacugcguu

SEQ ID NO: 40501 - RNA, 22 nt, Human
aaggugugcugugagaccuggu

SEQ ID NO: 40502 - RNA, 23 nt, Human
aagguguuuguuuucagaaagca

SEQ ID NO: 40503 - RNA, 22 nt, Human
aagguuuauuaaauguugcaug

SEQ ID NO: 40504 - RNA, 22 nt, Human
aaugaguuuguucuauuauuug

SEQ ID NO: 40505 - RNA, 22 nt, Human
aaugauaccaaacauguagaua

SEQ ID NO: 40506 - RNA, 22 nt, Human
aaugauaugcaaauuaucauca

SEQ ID NO: 40507 - RNA, 20 nt, Human
aaugaucagcauagcaagga

SEQ ID NO: 40508 - RNA, 22 nt, Human
aaugaucauuauaaagugcucu

SEQ ID NO: 40509 - RNA, 21 nt, Human
aaugaugaaagaugacagagu

SEQ ID NO: 40510 - RNA, 22 nt, Human
aaugaugaacucagagggaacc

SEQ ID NO: 40511 - RNA, 22 nt, Human
aaugaugacaggauaaagaaca

SEQ ID NO: 40512 - RNA, 22 nt, Human
aaugaugggaaggagaaaagca

SEQ ID NO: 40513 - RNA, 22 nt, Human
aaugaugguuaaacacuggagg

SEQ ID NO: 40514 - RNA, 22 nt, Human
aaugaugguuucaucacuugaa

SEQ ID NO: 40515 - RNA, 22 nt, Human
aaugaugucgaaaaguaagcuc

SEQ ID NO: 40516 - RNA, 22 nt, Human
aaugauuggcacuagauacaca

SEQ ID NO: 40517 - RNA, 22 nt, Human
aaugauuuccccuacacagaag

SEQ ID NO: 40518 - RNA, 22 nt, Human
aaugcaaacuucuuguuacuug

SEQ ID NO: 40519 - RNA, 18 nt, Human
aaugcacacauuuacucc

SEQ ID NO: 40520 - RNA, 22 nt, Human
aaugcacauauauuuccuuauu

SEQ ID NO: 40521 - RNA, 22 nt, Human
aaugcacaugucuuggccucac

SEQ ID NO: 40522 - RNA, 22 nt, Human
aaugcacauguuguaauaaaua

SEQ ID NO: 40523 - RNA, 22 nt, Human
aaugcacuuaguaugaaugccu

SEQ ID NO: 40524 - RNA, 22 nt, Human
aaugcauaccaugucaucuuug

SEQ ID NO: 40525 - RNA, 22 nt, Human
aaugcauuccacugagauuugu

SEQ ID NO: 40526 - RNA, 18 nt, Human
aaugcauuuauggagaug

SEQ ID NO: 40527 - RNA, 22 nt, Human
aaugccaauauucauuuguguu

SEQ ID NO: 40528 - RNA, 22 nt, Human
aaugccguguuucuuacguuca

SEQ ID NO: 40529 - RNA, 22 nt, Human
aaugccuucaaguaucugagga

SEQ ID NO: 40530 - RNA, 22 nt, Human
aaugccuucccauuuauacuuu

SEQ ID NO: 40531 - RNA, 22 nt, Human
aaugcuaaaauggcacuaaagu

SEQ ID NO: 40532 - RNA, 22 nt, Human
aaugcuaucggcucuaagcaug

SEQ ID NO: 40533 - RNA, 22 nt, Human
aaugcucucugccauagcuaac

SEQ ID NO: 40534 - RNA, 21 nt, Human
aaugcugcccaguaagauggc

SEQ ID NO: 40535 - RNA, 22 nt, Human
aaugcuguucugagucugcagg

SEQ ID NO: 40536 - RNA, 22 nt, Human
aaugcuuaauucaauacugugu

SEQ ID NO: 40537 - RNA, 22 nt, Human
aaugcuuuaaauccuaguguaa

SEQ ID NO: 40538 - RNA, 22 nt, Human
aaugcuuuagaaaaccagcuuu

SEQ ID NO: 40539 - RNA, 22 nt, Human
aaugcuuucuuauaaccacugc

SEQ ID NO: 40540 - RNA, 22 nt, Human
aaugcuuugacuauaucuauaa

SEQ ID NO: 40541 - RNA, 22 nt, Human
aaugcuuuuacgacauguaccu

SEQ ID NO: 40542 - RNA, 22 nt, Human
aauggaacuuguaauuaugucc

SEQ ID NO: 40543 - RNA, 22 nt, Human
aauggaauaccuagguggccca

SEQ ID NO: 40544 - RNA, 22 nt, Human
aauggaaugccucacauguauu

SEQ ID NO: 40545 - RNA, 22 nt, Human
aauggaauucuccauuagaugu

SEQ ID NO: 40546 - RNA, 22 nt, Human
aauggagacuucaaaauggauu

SEQ ID NO: 40547 - RNA, 22 nt, Human
aauggagugguucuugcccucu

SEQ ID NO: 40548 - RNA, 22 nt, Human
aauggcagaggcaaagauggua

SEQ ID NO: 40549 - RNA, 22 nt, Human
aagucuuuugcuaagaguaaug

SEQ ID NO: 40550 - RNA, 22 nt, Human
aagugaauguagcaaacuugaa

SEQ ID NO: 40551 - RNA, 22 nt, Human
aagugacauaaaaucucccagg

SEQ ID NO: 40552 - RNA, 18 nt, Human
aagugacuggcaggccaa

SEQ ID NO: 40553 - RNA, 22 nt, Human
aagugaucuaaagaauauugaa

SEQ ID NO: 40554 - RNA, 22 nt, Human
aagugauuauuguuuucagguu

SEQ ID NO: 40555 - RNA, 22 nt, Human
aagugauucuagucaugauucu

SEQ ID NO: 40556 - RNA, 22 nt, Human
aagugauuguuccguugagugu

SEQ ID NO: 40557 - RNA, 22 nt, Human
aagugauuucugccugcauguu

SEQ ID NO: 40558 - RNA, 22 nt, Human
aagugcaaaucuguggcugaaa

SEQ ID NO: 40559 - RNA, 22 nt, Human
aagugcaagcaggacuuaguuu

SEQ ID NO: 40560 - RNA, 22 nt, Human
aagugcaaugaauagcugcaau

SEQ ID NO: 40561 - RNA, 22 nt, Human
aagugcaggaguggggaaagua

SEQ ID NO: 40562 - RNA, 22 nt, Human
aagugcaguggcgugaucuugg

SEQ ID NO: 40563 - RNA, 22 nt, Human
aagugcauaauaacucccaagu

SEQ ID NO: 40564 - RNA, 22 nt, Human
aagugcauauuuuuguuguaga

SEQ ID NO: 40565 - RNA, 21 nt, Human
aagugccacccacagaugcau

SEQ ID NO: 40566 - RNA, 22 nt, Human
aagugccccaggcuguuaacau

SEQ ID NO: 40567 - RNA, 22 nt, Human
aagugcuagaaccccagcaaca

SEQ ID NO: 40568 - RNA, 23 nt, Human
aagugcucaguggacagcauugc

SEQ ID NO: 40569 - RNA, 22 nt, Human
aagugcugggauuacaagcgug

SEQ ID NO: 40570 - RNA, 22 nt, Human
aagugcugggauuacagguguc

SEQ ID NO: 40571 - RNA, 22 nt, Human
aagugcuuggagcauaccuguu

SEQ ID NO: 40572 - RNA, 22 nt, Human
aagugcuuuacaaaugucuguu

SEQ ID NO: 40573 - RNA, 23 nt, Human
aagugcuuugggauggagucugg

SEQ ID NO: 40574 - RNA, 22 nt, Human
aagugcuuuuucuugagcugcu

SEQ ID NO: 40575 - RNA, 22 nt, Human
aaguggaagagaaguuaucuua

SEQ ID NO: 40576 - RNA, 22 nt, Human
aaguggcagaauaguggcagga

SEQ ID NO: 40577 - RNA, 22 nt, Human
aaguggcagccuuagaaggaga

SEQ ID NO: 40578 - RNA, 22 nt, Human
aagugguguguuggaagaaauc

SEQ ID NO: 40579 - RNA, 22 nt, Human
aagugguugcuugugagucccc

SEQ ID NO: 40580 - RNA, 22 nt, Human
aaguguagauuauggagugucu

SEQ ID NO: 40581 - RNA, 22 nt, Human
aaguguccucauucaacaugca

SEQ ID NO: 40582 - RNA, 22 nt, Human
aagugucuagcaccuggaugca

SEQ ID NO: 40583 - RNA, 22 nt, Human
aagugucuuuauauuugagaaa

SEQ ID NO: 40584 - RNA, 22 nt, Human
aagugucuuuuagccacuuuua

SEQ ID NO: 40585 - RNA, 22 nt, Human
aagugugagacacacaaaauua

SEQ ID NO: 40586 - RNA, 22 nt, Human
aaguguggggucucagagcuga

SEQ ID NO: 40587 - RNA, 22 nt, Human
aagugugguuuaggcaucuuuu

SEQ ID NO: 40588 - RNA, 22 nt, Human
aaguguguauuguuuaugcugc

SEQ ID NO: 40589 - RNA, 22 nt, Human
aagugugugagccugucaggcu

SEQ ID NO: 40590 - RNA, 22 nt, Human
aaguguguuuccgugauugagg

SEQ ID NO: 40591 - RNA, 22 nt, Human
aaguguuaaaagauuaaaugcu

SEQ ID NO: 40592 - RNA, 22 nt, Human
aaguguuaaagacuugaacacu

SEQ ID NO: 40593 - RNA, 22 nt, Human
aaguguuuaacggugauugagc

SEQ ID NO: 40594 - RNA, 22 nt, Human
aaguguuuaaugguuuugauga

SEQ ID NO: 40595 - RNA, 22 nt, Human
aaguguuucuuggaauguugcg

SEQ ID NO: 40596 - RNA, 22 nt, Human
aaguguuuggggaucauuuuaa

SEQ ID NO: 40597 - RNA, 22 nt, Human
aaguguuuuggcuucuguacac

SEQ ID NO: 40598 - RNA, 22 nt, Human
aaguuaagcauggccaugugac

SEQ ID NO: 40599 - RNA, 22 nt, Human
aaguuaaguaguacucucuuca

SEQ ID NO: 40600 - RNA, 22 nt, Human
aaguuacaagacuaaauggaag

SEQ ID NO: 40601 - RNA, 22 nt, Human
aaguuacaguuaugaaacucac

SEQ ID NO: 40602 - RNA, 20 nt, Human
aaguuacauuguauuguacc

SEQ ID NO: 40603 - RNA, 22 nt, Human
aaguuacuaugacucuucuuuu

SEQ ID NO: 40604 - RNA, 22 nt, Human
aaguuacuggcaagggcugcag

SEQ ID NO: 40605 - RNA, 22 nt, Human
aaguuagguugcauuggucauc

SEQ ID NO: 40606 - RNA, 22 nt, Human
aaguuaguggauaaacagcaaa

SEQ ID NO: 40607 - RNA, 22 nt, Human
aaguuauaucaucucauugacg

SEQ ID NO: 40608 - RNA, 22 nt, Human
aaguuaucuuugauuagaaaua

SEQ ID NO: 40609 - RNA, 22 nt, Human
aaguuauuuccucgugacugaa

SEQ ID NO: 40610 - RNA, 22 nt, Human
aaguucaaaaauguaaucagug

SEQ ID NO: 40611 - RNA, 22 nt, Human
aaguucaaggugauaguggcag

SEQ ID NO: 40612 - RNA, 22 nt, Human
aaguucaagucugcaucuuuuu

SEQ ID NO: 40613 - RNA, 22 nt, Human
aaugggaagucacuacuguuac

SEQ ID NO: 40614 - RNA, 22 nt, Human
aaugggaggauuuucucucuug

SEQ ID NO: 40615 - RNA, 22 nt, Human
aaugguaauggagagaacuacu

SEQ ID NO: 40616 - RNA, 19 nt, Human
aaugguaauuagagaaaug

SEQ ID NO: 40617 - RNA, 22 nt, Human
aaugguaucaccucacagaauu

SEQ ID NO: 40618 - RNA, 22 nt, Human
aaugguuuaacauaugcuugag

SEQ ID NO: 40619 - RNA, 22 nt, Human
aaugguuuauggggaccgcaaa

SEQ ID NO: 40620 - RNA, 19 nt, Human
aaugguuugaugaaguaua

SEQ ID NO: 40621 - RNA, 22 nt, Human
aaugguuuguaccuguccuugg

SEQ ID NO: 40622 - RNA, 22 nt, Human
aaugguuuugcuuuaguauucu

SEQ ID NO: 40623 - RNA, 22 nt, Human
aauguacaaaagucagccaacu

SEQ ID NO: 40624 - RNA, 22 nt, Human
aauguaccagccuaagaagugg

SEQ ID NO: 40625 - RNA, 21 nt, Human
aauguauaacagagcccauca

SEQ ID NO: 40626 - RNA, 22 nt, Human
aauguaugaagguuccaguuuc

SEQ ID NO: 40627 - RNA, 22 nt, Human
aauguaugacaguucuaguggu

SEQ ID NO: 40628 - RNA, 22 nt, Human
aauguaugcugugguaucuucu

SEQ ID NO: 40629 - RNA, 22 nt, Human
aauguauggauucaugucugug

SEQ ID NO: 40630 - RNA, 22 nt, Human
aauguaugugcaucauuuacau

SEQ ID NO: 40631 - RNA, 22 nt, Human
aauguauguguauaucaaauca

SEQ ID NO: 40632 - RNA, 22 nt, Human
aauguauuugauguauuagccu

SEQ ID NO: 40633 - RNA, 22 nt, Human
aauguauuuugggaguuucuuu

SEQ ID NO: 40634 - RNA, 22 nt, Human
aaugucaacacaagagaaaugc

SEQ ID NO: 40635 - RNA, 22 nt, Human
aaugucauugagcuccaauccu

SEQ ID NO: 40636 - RNA, 22 nt, Human
aaugucauugugaguuaggcuu

SEQ ID NO: 40637 - RNA, 22 nt, Human
aauguccuaggcaugauuuugu

SEQ ID NO: 40638 - RNA, 22 nt, Human
aaugucuagacauguuaaugca

SEQ ID NO: 40639 - RNA, 22 nt, Human
aaugucuaugauccuuuaaguu

SEQ ID NO: 40640 - RNA, 22 nt, Human
aaugucugcucuacucaggagg

SEQ ID NO: 40641 - RNA, 22 nt, Human
aaugucugucugcacguugcuu

SEQ ID NO: 40642 - RNA, 22 nt, Human
aaugucuuaaagucguguuaca

SEQ ID NO: 40643 - RNA, 22 nt, Human
aaugucuuuaaagugcaauaga

SEQ ID NO: 40644 - RNA, 22 nt, Human
aaugucuuuuaaccucuggacu

SEQ ID NO: 40645 - RNA, 22 nt, Human
aaugucuuuugauacaaguuac

SEQ ID NO: 40646 - RNA, 18 nt, Human
aaugugaauauuuacuuc

SEQ ID NO: 40647 - RNA, 22 nt, Human
aaugugaggccuugguaguuau

SEQ ID NO: 40648 - RNA, 22 nt, Human
aaugugauuagccucuacugga

SEQ ID NO: 40649 - RNA, 22 nt, Human
aaugugcaggcucaaaccuugu

SEQ ID NO: 40650 - RNA, 22 nt, Human
aauguggaugauacuaguacuu

SEQ ID NO: 40651 - RNA, 22 nt, Human
aaugugguuaaaauuugguugu

SEQ ID NO: 40652 - RNA, 22 nt, Human
aauguguagcagaaccaggauu

SEQ ID NO: 40653 - RNA, 22 nt, Human
aauguguauaagggagagcuaa

SEQ ID NO: 40654 - RNA, 22 nt, Human
aauguguaugaggaagagagaa

SEQ ID NO: 40655 - RNA, 22 nt, Human
aaugugucagcuugucgaucuu

SEQ ID NO: 40656 - RNA, 22 nt, Human
aaugugucccuuauuucacagg

SEQ ID NO: 40657 - RNA, 22 nt, Human
aauguguguucggggcccagag

SEQ ID NO: 40658 - RNA, 22 nt, Human
aauguguuacuguguaagagca

SEQ ID NO: 40659 - RNA, 22 nt, Human
aauguguucaguuaaaugaacu

SEQ ID NO: 40660 - RNA, 22 nt, Human
aauguuacacagguauaaucag

SEQ ID NO: 40661 - RNA, 22 nt, Human
aauguuauuucugcauaguagu

SEQ ID NO: 40662 - RNA, 22 nt, Human
aauguucagugccuuuaaacau

SEQ ID NO: 40663 - RNA, 22 nt, Human
aauguucauuguuuuccauaug

SEQ ID NO: 40664 - RNA, 22 nt, Human
aauguucugauguaggguuuag

SEQ ID NO: 40665 - RNA, 22 nt, Human
aauguucugcaacuguuuucau

SEQ ID NO: 40666 - RNA, 22 nt, Human
aauguugacaguggugaucuca

SEQ ID NO: 40667 - RNA, 22 nt, Human
aauguugaccuccugaauguuu

SEQ ID NO: 40668 - RNA, 22 nt, Human
aauguugauguuuucagugagc

SEQ ID NO: 40669 - RNA, 22 nt, Human
aauguuguuggcucuucaugau

SEQ ID NO: 40670 - RNA, 22 nt, Human
aauuaggaauaaaugaguacuu

SEQ ID NO: 40671 - RNA, 22 nt, Human
aauuaggagaaaacuguugucu

SEQ ID NO: 40672 - RNA, 22 nt, Human
aauuagggagagguagcuaggu

SEQ ID NO: 40673 - RNA, 22 nt, Human
aauuaguauugcgauucauuag

SEQ ID NO: 40674 - RNA, 22 nt, Human
aauuaguucaauggaugauaga

SEQ ID NO: 40675 - RNA, 22 nt, Human
aauuauacaauugucaaguucu

SEQ ID NO: 40676 - RNA, 22 nt, Human
aauuauauguuaaucuucaauu

SEQ ID NO: 40677 - RNA, 22 nt, Human
aauuauauuguggugugaaugu

SEQ ID NO: 40678 - RNA, 22 nt, Human
aauuauggugugugguuaaggg

SEQ ID NO: 40679 - RNA, 22 nt, Human
aauucaaauuacaauaguuguu

SEQ ID NO: 40680 - RNA, 22 nt, Human
aauucaacagucaguuaucuca

SEQ ID NO: 40681 - RNA, 22 nt, Human
aauucacaaaaguuagauccau

SEQ ID NO: 40682 - RNA, 22 nt, Human
aauucacaauuauguugggaga

SEQ ID NO: 40683 - RNA, 22 nt, Human
aauucacagcauuugcccaucu

SEQ ID NO: 40684 - RNA, 22 nt, Human
aauucacauauacauuauuccu

SEQ ID NO: 40685 - RNA, 22 nt, Human
aauucagaagcacaaaaccuag

SEQ ID NO: 40686 - RNA, 22 nt, Human
aauucagauggaagauucuggc

SEQ ID NO: 40687 - RNA, 22 nt, Human
aauucagugguuucugcaacaa

SEQ ID NO: 40688 - RNA, 22 nt, Human
aauucaguuggcaaacaugcug

SEQ ID NO: 40689 - RNA, 22 nt, Human
aauucauagcaacaaagaccca

SEQ ID NO: 40690 - RNA, 22 nt, Human
aauucaugaguagaaucuauau

SEQ ID NO: 40691 - RNA, 22 nt, Human
aauucauuaagaaagagcuaaa

SEQ ID NO: 40692 - RNA, 22 nt, Human
aauucauugccagaaucuauga

SEQ ID NO: 40693 - RNA, 22 nt, Human
aauuccaacagacaaaguuaga

SEQ ID NO: 40694 - RNA, 22 nt, Human
aauuccauccauuuguuucaac

SEQ ID NO: 40695 - RNA, 21 nt, Human
aauucccagaaacagcacaag

SEQ ID NO: 40696 - RNA, 22 nt, Human
aauuccucuaucuuucuucaag

SEQ ID NO: 40697 - RNA, 22 nt, Human
aauuccugucuuaacaguucug

SEQ ID NO: 40698 - RNA, 22 nt, Human
aauuccuuuggaucuucuggag

SEQ ID NO: 40699 - RNA, 22 nt, Human
aauucuaaauguaauuuagaau

SEQ ID NO: 40700 - RNA, 22 nt, Human
aauucugagaacaaaagguacu

SEQ ID NO: 40701 - RNA, 22 nt, Human
aauucugaugaauaaaucaucc

SEQ ID NO: 40702 - RNA, 22 nt, Human
aauucugauuagaugccuuugu

SEQ ID NO: 40703 - RNA, 22 nt, Human
aauucuguuacuaaugugaugu

SEQ ID NO: 40704 - RNA, 22 nt, Human
aauucuucaagugcuuuggaga

SEQ ID NO: 40705 - RNA, 22 nt, Human
aauucuuggaaacauuacugga

SEQ ID NO: 40706 - RNA, 22 nt, Human
aauucuugguccuaguguauaa

SEQ ID NO: 40707 - RNA, 22 nt, Human
aauugaaagaagugggauugcc

SEQ ID NO: 40708 - RNA, 22 nt, Human
aauugaacuugaucuuuagcua

SEQ ID NO: 40709 - RNA, 22 nt, Human
aauugacagaaaguuuacgagg

SEQ ID NO: 40710 - RNA, 22 nt, Human
aauugagaugacagaggaauag

SEQ ID NO: 40711 - RNA, 22 nt, Human
aauugcaauuuucuuaaggucu

SEQ ID NO: 40712 - RNA, 22 nt, Human
aauugcauauauaugaggccau

SEQ ID NO: 40713 - RNA, 22 nt, Human
aauugcauuacagaaacuuuca

SEQ ID NO: 40714 - RNA, 22 nt, Human
aauugcuaguuuguagcauuug

SEQ ID NO: 40715 - RNA, 22 nt, Human
aauugcuuacuguuuuucaccu

SEQ ID NO: 40716 - RNA, 17 nt, Human
aauugcuuguacuccca

SEQ ID NO: 40717 - RNA, 22 nt, Human
aauugcuuugaagaagggagcg

SEQ ID NO: 40718 - RNA, 22 nt, Human
aauuggcuauauuauuuagccu

SEQ ID NO: 40719 - RNA, 22 nt, Human
aauugguuugaguugucucuau

SEQ ID NO: 40720 - RNA, 22 nt, Human
aauuguaagugcugaguuaagg

SEQ ID NO: 40721 - RNA, 22 nt, Human
aauuguacaagccuugugccau

SEQ ID NO: 40722 - RNA, 22 nt, Human
aaugugugaacuucagagcauc

SEQ ID NO: 40723 - RNA, 22 nt, Human
aaugugugccuguuaaggggca

SEQ ID NO: 40724 - RNA, 22 nt, Human
aauguguuuaguuaaugaguug

SEQ ID NO: 40725 - RNA, 22 nt, Human
aauguguuuucacugaagauuc

SEQ ID NO: 40726 - RNA, 22 nt, Human
aauguuaaaaccuucagugcuu

SEQ ID NO: 40727 - RNA, 22 nt, Human
aauguuaaguuuagauuauaac

SEQ ID NO: 40728 - RNA, 22 nt, Human
aauguuaauguguuugcuuaug

SEQ ID NO: 40729 - RNA, 22 nt, Human
aauguuaauucacagccaaaua

SEQ ID NO: 40730 - RNA, 22 nt, Human
aauguuacaggaccuaagauga

SEQ ID NO: 40731 - RNA, 22 nt, Human
aauguuacgaucaacaacacau

SEQ ID NO: 40732 - RNA, 22 nt, Human
aauguuaugugguucaacuuaa

SEQ ID NO: 40733 - RNA, 22 nt, Human
aauguuauuguccuuuccaaaa

SEQ ID NO: 40734 - RNA, 20 nt, Human
aauguucaaaggugauggca

SEQ ID NO: 40735 - RNA, 22 nt, Human
aauguucaguagaauaggaaug

SEQ ID NO: 40736 - RNA, 22 nt, Human
aauguucauuagcauuguugac

SEQ ID NO: 40737 - RNA, 22 nt, Human
aauguuccuauuuacccccuaa

SEQ ID NO: 40738 - RNA, 22 nt, Human
aauguugagcuugaaaguaggu

SEQ ID NO: 40739 - RNA, 22 nt, Human
aauguuguaaauauucuuugag

SEQ ID NO: 40740 - RNA, 20 nt, Human
aauguuucugaacagguagu

SEQ ID NO: 40741 - RNA, 22 nt, Human
aauguuugaccaaaaaacugca

SEQ ID NO: 40742 - RNA, 22 nt, Human
aauguuugcaucuauucacaug

SEQ ID NO: 40743 - RNA, 22 nt, Human
aauguuugucaucacacagaua

SEQ ID NO: 40744 - RNA, 18 nt, Human
aauguuuguccucucuaa

SEQ ID NO: 40745 - RNA, 22 nt, Human
aauguuuuaaaagagauugaga

SEQ ID NO: 40746 - RNA, 22 nt, Human
aauguuuuacagaucccauuag

SEQ ID NO: 40747 - RNA, 22 nt, Human
aauguuuucauuauccuaacug

SEQ ID NO: 40748 - RNA, 22 nt, Human
aauuaaaaaaggagagcuugcu

SEQ ID NO: 40749 - RNA, 22 nt, Human
aauuaaauugguuuagagagga

SEQ ID NO: 40750 - RNA, 22 nt, Human
aauuaacuaaaauucacuuuau

SEQ ID NO: 40751 - RNA, 22 nt, Human
aauuaagucacacaccuaaacc

SEQ ID NO: 40752 - RNA, 22 nt, Human
aauuaauauuuguggaauuaau

SEQ ID NO: 40753 - RNA, 22 nt, Human
aauuaauucaguuuuuaaggga

SEQ ID NO: 40754 - RNA, 22 nt, Human
aauuaauuuuguucauucaguc

SEQ ID NO: 40755 - RNA, 23 nt, Human
aauuacaaccaagaacuggaagg

SEQ ID NO: 40756 - RNA, 22 nt, Human
aauuagaaccagaagccauauu

SEQ ID NO: 40757 - RNA, 22 nt, Human
aauuagaagcuguuagcaaaau

SEQ ID NO: 40758 - RNA, 22 nt, Human
aauuagagaagcuucuuccauu

SEQ ID NO: 40759 - RNA, 22 nt, Human
aauuagaguagagccuaagaau

SEQ ID NO: 40760 - RNA, 20 nt, Human
aauuagcuuaagucaaucag

SEQ ID NO: 40761 - RNA, 22 nt, Human
aauuagcuucagcuuguggggc

SEQ ID NO: 40762 - RNA, 22 nt, Human
aauuagcuuuaccuaggauugu

SEQ ID NO: 40763 - RNA, 22 nt, Human
aauuagggaaguauuuaguagu

SEQ ID NO: 40764 - RNA, 22 nt, Human
aauuaguucacguccugugcuu

SEQ ID NO: 40765 - RNA, 22 nt, Human
aauuauggucacuguuccuggg

SEQ ID NO: 40766 - RNA, 22 nt, Human
aauucaaucuguagauugugau

SEQ ID NO: 40767 - RNA, 22 nt, Human
aauucacaccuccgguuuuucu

SEQ ID NO: 40768 - RNA, 22 nt, Human
aauucacagaaccauggugcuc

SEQ ID NO: 40769 - RNA, 22 nt, Human
aauucacauccgaccaggucaa

SEQ ID NO: 40770 - RNA, 22 nt, Human
aauucacauguugaaguccuaa

SEQ ID NO: 40771 - RNA, 22 nt, Human
aauucagaaaaauucacuccua

SEQ ID NO: 40772 - RNA, 22 nt, Human
aauucagcaaaaagauacagga

SEQ ID NO: 40773 - RNA, 22 nt, Human
aauucagcacagaggaaccagu

SEQ ID NO: 40774 - RNA, 22 nt, Human
aauucagguuauauuugcaacu

SEQ ID NO: 40775 - RNA, 22 nt, Human
aauucauacucuauauugcuuu

SEQ ID NO: 40776 - RNA, 22 nt, Human
aauucaucauuuuauagcuagu

SEQ ID NO: 40777 - RNA, 22 nt, Human
aauuccaaguagcaucccauca

SEQ ID NO: 40778 - RNA, 22 nt, Human
aauuccacagaugucuaucugu

SEQ ID NO: 40779 - RNA, 22 nt, Human
aauuccagaggaggacaguccu

SEQ ID NO: 40780 - RNA, 22 nt, Human
aauuccuaguuguacuuaguga

SEQ ID NO: 40781 - RNA, 22 nt, Human
aauucucaggaauuucaucugu

SEQ ID NO: 40782 - RNA, 22 nt, Human
aauucucagguaaaaguuaagu

SEQ ID NO: 40783 - RNA, 22 nt, Human
aauucugaugauacugcauugu

SEQ ID NO: 40784 - RNA, 20 nt, Human
aauucugucuuuucugcugc

SEQ ID NO: 40785 - RNA, 22 nt, Human
aauucugugcaggcagagcuau

SEQ ID NO: 40786 - RNA, 19 nt, Human
aauucuguuucagcagauc

SEQ ID NO: 40787 - RNA, 22 nt, Human
acaaaugcagcauaaagugaac

SEQ ID NO: 40788 - RNA, 23 nt, Human
acaaaugcccauacaucuaguuc

SEQ ID NO: 40789 - RNA, 22 nt, Human
acaaaugcuuaguucaccaaaa

SEQ ID NO: 40790 - RNA, 22 nt, Human
acaaauggaacaaugaagacug

SEQ ID NO: 40791 - RNA, 22 nt, Human
acaaauggacucucaucuuuug

SEQ ID NO: 40792 - RNA, 22 nt, Human
acaaaugugauuguuucugaaa

SEQ ID NO: 40793 - RNA, 22 nt, Human
acaaauguuggauuugucuucc

SEQ ID NO: 40794 - RNA, 22 nt, Human
acaaauugccuagucuagcauc

SEQ ID NO: 40795 - RNA, 22 nt, Human
acaaauuguugggacucagccc

SEQ ID NO: 40796 - RNA, 21 nt, Human
acaaauuguuuauauaggaag

SEQ ID NO: 40797 - RNA, 22 nt, Human
acaaauuuauugaagggcauau

SEQ ID NO: 40798 - RNA, 22 nt, Human
acaaauuugaauccugacuucu

SEQ ID NO: 40799 - RNA, 22 nt, Human
acaaauuuggugagaguaaaua

SEQ ID NO: 40800 - RNA, 22 nt, Human
acaaauuuguguaguuauggca

SEQ ID NO: 40801 - RNA, 20 nt, Human
acaacaaacuugcuuaagga

SEQ ID NO: 40802 - RNA, 22 nt, Human
acaacacauguguauaugugug

SEQ ID NO: 40803 - RNA, 22 nt, Human
acaacaggguaaggcaggccau

SEQ ID NO: 40804 - RNA, 22 nt, Human
acaacaguagccuuuacaaggc

SEQ ID NO: 40805 - RNA, 22 nt, Human
acaacaguuuagguauuuguag

SEQ ID NO: 40806 - RNA, 22 nt, Human
acaaccaagaacagagggaaag

SEQ ID NO: 40807 - RNA, 22 nt, Human
acaacuguuggaggaacacagg

SEQ ID NO: 40808 - RNA, 22 nt, Human
acaacuucaauugggauucucc

SEQ ID NO: 40809 - RNA, 22 nt, Human
acaacuucucacagauaaauuu

SEQ ID NO: 40810 - RNA, 23 nt, Human
acaacuuuacagauacauuuugu

SEQ ID NO: 40811 - RNA, 22 nt, Human
acaacuuuagucuggagggaaa

SEQ ID NO: 40812 - RNA, 22 nt, Human
acaacuuucuggguuaucugau

SEQ ID NO: 40813 - RNA, 22 nt, Human
acaacuuugacccuuguucuua

SEQ ID NO: 40814 - RNA, 22 nt, Human
acaacuuuguagcaauuccacg

SEQ ID NO: 40815 - RNA, 22 nt, Human
acaagaagagcauuugcagggu

SEQ ID NO: 40816 - RNA, 22 nt, Human
acaagaagucacaucuaggagu

SEQ ID NO: 40817 - RNA, 22 nt, Human
acaagaauuauuucuaguuaac

SEQ ID NO: 40818 - RNA, 22 nt, Human
acaagagagacacuaggaaugu

SEQ ID NO: 40819 - RNA, 22 nt, Human
acaagagcauugcagguguguu

SEQ ID NO: 40820 - RNA, 22 nt, Human
acaagagcccuuucagauugac

SEQ ID NO: 40821 - RNA, 22 nt, Human
acaagaguaauuucaacagagu

SEQ ID NO: 40822 - RNA, 22 nt, Human
acaagagugagauuaucaugua

SEQ ID NO: 40823 - RNA, 22 nt, Human
acaagcacuucacuguccucug

SEQ ID NO: 40824 - RNA, 22 nt, Human
acaagcagagauuaaauguuuu

SEQ ID NO: 40825 - RNA, 22 nt, Human
acaagcauaagugagaugaaua

SEQ ID NO: 40826 - RNA, 22 nt, Human
acaagcaugugguaaaaagacc

SEQ ID NO: 40827 - RNA, 22 nt, Human
acaagcucagaucccugucucu

SEQ ID NO: 40828 - RNA, 20 nt, Human
acaaggaaccaggagguggc

SEQ ID NO: 40829 - RNA, 22 nt, Human
acaaggacaugcaauuuggauu

SEQ ID NO: 40830 - RNA, 22 nt, Human
acaaggcacuuuaugaagagga

SEQ ID NO: 40831 - RNA, 22 nt, Human
acaacaaucuacccuagcuucu

SEQ ID NO: 40832 - RNA, 22 nt, Human
acaacacagcuuuccucaaguu

SEQ ID NO: 40833 - RNA, 22 nt, Human
acaacaguccaguauagacugu

SEQ ID NO: 40834 - RNA, 22 nt, Human
acaacauucuuaaauacacuga

SEQ ID NO: 40835 - RNA, 22 nt, Human
acaacuagcagguauuaauuuu

SEQ ID NO: 40836 - RNA, 22 nt, Human
acaacugaugggucauguggga

SEQ ID NO: 40837 - RNA, 22 nt, Human
acaacuggcuuuuuagcuuguu

SEQ ID NO: 40838 - RNA, 22 nt, Human
acaacugggggcauuacuggca

SEQ ID NO: 40839 - RNA, 22 nt, Human
acaacuguuagacacuucuaag

SEQ ID NO: 40840 - RNA, 22 nt, Human
acaacuuuaauggguuucagcu

SEQ ID NO: 40841 - RNA, 22 nt, Human
acaacuuuucuaucauguggaa

SEQ ID NO: 40842 - RNA, 22 nt, Human
acaagaaagguaggauucaggu

SEQ ID NO: 40843 - RNA, 22 nt, Human
acaagauacucagcuacaagac

SEQ ID NO: 40844 - RNA, 22 nt, Human
acaagauucaaugaauugauug

SEQ ID NO: 40845 - RNA, 22 nt, Human
acaagauuuaaugcaacccaag

SEQ ID NO: 40846 - RNA, 22 nt, Human
acaagauuuuaugacucuuuuu

SEQ ID NO: 40847 - RNA, 22 nt, Human
acaagauuuugucugguagggu

SEQ ID NO: 40848 - RNA, 17 nt, Human
acaagcaguggccaugg

SEQ ID NO: 40849 - RNA, 22 nt, Human
acaagccaauuacugugccagg

SEQ ID NO: 40850 - RNA, 22 nt, Human
acaagcgagcggcuucuggccg

SEQ ID NO: 40851 - RNA, 22 nt, Human
acaagcgggccacagugcuggu

SEQ ID NO: 40852 - RNA, 22 nt, Human
acaagcuguggugggacaagag

SEQ ID NO: 40853 - RNA, 22 nt, Human
acaagcuuauuaaguuaucugu

SEQ ID NO: 40854 - RNA, 22 nt, Human
acaagcuuugugauaguagaga

SEQ ID NO: 40855 - RNA, 22 nt, Human
acaaggagaagaaauuggucau

SEQ ID NO: 40856 - RNA, 22 nt, Human
acaaggagagcacacaugggga

SEQ ID NO: 40857 - RNA, 22 nt, Human
acaaggaggauauguuuaaggg

SEQ ID NO: 40858 - RNA, 22 nt, Human
acaaggauuuguuccuaauguu

SEQ ID NO: 40859 - RNA, 23 nt, Human
acaaggcaacauagaucagggca

SEQ ID NO: 40860 - RNA, 22 nt, Human
acaaggcuaugaaguauuaguu

SEQ ID NO: 40861 - RNA, 23 nt, Human
acaaggcucuguucugcaguuuc

SEQ ID NO: 40862 - RNA, 22 nt, Human
acaaggcugaacagugaagccg

SEQ ID NO: 40863 - RNA, 19 nt, Human
acaagggcaggcaagguga

SEQ ID NO: 40864 - RNA, 22 nt, Human
acaagguacaaaacagagcaca

SEQ ID NO: 40865 - RNA, 18 nt, Human
acaaggucaauugguuac

SEQ ID NO: 40866 - RNA, 22 nt, Human
acaagguugauucuggcaucug

SEQ ID NO: 40867 - RNA, 22 nt, Human
acaagguuugguaccacaucca

SEQ ID NO: 40868 - RNA, 22 nt, Human
acaagguuugguccuauauuuu

SEQ ID NO: 40869 - RNA, 22 nt, Human
acaaguaauuuaugcaaacgga

SEQ ID NO: 40870 - RNA, 22 nt, Human
acaaguaccaaaugcucaagua

SEQ ID NO: 40871 - RNA, 22 nt, Human
acaaguaguaaauuauuaggug

SEQ ID NO: 40872 - RNA, 22 nt, Human
acaagucacucuaucauuuuca

SEQ ID NO: 40873 - RNA, 22 nt, Human
acaagucaguggaauuaauauu

SEQ ID NO: 40874 - RNA, 22 nt, Human
acaagucucaacagcagccagc

SEQ ID NO: 40875 - RNA, 22 nt, Human
acaagucuuuuucaugucuucu

SEQ ID NO: 40876 - RNA, 22 nt, Human
acaaguggguccuacauaaagc

SEQ ID NO: 40877 - RNA, 23 nt, Human
acaaguguuuccaauauggcugg

SEQ ID NO: 40878 - RNA, 22 nt, Human
acaaguucugggaauuaggaca

SEQ ID NO: 40879 - RNA, 22 nt, Human
acaaguuuauuugauuagaaca

SEQ ID NO: 40880 - RNA, 22 nt, Human
acaaguuuuggaagucuuaagg

SEQ ID NO: 40881 - RNA, 20 nt, Human
acaauacagguugugucuga

SEQ ID NO: 40882 - RNA, 22 nt, Human
acaauacuagccaagguuauua

SEQ ID NO: 40883 - RNA, 19 nt, Human
acaauagaaaagucuuuug

SEQ ID NO: 40884 - RNA, 22 nt, Human
acaauagauacugggcacauau

SEQ ID NO: 40885 - RNA, 22 nt, Human
acaauauacacauccuaauggg

SEQ ID NO: 40886 - RNA, 22 nt, Human
acaaucacacaugcaauuauac

SEQ ID NO: 40887 - RNA, 22 nt, Human
acaaucuuauuaguaguauaga

SEQ ID NO: 40888 - RNA, 22 nt, Human
acaaugaacgcuuuuuaacugu

SEQ ID NO: 40889 - RNA, 22 nt, Human
acaaugaagauaauguugcagu

SEQ ID NO: 40890 - RNA, 22 nt, Human
acaaugaagcuccacugagcuu

SEQ ID NO: 40891 - RNA, 22 nt, Human
acaaugaauacuaagcaccagg

SEQ ID NO: 40892 - RNA, 22 nt, Human
acaaugaauuuaauaccuuauu

SEQ ID NO: 40893 - RNA, 22 nt, Human
acaaugaccaaaauguuuccag

SEQ ID NO: 40894 - RNA, 22 nt, Human
acaaugcaauaggagcuagaaa

SEQ ID NO: 40895 - RNA, 22 nt, Human
acaaugcaccagcaucuucacc

SEQ ID NO: 40896 - RNA, 22 nt, Human
acaaugcaccuauuuuaaaacu

SEQ ID NO: 40897 - RNA, 22 nt, Human
acaaugcucauauuuaugccaa

SEQ ID NO: 40898 - RNA, 22 nt, Human
acaauguaggcugaaaaagcuu

SEQ ID NO: 40899 - RNA, 22 nt, Human
acaauguaguugucaugagaca

SEQ ID NO: 40900 - RNA, 22 nt, Human
acaaugugggcaugagaaacca

SEQ ID NO: 40901 - RNA, 22 nt, Human
acaauguucuacauauacauaa

SEQ ID NO: 40902 - RNA, 22 nt, Human
aauucuuguuguuaguauauuu

SEQ ID NO: 40903 - RNA, 22 nt, Human
aauugaaauucuuuguggucca

SEQ ID NO: 40904 - RNA, 21 nt, Human
aauugaagauguggagccauu

SEQ ID NO: 40905 - RNA, 22 nt, Human
aauugacaaaucauacuuguau

SEQ ID NO: 40906 - RNA, 22 nt, Human
aauugcaacagguagacuuuuc

SEQ ID NO: 40907 - RNA, 22 nt, Human
aauugcacauuucaguguucug

SEQ ID NO: 40908 - RNA, 22 nt, Human
aauugcauaaauuucauagcau

SEQ ID NO: 40909 - RNA, 22 nt, Human
aauugcauguuaaugacuaagu

SEQ ID NO: 40910 - RNA, 20 nt, Human
aauugcccauccuccuagcc

SEQ ID NO: 40911 - RNA, 22 nt, Human
aauugcuagacuauacuguaau

SEQ ID NO: 40912 - RNA, 22 nt, Human
aauugcuuaucuuguugaauag

SEQ ID NO: 40913 - RNA, 16 nt, Human
aauugcuucuugcugc

SEQ ID NO: 40914 - RNA, 22 nt, Human
aauugcuuuacaagccguuuaa

SEQ ID NO: 40915 - RNA, 22 nt, Human
aauuggacugugcugcucaaaa

SEQ ID NO: 40916 - RNA, 23 nt, Human
aauuggacuugcugucaaacuuc

SEQ ID NO: 40917 - RNA, 22 nt, Human
aauuggcagaacuuuauauauu

SEQ ID NO: 40918 - RNA, 22 nt, Human
aauugguuugaauaaauaaaga

SEQ ID NO: 40919 - RNA, 22 nt, Human
aauuguacaggaaguugcugga

SEQ ID NO: 40920 - RNA, 17 nt, Human
aauugucagcaguagcu

SEQ ID NO: 40921 - RNA, 22 nt, Human
aauugugcccgugacauuucau

SEQ ID NO: 40922 - RNA, 22 nt, Human
aauuuacaggugcacucgccau

SEQ ID NO: 40923 - RNA, 22 nt, Human
aauuuagauugauaaacaugga

SEQ ID NO: 40924 - RNA, 22 nt, Human
aauuuaguccuuacagugcaga

SEQ ID NO: 40925 - RNA, 22 nt, Human
aauuuauauguaauuaggcaca

SEQ ID NO: 40926 - RNA, 22 nt, Human
aauuuaucuuuaguaagcuucu

SEQ ID NO: 40927 - RNA, 22 nt, Human
aauuucacagugaacuuugagg

SEQ ID NO: 40928 - RNA, 22 nt, Human
aauuucaccugcacuacaucgc

SEQ ID NO: 40929 - RNA, 22 nt, Human
aauuucacuggaaaagauaauu

SEQ ID NO: 40930 - RNA, 22 nt, Human
aauuucagaacccaaauuagcg

SEQ ID NO: 40931 - RNA, 22 nt, Human
aauuucagaccauuugcaauua

SEQ ID NO: 40932 - RNA, 22 nt, Human
aauuucagagguagagauucua

SEQ ID NO: 40933 - RNA, 22 nt, Human
aauuucagcucaaacuuguguu

SEQ ID NO: 40934 - RNA, 22 nt, Human
aauuucagcuuaaguuguuugg

SEQ ID NO: 40935 - RNA, 22 nt, Human
aauuucaguaugaaguuucaca

SEQ ID NO: 40936 - RNA, 22 nt, Human
aauuuccagaucagaugacuca

SEQ ID NO: 40937 - RNA, 23 nt, Human
aauuuccccugucucugauuugg

SEQ ID NO: 40938 - RNA, 22 nt, Human
aauuucucaauuguuacaggug

SEQ ID NO: 40939 - RNA, 20 nt, Human
aauuucuccuggguaacaga

SEQ ID NO: 40940 - RNA, 22 nt, Human
acaacaaaaucacuagucuucc

SEQ ID NO: 40941 - RNA, 22 nt, Human
acaacaagagcuaaggguaagg

SEQ ID NO: 40942 - RNA, 22 nt, Human
acaacagagcuggacugagagg

SEQ ID NO: 40943 - RNA, 23 nt, Human
acaacaggaaaucagaccugaac

SEQ ID NO: 40944 - RNA, 22 nt, Human
acaacagugugguggaaggagc

SEQ ID NO: 40945 - RNA, 22 nt, Human
acaacauuuaaggaggcacuga

SEQ ID NO: 40946 - RNA, 23 nt, Human
acaaccagcacuggagggcacca

SEQ ID NO: 40947 - RNA, 22 nt, Human
acaaccuguucguuuccacaga

SEQ ID NO: 40948 - RNA, 22 nt, Human
acaacugucuucuucaugcucc

SEQ ID NO: 40949 - RNA, 22 nt, Human
acaagaaccaaagaaggauauu

SEQ ID NO: 40950 - RNA, 22 nt, Human
acaagaauguagauuaguuaag

SEQ ID NO: 40951 - RNA, 22 nt, Human
acaagagacaagagguucuucu

SEQ ID NO: 40952 - RNA, 22 nt, Human
acaagagucugcauuucuaaca

SEQ ID NO: 40953 - RNA, 22 nt, Human
acaagauguguuuauacaagcu

SEQ ID NO: 40954 - RNA, 22 nt, Human
acaagauugauaagucugcccu

SEQ ID NO: 40955 - RNA, 22 nt, Human
acaagauuuagcuuaaagggcu

SEQ ID NO: 40956 - RNA, 23 nt, Human
acaagcagcccagugcucugccu

SEQ ID NO: 40957 - RNA, 22 nt, Human
acaagcaucagguucagcaaua

SEQ ID NO: 40958 - RNA, 22 nt, Human
acaagcaugggcuuugacauca

SEQ ID NO: 40959 - RNA, 22 nt, Human
acaagcuccuuauucagcuggg

SEQ ID NO: 40960 - RNA, 22 nt, Human
acaaggacauaggaaacuacaa

SEQ ID NO: 40961 - RNA, 22 nt, Human
acaaggaccaugaggcagaccc

SEQ ID NO: 40962 - RNA, 22 nt, Human
acaaggacgucacuuccacggu

SEQ ID NO: 40963 - RNA, 22 nt, Human
acaaggaggucuggggggcccu

SEQ ID NO: 40964 - RNA, 22 nt, Human
acaaggaucuguguaggcaggc

SEQ ID NO: 40965 - RNA, 22 nt, Human
acaaggcaauggcaggauuuca

SEQ ID NO: 40966 - RNA, 22 nt, Human
acaaggcaauuccuggugaauu

SEQ ID NO: 40967 - RNA, 22 nt, Human
acaaggcaguacaaugaugaca

SEQ ID NO: 40968 - RNA, 22 nt, Human
acaaggcaguuaaaaugguuaa

SEQ ID NO: 40969 - RNA, 22 nt, Human
acaaggcauuccggaaguaacc

SEQ ID NO: 40970 - RNA, 22 nt, Human
acaaggcgugacggagagagga

SEQ ID NO: 40971 - RNA, 22 nt, Human
acaaggcuaauuuggaagauac

SEQ ID NO: 40972 - RNA, 22 nt, Human
acaaggcugcugugauugggaa

SEQ ID NO: 40973 - RNA, 22 nt, Human
acaaggcuggcugggaaaaacu

SEQ ID NO: 40974 - RNA, 22 nt, Human
acaaggcugugggagaaccucu

SEQ ID NO: 40975 - RNA, 22 nt, Human
acaagggauuguugaguagucu

SEQ ID NO: 40976 - RNA, 22 nt, Human
acaagguaagaaacauuggcuu

SEQ ID NO: 40977 - RNA, 22 nt, Human
acaagguuguucugaggauuua

SEQ ID NO: 40978 - RNA, 22 nt, Human
acaagguuuaaauagccaucag

SEQ ID NO: 40979 - RNA, 22 nt, Human
acaaguaggugcacuucaauag

SEQ ID NO: 40980 - RNA, 22 nt, Human
acaauaaggauuuuuaggggca

SEQ ID NO: 40981 - RNA, 22 nt, Human
acaauacuauuuucaguauccu

SEQ ID NO: 40982 - RNA, 22 nt, Human
acaauacuuaccaauguuuuug

SEQ ID NO: 40983 - RNA, 22 nt, Human
acaauagaaauaauuaagcaca

SEQ ID NO: 40984 - RNA, 22 nt, Human
acaauagaaggaaacugacaua

SEQ ID NO: 40985 - RNA, 21 nt, Human
acaauagaauagaguguggug

SEQ ID NO: 40986 - RNA, 22 nt, Human
acaauagacaaagugaauggcu

SEQ ID NO: 40987 - RNA, 22 nt, Human
acaauagucaaugcacgucauu

SEQ ID NO: 40988 - RNA, 22 nt, Human
acaauagugccuggcauagagu

SEQ ID NO: 40989 - RNA, 22 nt, Human
acaauauuugggggcaguuugu

SEQ ID NO: 40990 - RNA, 22 nt, Human
acaaucuggaaaaguuaacuau

SEQ ID NO: 40991 - RNA, 20 nt, Human
acaaucuguuuguugucugu

SEQ ID NO: 40992 - RNA, 22 nt, Human
acaaugaaaaaauuuacugugg

SEQ ID NO: 40993 - RNA, 22 nt, Human
acaaugaaagguauucugaacu

SEQ ID NO: 40994 - RNA, 22 nt, Human
acaaugaagggagacacuugcu

SEQ ID NO: 40995 - RNA, 19 nt, Human
acaaugaauguguucucuu

SEQ ID NO: 40996 - RNA, 22 nt, Human
acaaugaugcagaugaguaaga

SEQ ID NO: 40997 - RNA, 22 nt, Human
acaaugauuuuuuagaguaguu

SEQ ID NO: 40998 - RNA, 22 nt, Human
acaaugcaauuguaaggugugu

SEQ ID NO: 40999 - RNA, 23 nt, Human
acaaugcacuuuaaaugguuccc

SEQ ID NO: 41000 - RNA, 17 nt, Human
acaaugcagucucuagu

SEQ ID NO: 41001 - RNA, 22 nt, Human
acaaugcauaaguuucucccag

SEQ ID NO: 41002 - RNA, 22 nt, Human
acaaugcugcagggaaauuagg

SEQ ID NO: 41003 - RNA, 22 nt, Human
acaaugcuguugagacauucuu

SEQ ID NO: 41004 - RNA, 22 nt, Human
acaaugcuugguuuuucuagaa

SEQ ID NO: 41005 - RNA, 22 nt, Human
acaauguaggaguaugacagua

SEQ ID NO: 41006 - RNA, 22 nt, Human
acaauguaggauauguacuugu

SEQ ID NO: 41007 - RNA, 22 nt, Human
acaaugucaaaauaggaaacau

SEQ ID NO: 41008 - RNA, 22 nt, Human
acaaugucaccucucauguuuu

SEQ ID NO: 41009 - RNA, 22 nt, Human
acaaugugcuuaugaaggcagu

SEQ ID NO: 41010 - RNA, 22 nt, Human
acaauuacucaacuuugcugcu

SEQ ID NO: 41011 - RNA, 22 nt, Human
acaauucaagaagagagaugaa

SEQ ID NO: 41012 - RNA, 22 nt, Human
acaauucaagaugagauucagg

SEQ ID NO: 41013 - RNA, 22 nt, Human
acaauucugaugguuucccagu

SEQ ID NO: 41014 - RNA, 22 nt, Human
acaauucuggguauuuauauag

SEQ ID NO: 41015 - RNA, 22 nt, Human
acaauugacuguauuuuuagcu

SEQ ID NO: 41016 - RNA, 21 nt, Human
acaauugauggcuuaaguugc

SEQ ID NO: 41017 - RNA, 22 nt, Human
acaauugcuaaugcuucuguug

SEQ ID NO: 41018 - RNA, 22 nt, Human
acaauuuuaagccagagugggu

SEQ ID NO: 41019 - RNA, 22 nt, Human
acaauuuuccccauagguuauc

SEQ ID NO: 41020 - RNA, 22 nt, Human
acacaaaguuggaugacaaaau

SEQ ID NO: 41021 - RNA, 17 nt, Human
acacaagcaccuugagg

SEQ ID NO: 41022 - RNA, 22 nt, Human
acacaagcagcuuuugagcgga

SEQ ID NO: 41023 - RNA, 22 nt, Human
acacaagggccuauaguguauu

SEQ ID NO: 41024 - RNA, 22 nt, Human
acacaagucccuccauacucuc

SEQ ID NO: 41025 - RNA, 22 nt, Human
acacaaugauucacaagcagca

SEQ ID NO: 41026 - RNA, 22 nt, Human
acacaaugucaucauaauguca

SEQ ID NO: 41027 - RNA, 22 nt, Human
acacaauuucauaaacaccaug

SEQ ID NO: 41028 - RNA, 20 nt, Human
acacacagagacaugcgcau

SEQ ID NO: 41029 - RNA, 19 nt, Human
acacaccagugccugugac

SEQ ID NO: 41030 - RNA, 22 nt, Human
acacaccaugauuuauuuaccc

SEQ ID NO: 41031 - RNA, 21 nt, Human
acacacugaguuuuccacugu

SEQ ID NO: 41032 - RNA, 22 nt, Human
acacacugcucgcucagauuaa

SEQ ID NO: 41033 - RNA, 22 nt, Human
acacagaaccucauagccucuc

SEQ ID NO: 41034 - RNA, 22 nt, Human
acacagaagaucucuuaaugcu

SEQ ID NO: 41035 - RNA, 22 nt, Human
acacagaagcuuuuucuauucc

SEQ ID NO: 41036 - RNA, 22 nt, Human
acaggaggagcuguuucaggga

SEQ ID NO: 41037 - RNA, 22 nt, Human
acaggagggacaccuuccugcu

SEQ ID NO: 41038 - RNA, 22 nt, Human
acaggaguuaaccaugggaagu

SEQ ID NO: 41039 - RNA, 22 nt, Human
acaggaguuucugacagagaca

SEQ ID NO: 41040 - RNA, 22 nt, Human
acaggaugauaaaggauggcca

SEQ ID NO: 41041 - RNA, 21 nt, Human
acaggaugauuuuuccuuaug

SEQ ID NO: 41042 - RNA, 22 nt, Human
acaggauggccagcugauauug

SEQ ID NO: 41043 - RNA, 22 nt, Human
acaggaugggcgcacagagcua

SEQ ID NO: 41044 - RNA, 22 nt, Human
acaggauuaauaaaaaauugua

SEQ ID NO: 41045 - RNA, 22 nt, Human
acaggcaaggccagugagaaau

SEQ ID NO: 41046 - RNA, 22 nt, Human
acaggcaagucacacaacuugu

SEQ ID NO: 41047 - RNA, 21 nt, Human
acaggcaauuucauaugguuc

SEQ ID NO: 41048 - RNA, 22 nt, Human
acaggcacaggugugccccacc

SEQ ID NO: 41049 - RNA, 22 nt, Human
acaguguuuucuuaaggagaaa

SEQ ID NO: 41050 - RNA, 22 nt, Human
acaguuaaauauuucuacuggg

SEQ ID NO: 41051 - RNA, 22 nt, Human
acaguuaagcaguaugaucaca

SEQ ID NO: 41052 - RNA, 22 nt, Human
acaguuaauaaguaguaaguca

SEQ ID NO: 41053 - RNA, 22 nt, Human
acaguuacauuaaacaaaagga

SEQ ID NO: 41054 - RNA, 23 nt, Human
acaguuauagcugugaauaacau

SEQ ID NO: 41055 - RNA, 22 nt, Human
acaguucacuuuuuauaucaaa

SEQ ID NO: 41056 - RNA, 22 nt, Human
acaguucagacaaguguuccau

SEQ ID NO: 41057 - RNA, 19 nt, Human
acaguucuaauuucugugg

SEQ ID NO: 41058 - RNA, 22 nt, Human
acaguucugaagacuagagccu

SEQ ID NO: 41059 - RNA, 22 nt, Human
acaguucuuaaaacuugaauua

SEQ ID NO: 41060 - RNA, 22 nt, Human
acaguucuuuggauggaagaau

SEQ ID NO: 41061 - RNA, 22 nt, Human
acaguugacagggagaggguua

SEQ ID NO: 41062 - RNA, 22 nt, Human
acaguugagaugcaacuuuggg

SEQ ID NO: 41063 - RNA, 22 nt, Human
acaguugaggacuuaaacaaaa

SEQ ID NO: 41064 - RNA, 22 nt, Human
acaguuuaugguguuuuauaua

SEQ ID NO: 41065 - RNA, 22 nt, Human
acaguuuauguaaagcugccaa

SEQ ID NO: 41066 - RNA, 20 nt, Human
acaguuuauuuuacuugguu

SEQ ID NO: 41067 - RNA, 22 nt, Human
acaguuucuccauuuacaccuu

SEQ ID NO: 41068 - RNA, 22 nt, Human
acaguuugcacuguucaucaaa

SEQ ID NO: 41069 - RNA, 22 nt, Human
acaguuugcccugacauucucc

SEQ ID NO: 41070 - RNA, 19 nt, Human
acaguuugggaaaugagca

SEQ ID NO: 41071 - RNA, 22 nt, Human
acauaacauaguugacauuuuu

SEQ ID NO: 41072 - RNA, 22 nt, Human
acauaacaugucaaucacccga

SEQ ID NO: 41073 - RNA, 22 nt, Human
acauaauaccuaggacaguuug

SEQ ID NO: 41074 - RNA, 22 nt, Human
acauaauagguaccugaauaau

SEQ ID NO: 41075 - RNA, 22 nt, Human
acauaaugaaaugcagaaauca

SEQ ID NO: 41076 - RNA, 22 nt, Human
acauacacacauacuuucuccu

SEQ ID NO: 41077 - RNA, 21 nt, Human
acauacauaccuuaccaccuu

SEQ ID NO: 41078 - RNA, 22 nt, Human
acauacauguaaaggaaauuau

SEQ ID NO: 41079 - RNA, 21 nt, Human
acauacauuaucuuuuuaaaa

SEQ ID NO: 41080 - RNA, 22 nt, Human
acauacauugccucauugguaa

SEQ ID NO: 41081 - RNA, 22 nt, Human
acauacuugaagcaagugauca

SEQ ID NO: 41082 - RNA, 22 nt, Human
acauacuuuguccuuaacguac

SEQ ID NO: 41083 - RNA, 20 nt, Human
acauagaucagugauugaca

SEQ ID NO: 41084 - RNA, 22 nt, Human
acauagaucugugauucauucu

SEQ ID NO: 41085 - RNA, 22 nt, Human
acauagcauguuuggacacaug

SEQ ID NO: 41086 - RNA, 20 nt, Human
acauagcuauagaaagucga

SEQ ID NO: 41087 - RNA, 22 nt, Human
acauagcucagcauaaucgugg

SEQ ID NO: 41088 - RNA, 22 nt, Human
acauagcucaguaucacuuacu

SEQ ID NO: 41089 - RNA, 22 nt, Human
acauaggccaauauccagagcu

SEQ ID NO: 41090 - RNA, 22 nt, Human
acauaguaagugcucaguaaau

SEQ ID NO: 41091 - RNA, 22 nt, Human
acauauaugugcacaugugcag

SEQ ID NO: 41092 - RNA, 22 nt, Human
acauauauuacuaguaaagaca

SEQ ID NO: 41093 - RNA, 22 nt, Human
acauaucuuuacucaucaucuc

SEQ ID NO: 41094 - RNA, 20 nt, Human
acauaugaaugauagagcca

SEQ ID NO: 41095 - RNA, 22 nt, Human
acauaugagguguuauucuaug

SEQ ID NO: 41096 - RNA, 22 nt, Human
acauaugcgaucauaggaugca

SEQ ID NO: 41097 - RNA, 22 nt, Human
acauauguauauguacacaguc

SEQ ID NO: 41098 - RNA, 22 nt, Human
acauaugugcuuauauccauga

SEQ ID NO: 41099 - RNA, 22 nt, Human
acauaugugucugcacaugccc

SEQ ID NO: 41100 - RNA, 22 nt, Human
acauauuggcaaacuggaggca

SEQ ID NO: 41101 - RNA, 20 nt, Human
acaucaacuagucacagaca

SEQ ID NO: 41102 - RNA, 22 nt, Human
acaucagagggcucacaugauc

SEQ ID NO: 41103 - RNA, 22 nt, Human
acaucagauuaugcuuugcuua

SEQ ID NO: 41104 - RNA, 22 nt, Human
acaucaguaauuaagucucaag

SEQ ID NO: 41105 - RNA, 22 nt, Human
acaucagucuuuugcauacaua

SEQ ID NO: 41106 - RNA, 23 nt, Human
acaucaugauagccaacuuggga

SEQ ID NO: 41107 - RNA, 22 nt, Human
acaucauuucuaguuccuguca

SEQ ID NO: 41108 - RNA, 22 nt, Human
acauccaguaucagaagcauca

SEQ ID NO: 41109 - RNA, 23 nt, Human
acauccaugaaucaucugcuuuc

SEQ ID NO: 41110 - RNA, 22 nt, Human
acauccaugcaugucugugcac

SEQ ID NO: 41111 - RNA, 22 nt, Human
acaucccucagucagacuguaa

SEQ ID NO: 41112 - RNA, 22 nt, Human
acaucuauuuuuuucuguccau

SEQ ID NO: 41113 - RNA, 22 nt, Human
acaucucuucuuaaggcuccag

SEQ ID NO: 41114 - RNA, 22 nt, Human
acaucugacaugaucuucagua

SEQ ID NO: 41115 - RNA, 22 nt, Human
acaucugaccauuacaagacau

SEQ ID NO: 41116 - RNA, 22 nt, Human
acaucuguccucugcagagcuc

SEQ ID NO: 41117 - RNA, 22 nt, Human
acaucuguugauugauguuaca

SEQ ID NO: 41118 - RNA, 22 nt, Human
acaucuucaaagugcuuugcaa

SEQ ID NO: 41119 - RNA, 22 nt, Human
acaucuuugcucuuauagagcu

SEQ ID NO: 41120 - RNA, 22 nt, Human
acaucuuuuacucugguucggg

SEQ ID NO: 41121 - RNA, 22 nt, Human
acaugaaaaauguuugcaguuu

SEQ ID NO: 41122 - RNA, 22 nt, Human
acaugaaacccagccguggucc

SEQ ID NO: 41123 - RNA, 22 nt, Human
acaugaaauucuagcugaaccc

SEQ ID NO: 41124 - RNA, 22 nt, Human
acaugacagugcuuagcaaacu

SEQ ID NO: 41125 - RNA, 22 nt, Human
acaugagaucacaaagauaaau

SEQ ID NO: 41126 - RNA, 22 nt, Human
acaugagauuuggguggugaua

SEQ ID NO: 41127 - RNA, 22 nt, Human
acaugauauuaaugucuuauuu

SEQ ID NO: 41128 - RNA, 22 nt, Human
acaugaucccaccugccuauaa

SEQ ID NO: 41129 - RNA, 22 nt, Human
acaugaucugacuugcuuuuua

SEQ ID NO: 41130 - RNA, 22 nt, Human
acaugauuaaaagauuuuaaag

SEQ ID NO: 41131 - RNA, 22 nt, Human
acaugauucuugauaggcauug

SEQ ID NO: 41132 - RNA, 22 nt, Human
acaugauuucagggaauucuca

SEQ ID NO: 41133 - RNA, 22 nt, Human
acaugcaaaaauauauuuauga

SEQ ID NO: 41134 - RNA, 23 nt, Human
acaugcaaaaaucacagucuccu

SEQ ID NO: 41135 - RNA, 22 nt, Human
acaugcaacuaaagggugccac

SEQ ID NO: 41136 - RNA, 22 nt, Human
acaugcaagccccugaacacau

SEQ ID NO: 41137 - RNA, 22 nt, Human
acaugcacugguugagggguuu

SEQ ID NO: 41138 - RNA, 22 nt, Human
acaugcagacgggauccuggca

SEQ ID NO: 41139 - RNA, 22 nt, Human
acaugcauacguguguuuaaaa

SEQ ID NO: 41140 - RNA, 21 nt, Human
acaugcauagagagauuucug

SEQ ID NO: 41141 - RNA, 22 nt, Human
acaugccaucuuugucaggagu

SEQ ID NO: 41142 - RNA, 22 nt, Human
acaugcuaugagagauuacuuc

SEQ ID NO: 41143 - RNA, 22 nt, Human
acaugcugggcaauguuguuuu

SEQ ID NO: 41144 - RNA, 20 nt, Human
acaugcuugagaggaugcag

SEQ ID NO: 41145 - RNA, 22 nt, Human
acaugcuuuaacuuauuuugau

SEQ ID NO: 41146 - RNA, 22 nt, Human
acauggaagcaaaguucuauuu

SEQ ID NO: 41147 - RNA, 22 nt, Human
acauggauaaauuuuacuuucc

SEQ ID NO: 41148 - RNA, 20 nt, Human
acauggaucaaaugucaguu

SEQ ID NO: 41149 - RNA, 23 nt, Human
acaugggaaaugcaaagagaagu

SEQ ID NO: 41150 - RNA, 23 nt, Human
acaugggagggacauggaggcug

SEQ ID NO: 41151 - RNA, 17 nt, Human
acacagagauuaacaca

SEQ ID NO: 41152 - RNA, 22 nt, Human
acacagagcuggaacugcuuca

SEQ ID NO: 41153 - RNA, 22 nt, Human
acacagagcuucucaacuggga

SEQ ID NO: 41154 - RNA, 22 nt, Human
acacagaggcuccagagauaga

SEQ ID NO: 41155 - RNA, 22 nt, Human
acacagaguaucuuuugccuag

SEQ ID NO: 41156 - RNA, 22 nt, Human
acacagaguauuuagaaggggu

SEQ ID NO: 41157 - RNA, 22 nt, Human
acacagaguccuuacugaggua

SEQ ID NO: 41158 - RNA, 22 nt, Human
auguagaauuccuucuacuuug

SEQ ID NO: 41159 - RNA, 22 nt, Human
auguagaggaguuucuggucug

SEQ ID NO: 41160 - RNA, 22 nt, Human
auguagcaucuauccugauaaa

SEQ ID NO: 41161 - RNA, 22 nt, Human
auguagcugcagaugauaaugc

SEQ ID NO: 41162 - RNA, 22 nt, Human
auguagucucuuugggaaacuc

SEQ ID NO: 41163 - RNA, 22 nt, Human
auguaucagauaaagcaugugg

SEQ ID NO: 41164 - RNA, 22 nt, Human
auguaucaugcaggguccauga

SEQ ID NO: 41165 - RNA, 22 nt, Human
auguauccuuauacacauuuau

SEQ ID NO: 41166 - RNA, 23 nt, Human
auguaucucauccaaggaagcuc

SEQ ID NO: 41167 - RNA, 22 nt, Human
auguaugaagcuuuguuuggga

SEQ ID NO: 41168 - RNA, 22 nt, Human
auguaugauauuuccaguauca

SEQ ID NO: 41169 - RNA, 22 nt, Human
auguaugcauagugaguaaaug

SEQ ID NO: 41170 - RNA, 22 nt, Human
auguauguucaagcaaugauua

SEQ ID NO: 41171 - RNA, 22 nt, Human
auguauguuucauaucuucauu

SEQ ID NO: 41172 - RNA, 22 nt, Human
auguauguuucuauauaugaca

SEQ ID NO: 41173 - RNA, 22 nt, Human
auguauguuuucaguuguauua

SEQ ID NO: 41174 - RNA, 22 nt, Human
auguauucaagccacauacauu

SEQ ID NO: 41175 - RNA, 22 nt, Human
auguauuuacugagaaggaaac

SEQ ID NO: 41176 - RNA, 22 nt, Human
augucaaagcagacugagagcg

SEQ ID NO: 41177 - RNA, 21 nt, Human
augucaaaugcuuuauuuuau

SEQ ID NO: 41178 - RNA, 22 nt, Human
augucacaggcaacaagauugc

SEQ ID NO: 41179 - RNA, 22 nt, Human
augucacagucugacucaguga

SEQ ID NO: 41180 - RNA, 22 nt, Human
augucacaucugggauggcccu

SEQ ID NO: 41181 - RNA, 22 nt, Human
augucacauggucaccucuagc

SEQ ID NO: 41182 - RNA, 22 nt, Human
augucaccaguuuccaaauuug

SEQ ID NO: 41183 - RNA, 22 nt, Human
augucacugugaggcagcuguc

SEQ ID NO: 41184 - RNA, 22 nt, Human
augucacuguuuaccagcucca

SEQ ID NO: 41185 - RNA, 22 nt, Human
augucagaagaacaaugagaua

SEQ ID NO: 41186 - RNA, 22 nt, Human
augucagagcuuccacaauagu

SEQ ID NO: 41187 - RNA, 22 nt, Human
augucagauuccuaaauaucuu

SEQ ID NO: 41188 - RNA, 20 nt, Human
augucaggaagggagucagg

SEQ ID NO: 41189 - RNA, 22 nt, Human
auguccaauagaagggagaagc

SEQ ID NO: 41190 - RNA, 22 nt, Human
auguccagaguguccuggaaag

SEQ ID NO: 41191 - RNA, 22 nt, Human
auguccaggaucuauccccaga

SEQ ID NO: 41192 - RNA, 22 nt, Human
auguccagggcacacagcagug

SEQ ID NO: 41193 - RNA, 22 nt, Human
augucccagacacuuuaucuua

SEQ ID NO: 41194 - RNA, 22 nt, Human
augucccuucuuuggugcucag

SEQ ID NO: 41195 - RNA, 22 nt, Human
auguccucaaaacugauugcag

SEQ ID NO: 41196 - RNA, 20 nt, Human
auguccugcuucuccucacc

SEQ ID NO: 41197 - RNA, 22 nt, Human
auguccuucuccucuuaccugc

SEQ ID NO: 41198 - RNA, 22 nt, Human
auguccuuguuuuggugacacu

SEQ ID NO: 41199 - RNA, 22 nt, Human
auguccuuuuaaaaugugagaa

SEQ ID NO: 41200 - RNA, 22 nt, Human
augucucugcugugguuagcuu

SEQ ID NO: 41201 - RNA, 22 nt, Human
augucucuuuacucuuagaacc

SEQ ID NO: 41202 - RNA, 22 nt, Human
augucucuuuagagcaacagua

SEQ ID NO: 41203 - RNA, 22 nt, Human
augucugcaaauaucugccagu

SEQ ID NO: 41204 - RNA, 22 nt, Human
augucugcuuuccuuuuaauca

SEQ ID NO: 41205 - RNA, 22 nt, Human
augucuggaggucaucugguua

SEQ ID NO: 41206 - RNA, 22 nt, Human
augucuguauguggagaggggu

SEQ ID NO: 41207 - RNA, 22 nt, Human
augucugucaucuuccaggaag

SEQ ID NO: 41208 - RNA, 22 nt, Human
augucuguccaacccugcaggg

SEQ ID NO: 41209 - RNA, 22 nt, Human
augucuguucauuauuaacugc

SEQ ID NO: 41210 - RNA, 21 nt, Human
augucuguucuuucuggcagg

SEQ ID NO: 41211 - RNA, 19 nt, Human
augucuguugaauuucaua

SEQ ID NO: 41212 - RNA, 22 nt, Human
augucuuuuaugauuacgggau

SEQ ID NO: 41213 - RNA, 22 nt, Human
augugaaaaauuucuuauuaca

SEQ ID NO: 41214 - RNA, 22 nt, Human
augugaaaccugugaguagagu

SEQ ID NO: 41215 - RNA, 22 nt, Human
augugaaacgcaaugggaucau

SEQ ID NO: 41216 - RNA, 22 nt, Human
augugaaauauuaagccgagga

SEQ ID NO: 41217 - RNA, 22 nt, Human
augugaacucuguacucucuga

SEQ ID NO: 41218 - RNA, 22 nt, Human
augugacuagcccuucaugacc

SEQ ID NO: 41219 - RNA, 22 nt, Human
augugacuccacagcugugcug

SEQ ID NO: 41220 - RNA, 22 nt, Human
augugagaacucaggaaauacu

SEQ ID NO: 41221 - RNA, 22 nt, Human
augugagggaaaucagucagaa

SEQ ID NO: 41222 - RNA, 20 nt, Human
augugagggguugaaguggg

SEQ ID NO: 41223 - RNA, 22 nt, Human
augugcaaggaguggcuguugu

SEQ ID NO: 41224 - RNA, 22 nt, Human
augugcaauuauuaagaagaga

SEQ ID NO: 41225 - RNA, 22 nt, Human
augugcauuaaaugucaauguu

SEQ ID NO: 41226 - RNA, 22 nt, Human
augugcccuuucugcuuugcag

SEQ ID NO: 41227 - RNA, 22 nt, Human
augugcuaaacucaacaaaucu

SEQ ID NO: 41228 - RNA, 22 nt, Human
augugcucacccuauuuaugga

SEQ ID NO: 41229 - RNA, 22 nt, Human
augugcuuauggucucugguug

SEQ ID NO: 41230 - RNA, 22 nt, Human
augugcuucaggaugucagugu

SEQ ID NO: 41231 - RNA, 22 nt, Human
augugcuuguaauguuaaaugu

SEQ ID NO: 41232 - RNA, 22 nt, Human
augugcuuuaaagaagccagcu

SEQ ID NO: 41233 - RNA, 22 nt, Human
augugcuuucuuuguuucauaa

SEQ ID NO: 41234 - RNA, 22 nt, Human
auguggcaaugguuagcacugu

SEQ ID NO: 41235 - RNA, 22 nt, Human
auguggcuagggaauaaaauau

SEQ ID NO: 41236 - RNA, 22 nt, Human
auguggcucauuguuugcuuac

SEQ ID NO: 41237 - RNA, 21 nt, Human
auguggcucccuuccucagga

SEQ ID NO: 41238 - RNA, 22 nt, Human
auguggcuccuuacucaucagc

SEQ ID NO: 41239 - RNA, 22 nt, Human
auguggcuguggacaccuuuca

SEQ ID NO: 41240 - RNA, 22 nt, Human
auguggcuuucugcguuuucuc

SEQ ID NO: 41241 - RNA, 22 nt, Human
auguggcuuuucuaacccuucc

SEQ ID NO: 41242 - RNA, 22 nt, Human
auguguaaaaagugcuuaauau

SEQ ID NO: 41243 - RNA, 22 nt, Human
auguguaaaaggcauguuuuau

SEQ ID NO: 41244 - RNA, 22 nt, Human
auguguaaagcuuuucuuuguu

SEQ ID NO: 41245 - RNA, 22 nt, Human
auguagagcuccuugauccucc

SEQ ID NO: 41246 - RNA, 23 nt, Human
auguagaguacagcacaacagca

SEQ ID NO: 41247 - RNA, 22 nt, Human
auguagaguagaauaguacaac

SEQ ID NO: 41248 - RNA, 20 nt, Human
auguagcagugugcugggaa

SEQ ID NO: 41249 - RNA, 22 nt, Human
auguagcaugcauguuguuuug

SEQ ID NO: 41250 - RNA, 22 nt, Human
auguaggauugagugauagagg

SEQ ID NO: 41251 - RNA, 22 nt, Human
auguagggaacuaaauucacug

SEQ ID NO: 41252 - RNA, 22 nt, Human
auguaguacuggguauguuucu

SEQ ID NO: 41253 - RNA, 21 nt, Human
auguagugacuucauuccuuc

SEQ ID NO: 41254 - RNA, 22 nt, Human
auguaguguagagauuagucuc

SEQ ID NO: 41255 - RNA, 22 nt, Human
auguaguuagaagauucaaaca

SEQ ID NO: 41256 - RNA, 22 nt, Human
auguaguuuggggcuagauuua

SEQ ID NO: 41257 - RNA, 22 nt, Human
auguauacgugcaagucacagg

SEQ ID NO: 41258 - RNA, 22 nt, Human
auguauacuaacacaugcaguu

SEQ ID NO: 41259 - RNA, 22 nt, Human
auguauaguggugaugauuaca

SEQ ID NO: 41260 - RNA, 22 nt, Human
auguauaugaagcuaguauuuu

SEQ ID NO: 41261 - RNA, 22 nt, Human
auguaucaauuaucugucugca

SEQ ID NO: 41262 - RNA, 22 nt, Human
auguaucacagcaauguaguca

SEQ ID NO: 41263 - RNA, 22 nt, Human
auguaucagaaauagcauuggc

SEQ ID NO: 41264 - RNA, 20 nt, Human
auguaugcaaaugucuucca

SEQ ID NO: 41265 - RNA, 22 nt, Human
auguaugcaugcuacaguuuuc

SEQ ID NO: 41266 - RNA, 22 nt, Human
auguaugggguguaugggauca

SEQ ID NO: 41267 - RNA, 22 nt, Human
augugucuuggaguuuuaaugu

SEQ ID NO: 41268 - RNA, 22 nt, Human
augugucuuucaagguauagaa

SEQ ID NO: 41269 - RNA, 22 nt, Human
augugucuuugagacucugcua

SEQ ID NO: 41270 - RNA, 22 nt, Human
augugugcauauucugccaccu

SEQ ID NO: 41271 - RNA, 18 nt, Human
auguguggcuuggggucc

SEQ ID NO: 41272 - RNA, 22 nt, Human
augugugguuuaagaauugaau

SEQ ID NO: 41273 - RNA, 22 nt, Human
auguguguauauauagucauuu

SEQ ID NO: 41274 - RNA, 22 nt, Human
auguguguaugugccuauaucu

SEQ ID NO: 41275 - RNA, 22 nt, Human
augugugugaugggcgccgcca

SEQ ID NO: 41276 - RNA, 22 nt, Human
augugugugugcgcgcgcagga

SEQ ID NO: 41277 - RNA, 22 nt, Human
auguguucacgugcacaugugc

SEQ ID NO: 41278 - RNA, 22 nt, Human
auguguuuguaccuuuaaauau

SEQ ID NO: 41279 - RNA, 22 nt, Human
auguguuuugguggaucauuca

SEQ ID NO: 41280 - RNA, 22 nt, Human
auguuaaaaaccaguacaguug

SEQ ID NO: 41281 - RNA, 22 nt, Human
auguuaaaagugaggauggcca

SEQ ID NO: 41282 - RNA, 22 nt, Human
auguuaaauagccauuuguuug

SEQ ID NO: 41283 - RNA, 22 nt, Human
auguuaacagcugcuucuggug

SEQ ID NO: 41284 - RNA, 23 nt, Human
auguuaagugaaauaggccagga

SEQ ID NO: 41285 - RNA, 17 nt, Human
auguuaauuucacauuu

SEQ ID NO: 41286 - RNA, 22 nt, Human
auguuacagagaaaguggaagc

SEQ ID NO: 41287 - RNA, 22 nt, Human
auguuaccaucuuuuaucuaca

SEQ ID NO: 41288 - RNA, 22 nt, Human
auguuaccuuguucuccaaaaa

SEQ ID NO: 41289 - RNA, 22 nt, Human
auguuagugauaguaaauagug

SEQ ID NO: 41290 - RNA, 22 nt, Human
auguuauucaauuugaauccaa

SEQ ID NO: 41291 - RNA, 22 nt, Human
auguuauugaugccugaggcuu

SEQ ID NO: 41292 - RNA, 22 nt, Human
auguuauuuauugaaacacuuu

SEQ ID NO: 41293 - RNA, 22 nt, Human
auguuauuucaaaauucccuug

SEQ ID NO: 41294 - RNA, 22 nt, Human
auguuauuuuggaaaauacaaa

SEQ ID NO: 41295 - RNA, 22 nt, Human
auguucaaacaaguuaaugcca

SEQ ID NO: 41296 - RNA, 22 nt, Human
auguucaaagaucgugcuaucc

SEQ ID NO: 41297 - RNA, 22 nt, Human
auguucagcauucuauaaauau

SEQ ID NO: 41298 - RNA, 22 nt, Human
auguucaguuagcacugaaguc

SEQ ID NO: 41299 - RNA, 22 nt, Human
auguucauuagucaacauuucu

SEQ ID NO: 41300 - RNA, 22 nt, Human
auguucauuuuauggcgaugcc

SEQ ID NO: 41301 - RNA, 22 nt, Human
auguucauuuucuuaaugugcc

SEQ ID NO: 41302 - RNA, 22 nt, Human
auguucccaagggauagaaaga

SEQ ID NO: 41303 - RNA, 22 nt, Human
auguucccagcacugaguaaca

SEQ ID NO: 41304 - RNA, 22 nt, Human
auguuccucacuauuuuggccc

SEQ ID NO: 41305 - RNA, 22 nt, Human
auguuccugauccucguucuau

SEQ ID NO: 41306 - RNA, 22 nt, Human
auguuccuuccagagagcagaa

SEQ ID NO: 41307 - RNA, 22 nt, Human
auguucuaaucccugcuaugua

SEQ ID NO: 41308 - RNA, 22 nt, Human
auguucuguuuuguaauucaua

SEQ ID NO: 41309 - RNA, 22 nt, Human
auguuggagucguaaggcaugg

SEQ ID NO: 41310 - RNA, 22 nt, Human
auguugggaaggccgcaggcac

SEQ ID NO: 41311 - RNA, 22 nt, Human
auguuguugaacucuuugcaug

SEQ ID NO: 41312 - RNA, 22 nt, Human
auguuuaaaggagucagagacu

SEQ ID NO: 41313 - RNA, 22 nt, Human
auguuuaaucggcugccuuucc

SEQ ID NO: 41314 - RNA, 22 nt, Human
auguuuaauuaucuggguuuug

SEQ ID NO: 41315 - RNA, 22 nt, Human
auguuuagucauucagcuccuu

SEQ ID NO: 41316 - RNA, 22 nt, Human
auguuuaugcaaacaugugagu

SEQ ID NO: 41317 - RNA, 22 nt, Human
auguuuauggagcagguauuag

SEQ ID NO: 41318 - RNA, 22 nt, Human
auguuuauuguuuuaagcugcu

SEQ ID NO: 41319 - RNA, 22 nt, Human
auguuucaaugcacuuuagccu

SEQ ID NO: 41320 - RNA, 22 nt, Human
auguuucaucaguaagguuuug

SEQ ID NO: 41321 - RNA, 22 nt, Human
auguuuccagcucagcugcagg

SEQ ID NO: 41322 - RNA, 22 nt, Human
auguuuccaucaaauuugauga

SEQ ID NO: 41323 - RNA, 22 nt, Human
auguuucuaaaacuugcauggc

SEQ ID NO: 41324 - RNA, 22 nt, Human
auguuucugaguguauauacau

SEQ ID NO: 41325 - RNA, 22 nt, Human
auguuugcauucuuauuaucgu

SEQ ID NO: 41326 - RNA, 22 nt, Human
auguuuguagguaagugacacu

SEQ ID NO: 41327 - RNA, 22 nt, Human
auguuuguguuacacucugcag

SEQ ID NO: 41328 - RNA, 22 nt, Human
auguuuuauauuuugcagcagu

SEQ ID NO: 41329 - RNA, 22 nt, Human
auguuuuaugcuucagaugagg

SEQ ID NO: 41330 - RNA, 22 nt, Human
auguuuuauuaccaacuuguac

SEQ ID NO: 41331 - RNA, 22 nt, Human
auguuuuccauugccauggaaa

SEQ ID NO: 41332 - RNA, 22 nt, Human
auguuuucuuucagacuucccu

SEQ ID NO: 41333 - RNA, 22 nt, Human
auguuuugauugguuaggucug

SEQ ID NO: 41334 - RNA, 22 nt, Human
auguuuugcuggauguuggcua

SEQ ID NO: 41335 - RNA, 22 nt, Human
auguuuuugagauacaaacaga

SEQ ID NO: 41336 - RNA, 22 nt, Human
auguuuuuggcuucaaguuucu

SEQ ID NO: 41337 - RNA, 22 nt, Human
auuaaaacuaaaaugccugauu

SEQ ID NO: 41338 - RNA, 22 nt, Human
auuaaaauuccaagguaugcca

SEQ ID NO: 41339 - RNA, 22 nt, Human
auuaaacaauguaaaguucuug

SEQ ID NO: 41340 - RNA, 22 nt, Human
auuaaaccccaguucucuuacu

SEQ ID NO: 41341 - RNA, 22 nt, Human
auuaaagacagcagauggaugg

SEQ ID NO: 41342 - RNA, 22 nt, Human
auuaaaugguggucauucauuu

SEQ ID NO: 41343 - RNA, 22 nt, Human
auuaaauuggacgcugggggaa

SEQ ID NO: 41344 - RNA, 22 nt, Human
auuaaauuuucacuaggcuccc

SEQ ID NO: 41345 - RNA, 22 nt, Human
auuaacagaauuuuacaugcuu

SEQ ID NO: 41346 - RNA, 22 nt, Human
auuaacaugaguuggagauagg

SEQ ID NO: 41347 - RNA, 22 nt, Human
auuaagacuauugauauuuaca

SEQ ID NO: 41348 - RNA, 22 nt, Human
auuaagaguuacaaauagagua

SEQ ID NO: 41349 - RNA, 22 nt, Human
auuaagcucuccaggaaaugua

SEQ ID NO: 41350 - RNA, 22 nt, Human
auuaaggaacaaagccuuuuga

SEQ ID NO: 41351 - RNA, 22 nt, Human
auuaaggaauguaggcaagaag

SEQ ID NO: 41352 - RNA, 22 nt, Human
auuaaguguauugcugagggua

SEQ ID NO: 41353 - RNA, 22 nt, Human
auuaauacauuauagggauugu

SEQ ID NO: 41354 - RNA, 22 nt, Human
auuaauauacacuguuagcaug

SEQ ID NO: 41355 - RNA, 22 nt, Human
auuaauauuugcaccuucuguc

SEQ ID NO: 41356 - RNA, 22 nt, Human
auuaauuuuaccuuuguaaaca

SEQ ID NO: 41357 - RNA, 22 nt, Human
auuacaaaagaagggagaaggu

SEQ ID NO: 41358 - RNA, 22 nt, Human
auuacaacuguucccacugucu

SEQ ID NO: 41359 - RNA, 22 nt, Human
auuacaagggucugacuggagg

SEQ ID NO: 41360 - RNA, 22 nt, Human
auuacaaguuucaguguuuugc

SEQ ID NO: 41361 - RNA, 22 nt, Human
auuacaaucgagagaaacaaau

SEQ ID NO: 41362 - RNA, 22 nt, Human
auguggcuggugacugccguac

SEQ ID NO: 41363 - RNA, 22 nt, Human
auguggcuuaguuaggugcccc

SEQ ID NO: 41364 - RNA, 22 nt, Human
auguggcuuggcagggaauaug

SEQ ID NO: 41365 - RNA, 22 nt, Human
auguggcuuuuccuggguuccu

SEQ ID NO: 41366 - RNA, 22 nt, Human
augugggccgugcggguguccu

SEQ ID NO: 41367 - RNA, 22 nt, Human
augugguuuuggauuauucaug

SEQ ID NO: 41368 - RNA, 22 nt, Human
auguguaaaguuagaugucuga

SEQ ID NO: 41369 - RNA, 22 nt, Human
auguguaggugaaucgaggcug

SEQ ID NO: 41370 - RNA, 22 nt, Human
auguguauauuuauuguaguuu

SEQ ID NO: 41371 - RNA, 22 nt, Human
auguguaucuaagguguucuau

SEQ ID NO: 41372 - RNA, 22 nt, Human
auguguaugucuuauucaaaga

SEQ ID NO: 41373 - RNA, 22 nt, Human
auguguauuacccuuucauucc

SEQ ID NO: 41374 - RNA, 22 nt, Human
auguguauugagcaccuacugc

SEQ ID NO: 41375 - RNA, 22 nt, Human
auguguauuuauuuggggcuua

SEQ ID NO: 41376 - RNA, 17 nt, Human
cauucuguaaucuuucu

SEQ ID NO: 41377 - RNA, 22 nt, Human
cauucugugauucuaaaucccu

SEQ ID NO: 41378 - RNA, 22 nt, Human
cauucuuauauuuacucauuca

SEQ ID NO: 41379 - RNA, 22 nt, Human
cauucuugcaccgugauggcuu

SEQ ID NO: 41380 - RNA, 22 nt, Human
cauugaaacagauguacccaug

SEQ ID NO: 41381 - RNA, 22 nt, Human
cauugcacgggcgucugucugu

SEQ ID NO: 41382 - RNA, 22 nt, Human
cauugcacuucugcuuuuccuc

SEQ ID NO: 41383 - RNA, 22 nt, Human
cauugcugcuuccaggcacagg

SEQ ID NO: 41384 - RNA, 22 nt, Human
cauugcuuaucuaguucacaua

SEQ ID NO: 41385 - RNA, 22 nt, Human
cauugcuuccuaugucccuucu

SEQ ID NO: 41386 - RNA, 22 nt, Human
cauugcuugauagcugaaaauu

SEQ ID NO: 41387 - RNA, 22 nt, Human
cauugggcggggaccucggcug

SEQ ID NO: 41388 - RNA, 22 nt, Human
cauugguuugauauugccaugg

SEQ ID NO: 41389 - RNA, 22 nt, Human
cauuguaagcuguugaauccuc

SEQ ID NO: 41390 - RNA, 18 nt, Human
cauuguacaaugcuuuau

SEQ ID NO: 41391 - RNA, 22 nt, Human
cauuguacaguuauuuuaaaau

SEQ ID NO: 41392 - RNA, 21 nt, Human
cauugucgacauuuuccccuc

SEQ ID NO: 41393 - RNA, 22 nt, Human
cauugucucuugucauuuagua

SEQ ID NO: 41394 - RNA, 22 nt, Human
cauuguugaacaccugcuggau

SEQ ID NO: 41395 - RNA, 22 nt, Human
cauuguugcugcuucaagauau

SEQ ID NO: 41396 - RNA, 22 nt, Human
auuucaacacuuuuggaauuag

SEQ ID NO: 41397 - RNA, 22 nt, Human
auuucaacauucucaguuguag

SEQ ID NO: 41398 - RNA, 19 nt, Human
auuucaagagguuuauugg

SEQ ID NO: 41399 - RNA, 22 nt, Human
auuucaaggacuacuuuucaau

SEQ ID NO: 41400 - RNA, 22 nt, Human
auuucaaguguugagcucauaa

SEQ ID NO: 41401 - RNA, 22 nt, Human
auuucacagcgugguugacugc

SEQ ID NO: 41402 - RNA, 22 nt, Human
auuucacagcugcuguucaggu

SEQ ID NO: 41403 - RNA, 22 nt, Human
auuucacagcugucaguguuac

SEQ ID NO: 41404 - RNA, 22 nt, Human
auuucagaguagaucguuauuu

SEQ ID NO: 41405 - RNA, 20 nt, Human
auuucaguguuugcaauuuc

SEQ ID NO: 41406 - RNA, 22 nt, Human
auuucaguguuuuaagaguuca

SEQ ID NO: 41407 - RNA, 22 nt, Human
auuucaucccaggcucuggaag

SEQ ID NO: 41408 - RNA, 22 nt, Human
auuucaucucuggaacauaacu

SEQ ID NO: 41409 - RNA, 22 nt, Human
auuucauggcagacuuuaaccc

SEQ ID NO: 41410 - RNA, 22 nt, Human
auuucauguaaauggaaugaua

SEQ ID NO: 41411 - RNA, 22 nt, Human
auuucauguugaucuuucgagg

SEQ ID NO: 41412 - RNA, 22 nt, Human
auuuccaacuaccccuccauuu

SEQ ID NO: 41413 - RNA, 22 nt, Human
auuuccaagaaagcuuuaggau

SEQ ID NO: 41414 - RNA, 21 nt, Human
auuuccaaggguaccuaagau

SEQ ID NO: 41415 - RNA, 22 nt, Human
auuuccaagguaauuuugagua

SEQ ID NO: 41416 - RNA, 22 nt, Human
auuuccaccaucucucugggcc

SEQ ID NO: 41417 - RNA, 16 nt, Human
auuuccagauuaugca

SEQ ID NO: 41418 - RNA, 22 nt, Human
auuuccaggaguugaggucuga

SEQ ID NO: 41419 - RNA, 22 nt, Human
auuuccagugcacugaauagaa

SEQ ID NO: 41420 - RNA, 22 nt, Human
auuuccaugaaguuuaguuaua

SEQ ID NO: 41421 - RNA, 22 nt, Human
auuucccacucaggccgcggcg

SEQ ID NO: 41422 - RNA, 22 nt, Human
auuucccagggcccucauaguu

SEQ ID NO: 41423 - RNA, 22 nt, Human
auuuccucaugaucauaaugca

SEQ ID NO: 41424 - RNA, 17 nt, Human
auuuccugcaagccccu

SEQ ID NO: 41425 - RNA, 22 nt, Human
auuuccugcaggggcugguggg

SEQ ID NO: 41426 - RNA, 22 nt, Human
auuuccuguaccuaucaaggca

SEQ ID NO: 41427 - RNA, 16 nt, Human
auuuccuugugaguuu

SEQ ID NO: 41428 - RNA, 22 nt, Human
auuucuagaggcagcuucuagg

SEQ ID NO: 41429 - RNA, 22 nt, Human
auuucuagauauggagaguggu

SEQ ID NO: 41430 - RNA, 23 nt, Human
auuucuaggggauuuucuggugc

SEQ ID NO: 41431 - RNA, 22 nt, Human
auuucucaaccaggucaaaaag

SEQ ID NO: 41432 - RNA, 22 nt, Human
auuucucaaguaaaugagucau

SEQ ID NO: 41433 - RNA, 22 nt, Human
auuucucacccuaccucacucc

SEQ ID NO: 41434 - RNA, 22 nt, Human
auuucucacugagcagauaaaa

SEQ ID NO: 41435 - RNA, 22 nt, Human
auuucucaucaagugccaacuc

SEQ ID NO: 41436 - RNA, 22 nt, Human
auuucucauuaagaucuuccaa

SEQ ID NO: 41437 - RNA, 22 nt, Human
auuucuccuccagauggugguu

SEQ ID NO: 41438 - RNA, 22 nt, Human
auuucucugcaguguucggaau

SEQ ID NO: 41439 - RNA, 22 nt, Human
auuucucugccucagcuucugc

SEQ ID NO: 41440 - RNA, 22 nt, Human
auuucucuuagcaagacauuac

SEQ ID NO: 41441 - RNA, 22 nt, Human
auuucugauacccggucacccu

SEQ ID NO: 41442 - RNA, 22 nt, Human
auuucuggauuuuggaugcugc

SEQ ID NO: 41443 - RNA, 22 nt, Human
auuucuguaacuuaugaaaguu

SEQ ID NO: 41444 - RNA, 22 nt, Human
auuucuguaguccacauucuuu

SEQ ID NO: 41445 - RNA, 22 nt, Human
auuucuguggcuucauucuccu

SEQ ID NO: 41446 - RNA, 22 nt, Human
auuucuuaaaacuucagggaga

SEQ ID NO: 41447 - RNA, 22 nt, Human
auuucuuaugaauauugacugu

SEQ ID NO: 41448 - RNA, 22 nt, Human
auuucuucagguucuucuagga

SEQ ID NO: 41449 - RNA, 22 nt, Human
auuucuuccuucuccuagaaga

SEQ ID NO: 41450 - RNA, 22 nt, Human
auuucuugugggaaaugcagca

SEQ ID NO: 41451 - RNA, 22 nt, Human
auuucuuucuggccacgguuuu

SEQ ID NO: 41452 - RNA, 22 nt, Human
auuucuuuucaagagggugcuu

SEQ ID NO: 41453 - RNA, 22 nt, Human
auuugaaaucuggguuacucug

SEQ ID NO: 41454 - RNA, 22 nt, Human
auuugaauggcuuaacacaacg

SEQ ID NO: 41455 - RNA, 22 nt, Human
auuugcaaagguuaacagcagu

SEQ ID NO: 41456 - RNA, 22 nt, Human
auuugcaaagucguaucuguga

SEQ ID NO: 41457 - RNA, 22 nt, Human
auuugcaagcaugcacaaaagc

SEQ ID NO: 41458 - RNA, 22 nt, Human
auuugcaauuuuacuuugcagu

SEQ ID NO: 41459 - RNA, 22 nt, Human
auuugcagagcucugaauuuug

SEQ ID NO: 41460 - RNA, 22 nt, Human
auuugcaugcuucuauugugaa

SEQ ID NO: 41461 - RNA, 21 nt, Human
auuugcauuaaaauauuacgc

SEQ ID NO: 41462 - RNA, 22 nt, Human
auuugcauuuacauagcauaga

SEQ ID NO: 41463 - RNA, 22 nt, Human
auuugccaugaagaguguuuga

SEQ ID NO: 41464 - RNA, 22 nt, Human
auuugccuuggugauuuguaaa

SEQ ID NO: 41465 - RNA, 22 nt, Human
auuugcuaguggaauuuuccug

SEQ ID NO: 41466 - RNA, 22 nt, Human
auuugcucuagcugcagugaau

SEQ ID NO: 41467 - RNA, 22 nt, Human
auuugcuuaucuccacaguugu

SEQ ID NO: 41468 - RNA, 22 nt, Human
auuugcuuggucuucucuccgu

SEQ ID NO: 41469 - RNA, 19 nt, Human
auuugcuugucugcucugc

SEQ ID NO: 41470 - RNA, 22 nt, Human
auuugcuuuaagguauaaaagg

SEQ ID NO: 41471 - RNA, 22 nt, Human
auuuggaaaagcgguaacuugc

SEQ ID NO: 41472 - RNA, 22 nt, Human
auuuggaaaugcaucucuugag

SEQ ID NO: 41473 - RNA, 22 nt, Human
auuuggaagcauuuccaaagca

SEQ ID NO: 41474 - RNA, 22 nt, Human
auuuggaaggcguuucucugua

SEQ ID NO: 41475 - RNA, 22 nt, Human
auuuggauucuuauuuagcacu

SEQ ID NO: 41476 - RNA, 22 nt, Human
auuuggcacacuggguucucgu

SEQ ID NO: 41477 - RNA, 22 nt, Human
auuugggaauuauuugccuaau

SEQ ID NO: 41478 - RNA, 22 nt, Human
auuuggucacaccaguccacau

SEQ ID NO: 41479 - RNA, 22 nt, Human
auuuggucacuaggaaaaucaa

SEQ ID NO: 41480 - RNA, 22 nt, Human
auuuggugccugggaaaucucu

SEQ ID NO: 41481 - RNA, 22 nt, Human
auuuggugguuccuuuuccgaa

SEQ ID NO: 41482 - RNA, 22 nt, Human
auuugguguucaucuuuuagug

SEQ ID NO: 41483 - RNA, 22 nt, Human
auuuguaacacgugacagguug

SEQ ID NO: 41484 - RNA, 22 nt, Human
auuuguaagcuagagccaugau

SEQ ID NO: 41485 - RNA, 22 nt, Human
caaauagugucacauugugagg

SEQ ID NO: 41486 - RNA, 22 nt, Human
caaauaucuuuggcaaagagaa

SEQ ID NO: 41487 - RNA, 22 nt, Human
caaaucacaaugugagacugag

SEQ ID NO: 41488 - RNA, 22 nt, Human
caaaucauggaauaacuagaga

SEQ ID NO: 41489 - RNA, 17 nt, Human
caaauccuaggaugucu

SEQ ID NO: 41490 - RNA, 22 nt, Human
caaauccucaccucaucaugaa

SEQ ID NO: 41491 - RNA, 22 nt, Human
caaauccugcagggcuuagaug

SEQ ID NO: 41492 - RNA, 22 nt, Human
caaauccuggagccaugguaac

SEQ ID NO: 41493 - RNA, 22 nt, Human
caaaucuaggaugcauguagug

SEQ ID NO: 41494 - RNA, 22 nt, Human
caaaucugagucuacaauuuua

SEQ ID NO: 41495 - RNA, 22 nt, Human
caaaugaaaauggcgucuugga

SEQ ID NO: 41496 - RNA, 22 nt, Human
caaaugaagguggugggucauu

SEQ ID NO: 41497 - RNA, 22 nt, Human
caaaugaauuucccugcaaaug

SEQ ID NO: 41498 - RNA, 22 nt, Human
caaaugaugcauggcuagugag

SEQ ID NO: 41499 - RNA, 22 nt, Human
caaaugcauagaaagaugaaac

SEQ ID NO: 41500 - RNA, 22 nt, Human
caaaugcauaguuuauaagaag

SEQ ID NO: 41501 - RNA, 22 nt, Human
caaaugcuacuaauaggcaagu

SEQ ID NO: 41502 - RNA, 22 nt, Human
caaaugcuaugauuuugaguuu

SEQ ID NO: 41503 - RNA, 22 nt, Human
caaauggcuggcauccuucuac

SEQ ID NO: 41504 - RNA, 19 nt, Human
caaaugggacaggaaggca

SEQ ID NO: 41505 - RNA, 22 nt, Human
caaauguaauaaggaguuuccc

SEQ ID NO: 41506 - RNA, 23 nt, Human
caaauguaguguguccaccccug

SEQ ID NO: 41507 - RNA, 22 nt, Human
caaauguauaaauguacuuucu

SEQ ID NO: 41508 - RNA, 22 nt, Human
caaauguguagagcuuuugggg

SEQ ID NO: 41509 - RNA, 22 nt, Human
caaauguguuuuuucuucuaca

SEQ ID NO: 41510 - RNA, 22 nt, Human
caaauguuauucauucuuguuu

SEQ ID NO: 41511 - RNA, 22 nt, Human
caaauguugacuaagaggguuu

SEQ ID NO: 41512 - RNA, 22 nt, Human
caaauguugcuguaauguuugu

SEQ ID NO: 41513 - RNA, 22 nt, Human
caaauuaaugugucucaaaaua

SEQ ID NO: 41514 - RNA, 22 nt, Human
caaauucaaauuucaucagugu

SEQ ID NO: 41515 - RNA, 22 nt, Human
ccacaggaccagaggagaucac

SEQ ID NO: 41516 - RNA, 22 nt, Human
ccacaggaggaacaauuagaug

SEQ ID NO: 41517 - RNA, 20 nt, Human
ccacaggaguccagucgacc

SEQ ID NO: 41518 - RNA, 22 nt, Human
ccacagggacuguuaaaacccu

SEQ ID NO: 41519 - RNA, 22 nt, Human
ccacagggauaggaauggggcu

SEQ ID NO: 41520 - RNA, 22 nt, Human
ccacagggccuuuccugcuggc

SEQ ID NO: 41521 - RNA, 22 nt, Human
ccacagguacggauugaggacc

SEQ ID NO: 41522 - RNA, 22 nt, Human
ccacaguacaggaaaucuuguu

SEQ ID NO: 41523 - RNA, 22 nt, Human
ccacaguagaauucaucucccu

SEQ ID NO: 41524 - RNA, 22 nt, Human
ccacagugaucccugccugcga

SEQ ID NO: 41525 - RNA, 22 nt, Human
ccacagugguuguggcaugugg

SEQ ID NO: 41526 - RNA, 22 nt, Human
ccacaguguuuugucacauuag

SEQ ID NO: 41527 - RNA, 22 nt, Human
ccacaguuucuucaucuauaaa

SEQ ID NO: 41528 - RNA, 22 nt, Human
ccacaucuaucuuuaguaugaa

SEQ ID NO: 41529 - RNA, 22 nt, Human
ccacaucucuugauguaccuac

SEQ ID NO: 41530 - RNA, 22 nt, Human
ccacaugagcuggcaaugcccu

SEQ ID NO: 41531 - RNA, 22 nt, Human
ccacaugaugaggaagcugaac

SEQ ID NO: 41532 - RNA, 22 nt, Human
ccacaugcucaccaagucccug

SEQ ID NO: 41533 - RNA, 22 nt, Human
ccacaugcucucucuccagguu

SEQ ID NO: 41534 - RNA, 23 nt, Human
ccacauggcaagaugaugcauuc

SEQ ID NO: 41535 - RNA, 22 nt, Human
ccacaugguccucauuuacucu

SEQ ID NO: 41536 - RNA, 21 nt, Human
ccacauggugaaacccuaucu

SEQ ID NO: 41537 - RNA, 21 nt, Human
ccacauucucauucugacugc

SEQ ID NO: 41538 - RNA, 22 nt, Human
ccacauuuacugauguauguau

SEQ ID NO: 41539 - RNA, 20 nt, Human
ccacauuuuacuguuugcca

SEQ ID NO: 41540 - RNA, 22 nt, Human
ccacauuuuugauacucucacu

SEQ ID NO: 41541 - RNA, 22 nt, Human
ccaccacauuugccuagacuuu

SEQ ID NO: 41542 - RNA, 22 nt, Human
ccaccacugaggcacaggagcc

SEQ ID NO: 41543 - RNA, 22 nt, Human
ccaccaggcucuguccgagcgg

SEQ ID NO: 41544 - RNA, 21 nt, Human
ccaccaggucuucugcucggg

SEQ ID NO: 41545 - RNA, 22 nt, Human
ccaccaugggaagagagacuaa

SEQ ID NO: 41546 - RNA, 22 nt, Human
ccaccauuauaucucccaugcc

SEQ ID NO: 41547 - RNA, 22 nt, Human
ccacccacaaccagcuggcugu

SEQ ID NO: 41548 - RNA, 18 nt, Human
ccacccagggggagagga

SEQ ID NO: 41549 - RNA, 22 nt, Human
ccacccaugugacuaccucaug

SEQ ID NO: 41550 - RNA, 22 nt, Human
ccaccccugggugcagggagcg

SEQ ID NO: 41551 - RNA, 22 nt, Human
ccacccuaacaauccuuacugu

SEQ ID NO: 41552 - RNA, 22 nt, Human
ccacccugccuugggccaguga

SEQ ID NO: 41553 - RNA, 20 nt, Human
ccacccugcuaagaauacac

SEQ ID NO: 41554 - RNA, 22 nt, Human
ccacccuguguuuuugccauug

SEQ ID NO: 41555 - RNA, 22 nt, Human
ccaccgaaacgucugcggaucc

SEQ ID NO: 41556 - RNA, 22 nt, Human
ccaccgccauggcguuguacag

SEQ ID NO: 41557 - RNA, 22 nt, Human
ccaccuccuaggccuggagaag

SEQ ID NO: 41558 - RNA, 22 nt, Human
ccaccugugcuugguacuccau

SEQ ID NO: 41559 - RNA, 22 nt, Human
ccacgagggaaccagguggggu

SEQ ID NO: 41560 - RNA, 22 nt, Human
ccacgcucauccucucugagag

SEQ ID NO: 41561 - RNA, 22 nt, Human
ccacguguagguggacaggauc

SEQ ID NO: 41562 - RNA, 22 nt, Human
ccacuaguuuaauaccuuccuu

SEQ ID NO: 41563 - RNA, 21 nt, Human
ccacucaugacuccacucacc

SEQ ID NO: 41564 - RNA, 22 nt, Human
ccacucugauuucaagggagau

SEQ ID NO: 41565 - RNA, 23 nt, Human
ccacugaagaauccagggaguuu

SEQ ID NO: 41566 - RNA, 22 nt, Human
ccacugcccccugaagaccagg

SEQ ID NO: 41567 - RNA, 22 nt, Human
ccacugccuauuugcagggccc

SEQ ID NO: 41568 - RNA, 22 nt, Human
ccacugcuaacuugcugcagcu

SEQ ID NO: 41569 - RNA, 22 nt, Human
ccacugcuagagaugcaucccc

SEQ ID NO: 41570 - RNA, 22 nt, Human
ccacuggcuuuuccuaggucuc

SEQ ID NO: 41571 - RNA, 22 nt, Human
ccacuguaaccauuaucaccau

SEQ ID NO: 41572 - RNA, 22 nt, Human
ccacuguaaguuugaaaauaac

SEQ ID NO: 41573 - RNA, 22 nt, Human
ccacuguagagauuugaaugcc

SEQ ID NO: 41574 - RNA, 22 nt, Human
ccacugucugugacaucagaaa

SEQ ID NO: 41575 - RNA, 22 nt, Human
ccacugugagcaugaacaggac

SEQ ID NO: 41576 - RNA, 22 nt, Human
ccacugugcccagccucauggg

SEQ ID NO: 41577 - RNA, 22 nt, Human
ccacuguguccaccaggaaugc

SEQ ID NO: 41578 - RNA, 22 nt, Human
ccacuguuggcccgaagggguc

SEQ ID NO: 41579 - RNA, 22 nt, Human
ccacuguuuccuuucugcuggc

SEQ ID NO: 41580 - RNA, 22 nt, Human
ccacuguuuuucaguuaacuuu

SEQ ID NO: 41581 - RNA, 22 nt, Human
ccacuucaucccagcucagaua

SEQ ID NO: 41582 - RNA, 22 nt, Human
ccacuugaaucaaauucuuagg

SEQ ID NO: 41583 - RNA, 22 nt, Human
ccacuugaauuuuagugguuuu

SEQ ID NO: 41584 - RNA, 22 nt, Human
ccacuuugagaagcugaugaaa

SEQ ID NO: 41585 - RNA, 22 nt, Human
ccacuuugcaagauauucagag

SEQ ID NO: 41586 - RNA, 22 nt, Human
ccacuuuggcaccuucugccua

SEQ ID NO: 41587 - RNA, 22 nt, Human
ccacuuuucacuaagaugaauu

SEQ ID NO: 41588 - RNA, 22 nt, Human
ccagaaaaggagcugcaggaug

SEQ ID NO: 41589 - RNA, 22 nt, Human
ccagaaacaccuggauucuguu

SEQ ID NO: 41590 - RNA, 22 nt, Human
ccagaagaccccguccaccucc

SEQ ID NO: 41591 - RNA, 22 nt, Human
ccagaagagaucacaguucuug

SEQ ID NO: 41592 - RNA, 20 nt, Human
ccagaagcacucuucauguu

SEQ ID NO: 41593 - RNA, 22 nt, Human
ccagaagcagagccugaggcag

SEQ ID NO: 41594 - RNA, 22 nt, Human
cacuguccaauagauacauaau

SEQ ID NO: 41595 - RNA, 22 nt, Human
cacugucuugauuacuaugggu

SEQ ID NO: 41596 - RNA, 22 nt, Human
cacugucuuuugugaagacaau

SEQ ID NO: 41597 - RNA, 22 nt, Human
cacuguggaauuagaauaaccu

SEQ ID NO: 41598 - RNA, 22 nt, Human
cacuguggcuuaccaaagcuaa

SEQ ID NO: 41599 - RNA, 22 nt, Human
cacugugggccugucgugggug

SEQ ID NO: 41600 - RNA, 17 nt, Human
cacugugggggcauuua

SEQ ID NO: 41601 - RNA, 22 nt, Human
cacugugucagaguaugaugau

SEQ ID NO: 41602 - RNA, 22 nt, Human
cacugugucuggagugagcugg

SEQ ID NO: 41603 - RNA, 22 nt, Human
cacuguucaucaaaacugcucu

SEQ ID NO: 41604 - RNA, 22 nt, Human
cacuguugagcaauguacagug

SEQ ID NO: 41605 - RNA, 22 nt, Human
cacuguuuuauuccaacauagg

SEQ ID NO: 41606 - RNA, 22 nt, Human
cacuucaacaguuauuucuuag

SEQ ID NO: 41607 - RNA, 22 nt, Human
cacuucaagagcaagggugcca

SEQ ID NO: 41608 - RNA, 22 nt, Human
cacuucaaucucugccuccauc

SEQ ID NO: 41609 - RNA, 22 nt, Human
cacuucacuuggaugccuuuuc

SEQ ID NO: 41610 - RNA, 22 nt, Human
cacuucagguucuggcagggcg

SEQ ID NO: 41611 - RNA, 22 nt, Human
cacuucuguugccuugugcaau

SEQ ID NO: 41612 - RNA, 22 nt, Human
cacuugaaauauuaggggugau

SEQ ID NO: 41613 - RNA, 22 nt, Human
cacuugaacccgggaggcugag

SEQ ID NO: 41614 - RNA, 22 nt, Human
cacuugaaguuugggggacucu

SEQ ID NO: 41615 - RNA, 21 nt, Human
cacuugaaugguguuuuacaa

SEQ ID NO: 41616 - RNA, 21 nt, Human
cacuuuaaaaauaucuuuaua

SEQ ID NO: 41617 - RNA, 22 nt, Human
cacuuuauaaaauuggugugag

SEQ ID NO: 41618 - RNA, 19 nt, Human
cacuuuauuucuguuuugu

SEQ ID NO: 41619 - RNA, 22 nt, Human
cacuuucucaugaauuuggccc

SEQ ID NO: 41620 - RNA, 22 nt, Human
cacuuucuguguaucuuccauu

SEQ ID NO: 41621 - RNA, 22 nt, Human
cacuuugaagagcuuuuugaca

SEQ ID NO: 41622 - RNA, 22 nt, Human
cacuuugaugcagggcucagua

SEQ ID NO: 41623 - RNA, 22 nt, Human
cacuuugauuugugaugugaga

SEQ ID NO: 41624 - RNA, 22 nt, Human
cacuuugcaggguggugggagg

SEQ ID NO: 41625 - RNA, 22 nt, Human
cacuuugccucuuaccuguggu

SEQ ID NO: 41626 - RNA, 19 nt, Human
cacuuugcugaacucuucu

SEQ ID NO: 41627 - RNA, 22 nt, Human
cagaaaaccugacucuagaacu

SEQ ID NO: 41628 - RNA, 22 nt, Human
cagaaaaggguguuuguucagg

SEQ ID NO: 41629 - RNA, 22 nt, Human
cagaaaccucccugaauauuuu

SEQ ID NO: 41630 - RNA, 22 nt, Human
cagaaacugcuccccugguagg

SEQ ID NO: 41631 - RNA, 22 nt, Human
cagaaagcagagcugagccuuu

SEQ ID NO: 41632 - RNA, 22 nt, Human
cagaaagcccuauguacagugg

SEQ ID NO: 41633 - RNA, 22 nt, Human
cagaaagcgggaugcagcaugu

SEQ ID NO: 41634 - RNA, 22 nt, Human
cagaaagcucuuucaaucuugc

SEQ ID NO: 41635 - RNA, 22 nt, Human
cagaaagcuuaggcaaguugga

SEQ ID NO: 41636 - RNA, 22 nt, Human
cagaaaggacuuugguuggcuu

SEQ ID NO: 41637 - RNA, 18 nt, Human
cagaaaguuauuuacucu

SEQ ID NO: 41638 - RNA, 23 nt, Human
cagaaaguuugagaagauacauc

SEQ ID NO: 41639 - RNA, 23 nt, Human
cagaaauaaacugguuuguagau

SEQ ID NO: 41640 - RNA, 22 nt, Human
cagaaauaaaguggacagagua

SEQ ID NO: 41641 - RNA, 22 nt, Human
cagaaauagacaauggcagugg

SEQ ID NO: 41642 - RNA, 22 nt, Human
cagaaauaugugccaugccuua

SEQ ID NO: 41643 - RNA, 22 nt, Human
cagaaaucuccaugucagacau

SEQ ID NO: 41644 - RNA, 22 nt, Human
cagaaauggaaguucugguuua

SEQ ID NO: 41645 - RNA, 22 nt, Human
cagaaauggucuguucagcuua

SEQ ID NO: 41646 - RNA, 22 nt, Human
cagaaauguuuaugcuuuugaa

SEQ ID NO: 41647 - RNA, 22 nt, Human
cagaaauucccauuucagauuc

SEQ ID NO: 41648 - RNA, 22 nt, Human
cagaacagaaacguuguuccau

SEQ ID NO: 41649 - RNA, 19 nt, Human
cagaacagaggucauggcc

SEQ ID NO: 41650 - RNA, 22 nt, Human
cagaacaguaccuagcacauag

SEQ ID NO: 41651 - RNA, 22 nt, Human
cagaacauccccacugcuaccu

SEQ ID NO: 41652 - RNA, 20 nt, Human
cagaacaugagcaucgagcc

SEQ ID NO: 41653 - RNA, 22 nt, Human
cagaacaugauauaaacagaag

SEQ ID NO: 41654 - RNA, 22 nt, Human
cagaacauucuugccaguacau

SEQ ID NO: 41655 - RNA, 22 nt, Human
cagaacuguuauaacagcuguu

SEQ ID NO: 41656 - RNA, 22 nt, Human
cagaagaaaguggggagacaag

SEQ ID NO: 41657 - RNA, 22 nt, Human
cagaagaguagcugaacaaguu

SEQ ID NO: 41658 - RNA, 20 nt, Human
cagaagcaaggcagguaccu

SEQ ID NO: 41659 - RNA, 18 nt, Human
cagaagcaggcagugcag

SEQ ID NO: 41660 - RNA, 22 nt, Human
cagaagcauuccagcaaauagu

SEQ ID NO: 41661 - RNA, 22 nt, Human
cagaagccugccucagaugcac

SEQ ID NO: 41662 - RNA, 22 nt, Human
cagaaggcaaacaaaaggauuu

SEQ ID NO: 41663 - RNA, 22 nt, Human
cagaaggcaaggccugccacgc

SEQ ID NO: 41664 - RNA, 22 nt, Human
cagaaggcagcaaaugaaaacc

SEQ ID NO: 41665 - RNA, 22 nt, Human
cagaaggcuggcagauugagau

SEQ ID NO: 41666 - RNA, 22 nt, Human
cagaagggacaggguuuguaga

SEQ ID NO: 41667 - RNA, 22 nt, Human
cagaagggcagcacugggaagg

SEQ ID NO: 41668 - RNA, 22 nt, Human
cagaagguuuacacuggacugu

SEQ ID NO: 41669 - RNA, 22 nt, Human
cagaaguaagauuacugugagu

SEQ ID NO: 41670 - RNA, 20 nt, Human
cccagguaggugccaugagu

SEQ ID NO: 41671 - RNA, 22 nt, Human
cccagguaguuggaagagacaa

SEQ ID NO: 41672 - RNA, 22 nt, Human
cccagguccccaccugucugcu

SEQ ID NO: 41673 - RNA, 22 nt, Human
cccaggucccgccccagcucua

SEQ ID NO: 41674 - RNA, 22 nt, Human
cccaggucuaugccagcucuga

SEQ ID NO: 41675 - RNA, 22 nt, Human
cccaggucugugccagcucuga

SEQ ID NO: 41676 - RNA, 22 nt, Human
cccaguaagaagcuggcaccag

SEQ ID NO: 41677 - RNA, 22 nt, Human
cccaguaaucggagaguacuua

SEQ ID NO: 41678 - RNA, 22 nt, Human
cccaguaccucuguucccugcu

SEQ ID NO: 41679 - RNA, 22 nt, Human
cccaguauugagcuacaggccu

SEQ ID NO: 41680 - RNA, 22 nt, Human
cccaguccuaaagcagacgcca

SEQ ID NO: 41681 - RNA, 19 nt, Human
cccagucuagguccuagga

SEQ ID NO: 41682 - RNA, 18 nt, Human
cccagugcucacugccuc

SEQ ID NO: 41683 - RNA, 22 nt, Human
cccaguggcccagcauguggug

SEQ ID NO: 41684 - RNA, 22 nt, Human
cccaguggcuuuugcccagguu

SEQ ID NO: 41685 - RNA, 22 nt, Human
cccagugucuccaacaucagau

SEQ ID NO: 41686 - RNA, 22 nt, Human
cccagugugccccuccugcagc

SEQ ID NO: 41687 - RNA, 22 nt, Human
cccaguguuccuugaggggcug

SEQ ID NO: 41688 - RNA, 22 nt, Human
cccaucaggaacccaggagccc

SEQ ID NO: 41689 - RNA, 22 nt, Human
cccaugacucucauucacaguc

SEQ ID NO: 41690 - RNA, 22 nt, Human
cccaugccuucugacucacagg

SEQ ID NO: 41691 - RNA, 23 nt, Human
cccaugcugggcgcagugaaugg

SEQ ID NO: 41692 - RNA, 22 nt, Human
cccaugcugugccuagagagca

SEQ ID NO: 41693 - RNA, 22 nt, Human
cccauggcaauaaggucacagg

SEQ ID NO: 41694 - RNA, 22 nt, Human
cccauggcagucagagauaaga

SEQ ID NO: 41695 - RNA, 22 nt, Human
cccauggcuuaggagggagugu

SEQ ID NO: 41696 - RNA, 22 nt, Human
cccauucccuuuacuguugcau

SEQ ID NO: 41697 - RNA, 22 nt, Human
cccauuuagaccuauucugccc

SEQ ID NO: 41698 - RNA, 22 nt, Human
cccauuuguauagagccuuaua

SEQ ID NO: 41699 - RNA, 22 nt, Human
cccauuuguccaaaguauaaaa

SEQ ID NO: 41700 - RNA, 22 nt, Human
cccauuuuagcaagggguggcg

SEQ ID NO: 41701 - RNA, 22 nt, Human
ccccaaaauucuuaaguugaau

SEQ ID NO: 41702 - RNA, 22 nt, Human
ccccaaggugcucacugucugg

SEQ ID NO: 41703 - RNA, 22 nt, Human
cccuggauuuacaucauucuga

SEQ ID NO: 41704 - RNA, 22 nt, Human
cccuggcaaaacacucucuuga

SEQ ID NO: 41705 - RNA, 17 nt, Human
cccuggcaaagaauggc

SEQ ID NO: 41706 - RNA, 22 nt, Human
cccuggcagaagguguagaagc

SEQ ID NO: 41707 - RNA, 22 nt, Human
cccuggcagagggggcaggugc

SEQ ID NO: 41708 - RNA, 22 nt, Human
cccuggcagcaaucacuggugu

SEQ ID NO: 41709 - RNA, 22 nt, Human
cccuggcaugcaugucccuggc

SEQ ID NO: 41710 - RNA, 22 nt, Human
cccuggccagcucaugucugag

SEQ ID NO: 41711 - RNA, 22 nt, Human
cccuggccuccaggcaguccug

SEQ ID NO: 41712 - RNA, 22 nt, Human
cccuggcucuucaccaccugcc

SEQ ID NO: 41713 - RNA, 22 nt, Human
cccuggcugcuaccagguagcu

SEQ ID NO: 41714 - RNA, 22 nt, Human
cccuggcuuaaaaaccucauau

SEQ ID NO: 41715 - RNA, 22 nt, Human
cccuggcuuggcacucuccacu

SEQ ID NO: 41716 - RNA, 22 nt, Human
cccugggaaguauuccagcuau

SEQ ID NO: 41717 - RNA, 22 nt, Human
cccugggacccgcugcagaggc

SEQ ID NO: 41718 - RNA, 22 nt, Human
cccugggagcugccuggcugac

SEQ ID NO: 41719 - RNA, 22 nt, Human
cccugggauggauuggcaggaa

SEQ ID NO: 41720 - RNA, 22 nt, Human
cccugggcagucugcacuucag

SEQ ID NO: 41721 - RNA, 22 nt, Human
cccugggcucagagcagguagc

SEQ ID NO: 41722 - RNA, 22 nt, Human
cccuggggagcaggcgaaggag

SEQ ID NO: 41723 - RNA, 22 nt, Human
cccuggguucuggcugggcugc

SEQ ID NO: 41724 - RNA, 22 nt, Human
cccugguucagguuucucugaa

SEQ ID NO: 41725 - RNA, 21 nt, Human
cccugguuccacugucaccgc

SEQ ID NO: 41726 - RNA, 22 nt, Human
cccuguacagucucuguggcac

SEQ ID NO: 41727 - RNA, 22 nt, Human
cccuguauagauacaggucaua

SEQ ID NO: 41728 - RNA, 22 nt, Human
cccugucucauugaucacuugu

SEQ ID NO: 41729 - RNA, 20 nt, Human
cccugugauuggcaaguguc

SEQ ID NO: 41730 - RNA, 22 nt, Human
cccugugcacacacuucacucu

SEQ ID NO: 41731 - RNA, 22 nt, Human
cccugugcauuggaggguguuu

SEQ ID NO: 41732 - RNA, 22 nt, Human
cccugugccucaguuuccucau

SEQ ID NO: 41733 - RNA, 22 nt, Human
cccuguggaggcagcauccugc

SEQ ID NO: 41734 - RNA, 22 nt, Human
cccuguggcaggaggaggagca

SEQ ID NO: 41735 - RNA, 22 nt, Human
cccugugggaacuccugaguug

SEQ ID NO: 41736 - RNA, 22 nt, Human
cccuguuuaagaaaccuguaaa

SEQ ID NO: 41737 - RNA, 22 nt, Human
cccuguuuauuuuuggagagaa

SEQ ID NO: 41738 - RNA, 22 nt, Human
cccuguuuuaaguugauauuga

SEQ ID NO: 41739 - RNA, 22 nt, Human
cccuuagaacaacauuagcaua

SEQ ID NO: 41740 - RNA, 22 nt, Human
cccuuagagauucugucagagu

SEQ ID NO: 41741 - RNA, 22 nt, Human
cccuuagccaggaaaucgaccu

SEQ ID NO: 41742 - RNA, 22 nt, Human
cccuuagcuccaagggguuugg

SEQ ID NO: 41743 - RNA, 22 nt, Human
cccuuagcuggugagcccagcg

SEQ ID NO: 41744 - RNA, 22 nt, Human
cccuucaagcucucuggguuuu

SEQ ID NO: 41745 - RNA, 22 nt, Human
cccuucagugcgugagaaugag

SEQ ID NO: 41746 - RNA, 22 nt, Human
cccuuccucaaggagcuguguu

SEQ ID NO: 41747 - RNA, 22 nt, Human
cccuugagguagacugaacacc

SEQ ID NO: 41748 - RNA, 22 nt, Human
cccuugcacauuugucuuuaau

SEQ ID NO: 41749 - RNA, 21 nt, Human
cccuugccugcacuccucggc

SEQ ID NO: 41750 - RNA, 22 nt, Human
cccuuggaggaagcucuaggcu

SEQ ID NO: 41751 - RNA, 22 nt, Human
cccuugggccccagcucagggc

SEQ ID NO: 41752 - RNA, 22 nt, Human
cccuugggcuucagcccuaccg

SEQ ID NO: 41753 - RNA, 22 nt, Human
cccuuuaaaguuuuaccagcag

SEQ ID NO: 41754 - RNA, 22 nt, Human
cccuuuaacacacagaggcugc

SEQ ID NO: 41755 - RNA, 20 nt, Human
cccuuuaagcuuuaguaugc

SEQ ID NO: 41756 - RNA, 22 nt, Human
cccuuucuccagaacugucuga

SEQ ID NO: 41757 - RNA, 22 nt, Human
cccuuucuucuugacugaaaac

SEQ ID NO: 41758 - RNA, 20 nt, Human
cccuuuucacgaaaaggaga

SEQ ID NO: 41759 - RNA, 22 nt, Human
ccgagcuguggucucuuuuacg

SEQ ID NO: 41760 - RNA, 22 nt, Human
ccgaggaauuuuuauaagaucu

SEQ ID NO: 41761 - RNA, 22 nt, Human
ccgaggcuggccucagggcugu

SEQ ID NO: 41762 - RNA, 22 nt, Human
ccgcgagguggagguugcagug

SEQ ID NO: 41763 - RNA, 22 nt, Human
ccgcgcgcgugggcguccaggg

SEQ ID NO: 41764 - RNA, 22 nt, Human
ccgcguggcacccuccuggagg

SEQ ID NO: 41765 - RNA, 22 nt, Human
ccgcuguccuggagcugcugcu

SEQ ID NO: 41766 - RNA, 22 nt, Human
ccggcgggcagcggcagugagc

SEQ ID NO: 41767 - RNA, 22 nt, Human
ccggcgggcgcggugacgucag

SEQ ID NO: 41768 - RNA, 22 nt, Human
ccgggagaguggaaccaagagg

SEQ ID NO: 41769 - RNA, 18 nt, Human
ccgggcuuuggugacaca

SEQ ID NO: 41770 - RNA, 22 nt, Human
ccggggacuuaaagugaaggaa

SEQ ID NO: 41771 - RNA, 22 nt, Human
ccgggggaggcaagagacaugc

SEQ ID NO: 41772 - RNA, 22 nt, Human
ccgggggcgggacgagcuugac

SEQ ID NO: 41773 - RNA, 22 nt, Human
ccggggugcgaggagcgucuuu

SEQ ID NO: 41774 - RNA, 23 nt, Human
ccgugaagacagacagacagcag

SEQ ID NO: 41775 - RNA, 23 nt, Human
ccguguguauacucuguaauaga

SEQ ID NO: 41776 - RNA, 22 nt, Human
ccguuaaucccauaauauggau

SEQ ID NO: 41777 - RNA, 21 nt, Human
ccuaaacaagacugacacaca

SEQ ID NO: 41778 - RNA, 22 nt, Human
ccuaagaauuaaugaauacacc

SEQ ID NO: 41779 - RNA, 22 nt, Human
ccuaagagauuauugcuccugc

SEQ ID NO: 41780 - RNA, 22 nt, Human
ccuaaggaccagggcuuccagc

SEQ ID NO: 41781 - RNA, 22 nt, Human
ccuaaguugagaagccaguagc

SEQ ID NO: 41782 - RNA, 22 nt, Human
ccuaauuaucucccaaagaucc

SEQ ID NO: 41783 - RNA, 22 nt, Human
ccuaauuugauuuuaaauagcc

SEQ ID NO: 41784 - RNA, 22 nt, Human
ccuacagagcagcaggaccaga

SEQ ID NO: 41785 - RNA, 22 nt, Human
ccuaccaguaggaggccagaga

SEQ ID NO: 41786 - RNA, 22 nt, Human
ccuacucccuuucuagaguaug

SEQ ID NO: 41787 - RNA, 19 nt, Human
ccuagagcaguaccuggua

SEQ ID NO: 41788 - RNA, 22 nt, Human
ccuagaggcugcaaggagaggc

SEQ ID NO: 41789 - RNA, 22 nt, Human
cagaaguaaugaugucauuccu

SEQ ID NO: 41790 - RNA, 22 nt, Human
cagaaguggcaucauucaagag

SEQ ID NO: 41791 - RNA, 22 nt, Human
cagaaguuagugucugccagua

SEQ ID NO: 41792 - RNA, 22 nt, Human
cagaaguuaugucaauggucau

SEQ ID NO: 41793 - RNA, 22 nt, Human
cagaaguuccuauuuaccuccu

SEQ ID NO: 41794 - RNA, 22 nt, Human
cagaaguugauccugcguuucc

SEQ ID NO: 41795 - RNA, 22 nt, Human
cagaaguuugaaugagagccug

SEQ ID NO: 41796 - RNA, 22 nt, Human
cagaauaaaaacuccuaugucu

SEQ ID NO: 41797 - RNA, 22 nt, Human
cagaauaugacaagauuuuccu

SEQ ID NO: 41798 - RNA, 22 nt, Human
cagaaugaaauguaagaacacc

SEQ ID NO: 41799 - RNA, 22 nt, Human
cagaaugaguagcaucuucacc

SEQ ID NO: 41800 - RNA, 20 nt, Human
cagaaugcuguaaucaagaa

SEQ ID NO: 41801 - RNA, 22 nt, Human
cagaauguagaucaucaucaag

SEQ ID NO: 41802 - RNA, 22 nt, Human
cagaauuauaguugcuuuuuaa

SEQ ID NO: 41803 - RNA, 22 nt, Human
cagacacacacccuggccuagc

SEQ ID NO: 41804 - RNA, 22 nt, Human
cagacagaaggaaggccaacau

SEQ ID NO: 41805 - RNA, 22 nt, Human
cagacagggguaaccuuccuca

SEQ ID NO: 41806 - RNA, 22 nt, Human
cagacaggguccuguccgucac

SEQ ID NO: 41807 - RNA, 21 nt, Human
cagacaugagucucagcuuug

SEQ ID NO: 41808 - RNA, 22 nt, Human
cagacauggaaauuuaguguua

SEQ ID NO: 41809 - RNA, 22 nt, Human
cagaccagcucuaugaacccaa

SEQ ID NO: 41810 - RNA, 21 nt, Human
cagaccauugcaugagcaggu

SEQ ID NO: 41811 - RNA, 22 nt, Human
cagacccucgggugaguuggcc

SEQ ID NO: 41812 - RNA, 22 nt, Human
caggcucagaugcccugcgcug

SEQ ID NO: 41813 - RNA, 22 nt, Human
caggcuccagcuuccugcucag

SEQ ID NO: 41814 - RNA, 22 nt, Human
caggcucccgcuccacugggca

SEQ ID NO: 41815 - RNA, 22 nt, Human
caggcucuuccauccugcugag

SEQ ID NO: 41816 - RNA, 22 nt, Human
caggcucuuuugguggcaagga

SEQ ID NO: 41817 - RNA, 22 nt, Human
caggcugaggguuaggccuuag

SEQ ID NO: 41818 - RNA, 22 nt, Human
caggcugcagcagcaguggccc

SEQ ID NO: 41819 - RNA, 22 nt, Human
caggcugcccuagcuuggacau

SEQ ID NO: 41820 - RNA, 22 nt, Human
caggcugccgugaagcaggccu

SEQ ID NO: 41821 - RNA, 22 nt, Human
caggcugcggccgugugagcau

SEQ ID NO: 41822 - RNA, 22 nt, Human
caggcugcuccaggguaggaaa

SEQ ID NO: 41823 - RNA, 22 nt, Human
caggcuggaguacaauugugug

SEQ ID NO: 41824 - RNA, 22 nt, Human
caggcuggaguuaccuuuaggg

SEQ ID NO: 41825 - RNA, 22 nt, Human
caggcugggcugguguuagagu

SEQ ID NO: 41826 - RNA, 22 nt, Human
caggcugucugaauggaggccc

SEQ ID NO: 41827 - RNA, 23 nt, Human
cagcuucuuugggauucuuuaua

SEQ ID NO: 41828 - RNA, 22 nt, Human
cagcuugcuaacugguaggggu

SEQ ID NO: 41829 - RNA, 20 nt, Human
cagcuuggaugagaggcuga

SEQ ID NO: 41830 - RNA, 22 nt, Human
cagcuuggcgaauguagguaug

SEQ ID NO: 41831 - RNA, 22 nt, Human
cagcuugggucaggugccugcu

SEQ ID NO: 41832 - RNA, 22 nt, Human
cagcuugugaaaugucaccacu

SEQ ID NO: 41833 - RNA, 22 nt, Human
cagcuuuaccaauauuuggaaa

SEQ ID NO: 41834 - RNA, 22 nt, Human
cagcuuuaccuuuaggaguaac

SEQ ID NO: 41835 - RNA, 17 nt, Human
cagcuuuaugcuacugu

SEQ ID NO: 41836 - RNA, 22 nt, Human
cagcuuuauuaaugauugucuu

SEQ ID NO: 41837 - RNA, 22 nt, Human
cagcuuuauuucacguguuugu

SEQ ID NO: 41838 - RNA, 23 nt, Human
cagcuuucagggcuuuagggaag

SEQ ID NO: 41839 - RNA, 22 nt, Human
cagcuuuccagagaccugcccc

SEQ ID NO: 41840 - RNA, 22 nt, Human
cagcuuugaccuaaaguaggaa

SEQ ID NO: 41841 - RNA, 22 nt, Human
cagcuuugauucacugccuagu

SEQ ID NO: 41842 - RNA, 22 nt, Human
cagcuuugauucuuucugccau

SEQ ID NO: 41843 - RNA, 22 nt, Human
cagcuuugugcaaugcagucuc

SEQ ID NO: 41844 - RNA, 22 nt, Human
cagcuuuugcagacuucuugcc

SEQ ID NO: 41845 - RNA, 22 nt, Human
cagcuuuuuagaaucuagggca

SEQ ID NO: 41846 - RNA, 22 nt, Human
caggaaaaugucaauggaaagc

SEQ ID NO: 41847 - RNA, 19 nt, Human
caggaaacaccuacugcua

SEQ ID NO: 41848 - RNA, 22 nt, Human
caggaaacauucccauaacaca

SEQ ID NO: 41849 - RNA, 21 nt, Human
caggaaagaaaacguacauau

SEQ ID NO: 41850 - RNA, 22 nt, Human
caggaaagagagcuauucacuu

SEQ ID NO: 41851 - RNA, 22 nt, Human
caggaaagagcugccaggcagg

SEQ ID NO: 41852 - RNA, 22 nt, Human
caggaaauaaaaaguaucuucu

SEQ ID NO: 41853 - RNA, 22 nt, Human
caggaaauaggcguuuguccuc

SEQ ID NO: 41854 - RNA, 22 nt, Human
caggaaauaucucaacacuuua

SEQ ID NO: 41855 - RNA, 22 nt, Human
caggaaauguauaauuuuauaa

SEQ ID NO: 41856 - RNA, 22 nt, Human
caggaaauucccagaaggacug

SEQ ID NO: 41857 - RNA, 22 nt, Human
caggaaauuggcuauuugggau

SEQ ID NO: 41858 - RNA, 22 nt, Human
caggaacaacucccagcaucuc

SEQ ID NO: 41859 - RNA, 22 nt, Human
caggaacagcaccaggagcuag

SEQ ID NO: 41860 - RNA, 22 nt, Human
caggaacauguuggaaagaaau

SEQ ID NO: 41861 - RNA, 22 nt, Human
caggaaccaugaagacauauac

SEQ ID NO: 41862 - RNA, 22 nt, Human
caggaaccugcuccaagaggca

SEQ ID NO: 41863 - RNA, 22 nt, Human
caggaaccugugcguagggaug

SEQ ID NO: 41864 - RNA, 22 nt, Human
caggaagaaggguggugagucc

SEQ ID NO: 41865 - RNA, 22 nt, Human
caggaagagguaucaccgagca

SEQ ID NO: 41866 - RNA, 23 nt, Human
caggaagcagaugggguagaaga

SEQ ID NO: 41867 - RNA, 22 nt, Human
caggaagccacaggacagguag

SEQ ID NO: 41868 - RNA, 22 nt, Human
caggaagcucuuagcagucacc

SEQ ID NO: 41869 - RNA, 22 nt, Human
caggaaggcccaccuguccugu

SEQ ID NO: 41870 - RNA, 22 nt, Human
caggaaguagaguuggccagcc

SEQ ID NO: 41871 - RNA, 22 nt, Human
caggaaugaaaggucaggguug

SEQ ID NO: 41872 - RNA, 22 nt, Human
caggaaugaguucuggugcucu

SEQ ID NO: 41873 - RNA, 22 nt, Human
caggaaugaucugcugagugau

SEQ ID NO: 41874 - RNA, 22 nt, Human
caggaaugccaaccagugcaug

SEQ ID NO: 41875 - RNA, 22 nt, Human
caggaaugccuucuucagccau

SEQ ID NO: 41876 - RNA, 22 nt, Human
caggaaugguuaaucuaaagug

SEQ ID NO: 41877 - RNA, 22 nt, Human
caggaauguagcagcgauggaa

SEQ ID NO: 41878 - RNA, 22 nt, Human
caggaauguccuugucauuuca

SEQ ID NO: 41879 - RNA, 22 nt, Human
caggacaaccucagguugcugc

SEQ ID NO: 41880 - RNA, 22 nt, Human
caggacaagagggaaucgauaa

SEQ ID NO: 41881 - RNA, 22 nt, Human
caggacaauggucauacuggau

SEQ ID NO: 41882 - RNA, 22 nt, Human
caggacaauuuugagccaccug

SEQ ID NO: 41883 - RNA, 22 nt, Human
caggacacagaauaaggcaguu

SEQ ID NO: 41884 - RNA, 22 nt, Human
caggacacauuucuuguucagg

SEQ ID NO: 41885 - RNA, 22 nt, Human
caggacagagcccagacugugu

SEQ ID NO: 41886 - RNA, 22 nt, Human
caggacaggaguggggucaaag

SEQ ID NO: 41887 - RNA, 22 nt, Human
caggacaggcccuguggggucu

SEQ ID NO: 41888 - RNA, 22 nt, Human
caggacaguuggcaucugcugc

SEQ ID NO: 41889 - RNA, 22 nt, Human
caggacaucgucaucaugggga

SEQ ID NO: 41890 - RNA, 22 nt, Human
caggaccaagcaaaguuucuuu

SEQ ID NO: 41891 - RNA, 22 nt, Human
caggacccaaccucccugcucu

SEQ ID NO: 41892 - RNA, 22 nt, Human
caggaccugaagacaggcaggu

SEQ ID NO: 41893 - RNA, 22 nt, Human
caggacgggcaaacaggauggu

SEQ ID NO: 41894 - RNA, 22 nt, Human
caggacugaagggcacagggaa

SEQ ID NO: 41895 - RNA, 22 nt, Human
caggacuggcucgcagugggug

SEQ ID NO: 41896 - RNA, 22 nt, Human
caggagaaacauaauuuucugg

SEQ ID NO: 41897 - RNA, 22 nt, Human
caggagagauaugaguccccac

SEQ ID NO: 41898 - RNA, 22 nt, Human
caggagauguaccuguuuuuga

SEQ ID NO: 41899 - RNA, 22 nt, Human
caggagcccagaguccucagcu

SEQ ID NO: 41900 - RNA, 22 nt, Human
caggagcccugguggguggaca

SEQ ID NO: 41901 - RNA, 22 nt, Human
caggagcuucugcccauggcca

SEQ ID NO: 41902 - RNA, 22 nt, Human
caggagcuuucuucccaaacuu

SEQ ID NO: 41903 - RNA, 22 nt, Human
caggaggaagaacucugcaaca

SEQ ID NO: 41904 - RNA, 22 nt, Human
caggaggagcauuagcgucuca

SEQ ID NO: 41905 - RNA, 22 nt, Human
caggaggcagaggaugcccagu

SEQ ID NO: 41906 - RNA, 22 nt, Human
caggaggcaggugcauuuugag

SEQ ID NO: 41907 - RNA, 22 nt, Human
caggaggcccacaggccccugc

SEQ ID NO: 41908 - RNA, 23 nt, Human
caggagggaaugaaguuagacaa

SEQ ID NO: 41909 - RNA, 22 nt, Human
caggagggcccgagacucuucc

SEQ ID NO: 41910 - RNA, 22 nt, Human
caggaggguguggaaaacuggg

SEQ ID NO: 41911 - RNA, 22 nt, Human
caggagguacauagauucagau

SEQ ID NO: 41912 - RNA, 22 nt, Human
caggaggugaaggagaaccagu

SEQ ID NO: 41913 - RNA, 22 nt, Human
caggagguuguaagagcaggcc

SEQ ID NO: 41914 - RNA, 22 nt, Human
caggaguccagagugucauuuu

SEQ ID NO: 41915 - RNA, 22 nt, Human
caggaguccaucuggccuggug

SEQ ID NO: 41916 - RNA, 22 nt, Human
caggagugagaugcgaucacuu

SEQ ID NO: 41917 - RNA, 22 nt, Human
caggaguguuugcuacaguuuc

SEQ ID NO: 41918 - RNA, 22 nt, Human
caggauaaauaguaaauguaag

SEQ ID NO: 41919 - RNA, 22 nt, Human
caggauccccaggucgccgucc

SEQ ID NO: 41920 - RNA, 22 nt, Human
caggaucuuuuaaugucuccag

SEQ ID NO: 41921 - RNA, 22 nt, Human
cucaggccaauaagcuccagcc

SEQ ID NO: 41922 - RNA, 22 nt, Human
cucaggccauuccuaccaaggg

SEQ ID NO: 41923 - RNA, 22 nt, Human
cucaggccauucuuccagcugc

SEQ ID NO: 41924 - RNA, 22 nt, Human
cucaggcugguuuggguuguuu

SEQ ID NO: 41925 - RNA, 22 nt, Human
cucagggaauuauuucuguccu

SEQ ID NO: 41926 - RNA, 22 nt, Human
cucagggaauugaaucuccuug

SEQ ID NO: 41927 - RNA, 22 nt, Human
cucagggaugggcagauguuaa

SEQ ID NO: 41928 - RNA, 22 nt, Human
cucagggcuugaguguccagga

SEQ ID NO: 41929 - RNA, 21 nt, Human
cucaggggauuuugagauuag

SEQ ID NO: 41930 - RNA, 22 nt, Human
cucagggggaaucaggucacag

SEQ ID NO: 41931 - RNA, 22 nt, Human
cucagggucugguccuuagauu

SEQ ID NO: 41932 - RNA, 18 nt, Human
cucagggugaccaaugca

SEQ ID NO: 41933 - RNA, 22 nt, Human
cucaguggggcgacagggugcu

SEQ ID NO: 41934 - RNA, 22 nt, Human
cucagugguggucacuuggugg

SEQ ID NO: 41935 - RNA, 22 nt, Human
cucagugugagugagaagugca

SEQ ID NO: 41936 - RNA, 20 nt, Human
cucaguguggccugaguguu

SEQ ID NO: 41937 - RNA, 22 nt, Human
cucaguguuaaagacuuuccag

SEQ ID NO: 41938 - RNA, 22 nt, Human
cucaguguuggagaccuucagg

SEQ ID NO: 41939 - RNA, 22 nt, Human
cucaguuuccccggccugggcg

SEQ ID NO: 41940 - RNA, 22 nt, Human
cucaguuuccucaacugcaaaa

SEQ ID NO: 41941 - RNA, 22 nt, Human
cucaguuucugacauuaaaauc

SEQ ID NO: 41942 - RNA, 22 nt, Human
cucaguuugugugauauugucu

SEQ ID NO: 41943 - RNA, 22 nt, Human
cucaguuuuuuuaagagccaug

SEQ ID NO: 41944 - RNA, 22 nt, Human
caggcaccaacuuccuggggag

SEQ ID NO: 41945 - RNA, 22 nt, Human
caggcaccagugagaagggccu

SEQ ID NO: 41946 - RNA, 22 nt, Human
caggcacccagcccagucgcac

SEQ ID NO: 41947 - RNA, 22 nt, Human
caggcaccuuugugcaugggca

SEQ ID NO: 41948 - RNA, 22 nt, Human
caggcacgguggcucaugccug

SEQ ID NO: 41949 - RNA, 22 nt, Human
caggcacuagcagaaugaggcu

SEQ ID NO: 41950 - RNA, 22 nt, Human
caggcacugcacuaccacuuuu

SEQ ID NO: 41951 - RNA, 22 nt, Human
caggcacuucugcugcuugucu

SEQ ID NO: 41952 - RNA, 22 nt, Human
caggcagaaggaaguaccaggc

SEQ ID NO: 41953 - RNA, 17 nt, Human
caggcagacauguaagc

SEQ ID NO: 41954 - RNA, 22 nt, Human
caggcagagaacucauccguga

SEQ ID NO: 41955 - RNA, 22 nt, Human
caggcagagacgucaguguagg

SEQ ID NO: 41956 - RNA, 22 nt, Human
caggcagagaggagcauuuaau

SEQ ID NO: 41957 - RNA, 22 nt, Human
caggcagagccaaucguggggu

SEQ ID NO: 41958 - RNA, 22 nt, Human
caggcagagcugaagauagaug

SEQ ID NO: 41959 - RNA, 22 nt, Human
caggcagaggcuuuucauggcu

SEQ ID NO: 41960 - RNA, 22 nt, Human
caggcagagguaccaagauuga

SEQ ID NO: 41961 - RNA, 22 nt, Human
caggcagauuugcugcccucca

SEQ ID NO: 41962 - RNA, 22 nt, Human
caggcagcagccacucugguau

SEQ ID NO: 41963 - RNA, 22 nt, Human
caggcagcaucagucugcugua

SEQ ID NO: 41964 - RNA, 22 nt, Human
caggcagccaggggaccugucc

SEQ ID NO: 41965 - RNA, 22 nt, Human
caggcagcccugcaccaagugu

SEQ ID NO: 41966 - RNA, 22 nt, Human
caggcagcucuaauggaaagug

SEQ ID NO: 41967 - RNA, 22 nt, Human
caggcagcucugcuuuuccuaa

SEQ ID NO: 41968 - RNA, 22 nt, Human
caggcaguggccauguugggag

SEQ ID NO: 41969 - RNA, 22 nt, Human
caggcagugucccaggaagcca

SEQ ID NO: 41970 - RNA, 22 nt, Human
caggcauuucgcaaaggcugag

SEQ ID NO: 41971 - RNA, 22 nt, Human
caggccacagcuaaagaggauu

SEQ ID NO: 41972 - RNA, 22 nt, Human
caggccagggagaauaugaagc

SEQ ID NO: 41973 - RNA, 22 nt, Human
caggcccacugcuugucuaguc

SEQ ID NO: 41974 - RNA, 22 nt, Human
caggcccagggagggagaccaa

SEQ ID NO: 41975 - RNA, 22 nt, Human
caggcccaggguuauugggaaa

SEQ ID NO: 41976 - RNA, 22 nt, Human
caggcccugaggauucggcggg

SEQ ID NO: 41977 - RNA, 22 nt, Human
caggcccugcacagugguccug

SEQ ID NO: 41978 - RNA, 22 nt, Human
caggcccugggcaggaucagcc

SEQ ID NO: 41979 - RNA, 22 nt, Human
caggccggccggccccagcucu

SEQ ID NO: 41980 - RNA, 22 nt, Human
caggccgggcacugcgcuaggu

SEQ ID NO: 41981 - RNA, 22 nt, Human
caggccucaccagcggagcugc

SEQ ID NO: 41982 - RNA, 22 nt, Human
caggccucagggcuguccguag

SEQ ID NO: 41983 - RNA, 22 nt, Human
caggccuccacuccacgcagac

SEQ ID NO: 41984 - RNA, 22 nt, Human
caggccucuccuuagucuggca

SEQ ID NO: 41985 - RNA, 20 nt, Human
caggccucugggggcccugg

SEQ ID NO: 41986 - RNA, 22 nt, Human
caggccucuuccaugcagcagc

SEQ ID NO: 41987 - RNA, 22 nt, Human
caggccugcaggaaaggcuccc

SEQ ID NO: 41988 - RNA, 22 nt, Human
caggccugcuucuuacccuuca

SEQ ID NO: 41989 - RNA, 22 nt, Human
caggccuggggcuggcuuccag

SEQ ID NO: 41990 - RNA, 22 nt, Human
caggccuggguucaaaucccuu

SEQ ID NO: 41991 - RNA, 22 nt, Human
caggccugguugagcccugaga

SEQ ID NO: 41992 - RNA, 22 nt, Human
caggccugucugcacaugaggc

SEQ ID NO: 41993 - RNA, 20 nt, Human
caggccuucaggauggcugg

SEQ ID NO: 41994 - RNA, 22 nt, Human
caggccuugaguuuugggcuuu

SEQ ID NO: 41995 - RNA, 22 nt, Human
caggccuugcgucccauggccu

SEQ ID NO: 41996 - RNA, 22 nt, Human
caggccuugucaagaaaaugcc

SEQ ID NO: 41997 - RNA, 22 nt, Human
caggccuuucuuggggcuuaga

SEQ ID NO: 41998 - RNA, 22 nt, Human
caggccuuugcacgugcaguug

SEQ ID NO: 41999 - RNA, 22 nt, Human
caggccuuugcagggagagaga

SEQ ID NO: 42000 - RNA, 22 nt, Human
caggccuuuuuuccugcagugu

SEQ ID NO: 42001 - RNA, 22 nt, Human
caggcgagggcccugaggagcc

SEQ ID NO: 42002 - RNA, 22 nt, Human
caggcgagugaacagacucuca

SEQ ID NO: 42003 - RNA, 22 nt, Human
caggcgucacugccacggguau

SEQ ID NO: 42004 - RNA, 22 nt, Human
caggcuaaagcuuugagcaugu

SEQ ID NO: 42005 - RNA, 22 nt, Human
caggcuagauuggggccaguag

SEQ ID NO: 42006 - RNA, 22 nt, Human
caggcuagcagggcccagggca

SEQ ID NO: 42007 - RNA, 22 nt, Human
caggcuauauuuaaagaagaac

SEQ ID NO: 42008 - RNA, 22 nt, Human
caggcucagaagccaguggagc

SEQ ID NO: 42009 - RNA, 22 nt, Human
caggcucccacuuggcuuaaag

SEQ ID NO: 42010 - RNA, 22 nt, Human
caggcucccugcaggccaguga

SEQ ID NO: 42011 - RNA, 22 nt, Human
caggcucccugccagggccggc

SEQ ID NO: 42012 - RNA, 22 nt, Human
caggcucccuucucggaauucu

SEQ ID NO: 42013 - RNA, 22 nt, Human
caggcuccucacucaugcuccc

SEQ ID NO: 42014 - RNA, 22 nt, Human
caggcuccuuaucuuacaacuu

SEQ ID NO: 42015 - RNA, 21 nt, Human
caggcucugcuagaggagccu

SEQ ID NO: 42016 - RNA, 22 nt, Human
caggcugagcucuggccugggc

SEQ ID NO: 42017 - RNA, 22 nt, Human
caggcugaggcaguaggguuug

SEQ ID NO: 42018 - RNA, 22 nt, Human
caggcugcaagaaaggcauuca

SEQ ID NO: 42019 - RNA, 22 nt, Human
caggcugcagugcaguggcuau

SEQ ID NO: 42020 - RNA, 22 nt, Human
caggcugcuguccacaaagcau

SEQ ID NO: 42021 - RNA, 22 nt, Human
caggcuggacauuagauacaua

SEQ ID NO: 42022 - RNA, 22 nt, Human
caggcuggagugcagugucgcc

SEQ ID NO: 42023 - RNA, 22 nt, Human
caggcugggacugaccccugcu

SEQ ID NO: 42024 - RNA, 22 nt, Human
caggcugugaaacugagaugcg

SEQ ID NO: 42025 - RNA, 22 nt, Human
caggcugugggagucaggaccc

SEQ ID NO: 42026 - RNA, 22 nt, Human
caggcuuccgccagguuuccag

SEQ ID NO: 42027 - RNA, 22 nt, Human
caggcuugaagcuucagaguau

SEQ ID NO: 42028 - RNA, 21 nt, Human
caggcuugacccuagugggaa

SEQ ID NO: 42029 - RNA, 22 nt, Human
caggcuugagggcaggcccagu

SEQ ID NO: 42030 - RNA, 22 nt, Human
acauuuugaaagggaaauuguu

SEQ ID NO: 42031 - RNA, 22 nt, Human
acauuuuuggguugaugucuga

SEQ ID NO: 42032 - RNA, 21 nt, Human
accaaaaccuauacuuucugu

SEQ ID NO: 42033 - RNA, 22 nt, Human
accaaaaccugcuacuaaagga

SEQ ID NO: 42034 - RNA, 22 nt, Human
accaaacaaaauugugcacugu

SEQ ID NO: 42035 - RNA, 22 nt, Human
accagagauggggcuucucugu

SEQ ID NO: 42036 - RNA, 22 nt, Human
accagagcuggcucugagcacc

SEQ ID NO: 42037 - RNA, 22 nt, Human
accagagcuuacaugcuagaaa

SEQ ID NO: 42038 - RNA, 20 nt, Human
accagaggaaagagcaguga

SEQ ID NO: 42039 - RNA, 22 nt, Human
accagaguaauguguggaaauu

SEQ ID NO: 42040 - RNA, 22 nt, Human
accagcagccuagagcguucuu

SEQ ID NO: 42041 - RNA, 22 nt, Human
accagcaggccaggggcacugc

SEQ ID NO: 42042 - RNA, 22 nt, Human
accagcagguggcaguauguau

SEQ ID NO: 42043 - RNA, 22 nt, Human
accagcaucaccuggaggccug

SEQ ID NO: 42044 - RNA, 22 nt, Human
accagcucagagcaggcuccug

SEQ ID NO: 42045 - RNA, 22 nt, Human
accagcugaguucucggauggu

SEQ ID NO: 42046 - RNA, 22 nt, Human
accagcugcugauugcuaaaug

SEQ ID NO: 42047 - RNA, 22 nt, Human
accagcuguuaucuguaguauc

SEQ ID NO: 42048 - RNA, 22 nt, Human
accaggaacaagccauggagga

SEQ ID NO: 42049 - RNA, 18 nt, Human
accaggaagcuucuuguc

SEQ ID NO: 42050 - RNA, 22 nt, Human
accaggaagugugggccaacgu

SEQ ID NO: 42051 - RNA, 22 nt, Human
accaggaauauuuugcucauuu

SEQ ID NO: 42052 - RNA, 22 nt, Human
accaggacuucauuagguucuu

SEQ ID NO: 42053 - RNA, 19 nt, Human
accaggagacagugagcuu

SEQ ID NO: 42054 - RNA, 22 nt, Human
accaggagacaugaccaaugag

SEQ ID NO: 42055 - RNA, 22 nt, Human
accaggagagauuuuauugaga

SEQ ID NO: 42056 - RNA, 22 nt, Human
accaggaguaacagugaguggu

SEQ ID NO: 42057 - RNA, 22 nt, Human
accaggaguugggggugggacc

SEQ ID NO: 42058 - RNA, 22 nt, Human
accaggaguuuugaccaggggc

SEQ ID NO: 42059 - RNA, 22 nt, Human
accaggcaaaaccacaggagca

SEQ ID NO: 42060 - RNA, 22 nt, Human
accaggcacucuuguggcagug

SEQ ID NO: 42061 - RNA, 22 nt, Human
accaggcagcaccaaagccggu

SEQ ID NO: 42062 - RNA, 21 nt, Human
accaggccaggaggcuggcac

SEQ ID NO: 42063 - RNA, 22 nt, Human
accaggcugugaagugagacua

SEQ ID NO: 42064 - RNA, 22 nt, Human
accaggcuguugggcccagugu

SEQ ID NO: 42065 - RNA, 22 nt, Human
accaggcuuaauccuuugcuau

SEQ ID NO: 42066 - RNA, 22 nt, Human
accagggcugacaaucugaugg

SEQ ID NO: 42067 - RNA, 22 nt, Human
accagguggccccagcgugguu

SEQ ID NO: 42068 - RNA, 22 nt, Human
accaguaggaguuggagaggaa

SEQ ID NO: 42069 - RNA, 22 nt, Human
accaguaugugccuucaguguc

SEQ ID NO: 42070 - RNA, 21 nt, Human
accagucccuagucuuauccu

SEQ ID NO: 42071 - RNA, 22 nt, Human
accagucuuguugccaugucug

SEQ ID NO: 42072 - RNA, 22 nt, Human
accagugaguauuuguaacaga

SEQ ID NO: 42073 - RNA, 22 nt, Human
accaguuaaagaauaugaggcc

SEQ ID NO: 42074 - RNA, 21 nt, Human
accaguuuggggggcuuccug

SEQ ID NO: 42075 - RNA, 20 nt, Human
accauaauguuaauuacaaa

SEQ ID NO: 42076 - RNA, 22 nt, Human
accauauaacaaguuuaggaga

SEQ ID NO: 42077 - RNA, 22 nt, Human
accaucagagcacaguccgugc

SEQ ID NO: 42078 - RNA, 22 nt, Human
accaucagucacauguagagaa

SEQ ID NO: 42079 - RNA, 22 nt, Human
accauccugaaaccuucaugcu

SEQ ID NO: 42080 - RNA, 22 nt, Human
accauccuuuaguuugcguuuc

SEQ ID NO: 42081 - RNA, 22 nt, Human
accaucuuagcagacugcagug

SEQ ID NO: 42082 - RNA, 21 nt, Human
accaucuuccaugcauuauau

SEQ ID NO: 42083 - RNA, 22 nt, Human
accaucuuuuccucugccuccu

SEQ ID NO: 42084 - RNA, 22 nt, Human
accaugaguuauuugacaggcc

SEQ ID NO: 42085 - RNA, 22 nt, Human
accaugaucugcucugguguuu

SEQ ID NO: 42086 - RNA, 22 nt, Human
accaugcaucaguuaaaaggag

SEQ ID NO: 42087 - RNA, 22 nt, Human
accaugggucagccaccucagc

SEQ ID NO: 42088 - RNA, 22 nt, Human
accaugucauuuauuggccaaa

SEQ ID NO: 42089 - RNA, 22 nt, Human
accauguguuuuacacauggua

SEQ ID NO: 42090 - RNA, 21 nt, Human
accauuaacacccagguuucu

SEQ ID NO: 42091 - RNA, 22 nt, Human
accauucugucucuuuacaaau

SEQ ID NO: 42092 - RNA, 22 nt, Human
accauucuuuacaucagcacag

SEQ ID NO: 42093 - RNA, 22 nt, Human
accauugccuagaaaaauuccu

SEQ ID NO: 42094 - RNA, 22 nt, Human
accauuuacucccauuggaagu

SEQ ID NO: 42095 - RNA, 22 nt, Human
accauuugacucucuaaggaua

SEQ ID NO: 42096 - RNA, 22 nt, Human
accauuuuggguauuuucagag

SEQ ID NO: 42097 - RNA, 22 nt, Human
acccacaccuccguauaucacu

SEQ ID NO: 42098 - RNA, 22 nt, Human
acccacgaagaugagcggcaug

SEQ ID NO: 42099 - RNA, 22 nt, Human
acccacugucaucucugaccac

SEQ ID NO: 42100 - RNA, 22 nt, Human
acccagaggugucuagcaagcu

SEQ ID NO: 42101 - RNA, 22 nt, Human
acccagccacagcauugaggga

SEQ ID NO: 42102 - RNA, 22 nt, Human
acccagcuggaugcauggaggc

SEQ ID NO: 42103 - RNA, 22 nt, Human
acccaggacaaaauaaccaggu

SEQ ID NO: 42104 - RNA, 22 nt, Human
acccaggacucucuuccaguag

SEQ ID NO: 42105 - RNA, 22 nt, Human
acccaggagagagcuauaaaau

SEQ ID NO: 42106 - RNA, 22 nt, Human
acccaggaggcaagguugcagu

SEQ ID NO: 42107 - RNA, 22 nt, Human
acccaggccauuggcaagaguc

SEQ ID NO: 42108 - RNA, 22 nt, Human
acccaggccugagagacaggag

SEQ ID NO: 42109 - RNA, 22 nt, Human
acccaggcuagagugcaguggu

SEQ ID NO: 42110 - RNA, 18 nt, Human
acccaggcucaugguccu

SEQ ID NO: 42111 - RNA, 22 nt, Human
acccaggcuggagugcaguagc

SEQ ID NO: 42112 - RNA, 22 nt, Human
acccagggaccccgcugacgcc

SEQ ID NO: 42113 - RNA, 22 nt, Human
acccaggggcagccuugcugug

SEQ ID NO: 42114 - RNA, 22 nt, Human
acccaggucucucgacuucugg

SEQ ID NO: 42115 - RNA, 23 nt, Human
acccaguuagagcccuuuaggaa

SEQ ID NO: 42116 - RNA, 22 nt, Human
acccaguuccuaagcauccaug

SEQ ID NO: 42117 - RNA, 18 nt, Human
acccaguuugaaggaaag

SEQ ID NO: 42118 - RNA, 22 nt, Human
acccaugugcucuuuuguaccc

SEQ ID NO: 42119 - RNA, 22 nt, Human
acccauuccuuuacuucaucug

SEQ ID NO: 42120 - RNA, 19 nt, Human
acccauuuucaguauuggc

SEQ ID NO: 42121 - RNA, 22 nt, Human
acccauuuuuaaauauaacuug

SEQ ID NO: 42122 - RNA, 22 nt, Human
accccaaaagaguaauagaauu

SEQ ID NO: 42123 - RNA, 22 nt, Human
accccagcgcauauggucugcg

SEQ ID NO: 42124 - RNA, 23 nt, Human
accccaggcaucgcauuccucuu

SEQ ID NO: 42125 - RNA, 22 nt, Human
accccaggucuccaggcucugg

SEQ ID NO: 42126 - RNA, 22 nt, Human
acccccaaacaucaagggcuga

SEQ ID NO: 42127 - RNA, 22 nt, Human
acccccacggaaggccguacgc

SEQ ID NO: 42128 - RNA, 22 nt, Human
acccgcccucagccuuaccgug

SEQ ID NO: 42129 - RNA, 22 nt, Human
acccgugguuuuauacuacuuc

SEQ ID NO: 42130 - RNA, 16 nt, Human
acccucagaaacugcu

SEQ ID NO: 42131 - RNA, 22 nt, Human
acccucagaguaggcacugcug

SEQ ID NO: 42132 - RNA, 22 nt, Human
acccucagcuggagauugaauu

SEQ ID NO: 42133 - RNA, 22 nt, Human
acccucaugaagcuggccugga

SEQ ID NO: 42134 - RNA, 22 nt, Human
acccuccacuuuaucugucuuu

SEQ ID NO: 42135 - RNA, 22 nt, Human
acccuccaggcugcagcuccug

SEQ ID NO: 42136 - RNA, 19 nt, Human
acccucuccccacuggguc

SEQ ID NO: 42137 - RNA, 19 nt, Human
acccucucuguagaaagau

SEQ ID NO: 42138 - RNA, 22 nt, Human
acccucugcaucagcuucuuua

SEQ ID NO: 42139 - RNA, 22 nt, Human
acccagggccacagcccgcagu

SEQ ID NO: 42140 - RNA, 22 nt, Human
acccaggggcgaagcuggccac

SEQ ID NO: 42141 - RNA, 22 nt, Human
acccagggucaccccguagggu

SEQ ID NO: 42142 - RNA, 22 nt, Human
acccaggguuccugggucccag

SEQ ID NO: 42143 - RNA, 22 nt, Human
acccaggguuugagcucugcag

SEQ ID NO: 42144 - RNA, 22 nt, Human
acccagguggcucugacggggg

SEQ ID NO: 42145 - RNA, 22 nt, Human
acccagugacauccuuuaccug

SEQ ID NO: 42146 - RNA, 22 nt, Human
acccaugaguguaucuuuaaaa

SEQ ID NO: 42147 - RNA, 22 nt, Human
acccaugggccaguuggggugg

SEQ ID NO: 42148 - RNA, 22 nt, Human
accccagggcugccagccuccu

SEQ ID NO: 42149 - RNA, 22 nt, Human
accccaggucaucugagagucc

SEQ ID NO: 42150 - RNA, 22 nt, Human
acccccaaacaugaucauggug

SEQ ID NO: 42151 - RNA, 21 nt, Human
acccccacaccuccuuaguuc

SEQ ID NO: 42152 - RNA, 22 nt, Human
accccucagcucuucgugcccc

SEQ ID NO: 42153 - RNA, 22 nt, Human
accccuuuuauagaagaacaga

SEQ ID NO: 42154 - RNA, 22 nt, Human
acaggccugacacacagagggc

SEQ ID NO: 42155 - RNA, 22 nt, Human
acaggccugauguuauccuauu

SEQ ID NO: 42156 - RNA, 22 nt, Human
acaggccuuaggagagaugggg

SEQ ID NO: 42157 - RNA, 21 nt, Human
acaggccuuaggggccauuca

SEQ ID NO: 42158 - RNA, 20 nt, Human
acaggcgcuggggagauggc

SEQ ID NO: 42159 - RNA, 22 nt, Human
acaggcucucagccaguuggca

SEQ ID NO: 42160 - RNA, 21 nt, Human
acaggcucuggggaugcuggg

SEQ ID NO: 42161 - RNA, 22 nt, Human
acaggcugccacuugcauccaa

SEQ ID NO: 42162 - RNA, 22 nt, Human
acaggcugcccgcuccccaccu

SEQ ID NO: 42163 - RNA, 22 nt, Human
acaggcugcugagccauuugcu

SEQ ID NO: 42164 - RNA, 22 nt, Human
acaggcugcugggcuccgugcu

SEQ ID NO: 42165 - RNA, 22 nt, Human
acaggcuggaggaggaccaaga

SEQ ID NO: 42166 - RNA, 22 nt, Human
acaggcugguuuguaaaagaug

SEQ ID NO: 42167 - RNA, 18 nt, Human
acaggcugugggaauggu

SEQ ID NO: 42168 - RNA, 22 nt, Human
acaggcuucucacagaaaaggg

SEQ ID NO: 42169 - RNA, 22 nt, Human
acaggcuugcacuaggguggca

SEQ ID NO: 42170 - RNA, 21 nt, Human
acaggcuuuagaaaaugacuc

SEQ ID NO: 42171 - RNA, 20 nt, Human
acaggcuuuggagucugaau

SEQ ID NO: 42172 - RNA, 23 nt, Human
acagggaaaagucaucaguguga

SEQ ID NO: 42173 - RNA, 22 nt, Human
acagggaaggcauccgcgaaug

SEQ ID NO: 42174 - RNA, 22 nt, Human
acagggaauggagggaucagua

SEQ ID NO: 42175 - RNA, 22 nt, Human
acagggaccugugagcuccaua

SEQ ID NO: 42176 - RNA, 22 nt, Human
acagggaccuuggaagcuggaa

SEQ ID NO: 42177 - RNA, 22 nt, Human
acagggagccccagcauuucca

SEQ ID NO: 42178 - RNA, 18 nt, Human
acagggagggcgcugggg

SEQ ID NO: 42179 - RNA, 22 nt, Human
acagggagugcaauucauauug

SEQ ID NO: 42180 - RNA, 22 nt, Human
acagggcaaccucugggagacu

SEQ ID NO: 42181 - RNA, 22 nt, Human
acagggcaccugagguaggaag

SEQ ID NO: 42182 - RNA, 22 nt, Human
acagggcagaaauguugcaucu

SEQ ID NO: 42183 - RNA, 22 nt, Human
acagggcagcaacuuugugccu

SEQ ID NO: 42184 - RNA, 22 nt, Human
acagggcagugucuugaaaaau

SEQ ID NO: 42185 - RNA, 22 nt, Human
acagggcaugugcaagagacau

SEQ ID NO: 42186 - RNA, 22 nt, Human
acagggcauuuccucuaugugu

SEQ ID NO: 42187 - RNA, 22 nt, Human
acagggccaauguuagcauuga

SEQ ID NO: 42188 - RNA, 22 nt, Human
acagggcccuugccagcacaag

SEQ ID NO: 42189 - RNA, 22 nt, Human
acagggccuuugauggauuaua

SEQ ID NO: 42190 - RNA, 22 nt, Human
acagggcuuaguggaaauuuuu

SEQ ID NO: 42191 - RNA, 22 nt, Human
acagggcuugugacaacuuuaa

SEQ ID NO: 42192 - RNA, 22 nt, Human
acagggcuuuuaaucaguaguu

SEQ ID NO: 42193 - RNA, 22 nt, Human
acaggggaauuuacugucauua

SEQ ID NO: 42194 - RNA, 19 nt, Human
acaggggcuagcggaagca

SEQ ID NO: 42195 - RNA, 22 nt, Human
acaggggcuccgaaggugaggg

SEQ ID NO: 42196 - RNA, 22 nt, Human
acagggucaagggugcuacaag

SEQ ID NO: 42197 - RNA, 22 nt, Human
acagggucuuagagaucaccug

SEQ ID NO: 42198 - RNA, 22 nt, Human
acaggguggggauggugagcuu

SEQ ID NO: 42199 - RNA, 23 nt, Human
acagguacacuugauugcaaucc

SEQ ID NO: 42200 - RNA, 22 nt, Human
acagguacauacuugggaucca

SEQ ID NO: 42201 - RNA, 22 nt, Human
acagguagcauuuuuccucuuu

SEQ ID NO: 42202 - RNA, 22 nt, Human
acagguagguuaaaauguguca

SEQ ID NO: 42203 - RNA, 22 nt, Human
acagguagucugaacacugggu

SEQ ID NO: 42204 - RNA, 22 nt, Human
acagguagugggcuagaucugg

SEQ ID NO: 42205 - RNA, 22 nt, Human
acaggucuacuggcaagcagug

SEQ ID NO: 42206 - RNA, 22 nt, Human
acaggugacuugcauuuucaca

SEQ ID NO: 42207 - RNA, 22 nt, Human
acagguggaaacaugguguugg

SEQ ID NO: 42208 - RNA, 22 nt, Human
acagguggcagaagcauuuacu

SEQ ID NO: 42209 - RNA, 22 nt, Human
acagguggccccgagggagugg

SEQ ID NO: 42210 - RNA, 22 nt, Human
acagguguagcaggagcaucaa

SEQ ID NO: 42211 - RNA, 22 nt, Human
acagguguaugaauauguucca

SEQ ID NO: 42212 - RNA, 22 nt, Human
acagguguggggcugugguacu

SEQ ID NO: 42213 - RNA, 22 nt, Human
acagguuugucugauguaauga

SEQ ID NO: 42214 - RNA, 22 nt, Human
acagguuuuuggauaauccuuu

SEQ ID NO: 42215 - RNA, 22 nt, Human
acaguaaaauuaagggcaguua

SEQ ID NO: 42216 - RNA, 16 nt, Human
acaguaaagcuggaca

SEQ ID NO: 42217 - RNA, 22 nt, Human
acaguaaauaaugcauguugau

SEQ ID NO: 42218 - RNA, 22 nt, Human
acaguaaauauuaagccugagu

SEQ ID NO: 42219 - RNA, 22 nt, Human
acaguaacagucuauuucucag

SEQ ID NO: 42220 - RNA, 22 nt, Human
acaguaaggguaaauaagaaca

SEQ ID NO: 42221 - RNA, 22 nt, Human
acaguaaucauaugauuuucuc

SEQ ID NO: 42222 - RNA, 22 nt, Human
acaguaauuaaggucugaaacg

SEQ ID NO: 42223 - RNA, 22 nt, Human
acaguaauuguguacgaggaca

SEQ ID NO: 42224 - RNA, 22 nt, Human
acaguacaggacgaguuuuccu

SEQ ID NO: 42225 - RNA, 22 nt, Human
acaguacagugcagaggaagau

SEQ ID NO: 42226 - RNA, 22 nt, Human
acaguagcuaauauugcauuau

SEQ ID NO: 42227 - RNA, 22 nt, Human
acaguagugccaugaccuacag

SEQ ID NO: 42228 - RNA, 22 nt, Human
acaguauaaacuccuaaaagcc

SEQ ID NO: 42229 - RNA, 22 nt, Human
acaguauaccauugugacuuug

SEQ ID NO: 42230 - RNA, 22 nt, Human
acaguauauaugguuaucugau

SEQ ID NO: 42231 - RNA, 21 nt, Human
acaguauauuagauauuugaa

SEQ ID NO: 42232 - RNA, 22 nt, Human
acaguauuugcgauacugauga

SEQ ID NO: 42233 - RNA, 22 nt, Human
acagucaaaugucuaucuucuu

SEQ ID NO: 42234 - RNA, 22 nt, Human
acaguccuguacaggccauauc

SEQ ID NO: 42235 - RNA, 20 nt, Human
acagucgccuaucaaccagg

SEQ ID NO: 42236 - RNA, 22 nt, Human
acagucuaggugugugauuuaa

SEQ ID NO: 42237 - RNA, 22 nt, Human
acagucucuccacacugcaggg

SEQ ID NO: 42238 - RNA, 22 nt, Human
acagucucuguugcugcuguuu

SEQ ID NO: 42239 - RNA, 22 nt, Human
acagucugcagggugaacaugu

SEQ ID NO: 42240 - RNA, 22 nt, Human
acagucugcauaugaccuguag

SEQ ID NO: 42241 - RNA, 17 nt, Human
acagucugccugacagu

SEQ ID NO: 42242 - RNA, 22 nt, Human
acagucugcuugucuccauggu

SEQ ID NO: 42243 - RNA, 22 nt, Human
acagucuuaugcauacacuauu

SEQ ID NO: 42244 - RNA, 22 nt, Human
acagucuugcuguauggucagg

SEQ ID NO: 42245 - RNA, 22 nt, Human
acagucuuuagaguauuguccu

SEQ ID NO: 42246 - RNA, 22 nt, Human
acagucuuugcaggagaaagga

SEQ ID NO: 42247 - RNA, 22 nt, Human
acagugagcccacuccaggaga

SEQ ID NO: 42248 - RNA, 22 nt, Human
acauugauugagcacccauuau

SEQ ID NO: 42249 - RNA, 22 nt, Human
acauugcagauguguuuaaugu

SEQ ID NO: 42250 - RNA, 19 nt, Human
acauuggacauggaucuug

SEQ ID NO: 42251 - RNA, 22 nt, Human
acauuguuugagaauacagaug

SEQ ID NO: 42252 - RNA, 22 nt, Human
acauuguuuggaggagugagag

SEQ ID NO: 42253 - RNA, 22 nt, Human
acauuuaaauaugccuuauauu

SEQ ID NO: 42254 - RNA, 22 nt, Human
acauuuaaccaaacuguuuaau

SEQ ID NO: 42255 - RNA, 22 nt, Human
acauuuaaguuaaaaccucagu

SEQ ID NO: 42256 - RNA, 22 nt, Human
acauuuaaugauccuacuguga

SEQ ID NO: 42257 - RNA, 22 nt, Human
acauuuacuuaucaaaagucag

SEQ ID NO: 42258 - RNA, 19 nt, Human
acauuuagaauguacuugc

SEQ ID NO: 42259 - RNA, 22 nt, Human
acauuuagcuguacaaucuaug

SEQ ID NO: 42260 - RNA, 22 nt, Human
acauuuauauuuaguggggaau

SEQ ID NO: 42261 - RNA, 22 nt, Human
acauuucaguaaguguuaauuu

SEQ ID NO: 42262 - RNA, 22 nt, Human
acauuucuaauuuaauguaaca

SEQ ID NO: 42263 - RNA, 18 nt, Human
acauuucuaugcuucugg

SEQ ID NO: 42264 - RNA, 22 nt, Human
acauuucucauaggagagccac

SEQ ID NO: 42265 - RNA, 22 nt, Human
acauuucuccuugcaggaguca

SEQ ID NO: 42266 - RNA, 22 nt, Human
acauuucugcauguaggguaau

SEQ ID NO: 42267 - RNA, 22 nt, Human
acauuucuggaguuucucaaca

SEQ ID NO: 42268 - RNA, 22 nt, Human
acauuucuuagccuaguuccag

SEQ ID NO: 42269 - RNA, 22 nt, Human
acauuucuuuucaucucuauau

SEQ ID NO: 42270 - RNA, 22 nt, Human
acauuugacauuuaguaucagc

SEQ ID NO: 42271 - RNA, 22 nt, Human
acauuugauuccauccucuacu

SEQ ID NO: 42272 - RNA, 22 nt, Human
acauuuguaugcguuuuuacug

SEQ ID NO: 42273 - RNA, 22 nt, Human
acauuugugggggaacaggaua

SEQ ID NO: 42274 - RNA, 22 nt, Human
acauuuguugccauucauggag

SEQ ID NO: 42275 - RNA, 22 nt, Human
acauuuuacaccaagacuucuu

SEQ ID NO: 42276 - RNA, 22 nt, Human
acauuuuacaguugucuggcua

SEQ ID NO: 42277 - RNA, 20 nt, Human
acauuuuggcauacucucaa

SEQ ID NO: 42278 - RNA, 22 nt, Human
acauuuuuauccugagugccag

SEQ ID NO: 42279 - RNA, 22 nt, Human
acauuuuucuaggaggcaaggu

SEQ ID NO: 42280 - RNA, 22 nt, Human
accaaaaagauauguugaagcc

SEQ ID NO: 42281 - RNA, 22 nt, Human
accaagaguccaagugagguug

SEQ ID NO: 42282 - RNA, 22 nt, Human
accaagcacaaagaugaguaaa

SEQ ID NO: 42283 - RNA, 22 nt, Human
accaagcuucguggaggaaguu

SEQ ID NO: 42284 - RNA, 22 nt, Human
accaaggaagaaucuauuugag

SEQ ID NO: 42285 - RNA, 22 nt, Human
accaaggaguuugguauuuuag

SEQ ID NO: 42286 - RNA, 22 nt, Human
accaauauaaguauagguaagu

SEQ ID NO: 42287 - RNA, 22 nt, Human
acuguggauaagucagagaugu

SEQ ID NO: 42288 - RNA, 22 nt, Human
acuguggcacuaggcaccuuac

SEQ ID NO: 42289 - RNA, 22 nt, Human
acuguggccugcuguaugggcu

SEQ ID NO: 42290 - RNA, 22 nt, Human
acuguggcuaauucauuugguc

SEQ ID NO: 42291 - RNA, 18 nt, Human
acuguggcucagaguugc

SEQ ID NO: 42292 - RNA, 22 nt, Human
acuguggcucagggaaugcaug

SEQ ID NO: 42293 - RNA, 22 nt, Human
acugugggaaccacugaaucag

SEQ ID NO: 42294 - RNA, 22 nt, Human
acugugggacaucccucccuau

SEQ ID NO: 42295 - RNA, 22 nt, Human
acugugggagcgcaguggcagc

SEQ ID NO: 42296 - RNA, 23 nt, Human
acugugggcaccacagagagugu

SEQ ID NO: 42297 - RNA, 22 nt, Human
acugugggcagcuucugggaac

SEQ ID NO: 42298 - RNA, 22 nt, Human
acuguggggugaggcccaagaa

SEQ ID NO: 42299 - RNA, 22 nt, Human
acugugucuagcaccacguguc

SEQ ID NO: 42300 - RNA, 22 nt, Human
acugugugaaacaucaaugugu

SEQ ID NO: 42301 - RNA, 22 nt, Human
acugugugcccugacgccaggg

SEQ ID NO: 42302 - RNA, 22 nt, Human
acugugugcuggacaugauguu

SEQ ID NO: 42303 - RNA, 22 nt, Human
acuguguuaaauacagagaugg

SEQ ID NO: 42304 - RNA, 22 nt, Human
acuguuaaaguaauuaauuguc

SEQ ID NO: 42305 - RNA, 22 nt, Human
acuguuaagaaggaggauggaa

SEQ ID NO: 42306 - RNA, 22 nt, Human
acuguuaauucaaucaacaggu

SEQ ID NO: 42307 - RNA, 22 nt, Human
acuguuacagagcaggaaauug

SEQ ID NO: 42308 - RNA, 22 nt, Human
acuguuacagggcacugaacau

SEQ ID NO: 42309 - RNA, 22 nt, Human
acuguuauuuguaauccauuau

SEQ ID NO: 42310 - RNA, 20 nt, Human
acuguucaagggccuggugg

SEQ ID NO: 42311 - RNA, 22 nt, Human
acuguucaucucuuagaaagua

SEQ ID NO: 42312 - RNA, 19 nt, Human
acuguucuaacuugcagcu

SEQ ID NO: 42313 - RNA, 22 nt, Human
acuguucugccaacuuugguua

SEQ ID NO: 42314 - RNA, 22 nt, Human
acuguucugccaagaucaacgu

SEQ ID NO: 42315 - RNA, 22 nt, Human
acuguucuucauuuagcaaaga

SEQ ID NO: 42316 - RNA, 22 nt, Human
acuguucuucccauuuauauug

SEQ ID NO: 42317 - RNA, 22 nt, Human
acuguucuuguaacacuuaaau

SEQ ID NO: 42318 - RNA, 22 nt, Human
acuguuggcuucugguagugac

SEQ ID NO: 42319 - RNA, 22 nt, Human
acuguuugcugauagauauuua

SEQ ID NO: 42320 - RNA, 22 nt, Human
acuuaaagguuagcuauucuac

SEQ ID NO: 42321 - RNA, 22 nt, Human
acuuaaaguaguuuuacugugg

SEQ ID NO: 42322 - RNA, 23 nt, Human
acuuaaaugguucuuuaucucag

SEQ ID NO: 42323 - RNA, 22 nt, Human
acuuaacagacauuauuuaccu

SEQ ID NO: 42324 - RNA, 22 nt, Human
acuuaaugguuccuaaaaugug

SEQ ID NO: 42325 - RNA, 22 nt, Human
acuuagaaauucaguuuuguca

SEQ ID NO: 42326 - RNA, 22 nt, Human
acuuagaauuaguguagaauga

SEQ ID NO: 42327 - RNA, 22 nt, Human
acuuagauuuccuuacugggug

SEQ ID NO: 42328 - RNA, 22 nt, Human
acuuagcagagugaguugacua

SEQ ID NO: 42329 - RNA, 22 nt, Human
acuuagcaguuuagaauauguc

SEQ ID NO: 42330 - RNA, 22 nt, Human
acuuaguauuuuucagcuuuga

SEQ ID NO: 42331 - RNA, 22 nt, Human
acuuagugcccuggcccuuaca

SEQ ID NO: 42332 - RNA, 22 nt, Human
acuuauaggccaaguagacugu

SEQ ID NO: 42333 - RNA, 22 nt, Human
acuuaugaaugucauuauaaug

SEQ ID NO: 42334 - RNA, 22 nt, Human
acuuaugaggagaaaauauaua

SEQ ID NO: 42335 - RNA, 22 nt, Human
acuuauuagcugugugaccuug

SEQ ID NO: 42336 - RNA, 22 nt, Human
acuuauucugagauuaugauca

SEQ ID NO: 42337 - RNA, 22 nt, Human
acuuauuucauggaucauaaug

SEQ ID NO: 42338 - RNA, 22 nt, Human
acuucacaacuguacauggcag

SEQ ID NO: 42339 - RNA, 22 nt, Human
acuucacauuagcuaaaaggga

SEQ ID NO: 42340 - RNA, 22 nt, Human
acuucagagacuuuauggucca

SEQ ID NO: 42341 - RNA, 22 nt, Human
acuucaguaggugauaugugca

SEQ ID NO: 42342 - RNA, 22 nt, Human
acuucauauggacagcaaacua

SEQ ID NO: 42343 - RNA, 22 nt, Human
acuucauguacuguucaaggcc

SEQ ID NO: 42344 - RNA, 22 nt, Human
acuucauguaguccaucagguu

SEQ ID NO: 42345 - RNA, 22 nt, Human
acuucauucauuuucacgaaug

SEQ ID NO: 42346 - RNA, 22 nt, Human
acuuccaaaacacagcauggca

SEQ ID NO: 42347 - RNA, 22 nt, Human
acuuccagaggguguggaaaua

SEQ ID NO: 42348 - RNA, 22 nt, Human
acuuccaggguagaggggaaga

SEQ ID NO: 42349 - RNA, 22 nt, Human
acuucccaacacuuuugagaug

SEQ ID NO: 42350 - RNA, 22 nt, Human
acuuccugaauggggcuaauua

SEQ ID NO: 42351 - RNA, 22 nt, Human
acuuccuuuugggaaacuguuu

SEQ ID NO: 42352 - RNA, 22 nt, Human
acuucuaugcacagagcuugga

SEQ ID NO: 42353 - RNA, 18 nt, Human
acuucucauuucucugca

SEQ ID NO: 42354 - RNA, 22 nt, Human
acuucucugcuaccugcaaaga

SEQ ID NO: 42355 - RNA, 22 nt, Human
acuucucuuuaguacuaaaugu

SEQ ID NO: 42356 - RNA, 19 nt, Human
acuucugaggaacugcaca

SEQ ID NO: 42357 - RNA, 19 nt, Human
acugggaaaaaggcacugg

SEQ ID NO: 42358 - RNA, 22 nt, Human
acugggaaccugugcuaggagg

SEQ ID NO: 42359 - RNA, 22 nt, Human
acugggaagacuggaauugcuc

SEQ ID NO: 42360 - RNA, 22 nt, Human
acugggaagcuguuuugcuuuu

SEQ ID NO: 42361 - RNA, 22 nt, Human
acugggaaggaaaggaauguaa

SEQ ID NO: 42362 - RNA, 22 nt, Human
acugggaaggagcaggaucugu

SEQ ID NO: 42363 - RNA, 21 nt, Human
acugggagaacgagccuuucc

SEQ ID NO: 42364 - RNA, 22 nt, Human
acugggaggcaaagagcaagga

SEQ ID NO: 42365 - RNA, 22 nt, Human
acugggaguucuccaugucccu

SEQ ID NO: 42366 - RNA, 20 nt, Human
acugggcauaccuguccugu

SEQ ID NO: 42367 - RNA, 22 nt, Human
acugggcaugaugagucaccua

SEQ ID NO: 42368 - RNA, 22 nt, Human
acugggccagaucagagcaacu

SEQ ID NO: 42369 - RNA, 22 nt, Human
acugggccgcgcugcagagggc

SEQ ID NO: 42370 - RNA, 22 nt, Human
acugggccggugcagaguaguu

SEQ ID NO: 42371 - RNA, 22 nt, Human
acugggccuacccagauuggca

SEQ ID NO: 42372 - RNA, 22 nt, Human
acugggccugauugggucggag

SEQ ID NO: 42373 - RNA, 22 nt, Human
acugggccuggauuggcguguc

SEQ ID NO: 42374 - RNA, 22 nt, Human
acugggcuaccccaccauuacc

SEQ ID NO: 42375 - RNA, 22 nt, Human
acugggcuagaguggaagcugg

SEQ ID NO: 42376 - RNA, 21 nt, Human
acugggcuagccugacuucug

SEQ ID NO: 42377 - RNA, 22 nt, Human
acugggcucccaggcuugucau

SEQ ID NO: 42378 - RNA, 22 nt, Human
acugggcuggggcucauucucc

SEQ ID NO: 42379 - RNA, 22 nt, Human
acugggcuguggacacccagcg

SEQ ID NO: 42380 - RNA, 22 nt, Human
acugggcuguuccuuauuucua

SEQ ID NO: 42381 - RNA, 23 nt, Human
acugggcuuaugaggaggcuugu

SEQ ID NO: 42382 - RNA, 22 nt, Human
acuggggaguugaagcacuuuc

SEQ ID NO: 42383 - RNA, 22 nt, Human
acuggggccuccuccaugcucu

SEQ ID NO: 42384 - RNA, 22 nt, Human
acuggggugaaauuggaguguc

SEQ ID NO: 42385 - RNA, 22 nt, Human
acugggguuuaggccugggcaa

SEQ ID NO: 42386 - RNA, 23 nt, Human
acugguacagguuuacugguguc

SEQ ID NO: 42387 - RNA, 22 nt, Human
acuggugguuucuccccagaga

SEQ ID NO: 42388 - RNA, 22 nt, Human
acuguaaaacagguuucaucau

SEQ ID NO: 42389 - RNA, 22 nt, Human
acuguaaaagaaggucuuugca

SEQ ID NO: 42390 - RNA, 22 nt, Human
acuguaaaauacauaaguauug

SEQ ID NO: 42391 - RNA, 22 nt, Human
acuguaaauuacauaagaacag

SEQ ID NO: 42392 - RNA, 22 nt, Human
acuguaauaugguucuuuugau

SEQ ID NO: 42393 - RNA, 22 nt, Human
acuguaauauuuuaagaugucu

SEQ ID NO: 42394 - RNA, 22 nt, Human
acuguacaaccucugccccugu

SEQ ID NO: 42395 - RNA, 22 nt, Human
acuguacaacugcugagcagaa

SEQ ID NO: 42396 - RNA, 22 nt, Human
acuguacucuuauagccaucug

SEQ ID NO: 42397 - RNA, 22 nt, Human
acuguacugaaaaguaagcaag

SEQ ID NO: 42398 - RNA, 22 nt, Human
acuguacuuacgcauauacagg

SEQ ID NO: 42399 - RNA, 22 nt, Human
acuguagcugccacuggaugca

SEQ ID NO: 42400 - RNA, 22 nt, Human
acuguauacuucuguauacaau

SEQ ID NO: 42401 - RNA, 22 nt, Human
acuguauagauggaguugauuu

SEQ ID NO: 42402 - RNA, 22 nt, Human
acuuugaaacuaaaauucauua

SEQ ID NO: 42403 - RNA, 22 nt, Human
acuuugauaguuuaaucuagga

SEQ ID NO: 42404 - RNA, 22 nt, Human
acuuugaucuaaguuucuuuga

SEQ ID NO: 42405 - RNA, 22 nt, Human
acuuugcaaaaggaaaucaccu

SEQ ID NO: 42406 - RNA, 22 nt, Human
acuuugcaggccuuuucuugug

SEQ ID NO: 42407 - RNA, 22 nt, Human
acuuugcagggcuugauaucca

SEQ ID NO: 42408 - RNA, 22 nt, Human
acuuugcagguacaugagcauc

SEQ ID NO: 42409 - RNA, 23 nt, Human
acuuugcauacccaaauuguuuu

SEQ ID NO: 42410 - RNA, 19 nt, Human
acuuugcaugugugucuaa

SEQ ID NO: 42411 - RNA, 22 nt, Human
acuuuggacgccaugcuguuug

SEQ ID NO: 42412 - RNA, 22 nt, Human
acuuuggaucugauguaaucag

SEQ ID NO: 42413 - RNA, 21 nt, Human
acuuugggaggugugaggggc

SEQ ID NO: 42414 - RNA, 22 nt, Human
acuuuguaauaacuccugaguu

SEQ ID NO: 42415 - RNA, 22 nt, Human
acuuuguaauaguuuaagguca

SEQ ID NO: 42416 - RNA, 22 nt, Human
acuuuguauaagacaauaaaga

SEQ ID NO: 42417 - RNA, 22 nt, Human
acuuuguuccuuucacaaagaa

SEQ ID NO: 42418 - RNA, 22 nt, Human
acuuuguuuccauauuuguagc

SEQ ID NO: 42419 - RNA, 22 nt, Human
acuuuguuuggcuauuagaguc

SEQ ID NO: 42420 - RNA, 22 nt, Human
acuuuguuuuauagcacauaag

SEQ ID NO: 42421 - RNA, 22 nt, Human
acuuuucaaaugggaaacucag

SEQ ID NO: 42422 - RNA, 22 nt, Human
acuuuucccuugguagaguugc

SEQ ID NO: 42423 - RNA, 22 nt, Human
acuuuugaggacuuuauuguau

SEQ ID NO: 42424 - RNA, 22 nt, Human
acuuuugugcaggucucuccca

SEQ ID NO: 42425 - RNA, 22 nt, Human
acuuuuuuauaaggaagaagau

SEQ ID NO: 42426 - RNA, 21 nt, Human
agaaaaaccagcauguuuuca

SEQ ID NO: 42427 - RNA, 22 nt, Human
agaaaaacuaagaguggguggu

SEQ ID NO: 42428 - RNA, 22 nt, Human
agaaaacuugcucgagccuguu

SEQ ID NO: 42429 - RNA, 23 nt, Human
agaaaagcuuggacacauggccu

SEQ ID NO: 42430 - RNA, 22 nt, Human
agaaaaggauugauggaucaga

SEQ ID NO: 42431 - RNA, 22 nt, Human
agaaaagggcaggagggauaca

SEQ ID NO: 42432 - RNA, 22 nt, Human
agaaaagguugaaaguaggauu

SEQ ID NO: 42433 - RNA, 22 nt, Human
agaaaagugcucuagugagagc

SEQ ID NO: 42434 - RNA, 22 nt, Human
agaaaauaaauugaugguggaa

SEQ ID NO: 42435 - RNA, 22 nt, Human
agaaaauaauuucuuggcuggu

SEQ ID NO: 42436 - RNA, 22 nt, Human
agaaaaugugaacuugugaauu

SEQ ID NO: 42437 - RNA, 20 nt, Human
agaaaauguuuucagcugga

SEQ ID NO: 42438 - RNA, 22 nt, Human
agaaaauuuauucauguuaguu

SEQ ID NO: 42439 - RNA, 22 nt, Human
agaaacagaaccaggugucauu

SEQ ID NO: 42440 - RNA, 22 nt, Human
agaaacaucgcuuaguccucau

SEQ ID NO: 42441 - RNA, 22 nt, Human
agaaacauuuagauuauauguc

SEQ ID NO: 42442 - RNA, 23 nt, Human
agaaaccacugaagagauccagu

SEQ ID NO: 42443 - RNA, 22 nt, Human
agaaaccuccauuuauucacuc

SEQ ID NO: 42444 - RNA, 22 nt, Human
agaaacucauccuggagaugac

SEQ ID NO: 42445 - RNA, 22 nt, Human
agaaacucuaggucaauugagg

SEQ ID NO: 42446 - RNA, 22 nt, Human
agaaacugaauuauuucugagg

SEQ ID NO: 42447 - RNA, 22 nt, Human
agaaacuguguuacuagaaugu

SEQ ID NO: 42448 - RNA, 22 nt, Human
agaaagaacguugguuaucuua

SEQ ID NO: 42449 - RNA, 22 nt, Human
agaaagacaaaaugcaguggcu

SEQ ID NO: 42450 - RNA, 17 nt, Human
agaaagaggauccacag

SEQ ID NO: 42451 - RNA, 22 nt, Human
agaaagauccuucuggcugccu

SEQ ID NO: 42452 - RNA, 22 nt, Human
agaaagcagcauuuaugaucuc

SEQ ID NO: 42453 - RNA, 22 nt, Human
agaaagcccacccagaagaugu

SEQ ID NO: 42454 - RNA, 22 nt, Human
agaaagccucaaucuucaggcc

SEQ ID NO: 42455 - RNA, 22 nt, Human
agaaaggagaccagcucugccc

SEQ ID NO: 42456 - RNA, 22 nt, Human
agaaaggagcaccgugggggau

SEQ ID NO: 42457 - RNA, 22 nt, Human
agaaaggaggaagaaugaccuc

SEQ ID NO: 42458 - RNA, 22 nt, Human
agaaagggucacugaaagagga

SEQ ID NO: 42459 - RNA, 22 nt, Human
agaaaggucacuuagccucagc

SEQ ID NO: 42460 - RNA, 22 nt, Human
agaaagguggaugcucuggaau

SEQ ID NO: 42461 - RNA, 22 nt, Human
agaaagugugucauacuaagug

SEQ ID NO: 42462 - RNA, 22 nt, Human
agaaaguuaucacaaaauugag

SEQ ID NO: 42463 - RNA, 22 nt, Human
agaaaguucacugguauauuuu

SEQ ID NO: 42464 - RNA, 22 nt, Human
agaaaguuguuggaggaaauga

SEQ ID NO: 42465 - RNA, 22 nt, Human
agaaaguuguuuuagccaaacc

SEQ ID NO: 42466 - RNA, 22 nt, Human
acuguuuucuuagcucccugcu

SEQ ID NO: 42467 - RNA, 22 nt, Human
acuuaaaaacagauccagcagg

SEQ ID NO: 42468 - RNA, 22 nt, Human
acuuaaaaccagacagcgucau

SEQ ID NO: 42469 - RNA, 22 nt, Human
acuuaaagaggcuacuuuuggu

SEQ ID NO: 42470 - RNA, 22 nt, Human
acuuaaaguuauaauuugcuaa

SEQ ID NO: 42471 - RNA, 21 nt, Human
acuuaaauuccuugauauuua

SEQ ID NO: 42472 - RNA, 22 nt, Human
acuuacaagcuagggaagcuug

SEQ ID NO: 42473 - RNA, 22 nt, Human
acuuacaaucaaccaccuugga

SEQ ID NO: 42474 - RNA, 22 nt, Human
acuuaccagagaggauccgccc

SEQ ID NO: 42475 - RNA, 22 nt, Human
acuuagauaacaaaccuguggu

SEQ ID NO: 42476 - RNA, 22 nt, Human
acuuagauuccugguaccuccg

SEQ ID NO: 42477 - RNA, 22 nt, Human
acuuagcaaaucuuuuggauuc

SEQ ID NO: 42478 - RNA, 22 nt, Human
acuuagcaccuauggcauuuuu

SEQ ID NO: 42479 - RNA, 22 nt, Human
acuuagcagaguugaauguacu

SEQ ID NO: 42480 - RNA, 22 nt, Human
acuuagcagguggugacucgaa

SEQ ID NO: 42481 - RNA, 22 nt, Human
acuuauguaguaccucuuaugu

SEQ ID NO: 42482 - RNA, 19 nt, Human
acuucaaaucuuagagaaa

SEQ ID NO: 42483 - RNA, 22 nt, Human
acuucaaauuuucagaagaaau

SEQ ID NO: 42484 - RNA, 22 nt, Human
acuucacagaaauuuuaugagg

SEQ ID NO: 42485 - RNA, 22 nt, Human
acuucacuuguaaaugcagccu

SEQ ID NO: 42486 - RNA, 22 nt, Human
acuucauauuguuuccacuaga

SEQ ID NO: 42487 - RNA, 23 nt, Human
acuucauggcacugucuuagagg

SEQ ID NO: 42488 - RNA, 22 nt, Human
acuucauguuguuuacaacuua

SEQ ID NO: 42489 - RNA, 22 nt, Human
acuucauugcuaagaacaaggu

SEQ ID NO: 42490 - RNA, 22 nt, Human
acuucauuguaauauuauagca

SEQ ID NO: 42491 - RNA, 22 nt, Human
acuucauuucauuugcacagug

SEQ ID NO: 42492 - RNA, 22 nt, Human
acuuccaacuucaguccugagc

SEQ ID NO: 42493 - RNA, 22 nt, Human
acuuccagaaaugauuuaauuu

SEQ ID NO: 42494 - RNA, 22 nt, Human
acuuccagaacagguacauuuu

SEQ ID NO: 42495 - RNA, 22 nt, Human
acuuccagaauuagaauuuaag

SEQ ID NO: 42496 - RNA, 22 nt, Human
acuuccagauggccccaucuaa

SEQ ID NO: 42497 - RNA, 22 nt, Human
acuuccagcugcccugugugcu

SEQ ID NO: 42498 - RNA, 22 nt, Human
acuuccaggaggugucacugaa

SEQ ID NO: 42499 - RNA, 16 nt, Human
acuuccaggggagccc

SEQ ID NO: 42500 - RNA, 22 nt, Human
acuucccacugcagugacugag

SEQ ID NO: 42501 - RNA, 22 nt, Human
acuucccaggugguguggaguu

SEQ ID NO: 42502 - RNA, 22 nt, Human
acuuccccgaagcuggaaauag

SEQ ID NO: 42503 - RNA, 22 nt, Human
acuucccugugggcagguagug

SEQ ID NO: 42504 - RNA, 22 nt, Human
acuuccugcaaucguccacucc

SEQ ID NO: 42505 - RNA, 22 nt, Human
acuuccuguaaauagaauucca

SEQ ID NO: 42506 - RNA, 22 nt, Human
acuuccuguguuggucuugcug

SEQ ID NO: 42507 - RNA, 22 nt, Human
acuuccuuuucaaccauacagc

SEQ ID NO: 42508 - RNA, 22 nt, Human
acuucuaagcucaaauugguau

SEQ ID NO: 42509 - RNA, 22 nt, Human
acuucuaaucagaaggucuggu

SEQ ID NO: 42510 - RNA, 22 nt, Human
acuucucuucauagguggcaau

SEQ ID NO: 42511 - RNA, 22 nt, Human
acuucugaagcagagauuuggg

SEQ ID NO: 42512 - RNA, 22 nt, Human
acuucugauuaaggaugaaugc

SEQ ID NO: 42513 - RNA, 22 nt, Human
acuucuggauagagucagcuuu

SEQ ID NO: 42514 - RNA, 22 nt, Human
acuucuguaaagggaagacagu

SEQ ID NO: 42515 - RNA, 22 nt, Human
acuucuucuucagcugggggau

SEQ ID NO: 42516 - RNA, 22 nt, Human
acuucuuucacaauguuucuag

SEQ ID NO: 42517 - RNA, 22 nt, Human
acccagggcagccagcggggag

SEQ ID NO: 42518 - RNA, 22 nt, Human
acccagggcucaagcguaggca

SEQ ID NO: 42519 - RNA, 22 nt, Human
acccagggcuuaaggcggugca

SEQ ID NO: 42520 - RNA, 19 nt, Human
acccagggguuuaugugug

SEQ ID NO: 42521 - RNA, 22 nt, Human
acccaggguagaaccucagagc

SEQ ID NO: 42522 - RNA, 22 nt, Human
acccagucuggagugcagugac

SEQ ID NO: 42523 - RNA, 22 nt, Human
accccaagacaguagaagagaa

SEQ ID NO: 42524 - RNA, 22 nt, Human
accccacagcauacaaaggcac

SEQ ID NO: 42525 - RNA, 22 nt, Human
accccacuccucuguuuuaacu

SEQ ID NO: 42526 - RNA, 20 nt, Human
accccagccccucuaucuga

SEQ ID NO: 42527 - RNA, 22 nt, Human
accccagcucugagccacacca

SEQ ID NO: 42528 - RNA, 22 nt, Human
accccaggaaguggaggucaug

SEQ ID NO: 42529 - RNA, 22 nt, Human
accccaggagcugugccuaguc

SEQ ID NO: 42530 - RNA, 22 nt, Human
accccagguccagguuacagag

SEQ ID NO: 42531 - RNA, 22 nt, Human
acccccaagaggggccuucagc

SEQ ID NO: 42532 - RNA, 22 nt, Human
acccccuucgcacacucuuuca

SEQ ID NO: 42533 - RNA, 22 nt, Human
accccucaucaguugcuuccua

SEQ ID NO: 42534 - RNA, 22 nt, Human
accccuucuccuggcuguucca

SEQ ID NO: 42535 - RNA, 22 nt, Human
accccuuggaguccgcgcccag

SEQ ID NO: 42536 - RNA, 22 nt, Human
acccgggaggcaggagucauag

SEQ ID NO: 42537 - RNA, 22 nt, Human
acccucaagauggaagcaguuu

SEQ ID NO: 42538 - RNA, 17 nt, Human
acccucaaucuccugca

SEQ ID NO: 42539 - RNA, 22 nt, Human
acccucagacagcuguggccag

SEQ ID NO: 42540 - RNA, 22 nt, Human
acccucaguaaucgugcaguuu

SEQ ID NO: 42541 - RNA, 22 nt, Human
acccucgauaugaucugaugaa

SEQ ID NO: 42542 - RNA, 19 nt, Human
acccucucagugccugagg

SEQ ID NO: 42543 - RNA, 19 nt, Human
acccucugccacaagccuc

SEQ ID NO: 42544 - RNA, 22 nt, Human
acccugaagcaggcacucagcu

SEQ ID NO: 42545 - RNA, 22 nt, Human
acccugagaugccacagcauga

SEQ ID NO: 42546 - RNA, 22 nt, Human
acccugagccgccaggaaggcc

SEQ ID NO: 42547 - RNA, 22 nt, Human
acccugagggaugagaguugca

SEQ ID NO: 42548 - RNA, 22 nt, Human
acccugagucacugucugucug

SEQ ID NO: 42549 - RNA, 22 nt, Human
acccugauggccagauugugga

SEQ ID NO: 42550 - RNA, 22 nt, Human
acccugcccucuccagcucagg

SEQ ID NO: 42551 - RNA, 22 nt, Human
acccuggacaucuugucauagc

SEQ ID NO: 42552 - RNA, 22 nt, Human
acccuggacuggggcugaggcu

SEQ ID NO: 42553 - RNA, 22 nt, Human
acccuggaggucuacagugcag

SEQ ID NO: 42554 - RNA, 18 nt, Human
acccugggcaauucacuc

SEQ ID NO: 42555 - RNA, 22 nt, Human
acccuggggucacccuucucug

SEQ ID NO: 42556 - RNA, 16 nt, Human
acccuggguaguccug

SEQ ID NO: 42557 - RNA, 22 nt, Human
acccuggguauuucccaaacuu

SEQ ID NO: 42558 - RNA, 22 nt, Human
acccuguauacgcuacauuuuu

SEQ ID NO: 42559 - RNA, 22 nt, Human
acccuguugguggaucagauug

SEQ ID NO: 42560 - RNA, 22 nt, Human
acccuuuagaaggcaucucagu

SEQ ID NO: 42561 - RNA, 20 nt, Human
acccuuugccggaugccaag

SEQ ID NO: 42562 - RNA, 22 nt, Human
acccuuugccuagaggggcuuu

SEQ ID NO: 42563 - RNA, 22 nt, Human
accgaguuagccaggauggucu

SEQ ID NO: 42564 - RNA, 22 nt, Human
accgcagugacgugggacuucc

SEQ ID NO: 42565 - RNA, 22 nt, Human
accgggaaguccugcacugggc

SEQ ID NO: 42566 - RNA, 22 nt, Human
accgggcuaauuuuuguaucuu

SEQ ID NO: 42567 - RNA, 22 nt, Human
accguuuacaccacuaccgcuu

SEQ ID NO: 42568 - RNA, 22 nt, Human
accuaaauucuggcugauuagg

SEQ ID NO: 42569 - RNA, 22 nt, Human
accuacauaguuaaguaacaaa

SEQ ID NO: 42570 - RNA, 22 nt, Human
accuacaucaagggagugguag

SEQ ID NO: 42571 - RNA, 22 nt, Human
accuacauguuccacauaguug

SEQ ID NO: 42572 - RNA, 22 nt, Human
accuacccuuagaucacaaggg

SEQ ID NO: 42573 - RNA, 22 nt, Human
accuagaacugcaggcuauuuu

SEQ ID NO: 42574 - RNA, 22 nt, Human
accuagaguagucaaauucaua

SEQ ID NO: 42575 - RNA, 22 nt, Human
acguucaaugucagucaacuuu

SEQ ID NO: 42576 - RNA, 22 nt, Human
acguuuuauucccaugcagcau

SEQ ID NO: 42577 - RNA, 19 nt, Human
acuaaaaaugauguuugag

SEQ ID NO: 42578 - RNA, 22 nt, Human
acuaaacacaugagauuccugc

SEQ ID NO: 42579 - RNA, 22 nt, Human
acuaaagaugucuaaauauauu

SEQ ID NO: 42580 - RNA, 22 nt, Human
acuaaagcucacagaguugaac

SEQ ID NO: 42581 - RNA, 22 nt, Human
acuaaaguauggaagugaauaa

SEQ ID NO: 42582 - RNA, 22 nt, Human
acuaaagucagacugcauugau

SEQ ID NO: 42583 - RNA, 22 nt, Human
acuaaagucaucaaagaacuuu

SEQ ID NO: 42584 - RNA, 22 nt, Human
acuaaaguucacggucagcuuu

SEQ ID NO: 42585 - RNA, 22 nt, Human
acuaaauacacacauuuguuca

SEQ ID NO: 42586 - RNA, 22 nt, Human
acuaaauauuugagagguguag

SEQ ID NO: 42587 - RNA, 22 nt, Human
acuaaauuugucaaugacacuu

SEQ ID NO: 42588 - RNA, 22 nt, Human
acuaagugauucuaagcaucuu

SEQ ID NO: 42589 - RNA, 22 nt, Human
acuaagugggacauuuacuagg

SEQ ID NO: 42590 - RNA, 22 nt, Human
acuaauugagugcaugaucuuu

SEQ ID NO: 42591 - RNA, 22 nt, Human
acuaauuguauaguugauguaa

SEQ ID NO: 42592 - RNA, 22 nt, Human
acuacaaaagcacuggguauua

SEQ ID NO: 42593 - RNA, 22 nt, Human
acuacacagggaugugacuacc

SEQ ID NO: 42594 - RNA, 22 nt, Human
acuacaguaagggaggcagcau

SEQ ID NO: 42595 - RNA, 22 nt, Human
acuacaucuugcauaucuauaa

SEQ ID NO: 42596 - RNA, 22 nt, Human
acuacauuaugaggaaagagug

SEQ ID NO: 42597 - RNA, 22 nt, Human
acuacauucaugcucguguugg

SEQ ID NO: 42598 - RNA, 22 nt, Human
acuacauuuccugaccccugug

SEQ ID NO: 42599 - RNA, 22 nt, Human
acuacuaguggcuacaauaaug

SEQ ID NO: 42600 - RNA, 22 nt, Human
acuagaaaauuccuagaaacua

SEQ ID NO: 42601 - RNA, 22 nt, Human
acuagaacuucuaacuaagguc

SEQ ID NO: 42602 - RNA, 22 nt, Human
acuagaccaaggaauccuggaa

SEQ ID NO: 42603 - RNA, 23 nt, Human
acuagacuucaucgaagguuacc

SEQ ID NO: 42604 - RNA, 19 nt, Human
acuagcacccagguaaaug

SEQ ID NO: 42605 - RNA, 21 nt, Human
acuagcuuucuggagaagugu

SEQ ID NO: 42606 - RNA, 22 nt, Human
acuaggaacgggguuugcacuc

SEQ ID NO: 42607 - RNA, 22 nt, Human
acuagggagaagcacuuacaca

SEQ ID NO: 42608 - RNA, 22 nt, Human
acuagggauuacacuguauuca

SEQ ID NO: 42609 - RNA, 22 nt, Human
acuaguauucuuggucuuguau

SEQ ID NO: 42610 - RNA, 22 nt, Human
acuaguauugccuacuguacau

SEQ ID NO: 42611 - RNA, 20 nt, Human
acuagucuaaaagggcugac

SEQ ID NO: 42612 - RNA, 22 nt, Human
acuagucugcauuacaaaauag

SEQ ID NO: 42613 - RNA, 23 nt, Human
acuauaaaguuguucugauuuac

SEQ ID NO: 42614 - RNA, 22 nt, Human
acuauacaccaaaauauuaagg

SEQ ID NO: 42615 - RNA, 22 nt, Human
acuauacagaagaggauaggaa

SEQ ID NO: 42616 - RNA, 22 nt, Human
acuauauaagauuggcauuuuu

SEQ ID NO: 42617 - RNA, 22 nt, Human
acuauauacacauuaucuuguu

SEQ ID NO: 42618 - RNA, 22 nt, Human
acuaucaacaucauugcucuag

SEQ ID NO: 42619 - RNA, 22 nt, Human
acuaucuuccuuaugccuauca

SEQ ID NO: 42620 - RNA, 22 nt, Human
acuauguacccaaagaucugau

SEQ ID NO: 42621 - RNA, 22 nt, Human
acuauuagcauaucaugaaugg

SEQ ID NO: 42622 - RNA, 22 nt, Human
acuauucaagugcucauucaga

SEQ ID NO: 42623 - RNA, 22 nt, Human
acuauucacagauucaguguuc

SEQ ID NO: 42624 - RNA, 22 nt, Human
acucaaauagcugccccuagug

SEQ ID NO: 42625 - RNA, 22 nt, Human
acucaaauuugucaacugaagc

SEQ ID NO: 42626 - RNA, 22 nt, Human
acucaaguggccuugauggcuu

SEQ ID NO: 42627 - RNA, 23 nt, Human
acucacaaagcaggaucauguug

SEQ ID NO: 42628 - RNA, 22 nt, Human
acucacaagugaugugaauggc

SEQ ID NO: 42629 - RNA, 22 nt, Human
acucacauuucaucaggccaag

SEQ ID NO: 42630 - RNA, 22 nt, Human
acucacuucuuuuacuauaaaa

SEQ ID NO: 42631 - RNA, 22 nt, Human
acucagaaugucacugagggac

SEQ ID NO: 42632 - RNA, 22 nt, Human
acucagagaaacagcagggugu

SEQ ID NO: 42633 - RNA, 22 nt, Human
acucagagaauaucuagaagga

SEQ ID NO: 42634 - RNA, 22 nt, Human
acucagagcuuggcuccuugcu

SEQ ID NO: 42635 - RNA, 22 nt, Human
acccaggcuggagugcaguguc

SEQ ID NO: 42636 - RNA, 22 nt, Human
acccaggcuggcagaggcuccu

SEQ ID NO: 42637 - RNA, 22 nt, Human
acccagggagugcuccuguucu

SEQ ID NO: 42638 - RNA, 21 nt, Human
acccaggggaagcagaaacug

SEQ ID NO: 42639 - RNA, 22 nt, Human
acccaggguagagugcaguggc

SEQ ID NO: 42640 - RNA, 19 nt, Human
acccaggguugauguccag

SEQ ID NO: 42641 - RNA, 22 nt, Human
acccagucauccuggugugaga

SEQ ID NO: 42642 - RNA, 22 nt, Human
acccauacacacauauuuaugu

SEQ ID NO: 42643 - RNA, 23 nt, Human
acccaucucuccugucaugcaga

SEQ ID NO: 42644 - RNA, 18 nt, Human
acccauuauauuuguagc

SEQ ID NO: 42645 - RNA, 22 nt, Human
acccauuuguccagcaaagaua

SEQ ID NO: 42646 - RNA, 17 nt, Human
acccauuuugcacaggc

SEQ ID NO: 42647 - RNA, 20 nt, Human
accccacagaguccauugca

SEQ ID NO: 42648 - RNA, 22 nt, Human
accccagaaucuaugcuuuaca

SEQ ID NO: 42649 - RNA, 22 nt, Human
accccagaggcggaggcugcag

SEQ ID NO: 42650 - RNA, 22 nt, Human
accccagcccugcuucugggag

SEQ ID NO: 42651 - RNA, 22 nt, Human
accccaggcccagggaagaggc

SEQ ID NO: 42652 - RNA, 22 nt, Human
accccccagauaaucccuugag

SEQ ID NO: 42653 - RNA, 22 nt, Human
acccgcuuccggagcugcagug

SEQ ID NO: 42654 - RNA, 22 nt, Human
acccggaggcgggggaugcagu

SEQ ID NO: 42655 - RNA, 22 nt, Human
acccucagcuucuuggauuaau

SEQ ID NO: 42656 - RNA, 22 nt, Human
acccuccccaagaggucgugcc

SEQ ID NO: 42657 - RNA, 22 nt, Human
acccucugagaggcacacuuug

SEQ ID NO: 42658 - RNA, 22 nt, Human
acccugaagaaacuucuaagug

SEQ ID NO: 42659 - RNA, 22 nt, Human
acccugagaaagucacaugcau

SEQ ID NO: 42660 - RNA, 22 nt, Human
acccugauauagguccaagagc

SEQ ID NO: 42661 - RNA, 22 nt, Human
acccuggcccauugcugugccu

SEQ ID NO: 42662 - RNA, 22 nt, Human
acccuggcucucuggccaccgc

SEQ ID NO: 42663 - RNA, 22 nt, Human
acccugggagggagaaaucaga

SEQ ID NO: 42664 - RNA, 22 nt, Human
acccugggcacaccauuucccc

SEQ ID NO: 42665 - RNA, 22 nt, Human
acccuggggguggccagugcca

SEQ ID NO: 42666 - RNA, 22 nt, Human
acccugggucucaaucauccua

SEQ ID NO: 42667 - RNA, 22 nt, Human
acccugucuucccugggcauca

SEQ ID NO: 42668 - RNA, 22 nt, Human
acccuguuaugguguaacauuu

SEQ ID NO: 42669 - RNA, 22 nt, Human
acccuucauagaggagaagcug

SEQ ID NO: 42670 - RNA, 22 nt, Human
acccuugguuuugcagagcugu

SEQ ID NO: 42671 - RNA, 22 nt, Human
accgaaggaaacuggaaccguu

SEQ ID NO: 42672 - RNA, 22 nt, Human
accguauauguuugcugugccc

SEQ ID NO: 42673 - RNA, 22 nt, Human
accguggauuuguagucauuuc

SEQ ID NO: 42674 - RNA, 22 nt, Human
accuaaaucuaccucauguuuu

SEQ ID NO: 42675 - RNA, 22 nt, Human
accuacagagaucugcauuuuu

SEQ ID NO: 42676 - RNA, 22 nt, Human
accuacagaucuuugaaugugu

SEQ ID NO: 42677 - RNA, 20 nt, Human
accuacauguauagugaggg

SEQ ID NO: 42678 - RNA, 23 nt, Human
accuacauuauagggauaugggu

SEQ ID NO: 42679 - RNA, 22 nt, Human
accuacugcuccacagugacua

SEQ ID NO: 42680 - RNA, 22 nt, Human
accuagaaugaagcaaugcugu

SEQ ID NO: 42681 - RNA, 22 nt, Human
accuagcugaggagugugagug

SEQ ID NO: 42682 - RNA, 22 nt, Human
accucaagaauguauaacacag

SEQ ID NO: 42683 - RNA, 22 nt, Human
accucagcuauuucaaaacaga

SEQ ID NO: 42684 - RNA, 22 nt, Human
acucuucacuuccccugccagc

SEQ ID NO: 42685 - RNA, 22 nt, Human
acucuucauacagucaucuaau

SEQ ID NO: 42686 - RNA, 22 nt, Human
acucuugaagguggugggagug

SEQ ID NO: 42687 - RNA, 22 nt, Human
acugaaauacugcucuuggauu

SEQ ID NO: 42688 - RNA, 22 nt, Human
acugaaaugaaaucuaucaucu

SEQ ID NO: 42689 - RNA, 22 nt, Human
acugaacaccauuuauaacauu

SEQ ID NO: 42690 - RNA, 22 nt, Human
acugaacuuggugaaugccaca

SEQ ID NO: 42691 - RNA, 18 nt, Human
acugaagaugcaagaccu

SEQ ID NO: 42692 - RNA, 23 nt, Human
acugaagaugucuuaguggcccu

SEQ ID NO: 42693 - RNA, 22 nt, Human
acugaaggaaagccuuugcaug

SEQ ID NO: 42694 - RNA, 22 nt, Human
acugaaguccacacauguagga

SEQ ID NO: 42695 - RNA, 20 nt, Human
acugacagggaacuaaggcu

SEQ ID NO: 42696 - RNA, 22 nt, Human
acugacucuuguuaacuucagc

SEQ ID NO: 42697 - RNA, 22 nt, Human
acugagaaagaccacauggaga

SEQ ID NO: 42698 - RNA, 19 nt, Human
acugagaaccugacccagg

SEQ ID NO: 42699 - RNA, 22 nt, Human
acugagaacucaagagaaaagg

SEQ ID NO: 42700 - RNA, 20 nt, Human
acugagaccaauaaguagaa

SEQ ID NO: 42701 - RNA, 22 nt, Human
acugagacugccccuguaacaa

SEQ ID NO: 42702 - RNA, 22 nt, Human
acugagacuuuguugaguucuu

SEQ ID NO: 42703 - RNA, 21 nt, Human
acugagagauguuggaucaua

SEQ ID NO: 42704 - RNA, 22 nt, Human
acugagagcguguacaaacuua

SEQ ID NO: 42705 - RNA, 22 nt, Human
acugagaggugauagugacauu

SEQ ID NO: 42706 - RNA, 22 nt, Human
acugagagucaagauagcaugg

SEQ ID NO: 42707 - RNA, 22 nt, Human
acugagagucuuagaaacacau

SEQ ID NO: 42708 - RNA, 22 nt, Human
acugagaguugaaaagggagga

SEQ ID NO: 42709 - RNA, 23 nt, Human
acugagcaauguuuacauacuug

SEQ ID NO: 42710 - RNA, 22 nt, Human
acugagcauggcucacagagag

SEQ ID NO: 42711 - RNA, 23 nt, Human
acugagcauuaguauuuuuauaa

SEQ ID NO: 42712 - RNA, 22 nt, Human
acugagccuugaagcuagauag

SEQ ID NO: 42713 - RNA, 22 nt, Human
acugagcucuagguuuugaacc

SEQ ID NO: 42714 - RNA, 22 nt, Human
acugagcucuugacugggaguu

SEQ ID NO: 42715 - RNA, 22 nt, Human
acugagcugcuugaagugaacu

SEQ ID NO: 42716 - RNA, 22 nt, Human
acugaggaacauauauaagaug

SEQ ID NO: 42717 - RNA, 22 nt, Human
acugaggcuuaaagagauuagg

SEQ ID NO: 42718 - RNA, 22 nt, Human
acugagggagagucuuagguug

SEQ ID NO: 42719 - RNA, 22 nt, Human
acugagguuuacuugaaggaga

SEQ ID NO: 42720 - RNA, 22 nt, Human
acugagguuucauuuuaucgcu

SEQ ID NO: 42721 - RNA, 22 nt, Human
acugauacaucuguggaagugg

SEQ ID NO: 42722 - RNA, 22 nt, Human
acugauacgguuuuagagucca

SEQ ID NO: 42723 - RNA, 22 nt, Human
acugaucacagauauguauauu

SEQ ID NO: 42724 - RNA, 22 nt, Human
acugaucacauagauauauucc

SEQ ID NO: 42725 - RNA, 20 nt, Human
acugaucuuguucuuacucc

SEQ ID NO: 42726 - RNA, 22 nt, Human
acugaugaaaacuaauaaauua

SEQ ID NO: 42727 - RNA, 22 nt, Human
acugaugaaagguaagacucca

SEQ ID NO: 42728 - RNA, 22 nt, Human
acugaugaagaguaccacuguu

SEQ ID NO: 42729 - RNA, 22 nt, Human
acugauggcccaccuuggucuc

SEQ ID NO: 42730 - RNA, 22 nt, Human
acugauuaaaaacagacauuua

SEQ ID NO: 42731 - RNA, 22 nt, Human
acugauuacacgaguucugacu

SEQ ID NO: 42732 - RNA, 22 nt, Human
acugauucaaguuaugcaucuu

SEQ ID NO: 42733 - RNA, 22 nt, Human
acugauugcauucauaggguuu

SEQ ID NO: 42734 - RNA, 22 nt, Human
acugcaaaaaugggugcauuca

SEQ ID NO: 42735 - RNA, 21 nt, Human
acugcaaacagcagagacuga

SEQ ID NO: 42736 - RNA, 22 nt, Human
acugcaaagccagauauuauca

SEQ ID NO: 42737 - RNA, 22 nt, Human
acugcaaggaggugggguauca

SEQ ID NO: 42738 - RNA, 22 nt, Human
acugcacacauguuuaagugga

SEQ ID NO: 42739 - RNA, 22 nt, Human
acugcacacuuagcaucuggga

SEQ ID NO: 42740 - RNA, 22 nt, Human
acugcacagaaccuuagaauau

SEQ ID NO: 42741 - RNA, 22 nt, Human
acugcacagucccagaggaugc

SEQ ID NO: 42742 - RNA, 22 nt, Human
acugcacuccagcccgagcaac

SEQ ID NO: 42743 - RNA, 22 nt, Human
acugcacuucacccugggugac

SEQ ID NO: 42744 - RNA, 22 nt, Human
acugcagcccccuauuaggacu

SEQ ID NO: 42745 - RNA, 22 nt, Human
acugcagccuuugggcucauaa

SEQ ID NO: 42746 - RNA, 21 nt, Human
acugcaucugaagucccagga

SEQ ID NO: 42747 - RNA, 22 nt, Human
acugcaugauaauaauagcaga

SEQ ID NO: 42748 - RNA, 22 nt, Human
acugcauuaucaccaagaugua

SEQ ID NO: 42749 - RNA, 22 nt, Human
acugcauuggagagcaugaauu

SEQ ID NO: 42750 - RNA, 22 nt, Human
acugcauuugucugucucaauu

SEQ ID NO: 42751 - RNA, 22 nt, Human
acugccaaugguaguuugaugg

SEQ ID NO: 42752 - RNA, 22 nt, Human
acugccacguuccaggcuuagc

SEQ ID NO: 42753 - RNA, 20 nt, Human
acugccagccuugucuacug

SEQ ID NO: 42754 - RNA, 22 nt, Human
acugcccagaagagaugaaagu

SEQ ID NO: 42755 - RNA, 22 nt, Human
acugcccagugauuggugguua

SEQ ID NO: 42756 - RNA, 22 nt, Human
acugcccuggagacagcagagu

SEQ ID NO: 42757 - RNA, 22 nt, Human
acugcccuuguccuggcacacc

SEQ ID NO: 42758 - RNA, 22 nt, Human
acugccugccuuccagguacug

SEQ ID NO: 42759 - RNA, 22 nt, Human
acugccugcucauaacauugcu

SEQ ID NO: 42760 - RNA, 22 nt, Human
acugccugcuccuggcuccaca

SEQ ID NO: 42761 - RNA, 22 nt, Human
acugccuuauaugcugugugug

SEQ ID NO: 42762 - RNA, 22 nt, Human
acugccuucaugcagaccccug

SEQ ID NO: 42763 - RNA, 22 nt, Human
acugccuugauucaugcugaug

SEQ ID NO: 42764 - RNA, 22 nt, Human
acugccuugauugccaguuucc

SEQ ID NO: 42765 - RNA, 22 nt, Human
acugcuagugagaaaauaacca

SEQ ID NO: 42766 - RNA, 22 nt, Human
acugcucucugcaaguagaugg

SEQ ID NO: 42767 - RNA, 22 nt, Human
agaguuugaauuuugaaaagau

SEQ ID NO: 42768 - RNA, 22 nt, Human
agaguuuguguccuuuaucagg

SEQ ID NO: 42769 - RNA, 17 nt, Human
agaguuuuaagaaauuu

SEQ ID NO: 42770 - RNA, 22 nt, Human
agaguuuuauggcuuuaauucu

SEQ ID NO: 42771 - RNA, 22 nt, Human
agauaaaaugguucaaaggcua

SEQ ID NO: 42772 - RNA, 22 nt, Human
agauaacuaaagaaagggauua

SEQ ID NO: 42773 - RNA, 22 nt, Human
agauaacuuuuggguauucaug

SEQ ID NO: 42774 - RNA, 22 nt, Human
agauaaguacuguuauuauugc

SEQ ID NO: 42775 - RNA, 22 nt, Human
agauaauaaauguuuuagguuu

SEQ ID NO: 42776 - RNA, 22 nt, Human
agauaaucucuaggcuucaugu

SEQ ID NO: 42777 - RNA, 22 nt, Human
agauaauuugaguaaauuaauu

SEQ ID NO: 42778 - RNA, 22 nt, Human
agauacaaaaagggagaagauu

SEQ ID NO: 42779 - RNA, 22 nt, Human
agauacaaaggccuacagagca

SEQ ID NO: 42780 - RNA, 22 nt, Human
agauacaacucagaaguguggu

SEQ ID NO: 42781 - RNA, 22 nt, Human
agauacacagcccugccaucac

SEQ ID NO: 42782 - RNA, 22 nt, Human
agauacagaaguuuuucccuau

SEQ ID NO: 42783 - RNA, 22 nt, Human
agauacagaccucuuauuaagg

SEQ ID NO: 42784 - RNA, 22 nt, Human
agauacaguguuacauuuuuau

SEQ ID NO: 42785 - RNA, 20 nt, Human
agauacaguuuaauuacucu

SEQ ID NO: 42786 - RNA, 22 nt, Human
agauacauggaacgucaaaccu

SEQ ID NO: 42787 - RNA, 22 nt, Human
agauacauuaguaguuacuugu

SEQ ID NO: 42788 - RNA, 22 nt, Human
agauacauuguucuaagcauug

SEQ ID NO: 42789 - RNA, 22 nt, Human
agauacuaagcauuuccagcac

SEQ ID NO: 42790 - RNA, 22 nt, Human
agauacuauggaauuuuaugag

SEQ ID NO: 42791 - RNA, 21 nt, Human
agauaguugggcaugcagcug

SEQ ID NO: 42792 - RNA, 22 nt, Human
agauauacacccauaucacaua

SEQ ID NO: 42793 - RNA, 22 nt, Human
agcaaacagugugcuaagaaau

SEQ ID NO: 42794 - RNA, 20 nt, Human
agcaaacucuucccaucuuc

SEQ ID NO: 42795 - RNA, 22 nt, Human
agcaaagcaucacuccaaucug

SEQ ID NO: 42796 - RNA, 22 nt, Human
agcaaagcugauuaagagcaca

SEQ ID NO: 42797 - RNA, 22 nt, Human
agcaaaguaugugcugggagcu

SEQ ID NO: 42798 - RNA, 22 nt, Human
agcaaauauuuuguugaagugc

SEQ ID NO: 42799 - RNA, 22 nt, Human
agcaaaucagcugcucaggaaa

SEQ ID NO: 42800 - RNA, 19 nt, Human
agcaacaccguuuauuucc

SEQ ID NO: 42801 - RNA, 22 nt, Human
agcaacagcagguuugcacucc

SEQ ID NO: 42802 - RNA, 22 nt, Human
agcaacagcccugagguucaug

SEQ ID NO: 42803 - RNA, 22 nt, Human
agcaacaggaccauggagccca

SEQ ID NO: 42804 - RNA, 18 nt, Human
agcaacaggaucccaggg

SEQ ID NO: 42805 - RNA, 22 nt, Human
agcaacaggcauaauguguuga

SEQ ID NO: 42806 - RNA, 22 nt, Human
agcaacauugagacugcaguug

SEQ ID NO: 42807 - RNA, 22 nt, Human
agcaaccuggaucauggugaaa

SEQ ID NO: 42808 - RNA, 22 nt, Human
agcaacuauauugaaagccacc

SEQ ID NO: 42809 - RNA, 22 nt, Human
agcaacugggcucauuuuuuaa

SEQ ID NO: 42810 - RNA, 22 nt, Human
agcaacuuuucuagacaugguc

SEQ ID NO: 42811 - RNA, 22 nt, Human
agcaagaagcuuugcugugaua

SEQ ID NO: 42812 - RNA, 22 nt, Human
agcaagaagggcaaggaaguuu

SEQ ID NO: 42813 - RNA, 21 nt, Human
agcaagaaucaggaaggcucu

SEQ ID NO: 42814 - RNA, 22 nt, Human
agcaagacucagcaggauacca

SEQ ID NO: 42815 - RNA, 20 nt, Human
agcaagaguaaggacagcga

SEQ ID NO: 42816 - RNA, 22 nt, Human
agcaagaugaaggauucaagac

SEQ ID NO: 42817 - RNA, 22 nt, Human
agcaagauuuaaacccagguca

SEQ ID NO: 42818 - RNA, 21 nt, Human
agcaagcagaauccaucuaga

SEQ ID NO: 42819 - RNA, 22 nt, Human
agcaagcagugaaguugaaugu

SEQ ID NO: 42820 - RNA, 22 nt, Human
agcaagcuaacauaggagauug

SEQ ID NO: 42821 - RNA, 22 nt, Human
agcaagcuggaggggcucauga

SEQ ID NO: 42822 - RNA, 22 nt, Human
agcaagcugucaagagagcuga

SEQ ID NO: 42823 - RNA, 21 nt, Human
agcaaggcagccucucagccu

SEQ ID NO: 42824 - RNA, 22 nt, Human
agcaaggcagcuuucacugcuu

SEQ ID NO: 42825 - RNA, 22 nt, Human
agcaaggccgagaggaugcuau

SEQ ID NO: 42826 - RNA, 20 nt, Human
agcaaggcuaaaucaugauu

SEQ ID NO: 42827 - RNA, 22 nt, Human
agcaaggcuucagagcugucug

SEQ ID NO: 42828 - RNA, 22 nt, Human
agcaaguggaaucauggaaaag

SEQ ID NO: 42829 - RNA, 22 nt, Human
agcaaguguaagaaugcagaau

SEQ ID NO: 42830 - RNA, 22 nt, Human
agcaaguugaaugauaauacuc

SEQ ID NO: 42831 - RNA, 22 nt, Human
agcaauaauuuaggccuuuccu

SEQ ID NO: 42832 - RNA, 22 nt, Human
agcaauaugacauugcuacauc

SEQ ID NO: 42833 - RNA, 23 nt, Human
agcaaucuguguuucagcaagcc

SEQ ID NO: 42834 - RNA, 22 nt, Human
agcaaugaaaugaaaucagucu

SEQ ID NO: 42835 - RNA, 22 nt, Human
agcaaugaccagugaucuugua

SEQ ID NO: 42836 - RNA, 22 nt, Human
agcaaugacuuugaaaucauga

SEQ ID NO: 42837 - RNA, 22 nt, Human
agcaaugcaaucuuaaccuuga

SEQ ID NO: 42838 - RNA, 23 nt, Human
agcaaugcugggagacucuguaa

SEQ ID NO: 42839 - RNA, 22 nt, Human
agcaauguuggccuauauaccu

SEQ ID NO: 42840 - RNA, 22 nt, Human
agcaauuaugauaaggccgcug

SEQ ID NO: 42841 - RNA, 22 nt, Human
agcaauuauggaguuguugacg

SEQ ID NO: 42842 - RNA, 22 nt, Human
agcaauuucucgcaccagacgc

SEQ ID NO: 42843 - RNA, 21 nt, Human
agcaauuuuuccuccucugca

SEQ ID NO: 42844 - RNA, 22 nt, Human
agcacaauauaaagugaacgca

SEQ ID NO: 42845 - RNA, 23 nt, Human
agcacacuuguacaaugcccuag

SEQ ID NO: 42846 - RNA, 22 nt, Human
agcacagaaaguauugacugaa

SEQ ID NO: 42847 - RNA, 23 nt, Human
agcacagacuagaaaggucuuuc

SEQ ID NO: 42848 - RNA, 22 nt, Human
agcacagagagcucuagguaaa

SEQ ID NO: 42849 - RNA, 22 nt, Human
agcacagaguugcagagagcgu

SEQ ID NO: 42850 - RNA, 22 nt, Human
agcacagaguugcucacugccg

SEQ ID NO: 42851 - RNA, 22 nt, Human
agcacagaugugaguggaggcu

SEQ ID NO: 42852 - RNA, 22 nt, Human
agcacagauucugaagaguccu

SEQ ID NO: 42853 - RNA, 22 nt, Human
agcacagcagcgucuaaccgau

SEQ ID NO: 42854 - RNA, 22 nt, Human
agcacagcuuagcaccuggcac

SEQ ID NO: 42855 - RNA, 22 nt, Human
agcacaggacguagagcuugga

SEQ ID NO: 42856 - RNA, 22 nt, Human
agcacagugcugggcacacagu

SEQ ID NO: 42857 - RNA, 22 nt, Human
agcacauguauucuccuugaau

SEQ ID NO: 42858 - RNA, 20 nt, Human
agcacauuaaacauacuccu

SEQ ID NO: 42859 - RNA, 22 nt, Human
agcacauuuucucaaagcucau

SEQ ID NO: 42860 - RNA, 22 nt, Human
agcaccagcucaaggugcaccu

SEQ ID NO: 42861 - RNA, 22 nt, Human
agcaccaucggguucuugcuuu

SEQ ID NO: 42862 - RNA, 22 nt, Human
agcacccuccaacuucccugua

SEQ ID NO: 42863 - RNA, 22 nt, Human
agcacccuggggaagcacaaag

SEQ ID NO: 42864 - RNA, 22 nt, Human
agcacccuucagcccagccugg

SEQ ID NO: 42865 - RNA, 22 nt, Human
agcaccuggucuccuggcgcug

SEQ ID NO: 42866 - RNA, 22 nt, Human
agcaccuguguucaugccucau

SEQ ID NO: 42867 - RNA, 21 nt, Human
agcaccuuacagcuauaaugg

SEQ ID NO: 42868 - RNA, 22 nt, Human
agcaccuucacaggcucucagg

SEQ ID NO: 42869 - RNA, 22 nt, Human
agcaccuugagaucaagcagug

SEQ ID NO: 42870 - RNA, 22 nt, Human
agcaccuugcucuuggccuucc

SEQ ID NO: 42871 - RNA, 22 nt, Human
agcacguucuucauuacuucac

SEQ ID NO: 42872 - RNA, 17 nt, Human
agcacuaaaaugcuucc

SEQ ID NO: 42873 - RNA, 22 nt, Human
agcacuagagccaaaauuuggg

SEQ ID NO: 42874 - RNA, 22 nt, Human
agcacuauuccaaugauccaau

SEQ ID NO: 42875 - RNA, 23 nt, Human
agcacucaugcugcagaagucau

SEQ ID NO: 42876 - RNA, 22 nt, Human
agcacugauuuaaacuggauuu

SEQ ID NO: 42877 - RNA, 22 nt, Human
agcacugauuuuguugcacuua

SEQ ID NO: 42878 - RNA, 22 nt, Human
agcacugcuuuagagccucugc

SEQ ID NO: 42879 - RNA, 22 nt, Human
agcacuggaguuuagugggauu

SEQ ID NO: 42880 - RNA, 22 nt, Human
agcacugggaacgcauggggcc

SEQ ID NO: 42881 - RNA, 20 nt, Human
agcacugucugaccaguggc

SEQ ID NO: 42882 - RNA, 22 nt, Human
agcacuguggggaacucacaga

SEQ ID NO: 42883 - RNA, 22 nt, Human
agcacuuguagacuagaauuuu

SEQ ID NO: 42884 - RNA, 22 nt, Human
agaccaugggcucugaagagca

SEQ ID NO: 42885 - RNA, 22 nt, Human
agacccagaaagcagcugcauu

SEQ ID NO: 42886 - RNA, 22 nt, Human
agacccucuccaugcccacugc

SEQ ID NO: 42887 - RNA, 22 nt, Human
agacccucuccucauggacaug

SEQ ID NO: 42888 - RNA, 20 nt, Human
agacccucuggacugggccc

SEQ ID NO: 42889 - RNA, 21 nt, Human
agacccugcauauguucagua

SEQ ID NO: 42890 - RNA, 22 nt, Human
agacccugcauuuuccaggguu

SEQ ID NO: 42891 - RNA, 22 nt, Human
agacccuggagaaugaaagugc

SEQ ID NO: 42892 - RNA, 22 nt, Human
agacccuggggaaagucacuuc

SEQ ID NO: 42893 - RNA, 22 nt, Human
agacccugucaguguuaggaaa

SEQ ID NO: 42894 - RNA, 22 nt, Human
agacccuugcagucugguuguc

SEQ ID NO: 42895 - RNA, 22 nt, Human
agaccugcagggccaggccugc

SEQ ID NO: 42896 - RNA, 22 nt, Human
agaccugugaucacauggaaug

SEQ ID NO: 42897 - RNA, 22 nt, Human
agacgagggcccccaggacagc

SEQ ID NO: 42898 - RNA, 22 nt, Human
agacgcgcagaaggaagcggcc

SEQ ID NO: 42899 - RNA, 22 nt, Human
agacgcuauuuugaggggucua

SEQ ID NO: 42900 - RNA, 22 nt, Human
agacggauuaccugaggucagg

SEQ ID NO: 42901 - RNA, 22 nt, Human
agacuacaggagaaacucacuc

SEQ ID NO: 42902 - RNA, 22 nt, Human
cugagguggaacagaggugaag

SEQ ID NO: 42903 - RNA, 22 nt, Human
cugagguggggccugggcauca

SEQ ID NO: 42904 - RNA, 22 nt, Human
cugaguccuugggcuuagagug

SEQ ID NO: 42905 - RNA, 22 nt, Human
cugagucuccuggggaggugaa

SEQ ID NO: 42906 - RNA, 22 nt, Human
cugagugauagcgauggggaac

SEQ ID NO: 42907 - RNA, 22 nt, Human
cugagugaucagcuuggguccg

SEQ ID NO: 42908 - RNA, 22 nt, Human
cugaguggguuucugcuuguca

SEQ ID NO: 42909 - RNA, 22 nt, Human
cugaguucuaggcugccaccuu

SEQ ID NO: 42910 - RNA, 21 nt, Human
cugauaauuguuaaauuauuu

SEQ ID NO: 42911 - RNA, 22 nt, Human
cugauacacucccuaaaauaua

SEQ ID NO: 42912 - RNA, 22 nt, Human
cugauaggauuuaguuucuguu

SEQ ID NO: 42913 - RNA, 18 nt, Human
cugauagggguggcagcu

SEQ ID NO: 42914 - RNA, 22 nt, Human
cugauagguuauuuucagugag

SEQ ID NO: 42915 - RNA, 22 nt, Human
cugauauggaugccucauuguc

SEQ ID NO: 42916 - RNA, 22 nt, Human
cugauauucuuugagcugcuaa

SEQ ID NO: 42917 - RNA, 22 nt, Human
cugaugaggauauagauacaca

SEQ ID NO: 42918 - RNA, 22 nt, Human
cugaugccccuggaccugugac

SEQ ID NO: 42919 - RNA, 22 nt, Human
cugaugcuugcaacaaagaacc

SEQ ID NO: 42920 - RNA, 22 nt, Human
cugauggagacuccacugugau

SEQ ID NO: 42921 - RNA, 17 nt, Human
cugauggauuuuuucca

SEQ ID NO: 42922 - RNA, 22 nt, Human
cugauguguuuuaguuugguaa

SEQ ID NO: 42923 - RNA, 21 nt, Human
cugauugugaaagucaucauu

SEQ ID NO: 42924 - RNA, 22 nt, Human
cugauuuacauauacaaaagau

SEQ ID NO: 42925 - RNA, 22 nt, Human
cugauuuagauuucacacguga

SEQ ID NO: 42926 - RNA, 17 nt, Human
cugauuuauuagcagac

SEQ ID NO: 42927 - RNA, 22 nt, Human
cugauuuucaaaauguguuaaa

SEQ ID NO: 42928 - RNA, 22 nt, Human
cugcaaauaggggugugaauaa

SEQ ID NO: 42929 - RNA, 22 nt, Human
cugcaaaugccucggugugcgg

SEQ ID NO: 42930 - RNA, 22 nt, Human
cugcaaaugggcuuuagguggc

SEQ ID NO: 42931 - RNA, 22 nt, Human
cugcaaauugguggugaggcaa

SEQ ID NO: 42932 - RNA, 22 nt, Human
cugcaacucucuccagaggcug

SEQ ID NO: 42933 - RNA, 22 nt, Human
cugcaaggaguugacauugucu

SEQ ID NO: 42934 - RNA, 22 nt, Human
cugcaagguauauguuaucaua

SEQ ID NO: 42935 - RNA, 22 nt, Human
cugcaagguccaccugcuacau

SEQ ID NO: 42936 - RNA, 22 nt, Human
cugcaauaugaugucugagaaa

SEQ ID NO: 42937 - RNA, 22 nt, Human
cugcacagaggucggucugcca

SEQ ID NO: 42938 - RNA, 22 nt, Human
cugcacagggauauggggagcu

SEQ ID NO: 42939 - RNA, 22 nt, Human
cugcaccacagccugaggcagc

SEQ ID NO: 42940 - RNA, 22 nt, Human
cugcacccaggccuggucccag

SEQ ID NO: 42941 - RNA, 22 nt, Human
cugcacccaugagcucaaggga

SEQ ID NO: 42942 - RNA, 22 nt, Human
cugcacccugcagguaccccug

SEQ ID NO: 42943 - RNA, 22 nt, Human
cugcaccuacagccacauuuac

SEQ ID NO: 42944 - RNA, 20 nt, Human
cugcacugaacaugucugag

SEQ ID NO: 42945 - RNA, 22 nt, Human
cugcacugaagaaaggagcucu

SEQ ID NO: 42946 - RNA, 22 nt, Human
cugcacugagcucucccagccc

SEQ ID NO: 42947 - RNA, 22 nt, Human
cugcacuguguaacagauaacu

SEQ ID NO: 42948 - RNA, 22 nt, Human
cugcacuguguauuccuuggcu

SEQ ID NO: 42949 - RNA, 22 nt, Human
cugcacuugacaugcucucaga

SEQ ID NO: 42950 - RNA, 22 nt, Human
cugcagaaaccuuuccugauuu

SEQ ID NO: 42951 - RNA, 22 nt, Human
cugcagagaauuguggggcuuc

SEQ ID NO: 42952 - RNA, 22 nt, Human
cugcagagcaaguucucuguug

SEQ ID NO: 42953 - RNA, 22 nt, Human
cugcagagcagccaguccccca

SEQ ID NO: 42954 - RNA, 22 nt, Human
cugcagagcuuucugaaugaag

SEQ ID NO: 42955 - RNA, 22 nt, Human
cugcagaggccucgccuccucu

SEQ ID NO: 42956 - RNA, 22 nt, Human
cugcagagguugguucuaagau

SEQ ID NO: 42957 - RNA, 22 nt, Human
cugcagaugucucaauuuuauu

SEQ ID NO: 42958 - RNA, 22 nt, Human
cugcagauuuggugucugguga

SEQ ID NO: 42959 - RNA, 22 nt, Human
cugcagcagccuccagccuugg

SEQ ID NO: 42960 - RNA, 22 nt, Human
cugcagcaggaggcuccugcag

SEQ ID NO: 42961 - RNA, 22 nt, Human
cugcagcagugugucucauuuu

SEQ ID NO: 42962 - RNA, 22 nt, Human
cugcagccuccaccuuuugggu

SEQ ID NO: 42963 - RNA, 22 nt, Human
cugcagccuccuccagcuacgu

SEQ ID NO: 42964 - RNA, 22 nt, Human
caugccaugugugaggagagga

SEQ ID NO: 42965 - RNA, 22 nt, Human
caugccauuugguggauugaga

SEQ ID NO: 42966 - RNA, 22 nt, Human
caugccauuuuucuagauugag

SEQ ID NO: 42967 - RNA, 22 nt, Human
caugcuaaaauaucugaagauu

SEQ ID NO: 42968 - RNA, 22 nt, Human
caugcuaaaccagaacauagga

SEQ ID NO: 42969 - RNA, 22 nt, Human
caugcuccagcuccagacaggu

SEQ ID NO: 42970 - RNA, 22 nt, Human
caugcucugcagcagaccugug

SEQ ID NO: 42971 - RNA, 19 nt, Human
caugcugaccugcuguggu

SEQ ID NO: 42972 - RNA, 22 nt, Human
caugcugauucuuccugagcuu

SEQ ID NO: 42973 - RNA, 22 nt, Human
caugcugggccuugggugcacu

SEQ ID NO: 42974 - RNA, 22 nt, Human
caugcuggguaaagguggugaa

SEQ ID NO: 42975 - RNA, 22 nt, Human
caugcugugguaaaucacugaa

SEQ ID NO: 42976 - RNA, 22 nt, Human
caugcuguugaauaugacauug

SEQ ID NO: 42977 - RNA, 22 nt, Human
caugcuuaauuggagcauucau

SEQ ID NO: 42978 - RNA, 22 nt, Human
caugcuuauucauucugcuaac

SEQ ID NO: 42979 - RNA, 22 nt, Human
caugcuucacacacugaaugac

SEQ ID NO: 42980 - RNA, 22 nt, Human
caugcuucaugcaaaauucuga

SEQ ID NO: 42981 - RNA, 22 nt, Human
caugcuugcugccucauuguuc

SEQ ID NO: 42982 - RNA, 22 nt, Human
caugcuuuuugacaacaagcug

SEQ ID NO: 42983 - RNA, 22 nt, Human
caugcuuuuuucuaguauaaau

SEQ ID NO: 42984 - RNA, 22 nt, Human
cauggaggaguuaggugugagu

SEQ ID NO: 42985 - RNA, 22 nt, Human
cauggaggccaggaaacagccu

SEQ ID NO: 42986 - RNA, 22 nt, Human
cauggaucauaaaugugcuaaa

SEQ ID NO: 42987 - RNA, 22 nt, Human
cauggcagaaaccugagcugcu

SEQ ID NO: 42988 - RNA, 22 nt, Human
cauggcagagaaggggaacugg

SEQ ID NO: 42989 - RNA, 22 nt, Human
cauggcagccugcccugcuugc

SEQ ID NO: 42990 - RNA, 22 nt, Human
cauggcagcuuugggaggagga

SEQ ID NO: 42991 - RNA, 22 nt, Human
cauggcaggaaaaugaacaggc

SEQ ID NO: 42992 - RNA, 22 nt, Human
cauggcaggaucugggcccaca

SEQ ID NO: 42993 - RNA, 22 nt, Human
cauggccaaggaugcucaacca

SEQ ID NO: 42994 - RNA, 22 nt, Human
cauggccagcccccaguuccuc

SEQ ID NO: 42995 - RNA, 22 nt, Human
cauggccccaaaucccaugcau

SEQ ID NO: 42996 - RNA, 22 nt, Human
cauggccucaaaggacugcaga

SEQ ID NO: 42997 - RNA, 22 nt, Human
cauggccucucuccuggaaugg

SEQ ID NO: 42998 - RNA, 22 nt, Human
cauggccugccuccuccuggug

SEQ ID NO: 42999 - RNA, 22 nt, Human
cauggcugaaauucuucgcuug

SEQ ID NO: 43000 - RNA, 22 nt, Human
cauggcuuagaaguuccagccc

SEQ ID NO: 43001 - RNA, 22 nt, Human
cauggcuucaaagccuuuggca

SEQ ID NO: 43002 - RNA, 22 nt, Human
cauggcuucgcgcguccccgcu

SEQ ID NO: 43003 - RNA, 22 nt, Human
cauggcuucgucacagagggca

SEQ ID NO: 43004 - RNA, 22 nt, Human
cauggcuuuuuuauucugaaug

SEQ ID NO: 43005 - RNA, 22 nt, Human
caugggagguuggcuuggcaug

SEQ ID NO: 43006 - RNA, 23 nt, Human
caugggagugagaaugccagcuc

SEQ ID NO: 43007 - RNA, 22 nt, Human
caugggcccgugagaggcaggg

SEQ ID NO: 43008 - RNA, 22 nt, Human
caugggcugaaaaucugcaaac

SEQ ID NO: 43009 - RNA, 22 nt, Human
caugggcuugcucucugagcuc

SEQ ID NO: 43010 - RNA, 22 nt, Human
cauggggagacaccuagggaaa

SEQ ID NO: 43011 - RNA, 22 nt, Human
caucagaccugccagacuaggu

SEQ ID NO: 43012 - RNA, 19 nt, Human
caucagagggcauaggaug

SEQ ID NO: 43013 - RNA, 21 nt, Human
caucagauuuagaaguucuau

SEQ ID NO: 43014 - RNA, 22 nt, Human
caucagcaggcaacacucuugg

SEQ ID NO: 43015 - RNA, 23 nt, Human
caucagccucagucuguggaccc

SEQ ID NO: 43016 - RNA, 22 nt, Human
caucagcuuuucuaugugguga

SEQ ID NO: 43017 - RNA, 22 nt, Human
caucaggaaaaaacuggagcca

SEQ ID NO: 43018 - RNA, 22 nt, Human
caucaggaucucucuggaaugc

SEQ ID NO: 43019 - RNA, 22 nt, Human
caucagugcccuuggggaugcc

SEQ ID NO: 43020 - RNA, 20 nt, Human
caucagugccugacaggucc

SEQ ID NO: 43021 - RNA, 22 nt, Human
caucaguggauauagauuagcg

SEQ ID NO: 43022 - RNA, 22 nt, Human
caucaguguucacuauuccuuc

SEQ ID NO: 43023 - RNA, 22 nt, Human
caucaguucaugucuagcugcu

SEQ ID NO: 43024 - RNA, 22 nt, Human
caucaguucccaggcccagaca

SEQ ID NO: 43025 - RNA, 22 nt, Human
caucaguuccugccccugcccc

SEQ ID NO: 43026 - RNA, 22 nt, Human
caucaguuuggucaaugauggg

SEQ ID NO: 43027 - RNA, 22 nt, Human
caucauacuguuuacacucaaa

SEQ ID NO: 43028 - RNA, 20 nt, Human
caucaucacaugagccaauu

SEQ ID NO: 43029 - RNA, 22 nt, Human
caucauugccuguuucccuugg

SEQ ID NO: 43030 - RNA, 22 nt, Human
caucauuguuagggacucuaac

SEQ ID NO: 43031 - RNA, 22 nt, Human
caucauuuguucacuugauucc

SEQ ID NO: 43032 - RNA, 20 nt, Human
caucauuuuaaaaucucucc

SEQ ID NO: 43033 - RNA, 22 nt, Human
cauccaaagcaaauaucuuaaa

SEQ ID NO: 43034 - RNA, 22 nt, Human
cauccaauaccaguuugcaggc

SEQ ID NO: 43035 - RNA, 22 nt, Human
cauccagcuccugggggccacc

SEQ ID NO: 43036 - RNA, 22 nt, Human
cauccaggcaccacaaccagcu

SEQ ID NO: 43037 - RNA, 22 nt, Human
cauccaguggucagggaaguug

SEQ ID NO: 43038 - RNA, 22 nt, Human
cauccauuaacucauuuguuuc

SEQ ID NO: 43039 - RNA, 17 nt, Human
cauccgugagcucggca

SEQ ID NO: 43040 - RNA, 22 nt, Human
cauccugacuggguaaagcuua

SEQ ID NO: 43041 - RNA, 22 nt, Human
cauccugagaaaauaaaggaga

SEQ ID NO: 43042 - RNA, 22 nt, Human
cauccuucaaaggcuacaauua

SEQ ID NO: 43043 - RNA, 22 nt, Human
caucuacaggagaaugucacug

SEQ ID NO: 43044 - RNA, 22 nt, Human
caucuacaugcuugccacugcu

SEQ ID NO: 43045 - RNA, 22 nt, Human
caucuaccuccacccuauauau

SEQ ID NO: 43046 - RNA, 22 nt, Human
caucucaguguacagggagucu

SEQ ID NO: 43047 - RNA, 22 nt, Human
caucuccagguuuagggagcac

SEQ ID NO: 43048 - RNA, 22 nt, Human
caucuccuuuggucuacuucca

SEQ ID NO: 43049 - RNA, 22 nt, Human
caucugaauaucccaggcauau

SEQ ID NO: 43050 - RNA, 22 nt, Human
caucugaugggaauauaagagc

SEQ ID NO: 43051 - RNA, 22 nt, Human
caucugcuguuccuuggacuca

SEQ ID NO: 43052 - RNA, 19 nt, Human
caucuggaugauucuccug

SEQ ID NO: 43053 - RNA, 22 nt, Human
caucuggcuagcuaucauugug

SEQ ID NO: 43054 - RNA, 22 nt, Human
caucuguucuauccacguugcu

SEQ ID NO: 43055 - RNA, 22 nt, Human
caucuguuuuugucaauuacau

SEQ ID NO: 43056 - RNA, 21 nt, Human
caucuuaauugaaagcagaga

SEQ ID NO: 43057 - RNA, 22 nt, Human
caucuuauuuucuucuagugcu

SEQ ID NO: 43058 - RNA, 22 nt, Human
caucuucagugauuaccuaaaa

SEQ ID NO: 43059 - RNA, 22 nt, Human
caucuucugggacuucucaguu

SEQ ID NO: 43060 - RNA, 20 nt, Human
caucuugaaggucuuccaca

SEQ ID NO: 43061 - RNA, 22 nt, Human
caucuugaagguuucuuuagcu

SEQ ID NO: 43062 - RNA, 22 nt, Human
caucuugacugggauaagggau

SEQ ID NO: 43063 - RNA, 22 nt, Human
caucuugcugacuugcauuauu

SEQ ID NO: 43064 - RNA, 22 nt, Human
caucuugcuggguuuuaucaua

SEQ ID NO: 43065 - RNA, 22 nt, Human
caucuugcuguuauguuuaugu

SEQ ID NO: 43066 - RNA, 19 nt, Human
caucuuggaguacuccuuu

SEQ ID NO: 43067 - RNA, 22 nt, Human
caucuugucuuuuugggccuga

SEQ ID NO: 43068 - RNA, 22 nt, Human
caucuugugaggaccuucuugc

SEQ ID NO: 43069 - RNA, 22 nt, Human
caucuuuaacaauuuacaaugu

SEQ ID NO: 43070 - RNA, 22 nt, Human
caucuuuaauuugugacaacua

SEQ ID NO: 43071 - RNA, 22 nt, Human
caucuuuagggaccauuauucu

SEQ ID NO: 43072 - RNA, 22 nt, Human
caucuuuaguagguucuggaga

SEQ ID NO: 43073 - RNA, 22 nt, Human
caucuuuaguuauugaauauag

SEQ ID NO: 43074 - RNA, 22 nt, Human
caucuuuauuuauauagacagg

SEQ ID NO: 43075 - RNA, 22 nt, Human
caucuuugggcugcauggaagg

SEQ ID NO: 43076 - RNA, 19 nt, Human
caucuuuggucaccuaguc

SEQ ID NO: 43077 - RNA, 22 nt, Human
caucuuuugguaggagccgggc

SEQ ID NO: 43078 - RNA, 22 nt, Human
caugaaaauaacauuguuguga

SEQ ID NO: 43079 - RNA, 22 nt, Human
cugcagcuccucucugugcccc

SEQ ID NO: 43080 - RNA, 22 nt, Human
cugcagcuccugagcucagaga

SEQ ID NO: 43081 - RNA, 22 nt, Human
cugcagcuccuucuggcaugug

SEQ ID NO: 43082 - RNA, 17 nt, Human
cugcagcuggagggcca

SEQ ID NO: 43083 - RNA, 22 nt, Human
cugcagcuuaaaggaguucaau

SEQ ID NO: 43084 - RNA, 22 nt, Human
cugcagcuuauuugcuguguga

SEQ ID NO: 43085 - RNA, 22 nt, Human
cugcaggaaggggacggagugg

SEQ ID NO: 43086 - RNA, 22 nt, Human
cugcaggaaucugugcuaggug

SEQ ID NO: 43087 - RNA, 22 nt, Human
cugcaggagcaagccugggaga

SEQ ID NO: 43088 - RNA, 22 nt, Human
cugcaggcauuuauucaugcaa

SEQ ID NO: 43089 - RNA, 22 nt, Human
cugcagggagaggggacagccu

SEQ ID NO: 43090 - RNA, 22 nt, Human
cugcagggauugcuucuguaua

SEQ ID NO: 43091 - RNA, 22 nt, Human
cugcagggccauggguucuaua

SEQ ID NO: 43092 - RNA, 22 nt, Human
cugcagggcccaaggucaacgg

SEQ ID NO: 43093 - RNA, 22 nt, Human
cugcagggcccgccugagcccu

SEQ ID NO: 43094 - RNA, 22 nt, Human
cugcagggcuuaccuugcucug

SEQ ID NO: 43095 - RNA, 22 nt, Human
cugcaggggcaguccacuuccu

SEQ ID NO: 43096 - RNA, 22 nt, Human
cugcaggggccucgagcacagg

SEQ ID NO: 43097 - RNA, 22 nt, Human
cugcagggguguccuguauugg

SEQ ID NO: 43098 - RNA, 20 nt, Human
cugcagggugagugggcgau

SEQ ID NO: 43099 - RNA, 22 nt, Human
cugcaggguucggagaguuccc

SEQ ID NO: 43100 - RNA, 22 nt, Human
cugcaggguuuuucaaggacaa

SEQ ID NO: 43101 - RNA, 22 nt, Human
cugcaguagcaccuguggcuuu

SEQ ID NO: 43102 - RNA, 22 nt, Human
cugcagucagcuuuuaagaucu

SEQ ID NO: 43103 - RNA, 22 nt, Human
cugcagucugacauacgaggac

SEQ ID NO: 43104 - RNA, 22 nt, Human
cugcagugcaagcccagaugga

SEQ ID NO: 43105 - RNA, 22 nt, Human
cugcaguucucaauuucuauug

SEQ ID NO: 43106 - RNA, 22 nt, Human
cugcaguuggauaaagauacuu

SEQ ID NO: 43107 - RNA, 22 nt, Human
cugcaguuugaccuuguuuucu

SEQ ID NO: 43108 - RNA, 22 nt, Human
cugcaguuugcuaagagacaaa

SEQ ID NO: 43109 - RNA, 22 nt, Human
cugcaguuuguaaacauuuuaa

SEQ ID NO: 43110 - RNA, 22 nt, Human
cugcauaugagaauaggagaaa

SEQ ID NO: 43111 - RNA, 22 nt, Human
cugcauaugauagaugccuugc

SEQ ID NO: 43112 - RNA, 22 nt, Human
cugcaucauuuucagacaaugg

SEQ ID NO: 43113 - RNA, 22 nt, Human
cugcauccauguugcugcaaag

SEQ ID NO: 43114 - RNA, 22 nt, Human
cugcaucucaggagacgggucu

SEQ ID NO: 43115 - RNA, 22 nt, Human
cugcaucucugcuagucaguca

SEQ ID NO: 43116 - RNA, 22 nt, Human
cugcaugaagucuuuuuuauag

SEQ ID NO: 43117 - RNA, 22 nt, Human
cugcaugcugagccaacaguga

SEQ ID NO: 43118 - RNA, 23 nt, Human
cugcauguccacugguguaaaug

SEQ ID NO: 43119 - RNA, 22 nt, Human
cugcauguguuauauuugguuc

SEQ ID NO: 43120 - RNA, 22 nt, Human
ccaggacauguugcaaguuuau

SEQ ID NO: 43121 - RNA, 22 nt, Human
ccaggaccacacgacaggagag

SEQ ID NO: 43122 - RNA, 22 nt, Human
ccaggaccuggagcucuaugaa

SEQ ID NO: 43123 - RNA, 22 nt, Human
ccaggagaagcaucugagugua

SEQ ID NO: 43124 - RNA, 22 nt, Human
ccaggagagcagaagcccaggc

SEQ ID NO: 43125 - RNA, 22 nt, Human
ccaggagauaagcugaguuuau

SEQ ID NO: 43126 - RNA, 22 nt, Human
ccaggagaugauguuggggauu

SEQ ID NO: 43127 - RNA, 22 nt, Human
ccaggagcaaagaucacuggga

SEQ ID NO: 43128 - RNA, 22 nt, Human
ccaggagcagaguagguguuca

SEQ ID NO: 43129 - RNA, 22 nt, Human
ccaggagcagccggcccaccug

SEQ ID NO: 43130 - RNA, 22 nt, Human
ccaggagcagggcuggcugcac

SEQ ID NO: 43131 - RNA, 22 nt, Human
ccaggagcauuaagagaacaua

SEQ ID NO: 43132 - RNA, 17 nt, Human
ccaggagcgugggucuc

SEQ ID NO: 43133 - RNA, 22 nt, Human
ccaggagcuggagggugcagug

SEQ ID NO: 43134 - RNA, 22 nt, Human
ccaggagcuggcauguggagag

SEQ ID NO: 43135 - RNA, 22 nt, Human
ccaggaggaugaggggcauaga

SEQ ID NO: 43136 - RNA, 22 nt, Human
ccaggaggcucugcccauccca

SEQ ID NO: 43137 - RNA, 16 nt, Human
ccaggaggcugacacc

SEQ ID NO: 43138 - RNA, 22 nt, Human
ccaggagggaccgcggcauccc

SEQ ID NO: 43139 - RNA, 22 nt, Human
ccaggagggaggaguuccugag

SEQ ID NO: 43140 - RNA, 22 nt, Human
ccaggaggugcuggaagaaagc

SEQ ID NO: 43141 - RNA, 22 nt, Human
ccaggagguggagauugcagug

SEQ ID NO: 43142 - RNA, 22 nt, Human
ccaggagguggcaggacuugcc

SEQ ID NO: 43143 - RNA, 22 nt, Human
ccaggauaguaugaguagggau

SEQ ID NO: 43144 - RNA, 22 nt, Human
ccaggcaaaacagauuuguaug

SEQ ID NO: 43145 - RNA, 22 nt, Human
ccaggcaagagaggcucuggca

SEQ ID NO: 43146 - RNA, 22 nt, Human
ccaggcaauguucuaagugauu

SEQ ID NO: 43147 - RNA, 22 nt, Human
ccaggcacaggugggccucaga

SEQ ID NO: 43148 - RNA, 22 nt, Human
ccaggcaccaaaguaugcuuua

SEQ ID NO: 43149 - RNA, 22 nt, Human
ccaggcagaaugaaaccccugu

SEQ ID NO: 43150 - RNA, 21 nt, Human
ccaggcagagcugugaguucu

SEQ ID NO: 43151 - RNA, 22 nt, Human
ccaggcagaugggccggcuuca

SEQ ID NO: 43152 - RNA, 22 nt, Human
ccaggcaggcgauggugcagug

SEQ ID NO: 43153 - RNA, 22 nt, Human
ccaggcaguggaagcuaaaauu

SEQ ID NO: 43154 - RNA, 22 nt, Human
ccaggccaguguuugguccagg

SEQ ID NO: 43155 - RNA, 22 nt, Human
ccaggcccugcuccucacacca

SEQ ID NO: 43156 - RNA, 22 nt, Human
ccaggcccuugcaagucccacc

SEQ ID NO: 43157 - RNA, 22 nt, Human
ccaggccuuccaguacgcagaa

SEQ ID NO: 43158 - RNA, 22 nt, Human
ccaggccuucugaggacacucu

SEQ ID NO: 43159 - RNA, 22 nt, Human
ccaggcuagaaacugaggcaca

SEQ ID NO: 43160 - RNA, 22 nt, Human
ccaggcuagagagcaguggcac

SEQ ID NO: 43161 - RNA, 22 nt, Human
ccaggcuagagugcaauggcgc

SEQ ID NO: 43162 - RNA, 17 nt, Human
ccaggcuauaccaggcu

SEQ ID NO: 43163 - RNA, 22 nt, Human
ccaggcucacugacuaccacau

SEQ ID NO: 43164 - RNA, 22 nt, Human
ccaggcucagcuauuaagaaac

SEQ ID NO: 43165 - RNA, 22 nt, Human
ccaggcucaggccugcucguug

SEQ ID NO: 43166 - RNA, 22 nt, Human
ccaggcucagggcagacuuuca

SEQ ID NO: 43167 - RNA, 22 nt, Human
ccaggcucaggugcgagagaca

SEQ ID NO: 43168 - RNA, 22 nt, Human
ccaggcuccucaugaucuuguu

SEQ ID NO: 43169 - RNA, 22 nt, Human
ccaggcucugacauagauggga

SEQ ID NO: 43170 - RNA, 22 nt, Human
ccaggcucugucuggucagaag

SEQ ID NO: 43171 - RNA, 22 nt, Human
ccaggcugcucacaagcugccc

SEQ ID NO: 43172 - RNA, 22 nt, Human
ccaggcugcuuagccuuaucuu

SEQ ID NO: 43173 - RNA, 22 nt, Human
ccaggcugcuuuauuacucugu

SEQ ID NO: 43174 - RNA, 22 nt, Human
ccaggcuggaaucaauauucug

SEQ ID NO: 43175 - RNA, 22 nt, Human
ccaggcuggagugcaguagugu

SEQ ID NO: 43176 - RNA, 20 nt, Human
ccaggcuggcaaaugggggc

SEQ ID NO: 43177 - RNA, 21 nt, Human
ccaggcuggccaugguauuga

SEQ ID NO: 43178 - RNA, 22 nt, Human
ccaggcuguaaacaccuucaaa

SEQ ID NO: 43179 - RNA, 22 nt, Human
ccaggcugugcuuuucauaaau

SEQ ID NO: 43180 - RNA, 22 nt, Human
ccaggcuuauuaucuucuccau

SEQ ID NO: 43181 - RNA, 22 nt, Human
ccaggcuucugauuccaggcac

SEQ ID NO: 43182 - RNA, 22 nt, Human
ccaggcuugaagggaagaaugg

SEQ ID NO: 43183 - RNA, 19 nt, Human
ccaggcuuuaugcaaauac

SEQ ID NO: 43184 - RNA, 22 nt, Human
ccagggaagaauaggugugguu

SEQ ID NO: 43185 - RNA, 22 nt, Human
ccagggaagcuggucacgcagg

SEQ ID NO: 43186 - RNA, 22 nt, Human
ccagggaaugugggaugacucu

SEQ ID NO: 43187 - RNA, 22 nt, Human
ccagggagcccacaggacaaug

SEQ ID NO: 43188 - RNA, 18 nt, Human
ccagggagcuuauuagga

SEQ ID NO: 43189 - RNA, 23 nt, Human
ccagggagugcuacuaucaagcc

SEQ ID NO: 43190 - RNA, 21 nt, Human
ccagggauguugaacugaaag

SEQ ID NO: 43191 - RNA, 22 nt, Human
ccagggcaaaugagaucauagc

SEQ ID NO: 43192 - RNA, 22 nt, Human
ccagggcaauaggaacacuuuu

SEQ ID NO: 43193 - RNA, 22 nt, Human
ccagggcacguugggacaguac

SEQ ID NO: 43194 - RNA, 22 nt, Human
ccagggcacuuaggcccagccc

SEQ ID NO: 43195 - RNA, 22 nt, Human
ccagggcagcagaauuggggca

SEQ ID NO: 43196 - RNA, 22 nt, Human
ccagggcaggggcuggaguuca

SEQ ID NO: 43197 - RNA, 22 nt, Human
ccagggcauguaacuaauggug

SEQ ID NO: 43198 - RNA, 22 nt, Human
ccagggccaagagaccucgagg

SEQ ID NO: 43199 - RNA, 22 nt, Human
ccagggccaguaagauuggcau

SEQ ID NO: 43200 - RNA, 22 nt, Human
ccagggccuacagcuuaagucc

SEQ ID NO: 43201 - RNA, 22 nt, Human
ccagggccugagggcgacgccc

SEQ ID NO: 43202 - RNA, 19 nt, Human
ccagggcuccaagcugagu

SEQ ID NO: 43203 - RNA, 22 nt, Human
ccagggcuccauugcucauccu

SEQ ID NO: 43204 - RNA, 22 nt, Human
ccagggcucugcuucugccaug

SEQ ID NO: 43205 - RNA, 22 nt, Human
ccagggcugagacuguauuggg

SEQ ID NO: 43206 - RNA, 22 nt, Human
ccagggcugcugggggaguuga

SEQ ID NO: 43207 - RNA, 22 nt, Human
ccagggcuggaccagugcuugg

SEQ ID NO: 43208 - RNA, 22 nt, Human
ccagggcuggguuugucggugu

SEQ ID NO: 43209 - RNA, 22 nt, Human
ccagggcuggugggagaugcug

SEQ ID NO: 43210 - RNA, 22 nt, Human
ccagggcuuuaucugccuuuga

SEQ ID NO: 43211 - RNA, 21 nt, Human
ccaggggcaaauugucguuuc

SEQ ID NO: 43212 - RNA, 22 nt, Human
ccagggggcuuggugaggccau

SEQ ID NO: 43213 - RNA, 22 nt, Human
ccaggguaccccaagggcaggu

SEQ ID NO: 43214 - RNA, 22 nt, Human
ccagggugagaaaaggcuggau

SEQ ID NO: 43215 - RNA, 22 nt, Human
ccaggguggaggcuggauggag

SEQ ID NO: 43216 - RNA, 22 nt, Human
ccaggguggggcaggcccacug

SEQ ID NO: 43217 - RNA, 22 nt, Human
ccagggugugagaaggaaguag

SEQ ID NO: 43218 - RNA, 22 nt, Human
ccagggugugggcgucggcacg

SEQ ID NO: 43219 - RNA, 22 nt, Human
ccaggguugcuguauggcacuu

SEQ ID NO: 43220 - RNA, 22 nt, Human
ccaggguuggucucucugaggu

SEQ ID NO: 43221 - RNA, 22 nt, Human
ccagguaaauuaccuacugaau

SEQ ID NO: 43222 - RNA, 22 nt, Human
ccagguacauggagaagaacag

SEQ ID NO: 43223 - RNA, 22 nt, Human
ccaggucaagcuccccuguggu

SEQ ID NO: 43224 - RNA, 17 nt, Human
ccaggucuccuugcuuu

SEQ ID NO: 43225 - RNA, 22 nt, Human
ccaggucuggaaccaccagggc

SEQ ID NO: 43226 - RNA, 22 nt, Human
ccaggucuuugacuaauaugcu

SEQ ID NO: 43227 - RNA, 22 nt, Human
ccaggugccuccagucacagug

SEQ ID NO: 43228 - RNA, 22 nt, Human
cuguggaccugcucuuagagac

SEQ ID NO: 43229 - RNA, 18 nt, Human
ccaggccaugaaccucug

SEQ ID NO: 43230 - RNA, 22 nt, Human
ccaggccauucccagaguugcu

SEQ ID NO: 43231 - RNA, 22 nt, Human
ccaggccccagggcuggcuuuc

SEQ ID NO: 43232 - RNA, 22 nt, Human
ccaggcccccgagcagaagaca

SEQ ID NO: 43233 - RNA, 22 nt, Human
ccaggccucaccugcccaccua

SEQ ID NO: 43234 - RNA, 22 nt, Human
ccaggccuccugugaguggacc

SEQ ID NO: 43235 - RNA, 23 nt, Human
ccaggccucucagagggugugcc

SEQ ID NO: 43236 - RNA, 22 nt, Human
ccaggccucuggcugcuuaguc

SEQ ID NO: 43237 - RNA, 22 nt, Human
cccaggagaugcacuccauugg

SEQ ID NO: 43238 - RNA, 22 nt, Human
cccaggagauggagguugcagu

SEQ ID NO: 43239 - RNA, 22 nt, Human
cccaggagauggugcguggucu

SEQ ID NO: 43240 - RNA, 22 nt, Human
cccaggagcuucucucugccuc

SEQ ID NO: 43241 - RNA, 22 nt, Human
cccaggaggcagagcuugcagu

SEQ ID NO: 43242 - RNA, 22 nt, Human
cccaggaggcagagguugcagu

SEQ ID NO: 43243 - RNA, 22 nt, Human
cccaggaggguggccucugccc

SEQ ID NO: 43244 - RNA, 15 nt, Human
cccaggaguucgaga

SEQ ID NO: 43245 - RNA, 22 nt, Human
cccaggaguucgaggcuguagu

SEQ ID NO: 43246 - RNA, 20 nt, Human
cccaggaguuugcucuuacu

SEQ ID NO: 43247 - RNA, 22 nt, Human
cccaggaugucgaggcugcagu

SEQ ID NO: 43248 - RNA, 22 nt, Human
cccaggcacacugaagugacau

SEQ ID NO: 43249 - RNA, 22 nt, Human
cccaggcacagauuaucccaau

SEQ ID NO: 43250 - RNA, 22 nt, Human
cccaggcacauccacucuguga

SEQ ID NO: 43251 - RNA, 22 nt, Human
cccaggcagcccuucugacgca

SEQ ID NO: 43252 - RNA, 22 nt, Human
cccaggcaguagaaagaagagg

SEQ ID NO: 43253 - RNA, 17 nt, Human
cccaggccgccgggagc

SEQ ID NO: 43254 - RNA, 19 nt, Human
cccaggcuacauggagagg

SEQ ID NO: 43255 - RNA, 22 nt, Human
cccaggcuagaaaggccaacaa

SEQ ID NO: 43256 - RNA, 22 nt, Human
cccaggcuaguaugauaucagu

SEQ ID NO: 43257 - RNA, 22 nt, Human
cccaggcuccuacuguauucug

SEQ ID NO: 43258 - RNA, 22 nt, Human
cccaggcuccugacucauucua

SEQ ID NO: 43259 - RNA, 22 nt, Human
cccaggcugaguuagagguguc

SEQ ID NO: 43260 - RNA, 22 nt, Human
cccaggcugaugggaugggcca

SEQ ID NO: 43261 - RNA, 22 nt, Human
cccaggcugccacgauuacugc

SEQ ID NO: 43262 - RNA, 22 nt, Human
cccaggcuggagugcaauggug

SEQ ID NO: 43263 - RNA, 22 nt, Human
cccaggcugucuguccuuugcu

SEQ ID NO: 43264 - RNA, 22 nt, Human
cccaggcugugcaaacuucaaa

SEQ ID NO: 43265 - RNA, 22 nt, Human
cccaggcuuuuaaguuagacag

SEQ ID NO: 43266 - RNA, 22 nt, Human
cccagggaagggcuaccugagg

SEQ ID NO: 43267 - RNA, 23 nt, Human
cccagggacacgaugacaccucc

SEQ ID NO: 43268 - RNA, 22 nt, Human
cccagggacagaugggcagcua

SEQ ID NO: 43269 - RNA, 20 nt, Human
cccagggaccugagcuccau

SEQ ID NO: 43270 - RNA, 22 nt, Human
cccagggacucgggauucuagg

SEQ ID NO: 43271 - RNA, 22 nt, Human
cccagggagagcgcggaggcgg

SEQ ID NO: 43272 - RNA, 22 nt, Human
cccagggaggcccaggcucugc

SEQ ID NO: 43273 - RNA, 22 nt, Human
cccagggcuuuucucacuagac

SEQ ID NO: 43274 - RNA, 22 nt, Human
cccagggguaaggcgcagcgug

SEQ ID NO: 43275 - RNA, 22 nt, Human
cccagggguucuagaccagcuu

SEQ ID NO: 43276 - RNA, 22 nt, Human
cccagggucccugcucucugug

SEQ ID NO: 43277 - RNA, 22 nt, Human
cccaggguccggauaacccugg

SEQ ID NO: 43278 - RNA, 19 nt, Human
cccaggguuuccucucucc

SEQ ID NO: 43279 - RNA, 22 nt, Human
cccagguaaggaugcuccucau

SEQ ID NO: 43280 - RNA, 23 nt, Human
cccagguagcccucuagagccug

SEQ ID NO: 43281 - RNA, 22 nt, Human
cccaggucuccugcuucccagg

SEQ ID NO: 43282 - RNA, 22 nt, Human
cccaggugcugcgugaagccuc

SEQ ID NO: 43283 - RNA, 22 nt, Human
cccagguggcagaagcugcagu

SEQ ID NO: 43284 - RNA, 20 nt, Human
cccaggugucugaagcucug

SEQ ID NO: 43285 - RNA, 22 nt, Human
cccagguguuuguggcagaggu

SEQ ID NO: 43286 - RNA, 22 nt, Human
cccagucauccugcaggugaaa

SEQ ID NO: 43287 - RNA, 22 nt, Human
cccagugcuaugccuauuacau

SEQ ID NO: 43288 - RNA, 22 nt, Human
cccaguggaaggaguagaagac

SEQ ID NO: 43289 - RNA, 22 nt, Human
cccaguggcuguccccaugggc

SEQ ID NO: 43290 - RNA, 22 nt, Human
cccaguggggagcuucugccuu

SEQ ID NO: 43291 - RNA, 22 nt, Human
cccagugucucuugugccuuuc

SEQ ID NO: 43292 - RNA, 22 nt, Human
cccagugucugggccugcaggg

SEQ ID NO: 43293 - RNA, 22 nt, Human
cccagugugaugagguugcuaa

SEQ ID NO: 43294 - RNA, 22 nt, Human
cccagugugguugugaauucug

SEQ ID NO: 43295 - RNA, 22 nt, Human
cccaguguuacgugacagccug

SEQ ID NO: 43296 - RNA, 22 nt, Human
cccaguuuucugauugaagagc

SEQ ID NO: 43297 - RNA, 22 nt, Human
cccauauacuuuuucuggucca

SEQ ID NO: 43298 - RNA, 22 nt, Human
cccaucacagacacuggguuau

SEQ ID NO: 43299 - RNA, 22 nt, Human
cccaucucagucgugcuaaggg

SEQ ID NO: 43300 - RNA, 22 nt, Human
cccaugaacugucuugcuguag

SEQ ID NO: 43301 - RNA, 22 nt, Human
cccaugagguggagguugcagu

SEQ ID NO: 43302 - RNA, 22 nt, Human
cccaugagugcugcucagaggc

SEQ ID NO: 43303 - RNA, 22 nt, Human
cccaugcugaguggccugagau

SEQ ID NO: 43304 - RNA, 22 nt, Human
cccauggguuuuccucccugcc

SEQ ID NO: 43305 - RNA, 18 nt, Human
cccauguugccagucagc

SEQ ID NO: 43306 - RNA, 22 nt, Human
cccauuuaaacacaagcuuuca

SEQ ID NO: 43307 - RNA, 22 nt, Human
cccauuuaucccaagguuacuc

SEQ ID NO: 43308 - RNA, 23 nt, Human
cccauuuucauguuaacuccugg

SEQ ID NO: 43309 - RNA, 22 nt, Human
ccccaaagcugaguucccgccu

SEQ ID NO: 43310 - RNA, 19 nt, Human
ccccaaaguuuagauguug

SEQ ID NO: 43311 - RNA, 22 nt, Human
ccccaccagcacccucucuauc

SEQ ID NO: 43312 - RNA, 22 nt, Human
ccccacccaccuaagagaaacu

SEQ ID NO: 43313 - RNA, 23 nt, Human
ccccacuaccgugaugugcgagg

SEQ ID NO: 43314 - RNA, 22 nt, Human
ccccacucucggccagauaggc

SEQ ID NO: 43315 - RNA, 22 nt, Human
ccccacuuugaguagcacuuga

SEQ ID NO: 43316 - RNA, 22 nt, Human
ccccagaaguuugcacaagaga

SEQ ID NO: 43317 - RNA, 22 nt, Human
ccccagcacuuggaguggggag

SEQ ID NO: 43318 - RNA, 22 nt, Human
ccccagccagcuuguaguagaa

SEQ ID NO: 43319 - RNA, 22 nt, Human
ccccagcugagauuugaggaga

SEQ ID NO: 43320 - RNA, 22 nt, Human
ccccaggagaaaucuuaaacua

SEQ ID NO: 43321 - RNA, 22 nt, Human
ccccaggccuguuggauggcgc

SEQ ID NO: 43322 - RNA, 22 nt, Human
ccccagggucaguguguggagg

SEQ ID NO: 43323 - RNA, 22 nt, Human
ccccagugguugcaacagcaga

SEQ ID NO: 43324 - RNA, 22 nt, Human
ccccaugaaguagggucucuga

SEQ ID NO: 43325 - RNA, 22 nt, Human
cccccaaaguuugcacggauaa

SEQ ID NO: 43326 - RNA, 22 nt, Human
cccccaccguguuccugcucgg

SEQ ID NO: 43327 - RNA, 22 nt, Human
cccccagcucugcugggucccg

SEQ ID NO: 43328 - RNA, 22 nt, Human
cccccaggcucugacacaggag

SEQ ID NO: 43329 - RNA, 22 nt, Human
cccccaggggcuccgccucgug

SEQ ID NO: 43330 - RNA, 22 nt, Human
cccccuggcaggcuggccucuc

SEQ ID NO: 43331 - RNA, 22 nt, Human
ccccgcccugcgcggggauaac

SEQ ID NO: 43332 - RNA, 22 nt, Human
ccccucccugaccugguugggc

SEQ ID NO: 43333 - RNA, 22 nt, Human
ccccuccugcagcaccuuucuu

SEQ ID NO: 43334 - RNA, 22 nt, Human
ccccucugcaaauagccaggcu

SEQ ID NO: 43335 - RNA, 22 nt, Human
ccccucuugugggcucagguca

SEQ ID NO: 43336 - RNA, 22 nt, Human
ccccuuccacagugcuuccuaa

SEQ ID NO: 43337 - RNA, 22 nt, Human
ccccuuccgucucuugaguguc

SEQ ID NO: 43338 - RNA, 21 nt, Human
ccuccaggagcagagcccuga

SEQ ID NO: 43339 - RNA, 22 nt, Human
ccuccaggauaagucagggccu

SEQ ID NO: 43340 - RNA, 20 nt, Human
ccuccaggcacacccaugug

SEQ ID NO: 43341 - RNA, 22 nt, Human
ccuccaggcugaauaucuagaa

SEQ ID NO: 43342 - RNA, 22 nt, Human
ccuccaggcugguuaucagcug

SEQ ID NO: 43343 - RNA, 22 nt, Human
ccuccagguguuacauaugacu

SEQ ID NO: 43344 - RNA, 17 nt, Human
ccucccacaccgcccug

SEQ ID NO: 43345 - RNA, 22 nt, Human
ccucccacauccuagcucugcu

SEQ ID NO: 43346 - RNA, 22 nt, Human
ccucccacauugaggacaugcu

SEQ ID NO: 43347 - RNA, 19 nt, Human
ccucccacggauuccuucc

SEQ ID NO: 43348 - RNA, 22 nt, Human
ccucccagaugugcccaaugga

SEQ ID NO: 43349 - RNA, 22 nt, Human
ccucccagugccggggccggcu

SEQ ID NO: 43350 - RNA, 22 nt, Human
ccuccccaugacccggugcugg

SEQ ID NO: 43351 - RNA, 22 nt, Human
ccuccccucagacagagacugg

SEQ ID NO: 43352 - RNA, 23 nt, Human
ccuccccuucccacagcugggug

SEQ ID NO: 43353 - RNA, 18 nt, Human
ccucccucauuuucccag

SEQ ID NO: 43354 - RNA, 22 nt, Human
ccucccuccauugccaucgucu

SEQ ID NO: 43355 - RNA, 22 nt, Human
ccucccuucaguagagcccaau

SEQ ID NO: 43356 - RNA, 22 nt, Human
ccucccuuuuggugucugcaua

SEQ ID NO: 43357 - RNA, 22 nt, Human
ccuccuggccugugcagagccc

SEQ ID NO: 43358 - RNA, 22 nt, Human
ccuccugggacaggcuggcaca

SEQ ID NO: 43359 - RNA, 22 nt, Human
ccuccugggacucauuagcacc

SEQ ID NO: 43360 - RNA, 23 nt, Human
ccuccugggcacaggccugaugg

SEQ ID NO: 43361 - RNA, 22 nt, Human
ccuccugggccuugcucuguga

SEQ ID NO: 43362 - RNA, 22 nt, Human
ccuccuggugggcgcuucuggc

SEQ ID NO: 43363 - RNA, 19 nt, Human
ccuccuguggcgggugggg

SEQ ID NO: 43364 - RNA, 22 nt, Human
ccuccuguugucaccaggcgug

SEQ ID NO: 43365 - RNA, 22 nt, Human
ccucgaccuccccaggcucagg

SEQ ID NO: 43366 - RNA, 22 nt, Human
ccucgagcagcgaccccuccac

SEQ ID NO: 43367 - RNA, 22 nt, Human
ccucgcugugugaccuugggug

SEQ ID NO: 43368 - RNA, 22 nt, Human
ccucggagcgggucagagaggg

SEQ ID NO: 43369 - RNA, 22 nt, Human
ccucggaggcggaggcugcagu

SEQ ID NO: 43370 - RNA, 22 nt, Human
ccucuacagggcauagcccaaa

SEQ ID NO: 43371 - RNA, 22 nt, Human
ccucuaggauguggcuggagga

SEQ ID NO: 43372 - RNA, 22 nt, Human
ccucuauguacacauuuccagc

SEQ ID NO: 43373 - RNA, 22 nt, Human
ccucuccagcggccucagggcc

SEQ ID NO: 43374 - RNA, 21 nt, Human
ccucucucauuguaaugaagu

SEQ ID NO: 43375 - RNA, 22 nt, Human
ccucucuguagcagcccccagu

SEQ ID NO: 43376 - RNA, 22 nt, Human
ccucugacuccuggacuugggg

SEQ ID NO: 43377 - RNA, 22 nt, Human
ccucugagagaaggccuucagc

SEQ ID NO: 43378 - RNA, 22 nt, Human
ccucugagcuggccuguggggc

SEQ ID NO: 43379 - RNA, 22 nt, Human
ccucugaggucauggacuuggc

SEQ ID NO: 43380 - RNA, 22 nt, Human
ccucugagucaugcgcauagga

SEQ ID NO: 43381 - RNA, 22 nt, Human
ccucugaguccucccugguugc

SEQ ID NO: 43382 - RNA, 22 nt, Human
ccucugaguccuuugggcucuc

SEQ ID NO: 43383 - RNA, 22 nt, Human
ccucugagugacagccuccucu

SEQ ID NO: 43384 - RNA, 22 nt, Human
ccucugcagcagagagccagag

SEQ ID NO: 43385 - RNA, 22 nt, Human
ccucugccaccucccacgaggc

SEQ ID NO: 43386 - RNA, 22 nt, Human
ccucugccugcacaucauccug

SEQ ID NO: 43387 - RNA, 22 nt, Human
ccucugcgcccuugaucagcca

SEQ ID NO: 43388 - RNA, 22 nt, Human
ccucuggagucagaccagcuug

SEQ ID NO: 43389 - RNA, 22 nt, Human
ccucuggccacaugggacauag

SEQ ID NO: 43390 - RNA, 22 nt, Human
gacuggaaagccuguccucaga

SEQ ID NO: 43391 - RNA, 22 nt, Human
gacuggauauugaguacugcaa

SEQ ID NO: 43392 - RNA, 22 nt, Human
gacugggacaggacagacaucu

SEQ ID NO: 43393 - RNA, 22 nt, Human
gacuggggaaggacccgagacc

SEQ ID NO: 43394 - RNA, 22 nt, Human
gacugggggcagccgcaccagu

SEQ ID NO: 43395 - RNA, 22 nt, Human
gacuggguccucugcuuauggu

SEQ ID NO: 43396 - RNA, 22 nt, Human
gacugguaagguauuggaauuc

SEQ ID NO: 43397 - RNA, 22 nt, Human
gacuguacgucauugaaggcca

SEQ ID NO: 43398 - RNA, 22 nt, Human
gacuguacuugagagaggaacu

SEQ ID NO: 43399 - RNA, 22 nt, Human
gacugucauucuagugcccaug

SEQ ID NO: 43400 - RNA, 22 nt, Human
gacuguggauagaacacugcag

SEQ ID NO: 43401 - RNA, 22 nt, Human
gacuguggcaggcucagcacug

SEQ ID NO: 43402 - RNA, 22 nt, Human
gacuguggucuguucuccaggu

SEQ ID NO: 43403 - RNA, 22 nt, Human
gacuguuagaauguaaaauaua

SEQ ID NO: 43404 - RNA, 22 nt, Human
gacuuagacccugucuuuauuc

SEQ ID NO: 43405 - RNA, 22 nt, Human
gacuucaaagcgugauaaagau

SEQ ID NO: 43406 - RNA, 22 nt, Human
gacuucaaaggucaaacaucgc

SEQ ID NO: 43407 - RNA, 17 nt, Human
gacuucaacuucugcug

SEQ ID NO: 43408 - RNA, 21 nt, Human
gacuucaugggucaaccaauu

SEQ ID NO: 43409 - RNA, 22 nt, Human
gacuugccugcacugagccuau

SEQ ID NO: 43410 - RNA, 22 nt, Human
gacuugggagucuucugagaug

SEQ ID NO: 43411 - RNA, 22 nt, Human
gacuugggcugagggccagcag

SEQ ID NO: 43412 - RNA, 22 nt, Human
gacuugggugucggggcagucu

SEQ ID NO: 43413 - RNA, 22 nt, Human
gacuuuaaaaugcuagaacagg

SEQ ID NO: 43414 - RNA, 22 nt, Human
gacuuuaaguaagucaaggagc

SEQ ID NO: 43415 - RNA, 22 nt, Human
gacuuuauccugccugaccacg

SEQ ID NO: 43416 - RNA, 22 nt, Human
gacuuuaugaagagaugaccaa

SEQ ID NO: 43417 - RNA, 22 nt, Human
gacuuuauucguuaacuguuaa

SEQ ID NO: 43418 - RNA, 22 nt, Human
gacuuucuguccagugauuucu

SEQ ID NO: 43419 - RNA, 22 nt, Human
gacuuugauuaaaucaagcaaa

SEQ ID NO: 43420 - RNA, 22 nt, Human
gacuuugccacugaccuccaac

SEQ ID NO: 43421 - RNA, 22 nt, Human
gacuuuggcuuuuauucuaggu

SEQ ID NO: 43422 - RNA, 22 nt, Human
gacuuuuagaauggugaggaau

SEQ ID NO: 43423 - RNA, 22 nt, Human
gagaaaagcgaaggaccuggag

SEQ ID NO: 43424 - RNA, 22 nt, Human
gagaaaauagcauguguaguau

SEQ ID NO: 43425 - RNA, 22 nt, Human
gagaaacaacacuugaugccuu

SEQ ID NO: 43426 - RNA, 19 nt, Human
gagaaaccccgucuuuagg

SEQ ID NO: 43427 - RNA, 22 nt, Human
gagaaacuaacaucugaaggug

SEQ ID NO: 43428 - RNA, 22 nt, Human
gagaaagaugaagaguggcguu

SEQ ID NO: 43429 - RNA, 22 nt, Human
gagaaagauguaggcugggagg

SEQ ID NO: 43430 - RNA, 18 nt, Human
gagaaagcagggaauguu

SEQ ID NO: 43431 - RNA, 22 nt, Human
gagaaagcuaaauaaguugauu

SEQ ID NO: 43432 - RNA, 22 nt, Human
gagaaaggcauuccuaugcaaa

SEQ ID NO: 43433 - RNA, 18 nt, Human
gagaaaguuugggcagaa

SEQ ID NO: 43434 - RNA, 22 nt, Human
gagaaauagauucaugguagau

SEQ ID NO: 43435 - RNA, 22 nt, Human
gagaaaugagugauucacuuuu

SEQ ID NO: 43436 - RNA, 22 nt, Human
gagaaaugcuagcuuaggaauc

SEQ ID NO: 43437 - RNA, 22 nt, Human
gagaaauuuugaguggcuuucu

SEQ ID NO: 43438 - RNA, 22 nt, Human
gagaacacuaaugguuucuuaa

SEQ ID NO: 43439 - RNA, 22 nt, Human
gagaacaggcucuggagucaga

SEQ ID NO: 43440 - RNA, 22 nt, Human
gagaacagugucauccuauaau

SEQ ID NO: 43441 - RNA, 22 nt, Human
gagaaccucuccacaagucugg

SEQ ID NO: 43442 - RNA, 22 nt, Human
gagaacucagacgcaggucaug

SEQ ID NO: 43443 - RNA, 22 nt, Human
gagaacugauuagcauuugcca

SEQ ID NO: 43444 - RNA, 22 nt, Human
gagaagcagguuuagcagacaa

SEQ ID NO: 43445 - RNA, 22 nt, Human
gagaagccgagucagcugagcc

SEQ ID NO: 43446 - RNA, 18 nt, Human
gagaagcugauugaaugc

SEQ ID NO: 43447 - RNA, 21 nt, Human
ccugagaucuggaguggcuuu

SEQ ID NO: 43448 - RNA, 22 nt, Human
ccugagauguguaacagauggu

SEQ ID NO: 43449 - RNA, 19 nt, Human
ccugagauuccuccuuuuc

SEQ ID NO: 43450 - RNA, 22 nt, Human
ccugagauuuguaauuuuugua

SEQ ID NO: 43451 - RNA, 22 nt, Human
ccugagcaaaggaaggaugacu

SEQ ID NO: 43452 - RNA, 22 nt, Human
ccugagcaaaggcccagaggga

SEQ ID NO: 43453 - RNA, 22 nt, Human
ccugagcagcucugaggggcga

SEQ ID NO: 43454 - RNA, 22 nt, Human
ccugagcaucagcgccuccuua

SEQ ID NO: 43455 - RNA, 22 nt, Human
ccugagcauuagacauccauca

SEQ ID NO: 43456 - RNA, 22 nt, Human
ccugagccgagcgcucuuucuc

SEQ ID NO: 43457 - RNA, 22 nt, Human
ccugagccucuugcacgcucag

SEQ ID NO: 43458 - RNA, 22 nt, Human
ccugagccugcagccgagcaga

SEQ ID NO: 43459 - RNA, 22 nt, Human
ccugagccuggcucaugcacuc

SEQ ID NO: 43460 - RNA, 21 nt, Human
ccugagccuguuuauccagaa

SEQ ID NO: 43461 - RNA, 22 nt, Human
ccugagcuagggaaggaagacc

SEQ ID NO: 43462 - RNA, 22 nt, Human
ccugagcuggaagagcuugugc

SEQ ID NO: 43463 - RNA, 22 nt, Human
ccugagcuggagacauuacaua

SEQ ID NO: 43464 - RNA, 22 nt, Human
ccugagcuggcagugaccugga

SEQ ID NO: 43465 - RNA, 22 nt, Human
ccugagcuugauccuucugucu

SEQ ID NO: 43466 - RNA, 22 nt, Human
ccugaggacagugugaccaugg

SEQ ID NO: 43467 - RNA, 22 nt, Human
ccugaggacaucagcaucaccu

SEQ ID NO: 43468 - RNA, 22 nt, Human
ccugaggagauuguggcugggg

SEQ ID NO: 43469 - RNA, 22 nt, Human
ccugaggcuuaaucugucccaa

SEQ ID NO: 43470 - RNA, 22 nt, Human
ccugagggaucuguggaauagc

SEQ ID NO: 43471 - RNA, 22 nt, Human
ccugagggcucagcccccagcc

SEQ ID NO: 43472 - RNA, 22 nt, Human
ccugaggggcugcaggccagcu

SEQ ID NO: 43473 - RNA, 22 nt, Human
ccugagggucaaggagcccuag

SEQ ID NO: 43474 - RNA, 22 nt, Human
ccugaggucacaacuugcuuau

SEQ ID NO: 43475 - RNA, 22 nt, Human
ccugaggucaugcauuuccaac

SEQ ID NO: 43476 - RNA, 22 nt, Human
ccugaggucaugguccaguguu

SEQ ID NO: 43477 - RNA, 22 nt, Human
ccugaggucuagagucagggug

SEQ ID NO: 43478 - RNA, 21 nt, Human
ccugagguuucuggccucugu

SEQ ID NO: 43479 - RNA, 22 nt, Human
ccugagucuguguuuuccuaag

SEQ ID NO: 43480 - RNA, 22 nt, Human
ccugagucuuucccauugcgcu

SEQ ID NO: 43481 - RNA, 22 nt, Human
ccugagugccaugagagcaccc

SEQ ID NO: 43482 - RNA, 22 nt, Human
ccugaguggagggauucugcag

SEQ ID NO: 43483 - RNA, 22 nt, Human
ccugaguggugcuaagcagaua

SEQ ID NO: 43484 - RNA, 22 nt, Human
ccugaguguaauaaugaaggca

SEQ ID NO: 43485 - RNA, 22 nt, Human
ccugaguucuuauuuccaguca

SEQ ID NO: 43486 - RNA, 19 nt, Human
ccugaguugggugaagaga

SEQ ID NO: 43487 - RNA, 22 nt, Human
ccugaucaaguuuucuggcucc

SEQ ID NO: 43488 - RNA, 22 nt, Human
ccugauggcugucugggccuga

SEQ ID NO: 43489 - RNA, 22 nt, Human
ccugauucugccacuacuagcc

SEQ ID NO: 43490 - RNA, 22 nt, Human
ccugcaagacuauuuaguucca

SEQ ID NO: 43491 - RNA, 22 nt, Human
ccugcaccaggcccagcauggu

SEQ ID NO: 43492 - RNA, 22 nt, Human
ccugcaccucugugcuuggaac

SEQ ID NO: 43493 - RNA, 22 nt, Human
ccugcaccuucaagaaaauaau

SEQ ID NO: 43494 - RNA, 22 nt, Human
ccugcacuucucacagcugcug

SEQ ID NO: 43495 - RNA, 22 nt, Human
ccugcagaaaggguccccagga

SEQ ID NO: 43496 - RNA, 22 nt, Human
ccugcagaggucaggccagaaa

SEQ ID NO: 43497 - RNA, 23 nt, Human
ccugcagcugccacgcccugcuc

SEQ ID NO: 43498 - RNA, 22 nt, Human
ccugcagggaaucgaggcagaa

SEQ ID NO: 43499 - RNA, 22 nt, Human
ccugcaggggagagacuucuag

SEQ ID NO: 43500 - RNA, 22 nt, Human
ccugcagguugcagaggcggaa

SEQ ID NO: 43501 - RNA, 22 nt, Human
ccugcagguuucccccggacgg

SEQ ID NO: 43502 - RNA, 22 nt, Human
ccugcaguuuguugugaccccg

SEQ ID NO: 43503 - RNA, 22 nt, Human
ccugcauguggucagcacuccu

SEQ ID NO: 43504 - RNA, 22 nt, Human
ccugccagauccccugagcuga

SEQ ID NO: 43505 - RNA, 22 nt, Human
ccugccagccagaucacucgcc

SEQ ID NO: 43506 - RNA, 22 nt, Human
ccugccagcccgcguucaugcc

SEQ ID NO: 43507 - RNA, 21 nt, Human
ccugccaggaaacugaguguc

SEQ ID NO: 43508 - RNA, 22 nt, Human
ccugccaggagcuggugcugca

SEQ ID NO: 43509 - RNA, 22 nt, Human
ccugccagggccuuggaagaaa

SEQ ID NO: 43510 - RNA, 22 nt, Human
ccugccagucacuaugucaccu

SEQ ID NO: 43511 - RNA, 22 nt, Human
ccugguccuuacgucauugcuu

SEQ ID NO: 43512 - RNA, 22 nt, Human
ccuggugcaccaaguaagggug

SEQ ID NO: 43513 - RNA, 22 nt, Human
ccugguggaaggugagugaggc

SEQ ID NO: 43514 - RNA, 22 nt, Human
ccugguggagaggggcggagcg

SEQ ID NO: 43515 - RNA, 22 nt, Human
ccugguggcgaauggugguagg

SEQ ID NO: 43516 - RNA, 22 nt, Human
ccuggugucuguuuacagcagc

SEQ ID NO: 43517 - RNA, 22 nt, Human
ccugguucagucuuucuaugcu

SEQ ID NO: 43518 - RNA, 22 nt, Human
ccugguuuaaugcucacuguug

SEQ ID NO: 43519 - RNA, 22 nt, Human
ccugguuucaggaacauaaucu

SEQ ID NO: 43520 - RNA, 22 nt, Human
ccuguaaauaguuucuucugac

SEQ ID NO: 43521 - RNA, 22 nt, Human
ccuguacagugaaugaauguga

SEQ ID NO: 43522 - RNA, 22 nt, Human
ccuguacaucugcucucauugc

SEQ ID NO: 43523 - RNA, 19 nt, Human
ccuguacauuauucucccc

SEQ ID NO: 43524 - RNA, 23 nt, Human
ccugucaacaaggccccacugua

SEQ ID NO: 43525 - RNA, 22 nt, Human
ccugucaccuagguacugagca

SEQ ID NO: 43526 - RNA, 22 nt, Human
ccugucaguugcugucagggau

SEQ ID NO: 43527 - RNA, 22 nt, Human
ccugucauacuaacguaguggg

SEQ ID NO: 43528 - RNA, 20 nt, Human
ccugucaucccagcauuuug

SEQ ID NO: 43529 - RNA, 22 nt, Human
ccuguccuccaagagcacaucu

SEQ ID NO: 43530 - RNA, 22 nt, Human
ccugucugaaucaugauuuccu

SEQ ID NO: 43531 - RNA, 22 nt, Human
ccugucugaggaggugcucuuu

SEQ ID NO: 43532 - RNA, 22 nt, Human
ccugucugcagauaucucaggu

SEQ ID NO: 43533 - RNA, 22 nt, Human
ccugucugcaugagugagcaua

SEQ ID NO: 43534 - RNA, 22 nt, Human
ccugucugcggaggaguggaag

SEQ ID NO: 43535 - RNA, 20 nt, Human
ccugucuggagacaaagaga

SEQ ID NO: 43536 - RNA, 22 nt, Human
ccugucugggcuugaguauuua

SEQ ID NO: 43537 - RNA, 18 nt, Human
ccugucugggguccccac

SEQ ID NO: 43538 - RNA, 22 nt, Human
ccugucuggugaggggguugca

SEQ ID NO: 43539 - RNA, 22 nt, Human
ccugugacgugucuccuggcac

SEQ ID NO: 43540 - RNA, 22 nt, Human
ccugugaggucaucugugguaa

SEQ ID NO: 43541 - RNA, 22 nt, Human
ccugugaguuuacauucuggcc

SEQ ID NO: 43542 - RNA, 22 nt, Human
ccugugcaauguugagguuuca

SEQ ID NO: 43543 - RNA, 22 nt, Human
ccugugcacuaucugcauuuuu

SEQ ID NO: 43544 - RNA, 22 nt, Human
ccugugcauccgguggucauug

SEQ ID NO: 43545 - RNA, 22 nt, Human
ccugugcaugccaggguacacc

SEQ ID NO: 43546 - RNA, 22 nt, Human
ccugugcauugaccacacucuc

SEQ ID NO: 43547 - RNA, 21 nt, Human
ccugugccaaaguguguuagg

SEQ ID NO: 43548 - RNA, 22 nt, Human
ccugugccagcugggcccugcc

SEQ ID NO: 43549 - RNA, 22 nt, Human
ccugugcccucugcauagcagc

SEQ ID NO: 43550 - RNA, 21 nt, Human
ccugugcuaucagcuuggguu

SEQ ID NO: 43551 - RNA, 20 nt, Human
ccugugcugcccucggggcc

SEQ ID NO: 43552 - RNA, 22 nt, Human
ccugugcuggacagggcugggc

SEQ ID NO: 43553 - RNA, 22 nt, Human
ccugugcugggugugagggaca

SEQ ID NO: 43554 - RNA, 22 nt, Human
ccuguggaccaggaggcagccc

SEQ ID NO: 43555 - RNA, 22 nt, Human
ccuguggagcuuucagcagcuc

SEQ ID NO: 43556 - RNA, 22 nt, Human
cuaaaauuaccuaccaguuuag

SEQ ID NO: 43557 - RNA, 22 nt, Human
cuaaacaagggauuauaauuga

SEQ ID NO: 43558 - RNA, 22 nt, Human
cuaaacaugaacuacauuuagg

SEQ ID NO: 43559 - RNA, 22 nt, Human
cuaaacauguagcuuuuguggu

SEQ ID NO: 43560 - RNA, 20 nt, Human
cuaaacucugcagauuuagu

SEQ ID NO: 43561 - RNA, 19 nt, Human
cuaaacuuaugugaccaca

SEQ ID NO: 43562 - RNA, 22 nt, Human
cuaaacuucuuggcaauuuuau

SEQ ID NO: 43563 - RNA, 22 nt, Human
cuaaacuuuguuuauacucuga

SEQ ID NO: 43564 - RNA, 22 nt, Human
cuaaacuuuuauaacauugaga

SEQ ID NO: 43565 - RNA, 22 nt, Human
cuaaagaauuuugcuugaccag

SEQ ID NO: 43566 - RNA, 22 nt, Human
cuaaagaucuacagaggcuuuu

SEQ ID NO: 43567 - RNA, 22 nt, Human
cuaaagauguacauuuuucucc

SEQ ID NO: 43568 - RNA, 22 nt, Human
cuaaaggcucagcauucuuuuc

SEQ ID NO: 43569 - RNA, 22 nt, Human
cuaaauacuagccuucagauuu

SEQ ID NO: 43570 - RNA, 22 nt, Human
cuaaaucuagucuuuacugauu

SEQ ID NO: 43571 - RNA, 22 nt, Human
cuaaaugacagguaccauagug

SEQ ID NO: 43572 - RNA, 22 nt, Human
cuaaaugauauuuugguuuccu

SEQ ID NO: 43573 - RNA, 22 nt, Human
cuaaaugucauggaguuguaga

SEQ ID NO: 43574 - RNA, 22 nt, Human
cuaaauuaucaugagaauuaug

SEQ ID NO: 43575 - RNA, 22 nt, Human
cuaaauuauuugcacauuagag

SEQ ID NO: 43576 - RNA, 18 nt, Human
cuaacagggaaaauagaa

SEQ ID NO: 43577 - RNA, 22 nt, Human
cuaaccuaguucaacaacuguc

SEQ ID NO: 43578 - RNA, 22 nt, Human
cuaacuuuagcuuagauuauca

SEQ ID NO: 43579 - RNA, 18 nt, Human
cuaagaggucguuucuca

SEQ ID NO: 43580 - RNA, 22 nt, Human
cuaagauaaaugcuuugaugaa

SEQ ID NO: 43581 - RNA, 21 nt, Human
cuaagcaaggagcagggguag

SEQ ID NO: 43582 - RNA, 20 nt, Human
cuaagcacuuugauaaacug

SEQ ID NO: 43583 - RNA, 22 nt, Human
cuaaggaugcauauguuuuguu

SEQ ID NO: 43584 - RNA, 22 nt, Human
cuaaggcagguccauuccagga

SEQ ID NO: 43585 - RNA, 22 nt, Human
cuaagggcuugcuggagccagg

SEQ ID NO: 43586 - RNA, 22 nt, Human
cuaauaauagagguggcauuug

SEQ ID NO: 43587 - RNA, 22 nt, Human
cuaauacucauuucuguaacuc

SEQ ID NO: 43588 - RNA, 22 nt, Human
cuaauguaaagcauuuguucag

SEQ ID NO: 43589 - RNA, 22 nt, Human
cuaauuauguuguuauaaucaa

SEQ ID NO: 43590 - RNA, 22 nt, Human
cuaauucucagcaugaacuggu

SEQ ID NO: 43591 - RNA, 22 nt, Human
cuaauucugaaacagugucaau

SEQ ID NO: 43592 - RNA, 22 nt, Human
cuaauucuguauuuggucauug

SEQ ID NO: 43593 - RNA, 22 nt, Human
cuacaaagaaaguauacuggac

SEQ ID NO: 43594 - RNA, 22 nt, Human
cuacaaagaauuucucuagcuc

SEQ ID NO: 43595 - RNA, 22 nt, Human
cuacaaagcucuucuacaggca

SEQ ID NO: 43596 - RNA, 22 nt, Human
cuacaaaguaccacagacuggg

SEQ ID NO: 43597 - RNA, 22 nt, Human
cuacaaugacagaauugaguag

SEQ ID NO: 43598 - RNA, 21 nt, Human
cuacacagcuuucuauaggaa

SEQ ID NO: 43599 - RNA, 22 nt, Human
cuacacaguucugccuaauggc

SEQ ID NO: 43600 - RNA, 22 nt, Human
cuacacugagagcucuucaggg

SEQ ID NO: 43601 - RNA, 22 nt, Human
cuacagaagccguggucaggaa

SEQ ID NO: 43602 - RNA, 22 nt, Human
cuacagaaguuucccuugcuua

SEQ ID NO: 43603 - RNA, 22 nt, Human
cuacagaaucuaccucaagcca

SEQ ID NO: 43604 - RNA, 22 nt, Human
cuacagaguucacaggauuuua

SEQ ID NO: 43605 - RNA, 22 nt, Human
cuacagcuggccuuggaaaacu

SEQ ID NO: 43606 - RNA, 22 nt, Human
cuacagguaugugcaugacauc

SEQ ID NO: 43607 - RNA, 22 nt, Human
cuacaggucaagcaguagcucu

SEQ ID NO: 43608 - RNA, 23 nt, Human
cuacagguuaauuuucaguggaa

SEQ ID NO: 43609 - RNA, 22 nt, Human
cuacagucuggcaggaauguua

SEQ ID NO: 43610 - RNA, 22 nt, Human
cuacagugucgugugguuucug

SEQ ID NO: 43611 - RNA, 22 nt, Human
cuacauaaauuuaucacagacu

SEQ ID NO: 43612 - RNA, 22 nt, Human
cuacaugaacucuuaagucaca

SEQ ID NO: 43613 - RNA, 22 nt, Human
cuacauguagguuuccuuaauu

SEQ ID NO: 43614 - RNA, 18 nt, Human
cuacauucauaggaaagg

SEQ ID NO: 43615 - RNA, 22 nt, Human
cuacauuuuucaccgagccucu

SEQ ID NO: 43616 - RNA, 22 nt, Human
cuacccagauccaggauggcua

SEQ ID NO: 43617 - RNA, 21 nt, Human
cuacccucacucccauuccuc

SEQ ID NO: 43618 - RNA, 22 nt, Human
cuaccgguccacgguuuaaaug

SEQ ID NO: 43619 - RNA, 22 nt, Human
cuaccugaaaagguugugguga

SEQ ID NO: 43620 - RNA, 22 nt, Human
cuaccugguacauagaaauguu

SEQ ID NO: 43621 - RNA, 22 nt, Human
cuacucugaaaacccagaaacu

SEQ ID NO: 43622 - RNA, 22 nt, Human
cuacugaugcuauacuucucag

SEQ ID NO: 43623 - RNA, 22 nt, Human
cuacuguuauuauuaauaguaa

SEQ ID NO: 43624 - RNA, 17 nt, Human
cuacuucuucuauucuu

SEQ ID NO: 43625 - RNA, 22 nt, Human
cuacuuuaacaauucgcaagaa

SEQ ID NO: 43626 - RNA, 19 nt, Human
cuacuuuauaauaugccuc

SEQ ID NO: 43627 - RNA, 20 nt, Human
cuagaacugagaaauuuaaa

SEQ ID NO: 43628 - RNA, 22 nt, Human
cuagaaguuggggcuagggaua

SEQ ID NO: 43629 - RNA, 22 nt, Human
cuagaauaucauaugaagagac

SEQ ID NO: 43630 - RNA, 22 nt, Human
cuagaauugcauucuaugaaua

SEQ ID NO: 43631 - RNA, 22 nt, Human
cuagagaaaauguuaauacagu

SEQ ID NO: 43632 - RNA, 22 nt, Human
cuagagaagaggcucagccagc

SEQ ID NO: 43633 - RNA, 18 nt, Human
cuagagaagguuacuaug

SEQ ID NO: 43634 - RNA, 22 nt, Human
cuagagaaucuuuuaagaagug

SEQ ID NO: 43635 - RNA, 22 nt, Human
cuagagcuauucaagguuuuau

SEQ ID NO: 43636 - RNA, 22 nt, Human
cuagauaagguggcuuggaauu

SEQ ID NO: 43637 - RNA, 22 nt, Human
cuagauccauuuucugucucug

SEQ ID NO: 43638 - RNA, 22 nt, Human
cuagaucugcccacugaaguuc

SEQ ID NO: 43639 - RNA, 22 nt, Human
cuagcacaguaugguaucagau

SEQ ID NO: 43640 - RNA, 22 nt, Human
cuagcacugagaauagugcaua

SEQ ID NO: 43641 - RNA, 22 nt, Human
cuagcagggauugggcacuggg

SEQ ID NO: 43642 - RNA, 22 nt, Human
cuagcaggucaaaccagcugau

SEQ ID NO: 43643 - RNA, 22 nt, Human
cuagccagacucaagggccacc

SEQ ID NO: 43644 - RNA, 22 nt, Human
cuagccagauuuaaagagagac

SEQ ID NO: 43645 - RNA, 22 nt, Human
cuagccugggauuugaacuuau

SEQ ID NO: 43646 - RNA, 22 nt, Human
cuagcuguaagagggauguggc

SEQ ID NO: 43647 - RNA, 19 nt, Human
cuagcuugucauuugugug

SEQ ID NO: 43648 - RNA, 22 nt, Human
cuagcuuuuuaugacaaucuug

SEQ ID NO: 43649 - RNA, 22 nt, Human
cuaggaccacuguaacaaagua

SEQ ID NO: 43650 - RNA, 22 nt, Human
cuaggaggcgggggcugcagua

SEQ ID NO: 43651 - RNA, 22 nt, Human
cuaggcaaaguauuaaugagug

SEQ ID NO: 43652 - RNA, 22 nt, Human
cuaggcacucacguggcuuuag

SEQ ID NO: 43653 - RNA, 22 nt, Human
cuaggcccaugagguuugcugg

SEQ ID NO: 43654 - RNA, 22 nt, Human
cuaggcuggagugcaguggcau

SEQ ID NO: 43655 - RNA, 22 nt, Human
cuaggcuguaaagagcuaggag

SEQ ID NO: 43656 - RNA, 22 nt, Human
cuaggcuugcaggguggacaug

SEQ ID NO: 43657 - RNA, 17 nt, Human
cuaggcuuggcagcucg

SEQ ID NO: 43658 - RNA, 22 nt, Human
cuagggaaaguggacauggcuu

SEQ ID NO: 43659 - RNA, 22 nt, Human
cuagggaccucagcuccuggag

SEQ ID NO: 43660 - RNA, 22 nt, Human
cuagggagacucgcaggacuca

SEQ ID NO: 43661 - RNA, 22 nt, Human
cuagggaguggcagagcuggga

SEQ ID NO: 43662 - RNA, 22 nt, Human
cuagggcaaugacucaaagcgg

SEQ ID NO: 43663 - RNA, 23 nt, Human
cuagggcaguauuucacagacac

SEQ ID NO: 43664 - RNA, 22 nt, Human
cuagggcuccaaagcugagaag

SEQ ID NO: 43665 - RNA, 22 nt, Human
agcagagccugggcuaggggug

SEQ ID NO: 43666 - RNA, 22 nt, Human
agcagagcuauucuugugcaau

SEQ ID NO: 43667 - RNA, 16 nt, Human
agcagaggugagugaa

SEQ ID NO: 43668 - RNA, 22 nt, Human
agcagagucugugugcacuuua

SEQ ID NO: 43669 - RNA, 22 nt, Human
agcagagugccccaucacaagg

SEQ ID NO: 43670 - RNA, 22 nt, Human
agcagaguuucucaacaucagc

SEQ ID NO: 43671 - RNA, 22 nt, Human
agcagauaggacauuucauucu

SEQ ID NO: 43672 - RNA, 22 nt, Human
agcagauaguagaacauguaua

SEQ ID NO: 43673 - RNA, 22 nt, Human
agcagaugaaucccagauaaag

SEQ ID NO: 43674 - RNA, 22 nt, Human
agcagauggugucaugggaugg

SEQ ID NO: 43675 - RNA, 22 nt, Human
agcagaugugucucugcacugu

SEQ ID NO: 43676 - RNA, 22 nt, Human
agcagauguucccuggucccuu

SEQ ID NO: 43677 - RNA, 22 nt, Human
agcagcaacugcuagaguggca

SEQ ID NO: 43678 - RNA, 19 nt, Human
agcagcaacuguugauuca

SEQ ID NO: 43679 - RNA, 18 nt, Human
agcagcaauuugggauga

SEQ ID NO: 43680 - RNA, 22 nt, Human
agcagcacgaguccacaaaucc

SEQ ID NO: 43681 - RNA, 22 nt, Human
agcagcagaagguuugcaccca

SEQ ID NO: 43682 - RNA, 22 nt, Human
agcagcagagcucuggucugca

SEQ ID NO: 43683 - RNA, 22 nt, Human
agcagcagaggucagaaaggua

SEQ ID NO: 43684 - RNA, 19 nt, Human
agcagcagcaccagggauu

SEQ ID NO: 43685 - RNA, 22 nt, Human
agcagcaggaggccauugucuu

SEQ ID NO: 43686 - RNA, 23 nt, Human
agcagcaggagguauugauaagg

SEQ ID NO: 43687 - RNA, 22 nt, Human
agcagcagggacaaaggaacag

SEQ ID NO: 43688 - RNA, 22 nt, Human
agcagcaggguguaauugggca

SEQ ID NO: 43689 - RNA, 22 nt, Human
agcagcaggugaccucgaugcc

SEQ ID NO: 43690 - RNA, 22 nt, Human
agcagcaggugcuucuggaucu

SEQ ID NO: 43691 - RNA, 22 nt, Human
agcagcaguugcugacguucua

SEQ ID NO: 43692 - RNA, 22 nt, Human
agcagcauauugugucuucaua

SEQ ID NO: 43693 - RNA, 21 nt, Human
agcagcaucagccucaccuga

SEQ ID NO: 43694 - RNA, 22 nt, Human
agcagccaauuggaggaugaag

SEQ ID NO: 43695 - RNA, 22 nt, Human
agcagccacacgccuccuucuc

SEQ ID NO: 43696 - RNA, 22 nt, Human
agcagccacagucugggacagg

SEQ ID NO: 43697 - RNA, 16 nt, Human
agcagccagcacugga

SEQ ID NO: 43698 - RNA, 22 nt, Human
agcagccauagauagcaugcaa

SEQ ID NO: 43699 - RNA, 22 nt, Human
agcagccauccuuagagaaaga

SEQ ID NO: 43700 - RNA, 19 nt, Human
agcagccaucgaccaugga

SEQ ID NO: 43701 - RNA, 21 nt, Human
agcagccauuucacagagacu

SEQ ID NO: 43702 - RNA, 22 nt, Human
agcagcccagauaaagcucagg

SEQ ID NO: 43703 - RNA, 23 nt, Human
agcagcccagaugccuuccaucc

SEQ ID NO: 43704 - RNA, 22 nt, Human
agcagccccucggcgggugcgc

SEQ ID NO: 43705 - RNA, 22 nt, Human
agcagcccuagggauugcuguu

SEQ ID NO: 43706 - RNA, 22 nt, Human
agcagccguauuauggugguuu

SEQ ID NO: 43707 - RNA, 22 nt, Human
agcagcuaaguagcgcaguuaa

SEQ ID NO: 43708 - RNA, 22 nt, Human
agcagcuagaauagugccuggu

SEQ ID NO: 43709 - RNA, 22 nt, Human
agcagcucaaagccugcaagga

SEQ ID NO: 43710 - RNA, 22 nt, Human
agcagcucaacagugucucuau

SEQ ID NO: 43711 - RNA, 22 nt, Human
agcagcucaagacuuaaauuug

SEQ ID NO: 43712 - RNA, 19 nt, Human
agcagcucagggaggcacc

SEQ ID NO: 43713 - RNA, 22 nt, Human
agcagcuccugccaugagugcu

SEQ ID NO: 43714 - RNA, 22 nt, Human
agcagcugaaaggcaaacuucu

SEQ ID NO: 43715 - RNA, 22 nt, Human
agcagcugaccagugaguccug

SEQ ID NO: 43716 - RNA, 22 nt, Human
agcagcugagccccagcuguga

SEQ ID NO: 43717 - RNA, 21 nt, Human
agcagcugcaguuucuaucug

SEQ ID NO: 43718 - RNA, 23 nt, Human
agcagcuggggugcucuuuuguc

SEQ ID NO: 43719 - RNA, 22 nt, Human
agcagcuggguccggcggagca

SEQ ID NO: 43720 - RNA, 22 nt, Human
agcagcuggugagcaagcucag

SEQ ID NO: 43721 - RNA, 22 nt, Human
agcagcuguacuuucaucuguu

SEQ ID NO: 43722 - RNA, 18 nt, Human
agcagcugucagaaugcc

SEQ ID NO: 43723 - RNA, 19 nt, Human
agcagcuuaauuuuguagc

SEQ ID NO: 43724 - RNA, 22 nt, Human
agcagcuuccugcucuucgccu

SEQ ID NO: 43725 - RNA, 18 nt, Human
agcagcuuugugcuugau

SEQ ID NO: 43726 - RNA, 22 nt, Human
agcaggaccaagaaggggaaaa

SEQ ID NO: 43727 - RNA, 21 nt, Human
agcaggaggcagucacagcuc

SEQ ID NO: 43728 - RNA, 22 nt, Human
agcaggaggguuuuguagaguc

SEQ ID NO: 43729 - RNA, 22 nt, Human
agcaggaguguccccuggcugu

SEQ ID NO: 43730 - RNA, 22 nt, Human
agcaggcaagcgugaguucucu

SEQ ID NO: 43731 - RNA, 22 nt, Human
agcaggcaccagggcucguccu

SEQ ID NO: 43732 - RNA, 22 nt, Human
agcaggcacuaugccaggaucu

SEQ ID NO: 43733 - RNA, 22 nt, Human
agcaggcaggcugccagugaau

SEQ ID NO: 43734 - RNA, 22 nt, Human
agcaggcaguguagagccuuca

SEQ ID NO: 43735 - RNA, 22 nt, Human
agcaggccacugcagcuggagc

SEQ ID NO: 43736 - RNA, 22 nt, Human
agcaggcccaagcuggggggaa

SEQ ID NO: 43737 - RNA, 21 nt, Human
agcaggcccaauggagggggc

SEQ ID NO: 43738 - RNA, 22 nt, Human
agcaggccugccaccucggggu

SEQ ID NO: 43739 - RNA, 20 nt, Human
agcaggccuuggggagagga

SEQ ID NO: 43740 - RNA, 22 nt, Human
agcaggcuacuccuguguucgu

SEQ ID NO: 43741 - RNA, 22 nt, Human
agcaggcuccuuccuucucugg

SEQ ID NO: 43742 - RNA, 22 nt, Human
agcaggcugggcaauaugggca

SEQ ID NO: 43743 - RNA, 22 nt, Human
agcaggcuuguuaugucugaga

SEQ ID NO: 43744 - RNA, 21 nt, Human
agcaggcuuuggaguggggcu

SEQ ID NO: 43745 - RNA, 22 nt, Human
agcagggaagccuccagaaccu

SEQ ID NO: 43746 - RNA, 19 nt, Human
agcagggacauggaacuuu

SEQ ID NO: 43747 - RNA, 22 nt, Human
agcagggaggcccagggcacug

SEQ ID NO: 43748 - RNA, 17 nt, Human
agcagggagucaaggga

SEQ ID NO: 43749 - RNA, 19 nt, Human
agcagggagugguuguggg

SEQ ID NO: 43750 - RNA, 22 nt, Human
agcagggcagcugaugcgcacg

SEQ ID NO: 43751 - RNA, 22 nt, Human
agcagggcagugaucagaaagg

SEQ ID NO: 43752 - RNA, 18 nt, Human
agcagggcauuuugccau

SEQ ID NO: 43753 - RNA, 22 nt, Human
agcagggcuccauuucacugcc

SEQ ID NO: 43754 - RNA, 22 nt, Human
agcagggcuggauuuggcaaga

SEQ ID NO: 43755 - RNA, 22 nt, Human
agcagggcuggggcacgagcca

SEQ ID NO: 43756 - RNA, 22 nt, Human
agcagggcuguguagguaauga

SEQ ID NO: 43757 - RNA, 22 nt, Human
agcagggguaacagaaggaaag

SEQ ID NO: 43758 - RNA, 22 nt, Human
agcaggggucucugcuaaugaa

SEQ ID NO: 43759 - RNA, 22 nt, Human
agcaggguuccaggaguugcag

SEQ ID NO: 43760 - RNA, 23 nt, Human
agcagguagguugaaauuuuccu

SEQ ID NO: 43761 - RNA, 22 nt, Human
agcaggugaauuccuggaugug

SEQ ID NO: 43762 - RNA, 22 nt, Human
agcaggugacagggcuguggug

SEQ ID NO: 43763 - RNA, 22 nt, Human
agaaaucuauguuuugguuaga

SEQ ID NO: 43764 - RNA, 22 nt, Human
agaaaugcagucucgucaaaag

SEQ ID NO: 43765 - RNA, 22 nt, Human
agaaaugcauuagcacauauag

SEQ ID NO: 43766 - RNA, 22 nt, Human
agaaauguccagggcuaggauc

SEQ ID NO: 43767 - RNA, 20 nt, Human
agaaaugugaaaggcugagu

SEQ ID NO: 43768 - RNA, 22 nt, Human
agaaauguuacaguuguuauuu

SEQ ID NO: 43769 - RNA, 22 nt, Human
agaaauuccuaagguacacaag

SEQ ID NO: 43770 - RNA, 22 nt, Human
agaacaauguuaaauuauuaag

SEQ ID NO: 43771 - RNA, 22 nt, Human
agaacaauugccccaaagcuug

SEQ ID NO: 43772 - RNA, 22 nt, Human
agaacacucuccugaaaauuaa

SEQ ID NO: 43773 - RNA, 22 nt, Human
agaacagaugugggcagaccug

SEQ ID NO: 43774 - RNA, 22 nt, Human
agaacagcacaggaaguguauc

SEQ ID NO: 43775 - RNA, 22 nt, Human
agaauucuguucuucgggugug

SEQ ID NO: 43776 - RNA, 20 nt, Human
agaauucuuacccuuugaug

SEQ ID NO: 43777 - RNA, 22 nt, Human
agaauugguuggggaaugugga

SEQ ID NO: 43778 - RNA, 22 nt, Human
agaauuguaagcaauuugauua

SEQ ID NO: 43779 - RNA, 22 nt, Human
agaauuguaauaauaauagcau

SEQ ID NO: 43780 - RNA, 22 nt, Human
agaauuguucuguagcuuggcu

SEQ ID NO: 43781 - RNA, 19 nt, Human
agaauuguuuugagacccc

SEQ ID NO: 43782 - RNA, 22 nt, Human
agaauuuaggaugcaugugaau

SEQ ID NO: 43783 - RNA, 22 nt, Human
agacaaauaacuuuuuaugucc

SEQ ID NO: 43784 - RNA, 22 nt, Human
agacaaauaagugcugggauuu

SEQ ID NO: 43785 - RNA, 22 nt, Human
agacaaauggaguaugagcaac

SEQ ID NO: 43786 - RNA, 22 nt, Human
agacaaaugguaauuaugucua

SEQ ID NO: 43787 - RNA, 22 nt, Human
agacaaauugggacauuguguu

SEQ ID NO: 43788 - RNA, 22 nt, Human
agacaacaucuaguuuggugga

SEQ ID NO: 43789 - RNA, 22 nt, Human
agacaaggaauguagcuuacuc

SEQ ID NO: 43790 - RNA, 19 nt, Human
agacaaguuuccagaagcc

SEQ ID NO: 43791 - RNA, 22 nt, Human
agacaauauauaauuuuaguug

SEQ ID NO: 43792 - RNA, 22 nt, Human
agacaauauguauauuaagaau

SEQ ID NO: 43793 - RNA, 22 nt, Human
agacaaugcaagcagggagugg

SEQ ID NO: 43794 - RNA, 22 nt, Human
agacaauggagagcagaguacu

SEQ ID NO: 43795 - RNA, 22 nt, Human
agacaauggagggaaauacuuc

SEQ ID NO: 43796 - RNA, 22 nt, Human
agacaauggcuaaguaaccugu

SEQ ID NO: 43797 - RNA, 22 nt, Human
agacaaugucaaggugaucauc

SEQ ID NO: 43798 - RNA, 22 nt, Human
agacaauuagcacaucacgggg

SEQ ID NO: 43799 - RNA, 22 nt, Human
agacaauuguucuaaguaaaaa

SEQ ID NO: 43800 - RNA, 19 nt, Human
agacacacuugauaugugu

SEQ ID NO: 43801 - RNA, 22 nt, Human
agacacagcugcaggagguggg

SEQ ID NO: 43802 - RNA, 22 nt, Human
agacacagguguaauuucugcu

SEQ ID NO: 43803 - RNA, 22 nt, Human
agacacagugcugggugcugag

SEQ ID NO: 43804 - RNA, 23 nt, Human
agacacauaggagcagcuauugg

SEQ ID NO: 43805 - RNA, 19 nt, Human
agacacaucacauuucucc

SEQ ID NO: 43806 - RNA, 17 nt, Human
agacacugagccaagua

SEQ ID NO: 43807 - RNA, 22 nt, Human
agacacugccacuucuguuccc

SEQ ID NO: 43808 - RNA, 22 nt, Human
agacacuggcacuggggaagcc

SEQ ID NO: 43809 - RNA, 21 nt, Human
agacacugguuuagcauucau

SEQ ID NO: 43810 - RNA, 23 nt, Human
agacacuguaaagaauugcaguu

SEQ ID NO: 43811 - RNA, 22 nt, Human
agacacuuggcagagagcuguu

SEQ ID NO: 43812 - RNA, 22 nt, Human
agacagaacagaauaauuguug

SEQ ID NO: 43813 - RNA, 20 nt, Human
agacagaaucagagauaaag

SEQ ID NO: 43814 - RNA, 22 nt, Human
agacagaauuugucagauaaau

SEQ ID NO: 43815 - RNA, 22 nt, Human
agacagacaaaauuccugccug

SEQ ID NO: 43816 - RNA, 22 nt, Human
agacagaccauggcuauucaga

SEQ ID NO: 43817 - RNA, 22 nt, Human
agacagacugguuugaauuggu

SEQ ID NO: 43818 - RNA, 23 nt, Human
agacagaggcugaggcuggccgc

SEQ ID NO: 43819 - RNA, 21 nt, Human
agacagagugcagucuacaua

SEQ ID NO: 43820 - RNA, 22 nt, Human
agacagcuagggcugcagggac

SEQ ID NO: 43821 - RNA, 18 nt, Human
agacagcugaaaggaaaa

SEQ ID NO: 43822 - RNA, 22 nt, Human
agacagcugggaaauggagugu

SEQ ID NO: 43823 - RNA, 22 nt, Human
agacaggagagggaacugccgg

SEQ ID NO: 43824 - RNA, 22 nt, Human
agacaggaugcauacucuuggu

SEQ ID NO: 43825 - RNA, 22 nt, Human
agacagggccacucauccucac

SEQ ID NO: 43826 - RNA, 22 nt, Human
agacagguaaauagagaugcug

SEQ ID NO: 43827 - RNA, 17 nt, Human
agacagguuauaguuga

SEQ ID NO: 43828 - RNA, 22 nt, Human
agacaguaugauauaugaauac

SEQ ID NO: 43829 - RNA, 22 nt, Human
agacagugaggcagagcuuccg

SEQ ID NO: 43830 - RNA, 22 nt, Human
agacagugauggacaggcagac

SEQ ID NO: 43831 - RNA, 22 nt, Human
agacagugcuaucccaucugug

SEQ ID NO: 43832 - RNA, 22 nt, Human
agacaguggaucgggaugcacu

SEQ ID NO: 43833 - RNA, 23 nt, Human
agacaguggccgagagguacuag

SEQ ID NO: 43834 - RNA, 20 nt, Human
agacaguggggagcuccuag

SEQ ID NO: 43835 - RNA, 22 nt, Human
agacauaaacuuacugaaauac

SEQ ID NO: 43836 - RNA, 19 nt, Human
agacauaaagaguuugcaa

SEQ ID NO: 43837 - RNA, 22 nt, Human
agacauagauaggcacugauug

SEQ ID NO: 43838 - RNA, 22 nt, Human
agacauauuggcuugcuuuaau

SEQ ID NO: 43839 - RNA, 22 nt, Human
agacauccuucaagugauaugu

SEQ ID NO: 43840 - RNA, 22 nt, Human
agacaucuaccuuucauucaaa

SEQ ID NO: 43841 - RNA, 22 nt, Human
agacaugaaaauuccaaacauc

SEQ ID NO: 43842 - RNA, 19 nt, Human
agacaugagacacaggaug

SEQ ID NO: 43843 - RNA, 22 nt, Human
agacaugcaauaaugugcacuc

SEQ ID NO: 43844 - RNA, 22 nt, Human
agacaugcuuggaggagaagga

SEQ ID NO: 43845 - RNA, 22 nt, Human
agacaugguugagaauaaagug

SEQ ID NO: 43846 - RNA, 22 nt, Human
agacauguccacaaagcauuca

SEQ ID NO: 43847 - RNA, 22 nt, Human
agacauuaugcugagugaaaga

SEQ ID NO: 43848 - RNA, 22 nt, Human
agacauuauggcuuucacuggg

SEQ ID NO: 43849 - RNA, 22 nt, Human
agacauuguuggccuauccucu

SEQ ID NO: 43850 - RNA, 22 nt, Human
agacauuuccugugaaccuacu

SEQ ID NO: 43851 - RNA, 22 nt, Human
agacauuuggagccaacuuucc

SEQ ID NO: 43852 - RNA, 22 nt, Human
agacauuuugauaccccuaccg

SEQ ID NO: 43853 - RNA, 22 nt, Human
agacauuuugcaauggguagcu

SEQ ID NO: 43854 - RNA, 22 nt, Human
agaccacaggcaugcacagagc

SEQ ID NO: 43855 - RNA, 22 nt, Human
agaccacuggccuccugcagac

SEQ ID NO: 43856 - RNA, 22 nt, Human
agaccagugaguaggccuuaga

SEQ ID NO: 43857 - RNA, 22 nt, Human
agaccaugaccugccacuaagc

SEQ ID NO: 43858 - RNA, 22 nt, Human
agaccauggccauccuaggaaa

SEQ ID NO: 43859 - RNA, 22 nt, Human
agacccagagggcugcugggag

SEQ ID NO: 43860 - RNA, 22 nt, Human
agacccaggauuggggcugccg

SEQ ID NO: 43861 - RNA, 22 nt, Human
agacccccuuuaauggaagugc

SEQ ID NO: 43862 - RNA, 22 nt, Human
agacccuucauguaguucccca

SEQ ID NO: 43863 - RNA, 22 nt, Human
agacccuugcaugaauuaauuc

SEQ ID NO: 43864 - RNA, 22 nt, Human
agacccuuugggucugugcagg

SEQ ID NO: 43865 - RNA, 22 nt, Human
agaccucuggauagaugugagg

SEQ ID NO: 43866 - RNA, 22 nt, Human
agaccuggagaccugaguggua

SEQ ID NO: 43867 - RNA, 22 nt, Human
agaccuggaugugagggaagua

SEQ ID NO: 43868 - RNA, 22 nt, Human
agaccuggauuccaauccuacc

SEQ ID NO: 43869 - RNA, 22 nt, Human
agaccugggugcccugugcuuu

SEQ ID NO: 43870 - RNA, 22 nt, Human
agaccuuuauuucaugauagga

SEQ ID NO: 43871 - RNA, 22 nt, Human
agacgagggccuggcacacagu

SEQ ID NO: 43872 - RNA, 22 nt, Human
agacuaaauaguuacagguagg

SEQ ID NO: 43873 - RNA, 22 nt, Human
agacuacagaauggcauuguuu

SEQ ID NO: 43874 - RNA, 22 nt, Human
agacuagagagauauaauaugg

SEQ ID NO: 43875 - RNA, 22 nt, Human
agacucugauaagcaacucuug

SEQ ID NO: 43876 - RNA, 22 nt, Human
agacucugggauuuugaaagca

SEQ ID NO: 43877 - RNA, 22 nt, Human
agacucugugcuccuugcuuuc

SEQ ID NO: 43878 - RNA, 22 nt, Human
agacucuuggagaagagcuaua

SEQ ID NO: 43879 - RNA, 22 nt, Human
agacugaaacaaucugcaggca

SEQ ID NO: 43880 - RNA, 22 nt, Human
agacugaagcaauucaaccagu

SEQ ID NO: 43881 - RNA, 20 nt, Human
agacugaagccaugugacua

SEQ ID NO: 43882 - RNA, 22 nt, Human
agacugaagcuccuugaggaca

SEQ ID NO: 43883 - RNA, 22 nt, Human
agccaggccuuuucucaagguu

SEQ ID NO: 43884 - RNA, 22 nt, Human
agaugaaagauuuuuauagaga

SEQ ID NO: 43885 - RNA, 18 nt, Human
agaugaaagcaaaugaca

SEQ ID NO: 43886 - RNA, 23 nt, Human
agaugaaagcuucccaucacagu

SEQ ID NO: 43887 - RNA, 22 nt, Human
agaugaagacucaggagcaggu

SEQ ID NO: 43888 - RNA, 22 nt, Human
agaugacagcuacgggaugaaa

SEQ ID NO: 43889 - RNA, 22 nt, Human
agaugauggccauguccucucc

SEQ ID NO: 43890 - RNA, 22 nt, Human
agaugcagaaaaacuaagugau

SEQ ID NO: 43891 - RNA, 22 nt, Human
agaugcagaguuugcuguggac

SEQ ID NO: 43892 - RNA, 21 nt, Human
agaugcagugacccacugggg

SEQ ID NO: 43893 - RNA, 21 nt, Human
agaugcaguuaugagaugcag

SEQ ID NO: 43894 - RNA, 22 nt, Human
agaugcaugcuuaauuagcaca

SEQ ID NO: 43895 - RNA, 22 nt, Human
agaugcauggaaaucucauuac

SEQ ID NO: 43896 - RNA, 22 nt, Human
agaugcugaagcugaggcaaca

SEQ ID NO: 43897 - RNA, 22 nt, Human
agaugcugauugaauagauuuc

SEQ ID NO: 43898 - RNA, 22 nt, Human
agaugcuggauggaaaaugauc

SEQ ID NO: 43899 - RNA, 22 nt, Human
agaugcugggaggcugagugca

SEQ ID NO: 43900 - RNA, 22 nt, Human
agaugcuuacuaugguuguaug

SEQ ID NO: 43901 - RNA, 22 nt, Human
agaugcuuuccugauauuuaug

SEQ ID NO: 43902 - RNA, 22 nt, Human
agauggaggaaggcugaacuca

SEQ ID NO: 43903 - RNA, 17 nt, Human
agauggcaggaggcaga

SEQ ID NO: 43904 - RNA, 22 nt, Human
agauggccccaggugcccaggg

SEQ ID NO: 43905 - RNA, 22 nt, Human
agauggcuauagauagccuuuc

SEQ ID NO: 43906 - RNA, 22 nt, Human
agauggcuccaguguccagagg

SEQ ID NO: 43907 - RNA, 22 nt, Human
agauggcucuuugaaggggaau

SEQ ID NO: 43908 - RNA, 22 nt, Human
agauggcugauuaacuccaugg

SEQ ID NO: 43909 - RNA, 22 nt, Human
agaugggcgcgcugcucugaug

SEQ ID NO: 43910 - RNA, 22 nt, Human
agauggguugagaacacaugcu

SEQ ID NO: 43911 - RNA, 22 nt, Human
agagagcugacuuuggagucag

SEQ ID NO: 43912 - RNA, 22 nt, Human
agagaggcgaguuaccugugcu

SEQ ID NO: 43913 - RNA, 22 nt, Human
agagagggaauauuugggguau

SEQ ID NO: 43914 - RNA, 22 nt, Human
agagauaguguauuaguugggc

SEQ ID NO: 43915 - RNA, 22 nt, Human
agagauauuauuuaccaaguua

SEQ ID NO: 43916 - RNA, 22 nt, Human
agagaucaguuaaaaucuuuuu

SEQ ID NO: 43917 - RNA, 22 nt, Human
agagauccuucaaucuaguuuu

SEQ ID NO: 43918 - RNA, 22 nt, Human
agagaucucugaagcugcugcu

SEQ ID NO: 43919 - RNA, 22 nt, Human
agagaugaaaaguggagacugg

SEQ ID NO: 43920 - RNA, 22 nt, Human
agagaugaacauaaaacaagga

SEQ ID NO: 43921 - RNA, 22 nt, Human
agagaugccaccuuuuugcugu

SEQ ID NO: 43922 - RNA, 22 nt, Human
agagaugcccuugaaaggauua

SEQ ID NO: 43923 - RNA, 22 nt, Human
agagauggagagcacuggggcu

SEQ ID NO: 43924 - RNA, 22 nt, Human
agagaugggaaggcagacuuca

SEQ ID NO: 43925 - RNA, 22 nt, Human
agagauguagcaaagaaccaca

SEQ ID NO: 43926 - RNA, 22 nt, Human
agagauguaugcauuugucaca

SEQ ID NO: 43927 - RNA, 22 nt, Human
agagauguucauucagcauguu

SEQ ID NO: 43928 - RNA, 22 nt, Human
agagauugugcuacucacccaa

SEQ ID NO: 43929 - RNA, 20 nt, Human
agagauuuuaguagccacag

SEQ ID NO: 43930 - RNA, 22 nt, Human
agagcaaagggacauggaagag

SEQ ID NO: 43931 - RNA, 22 nt, Human
agagcaaauagagaagccagcu

SEQ ID NO: 43932 - RNA, 21 nt, Human
agagcaaguuaaggcauuaau

SEQ ID NO: 43933 - RNA, 22 nt, Human
agagcaauggcauccagcugau

SEQ ID NO: 43934 - RNA, 22 nt, Human
agagcacaaauuaguuggucuu

SEQ ID NO: 43935 - RNA, 22 nt, Human
agagcacaaauuuuaaggaggc

SEQ ID NO: 43936 - RNA, 22 nt, Human
agagcacagaagaauaggugcu

SEQ ID NO: 43937 - RNA, 22 nt, Human
agagcacaggugcuggagccca

SEQ ID NO: 43938 - RNA, 22 nt, Human
agagcacuuucgagagccggag

SEQ ID NO: 43939 - RNA, 22 nt, Human
agagcagacauccuugucuugu

SEQ ID NO: 43940 - RNA, 22 nt, Human
agagcagcguuuguggaacacu

SEQ ID NO: 43941 - RNA, 22 nt, Human
agagcauccaucggccaggacc

SEQ ID NO: 43942 - RNA, 22 nt, Human
agagcauccugguuuuaugaag

SEQ ID NO: 43943 - RNA, 22 nt, Human
agagcaucuaacacauaagccu

SEQ ID NO: 43944 - RNA, 17 nt, Human
agagcauguguaggagc

SEQ ID NO: 43945 - RNA, 22 nt, Human
agagccaaguugucaaggcacu

SEQ ID NO: 43946 - RNA, 22 nt, Human
agagccacggcaggccuaggaa

SEQ ID NO: 43947 - RNA, 19 nt, Human
agagccagacagcauagga

SEQ ID NO: 43948 - RNA, 22 nt, Human
agagccagcauuugacacuggc

SEQ ID NO: 43949 - RNA, 22 nt, Human
agagccagcauuugggcccugc

SEQ ID NO: 43950 - RNA, 22 nt, Human
agagccaggacugugucucacu

SEQ ID NO: 43951 - RNA, 22 nt, Human
agagccaggcggcugggcaccu

SEQ ID NO: 43952 - RNA, 22 nt, Human
agagccaguuaagcacuuacag

SEQ ID NO: 43953 - RNA, 22 nt, Human
agagcccagguccuggagaggg

SEQ ID NO: 43954 - RNA, 22 nt, Human
agagcccugagucaguucugga

SEQ ID NO: 43955 - RNA, 22 nt, Human
agagccugagaggauaaugggg

SEQ ID NO: 43956 - RNA, 22 nt, Human
agagccugagccugaucuugaa

SEQ ID NO: 43957 - RNA, 22 nt, Human
agagccugaggaugucccagcu

SEQ ID NO: 43958 - RNA, 22 nt, Human
agagccugaggcccugagaggg

SEQ ID NO: 43959 - RNA, 22 nt, Human
agagccugcuguguaagucaca

SEQ ID NO: 43960 - RNA, 22 nt, Human
agagccuggacuuuucugagcc

SEQ ID NO: 43961 - RNA, 22 nt, Human
agagccuggcaaaagguccugc

SEQ ID NO: 43962 - RNA, 22 nt, Human
agagccugggcagcuccucugg

SEQ ID NO: 43963 - RNA, 22 nt, Human
agagccugugggagaugcagcu

SEQ ID NO: 43964 - RNA, 22 nt, Human
agagccuguuuugugggagaug

SEQ ID NO: 43965 - RNA, 20 nt, Human
agagccuugaggaagaugau

SEQ ID NO: 43966 - RNA, 22 nt, Human
agagcuaggaaugaccacucuc

SEQ ID NO: 43967 - RNA, 22 nt, Human
agagcuccaggguuuuguagug

SEQ ID NO: 43968 - RNA, 22 nt, Human
agagcuccugcauucuucccug

SEQ ID NO: 43969 - RNA, 22 nt, Human
agagcucugcagcuggccucag

SEQ ID NO: 43970 - RNA, 22 nt, Human
agagcugagcaccaagcauggu

SEQ ID NO: 43971 - RNA, 22 nt, Human
agagcugcaauuucauguggug

SEQ ID NO: 43972 - RNA, 22 nt, Human
agagcugcaccuaugcagaccu

SEQ ID NO: 43973 - RNA, 22 nt, Human
agagcuggaagcugcucuuaga

SEQ ID NO: 43974 - RNA, 22 nt, Human
agagcuggagcagccccacugg

SEQ ID NO: 43975 - RNA, 22 nt, Human
agagcuggcacugacccucacc

SEQ ID NO: 43976 - RNA, 22 nt, Human
agagcugggugaagugccauca

SEQ ID NO: 43977 - RNA, 22 nt, Human
agagcuggugcauauucagaaa

SEQ ID NO: 43978 - RNA, 22 nt, Human
agagcugguuuacucaggaauu

SEQ ID NO: 43979 - RNA, 22 nt, Human
agagcugugaaaaugagguuug

SEQ ID NO: 43980 - RNA, 22 nt, Human
agagcuguggauaguccuggau

SEQ ID NO: 43981 - RNA, 22 nt, Human
agagcuguuaauuuugcacugg

SEQ ID NO: 43982 - RNA, 22 nt, Human
agagcuguuugucuagagagug

SEQ ID NO: 43983 - RNA, 22 nt, Human
agagcuuagaauuucagaugau

SEQ ID NO: 43984 - RNA, 23 nt, Human
agagcuuagggaauucacaugag

SEQ ID NO: 43985 - RNA, 22 nt, Human
agagcuuauaucuuggccaucc

SEQ ID NO: 43986 - RNA, 23 nt, Human
agagcuuucuaaaauguaaaucu

SEQ ID NO: 43987 - RNA, 22 nt, Human
agagcuuugggacauuugcuag

SEQ ID NO: 43988 - RNA, 22 nt, Human
agaggaagauuuuauuaaccag

SEQ ID NO: 43989 - RNA, 22 nt, Human
agaggaauaaauuucuguagug

SEQ ID NO: 43990 - RNA, 22 nt, Human
agaggaauaugggugcacuaga

SEQ ID NO: 43991 - RNA, 22 nt, Human
agaggaaucugucuagacacaa

SEQ ID NO: 43992 - RNA, 22 nt, Human
agaggacaaaaugagaagugcu

SEQ ID NO: 43993 - RNA, 22 nt, Human
agaguuaaaugaaaugguaugu

SEQ ID NO: 43994 - RNA, 22 nt, Human
agaguuacugcagagaugaaua

SEQ ID NO: 43995 - RNA, 22 nt, Human
agaguuaucacuccaugcagcu

SEQ ID NO: 43996 - RNA, 22 nt, Human
agaguucucucucauuugagcu

SEQ ID NO: 43997 - RNA, 22 nt, Human
agaguucugaaauuaucuuuac

SEQ ID NO: 43998 - RNA, 22 nt, Human
agaguucugcucuucucaguga

SEQ ID NO: 43999 - RNA, 22 nt, Human
agaguucugucugccacacgaa

SEQ ID NO: 44000 - RNA, 22 nt, Human
agaguugcuaccaagaugcuag

SEQ ID NO: 44001 - RNA, 22 nt, Human
agaguuuaacacaagaaaaguu

SEQ ID NO: 44002 - RNA, 22 nt, Human
agaguuuggagagggugaggca

SEQ ID NO: 44003 - RNA, 22 nt, Human
agaguuuggauuuuaggacauc

SEQ ID NO: 44004 - RNA, 22 nt, Human
agaguuuguauuuuucagugaa

SEQ ID NO: 44005 - RNA, 22 nt, Human
agauaaacccaacuuaaugaag

SEQ ID NO: 44006 - RNA, 22 nt, Human
agauaacauuuauugaauguaa

SEQ ID NO: 44007 - RNA, 22 nt, Human
agauaacucauuuuguauaucc

SEQ ID NO: 44008 - RNA, 19 nt, Human
agauaagaguugacugugg

SEQ ID NO: 44009 - RNA, 22 nt, Human
agauaagauaguccagcacaau

SEQ ID NO: 44010 - RNA, 22 nt, Human
agauaagcuguuuuucaagaau

SEQ ID NO: 44011 - RNA, 17 nt, Human
agauaagcuucagagcu

SEQ ID NO: 44012 - RNA, 22 nt, Human
agauaauuauuuacuucaaagu

SEQ ID NO: 44013 - RNA, 22 nt, Human
agauacaaguuaagagaaagga

SEQ ID NO: 44014 - RNA, 22 nt, Human
agauacacagagcaucuucaga

SEQ ID NO: 44015 - RNA, 22 nt, Human
agauacagaaugguuguuuguc

SEQ ID NO: 44016 - RNA, 22 nt, Human
agauacagccugccagguucuu

SEQ ID NO: 44017 - RNA, 22 nt, Human
agauacagcuuuuuugucaguc

SEQ ID NO: 44018 - RNA, 20 nt, Human
agauacagugguuucuuuag

SEQ ID NO: 44019 - RNA, 22 nt, Human
agauaggagccaggacuuaaca

SEQ ID NO: 44020 - RNA, 22 nt, Human
agauaggccauuaagaaggaua

SEQ ID NO: 44021 - RNA, 22 nt, Human
agauauaauaauuuacaagugu

SEQ ID NO: 44022 - RNA, 22 nt, Human
agauauauuuaagguaauaagu

SEQ ID NO: 44023 - RNA, 22 nt, Human
agauaucaccaguuuuacauac

SEQ ID NO: 44024 - RNA, 22 nt, Human
agauaucuuacacuuugaaguu

SEQ ID NO: 44025 - RNA, 22 nt, Human
agauaugucccugucuaauauu

SEQ ID NO: 44026 - RNA, 22 nt, Human
agauaugugccaauuguuauaa

SEQ ID NO: 44027 - RNA, 22 nt, Human
agauauuaaucguacauaaggu

SEQ ID NO: 44028 - RNA, 22 nt, Human
agcagcauggcugacuaaagac

SEQ ID NO: 44029 - RNA, 22 nt, Human
agcagcauguaugagggugaac

SEQ ID NO: 44030 - RNA, 22 nt, Human
agcagcauguucauuacauuau

SEQ ID NO: 44031 - RNA, 22 nt, Human
agcagcauguugggaugugaaa

SEQ ID NO: 44032 - RNA, 22 nt, Human
agcagcauuuaaguuucuucua

SEQ ID NO: 44033 - RNA, 22 nt, Human
agcagccacccagcugcucauu

SEQ ID NO: 44034 - RNA, 22 nt, Human
agcagccagaaagggcagucga

SEQ ID NO: 44035 - RNA, 23 nt, Human
agcagccagagauccucggcccu

SEQ ID NO: 44036 - RNA, 22 nt, Human
agcagccaguucucugugguag

SEQ ID NO: 44037 - RNA, 23 nt, Human
agcagcccaauggcaagcucugg

SEQ ID NO: 44038 - RNA, 22 nt, Human
agcagcccaguuguacugagug

SEQ ID NO: 44039 - RNA, 22 nt, Human
agcagccuggacuuggaugugg

SEQ ID NO: 44040 - RNA, 22 nt, Human
agcagcuauuucuuccagagag

SEQ ID NO: 44041 - RNA, 22 nt, Human
agcagcucacaggauuccugaa

SEQ ID NO: 44042 - RNA, 22 nt, Human
agcagcucuggcacuguagcau

SEQ ID NO: 44043 - RNA, 22 nt, Human
agcagcucuuaacaaagcaugg

SEQ ID NO: 44044 - RNA, 22 nt, Human
agcagcugcagggagggucugc

SEQ ID NO: 44045 - RNA, 22 nt, Human
agcagcugcuccacuugcuuaa

SEQ ID NO: 44046 - RNA, 22 nt, Human
agcagcuggaacauaugaagaa

SEQ ID NO: 44047 - RNA, 22 nt, Human
agcagcuggcagcuucuucucu

SEQ ID NO: 44048 - RNA, 21 nt, Human
agcagcugggcaacauggagg

SEQ ID NO: 44049 - RNA, 22 nt, Human
agcagcuggggccugugacgau

SEQ ID NO: 44050 - RNA, 19 nt, Human
agcagcuguagauagacac

SEQ ID NO: 44051 - RNA, 22 nt, Human
agcagcuguggaaaaguaacua

SEQ ID NO: 44052 - RNA, 22 nt, Human
agcagcuguggggacaagggua

SEQ ID NO: 44053 - RNA, 23 nt, Human
agcagcugugguuuaccuuagua

SEQ ID NO: 44054 - RNA, 22 nt, Human
agcagcuguuagaaacaggaag

SEQ ID NO: 44055 - RNA, 22 nt, Human
agcagcuucagaggcgggcgca

SEQ ID NO: 44056 - RNA, 22 nt, Human
agcagcuucuauuuucuugguu

SEQ ID NO: 44057 - RNA, 22 nt, Human
agcagcuugagcuggggcuggc

SEQ ID NO: 44058 - RNA, 22 nt, Human
agcagcuuguuaaaaaguucca

SEQ ID NO: 44059 - RNA, 20 nt, Human
agcaggaaaagugccagucu

SEQ ID NO: 44060 - RNA, 22 nt, Human
agcaggaacgaguucaugggga

SEQ ID NO: 44061 - RNA, 22 nt, Human
agcaggaacucagggaguucuc

SEQ ID NO: 44062 - RNA, 22 nt, Human
agcaggaaggcuuuggggguuc

SEQ ID NO: 44063 - RNA, 22 nt, Human
agcaggaaggggaugaugggca

SEQ ID NO: 44064 - RNA, 22 nt, Human
agcaggaaggggccuagccugg

SEQ ID NO: 44065 - RNA, 22 nt, Human
agcaggaaucuguucuguauaa

SEQ ID NO: 44066 - RNA, 22 nt, Human
agcaggacaauaugggaucagg

SEQ ID NO: 44067 - RNA, 22 nt, Human
agcaggacacgaugcggcagga

SEQ ID NO: 44068 - RNA, 18 nt, Human
agcaggacuguggggugg

SEQ ID NO: 44069 - RNA, 22 nt, Human
agcaggagauggggcgugaugu

SEQ ID NO: 44070 - RNA, 22 nt, Human
agcaggaguuugaugcuuuuau

SEQ ID NO: 44071 - RNA, 22 nt, Human
agcaggcaagguccgugccucg

SEQ ID NO: 44072 - RNA, 22 nt, Human
agcaggcagcaugggacccucc

SEQ ID NO: 44073 - RNA, 22 nt, Human
agcaggcagccauuuggaaggc

SEQ ID NO: 44074 - RNA, 23 nt, Human
agcaggcaucuguggcacaaggc

SEQ ID NO: 44075 - RNA, 22 nt, Human
agcaggcauuugauauauauuu

SEQ ID NO: 44076 - RNA, 19 nt, Human
agcaggccaggcagguggc

SEQ ID NO: 44077 - RNA, 22 nt, Human
agcaggccucaugcaccagcua

SEQ ID NO: 44078 - RNA, 18 nt, Human
agcaggcguugccuggga

SEQ ID NO: 44079 - RNA, 22 nt, Human
agcaggcuaaucuugcugaaca

SEQ ID NO: 44080 - RNA, 22 nt, Human
agcaggcugaugggcaugcuug

SEQ ID NO: 44081 - RNA, 22 nt, Human
agcaggcugccuuccaaagccu

SEQ ID NO: 44082 - RNA, 22 nt, Human
agcaggcugcuggcguugaagu

SEQ ID NO: 44083 - RNA, 22 nt, Human
agcaggcuuucaagagucuucu

SEQ ID NO: 44084 - RNA, 22 nt, Human
agcagggacauggcaucucucc

SEQ ID NO: 44085 - RNA, 22 nt, Human
agcagggaggcggugugcuggc

SEQ ID NO: 44086 - RNA, 22 nt, Human
agcagggaggucuagcacgugg

SEQ ID NO: 44087 - RNA, 22 nt, Human
agcagggcaaagucaggcuaac

SEQ ID NO: 44088 - RNA, 22 nt, Human
agcagggcacuggaaggcacug

SEQ ID NO: 44089 - RNA, 22 nt, Human
agcagggcagguaaggaucaga

SEQ ID NO: 44090 - RNA, 22 nt, Human
agcagggcaugaauaaggguuu

SEQ ID NO: 44091 - RNA, 22 nt, Human
agcagggccaacaguaaacacc

SEQ ID NO: 44092 - RNA, 22 nt, Human
agcagggccucuggcacugguc

SEQ ID NO: 44093 - RNA, 22 nt, Human
agcagggccugagugaccuaac

SEQ ID NO: 44094 - RNA, 22 nt, Human
agcagggccuggcacuccuggg

SEQ ID NO: 44095 - RNA, 16 nt, Human
agcagggcgggaagga

SEQ ID NO: 44096 - RNA, 22 nt, Human
agcagggcucacauuaguggau

SEQ ID NO: 44097 - RNA, 22 nt, Human
agcagggcucugccaugggccc

SEQ ID NO: 44098 - RNA, 22 nt, Human
agcagggcugugcuccuuccga

SEQ ID NO: 44099 - RNA, 22 nt, Human
agcagggcuucugugccugugc

SEQ ID NO: 44100 - RNA, 22 nt, Human
agcagggcuuuggcuggcuuuc

SEQ ID NO: 44101 - RNA, 22 nt, Human
agcaggguuuggggauuggcac

SEQ ID NO: 44102 - RNA, 22 nt, Human
agcagagucuucaagggcaggc

SEQ ID NO: 44103 - RNA, 22 nt, Human
agcagauaugauacuuaauuua

SEQ ID NO: 44104 - RNA, 22 nt, Human
agcagauauuuguugagcacuu

SEQ ID NO: 44105 - RNA, 22 nt, Human
agcagaugcgucugagugggag

SEQ ID NO: 44106 - RNA, 22 nt, Human
agcagauggagaauggagucag

SEQ ID NO: 44107 - RNA, 22 nt, Human
agcagcaaaagagaauaguuug

SEQ ID NO: 44108 - RNA, 22 nt, Human
agcagcaagcagugcacggguu

SEQ ID NO: 44109 - RNA, 22 nt, Human
agcagcaaggaacagaauggac

SEQ ID NO: 44110 - RNA, 22 nt, Human
agcagcaccuguccucgcugcu

SEQ ID NO: 44111 - RNA, 22 nt, Human
agcagcagaaaguugauggcag

SEQ ID NO: 44112 - RNA, 22 nt, Human
agcagcagaagggagacccagg

SEQ ID NO: 44113 - RNA, 22 nt, Human
agcagcagaucaaacaggcuug

SEQ ID NO: 44114 - RNA, 22 nt, Human
agcagcagauccaaaaaaugug

SEQ ID NO: 44115 - RNA, 22 nt, Human
agcagcagauucagcaggaaug

SEQ ID NO: 44116 - RNA, 21 nt, Human
agcagcagcaguggggcuucu

SEQ ID NO: 44117 - RNA, 22 nt, Human
agcagcagcauugagcgcuugu

SEQ ID NO: 44118 - RNA, 19 nt, Human
agcagcagcuaccacuugu

SEQ ID NO: 44119 - RNA, 22 nt, Human
agcagcagcucaguucucagcu

SEQ ID NO: 44120 - RNA, 22 nt, Human
agcagcaggaggcuguccacca

SEQ ID NO: 44121 - RNA, 22 nt, Human
agcagcaggcuuaaggaaaagu

SEQ ID NO: 44122 - RNA, 22 nt, Human
agcagcagggcucugcccgugc

SEQ ID NO: 44123 - RNA, 22 nt, Human
agcagcagggucauugcucuuu

SEQ ID NO: 44124 - RNA, 22 nt, Human
agcagcaguguucuggaauucu

SEQ ID NO: 44125 - RNA, 22 nt, Human
agcagcauccccggccuccacc

SEQ ID NO: 44126 - RNA, 22 nt, Human
agcagcaucugguucugaugug

SEQ ID NO: 44127 - RNA, 22 nt, Human
agcagcaucuucuaaguaaggc

SEQ ID NO: 44128 - RNA, 22 nt, Human
agcagcauggagaaaccguuca

SEQ ID NO: 44129 - RNA, 22 nt, Human
agcagcauuaagggaacugcag

SEQ ID NO: 44130 - RNA, 22 nt, Human
agcagcauuccuggcuucuauc

SEQ ID NO: 44131 - RNA, 22 nt, Human
agcagccaaccuuacauucauc

SEQ ID NO: 44132 - RNA, 22 nt, Human
agcagccagagaaugaugcagu

SEQ ID NO: 44133 - RNA, 22 nt, Human
agcagccagagucugaacauua

SEQ ID NO: 44134 - RNA, 22 nt, Human
agcagccaggaaucugcagagc

SEQ ID NO: 44135 - RNA, 19 nt, Human
agcagccauagacaauaug

SEQ ID NO: 44136 - RNA, 22 nt, Human
agcagcccaaacagacuaagac

SEQ ID NO: 44137 - RNA, 22 nt, Human
agcagcccgaggaucauguguc

SEQ ID NO: 44138 - RNA, 23 nt, Human
agcagcccugggaccuggccugc

SEQ ID NO: 44139 - RNA, 22 nt, Human
agcagccuauucuucucuugga

SEQ ID NO: 44140 - RNA, 22 nt, Human
agcagccucccagggagcagcc

SEQ ID NO: 44141 - RNA, 22 nt, Human
agcagccucuguagaggucucc

SEQ ID NO: 44142 - RNA, 22 nt, Human
agcagccuggucucucgccaau

SEQ ID NO: 44143 - RNA, 21 nt, Human
agcagccuugugugccaggca

SEQ ID NO: 44144 - RNA, 22 nt, Human
agcagccuuugaucaucuggga

SEQ ID NO: 44145 - RNA, 22 nt, Human
agcagcuagacuucagaaucug

SEQ ID NO: 44146 - RNA, 22 nt, Human
agcagcucagaggcaccagggc

SEQ ID NO: 44147 - RNA, 22 nt, Human
agcagcucauggaguaggcacu

SEQ ID NO: 44148 - RNA, 22 nt, Human
agcauauuguaugucuauaugu

SEQ ID NO: 44149 - RNA, 22 nt, Human
agcauauugucuuuggugucuc

SEQ ID NO: 44150 - RNA, 22 nt, Human
agcauccaacaggagggaaggg

SEQ ID NO: 44151 - RNA, 22 nt, Human
agcauccaacuuugauuagaga

SEQ ID NO: 44152 - RNA, 22 nt, Human
agcauccaggccagguugggca

SEQ ID NO: 44153 - RNA, 22 nt, Human
agcauccuccuucccagagaug

SEQ ID NO: 44154 - RNA, 22 nt, Human
agcauccugccucuccucccaa

SEQ ID NO: 44155 - RNA, 22 nt, Human
agcaucucuaaauccaguaagu

SEQ ID NO: 44156 - RNA, 22 nt, Human
agcaucugcauaaugccuuccc

SEQ ID NO: 44157 - RNA, 22 nt, Human
agcaucuggauggaaagcaagg

SEQ ID NO: 44158 - RNA, 20 nt, Human
agcaucuugcaucuucaagu

SEQ ID NO: 44159 - RNA, 18 nt, Human
agcaugagagaggcugug

SEQ ID NO: 44160 - RNA, 21 nt, Human
agcaugcacuacuucaucuua

SEQ ID NO: 44161 - RNA, 22 nt, Human
agcaugcgcuugaucagcucca

SEQ ID NO: 44162 - RNA, 22 nt, Human
agcauggggcuccgcaaugaac

SEQ ID NO: 44163 - RNA, 22 nt, Human
agcauguugggaugagaaggaa

SEQ ID NO: 44164 - RNA, 22 nt, Human
agcauuauguccaugcuaaauu

SEQ ID NO: 44165 - RNA, 22 nt, Human
agcauuccacacugaagucugc

SEQ ID NO: 44166 - RNA, 22 nt, Human
agcauugguggccagagugccu

SEQ ID NO: 44167 - RNA, 22 nt, Human
agcauuuaagcuucugcaaagc

SEQ ID NO: 44168 - RNA, 22 nt, Human
agcauuuagucuuuauugcagc

SEQ ID NO: 44169 - RNA, 22 nt, Human
agcauuuauugaccugcugcug

SEQ ID NO: 44170 - RNA, 22 nt, Human
agcauuucuuggcccauuguag

SEQ ID NO: 44171 - RNA, 22 nt, Human
agcauuuucugagaguauagau

SEQ ID NO: 44172 - RNA, 22 nt, Human
agccaaagaucagugugcaagu

SEQ ID NO: 44173 - RNA, 23 nt, Human
agccaaaucuuaacuucuguuac

SEQ ID NO: 44174 - RNA, 22 nt, Human
agccaacuaggagauuaaggua

SEQ ID NO: 44175 - RNA, 22 nt, Human
agccaacuuagaagaaauuuga

SEQ ID NO: 44176 - RNA, 22 nt, Human
agccaagaagugaguaauagua

SEQ ID NO: 44177 - RNA, 22 nt, Human
agccaagaaucaugagcuaaua

SEQ ID NO: 44178 - RNA, 22 nt, Human
agccaaggacacggagccuccu

SEQ ID NO: 44179 - RNA, 22 nt, Human
agccaaggagugcagguggcuu

SEQ ID NO: 44180 - RNA, 22 nt, Human
agccaaggucgccccagggcaa

SEQ ID NO: 44181 - RNA, 22 nt, Human
agccaauacacugaagaucuaa

SEQ ID NO: 44182 - RNA, 22 nt, Human
agccaaucuccuguugaugcca

SEQ ID NO: 44183 - RNA, 22 nt, Human
agccacacagcuuaaugacaga

SEQ ID NO: 44184 - RNA, 22 nt, Human
agccacaggaaacagagacagc

SEQ ID NO: 44185 - RNA, 22 nt, Human
agccacaggccaugagauacca

SEQ ID NO: 44186 - RNA, 22 nt, Human
agccacagucaaccuguccaua

SEQ ID NO: 44187 - RNA, 22 nt, Human
agccacagucugaugccugaga

SEQ ID NO: 44188 - RNA, 22 nt, Human
agccaccaccacugaaagguua

SEQ ID NO: 44189 - RNA, 22 nt, Human
agccacugugcaggagcagugu

SEQ ID NO: 44190 - RNA, 23 nt, Human
agccacuucuaucuugcuccugg

SEQ ID NO: 44191 - RNA, 22 nt, Human
agccacuuuacuuucauauuuu

SEQ ID NO: 44192 - RNA, 22 nt, Human
agccagaaccacuggaacggug

SEQ ID NO: 44193 - RNA, 22 nt, Human
agccagacuuuaaaauagauga

SEQ ID NO: 44194 - RNA, 22 nt, Human
agccagagaacagcaggaaaug

SEQ ID NO: 44195 - RNA, 22 nt, Human
agccagagggaucuuucuaaga

SEQ ID NO: 44196 - RNA, 19 nt, Human
agccagaguggcccagggg

SEQ ID NO: 44197 - RNA, 22 nt, Human
agccagaugugagaaagaacac

SEQ ID NO: 44198 - RNA, 21 nt, Human
agccagcaacacagcaucucc

SEQ ID NO: 44199 - RNA, 22 nt, Human
agccagcacuuuuucucugggc

SEQ ID NO: 44200 - RNA, 22 nt, Human
agccagcaggugagugcagccu

SEQ ID NO: 44201 - RNA, 22 nt, Human
agccagcaucccuucagucucc

SEQ ID NO: 44202 - RNA, 22 nt, Human
agccagcaugaagacagaggcc

SEQ ID NO: 44203 - RNA, 22 nt, Human
agccagccccugacuguguccu

SEQ ID NO: 44204 - RNA, 22 nt, Human
agccagcucccuccccugcagg

SEQ ID NO: 44205 - RNA, 22 nt, Human
agccagcuguacugccugcuca

SEQ ID NO: 44206 - RNA, 22 nt, Human
agccagcugugggcucaggcgg

SEQ ID NO: 44207 - RNA, 22 nt, Human
agccagcuguguggucaggcaa

SEQ ID NO: 44208 - RNA, 22 nt, Human
agccagcuucuuuacgguggca

SEQ ID NO: 44209 - RNA, 22 nt, Human
agccaggaaccagcuacagucu

SEQ ID NO: 44210 - RNA, 22 nt, Human
agccaggaagaaggucacacca

SEQ ID NO: 44211 - RNA, 22 nt, Human
agcagugaugcaugacagccua

SEQ ID NO: 44212 - RNA, 19 nt, Human
agcaguggagccaugccug

SEQ ID NO: 44213 - RNA, 22 nt, Human
agcaguggcugaagauguuccu

SEQ ID NO: 44214 - RNA, 22 nt, Human
agcaguguuuaggcauucagua

SEQ ID NO: 44215 - RNA, 22 nt, Human
agcaguguuuugauucugggag

SEQ ID NO: 44216 - RNA, 19 nt, Human
agcaguuauaugcauggga

SEQ ID NO: 44217 - RNA, 22 nt, Human
agcaguuauauuacucucaggu

SEQ ID NO: 44218 - RNA, 22 nt, Human
agcaguuauauugaaauaaaaa

SEQ ID NO: 44219 - RNA, 22 nt, Human
agcaguuaucgaagaaucaggu

SEQ ID NO: 44220 - RNA, 20 nt, Human
agcaguuuccuaacucagcu

SEQ ID NO: 44221 - RNA, 22 nt, Human
agcauacaguaggugcucaguu

SEQ ID NO: 44222 - RNA, 22 nt, Human
agcauacuugacacuucucuau

SEQ ID NO: 44223 - RNA, 22 nt, Human
agcauagaguccugagggcagg

SEQ ID NO: 44224 - RNA, 22 nt, Human
agcaucagcagacucucagcua

SEQ ID NO: 44225 - RNA, 22 nt, Human
agcaucagccucuguccuggag

SEQ ID NO: 44226 - RNA, 22 nt, Human
agcauccagaaaacucucagaa

SEQ ID NO: 44227 - RNA, 22 nt, Human
agcauccagaugccugauguca

SEQ ID NO: 44228 - RNA, 22 nt, Human
agcauccagcauccuauagaaa

SEQ ID NO: 44229 - RNA, 19 nt, Human
agcauccagucaugggauc

SEQ ID NO: 44230 - RNA, 22 nt, Human
agcaucccaugacucuggagga

SEQ ID NO: 44231 - RNA, 22 nt, Human
agcauccugcuugcugucugug

SEQ ID NO: 44232 - RNA, 22 nt, Human
agcaucuaaacuaucaguuuga

SEQ ID NO: 44233 - RNA, 21 nt, Human
agcaucugaggcaguuuccua

SEQ ID NO: 44234 - RNA, 22 nt, Human
agcaucugcauauugggagacc

SEQ ID NO: 44235 - RNA, 22 nt, Human
agcaucugcuuaauggcuuaac

SEQ ID NO: 44236 - RNA, 22 nt, Human
agcaucuggucaugagugagaa

SEQ ID NO: 44237 - RNA, 22 nt, Human
agcaucugugauauuuuguuau

SEQ ID NO: 44238 - RNA, 22 nt, Human
agcaucuugaaauauaaaguca

SEQ ID NO: 44239 - RNA, 22 nt, Human
agcaugaaagcauaggacaguc

SEQ ID NO: 44240 - RNA, 18 nt, Human
agcaugagucaggggugc

SEQ ID NO: 44241 - RNA, 22 nt, Human
agcaugcacaugacuggcuuaa

SEQ ID NO: 44242 - RNA, 22 nt, Human
agcaugcaggaaccacauggca

SEQ ID NO: 44243 - RNA, 22 nt, Human
agcaugcauuuuuggacugugc

SEQ ID NO: 44244 - RNA, 22 nt, Human
agcaugcugguuacguguagca

SEQ ID NO: 44245 - RNA, 22 nt, Human
agcauggacaguggcagcagug

SEQ ID NO: 44246 - RNA, 18 nt, Human
agcauggcacaggcuccc

SEQ ID NO: 44247 - RNA, 22 nt, Human
agcauggccucccgggccuggc

SEQ ID NO: 44248 - RNA, 22 nt, Human
agcauggggcaaugcaugugcu

SEQ ID NO: 44249 - RNA, 22 nt, Human
agcauguguggagaaauauuuu

SEQ ID NO: 44250 - RNA, 22 nt, Human
agcauuaagccuggcucagagg

SEQ ID NO: 44251 - RNA, 19 nt, Human
agcauuaggcaaauuuuga

SEQ ID NO: 44252 - RNA, 22 nt, Human
agcauucaugaugacaacagga

SEQ ID NO: 44253 - RNA, 22 nt, Human
agcauucucagaaugucauuuu

SEQ ID NO: 44254 - RNA, 21 nt, Human
agcauucugcuucuuuccugg

SEQ ID NO: 44255 - RNA, 22 nt, Human
agcauugaaccagauguuacau

SEQ ID NO: 44256 - RNA, 22 nt, Human
agcauugucuccaagcaggucu

SEQ ID NO: 44257 - RNA, 22 nt, Human
agcauuuaaggguggauacagg

SEQ ID NO: 44258 - RNA, 22 nt, Human
agcauuuaggagaauuugagaa

SEQ ID NO: 44259 - RNA, 22 nt, Human
agcauuuauagccccuaucauc

SEQ ID NO: 44260 - RNA, 22 nt, Human
agcauuuccgcccucuucugcc

SEQ ID NO: 44261 - RNA, 22 nt, Human
agcauuugaaaacuauuuaauu

SEQ ID NO: 44262 - RNA, 22 nt, Human
agcauuugauauguuuaaaaag

SEQ ID NO: 44263 - RNA, 22 nt, Human
agcagcucccuccucagccacc

SEQ ID NO: 44264 - RNA, 22 nt, Human
agcagcuccucuaggaacggau

SEQ ID NO: 44265 - RNA, 22 nt, Human
agcagcucggccagucaccagg

SEQ ID NO: 44266 - RNA, 22 nt, Human
agcagcucugagaggccagcac

SEQ ID NO: 44267 - RNA, 17 nt, Human
agcagcugaagcagcca

SEQ ID NO: 44268 - RNA, 22 nt, Human
agcagcugagaugguaagauuc

SEQ ID NO: 44269 - RNA, 22 nt, Human
agcagcugaucaaagcacuuau

SEQ ID NO: 44270 - RNA, 22 nt, Human
agcagcugcagagggcuccccc

SEQ ID NO: 44271 - RNA, 22 nt, Human
agcagcugccacuggaauagga

SEQ ID NO: 44272 - RNA, 22 nt, Human
agcagcuggaacuaauaguggu

SEQ ID NO: 44273 - RNA, 22 nt, Human
agcagcugucccuuaacaucag

SEQ ID NO: 44274 - RNA, 23 nt, Human
agcagcuguggaguuuugcauuu

SEQ ID NO: 44275 - RNA, 22 nt, Human
agcagcugugggcaauauguaa

SEQ ID NO: 44276 - RNA, 20 nt, Human
agcagcuguguuuucauccu

SEQ ID NO: 44277 - RNA, 22 nt, Human
agcagcuguuuguugaauuggu

SEQ ID NO: 44278 - RNA, 22 nt, Human
agcagcuuaucuuggagaggca

SEQ ID NO: 44279 - RNA, 22 nt, Human
agcagcuucuuucacuccugga

SEQ ID NO: 44280 - RNA, 22 nt, Human
agcagcuugaggcuggauucca

SEQ ID NO: 44281 - RNA, 22 nt, Human
agcagcuuggggccgagauaga

SEQ ID NO: 44282 - RNA, 22 nt, Human
agcagcuugggucucuccugcu

SEQ ID NO: 44283 - RNA, 22 nt, Human
agcagcuugguuuuaggcaugg

SEQ ID NO: 44284 - RNA, 22 nt, Human
agcagcuuuaagucacugguua

SEQ ID NO: 44285 - RNA, 22 nt, Human
agcagcuuuccucuggggucag

SEQ ID NO: 44286 - RNA, 22 nt, Human
agcaggaaggucugugugaguc

SEQ ID NO: 44287 - RNA, 22 nt, Human
agcaggaaguagucuguaagca

SEQ ID NO: 44288 - RNA, 22 nt, Human
agcaggaaguccucucaggaga

SEQ ID NO: 44289 - RNA, 20 nt, Human
agcaggaaugaugcuuucau

SEQ ID NO: 44290 - RNA, 22 nt, Human
agcaggagaacacuguggcucu

SEQ ID NO: 44291 - RNA, 22 nt, Human
agcaggagcauuuccaugauuc

SEQ ID NO: 44292 - RNA, 22 nt, Human
agcaggagcugugggaagaugg

SEQ ID NO: 44293 - RNA, 23 nt, Human
agcaggauaauuuuauuaugccc

SEQ ID NO: 44294 - RNA, 21 nt, Human
agcaggcaaaggugaagucuu

SEQ ID NO: 44295 - RNA, 22 nt, Human
agcaggcacaagaaagggaggu

SEQ ID NO: 44296 - RNA, 22 nt, Human
agcaggcagcugggggaguuga

SEQ ID NO: 44297 - RNA, 22 nt, Human
agcaggcaggaaggcagcacug

SEQ ID NO: 44298 - RNA, 22 nt, Human
agcaggcaggaaugguggaaca

SEQ ID NO: 44299 - RNA, 22 nt, Human
agcaggcaggaggcuacuaagg

SEQ ID NO: 44300 - RNA, 19 nt, Human
agcaggcagguggcccagg

SEQ ID NO: 44301 - RNA, 21 nt, Human
agcaggcagugggcuggauuu

SEQ ID NO: 44302 - RNA, 22 nt, Human
agcaggcuaagggaccuguuua

SEQ ID NO: 44303 - RNA, 22 nt, Human
agcaggcuaggaaccucacugc

SEQ ID NO: 44304 - RNA, 22 nt, Human
agcaggcuccaggcuggccauc

SEQ ID NO: 44305 - RNA, 17 nt, Human
agcaggcugcagaggcc

SEQ ID NO: 44306 - RNA, 20 nt, Human
agcaggcugcagggugaaau

SEQ ID NO: 44307 - RNA, 23 nt, Human
agcaggcugcuucuccacagcug

SEQ ID NO: 44308 - RNA, 22 nt, Human
agcaggcuuacuuucugauuag

SEQ ID NO: 44309 - RNA, 22 nt, Human
agcaggcuuaugguugaaggga

SEQ ID NO: 44310 - RNA, 22 nt, Human
agcaggcuugguccccagccuc

SEQ ID NO: 44311 - RNA, 22 nt, Human
agcagggaauagcggaaagaau

SEQ ID NO: 44312 - RNA, 22 nt, Human
agcagggagaccaucucuuccu

SEQ ID NO: 44313 - RNA, 22 nt, Human
agcagggcagcuuuuuucagaa

SEQ ID NO: 44314 - RNA, 22 nt, Human
agcagggcagugcuucagcucu

SEQ ID NO: 44315 - RNA, 22 nt, Human
agcagggcaguuaaaggguccu

SEQ ID NO: 44316 - RNA, 23 nt, Human
agcagggccagaauacuugcugu

SEQ ID NO: 44317 - RNA, 22 nt, Human
agcagggcuccugaaagccgcg

SEQ ID NO: 44318 - RNA, 22 nt, Human
agcagggcugcggccccaccac

SEQ ID NO: 44319 - RNA, 22 nt, Human
agcagggcuugccgcuuguccu

SEQ ID NO: 44320 - RNA, 22 nt, Human
agguccugggaguucuagugug

SEQ ID NO: 44321 - RNA, 22 nt, Human
agguccugucuaucacccucgc

SEQ ID NO: 44322 - RNA, 22 nt, Human
aggucuacaugcuuaauauauc

SEQ ID NO: 44323 - RNA, 22 nt, Human
aggucuagauuuauagacagca

SEQ ID NO: 44324 - RNA, 20 nt, Human
aggucucagagcaagagccc

SEQ ID NO: 44325 - RNA, 22 nt, Human
aggucuccuugugggucuugcc

SEQ ID NO: 44326 - RNA, 22 nt, Human
aggucugacucuuugccacaua

SEQ ID NO: 44327 - RNA, 22 nt, Human
aggucugagcaggggagaacag

SEQ ID NO: 44328 - RNA, 22 nt, Human
aggucugauuuuuuauucccag

SEQ ID NO: 44329 - RNA, 22 nt, Human
aggucugccucacucacuucug

SEQ ID NO: 44330 - RNA, 22 nt, Human
aggucuggaaacagcagggaga

SEQ ID NO: 44331 - RNA, 22 nt, Human
aggucuggaggcggagucagga

SEQ ID NO: 44332 - RNA, 22 nt, Human
aggucugggauugaagacauca

SEQ ID NO: 44333 - RNA, 22 nt, Human
aggucuggugagagcaggugcu

SEQ ID NO: 44334 - RNA, 22 nt, Human
aggucuggugggcuuuagauug

SEQ ID NO: 44335 - RNA, 22 nt, Human
aggucugucuggccccaugaau

SEQ ID NO: 44336 - RNA, 22 nt, Human
aggugaaguuaaaaaccagucu

SEQ ID NO: 44337 - RNA, 22 nt, Human
aggugacaggacaggagcuggu

SEQ ID NO: 44338 - RNA, 22 nt, Human
aggugacaucccggcagcagag

SEQ ID NO: 44339 - RNA, 19 nt, Human
aggugacaugugacagccu

SEQ ID NO: 44340 - RNA, 19 nt, Human
aggugaggggcaccauguc

SEQ ID NO: 44341 - RNA, 22 nt, Human
aggugagguuugggagguguca

SEQ ID NO: 44342 - RNA, 22 nt, Human
aggugauaaguguuaaauaaag

SEQ ID NO: 44343 - RNA, 22 nt, Human
aggugauguccacagcuugcag

SEQ ID NO: 44344 - RNA, 22 nt, Human
aggugcagaaaaaaguccuuua

SEQ ID NO: 44345 - RNA, 17 nt, Human
aggugcagaggcagagc

SEQ ID NO: 44346 - RNA, 22 nt, Human
aggugcagcugguggagucugg

SEQ ID NO: 44347 - RNA, 21 nt, Human
aggugcaggccucaagcccca

SEQ ID NO: 44348 - RNA, 22 nt, Human
aggugcaucucguagcucuucu

SEQ ID NO: 44349 - RNA, 22 nt, Human
aggugccaacaguauuucugcc

SEQ ID NO: 44350 - RNA, 22 nt, Human
aggugccaagaugucacagaca

SEQ ID NO: 44351 - RNA, 22 nt, Human
aggugccaauuuucagugaaca

SEQ ID NO: 44352 - RNA, 22 nt, Human
aggugccacucucaugggcuac

SEQ ID NO: 44353 - RNA, 22 nt, Human
aggugccaggagggaauuuagg

SEQ ID NO: 44354 - RNA, 22 nt, Human
aggugccagugcuguggucccc

SEQ ID NO: 44355 - RNA, 23 nt, Human
aggugcccagggcagguuuacug

SEQ ID NO: 44356 - RNA, 22 nt, Human
aggugcccaucaccucacaguc

SEQ ID NO: 44357 - RNA, 22 nt, Human
aggugccuuccgcggagcucgc

SEQ ID NO: 44358 - RNA, 18 nt, Human
aggugcucaaaugggaaa

SEQ ID NO: 44359 - RNA, 22 nt, Human
aggugcuggagucugggcagga

SEQ ID NO: 44360 - RNA, 22 nt, Human
aggugcuggcgccccaggagac

SEQ ID NO: 44361 - RNA, 19 nt, Human
aggugcuggugaggguguu

SEQ ID NO: 44362 - RNA, 22 nt, Human
aggugcugugcuaugcacuugu

SEQ ID NO: 44363 - RNA, 22 nt, Human
aggugcuguuugucagcaguuu

SEQ ID NO: 44364 - RNA, 22 nt, Human
agguggaaauggcuuuccuagg

SEQ ID NO: 44365 - RNA, 22 nt, Human
agguggaguuggcuguaguuca

SEQ ID NO: 44366 - RNA, 22 nt, Human
agguggcagagcuggcccagcg

SEQ ID NO: 44367 - RNA, 22 nt, Human
agguggcagcagaaucagggag

SEQ ID NO: 44368 - RNA, 22 nt, Human
agguggcagcagccuggugaaa

SEQ ID NO: 44369 - RNA, 22 nt, Human
agguggcagcaggagaugugga

SEQ ID NO: 44370 - RNA, 22 nt, Human
agguggcaugagacuguaccag

SEQ ID NO: 44371 - RNA, 22 nt, Human
agguggccaagacuguuugaca

SEQ ID NO: 44372 - RNA, 19 nt, Human
agguggccauguccagccu

SEQ ID NO: 44373 - RNA, 22 nt, Human
agguggccggugccagccgggc

SEQ ID NO: 44374 - RNA, 22 nt, Human
agguggcuguauucagcuguaa

SEQ ID NO: 44375 - RNA, 22 nt, Human
agguggcuguggcuucccuugu

SEQ ID NO: 44376 - RNA, 22 nt, Human
aggugggcaccaggcuuguggu

SEQ ID NO: 44377 - RNA, 22 nt, Human
aggugggcggauucaugagguc

SEQ ID NO: 44378 - RNA, 22 nt, Human
aggugggcuuggugccaacaug

SEQ ID NO: 44379 - RNA, 22 nt, Human
agguggggaaaccagcgauccc

SEQ ID NO: 44380 - RNA, 21 nt, Human
agguggggcugcaccucugcu

SEQ ID NO: 44381 - RNA, 19 nt, Human
agguggguaagcaguucuc

SEQ ID NO: 44382 - RNA, 22 nt, Human
aggugucugggcuuuggaguca

SEQ ID NO: 44383 - RNA, 22 nt, Human
aggugucugugaugggagcgau

SEQ ID NO: 44384 - RNA, 22 nt, Human
aggugucuucagggugagacag

SEQ ID NO: 44385 - RNA, 22 nt, Human
aggugucuuugcggcccgccgc

SEQ ID NO: 44386 - RNA, 22 nt, Human
agguguggcuggggcagaggcc

SEQ ID NO: 44387 - RNA, 18 nt, Human
agguguguuucuaggagc

SEQ ID NO: 44388 - RNA, 22 nt, Human
agguuaggaaauagggcuguaa

SEQ ID NO: 44389 - RNA, 22 nt, Human
agguuaggaagauacagaaugu

SEQ ID NO: 44390 - RNA, 22 nt, Human
agguuauaugacugucaugccu

SEQ ID NO: 44391 - RNA, 22 nt, Human
agguuauaugucauacugaagu

SEQ ID NO: 44392 - RNA, 22 nt, Human
agguuauucucuaucucauccc

SEQ ID NO: 44393 - RNA, 22 nt, Human
agguucagaguuguugauguuu

SEQ ID NO: 44394 - RNA, 22 nt, Human
agguucaggcacuugcccaaca

SEQ ID NO: 44395 - RNA, 22 nt, Human
agcuccaggauaagacaggugc

SEQ ID NO: 44396 - RNA, 22 nt, Human
agcuccaggcagcauuaauaaa

SEQ ID NO: 44397 - RNA, 22 nt, Human
agcuccaggccuugggccccgg

SEQ ID NO: 44398 - RNA, 22 nt, Human
agcuccagggaaagaguggauc

SEQ ID NO: 44399 - RNA, 22 nt, Human
agcuccaggucagugcaccccu

SEQ ID NO: 44400 - RNA, 20 nt, Human
agcuccaugaaguagucacu

SEQ ID NO: 44401 - RNA, 22 nt, Human
agcucccagaagccagagucgg

SEQ ID NO: 44402 - RNA, 22 nt, Human
agcucccagcagagcuggccac

SEQ ID NO: 44403 - RNA, 22 nt, Human
agcucccagggcugggcaaguu

SEQ ID NO: 44404 - RNA, 22 nt, Human
agcucccauuaucuucugaaac

SEQ ID NO: 44405 - RNA, 22 nt, Human
agcuccccucguuucucuccau

SEQ ID NO: 44406 - RNA, 22 nt, Human
agcuccugcagacuccugcuca

SEQ ID NO: 44407 - RNA, 22 nt, Human
agcuccugccaacacugauggg

SEQ ID NO: 44408 - RNA, 22 nt, Human
agcuccugcgcacggugcacac

SEQ ID NO: 44409 - RNA, 22 nt, Human
agcuccugggagcaggugguac

SEQ ID NO: 44410 - RNA, 22 nt, Human
agcuccuguggcagcucuucug

SEQ ID NO: 44411 - RNA, 22 nt, Human
agcuccuguggcugaaagagga

SEQ ID NO: 44412 - RNA, 22 nt, Human
agcucuagggaagaaaggcaca

SEQ ID NO: 44413 - RNA, 22 nt, Human
agcucucaagauaagaaagaac

SEQ ID NO: 44414 - RNA, 22 nt, Human
agcucugacauugauucucagc

SEQ ID NO: 44415 - RNA, 22 nt, Human
agcucugacugaagagaugcaa

SEQ ID NO: 44416 - RNA, 22 nt, Human
agcucugagaaaguuagaaagu

SEQ ID NO: 44417 - RNA, 22 nt, Human
agcucugcuacucuguggggug

SEQ ID NO: 44418 - RNA, 22 nt, Human
agcucuggaacucccggcugcu

SEQ ID NO: 44419 - RNA, 21 nt, Human
agcucuggagcagcaaucaag

SEQ ID NO: 44420 - RNA, 22 nt, Human
agcucuggcuaagcugauaaau

SEQ ID NO: 44421 - RNA, 22 nt, Human
agcucugggggaaagucugcuc

SEQ ID NO: 44422 - RNA, 22 nt, Human
agcucugggucacggcugccga

SEQ ID NO: 44423 - RNA, 22 nt, Human
agcucugugaagccagcaguuc

SEQ ID NO: 44424 - RNA, 22 nt, Human
agcucuuuagagucucccuucu

SEQ ID NO: 44425 - RNA, 22 nt, Human
agcucuuugacuaaucuugcuu

SEQ ID NO: 44426 - RNA, 22 nt, Human
agcucuuuggaaggugugcacu

SEQ ID NO: 44427 - RNA, 22 nt, Human
agcucuuuggcacugagcagca

SEQ ID NO: 44428 - RNA, 22 nt, Human
agcucuuuugcucuccaaguuu

SEQ ID NO: 44429 - RNA, 22 nt, Human
agcccuucaagagcucuguccu

SEQ ID NO: 44430 - RNA, 23 nt, Human
agcccuugauaauaaagcaccag

SEQ ID NO: 44431 - RNA, 22 nt, Human
agccgcaagaaguacagcagca

SEQ ID NO: 44432 - RNA, 17 nt, Human
agccgggcauggaccag

SEQ ID NO: 44433 - RNA, 22 nt, Human
agccuacagagggcagguggag

SEQ ID NO: 44434 - RNA, 22 nt, Human
agccuagcugugugaggccauc

SEQ ID NO: 44435 - RNA, 23 nt, Human
agccucagccgguggcagaagug

SEQ ID NO: 44436 - RNA, 22 nt, Human
agccuccacagaugcaaagggc

SEQ ID NO: 44437 - RNA, 22 nt, Human
agccuccaguagcugaagagac

SEQ ID NO: 44438 - RNA, 22 nt, Human
agccuccuguagcccucaccca

SEQ ID NO: 44439 - RNA, 22 nt, Human
agccucucuccagcuuggcaga

SEQ ID NO: 44440 - RNA, 22 nt, Human
agccucucuuuauucccagcua

SEQ ID NO: 44441 - RNA, 22 nt, Human
agccucucuuucugguggcuaa

SEQ ID NO: 44442 - RNA, 22 nt, Human
agccucugcacuucuuacaggu

SEQ ID NO: 44443 - RNA, 20 nt, Human
agccucugcccuucccacug

SEQ ID NO: 44444 - RNA, 22 nt, Human
agccucugcuggcccuggcacu

SEQ ID NO: 44445 - RNA, 22 nt, Human
agccucugcuuaugcaaaggua

SEQ ID NO: 44446 - RNA, 22 nt, Human
agccucuguagaaagcagugug

SEQ ID NO: 44447 - RNA, 22 nt, Human
agccucuuccagcuccuuucua

SEQ ID NO: 44448 - RNA, 23 nt, Human
agccucuuguggauggucagcga

SEQ ID NO: 44449 - RNA, 22 nt, Human
agccugagccccauccagcuga

SEQ ID NO: 44450 - RNA, 22 nt, Human
agccugagugcuuaggacuguu

SEQ ID NO: 44451 - RNA, 21 nt, Human
agccugcaauguagguaccgg

SEQ ID NO: 44452 - RNA, 20 nt, Human
agccugccagcuggcccaga

SEQ ID NO: 44453 - RNA, 22 nt, Human
agccugcuggaccaagcucaug

SEQ ID NO: 44454 - RNA, 22 nt, Human
agccugcuucccuuugugcccc

SEQ ID NO: 44455 - RNA, 22 nt, Human
agccugcuugagaguccuggcu

SEQ ID NO: 44456 - RNA, 22 nt, Human
agccuggaauuaaggaaaugca

SEQ ID NO: 44457 - RNA, 22 nt, Human
agccuggaccaggggccucaga

SEQ ID NO: 44458 - RNA, 22 nt, Human
agccuggauccauguggcuacc

SEQ ID NO: 44459 - RNA, 22 nt, Human
agccuggcacugaggcagggcg

SEQ ID NO: 44460 - RNA, 22 nt, Human
agccuggcuaaauucucccaug

SEQ ID NO: 44461 - RNA, 22 nt, Human
agccugggaauuuagaguucgg

SEQ ID NO: 44462 - RNA, 21 nt, Human
agccugggaggcggagguugc

SEQ ID NO: 44463 - RNA, 22 nt, Human
agccugggccuggcuucccgcc

SEQ ID NO: 44464 - RNA, 18 nt, Human
agccugggcucugccugg

SEQ ID NO: 44465 - RNA, 20 nt, Human
agccuggggaauuccacccc

SEQ ID NO: 44466 - RNA, 22 nt, Human
agccugggguuucaguuugcac

SEQ ID NO: 44467 - RNA, 21 nt, Human
agccuggguauccuuugagga

SEQ ID NO: 44468 - RNA, 22 nt, Human
agccuggguuaggguucuuccc

SEQ ID NO: 44469 - RNA, 22 nt, Human
agccugugagggaugcugcagu

SEQ ID NO: 44470 - RNA, 22 nt, Human
agccugugugaagcccucagag

SEQ ID NO: 44471 - RNA, 22 nt, Human
agccugugugcuuuggacaggg

SEQ ID NO: 44472 - RNA, 21 nt, Human
agccuguugguuuacugcuca

SEQ ID NO: 44473 - RNA, 22 nt, Human
agccuuaaaugcuagauucaua

SEQ ID NO: 44474 - RNA, 22 nt, Human
agccuuagaggaaaacauuagu

SEQ ID NO: 44475 - RNA, 22 nt, Human
agccuuagauuugggcaagaac

SEQ ID NO: 44476 - RNA, 16 nt, Human
agccuuaggaacagcc

SEQ ID NO: 44477 - RNA, 22 nt, Human
agccuucagcaguucaggugcc

SEQ ID NO: 44478 - RNA, 22 nt, Human
agccuucauaaucuugggcuuu

SEQ ID NO: 44479 - RNA, 22 nt, Human
agccuugaacacugacugaagg

SEQ ID NO: 44480 - RNA, 22 nt, Human
agccuugagcaguucacuuggu

SEQ ID NO: 44481 - RNA, 22 nt, Human
agccuuggccguaagguaugcu

SEQ ID NO: 44482 - RNA, 21 nt, Human
agcgccugcaacaaggcagau

SEQ ID NO: 44483 - RNA, 22 nt, Human
agcgcuggcuggcgcuccuucc

SEQ ID NO: 44484 - RNA, 22 nt, Human
agcggcgccgagcuuggccagg

SEQ ID NO: 44485 - RNA, 22 nt, Human
agcggcgccggagggaggugcg

SEQ ID NO: 44486 - RNA, 22 nt, Human
agcggcugcuccgcaggcuggc

SEQ ID NO: 44487 - RNA, 22 nt, Human
agcggcuggaccagcguucaag

SEQ ID NO: 44488 - RNA, 22 nt, Human
agcgggcucaaguggccagcag

SEQ ID NO: 44489 - RNA, 22 nt, Human
agcgggcucacccgguuguugu

SEQ ID NO: 44490 - RNA, 22 nt, Human
agcgugaaggcgggcagucggc

SEQ ID NO: 44491 - RNA, 22 nt, Human
agcguggacugcugggcaaggu

SEQ ID NO: 44492 - RNA, 22 nt, Human
agcgugugccucgggguacacg

SEQ ID NO: 44493 - RNA, 22 nt, Human
agcuaaacuagguaaacagcag

SEQ ID NO: 44494 - RNA, 22 nt, Human
agcuaaaugcauuucaagacug

SEQ ID NO: 44495 - RNA, 22 nt, Human
agcuaaaugugaaaugucaacc

SEQ ID NO: 44496 - RNA, 22 nt, Human
agcuaagcucucagauacuaag

SEQ ID NO: 44497 - RNA, 22 nt, Human
agcuaaggaaucagaagagguu

SEQ ID NO: 44498 - RNA, 22 nt, Human
agcuaaggagcaaguaggaguu

SEQ ID NO: 44499 - RNA, 22 nt, Human
agcuaaugauacaugcuccaca

SEQ ID NO: 44500 - RNA, 22 nt, Human
agcuaaugaugagauacagaua

SEQ ID NO: 44501 - RNA, 23 nt, Human
agcuaaugggacagauuccaugg

SEQ ID NO: 44502 - RNA, 22 nt, Human
agcuacaagucaucagcuauca

SEQ ID NO: 44503 - RNA, 19 nt, Human
agcuacagcauggcgaggu

SEQ ID NO: 44504 - RNA, 22 nt, Human
agcuacaguggacaagugaacu

SEQ ID NO: 44505 - RNA, 22 nt, Human
agcuacaguugcccucagcagg

SEQ ID NO: 44506 - RNA, 22 nt, Human
agcuacuggagaacacaaaacc

SEQ ID NO: 44507 - RNA, 22 nt, Human
agcuagacuuucccuuuccaug

SEQ ID NO: 44508 - RNA, 22 nt, Human
agcuagccauguggcuccugug

SEQ ID NO: 44509 - RNA, 22 nt, Human
agcuaggagauuuugugaggcu

SEQ ID NO: 44510 - RNA, 22 nt, Human
agcuaggauaagcagagacugg

SEQ ID NO: 44511 - RNA, 22 nt, Human
agcuaguauuucauugaggauu

SEQ ID NO: 44512 - RNA, 22 nt, Human
agucagaauucgaucccagguc

SEQ ID NO: 44513 - RNA, 22 nt, Human
agucagacauaauucuaacauu

SEQ ID NO: 44514 - RNA, 23 nt, Human
agucagagcagaagggcugcuug

SEQ ID NO: 44515 - RNA, 17 nt, Human
agucagaggaguaucug

SEQ ID NO: 44516 - RNA, 22 nt, Human
agucagaguucuuggggagaca

SEQ ID NO: 44517 - RNA, 22 nt, Human
agucagaugaugugaggagugg

SEQ ID NO: 44518 - RNA, 22 nt, Human
agucagcaucugcacugugcug

SEQ ID NO: 44519 - RNA, 22 nt, Human
agucagcuacaaguucauucac

SEQ ID NO: 44520 - RNA, 22 nt, Human
agucaggaagcuggagcugggg

SEQ ID NO: 44521 - RNA, 22 nt, Human
agucaggacacagcaugaacau

SEQ ID NO: 44522 - RNA, 22 nt, Human
agucaggacagauuuucugggg

SEQ ID NO: 44523 - RNA, 22 nt, Human
agucaggauuuaaacucagaca

SEQ ID NO: 44524 - RNA, 22 nt, Human
agucaggauuuuggauuauucg

SEQ ID NO: 44525 - RNA, 22 nt, Human
agucaggcagcugagcuuuaug

SEQ ID NO: 44526 - RNA, 22 nt, Human
agucagucaaaauauaaauugu

SEQ ID NO: 44527 - RNA, 23 nt, Human
agucaguguaaguuuggaaugca

SEQ ID NO: 44528 - RNA, 22 nt, Human
agucaguguagaaagcccaggc

SEQ ID NO: 44529 - RNA, 22 nt, Human
agucaguguucuccggagaggc

SEQ ID NO: 44530 - RNA, 18 nt, Human
agucaguugauggggacc

SEQ ID NO: 44531 - RNA, 22 nt, Human
agucaguuuuaccaaucucagu

SEQ ID NO: 44532 - RNA, 22 nt, Human
agucauauauuuuguuugugca

SEQ ID NO: 44533 - RNA, 22 nt, Human
agucaucaccaguacagugugc

SEQ ID NO: 44534 - RNA, 22 nt, Human
agucaucucagguagcauuuac

SEQ ID NO: 44535 - RNA, 22 nt, Human
agucaucugaccucuucucaga

SEQ ID NO: 44536 - RNA, 22 nt, Human
agucaucugguuuugcauggca

SEQ ID NO: 44537 - RNA, 22 nt, Human
agucauuaagacaacuggagua

SEQ ID NO: 44538 - RNA, 22 nt, Human
cugaaguuaguuaugccuaaaa

SEQ ID NO: 44539 - RNA, 22 nt, Human
cugaaguucgccagacucgggc

SEQ ID NO: 44540 - RNA, 22 nt, Human
cugaaguucuacaagccucagg

SEQ ID NO: 44541 - RNA, 22 nt, Human
cugaaguuuaugcuuuucgggu

SEQ ID NO: 44542 - RNA, 22 nt, Human
cugaauccacacaaggugaugg

SEQ ID NO: 44543 - RNA, 22 nt, Human
cugaaugaaaucaaggacugag

SEQ ID NO: 44544 - RNA, 22 nt, Human
cugaaugacugaagucacaauu

SEQ ID NO: 44545 - RNA, 22 nt, Human
cugaaugagggauucugagggc

SEQ ID NO: 44546 - RNA, 22 nt, Human
cugaaugauaaucuuuugcugg

SEQ ID NO: 44547 - RNA, 22 nt, Human
cugaaugauauaagaucuuucu

SEQ ID NO: 44548 - RNA, 22 nt, Human
cugacagauacuuaugacauaa

SEQ ID NO: 44549 - RNA, 22 nt, Human
cugacagaucuggaucugaacu

SEQ ID NO: 44550 - RNA, 22 nt, Human
cugacagcucuggcuaguagaa

SEQ ID NO: 44551 - RNA, 22 nt, Human
cugacaggguagacagagggca

SEQ ID NO: 44552 - RNA, 22 nt, Human
cugacagguugguagcuuugga

SEQ ID NO: 44553 - RNA, 22 nt, Human
cugaccagaccccaggaggcug

SEQ ID NO: 44554 - RNA, 22 nt, Human
cugaccaggguagaggugagag

SEQ ID NO: 44555 - RNA, 22 nt, Human
cugaccaguccuuagcaccugg

SEQ ID NO: 44556 - RNA, 22 nt, Human
cugaccaucauggugaaacccc

SEQ ID NO: 44557 - RNA, 22 nt, Human
cugacccagaggaacugcaaag

SEQ ID NO: 44558 - RNA, 19 nt, Human
cugacccaggacaccacgg

SEQ ID NO: 44559 - RNA, 18 nt, Human
cugacccuggcucugggu

SEQ ID NO: 44560 - RNA, 22 nt, Human
cugacccuuuaggguauguuua

SEQ ID NO: 44561 - RNA, 22 nt, Human
cugaccugcuaagccccugucc

SEQ ID NO: 44562 - RNA, 22 nt, Human
cugacucccaaagaggacgcgu

SEQ ID NO: 44563 - RNA, 22 nt, Human
cugacucccugauucuggguuu

SEQ ID NO: 44564 - RNA, 18 nt, Human
cugacuccuuugcugcca

SEQ ID NO: 44565 - RNA, 22 nt, Human
cugacucuccucaagcauaaau

SEQ ID NO: 44566 - RNA, 22 nt, Human
cugacuguaauucuguucuuaa

SEQ ID NO: 44567 - RNA, 22 nt, Human
cugacuucagggauaaaaagua

SEQ ID NO: 44568 - RNA, 22 nt, Human
cugacuuugcucauaggucaaa

SEQ ID NO: 44569 - RNA, 22 nt, Human
cugagaaaauuucaggaagugu

SEQ ID NO: 44570 - RNA, 22 nt, Human
cugagaaagugaggguuaaaca

SEQ ID NO: 44571 - RNA, 22 nt, Human
cugagaagaggguauguggcgc

SEQ ID NO: 44572 - RNA, 19 nt, Human
cugagaauccuacuuauuu

SEQ ID NO: 44573 - RNA, 22 nt, Human
cugagacacaguggcugaaaag

SEQ ID NO: 44574 - RNA, 22 nt, Human
cugagacuguaccacuuccucc

SEQ ID NO: 44575 - RNA, 22 nt, Human
cugagagaaacaugacucagga

SEQ ID NO: 44576 - RNA, 22 nt, Human
cugagagaaucaugcugcaggu

SEQ ID NO: 44577 - RNA, 22 nt, Human
cugagagcaucgcuggagauag

SEQ ID NO: 44578 - RNA, 22 nt, Human
cugagagccuccuguuggcuag

SEQ ID NO: 44579 - RNA, 22 nt, Human
cugagaggcacaaggcauuucg

SEQ ID NO: 44580 - RNA, 22 nt, Human
cugagaggcggagguugcagug

SEQ ID NO: 44581 - RNA, 22 nt, Human
cugagcuguggaauaaacacug

SEQ ID NO: 44582 - RNA, 22 nt, Human
cugagcugugugguccugggca

SEQ ID NO: 44583 - RNA, 22 nt, Human
cugagcuuaacccuguuagcaa

SEQ ID NO: 44584 - RNA, 22 nt, Human
cugagcuuccaguuccuccagg

SEQ ID NO: 44585 - RNA, 22 nt, Human
cugaggaaagcugcagcgguac

SEQ ID NO: 44586 - RNA, 22 nt, Human
cugaggaaaguauugccuggug

SEQ ID NO: 44587 - RNA, 22 nt, Human
cugaggagcguuggucacgugu

SEQ ID NO: 44588 - RNA, 22 nt, Human
cugaggagcugaaggcccucca

SEQ ID NO: 44589 - RNA, 22 nt, Human
cugaggagucaguuccacucag

SEQ ID NO: 44590 - RNA, 22 nt, Human
cugaggagugggugggcaguga

SEQ ID NO: 44591 - RNA, 22 nt, Human
cugaggaguuucuuauaugugu

SEQ ID NO: 44592 - RNA, 17 nt, Human
cugaggauuaugguugu

SEQ ID NO: 44593 - RNA, 22 nt, Human
cugaggcacagugaacuucucc

SEQ ID NO: 44594 - RNA, 22 nt, Human
cugaggcaccggcaauguucug

SEQ ID NO: 44595 - RNA, 22 nt, Human
cugaggcaggggcagcuggaga

SEQ ID NO: 44596 - RNA, 22 nt, Human
cugaggcaugaaugugggcuuu

SEQ ID NO: 44597 - RNA, 18 nt, Human
cugaggccaacuacacug

SEQ ID NO: 44598 - RNA, 22 nt, Human
cugaggccagagugggccucuu

SEQ ID NO: 44599 - RNA, 22 nt, Human
cugaggccucacuguagucccu

SEQ ID NO: 44600 - RNA, 22 nt, Human
cugaggccucuccuuggcuugu

SEQ ID NO: 44601 - RNA, 22 nt, Human
cugaggccucucuccuuggcuu

SEQ ID NO: 44602 - RNA, 23 nt, Human
cugaggccugcugcguucagguu

SEQ ID NO: 44603 - RNA, 22 nt, Human
cugaggccuguguuggggcagu

SEQ ID NO: 44604 - RNA, 18 nt, Human
cugaggcuggcaggagcc

SEQ ID NO: 44605 - RNA, 22 nt, Human
cugaggcugggcauggggucca

SEQ ID NO: 44606 - RNA, 22 nt, Human
cugaggcugggcugaggguaua

SEQ ID NO: 44607 - RNA, 22 nt, Human
cugaggcuuguccucucagcuu

SEQ ID NO: 44608 - RNA, 22 nt, Human
cugagggacccugugaguaccu

SEQ ID NO: 44609 - RNA, 22 nt, Human
cugagggagacagugcggacua

SEQ ID NO: 44610 - RNA, 22 nt, Human
cugagggagagaauggggcaaa

SEQ ID NO: 44611 - RNA, 22 nt, Human
cugagggauguggauuuugguc

SEQ ID NO: 44612 - RNA, 22 nt, Human
cugagggccgggacccaguuuc

SEQ ID NO: 44613 - RNA, 22 nt, Human
cugagggccugaggaccuagau

SEQ ID NO: 44614 - RNA, 22 nt, Human
cugagggccuuggcuccugccc

SEQ ID NO: 44615 - RNA, 22 nt, Human
cugagggcuuccuugucccggg

SEQ ID NO: 44616 - RNA, 22 nt, Human
cugagggucaacuugauuguau

SEQ ID NO: 44617 - RNA, 22 nt, Human
cugagguaauuuuccagauaau

SEQ ID NO: 44618 - RNA, 22 nt, Human
cugagguaccuggagcaggucc

SEQ ID NO: 44619 - RNA, 22 nt, Human
cugagguacgcuggcucccugg

SEQ ID NO: 44620 - RNA, 22 nt, Human
cugagguagccauggcccaagu

SEQ ID NO: 44621 - RNA, 22 nt, Human
cugagguagcugugaauguucu

SEQ ID NO: 44622 - RNA, 22 nt, Human
cugagguagucauuuucuacuc

SEQ ID NO: 44623 - RNA, 22 nt, Human
cugagguaugugggacuagccu

SEQ ID NO: 44624 - RNA, 22 nt, Human
cugagguauugaaguaucuucu

SEQ ID NO: 44625 - RNA, 22 nt, Human
cugagguccucagagggaaagg

SEQ ID NO: 44626 - RNA, 19 nt, Human
cugaggugaggggcaucau

SEQ ID NO: 44627 - RNA, 22 nt, Human
cugaggugaugucaaauggguu

SEQ ID NO: 44628 - RNA, 22 nt, Human
cugaggugcuauggaggauacg

SEQ ID NO: 44629 - RNA, 23 nt, Human
cugagguggagagugagguaagu

SEQ ID NO: 44630 - RNA, 22 nt, Human
cugagguggcgccucucuuuaa

SEQ ID NO: 44631 - RNA, 22 nt, Human
cugaggugggaguuuuucucau

SEQ ID NO: 44632 - RNA, 22 nt, Human
cugaggugugagccacuucccc

SEQ ID NO: 44633 - RNA, 22 nt, Human
cugagguguggucugggaguau

SEQ ID NO: 44634 - RNA, 22 nt, Human
cugaguaagauacagaagcucc

SEQ ID NO: 44635 - RNA, 22 nt, Human
cugaguccagggacagaggcgu

SEQ ID NO: 44636 - RNA, 22 nt, Human
cugagugaggggagcuugaugg

SEQ ID NO: 44637 - RNA, 18 nt, Human
cugagugaugauggggug

SEQ ID NO: 44638 - RNA, 22 nt, Human
cugaguguuuucagccacggcc

SEQ ID NO: 44639 - RNA, 22 nt, Human
cugauaauuugcugacuuucag

SEQ ID NO: 44640 - RNA, 22 nt, Human
cugauagacaaucaccauggga

SEQ ID NO: 44641 - RNA, 22 nt, Human
cugaucccauuggcaguccagu

SEQ ID NO: 44642 - RNA, 22 nt, Human
cugaugaccuuggcaagucaca

SEQ ID NO: 44643 - RNA, 22 nt, Human
cugaugagcccaggugaccaug

SEQ ID NO: 44644 - RNA, 22 nt, Human
cugaugcuauaagccacagugg

SEQ ID NO: 44645 - RNA, 22 nt, Human
cugauggagugauggagaaauu

SEQ ID NO: 44646 - RNA, 22 nt, Human
cugauguuucuagaugcuugcc

SEQ ID NO: 44647 - RNA, 22 nt, Human
cugccugggccggccacccucu

SEQ ID NO: 44648 - RNA, 22 nt, Human
cugccuguauugucugcuuggg

SEQ ID NO: 44649 - RNA, 22 nt, Human
cugccugugaacauacuggggg

SEQ ID NO: 44650 - RNA, 22 nt, Human
cugccugugccaaugcuccuuu

SEQ ID NO: 44651 - RNA, 22 nt, Human
cugccugugccaccgccucauu

SEQ ID NO: 44652 - RNA, 22 nt, Human
cugccuguggguacaaguggaa

SEQ ID NO: 44653 - RNA, 22 nt, Human
cugccugugucuauuccuuuuu

SEQ ID NO: 44654 - RNA, 22 nt, Human
cugccuuccaaccccagacucc

SEQ ID NO: 44655 - RNA, 21 nt, Human
cugccuugaaugguacuggga

SEQ ID NO: 44656 - RNA, 22 nt, Human
cugccuuggaaaaugugguaau

SEQ ID NO: 44657 - RNA, 22 nt, Human
cugccuugguucccagccagca

SEQ ID NO: 44658 - RNA, 22 nt, Human
cugccuuuucaucugagcugga

SEQ ID NO: 44659 - RNA, 22 nt, Human
cugcgggcugucaggcgugcca

SEQ ID NO: 44660 - RNA, 22 nt, Human
cugcgugcauuaauauuuccuu

SEQ ID NO: 44661 - RNA, 22 nt, Human
cugcgugucuccuuggggcaga

SEQ ID NO: 44662 - RNA, 22 nt, Human
cugcguguuugcacccugucug

SEQ ID NO: 44663 - RNA, 22 nt, Human
cugcuagaauuucuggaaaaga

SEQ ID NO: 44664 - RNA, 20 nt, Human
cugcucagaccaacucuucu

SEQ ID NO: 44665 - RNA, 22 nt, Human
cugcucagcggaaggaagagcg

SEQ ID NO: 44666 - RNA, 22 nt, Human
cugcucaguaauaguccuaucu

SEQ ID NO: 44667 - RNA, 20 nt, Human
cugcuccacccggcucucag

SEQ ID NO: 44668 - RNA, 23 nt, Human
cugcuccaggacagcauggaggu

SEQ ID NO: 44669 - RNA, 19 nt, Human
cugcuccaggagcugggga

SEQ ID NO: 44670 - RNA, 22 nt, Human
cugcucuaagcugguggagagu

SEQ ID NO: 44671 - RNA, 22 nt, Human
cugcucuaggggcagggcccuu

SEQ ID NO: 44672 - RNA, 22 nt, Human
cugcucuccccaggccagucug

SEQ ID NO: 44673 - RNA, 22 nt, Human
cugcucugcagcuuggacuccc

SEQ ID NO: 44674 - RNA, 22 nt, Human
cugcucuggcguacucggcauc

SEQ ID NO: 44675 - RNA, 22 nt, Human
cugcucuggggaagccagaugu

SEQ ID NO: 44676 - RNA, 21 nt, Human
cugcucuggggaccggcugug

SEQ ID NO: 44677 - RNA, 22 nt, Human
cugcucugugcacuuguucagg

SEQ ID NO: 44678 - RNA, 22 nt, Human
cugcucuugagggacugcgguc

SEQ ID NO: 44679 - RNA, 22 nt, Human
cugcugaaaacaauaaugauga

SEQ ID NO: 44680 - RNA, 22 nt, Human
cugcugaaccuuugcuagauaa

SEQ ID NO: 44681 - RNA, 22 nt, Human
cugcugaaugucucuuugguuu

SEQ ID NO: 44682 - RNA, 22 nt, Human
cugcugacucauuuucaacacu

SEQ ID NO: 44683 - RNA, 22 nt, Human
cugcugacucuuccuggaguga

SEQ ID NO: 44684 - RNA, 20 nt, Human
cugcugagagccuggcuugc

SEQ ID NO: 44685 - RNA, 22 nt, Human
cugcugagcauuugcagggaca

SEQ ID NO: 44686 - RNA, 22 nt, Human
cugcugagccgcacccaggagc

SEQ ID NO: 44687 - RNA, 22 nt, Human
cugcugagccuggugcgggaug

SEQ ID NO: 44688 - RNA, 22 nt, Human
cugcugaggcuccggaccaagu

SEQ ID NO: 44689 - RNA, 22 nt, Human
cugcugaucagggcaaagcaaa

SEQ ID NO: 44690 - RNA, 22 nt, Human
cugcugaugaccucaaacucuu

SEQ ID NO: 44691 - RNA, 22 nt, Human
cugcugauguaagccaugcucu

SEQ ID NO: 44692 - RNA, 22 nt, Human
cugcugcauuacucuucucaag

SEQ ID NO: 44693 - RNA, 22 nt, Human
cugcugcauuccucuuuaugag

SEQ ID NO: 44694 - RNA, 22 nt, Human
cugcugccaagggugccacagg

SEQ ID NO: 44695 - RNA, 22 nt, Human
cugcugccauuagggcacagac

SEQ ID NO: 44696 - RNA, 22 nt, Human
cugagaguagcuggagaacauu

SEQ ID NO: 44697 - RNA, 22 nt, Human
cugagagucagcuucuccuccu

SEQ ID NO: 44698 - RNA, 22 nt, Human
cugagaguuaagagauggggcu

SEQ ID NO: 44699 - RNA, 22 nt, Human
cugagauggaguuuugcucuug

SEQ ID NO: 44700 - RNA, 22 nt, Human
cugagauggccacugggucuca

SEQ ID NO: 44701 - RNA, 22 nt, Human
cugagcacagaaauaagauauu

SEQ ID NO: 44702 - RNA, 22 nt, Human
cugagcagaccauggcagaggu

SEQ ID NO: 44703 - RNA, 22 nt, Human
cugagcagcaccuucaagaaac

SEQ ID NO: 44704 - RNA, 22 nt, Human
cugagcagcagggagacuggug

SEQ ID NO: 44705 - RNA, 22 nt, Human
cugagcagcuguuacagagugu

SEQ ID NO: 44706 - RNA, 22 nt, Human
cugagcaggcgguggagcggcu

SEQ ID NO: 44707 - RNA, 22 nt, Human
cugagccaaaaagcagagcuug

SEQ ID NO: 44708 - RNA, 22 nt, Human
cugagccaaggggacagugaca

SEQ ID NO: 44709 - RNA, 22 nt, Human
cugagcccaggcgggagcugag

SEQ ID NO: 44710 - RNA, 20 nt, Human
cugagcccccagccugcagg

SEQ ID NO: 44711 - RNA, 17 nt, Human
cugagccccgggcagcu

SEQ ID NO: 44712 - RNA, 22 nt, Human
cugagcccgggugcucuacccc

SEQ ID NO: 44713 - RNA, 22 nt, Human
cugagcccuccugcuugcugag

SEQ ID NO: 44714 - RNA, 20 nt, Human
cugagcccuuccugugaacc

SEQ ID NO: 44715 - RNA, 22 nt, Human
cugagcccuugaacccaagucc

SEQ ID NO: 44716 - RNA, 22 nt, Human
cugagcccuugcuuaugcuucc

SEQ ID NO: 44717 - RNA, 22 nt, Human
cugagccuugaugucccuuguc

SEQ ID NO: 44718 - RNA, 22 nt, Human
cugagcgacaaguagcuuuuga

SEQ ID NO: 44719 - RNA, 22 nt, Human
cugagcgcgggaccugaggcug

SEQ ID NO: 44720 - RNA, 20 nt, Human
cugagcgucuaagaggugag

SEQ ID NO: 44721 - RNA, 22 nt, Human
cugagcuaggaguuaggaagcu

SEQ ID NO: 44722 - RNA, 22 nt, Human
cugagcugagccaaaucugucu

SEQ ID NO: 44723 - RNA, 22 nt, Human
cugagcugggaguagagacucu

SEQ ID NO: 44724 - RNA, 22 nt, Human
cugagcugggaguggauagugg

SEQ ID NO: 44725 - RNA, 22 nt, Human
cugagcuguggccaccaauuua

SEQ ID NO: 44726 - RNA, 22 nt, Human
cugagcuguuacucuguccucg

SEQ ID NO: 44727 - RNA, 22 nt, Human
cugagcuuggccaggaaugaau

SEQ ID NO: 44728 - RNA, 22 nt, Human
cugaggaaggaguuaggcaguu

SEQ ID NO: 44729 - RNA, 22 nt, Human
cugaggaccccacaggaggccc

SEQ ID NO: 44730 - RNA, 22 nt, Human
cugaggagaaagaugguccaag

SEQ ID NO: 44731 - RNA, 17 nt, Human
cugaggagaacagaaag

SEQ ID NO: 44732 - RNA, 22 nt, Human
cugaggagaccaucaacuaauu

SEQ ID NO: 44733 - RNA, 22 nt, Human
cugaggagaugauaaugucauu

SEQ ID NO: 44734 - RNA, 22 nt, Human
cugaggagcccccucucagcau

SEQ ID NO: 44735 - RNA, 22 nt, Human
cugaggaggggccugagugaga

SEQ ID NO: 44736 - RNA, 22 nt, Human
cugaggagucagcuuacucacu

SEQ ID NO: 44737 - RNA, 22 nt, Human
cugaggcagaaaaagcaagggu

SEQ ID NO: 44738 - RNA, 22 nt, Human
cugaggcaggauggccuggcug

SEQ ID NO: 44739 - RNA, 22 nt, Human
cugaggccccucucuugagcuu

SEQ ID NO: 44740 - RNA, 22 nt, Human
cugaggccccucuugugagcau

SEQ ID NO: 44741 - RNA, 22 nt, Human
cugaggccguuggugggccuua

SEQ ID NO: 44742 - RNA, 22 nt, Human
cugaggccuaagacaugaauga

SEQ ID NO: 44743 - RNA, 22 nt, Human
cugaggccucguuggcuggaac

SEQ ID NO: 44744 - RNA, 22 nt, Human
cugaggccucucuccugggcuu

SEQ ID NO: 44745 - RNA, 22 nt, Human
cugaggccucuguucaccagaa

SEQ ID NO: 44746 - RNA, 22 nt, Human
cugaggccuggccccaccacag

SEQ ID NO: 44747 - RNA, 22 nt, Human
cugaggccuggugaggugguga

SEQ ID NO: 44748 - RNA, 22 nt, Human
cugaggcucaagggcagguggg

SEQ ID NO: 44749 - RNA, 22 nt, Human
cugaggcugagacaggugaaau

SEQ ID NO: 44750 - RNA, 22 nt, Human
cugaggcuuggaggggucuggu

SEQ ID NO: 44751 - RNA, 22 nt, Human
cugaggcuuugugugcaugccu

SEQ ID NO: 44752 - RNA, 22 nt, Human
cugagggaacuugggcaagucu

SEQ ID NO: 44753 - RNA, 22 nt, Human
cugagggagcugcuggccuugg

SEQ ID NO: 44754 - RNA, 22 nt, Human
cugagggaguuccugagcccac

SEQ ID NO: 44755 - RNA, 18 nt, Human
cugagggcaacagaggcu

SEQ ID NO: 44756 - RNA, 22 nt, Human
cugccgagugggucaugaggca

SEQ ID NO: 44757 - RNA, 22 nt, Human
cugccgggcccuggauuuggca

SEQ ID NO: 44758 - RNA, 22 nt, Human
cugccuagggucugguaccaca

SEQ ID NO: 44759 - RNA, 22 nt, Human
cugccucaugcugccugcagcc

SEQ ID NO: 44760 - RNA, 22 nt, Human
cugccuccucacguccacagug

SEQ ID NO: 44761 - RNA, 22 nt, Human
cugccuccugccgugcagcuuc

SEQ ID NO: 44762 - RNA, 22 nt, Human
cugccucuauaggaguccacca

SEQ ID NO: 44763 - RNA, 22 nt, Human
cugccucuccccagaguggccc

SEQ ID NO: 44764 - RNA, 22 nt, Human
cugccugcaucccacagugggg

SEQ ID NO: 44765 - RNA, 22 nt, Human
cugccugcgccaccaccacguc

SEQ ID NO: 44766 - RNA, 22 nt, Human
cugccugcucuauccaggccug

SEQ ID NO: 44767 - RNA, 22 nt, Human
cugccugcugccuguggagggu

SEQ ID NO: 44768 - RNA, 23 nt, Human
cugccugcuggggagacagaucu

SEQ ID NO: 44769 - RNA, 22 nt, Human
cugccugcuuuucugggagccg

SEQ ID NO: 44770 - RNA, 22 nt, Human
cugccuggacagcucuuaccuu

SEQ ID NO: 44771 - RNA, 22 nt, Human
cugccuggcccagggaugggcc

SEQ ID NO: 44772 - RNA, 22 nt, Human
cugccuggggcaucagucaagg

SEQ ID NO: 44773 - RNA, 22 nt, Human
cugccugguacuuuaggcacuu

SEQ ID NO: 44774 - RNA, 22 nt, Human
cugccugugauuuuucucuagu

SEQ ID NO: 44775 - RNA, 22 nt, Human
cugccugugcaugcagucagaa

SEQ ID NO: 44776 - RNA, 22 nt, Human
cugccuguggucugugaucuaa

SEQ ID NO: 44777 - RNA, 22 nt, Human
cugccuguuagucuagcaguua

SEQ ID NO: 44778 - RNA, 22 nt, Human
cugccuguuccugaucauucua

SEQ ID NO: 44779 - RNA, 18 nt, Human
cugccuguugcugagagg

SEQ ID NO: 44780 - RNA, 22 nt, Human
cugccuucaucucugagcuggg

SEQ ID NO: 44781 - RNA, 22 nt, Human
cugccuuugaaaguucuguuga

SEQ ID NO: 44782 - RNA, 22 nt, Human
cugccuuuuaaagccaguguua

SEQ ID NO: 44783 - RNA, 22 nt, Human
cugcgugagcgugcccgucuug

SEQ ID NO: 44784 - RNA, 22 nt, Human
cugcgugucucugucucauggc

SEQ ID NO: 44785 - RNA, 22 nt, Human
cugcguucauuuugagugcugu

SEQ ID NO: 44786 - RNA, 22 nt, Human
cugcuaaaccucucugagagcu

SEQ ID NO: 44787 - RNA, 22 nt, Human
cugcuacaccggaauagugaca

SEQ ID NO: 44788 - RNA, 22 nt, Human
cugcucaauuccggcacgcugg

SEQ ID NO: 44789 - RNA, 22 nt, Human
cugcucacgccaccguucauca

SEQ ID NO: 44790 - RNA, 22 nt, Human
cugcucagaggaaggaaugucu

SEQ ID NO: 44791 - RNA, 22 nt, Human
cugcucagucauguuggauugu

SEQ ID NO: 44792 - RNA, 22 nt, Human
cugcuccacaccuccauuuccu

SEQ ID NO: 44793 - RNA, 22 nt, Human
cugcuccucugagguagccaca

SEQ ID NO: 44794 - RNA, 22 nt, Human
cugcuccuguccagcagggcca

SEQ ID NO: 44795 - RNA, 22 nt, Human
cugcucuagguuccugcauaug

SEQ ID NO: 44796 - RNA, 22 nt, Human
cugcucugaagccaggauucug

SEQ ID NO: 44797 - RNA, 22 nt, Human
cugcucugacccuuucaccuuc

SEQ ID NO: 44798 - RNA, 22 nt, Human
cugcucugaguauuaacggagg

SEQ ID NO: 44799 - RNA, 20 nt, Human
cugcucugcuuugcaggugg

SEQ ID NO: 44800 - RNA, 22 nt, Human
cugcucuggucucuucauguuu

SEQ ID NO: 44801 - RNA, 22 nt, Human
cugcucugugguccaugagaca

SEQ ID NO: 44802 - RNA, 22 nt, Human
cugcucuguucccccaucaucu

SEQ ID NO: 44803 - RNA, 19 nt, Human
cugcugaauuagcucugga

SEQ ID NO: 44804 - RNA, 22 nt, Human
cugcugagguccuugcucagac

SEQ ID NO: 44805 - RNA, 22 nt, Human
cugcugauucuuaaaugugguu

SEQ ID NO: 44806 - RNA, 22 nt, Human
cugcugcaaucuggcuuccaug

SEQ ID NO: 44807 - RNA, 20 nt, Human
cugcugcccugucagccucu

SEQ ID NO: 44808 - RNA, 22 nt, Human
cugcugccggcgagccucccuu

SEQ ID NO: 44809 - RNA, 22 nt, Human
cugcugccugacaauuuagguu

SEQ ID NO: 44810 - RNA, 22 nt, Human
cugcugccugauugcagaccuc

SEQ ID NO: 44811 - RNA, 22 nt, Human
cugcugcccagugugcauuggg

SEQ ID NO: 44812 - RNA, 22 nt, Human
cugcugcccuagacccaguccu

SEQ ID NO: 44813 - RNA, 22 nt, Human
cugcugccuaguccaagacgug

SEQ ID NO: 44814 - RNA, 22 nt, Human
cugcugccucgacauugggaca

SEQ ID NO: 44815 - RNA, 22 nt, Human
cugcugcucgaccagucccagg

SEQ ID NO: 44816 - RNA, 22 nt, Human
cugcugcugagaaugccucagg

SEQ ID NO: 44817 - RNA, 22 nt, Human
cugcugggaaggucugcucagu

SEQ ID NO: 44818 - RNA, 22 nt, Human
cugcugggcuccucaugugacu

SEQ ID NO: 44819 - RNA, 22 nt, Human
cugcugggucccccugcugauu

SEQ ID NO: 44820 - RNA, 19 nt, Human
cugcugggugcugagggag

SEQ ID NO: 44821 - RNA, 22 nt, Human
cugcuggguuugccuuucacca

SEQ ID NO: 44822 - RNA, 22 nt, Human
cugcuggugaugucugggcaug

SEQ ID NO: 44823 - RNA, 22 nt, Human
cugcuguaaugagucagcaucu

SEQ ID NO: 44824 - RNA, 22 nt, Human
cugcugucaaaaaucacuccau

SEQ ID NO: 44825 - RNA, 22 nt, Human
cugcugucaaaggaaauauuug

SEQ ID NO: 44826 - RNA, 22 nt, Human
cugcugugacagcugccguguu

SEQ ID NO: 44827 - RNA, 22 nt, Human
cugcugugagugguucuugccu

SEQ ID NO: 44828 - RNA, 22 nt, Human
cugcugugauugggagaaaccg

SEQ ID NO: 44829 - RNA, 22 nt, Human
cugcugugcaacauugcaccua

SEQ ID NO: 44830 - RNA, 22 nt, Human
cugcugugcacccaggaaggcu

SEQ ID NO: 44831 - RNA, 22 nt, Human
cugcugugcaggugccuaugau

SEQ ID NO: 44832 - RNA, 22 nt, Human
cugcuguggccagccaggucaa

SEQ ID NO: 44833 - RNA, 21 nt, Human
cugcuguggcccccgacaugc

SEQ ID NO: 44834 - RNA, 22 nt, Human
cugcuguggguuaagacacugu

SEQ ID NO: 44835 - RNA, 18 nt, Human
cugcugugucgucugggc

SEQ ID NO: 44836 - RNA, 20 nt, Human
cugcuguguuauuguagaac

SEQ ID NO: 44837 - RNA, 22 nt, Human
cugcuguguuucugcuagaaaa

SEQ ID NO: 44838 - RNA, 22 nt, Human
cugcuguucagaggaccucacu

SEQ ID NO: 44839 - RNA, 22 nt, Human
cugcuguuccaccucugaaugc

SEQ ID NO: 44840 - RNA, 20 nt, Human
cugcuuaaguaagugacaca

SEQ ID NO: 44841 - RNA, 22 nt, Human
cugcuucacccaacuuugggau

SEQ ID NO: 44842 - RNA, 22 nt, Human
cugcuucagcaaagcuauuugc

SEQ ID NO: 44843 - RNA, 22 nt, Human
cugcuuccacacaagcaaagcu

SEQ ID NO: 44844 - RNA, 19 nt, Human
cugcuuccuucccucacug

SEQ ID NO: 44845 - RNA, 23 nt, Human
cugcuuccuugcuucauugcugg

SEQ ID NO: 44846 - RNA, 22 nt, Human
cugcuugaccuguuguucucac

SEQ ID NO: 44847 - RNA, 22 nt, Human
cugcuuggcuuauaaccucagg

SEQ ID NO: 44848 - RNA, 18 nt, Human
cugcuugggagacgucag

SEQ ID NO: 44849 - RNA, 22 nt, Human
cugcuuuaaaacccucagcugg

SEQ ID NO: 44850 - RNA, 22 nt, Human
cugcuuuaacucugggaagcca

SEQ ID NO: 44851 - RNA, 22 nt, Human
cugcuuuaaucccugccuggaa

SEQ ID NO: 44852 - RNA, 22 nt, Human
cugcuuuaccaaacucuuggau

SEQ ID NO: 44853 - RNA, 22 nt, Human
cugcuuuaucugagacaaguca

SEQ ID NO: 44854 - RNA, 22 nt, Human
cugcuuucuuguugcaucuuaa

SEQ ID NO: 44855 - RNA, 22 nt, Human
cugcuuugaggggcucuguaua

SEQ ID NO: 44856 - RNA, 22 nt, Human
cugcuuuggacaacuauucuug

SEQ ID NO: 44857 - RNA, 22 nt, Human
cuggaaagaccugcuugcuuuu

SEQ ID NO: 44858 - RNA, 22 nt, Human
cuggaaagauuuacacggggaa

SEQ ID NO: 44859 - RNA, 22 nt, Human
cuggaaaggguccucauucugu

SEQ ID NO: 44860 - RNA, 22 nt, Human
cuggaaaguacagugugucaca

SEQ ID NO: 44861 - RNA, 22 nt, Human
cuggaacuccuggggagcuggu

SEQ ID NO: 44862 - RNA, 22 nt, Human
cuggaagagcauuugcauaggg

SEQ ID NO: 44863 - RNA, 22 nt, Human
cuggaagaggacacacgaauca

SEQ ID NO: 44864 - RNA, 22 nt, Human
cuggaagaggggaaaugccaug

SEQ ID NO: 44865 - RNA, 22 nt, Human
cuggccucuguguucaccauag

SEQ ID NO: 44866 - RNA, 22 nt, Human
cuggccugagcacagcggcugc

SEQ ID NO: 44867 - RNA, 22 nt, Human
cuggccugaggucggcuguagg

SEQ ID NO: 44868 - RNA, 22 nt, Human
cuggccugcugggugagguccu

SEQ ID NO: 44869 - RNA, 22 nt, Human
cuggccuggggccucagcugcu

SEQ ID NO: 44870 - RNA, 22 nt, Human
cuggccuggggggacacauccc

SEQ ID NO: 44871 - RNA, 22 nt, Human
cuggccuucagacucggacuga

SEQ ID NO: 44872 - RNA, 22 nt, Human
cuggccuuggaagggagcccgu

SEQ ID NO: 44873 - RNA, 22 nt, Human
cuggccuuuuguuucuggagaa

SEQ ID NO: 44874 - RNA, 22 nt, Human
cuggcgcaacagaaaaucugga

SEQ ID NO: 44875 - RNA, 22 nt, Human
cuggcucacaggugagaugcau

SEQ ID NO: 44876 - RNA, 22 nt, Human
cuggcucagugccuucagaagu

SEQ ID NO: 44877 - RNA, 22 nt, Human
cuggcucaguucuugguuuuca

SEQ ID NO: 44878 - RNA, 22 nt, Human
cuggcuccagugacaagucgau

SEQ ID NO: 44879 - RNA, 22 nt, Human
cuggcuccauccuaggcaaaug

SEQ ID NO: 44880 - RNA, 22 nt, Human
cuggcuccauccuugagcucug

SEQ ID NO: 44881 - RNA, 22 nt, Human
cuggcucccagcuuucagggag

SEQ ID NO: 44882 - RNA, 22 nt, Human
cuggcucucgcugggaguacuu

SEQ ID NO: 44883 - RNA, 22 nt, Human
cuggcucucugagauauugagu

SEQ ID NO: 44884 - RNA, 22 nt, Human
cuggcucugacuccgcauauuu

SEQ ID NO: 44885 - RNA, 22 nt, Human
cuggcucugagcccaccuccag

SEQ ID NO: 44886 - RNA, 22 nt, Human
cuggcucugucacccuuucucc

SEQ ID NO: 44887 - RNA, 22 nt, Human
cuggcucuuucagccgcuggag

SEQ ID NO: 44888 - RNA, 22 nt, Human
cuggcugaucuccugaaugucu

SEQ ID NO: 44889 - RNA, 22 nt, Human
cuggcugcagcuccgaggaaga

SEQ ID NO: 44890 - RNA, 22 nt, Human
cuggcugccacuucagggucuu

SEQ ID NO: 44891 - RNA, 22 nt, Human
cuggcugccagcauuuggggga

SEQ ID NO: 44892 - RNA, 22 nt, Human
cuggcugcuugggacagccaug

SEQ ID NO: 44893 - RNA, 20 nt, Human
cuggcuggaaacuuagccuu

SEQ ID NO: 44894 - RNA, 22 nt, Human
cuggcuggaggugagucacuga

SEQ ID NO: 44895 - RNA, 22 nt, Human
cuggcuggcagaugcucuugcu

SEQ ID NO: 44896 - RNA, 22 nt, Human
cuggcugggagcgagcugcuca

SEQ ID NO: 44897 - RNA, 22 nt, Human
cuggcuggggaagucauuugau

SEQ ID NO: 44898 - RNA, 22 nt, Human
cuggcugguuuuuaaagcuagg

SEQ ID NO: 44899 - RNA, 22 nt, Human
cuggcuguaacauuuugccaua

SEQ ID NO: 44900 - RNA, 22 nt, Human
cuggcugugcuggaguugagga

SEQ ID NO: 44901 - RNA, 22 nt, Human
cuggcugugugucuucauucag

SEQ ID NO: 44902 - RNA, 22 nt, Human
cuggcuuccaccauggccccug

SEQ ID NO: 44903 - RNA, 22 nt, Human
cuggcuuccucaggagcagugg

SEQ ID NO: 44904 - RNA, 22 nt, Human
cuggcuuuaaugucaucuuucu

SEQ ID NO: 44905 - RNA, 22 nt, Human
cuggcuuucccuggacaacagc

SEQ ID NO: 44906 - RNA, 22 nt, Human
cuggcuuucuauuuggugcuau

SEQ ID NO: 44907 - RNA, 22 nt, Human
cuggcuuugaaggucuuuccua

SEQ ID NO: 44908 - RNA, 22 nt, Human
cuggcuuugaucagagugaccu

SEQ ID NO: 44909 - RNA, 22 nt, Human
cuggcuuuggaaacaauuuauc

SEQ ID NO: 44910 - RNA, 22 nt, Human
cuggcuuugguccccugugccu

SEQ ID NO: 44911 - RNA, 22 nt, Human
cuggcuuuguauaguucccuga

SEQ ID NO: 44912 - RNA, 22 nt, Human
cuggcuuuuagugugaagacuu

SEQ ID NO: 44913 - RNA, 22 nt, Human
cuggcuuuuggaggagggucag

SEQ ID NO: 44914 - RNA, 22 nt, Human
cugggaaagugugcuccccucc

SEQ ID NO: 44915 - RNA, 22 nt, Human
cugggaacaggcacugcuguca

SEQ ID NO: 44916 - RNA, 22 nt, Human
cugggaagccacaggguguggg

SEQ ID NO: 44917 - RNA, 22 nt, Human
cugggaaguagaaucagaugag

SEQ ID NO: 44918 - RNA, 22 nt, Human
cugggacacguugugcuuuaac

SEQ ID NO: 44919 - RNA, 22 nt, Human
cugggacagagcagcagugggg

SEQ ID NO: 44920 - RNA, 22 nt, Human
cugggacaguucagguagggca

SEQ ID NO: 44921 - RNA, 22 nt, Human
cugggacauuauaagaaacauu

SEQ ID NO: 44922 - RNA, 22 nt, Human
cugggacccacaccuggaaucu

SEQ ID NO: 44923 - RNA, 22 nt, Human
cugggaccuccugagguggagc

SEQ ID NO: 44924 - RNA, 22 nt, Human
cugggacugccauucacagcca

SEQ ID NO: 44925 - RNA, 22 nt, Human
cugggacuggaccucugccugg

SEQ ID NO: 44926 - RNA, 22 nt, Human
cugggagagccuuuccugaguc

SEQ ID NO: 44927 - RNA, 22 nt, Human
cugggagaggaaccucgagggu

SEQ ID NO: 44928 - RNA, 22 nt, Human
cugggagaugacucagagcagg

SEQ ID NO: 44929 - RNA, 22 nt, Human
cugggagcaagaggcugcaaau

SEQ ID NO: 44930 - RNA, 22 nt, Human
cugggagcaccauacuuguuuc

SEQ ID NO: 44931 - RNA, 22 nt, Human
cugggagcucagcccuggggug

SEQ ID NO: 44932 - RNA, 22 nt, Human
cugggagcuggaugcccugccc

SEQ ID NO: 44933 - RNA, 22 nt, Human
cugggaggauacacaagaucag

SEQ ID NO: 44934 - RNA, 22 nt, Human
cugggaggcagucucucuagaa

SEQ ID NO: 44935 - RNA, 22 nt, Human
cugggaggcggagguuguagug

SEQ ID NO: 44936 - RNA, 22 nt, Human
cugggagguggagguugcauug

SEQ ID NO: 44937 - RNA, 22 nt, Human
cugggaguccaggauacagaug

SEQ ID NO: 44938 - RNA, 22 nt, Human
cugggagucuggaauuuuggua

SEQ ID NO: 44939 - RNA, 22 nt, Human
cugggagugucccucugguaau

SEQ ID NO: 44940 - RNA, 22 nt, Human
cugggauccacgggcucccaag

SEQ ID NO: 44941 - RNA, 22 nt, Human
cugggaugggaacugagaauca

SEQ ID NO: 44942 - RNA, 22 nt, Human
cugggaugugaggagcgccucu

SEQ ID NO: 44943 - RNA, 17 nt, Human
cugggauguggacucuu

SEQ ID NO: 44944 - RNA, 22 nt, Human
cugggcaaauugugccagcuau

SEQ ID NO: 44945 - RNA, 22 nt, Human
cugggcacaggggagcagaguc

SEQ ID NO: 44946 - RNA, 22 nt, Human
cugggcacaguggcucacgccu

SEQ ID NO: 44947 - RNA, 22 nt, Human
cugggcacauuuugacuagugu

SEQ ID NO: 44948 - RNA, 20 nt, Human
cugggcaccugucugcaguu

SEQ ID NO: 44949 - RNA, 22 nt, Human
cugggcacugcaggguguugag

SEQ ID NO: 44950 - RNA, 22 nt, Human
cugggcagaauuuuaggauggc

SEQ ID NO: 44951 - RNA, 22 nt, Human
cugggcagcugugcaaacaaua

SEQ ID NO: 44952 - RNA, 22 nt, Human
cugggcaggauacuucauggga

SEQ ID NO: 44953 - RNA, 22 nt, Human
cugggcaguucgcuuucguuuu

SEQ ID NO: 44954 - RNA, 22 nt, Human
cugggcaguuuauucaguucug

SEQ ID NO: 44955 - RNA, 22 nt, Human
cugggcaugaaaaggaugccag

SEQ ID NO: 44956 - RNA, 23 nt, Human
cugggcauggagcuucagaggcu

SEQ ID NO: 44957 - RNA, 22 nt, Human
cugggccaaaagaaguguucuu

SEQ ID NO: 44958 - RNA, 22 nt, Human
cugggccaagaaguuguguaug

SEQ ID NO: 44959 - RNA, 22 nt, Human
cugggccacaucagaugaagac

SEQ ID NO: 44960 - RNA, 22 nt, Human
cugggccacuccagaugcccac

SEQ ID NO: 44961 - RNA, 22 nt, Human
gcuggagcugcagccugggccu

SEQ ID NO: 44962 - RNA, 22 nt, Human
gcuggaggaggaagugugaggg

SEQ ID NO: 44963 - RNA, 22 nt, Human
gcuggaguccaguggcaugauc

SEQ ID NO: 44964 - RNA, 22 nt, Human
gcuggagugcuggagugcagug

SEQ ID NO: 44965 - RNA, 22 nt, Human
gcuggaucccugugggaguggu

SEQ ID NO: 44966 - RNA, 22 nt, Human
gcuggcacauggcucagggccu

SEQ ID NO: 44967 - RNA, 22 nt, Human
gcuggcaccuauuuggaccugg

SEQ ID NO: 44968 - RNA, 22 nt, Human
gcuggcacugggaaggacugag

SEQ ID NO: 44969 - RNA, 22 nt, Human
gcuggcagacugggggcagaac

SEQ ID NO: 44970 - RNA, 22 nt, Human
gcuggcaggagccuuucccuuu

SEQ ID NO: 44971 - RNA, 22 nt, Human
gcuggcaggguucucacugaaa

SEQ ID NO: 44972 - RNA, 22 nt, Human
gcuggccaaaguguaccuggag

SEQ ID NO: 44973 - RNA, 22 nt, Human
gcuggccacauugugccguccu

SEQ ID NO: 44974 - RNA, 22 nt, Human
cugugucccuugucccagagcc

SEQ ID NO: 44975 - RNA, 22 nt, Human
cuguguccuccccaucacuucu

SEQ ID NO: 44976 - RNA, 22 nt, Human
cuguguccucccgcugcaccca

SEQ ID NO: 44977 - RNA, 23 nt, Human
cugugucuaugcagccauaucca

SEQ ID NO: 44978 - RNA, 22 nt, Human
cugugucucuaccuccccaucc

SEQ ID NO: 44979 - RNA, 22 nt, Human
cugugucuucugcuuacagucu

SEQ ID NO: 44980 - RNA, 22 nt, Human
cugugugaauagugaggucuau

SEQ ID NO: 44981 - RNA, 22 nt, Human
cugugugagugacugcaucuca

SEQ ID NO: 44982 - RNA, 22 nt, Human
cugugugcaacuugcaguuuug

SEQ ID NO: 44983 - RNA, 22 nt, Human
cugugugcugaaaugcagugag

SEQ ID NO: 44984 - RNA, 22 nt, Human
cugugugcuguuagggagcugc

SEQ ID NO: 44985 - RNA, 22 nt, Human
cuguguggacugguugaggccc

SEQ ID NO: 44986 - RNA, 22 nt, Human
cugugugucauuugucaauccu

SEQ ID NO: 44987 - RNA, 22 nt, Human
cuguguguccucggacgaguuu

SEQ ID NO: 44988 - RNA, 22 nt, Human
cuguguuucugagaagugggga

SEQ ID NO: 44989 - RNA, 22 nt, Human
cuguguuugaugagaagccacc

SEQ ID NO: 44990 - RNA, 22 nt, Human
cuguguuuggacaacuuuucag

SEQ ID NO: 44991 - RNA, 22 nt, Human
cuguuaaaaagaccaauggauu

SEQ ID NO: 44992 - RNA, 22 nt, Human
cuguuacacggaccuucaaauc

SEQ ID NO: 44993 - RNA, 22 nt, Human
cuguuacccagcaaccccagca

SEQ ID NO: 44994 - RNA, 22 nt, Human
cuguuacuaaucuuuucugcua

SEQ ID NO: 44995 - RNA, 22 nt, Human
cuguuacugcuggagccauuga

SEQ ID NO: 44996 - RNA, 22 nt, Human
cuguuacuguauuuaaucaucu

SEQ ID NO: 44997 - RNA, 23 nt, Human
cuguuauauggguguuaugugcu

SEQ ID NO: 44998 - RNA, 22 nt, Human
cuguuauauugguauauuuaca

SEQ ID NO: 44999 - RNA, 22 nt, Human
cuguuaucaucaggaggggaua

SEQ ID NO: 45000 - RNA, 22 nt, Human
cuguuaucuguuauugccaguu

SEQ ID NO: 45001 - RNA, 22 nt, Human
cuguuauuaaaaagcucaggcu

SEQ ID NO: 45002 - RNA, 22 nt, Human
cuguuauuuaugcugcuccauu

SEQ ID NO: 45003 - RNA, 22 nt, Human
cuguuauuuuccucugaacucu

SEQ ID NO: 45004 - RNA, 22 nt, Human
cuguucaguaaccuauaaaaca

SEQ ID NO: 45005 - RNA, 22 nt, Human
cuguucauggaaaaauaguugg

SEQ ID NO: 45006 - RNA, 22 nt, Human
cuguucuaucauuaaaagcuau

SEQ ID NO: 45007 - RNA, 22 nt, Human
cuguucugaacugccugcaugc

SEQ ID NO: 45008 - RNA, 22 nt, Human
cuguucugaccagugcagggau

SEQ ID NO: 45009 - RNA, 22 nt, Human
cuguucuggagacacugaugaa

SEQ ID NO: 45010 - RNA, 22 nt, Human
cuguucuuaucgucuuaauauc

SEQ ID NO: 45011 - RNA, 18 nt, Human
cuguugagauguggcuga

SEQ ID NO: 45012 - RNA, 22 nt, Human
cuguugaucucaguuagcuaga

SEQ ID NO: 45013 - RNA, 22 nt, Human
cuguugcagaggggcggagagg

SEQ ID NO: 45014 - RNA, 22 nt, Human
cuguugcaugacugugcaugcu

SEQ ID NO: 45015 - RNA, 22 nt, Human
cuguugcuaaguagugcaggua

SEQ ID NO: 45016 - RNA, 22 nt, Human
cuguugcugagguucaaggguc

SEQ ID NO: 45017 - RNA, 22 nt, Human
cuguugcugggaacgcauguca

SEQ ID NO: 45018 - RNA, 22 nt, Human
cuguuggaugguuuccaaaaga

SEQ ID NO: 45019 - RNA, 22 nt, Human
cuguuggaugugacacuguuag

SEQ ID NO: 45020 - RNA, 22 nt, Human
cuguuguagcugcgcugcuuca

SEQ ID NO: 45021 - RNA, 22 nt, Human
cuguuuaucccuuuggucagca

SEQ ID NO: 45022 - RNA, 22 nt, Human
cuguuuauuacacuggauagca

SEQ ID NO: 45023 - RNA, 20 nt, Human
cuguuuauuagaaguggauu

SEQ ID NO: 45024 - RNA, 22 nt, Human
cuguuucauagaguugugaauu

SEQ ID NO: 45025 - RNA, 22 nt, Human
cuguuucucccaacgcccuagu

SEQ ID NO: 45026 - RNA, 19 nt, Human
cuguuucugagcuugcuuu

SEQ ID NO: 45027 - RNA, 22 nt, Human
cuguuucuuugcugucagagag

SEQ ID NO: 45028 - RNA, 21 nt, Human
cuguuugcaagccuauguguc

SEQ ID NO: 45029 - RNA, 20 nt, Human
cuguuugcuaucaugagcug

SEQ ID NO: 45030 - RNA, 22 nt, Human
cuguuugucucucuccugaccc

SEQ ID NO: 45031 - RNA, 22 nt, Human
cuguuuuaucucaagaguucaa

SEQ ID NO: 45032 - RNA, 22 nt, Human
cuguuuuaugaagggaaugaga

SEQ ID NO: 45033 - RNA, 22 nt, Human
cuguuuuccuggguuccaugag

SEQ ID NO: 45034 - RNA, 22 nt, Human
cuguuuucuacagucugggucu

SEQ ID NO: 45035 - RNA, 22 nt, Human
cuguuuucuagggcugagguga

SEQ ID NO: 45036 - RNA, 22 nt, Human
cuuaaaaguugcuucccuaacu

SEQ ID NO: 45037 - RNA, 22 nt, Human
cuuaaagaaauugaggagagga

SEQ ID NO: 45038 - RNA, 22 nt, Human
cuuaaagaugucaaggcuguuu

SEQ ID NO: 45039 - RNA, 22 nt, Human
cuuaaauuggaugaguuaaguu

SEQ ID NO: 45040 - RNA, 22 nt, Human
cuuaacagcaagaucuguguca

SEQ ID NO: 45041 - RNA, 22 nt, Human
cuuaacauccugcauuuuucuu

SEQ ID NO: 45042 - RNA, 22 nt, Human
cuuaacaugggggguaagucug

SEQ ID NO: 45043 - RNA, 21 nt, Human
cuuaacauuuuaaaugaaagg

SEQ ID NO: 45044 - RNA, 22 nt, Human
cuuaacuugaugucucucugcu

SEQ ID NO: 45045 - RNA, 22 nt, Human
cuuaagaagcaagucucagcaa

SEQ ID NO: 45046 - RNA, 22 nt, Human
cuuaagaugaggucaugcuaua

SEQ ID NO: 45047 - RNA, 21 nt, Human
cuuaagauggcauaguacgaa

SEQ ID NO: 45048 - RNA, 22 nt, Human
cuuaagauugucagcuucagcc

SEQ ID NO: 45049 - RNA, 22 nt, Human
cuuaagauuugagauaccuaau

SEQ ID NO: 45050 - RNA, 22 nt, Human
cuuaagcaaaauauucuuucac

SEQ ID NO: 45051 - RNA, 22 nt, Human
cuuaaucauggcuugugggagg

SEQ ID NO: 45052 - RNA, 22 nt, Human
cuuaauguggaccugguuucua

SEQ ID NO: 45053 - RNA, 22 nt, Human
cuuaauuggcuuauuuccucaa

SEQ ID NO: 45054 - RNA, 22 nt, Human
cuuaauuuaagccuagaaugca

SEQ ID NO: 45055 - RNA, 22 nt, Human
cuuacaaauacacuuaggagag

SEQ ID NO: 45056 - RNA, 22 nt, Human
cuuacaagaccaaagaaaggau

SEQ ID NO: 45057 - RNA, 22 nt, Human
cuuacacuuuccgaaagcuugu

SEQ ID NO: 45058 - RNA, 22 nt, Human
cuuacagagaagaaaauguagu

SEQ ID NO: 45059 - RNA, 22 nt, Human
cuuacaguguugagggaauuaa

SEQ ID NO: 45060 - RNA, 22 nt, Human
cuuacauacugagaaaauaucc

SEQ ID NO: 45061 - RNA, 22 nt, Human
cuuacccaaauuagaguuacca

SEQ ID NO: 45062 - RNA, 22 nt, Human
cuuacuugaaauuccaagcagg

SEQ ID NO: 45063 - RNA, 22 nt, Human
cuuagaaauuguuacucauuca

SEQ ID NO: 45064 - RNA, 20 nt, Human
cuuagaaauuuuuacccugg

SEQ ID NO: 45065 - RNA, 22 nt, Human
cuuagaaugggacccaaugggu

SEQ ID NO: 45066 - RNA, 22 nt, Human
cuuagagcuuaggcuagccauu

SEQ ID NO: 45067 - RNA, 22 nt, Human
cuuagcaugcaguguucugccc

SEQ ID NO: 45068 - RNA, 20 nt, Human
cuuagcuaguaagaagcugu

SEQ ID NO: 45069 - RNA, 22 nt, Human
cuuagcuuguuuucaccuaaga

SEQ ID NO: 45070 - RNA, 22 nt, Human
cuuaggaaaguuucugcuuaug

SEQ ID NO: 45071 - RNA, 22 nt, Human
cuuaggaacgcucugccuagug

SEQ ID NO: 45072 - RNA, 22 nt, Human
cuuaggaaugcguuuccugggu

SEQ ID NO: 45073 - RNA, 22 nt, Human
cuuaggaguucacuugaauagu

SEQ ID NO: 45074 - RNA, 22 nt, Human
cuuaggcaguuuaggaaagaga

SEQ ID NO: 45075 - RNA, 22 nt, Human
cuuagggaaucuuagagcugga

SEQ ID NO: 45076 - RNA, 22 nt, Human
cuuagggagaaugccucugcag

SEQ ID NO: 45077 - RNA, 22 nt, Human
cuuaguuucucuguauguuuac

SEQ ID NO: 45078 - RNA, 22 nt, Human
cuuaguuucuguugcguucugu

SEQ ID NO: 45079 - RNA, 22 nt, Human
gcugugucagaaacucugggga

SEQ ID NO: 45080 - RNA, 22 nt, Human
gcugugugcuaggauauguuuu

SEQ ID NO: 45081 - RNA, 22 nt, Human
gcuguuagagaauuagaguggg

SEQ ID NO: 45082 - RNA, 22 nt, Human
gcuguuaggugcccugaccuug

SEQ ID NO: 45083 - RNA, 22 nt, Human
ggcagaggugaaguucacaagg

SEQ ID NO: 45084 - RNA, 22 nt, Human
ggcagaguggagugcggccucc

SEQ ID NO: 45085 - RNA, 22 nt, Human
ggcagauauauucgugaaauag

SEQ ID NO: 45086 - RNA, 22 nt, Human
ggcagauggaagaggcuggguc

SEQ ID NO: 45087 - RNA, 22 nt, Human
ggcagauggggugacaagagag

SEQ ID NO: 45088 - RNA, 22 nt, Human
ggcagcaaagucacauggaaaa

SEQ ID NO: 45089 - RNA, 22 nt, Human
ggcagcaacacgagugagcuaa

SEQ ID NO: 45090 - RNA, 22 nt, Human
ggcagcaaccaaccaggcauuu

SEQ ID NO: 45091 - RNA, 22 nt, Human
ggcagcaacucauuauuccugu

SEQ ID NO: 45092 - RNA, 22 nt, Human
ggcagcaaguggugggagacuu

SEQ ID NO: 45093 - RNA, 20 nt, Human
ggcagcaauucacccuaucc

SEQ ID NO: 45094 - RNA, 21 nt, Human
ggcagcacuaccugaagcaua

SEQ ID NO: 45095 - RNA, 22 nt, Human
ggcagcacugcagcuuguuggg

SEQ ID NO: 45096 - RNA, 22 nt, Human
ggcagcaggguagccauuucuc

SEQ ID NO: 45097 - RNA, 22 nt, Human
ggcagcaguuacaaaugugcag

SEQ ID NO: 45098 - RNA, 22 nt, Human
ggcagcaucacuugucuccagc

SEQ ID NO: 45099 - RNA, 22 nt, Human
ggcagcaucucauaucuucagg

SEQ ID NO: 45100 - RNA, 22 nt, Human
ggcagcaucucuggcagcagcu

SEQ ID NO: 45101 - RNA, 22 nt, Human
ggcagcaugggugccuuuguga

SEQ ID NO: 45102 - RNA, 22 nt, Human
ggcagccacccugggaggcaga

SEQ ID NO: 45103 - RNA, 22 nt, Human
ggcagccagagggcagcuggau

SEQ ID NO: 45104 - RNA, 22 nt, Human
ggcagccauacucagaccuggg

SEQ ID NO: 45105 - RNA, 22 nt, Human
ggcagccaugcuccaggugcag

SEQ ID NO: 45106 - RNA, 22 nt, Human
ggcagcccaccagcccacgucu

SEQ ID NO: 45107 - RNA, 22 nt, Human
ggcagcccuuucuggccagcuc

SEQ ID NO: 45108 - RNA, 18 nt, Human
ggcagccuggacaugcuc

SEQ ID NO: 45109 - RNA, 21 nt, Human
ggcagcguguggacaggaagg

SEQ ID NO: 45110 - RNA, 22 nt, Human
ggcagcuagaauugugaugcug

SEQ ID NO: 45111 - RNA, 22 nt, Human
ggcagcuauuccaagcagcacu

SEQ ID NO: 45112 - RNA, 21 nt, Human
ggcagcucagcagauggggac

SEQ ID NO: 45113 - RNA, 22 nt, Human
ggcagcucgaugacuucugcau

SEQ ID NO: 45114 - RNA, 20 nt, Human
ggcagcucuagucgaggccc

SEQ ID NO: 45115 - RNA, 23 nt, Human
ggcagcucucaucugaugacuga

SEQ ID NO: 45116 - RNA, 22 nt, Human
ggcagcucugcuaauugagccu

SEQ ID NO: 45117 - RNA, 22 nt, Human
gaaauacaguugggaggaggua

SEQ ID NO: 45118 - RNA, 20 nt, Human
gaaauacuuacccaacuguu

SEQ ID NO: 45119 - RNA, 22 nt, Human
gaaauagaagcugccaauuucu

SEQ ID NO: 45120 - RNA, 22 nt, Human
gaaauagaucucugggaugcaa

SEQ ID NO: 45121 - RNA, 22 nt, Human
gaaauauacaugaagucggcug

SEQ ID NO: 45122 - RNA, 22 nt, Human
gaaauauuacaguggaggggau

SEQ ID NO: 45123 - RNA, 22 nt, Human
gaaauauuguacuggagauguu

SEQ ID NO: 45124 - RNA, 22 nt, Human
gaaauauuucucuugagccccu

SEQ ID NO: 45125 - RNA, 22 nt, Human
gaaaucaauuucuugguugaua

SEQ ID NO: 45126 - RNA, 22 nt, Human
gaaaucaugagaucucuuggac

SEQ ID NO: 45127 - RNA, 22 nt, Human
gaaaucuacuuuggguuagaca

SEQ ID NO: 45128 - RNA, 22 nt, Human
gaaaucugcggugaggccugag

SEQ ID NO: 45129 - RNA, 22 nt, Human
gaaaucuugcucauugugacaa

SEQ ID NO: 45130 - RNA, 22 nt, Human
gaaaugaaauagcaccaagguu

SEQ ID NO: 45131 - RNA, 22 nt, Human
gaaaugaugucugugcugccac

SEQ ID NO: 45132 - RNA, 22 nt, Human
gaaaugauuuuaguuuaucaug

SEQ ID NO: 45133 - RNA, 22 nt, Human
gaaaugcaaauucucucucgcu

SEQ ID NO: 45134 - RNA, 22 nt, Human
gaaaugcauggaucuuggcaga

SEQ ID NO: 45135 - RNA, 22 nt, Human
gaaauguacuuuaaagccaucc

SEQ ID NO: 45136 - RNA, 22 nt, Human
gaaauguauuugacaguccuug

SEQ ID NO: 45137 - RNA, 18 nt, Human
gaaaugugauucuagggc

SEQ ID NO: 45138 - RNA, 22 nt, Human
gaaauguuggacacuugaaauu

SEQ ID NO: 45139 - RNA, 22 nt, Human
gaaauguugucucugcagcaau

SEQ ID NO: 45140 - RNA, 22 nt, Human
gaaauguuugggaggagucaac

SEQ ID NO: 45141 - RNA, 22 nt, Human
gaaauuaagcaggggucugugg

SEQ ID NO: 45142 - RNA, 22 nt, Human
gaaauugaaagaccaacugcau

SEQ ID NO: 45143 - RNA, 22 nt, Human
gaaauuuacaacuuucucaugg

SEQ ID NO: 45144 - RNA, 22 nt, Human
gaaauuuauuaucuacaucauu

SEQ ID NO: 45145 - RNA, 22 nt, Human
gaacaaacacaucccagcagug

SEQ ID NO: 45146 - RNA, 22 nt, Human
gaacaaacagaagaggcggaac

SEQ ID NO: 45147 - RNA, 22 nt, Human
gaacaaagacauggaggaggau

SEQ ID NO: 45148 - RNA, 22 nt, Human
gaacaaaucccuuccugucucc

SEQ ID NO: 45149 - RNA, 22 nt, Human
gaacaacuccaagggacaucau

SEQ ID NO: 45150 - RNA, 22 nt, Human
gaacaauacaggcuuuauuccu

SEQ ID NO: 45151 - RNA, 22 nt, Human
gaacaauagugguaacaaagcc

SEQ ID NO: 45152 - RNA, 19 nt, Human
gaacaauuuguuagcucuc

SEQ ID NO: 45153 - RNA, 22 nt, Human
gaacacagaagaauuucuaaga

SEQ ID NO: 45154 - RNA, 22 nt, Human
gaacacaguacuuuuccugaug

SEQ ID NO: 45155 - RNA, 22 nt, Human
gaacacagugugaucguauguc

SEQ ID NO: 45156 - RNA, 22 nt, Human
gaacacauuucucugacuguag

SEQ ID NO: 45157 - RNA, 22 nt, Human
gaacacuguuucuucgugaaca

SEQ ID NO: 45158 - RNA, 22 nt, Human
gaacagaugccugauucauagg

SEQ ID NO: 45159 - RNA, 22 nt, Human
gaacagcuauaaucaucugucc

SEQ ID NO: 45160 - RNA, 22 nt, Human
gaacaggcauaagcauuugcau

SEQ ID NO: 45161 - RNA, 22 nt, Human
gaacaggguuugagaggcuuag

SEQ ID NO: 45162 - RNA, 17 nt, Human
gaacaguguaagacacu

SEQ ID NO: 45163 - RNA, 22 nt, Human
gaacaucugccuuguggcugcc

SEQ ID NO: 45164 - RNA, 22 nt, Human
gaacauucacagacucaccauu

SEQ ID NO: 45165 - RNA, 22 nt, Human
gaacauucuugggcaaguuacu

SEQ ID NO: 45166 - RNA, 22 nt, Human
gaacauuuaugaugcaauaccu

SEQ ID NO: 45167 - RNA, 22 nt, Human
gaaccaaguaggauacaaggag

SEQ ID NO: 45168 - RNA, 22 nt, Human
gaaccagcagacuuugacaggu

SEQ ID NO: 45169 - RNA, 22 nt, Human
gaaccauuguugaaaagaauag

SEQ ID NO: 45170 - RNA, 22 nt, Human
gaacccaggaggcagagguugc

SEQ ID NO: 45171 - RNA, 22 nt, Human
gaaccucuaguuuguucuuuga

SEQ ID NO: 45172 - RNA, 22 nt, Human
gaaccucuauauuugugacauc

SEQ ID NO: 45173 - RNA, 22 nt, Human
gaaccugagcccagguggcauu

SEQ ID NO: 45174 - RNA, 22 nt, Human
gaaccugagcgggcagcaagcg

SEQ ID NO: 45175 - RNA, 22 nt, Human
gaaccugcuuccuuuuauauua

SEQ ID NO: 45176 - RNA, 22 nt, Human
gaaccuggaauguggcgcccaa

SEQ ID NO: 45177 - RNA, 22 nt, Human
gaaccuuaugguaaaucuagag

SEQ ID NO: 45178 - RNA, 22 nt, Human
gaacuacagugcauuuucuuaa

SEQ ID NO: 45179 - RNA, 22 nt, Human
gaacuagaauguucugauggag

SEQ ID NO: 45180 - RNA, 22 nt, Human
gaacuauaucuucaagaaaaug

SEQ ID NO: 45181 - RNA, 22 nt, Human
gaacuauaugucuuaaagcuuu

SEQ ID NO: 45182 - RNA, 22 nt, Human
gaacucaacacaguauuuggua

SEQ ID NO: 45183 - RNA, 22 nt, Human
gaacugaaacuugguuuaaagc

SEQ ID NO: 45184 - RNA, 22 nt, Human
gaacuggucaguuuagcccacu

SEQ ID NO: 45185 - RNA, 22 nt, Human
gaacuggugaagugaagggcag

SEQ ID NO: 45186 - RNA, 22 nt, Human
gaacuguagagaauacauuucu

SEQ ID NO: 45187 - RNA, 22 nt, Human
gaacugucauuggggacaucag

SEQ ID NO: 45188 - RNA, 22 nt, Human
gaacuguguuuguuucuagguc

SEQ ID NO: 45189 - RNA, 22 nt, Human
gaacuguuucuggugaaagagu

SEQ ID NO: 45190 - RNA, 22 nt, Human
gaacuuaacggcaacuauuuaa

SEQ ID NO: 45191 - RNA, 22 nt, Human
gaacuucuucuuuaagagacuc

SEQ ID NO: 45192 - RNA, 22 nt, Human
gaaggcuugauugaggaaugcc

SEQ ID NO: 45193 - RNA, 22 nt, Human
gaaggcuugccgggaagcggca

SEQ ID NO: 45194 - RNA, 22 nt, Human
gaaggcuuuucuaccagaucuu

SEQ ID NO: 45195 - RNA, 22 nt, Human
gaagggaaggaaagaaccagca

SEQ ID NO: 45196 - RNA, 18 nt, Human
gaagggagcuggaaugca

SEQ ID NO: 45197 - RNA, 22 nt, Human
gaagggcugcaggucugggccc

SEQ ID NO: 45198 - RNA, 22 nt, Human
gaagggcuuggcugggaggcca

SEQ ID NO: 45199 - RNA, 22 nt, Human
gaaggggacuggcagcugcaga

SEQ ID NO: 45200 - RNA, 22 nt, Human
gaagggggaaaaugacaacaga

SEQ ID NO: 45201 - RNA, 22 nt, Human
gaaggucaccuccccucucugg

SEQ ID NO: 45202 - RNA, 22 nt, Human
gaagguuugauccuuauuuaua

SEQ ID NO: 45203 - RNA, 21 nt, Human
gaaguacaccaggaaggccac

SEQ ID NO: 45204 - RNA, 22 nt, Human
gaaguacagggguucuuaggua

SEQ ID NO: 45205 - RNA, 22 nt, Human
gaaguacaguuuuaucuagcca

SEQ ID NO: 45206 - RNA, 22 nt, Human
gaaguagcauguugcugccaga

SEQ ID NO: 45207 - RNA, 22 nt, Human
gaaguauuacucugaauguauu

SEQ ID NO: 45208 - RNA, 20 nt, Human
gaaguccuguuauauccuuu

SEQ ID NO: 45209 - RNA, 22 nt, Human
gaagucucauuuggugucaguu

SEQ ID NO: 45210 - RNA, 22 nt, Human
gaagucucucuggagaguagaa

SEQ ID NO: 45211 - RNA, 22 nt, Human
gaagucugccugccuucucugu

SEQ ID NO: 45212 - RNA, 22 nt, Human
gaagucuucauucucucugaga

SEQ ID NO: 45213 - RNA, 22 nt, Human
gaagucuugaaacacaaacuag

SEQ ID NO: 45214 - RNA, 22 nt, Human
gaagucuuggcugaaaacccuc

SEQ ID NO: 45215 - RNA, 22 nt, Human
gaagugaagagauuagaaauca

SEQ ID NO: 45216 - RNA, 22 nt, Human
gaagugaagguuacucuagauu

SEQ ID NO: 45217 - RNA, 22 nt, Human
gaagugacaagaugcuaggauc

SEQ ID NO: 45218 - RNA, 22 nt, Human
gaaguggaagccaucggcaguc

SEQ ID NO: 45219 - RNA, 22 nt, Human
gaagugugcacaucuuacaagu

SEQ ID NO: 45220 - RNA, 22 nt, Human
gaaguuaguaccugguauacuu

SEQ ID NO: 45221 - RNA, 22 nt, Human
gaaguuagucuugaaguuaguc

SEQ ID NO: 45222 - RNA, 18 nt, Human
gaaguuaguggugugcua

SEQ ID NO: 45223 - RNA, 22 nt, Human
gaaguuaguuggggcccaagaa

SEQ ID NO: 45224 - RNA, 22 nt, Human
gaaguuauugccugugaugaaa

SEQ ID NO: 45225 - RNA, 22 nt, Human
gaaguucaaugucagcaucuau

SEQ ID NO: 45226 - RNA, 22 nt, Human
gaaguucaggugggaauugagc

SEQ ID NO: 45227 - RNA, 22 nt, Human
gaaguuccucguaggagucucu

SEQ ID NO: 45228 - RNA, 22 nt, Human
gaaguucucagcuaggugaugu

SEQ ID NO: 45229 - RNA, 22 nt, Human
gaaguucuggcucagagaggaa

SEQ ID NO: 45230 - RNA, 22 nt, Human
gaaguucugggaguggcgcccu

SEQ ID NO: 45231 - RNA, 22 nt, Human
gaaguucuuugcuccccaguac

SEQ ID NO: 45232 - RNA, 22 nt, Human
gaaguuuagaguguuguaauuu

SEQ ID NO: 45233 - RNA, 22 nt, Human
gaaguuuucugaggcuguagcu

SEQ ID NO: 45234 - RNA, 22 nt, Human
gaauaacauuggaacccugaag

SEQ ID NO: 45235 - RNA, 22 nt, Human
gaauaacugcuaucuuucuggc

SEQ ID NO: 45236 - RNA, 22 nt, Human
gaauaauagcagaaauuagcag

SEQ ID NO: 45237 - RNA, 22 nt, Human
gaauaauuuugaucagaaggga

SEQ ID NO: 45238 - RNA, 22 nt, Human
gaauacaaauaauaccaaggug

SEQ ID NO: 45239 - RNA, 22 nt, Human
gaauacaagccaggcacaaggc

SEQ ID NO: 45240 - RNA, 19 nt, Human
gaauacagauaauaagcag

SEQ ID NO: 45241 - RNA, 22 nt, Human
gaauacauaucagauguguuuc

SEQ ID NO: 45242 - RNA, 22 nt, Human
gaauacaucugaaggcuaugaa

SEQ ID NO: 45243 - RNA, 22 nt, Human
gaauacaugaacccuccugugg

SEQ ID NO: 45244 - RNA, 22 nt, Human
gaauacaugcacgacacggggg

SEQ ID NO: 45245 - RNA, 22 nt, Human
gaauacauuggaaaucagaaua

SEQ ID NO: 45246 - RNA, 22 nt, Human
gaauagauaagugacuauuugg

SEQ ID NO: 45247 - RNA, 22 nt, Human
gaauagauccucauuuauugau

SEQ ID NO: 45248 - RNA, 22 nt, Human
gaauagauuauacuugaagcau

SEQ ID NO: 45249 - RNA, 22 nt, Human
gaauagcuguaggcuagugucu

SEQ ID NO: 45250 - RNA, 22 nt, Human
gaauagcuuccuuuuuuccaaa

SEQ ID NO: 45251 - RNA, 22 nt, Human
gaauauauuucucuuaccuuua

SEQ ID NO: 45252 - RNA, 22 nt, Human
gaauaucccgcuaugcaaagua

SEQ ID NO: 45253 - RNA, 22 nt, Human
gaauaucugggagugggaagcu

SEQ ID NO: 45254 - RNA, 22 nt, Human
gaauauguuugacauuuaguug

SEQ ID NO: 45255 - RNA, 22 nt, Human
gaauauuuguaauuacuguuga

SEQ ID NO: 45256 - RNA, 22 nt, Human
gaauauuuuuaaagggacuaau

SEQ ID NO: 45257 - RNA, 22 nt, Human
gaaucacacucguaagugaguu

SEQ ID NO: 45258 - RNA, 22 nt, Human
gaaucacgguauucugcacggg

SEQ ID NO: 45259 - RNA, 22 nt, Human
gaaucagaaucucuaagguggg

SEQ ID NO: 45260 - RNA, 22 nt, Human
gaaucagacuacaaaugacccc

SEQ ID NO: 45261 - RNA, 22 nt, Human
gaaucagauacugauuucaguc

SEQ ID NO: 45262 - RNA, 22 nt, Human
gaaucaggauucaagaucagcu

SEQ ID NO: 45263 - RNA, 22 nt, Human
gaaucauagaacauuaauagaa

SEQ ID NO: 45264 - RNA, 22 nt, Human
gaaucauucauugcucaauuaa

SEQ ID NO: 45265 - RNA, 22 nt, Human
gaaucauuuagcucugcaugga

SEQ ID NO: 45266 - RNA, 22 nt, Human
gaaucauuuauuuuugacagca

SEQ ID NO: 45267 - RNA, 22 nt, Human
gaauccaucaugcagaacaaug

SEQ ID NO: 45268 - RNA, 22 nt, Human
gaaucccaaucuguuauugaca

SEQ ID NO: 45269 - RNA, 22 nt, Human
gaaucucaggggaguuacugga

SEQ ID NO: 45270 - RNA, 20 nt, Human
gaaucuuacuacauucucuc

SEQ ID NO: 45271 - RNA, 22 nt, Human
gaaucuuagaaagguuaaggaa

SEQ ID NO: 45272 - RNA, 22 nt, Human
gaaugaacaaaugugguggaga

SEQ ID NO: 45273 - RNA, 22 nt, Human
gaaugacauugaaaagacauug

SEQ ID NO: 45274 - RNA, 22 nt, Human
gaaugacauugagccauaacau

SEQ ID NO: 45275 - RNA, 22 nt, Human
gaaugauauuauuucgugcugg

SEQ ID NO: 45276 - RNA, 22 nt, Human
gaaugauuaacuaguugauaca

SEQ ID NO: 45277 - RNA, 22 nt, Human
gaaugcacuuccaacaucuauu

SEQ ID NO: 45278 - RNA, 22 nt, Human
gaaugcaguggugagaucuugg

SEQ ID NO: 45279 - RNA, 22 nt, Human
gaaugcauuccacgguagugau

SEQ ID NO: 45280 - RNA, 22 nt, Human
gaaugcucuuugguccuagacu

SEQ ID NO: 45281 - RNA, 22 nt, Human
gaaugcugguguucagaauuuu

SEQ ID NO: 45282 - RNA, 21 nt, Human
gaauggcaccauuagcauaua

SEQ ID NO: 45283 - RNA, 22 nt, Human
gaauguaauagucaguagaaca

SEQ ID NO: 45284 - RNA, 22 nt, Human
gaaugucuaaacauagcuuuua

SEQ ID NO: 45285 - RNA, 22 nt, Human
gaauguuacuuugauuuugucc

SEQ ID NO: 45286 - RNA, 22 nt, Human
gaauguuauuggacagcagugg

SEQ ID NO: 45287 - RNA, 22 nt, Human
gaauguuccucagacuucccca

SEQ ID NO: 45288 - RNA, 22 nt, Human
gaauguuucauguguauguuag

SEQ ID NO: 45289 - RNA, 22 nt, Human
gaauguuugugcagagucaucu

SEQ ID NO: 45290 - RNA, 22 nt, Human
gaauuacauaguuucuagguuc

SEQ ID NO: 45291 - RNA, 22 nt, Human
gaauuacaugacccugaguaga

SEQ ID NO: 45292 - RNA, 22 nt, Human
gaauuagguaauagaacuagua

SEQ ID NO: 45293 - RNA, 22 nt, Human
gaauuauaaacuagugacuuca

SEQ ID NO: 45294 - RNA, 19 nt, Human
gaauuauuuuuaugggaug

SEQ ID NO: 45295 - RNA, 22 nt, Human
gaauucaucgucuuagcugcca

SEQ ID NO: 45296 - RNA, 22 nt, Human
gaauucuaaccauuaagccaag

SEQ ID NO: 45297 - RNA, 22 nt, Human
gaauucugguuuugaaaugaau

SEQ ID NO: 45298 - RNA, 23 nt, Human
gaauucuuaaggucacuaaaguc

SEQ ID NO: 45299 - RNA, 22 nt, Human
gaauugcuaauccaagugacug

SEQ ID NO: 45300 - RNA, 22 nt, Human
gaauugcucugccuggccagcc

SEQ ID NO: 45301 - RNA, 22 nt, Human
ggcuggaaacucagguaggguu

SEQ ID NO: 45302 - RNA, 18 nt, Human
ggcuggaagcuguugcug

SEQ ID NO: 45303 - RNA, 22 nt, Human
ggcuggaaggcccuuuguugau

SEQ ID NO: 45304 - RNA, 22 nt, Human
ggcuggaagguagaagaugagg

SEQ ID NO: 45305 - RNA, 22 nt, Human
ggcuggaaguccaagaucaaga

SEQ ID NO: 45306 - RNA, 22 nt, Human
ggcuggaauguguggaugugau

SEQ ID NO: 45307 - RNA, 21 nt, Human
ggcuggacaucccaggagacu

SEQ ID NO: 45308 - RNA, 22 nt, Human
ggcuggacuugguccuguuuug

SEQ ID NO: 45309 - RNA, 22 nt, Human
ggcuggagaagggugguugaca

SEQ ID NO: 45310 - RNA, 22 nt, Human
ggcuggagauaugucuggaaca

SEQ ID NO: 45311 - RNA, 22 nt, Human
ggcuggaggagaauggguguga

SEQ ID NO: 45312 - RNA, 17 nt, Human
ggcuggaggggacccgg

SEQ ID NO: 45313 - RNA, 22 nt, Human
ggcuggagguagaagaacacuu

SEQ ID NO: 45314 - RNA, 19 nt, Human
ggcuggaguggccaucugu

SEQ ID NO: 45315 - RNA, 22 nt, Human
ggcuggagugggcuccagaguu

SEQ ID NO: 45316 - RNA, 22 nt, Human
ggcuggauguacuuuggggcug

SEQ ID NO: 45317 - RNA, 22 nt, Human
ggcuggcaagugucugcucaug

SEQ ID NO: 45318 - RNA, 22 nt, Human
ggcuggcacccuuggggauagg

SEQ ID NO: 45319 - RNA, 22 nt, Human
ggcuggcaccugcccuccgcug

SEQ ID NO: 45320 - RNA, 22 nt, Human
ggcuggcaggcacaguaugcaa

SEQ ID NO: 45321 - RNA, 22 nt, Human
ggcuggcagugugagagaggga

SEQ ID NO: 45322 - RNA, 22 nt, Human
ggcuggccucuacagggaggca

SEQ ID NO: 45323 - RNA, 22 nt, Human
ggcuggcugcaugcccccuccu

SEQ ID NO: 45324 - RNA, 22 nt, Human
ggcugggaggccgugcugaccu

SEQ ID NO: 45325 - RNA, 22 nt, Human
ggcugggcaaacaagacucuuc

SEQ ID NO: 45326 - RNA, 22 nt, Human
ggcugggcagcagcuguuaagc

SEQ ID NO: 45327 - RNA, 21 nt, Human
ggcugggcaggacccaccccu

SEQ ID NO: 45328 - RNA, 22 nt, Human
ggcugggcugcggcuguaccug

SEQ ID NO: 45329 - RNA, 22 nt, Human
ggcuggguacagggcagugugc

SEQ ID NO: 45330 - RNA, 21 nt, Human
ggcugggucaugcagcuggcc

SEQ ID NO: 45331 - RNA, 19 nt, Human
ggcugggucuggcagguuc

SEQ ID NO: 45332 - RNA, 22 nt, Human
ggcuggguuauuuauggccaag

SEQ ID NO: 45333 - RNA, 22 nt, Human
ggcuggguucugagaaagagua

SEQ ID NO: 45334 - RNA, 22 nt, Human
ggcugguguuacagucggcagc

SEQ ID NO: 45335 - RNA, 22 nt, Human
ggcuguauauacuguauacagu

SEQ ID NO: 45336 - RNA, 22 nt, Human
ggcuguccuuggccaaggcacu

SEQ ID NO: 45337 - RNA, 19 nt, Human
ggcugucuggcguguggau

SEQ ID NO: 45338 - RNA, 22 nt, Human
ggcugucuugggagcucccccg

SEQ ID NO: 45339 - RNA, 22 nt, Human
ggcugugacaaggcugcgggaa

SEQ ID NO: 45340 - RNA, 23 nt, Human
ggcugugcagccugcggcaaaag

SEQ ID NO: 45341 - RNA, 22 nt, Human
ggcugugcagggcagagucuca

SEQ ID NO: 45342 - RNA, 22 nt, Human
ggcugugcuuugcccaaagggc

SEQ ID NO: 45343 - RNA, 22 nt, Human
ggcugugcuuuguuagguuguc

SEQ ID NO: 45344 - RNA, 18 nt, Human
ggcuguggacaagauuag

SEQ ID NO: 45345 - RNA, 22 nt, Human
ggcuguggccagcggggcugag

SEQ ID NO: 45346 - RNA, 22 nt, Human
ggcugugggccagcuagacccu

SEQ ID NO: 45347 - RNA, 22 nt, Human
ggcuguggggaccaacaggacu

SEQ ID NO: 45348 - RNA, 22 nt, Human
ggcuguggggccggguacagug

SEQ ID NO: 45349 - RNA, 22 nt, Human
ggcugugguggcaucccugagc

SEQ ID NO: 45350 - RNA, 22 nt, Human
ggcuguguccccaccugagcag

SEQ ID NO: 45351 - RNA, 22 nt, Human
ggcuuaagaaaugucuaguuuu

SEQ ID NO: 45352 - RNA, 22 nt, Human
ggcuuaaugguucuuuuucuca

SEQ ID NO: 45353 - RNA, 22 nt, Human
ggcuucacagccccauuagugc

SEQ ID NO: 45354 - RNA, 22 nt, Human
ggcuucacaguuguagcagcuc

SEQ ID NO: 45355 - RNA, 22 nt, Human
ggcuucagugagcugagcucac

SEQ ID NO: 45356 - RNA, 19 nt, Human
ggcuucaguuuagcaggcu

SEQ ID NO: 45357 - RNA, 22 nt, Human
ggcuucauggacaaaagccuca

SEQ ID NO: 45358 - RNA, 22 nt, Human
ggcuucauggaggaggugaguc

SEQ ID NO: 45359 - RNA, 22 nt, Human
ggcuucauggaguucuacacca

SEQ ID NO: 45360 - RNA, 22 nt, Human
ggcuucauuuuaucuuaucaug

SEQ ID NO: 45361 - RNA, 22 nt, Human
ggcuuccaagguccucuccacc

SEQ ID NO: 45362 - RNA, 18 nt, Human
ggcuucccuacucacuuc

SEQ ID NO: 45363 - RNA, 22 nt, Human
ggcuucccugccucacuuauuc

SEQ ID NO: 45364 - RNA, 22 nt, Human
ggcuucccuuuccgagaggaga

SEQ ID NO: 45365 - RNA, 22 nt, Human
ggcuuccuaauacucccuacac

SEQ ID NO: 45366 - RNA, 19 nt, Human
ggcuucgaggcuggggaag

SEQ ID NO: 45367 - RNA, 22 nt, Human
ggcuucgcagcucggcagccgc

SEQ ID NO: 45368 - RNA, 22 nt, Human
ggcuucugaaccaggcccugga

SEQ ID NO: 45369 - RNA, 22 nt, Human
ggcuucugcucagccugcacgc

SEQ ID NO: 45370 - RNA, 22 nt, Human
ggcuucuguccucuggaucugu

SEQ ID NO: 45371 - RNA, 22 nt, Human
ggcuucugucucaagcaccagc

SEQ ID NO: 45372 - RNA, 20 nt, Human
ggcuucuucaggugucuauu

SEQ ID NO: 45373 - RNA, 22 nt, Human
ggcuucuuccugugaacauguu

SEQ ID NO: 45374 - RNA, 22 nt, Human
ggcuugaucacauaggucuccc

SEQ ID NO: 45375 - RNA, 22 nt, Human
ggcuuggaauugguaggaugua

SEQ ID NO: 45376 - RNA, 22 nt, Human
ggcuuggcuacaagccaugggc

SEQ ID NO: 45377 - RNA, 22 nt, Human
ggcuuggcugucucccagccca

SEQ ID NO: 45378 - RNA, 22 nt, Human
ggcuuggcuugggcucagaggc

SEQ ID NO: 45379 - RNA, 22 nt, Human
ggcuuuaacaacagaaauuuau

SEQ ID NO: 45380 - RNA, 22 nt, Human
ggcuuuaacagcagcuuugcug

SEQ ID NO: 45381 - RNA, 22 nt, Human
ggcuuuaaggaguaaaaaugcc

SEQ ID NO: 45382 - RNA, 22 nt, Human
ggcuuuaagguuuaggaagcaa

SEQ ID NO: 45383 - RNA, 22 nt, Human
gagcuuaaaacauagccagacu

SEQ ID NO: 45384 - RNA, 22 nt, Human
gagcuuaaauggcuaaauauaa

SEQ ID NO: 45385 - RNA, 22 nt, Human
gagcuuaggccagggacaggga

SEQ ID NO: 45386 - RNA, 23 nt, Human
gagcuuagucuacucagacaucc

SEQ ID NO: 45387 - RNA, 22 nt, Human
gagcuucacgggggacagcauu

SEQ ID NO: 45388 - RNA, 22 nt, Human
gagcuucagagaccacuuaacu

SEQ ID NO: 45389 - RNA, 22 nt, Human
gagcuucagcugccaugacugu

SEQ ID NO: 45390 - RNA, 22 nt, Human
gagcuucauauguugcagagaa

SEQ ID NO: 45391 - RNA, 22 nt, Human
gagcuuccugcaggucacugug

SEQ ID NO: 45392 - RNA, 18 nt, Human
gagcuugaaauggcuuuu

SEQ ID NO: 45393 - RNA, 22 nt, Human
gagcuugggugccaugcugagc

SEQ ID NO: 45394 - RNA, 22 nt, Human
gagcuugguguuauuucugugg

SEQ ID NO: 45395 - RNA, 22 nt, Human
gagcuuuaagggauaaaaugau

SEQ ID NO: 45396 - RNA, 22 nt, Human
gagcuuuacuucugacuggugc

SEQ ID NO: 45397 - RNA, 22 nt, Human
gagcuuugaucgcuaagccuca

SEQ ID NO: 45398 - RNA, 22 nt, Human
gagcuuugcauuauucagaagc

SEQ ID NO: 45399 - RNA, 22 nt, Human
gagcuuugccuaaaacuagaau

SEQ ID NO: 45400 - RNA, 22 nt, Human
gagcuuuguagcaggaaggaag

SEQ ID NO: 45401 - RNA, 22 nt, Human
gagcuuugucuccuggagaccc

SEQ ID NO: 45402 - RNA, 22 nt, Human
gagcuuuuauaccuucucucag

SEQ ID NO: 45403 - RNA, 22 nt, Human
gagcuuuucccgucuuucucgu

SEQ ID NO: 45404 - RNA, 23 nt, Human
gagcuuuuguaguagucacugug

SEQ ID NO: 45405 - RNA, 22 nt, Human
gaggaaaauaacaacuaagggc

SEQ ID NO: 45406 - RNA, 23 nt, Human
gaggaaagaauauagaugcaauc

SEQ ID NO: 45407 - RNA, 22 nt, Human
gaggaaaugguuguucaggugg

SEQ ID NO: 45408 - RNA, 22 nt, Human
gaggaacagagggcaaggccag

SEQ ID NO: 45409 - RNA, 22 nt, Human
gaggaacaugaggugaccuggg

SEQ ID NO: 45410 - RNA, 22 nt, Human
gagaggccaagggauccgugag

SEQ ID NO: 45411 - RNA, 22 nt, Human
gagaggccauggggugggaugc

SEQ ID NO: 45412 - RNA, 22 nt, Human
gagaggcucagggacuugcuga

SEQ ID NO: 45413 - RNA, 22 nt, Human
gagaggcuggcagugccagguu

SEQ ID NO: 45414 - RNA, 22 nt, Human
gagaggcugguaaagucugaac

SEQ ID NO: 45415 - RNA, 22 nt, Human
gagaggcuuaagggcugugaag

SEQ ID NO: 45416 - RNA, 22 nt, Human
gagaggcuugugugaagaacaa

SEQ ID NO: 45417 - RNA, 22 nt, Human
gagagggcaaacuuguagcuaa

SEQ ID NO: 45418 - RNA, 21 nt, Human
gagagggcauuauaggaagug

SEQ ID NO: 45419 - RNA, 22 nt, Human
gagaggggaccugugugucuag

SEQ ID NO: 45420 - RNA, 22 nt, Human
gagagggugccuggaagccagg

SEQ ID NO: 45421 - RNA, 22 nt, Human
gagagguacacccuuuaaacuu

SEQ ID NO: 45422 - RNA, 22 nt, Human
gagagguagcaguaagaacagg

SEQ ID NO: 45423 - RNA, 22 nt, Human
gagaggugaaauaguuguccgg

SEQ ID NO: 45424 - RNA, 22 nt, Human
gagagguggugaggacuugucu

SEQ ID NO: 45425 - RNA, 22 nt, Human
gagagguuccucccugcuuuac

SEQ ID NO: 45426 - RNA, 22 nt, Human
gagaguccuuaguuugcaggua

SEQ ID NO: 45427 - RNA, 22 nt, Human
gagagugaaggcuucccagcaa

SEQ ID NO: 45428 - RNA, 22 nt, Human
gagagugagauccuccugggga

SEQ ID NO: 45429 - RNA, 22 nt, Human
gagagugaugaaugguuaaaca

SEQ ID NO: 45430 - RNA, 17 nt, Human
gagaguguauuggaugc

SEQ ID NO: 45431 - RNA, 22 nt, Human
gagaguuccaguaaguggauuc

SEQ ID NO: 45432 - RNA, 22 nt, Human
gagauaauaauaguaccuaucu

SEQ ID NO: 45433 - RNA, 22 nt, Human
gagauacaguuggcugcaggcu

SEQ ID NO: 45434 - RNA, 22 nt, Human
gagauauaagaucuagaaagga

SEQ ID NO: 45435 - RNA, 22 nt, Human
gagauccacuuaauuuuuuugc

SEQ ID NO: 45436 - RNA, 20 nt, Human
gagauccucaucuguaaagu

SEQ ID NO: 45437 - RNA, 22 nt, Human
gagaucgguaaagagcaugcac

SEQ ID NO: 45438 - RNA, 22 nt, Human
gagaucucuagcacuuccugua

SEQ ID NO: 45439 - RNA, 22 nt, Human
gagaugaagaggcccuuggagu

SEQ ID NO: 45440 - RNA, 22 nt, Human
gagaugacaugccuguuguagg

SEQ ID NO: 45441 - RNA, 22 nt, Human
gagauggaaucuguguggaggg

SEQ ID NO: 45442 - RNA, 20 nt, Human
gagauggcuaagugcugaac

SEQ ID NO: 45443 - RNA, 23 nt, Human
gagauggcugguuguccucugaa

SEQ ID NO: 45444 - RNA, 22 nt, Human
gagauggggaauaggagcaagc

SEQ ID NO: 45445 - RNA, 22 nt, Human
gagaugguugcaauaguuuaaa

SEQ ID NO: 45446 - RNA, 22 nt, Human
gagauguacaauguguauuaau

SEQ ID NO: 45447 - RNA, 22 nt, Human
gagaugugauccuuugcugugu

SEQ ID NO: 45448 - RNA, 22 nt, Human
gagauucuauguuguugauuau

SEQ ID NO: 45449 - RNA, 22 nt, Human
gagauucuuuccagaacuuuga

SEQ ID NO: 45450 - RNA, 22 nt, Human
gagauuggccuggcuugccaac

SEQ ID NO: 45451 - RNA, 22 nt, Human
gagauuguuuagcuaccauggc

SEQ ID NO: 45452 - RNA, 22 nt, Human
gagauuuagcugcuuaacuccu

SEQ ID NO: 45453 - RNA, 20 nt, Human
gagauuuccaaucaugccca

SEQ ID NO: 45454 - RNA, 22 nt, Human
gagauuucuuuugaugccuguc

SEQ ID NO: 45455 - RNA, 22 nt, Human
gagauuuucagcuugacuggga

SEQ ID NO: 45456 - RNA, 22 nt, Human
gagcaaaauaaauucugacaaa

SEQ ID NO: 45457 - RNA, 22 nt, Human
gagcaacacuccacauugcuag

SEQ ID NO: 45458 - RNA, 22 nt, Human
gagcaacagggcgaggagaacu

SEQ ID NO: 45459 - RNA, 22 nt, Human
gagcaacaguggcagugguggg

SEQ ID NO: 45460 - RNA, 22 nt, Human
gagcaacaguuuaugguuuuuc

SEQ ID NO: 45461 - RNA, 22 nt, Human
gagcaagacuacaggcagauga

SEQ ID NO: 45462 - RNA, 22 nt, Human
gagcaagaguguuggacuuuga

SEQ ID NO: 45463 - RNA, 22 nt, Human
gagcaaggaggguggggccuuu

SEQ ID NO: 45464 - RNA, 22 nt, Human
gagcaauacauggcaugaaauu

SEQ ID NO: 45465 - RNA, 22 nt, Human
gagcaauagaaagaauacugcu

SEQ ID NO: 45466 - RNA, 22 nt, Human
gagcaaugcccuucaccagccc

SEQ ID NO: 45467 - RNA, 22 nt, Human
gagcaauggaagauagauaaca

SEQ ID NO: 45468 - RNA, 22 nt, Human
gagcacacacuuugaaauuagg

SEQ ID NO: 45469 - RNA, 22 nt, Human
gagcacagaacuaaaugcuggu

SEQ ID NO: 45470 - RNA, 22 nt, Human
gagcacagaaggagaaauaugg

SEQ ID NO: 45471 - RNA, 22 nt, Human
gagcacagcgcaguuuguaauu

SEQ ID NO: 45472 - RNA, 22 nt, Human
gagcacaggcuuugguggacac

SEQ ID NO: 45473 - RNA, 22 nt, Human
gagcacaguaaagcagugucac

SEQ ID NO: 45474 - RNA, 20 nt, Human
gagcacaguaaugacugcua

SEQ ID NO: 45475 - RNA, 22 nt, Human
gagcacauucccaggagcugcu

SEQ ID NO: 45476 - RNA, 22 nt, Human
gagcacccgucggugguaggaa

SEQ ID NO: 45477 - RNA, 22 nt, Human
gagcacccuuugcacaucaguc

SEQ ID NO: 45478 - RNA, 22 nt, Human
gagcaccucaauuugcuauuug

SEQ ID NO: 45479 - RNA, 22 nt, Human
gagcagaacuacucacauaucg

SEQ ID NO: 45480 - RNA, 22 nt, Human
gagcagagaauccagcuaagug

SEQ ID NO: 45481 - RNA, 22 nt, Human
gagcagagacaguacaacuggc

SEQ ID NO: 45482 - RNA, 22 nt, Human
gagcagagucuauuuccacacu

SEQ ID NO: 45483 - RNA, 22 nt, Human
gagcagaucucaggccuucugu

SEQ ID NO: 45484 - RNA, 22 nt, Human
gagcagaugugugccaggaugc

SEQ ID NO: 45485 - RNA, 22 nt, Human
gagcagcaaagggaggguaaau

SEQ ID NO: 45486 - RNA, 22 nt, Human
gagcagcagcugggccagguuc

SEQ ID NO: 45487 - RNA, 18 nt, Human
gagcagcaggaucaagaa

SEQ ID NO: 45488 - RNA, 22 nt, Human
gagcagcagguggcugugaugg

SEQ ID NO: 45489 - RNA, 22 nt, Human
gagcagcaucuccggcuuaaag

SEQ ID NO: 45490 - RNA, 22 nt, Human
gagcagcucagaggacuagugu

SEQ ID NO: 45491 - RNA, 22 nt, Human
gagcagcucgagaaggaagcag

SEQ ID NO: 45492 - RNA, 22 nt, Human
gagcagcucugugccuggagac

SEQ ID NO: 45493 - RNA, 22 nt, Human
gagcagcugcagugcagacccu

SEQ ID NO: 45494 - RNA, 22 nt, Human
gagcagcuggcuguauugguuu

SEQ ID NO: 45495 - RNA, 22 nt, Human
gagcagcugguaggugaaccca

SEQ ID NO: 45496 - RNA, 22 nt, Human
gagcagcuguucugacuugucu

SEQ ID NO: 45497 - RNA, 22 nt, Human
gagcaggaacugaaaaugagac

SEQ ID NO: 45498 - RNA, 22 nt, Human
ggcuuuauaggguagaggauca

SEQ ID NO: 45499 - RNA, 22 nt, Human
ggcuuuaugcagggauagaaau

SEQ ID NO: 45500 - RNA, 21 nt, Human
ggcuuuaugcucacccagccu

SEQ ID NO: 45501 - RNA, 22 nt, Human
ggcuuuauuaacucauccguaa

SEQ ID NO: 45502 - RNA, 22 nt, Human
ggcuuuauuauguggccaugug

SEQ ID NO: 45503 - RNA, 22 nt, Human
ggcuuucagccaaaggacaacc

SEQ ID NO: 45504 - RNA, 22 nt, Human
ggcuuucuaugaacucaaaggc

SEQ ID NO: 45505 - RNA, 22 nt, Human
ggcuuucucacagcauggcagc

SEQ ID NO: 45506 - RNA, 22 nt, Human
ggcuuugccuggaauuuccuug

SEQ ID NO: 45507 - RNA, 22 nt, Human
ggcuuugcuuaacgugcuucua

SEQ ID NO: 45508 - RNA, 22 nt, Human
ggcuuuguggggugaaguaaag

SEQ ID NO: 45509 - RNA, 22 nt, Human
ggcuuuugcuguguuuuccaga

SEQ ID NO: 45510 - RNA, 22 nt, Human
ggcuuuuguuucagcucugcua

SEQ ID NO: 45511 - RNA, 22 nt, Human
gggaaacucaggcauuuccacu

SEQ ID NO: 45512 - RNA, 22 nt, Human
gggaaagacccugagucuuauu

SEQ ID NO: 45513 - RNA, 22 nt, Human
gggaaagacuuauuuugacuuc

SEQ ID NO: 45514 - RNA, 23 nt, Human
gggaaaggauaugauccuagggg

SEQ ID NO: 45515 - RNA, 22 nt, Human
gggaaaucucguccucuauuua

SEQ ID NO: 45516 - RNA, 22 nt, Human
gggaaccaccccucugcccuga

SEQ ID NO: 45517 - RNA, 22 nt, Human
gggaacuguuuaacagggguuu

SEQ ID NO: 45518 - RNA, 22 nt, Human
gggaacuucagaaagucgcugc

SEQ ID NO: 45519 - RNA, 22 nt, Human
aggagacucagagaccuggccg

SEQ ID NO: 45520 - RNA, 22 nt, Human
aggagagagguuuuaaaugggg

SEQ ID NO: 45521 - RNA, 22 nt, Human
aggagaggaaucauuauuacaa

SEQ ID NO: 45522 - RNA, 22 nt, Human
aggagaggcaucaagaaaaucg

SEQ ID NO: 45523 - RNA, 22 nt, Human
aggagagggguaggauuaauuu

SEQ ID NO: 45524 - RNA, 22 nt, Human
aggagaguaccauugggccgca

SEQ ID NO: 45525 - RNA, 22 nt, Human
aggagauaagaggcuggugugg

SEQ ID NO: 45526 - RNA, 22 nt, Human
aggagaucagcuuagggaaggu

SEQ ID NO: 45527 - RNA, 22 nt, Human
aggagcacugagccagcauggg

SEQ ID NO: 45528 - RNA, 23 nt, Human
aggagcacuuucaguuuguaaag

SEQ ID NO: 45529 - RNA, 22 nt, Human
aggagcagauugguaagaucau

SEQ ID NO: 45530 - RNA, 22 nt, Human
aggagccaagauggggcaagua

SEQ ID NO: 45531 - RNA, 23 nt, Human
aggagccagcccuguucucagua

SEQ ID NO: 45532 - RNA, 22 nt, Human
aggagccagggaagcugcuuuc

SEQ ID NO: 45533 - RNA, 23 nt, Human
aggagccaggugcagcccuugug

SEQ ID NO: 45534 - RNA, 22 nt, Human
aggagccaguggaguuccugcc

SEQ ID NO: 45535 - RNA, 22 nt, Human
aggagccauccccaugagaggu

SEQ ID NO: 45536 - RNA, 22 nt, Human
aggagccaugagcaggaggcaa

SEQ ID NO: 45537 - RNA, 22 nt, Human
aggagccaugagugacaucaca

SEQ ID NO: 45538 - RNA, 23 nt, Human
aggagccaugaguuggauauguu

SEQ ID NO: 45539 - RNA, 22 nt, Human
aggagccauggaggugaggcgg

SEQ ID NO: 45540 - RNA, 22 nt, Human
aggagcccagccugggcucgga

SEQ ID NO: 45541 - RNA, 22 nt, Human
aggagccugagucacagugccu

SEQ ID NO: 45542 - RNA, 18 nt, Human
aggagcggcugcggcugc

SEQ ID NO: 45543 - RNA, 22 nt, Human
aggagcuaauucauaagccacu

SEQ ID NO: 45544 - RNA, 22 nt, Human
aggagcucaaagaugccaggag

SEQ ID NO: 45545 - RNA, 22 nt, Human
aggagcucacaucuuuauuucu

SEQ ID NO: 45546 - RNA, 22 nt, Human
aggagcucagccauucauuuga

SEQ ID NO: 45547 - RNA, 22 nt, Human
aggagcucauugaaguggauga

SEQ ID NO: 45548 - RNA, 22 nt, Human
aggagcucccgugaggagacca

SEQ ID NO: 45549 - RNA, 20 nt, Human
aggagcucugugcugggaag

SEQ ID NO: 45550 - RNA, 22 nt, Human
aggagcugaaacuucucauaug

SEQ ID NO: 45551 - RNA, 20 nt, Human
aggagcugaauuagaggguu

SEQ ID NO: 45552 - RNA, 22 nt, Human
aggagcugacuuguaaagcauu

SEQ ID NO: 45553 - RNA, 22 nt, Human
aggagcugauagucuauggaga

SEQ ID NO: 45554 - RNA, 22 nt, Human
aggagcugcaaauauuaguaau

SEQ ID NO: 45555 - RNA, 22 nt, Human
aggagcuggaguccaggcaagu

SEQ ID NO: 45556 - RNA, 16 nt, Human
aggagcuggguaggag

SEQ ID NO: 45557 - RNA, 23 nt, Human
aggaggaaaaguuaucugcugag

SEQ ID NO: 45558 - RNA, 22 nt, Human
aggaggaaggcuucauuagguu

SEQ ID NO: 45559 - RNA, 22 nt, Human
aggaggaauacaauccagcagc

SEQ ID NO: 45560 - RNA, 22 nt, Human
aggaggagguaagaaaagcaua

SEQ ID NO: 45561 - RNA, 22 nt, Human
aggaggcaacugagauuuagaa

SEQ ID NO: 45562 - RNA, 22 nt, Human
aggaggccauucucucaguagc

SEQ ID NO: 45563 - RNA, 22 nt, Human
aggaggcucucagguccucccc

SEQ ID NO: 45564 - RNA, 22 nt, Human
aggaggcugcaacccugaggcc

SEQ ID NO: 45565 - RNA, 21 nt, Human
aggaggcugucucuuucagcu

SEQ ID NO: 45566 - RNA, 22 nt, Human
aggagggaauaagaaagaguca

SEQ ID NO: 45567 - RNA, 22 nt, Human
aggagggauagaaaaauacuug

SEQ ID NO: 45568 - RNA, 22 nt, Human
aggaggggcaaugauagucugg

SEQ ID NO: 45569 - RNA, 22 nt, Human
aggagggugauccgggcugguc

SEQ ID NO: 45570 - RNA, 22 nt, Human
aggagggugggaagcaguuuua

SEQ ID NO: 45571 - RNA, 22 nt, Human
aggaggguuucaaugggaugag

SEQ ID NO: 45572 - RNA, 22 nt, Human
aggaggugagcggucauguggu

SEQ ID NO: 45573 - RNA, 22 nt, Human
aggaggugcuagagaagauguu

SEQ ID NO: 45574 - RNA, 22 nt, Human
aggagucagauuguuugaaugu

SEQ ID NO: 45575 - RNA, 22 nt, Human
aggagucaggaccaaauggaaa

SEQ ID NO: 45576 - RNA, 22 nt, Human
aggagugagcuuuggggucaga

SEQ ID NO: 45577 - RNA, 22 nt, Human
aggagugggggcgagaaguuaa

SEQ ID NO: 45578 - RNA, 22 nt, Human
aggaguuauggcagaaucaaau

SEQ ID NO: 45579 - RNA, 21 nt, Human
aggaguugcuguggccugguu

SEQ ID NO: 45580 - RNA, 22 nt, Human
aggaguuuggggauuagucagg

SEQ ID NO: 45581 - RNA, 23 nt, Human
aggauaaacuaaacucauuuugg

SEQ ID NO: 45582 - RNA, 22 nt, Human
aggauaacuuugaaaguaaauu

SEQ ID NO: 45583 - RNA, 22 nt, Human
aggauaauuggcauuuguaggc

SEQ ID NO: 45584 - RNA, 22 nt, Human
aggauacauguuuuuuaucaau

SEQ ID NO: 45585 - RNA, 22 nt, Human
aggauaguugugaagauaggcu

SEQ ID NO: 45586 - RNA, 22 nt, Human
aggauauaaaaagacuauuugg

SEQ ID NO: 45587 - RNA, 22 nt, Human
aggaucagugaauacucagggu

SEQ ID NO: 45588 - RNA, 23 nt, Human
aggauccugguacaggagcagag

SEQ ID NO: 45589 - RNA, 22 nt, Human
aggaucugugccucaacccaga

SEQ ID NO: 45590 - RNA, 22 nt, Human
aggaugagaagauuggaaucuu

SEQ ID NO: 45591 - RNA, 22 nt, Human
aggaugagauugcuguguugua

SEQ ID NO: 45592 - RNA, 22 nt, Human
aggaugaggcuggcaggucuug

SEQ ID NO: 45593 - RNA, 20 nt, Human
aggaugcagggagucugcag

SEQ ID NO: 45594 - RNA, 21 nt, Human
aggaugccgcaggcggagaag

SEQ ID NO: 45595 - RNA, 21 nt, Human
aggauggaaaggacuaggggu

SEQ ID NO: 45596 - RNA, 22 nt, Human
aggaugggccugggauaugcuu

SEQ ID NO: 45597 - RNA, 22 nt, Human
aggaugugagccagccuggccu

SEQ ID NO: 45598 - RNA, 22 nt, Human
aggaugugccaccagcuuugca

SEQ ID NO: 45599 - RNA, 22 nt, Human
aggauguguuuugagcugacua

SEQ ID NO: 45600 - RNA, 22 nt, Human
aggauuaaaguauauuuuugag

SEQ ID NO: 45601 - RNA, 22 nt, Human
aggauucuguaaucugugaaau

SEQ ID NO: 45602 - RNA, 22 nt, Human
aggauugugccuccagucagaa

SEQ ID NO: 45603 - RNA, 22 nt, Human
aggauuuaaucaguuggcauuu

SEQ ID NO: 45604 - RNA, 22 nt, Human
aggauuuaucaggaacucucuu

SEQ ID NO: 45605 - RNA, 22 nt, Human
aggauuuauuauaugcccucau

SEQ ID NO: 45606 - RNA, 22 nt, Human
aggauuugaaccuaggcaauca

SEQ ID NO: 45607 - RNA, 22 nt, Human
aggauuugaaccugcauccagu

SEQ ID NO: 45608 - RNA, 23 nt, Human
agucuucauuguauuuccagacc

SEQ ID NO: 45609 - RNA, 22 nt, Human
agucuucugcucugucacuaac

SEQ ID NO: 45610 - RNA, 22 nt, Human
agucuucuugaucuuuucagug

SEQ ID NO: 45611 - RNA, 22 nt, Human
agucuucuuucauuuacucagu

SEQ ID NO: 45612 - RNA, 22 nt, Human
agucuugcauuuucugaagaug

SEQ ID NO: 45613 - RNA, 22 nt, Human
agucuuuaacauuuggagauug

SEQ ID NO: 45614 - RNA, 22 nt, Human
agucuuuauacagaaauauaug

SEQ ID NO: 45615 - RNA, 22 nt, Human
agucuuuauugucgucacuaga

SEQ ID NO: 45616 - RNA, 22 nt, Human
agucuuuauuuagaguuaggac

SEQ ID NO: 45617 - RNA, 18 nt, Human
agucuuuauuucuuucau

SEQ ID NO: 45618 - RNA, 22 nt, Human
agugaaaaccuaaucaugcagu

SEQ ID NO: 45619 - RNA, 22 nt, Human
agugaaauacugucguuuuuag

SEQ ID NO: 45620 - RNA, 22 nt, Human
agugaaauggaugcugcuacug

SEQ ID NO: 45621 - RNA, 22 nt, Human
agugaaauuccuggucuuuguu

SEQ ID NO: 45622 - RNA, 19 nt, Human
agugaacuccauaucaggu

SEQ ID NO: 45623 - RNA, 22 nt, Human
agugaaguaaaagaugugcauc

SEQ ID NO: 45624 - RNA, 22 nt, Human
agugaauguccccgcgggucag

SEQ ID NO: 45625 - RNA, 23 nt, Human
agugacaaugggccagagguggc

SEQ ID NO: 45626 - RNA, 22 nt, Human
agugacacggagagacagcaug

SEQ ID NO: 45627 - RNA, 22 nt, Human
agugacagccaaauccauccau

SEQ ID NO: 45628 - RNA, 22 nt, Human
aguuaacuaaacugugaguaaa

SEQ ID NO: 45629 - RNA, 22 nt, Human
aguuaagaaggucaacgaggga

SEQ ID NO: 45630 - RNA, 22 nt, Human
aguuaagaauacacaucauaau

SEQ ID NO: 45631 - RNA, 22 nt, Human
aguuaaggggguucaucuguaa

SEQ ID NO: 45632 - RNA, 22 nt, Human
aguuacaaccaugacacaagca

SEQ ID NO: 45633 - RNA, 22 nt, Human
aguuacacauaaacauuaaagg

SEQ ID NO: 45634 - RNA, 22 nt, Human
aguuacauauaagaagacagac

SEQ ID NO: 45635 - RNA, 22 nt, Human
aguuacaugacugccggcggug

SEQ ID NO: 45636 - RNA, 22 nt, Human
aguuacugcuuucaggaaguuu

SEQ ID NO: 45637 - RNA, 18 nt, Human
aguuagaaaugaaggcca

SEQ ID NO: 45638 - RNA, 22 nt, Human
aguuagaauggauguugagagc

SEQ ID NO: 45639 - RNA, 22 nt, Human
aguuagagacacaugcacaugc

SEQ ID NO: 45640 - RNA, 22 nt, Human
aguuagaguuaauuuccuaaca

SEQ ID NO: 45641 - RNA, 22 nt, Human
aguuagcaaauaccacaaucug

SEQ ID NO: 45642 - RNA, 22 nt, Human
aguuaggacacuugagggcuaa

SEQ ID NO: 45643 - RNA, 22 nt, Human
aguuaggaguauaggaaugccu

SEQ ID NO: 45644 - RNA, 23 nt, Human
aguuaggucaaguuaggucaauu

SEQ ID NO: 45645 - RNA, 22 nt, Human
aguuauaggugguuuugagaau

SEQ ID NO: 45646 - RNA, 22 nt, Human
aguuauucauuuauucuguaca

SEQ ID NO: 45647 - RNA, 22 nt, Human
aguuauugaguaucuauaaugu

SEQ ID NO: 45648 - RNA, 22 nt, Human
aguuauugagugcagagcaggg

SEQ ID NO: 45649 - RNA, 22 nt, Human
aguuauuuacuccuuugucucu

SEQ ID NO: 45650 - RNA, 22 nt, Human
aguuauuucaguaacauaauag

SEQ ID NO: 45651 - RNA, 19 nt, Human
aguuauuucuaaauuuacc

SEQ ID NO: 45652 - RNA, 22 nt, Human
aguuauuuuacauggaaguuug

SEQ ID NO: 45653 - RNA, 22 nt, Human
aguuauuuuggaaaaugaguca

SEQ ID NO: 45654 - RNA, 22 nt, Human
aguucaaaaagguaaaguuuau

SEQ ID NO: 45655 - RNA, 22 nt, Human
aguucaaagcugcaguaaugga

SEQ ID NO: 45656 - RNA, 22 nt, Human
aguucaaagucaaggaaacugu

SEQ ID NO: 45657 - RNA, 22 nt, Human
aguucacaccaaaguuagguag

SEQ ID NO: 45658 - RNA, 22 nt, Human
aguucacagcaaaguggggacc

SEQ ID NO: 45659 - RNA, 22 nt, Human
aguucacauaucuguuuuauuu

SEQ ID NO: 45660 - RNA, 22 nt, Human
aguucacucuuuaugagaaagu

SEQ ID NO: 45661 - RNA, 22 nt, Human
aguucacugcuuaagccuuuga

SEQ ID NO: 45662 - RNA, 22 nt, Human
aguucagagguuaauuuauuug

SEQ ID NO: 45663 - RNA, 22 nt, Human
aguucagaguaaauguugaagg

SEQ ID NO: 45664 - RNA, 23 nt, Human
aguucagcucaguucagugagca

SEQ ID NO: 45665 - RNA, 22 nt, Human
aguucagcuucccaggucacug

SEQ ID NO: 45666 - RNA, 22 nt, Human
aguucaggcauaaggcaugaac

SEQ ID NO: 45667 - RNA, 22 nt, Human
aguucaguaguccuucauugua

SEQ ID NO: 45668 - RNA, 22 nt, Human
aguucauggaagauucaaugga

SEQ ID NO: 45669 - RNA, 22 nt, Human
aguucaugugguuuaacuuaau

SEQ ID NO: 45670 - RNA, 22 nt, Human
aguuccaaagccuguauucuua

SEQ ID NO: 45671 - RNA, 22 nt, Human
aguuccaccauuuaggaucugu

SEQ ID NO: 45672 - RNA, 22 nt, Human
aguuccauccuuccacugcccu

SEQ ID NO: 45673 - RNA, 22 nt, Human
aguucccaggugaugcugaugu

SEQ ID NO: 45674 - RNA, 22 nt, Human
aguucccuggaugagcuaaaaa

SEQ ID NO: 45675 - RNA, 18 nt, Human
aguuccuuaaauuggugu

SEQ ID NO: 45676 - RNA, 22 nt, Human
aguucuauaauuaaaaugaagg

SEQ ID NO: 45677 - RNA, 22 nt, Human
aguucuauuggguagguucugu

SEQ ID NO: 45678 - RNA, 22 nt, Human
aguucucaagguuaggaaaagu

SEQ ID NO: 45679 - RNA, 22 nt, Human
aguucucagaauugcaccucaa

SEQ ID NO: 45680 - RNA, 22 nt, Human
aguucucauuucacaggcagug

SEQ ID NO: 45681 - RNA, 22 nt, Human
aguucucuaugaagucuauugu

SEQ ID NO: 45682 - RNA, 20 nt, Human
aguucucuuccuugggccug

SEQ ID NO: 45683 - RNA, 22 nt, Human
aguucucuucucaucacccagg

SEQ ID NO: 45684 - RNA, 22 nt, Human
aguucucuuuagcucauauggu

SEQ ID NO: 45685 - RNA, 22 nt, Human
aguucugcaugaaaaaggacua

SEQ ID NO: 45686 - RNA, 22 nt, Human
aguucuggcccaggguuucuug

SEQ ID NO: 45687 - RNA, 22 nt, Human
aguucugggaaaaacauggcca

SEQ ID NO: 45688 - RNA, 22 nt, Human
aguucuguugucuagggaagcc

SEQ ID NO: 45689 - RNA, 22 nt, Human
aguucuugcuauaaaaacaaau

SEQ ID NO: 45690 - RNA, 19 nt, Human
aguucuuguccugucuguu

SEQ ID NO: 45691 - RNA, 22 nt, Human
aguucuuugugauggaaauuua

SEQ ID NO: 45692 - RNA, 22 nt, Human
aguucuuuugugaacauaugcu

SEQ ID NO: 45693 - RNA, 22 nt, Human
aguugaaauuaagagagaguuu

SEQ ID NO: 45694 - RNA, 22 nt, Human
aguugaauuaugagugucuuug

SEQ ID NO: 45695 - RNA, 22 nt, Human
aguugacauccauaacaggaag

SEQ ID NO: 45696 - RNA, 22 nt, Human
aguugagggugggagagaaaug

SEQ ID NO: 45697 - RNA, 22 nt, Human
aguugcagccuucaggagaccc

SEQ ID NO: 45698 - RNA, 21 nt, Human
aguugcauaggccagccaucc

SEQ ID NO: 45699 - RNA, 18 nt, Human
aguugcuagaugcuguag

SEQ ID NO: 45700 - RNA, 22 nt, Human
aguugcuaucgugaagcacgug

SEQ ID NO: 45701 - RNA, 22 nt, Human
aguugcucaauguggcugugga

SEQ ID NO: 45702 - RNA, 21 nt, Human
aguugcugcugcugcagguga

SEQ ID NO: 45703 - RNA, 18 nt, Human
aguugcuuauucugugca

SEQ ID NO: 45704 - RNA, 22 nt, Human
aguuggagaagaggucgggaau

SEQ ID NO: 45705 - RNA, 22 nt, Human
aguuggauggauuggaaugaag

SEQ ID NO: 45706 - RNA, 22 nt, Human
aguuggcauuccugcauccuau

SEQ ID NO: 45707 - RNA, 22 nt, Human
aguuggugagcgugugguaauc

SEQ ID NO: 45708 - RNA, 22 nt, Human
aguuguaaauucauagcuuaua

SEQ ID NO: 45709 - RNA, 22 nt, Human
aguuguaagaggcacaaggaag

SEQ ID NO: 45710 - RNA, 22 nt, Human
aguuguauuagagaacacaaac

SEQ ID NO: 45711 - RNA, 22 nt, Human
aguugucaccucuauucaaauc

SEQ ID NO: 45712 - RNA, 22 nt, Human
aguugugcugugaugcaggaua

SEQ ID NO: 45713 - RNA, 22 nt, Human
aguuuaaaucauguuuuguaac

SEQ ID NO: 45714 - RNA, 22 nt, Human
aguuuaacuuuggaaaacuaua

SEQ ID NO: 45715 - RNA, 20 nt, Human
aguuuaagaaaaagcuccag

SEQ ID NO: 45716 - RNA, 22 nt, Human
aguuuaauauccuucaacuuuc

SEQ ID NO: 45717 - RNA, 22 nt, Human
aguuuaauuggaggcguggcuc

SEQ ID NO: 45718 - RNA, 22 nt, Human
aguuuacagaugcuacaggagc

SEQ ID NO: 45719 - RNA, 22 nt, Human
aguuuacaugacguguauuuca

SEQ ID NO: 45720 - RNA, 22 nt, Human
aguuuacccacuguugaaauua

SEQ ID NO: 45721 - RNA, 22 nt, Human
aguuuacucuggugacaauuua

SEQ ID NO: 45722 - RNA, 22 nt, Human
aguuuagaauucauuuugccca

SEQ ID NO: 45723 - RNA, 22 nt, Human
aguuuagacaaagucuugcauu

SEQ ID NO: 45724 - RNA, 22 nt, Human
aguuuauguuguuuauaagcca

SEQ ID NO: 45725 - RNA, 19 nt, Human
aguuuauuauaggugauuc

SEQ ID NO: 45726 - RNA, 22 nt, Human
aguuuauuguauaugguaguuu

SEQ ID NO: 45727 - RNA, 22 nt, Human
agcugccucccugugcuugucc

SEQ ID NO: 45728 - RNA, 22 nt, Human
agcugccugcauuuauauccug

SEQ ID NO: 45729 - RNA, 22 nt, Human
agcugccuggagccagaguuga

SEQ ID NO: 45730 - RNA, 22 nt, Human
agcugccuggagucauuuccug

SEQ ID NO: 45731 - RNA, 17 nt, Human
agcugccuugcuugagc

SEQ ID NO: 45732 - RNA, 21 nt, Human
agcugccuuuagagagaacca

SEQ ID NO: 45733 - RNA, 22 nt, Human
agcugcucauuacuuucuguug

SEQ ID NO: 45734 - RNA, 22 nt, Human
agcugcuccuuuccugcaggcg

SEQ ID NO: 45735 - RNA, 22 nt, Human
agcugcucucacuggacgccug

SEQ ID NO: 45736 - RNA, 20 nt, Human
agcugcucucauccagaccu

SEQ ID NO: 45737 - RNA, 22 nt, Human
aggcucagccugggccuagagc

SEQ ID NO: 45738 - RNA, 20 nt, Human
aggcucaggguguuuaggaa

SEQ ID NO: 45739 - RNA, 22 nt, Human
aggcucaguauagcuggcaagu

SEQ ID NO: 45740 - RNA, 22 nt, Human
aggcucagucuguucaugcacu

SEQ ID NO: 45741 - RNA, 22 nt, Human
aggcucaguucacgucaacuuu

SEQ ID NO: 45742 - RNA, 22 nt, Human
aggcucauucuugccucugagc

SEQ ID NO: 45743 - RNA, 22 nt, Human
aggcuccaagagguuaagucac

SEQ ID NO: 45744 - RNA, 22 nt, Human
aggcuccacggucacuggcucu

SEQ ID NO: 45745 - RNA, 23 nt, Human
aggcuccacucccugggaugugg

SEQ ID NO: 45746 - RNA, 22 nt, Human
aggcuccagccaaugggucugu

SEQ ID NO: 45747 - RNA, 22 nt, Human
aggcuccaggccucccugcaug

SEQ ID NO: 45748 - RNA, 22 nt, Human
aggcuccagucugaaccuuggg

SEQ ID NO: 45749 - RNA, 22 nt, Human
auauuaguguagguagcuaaua

SEQ ID NO: 45750 - RNA, 22 nt, Human
auauuauaaguuauuucaaguu

SEQ ID NO: 45751 - RNA, 22 nt, Human
auauucacacuguuuaguuaca

SEQ ID NO: 45752 - RNA, 22 nt, Human
auauucacugagcauaaagcca

SEQ ID NO: 45753 - RNA, 22 nt, Human
auauucacuggguacuaaaaag

SEQ ID NO: 45754 - RNA, 22 nt, Human
auauucaucguguagaaauacu

SEQ ID NO: 45755 - RNA, 22 nt, Human
auauuccaguuauaucaaauca

SEQ ID NO: 45756 - RNA, 22 nt, Human
auauuccauugguuucccuucu

SEQ ID NO: 45757 - RNA, 22 nt, Human
auauucugccucacuacaguug

SEQ ID NO: 45758 - RNA, 22 nt, Human
auauucuggguuagauauguuu

SEQ ID NO: 45759 - RNA, 22 nt, Human
auauucuuauccuuuucucugu

SEQ ID NO: 45760 - RNA, 22 nt, Human
auauucuugugauuauaaagua

SEQ ID NO: 45761 - RNA, 22 nt, Human
auauugaucuuggaacugauuu

SEQ ID NO: 45762 - RNA, 21 nt, Human
auauuguagguaaagugcagg

SEQ ID NO: 45763 - RNA, 22 nt, Human
auauuuauaagcaagcaggacu

SEQ ID NO: 45764 - RNA, 22 nt, Human
auauuucacguagguuguuuuc

SEQ ID NO: 45765 - RNA, 22 nt, Human
auauuucaugggguuccauacu

SEQ ID NO: 45766 - RNA, 22 nt, Human
auauuuguauuucgugugugua

SEQ ID NO: 45767 - RNA, 22 nt, Human
auauuugucaucugccuuaguu

SEQ ID NO: 45768 - RNA, 22 nt, Human
auauuuguugaguucuuaugau

SEQ ID NO: 45769 - RNA, 22 nt, Human
aucaaaaugcuccagugauggu

SEQ ID NO: 45770 - RNA, 23 nt, Human
aucaaacuggugagaaugucagu

SEQ ID NO: 45771 - RNA, 22 nt, Human
aucaaaguaguagguuuuggac

SEQ ID NO: 45772 - RNA, 22 nt, Human
aucaaagugauuuguaaacagg

SEQ ID NO: 45773 - RNA, 22 nt, Human
aucaaaguucguaacugauaac

SEQ ID NO: 45774 - RNA, 22 nt, Human
aucaaaguuucccagaaguugu

SEQ ID NO: 45775 - RNA, 22 nt, Human
aucaaauauaauaauuuucgcu

SEQ ID NO: 45776 - RNA, 22 nt, Human
aucaaauuaugugcuacaagaa

SEQ ID NO: 45777 - RNA, 22 nt, Human
aucaacagagcaaagccugaac

SEQ ID NO: 45778 - RNA, 22 nt, Human
aucaacagugaagagaucaaga

SEQ ID NO: 45779 - RNA, 22 nt, Human
aucaacauagccacuccuuaga

SEQ ID NO: 45780 - RNA, 22 nt, Human
aucaacauuccaaugugguaga

SEQ ID NO: 45781 - RNA, 22 nt, Human
aucaacauuugcauccuuccac

SEQ ID NO: 45782 - RNA, 22 nt, Human
aucaagaauguucauucuucua

SEQ ID NO: 45783 - RNA, 22 nt, Human
aucaagaauugggagcuauuga

SEQ ID NO: 45784 - RNA, 22 nt, Human
aucaagagaaggggaagaugaa

SEQ ID NO: 45785 - RNA, 22 nt, Human
aucaagaguauugacaagacca

SEQ ID NO: 45786 - RNA, 22 nt, Human
aucaagggcgcgugguucggcg

SEQ ID NO: 45787 - RNA, 22 nt, Human
aucaagucugccugucuggagg

SEQ ID NO: 45788 - RNA, 22 nt, Human
aucaaguuuucuuaguugacug

SEQ ID NO: 45789 - RNA, 22 nt, Human
aucaaugacaguugaauucuac

SEQ ID NO: 45790 - RNA, 22 nt, Human
aucaauucuuaggaaaauagcu

SEQ ID NO: 45791 - RNA, 22 nt, Human
aucaauuuugaggauacaagaa

SEQ ID NO: 45792 - RNA, 22 nt, Human
aucacaaaggucucagagcaca

SEQ ID NO: 45793 - RNA, 22 nt, Human
aucacaaucuucaaaucgauuc

SEQ ID NO: 45794 - RNA, 22 nt, Human
aucacacuggacauuggauacu

SEQ ID NO: 45795 - RNA, 22 nt, Human
aucacagauugugaauaacuau

SEQ ID NO: 45796 - RNA, 22 nt, Human
aucacaggugguaggaaaagaa

SEQ ID NO: 45797 - RNA, 22 nt, Human
aucacaucacagguugagcuag

SEQ ID NO: 45798 - RNA, 22 nt, Human
aucaccuggccauuggguuaac

SEQ ID NO: 45799 - RNA, 22 nt, Human
aucacgucaugguuugaucugg

SEQ ID NO: 45800 - RNA, 22 nt, Human
aucacgugguuugagaguacgc

SEQ ID NO: 45801 - RNA, 22 nt, Human
aucacugaaauacugaaauuac

SEQ ID NO: 45802 - RNA, 20 nt, Human
aucacuggagaaggaaaccu

SEQ ID NO: 45803 - RNA, 22 nt, Human
aucacuguggaaaacuguaugg

SEQ ID NO: 45804 - RNA, 21 nt, Human
aucagaaaauguaauggagca

SEQ ID NO: 45805 - RNA, 22 nt, Human
aucagaaauagucauguuacuu

SEQ ID NO: 45806 - RNA, 22 nt, Human
aucagaaauugcccagcuguuu

SEQ ID NO: 45807 - RNA, 22 nt, Human
aucagaagcaggaggaaugaag

SEQ ID NO: 45808 - RNA, 22 nt, Human
aucagaagugauguguguuauu

SEQ ID NO: 45809 - RNA, 22 nt, Human
aucagaauagugggggacaguc

SEQ ID NO: 45810 - RNA, 22 nt, Human
aucagaccugucuccucuugcc

SEQ ID NO: 45811 - RNA, 22 nt, Human
aucagagaaauggagggcgcuu

SEQ ID NO: 45812 - RNA, 22 nt, Human
aucagagaaguuucacuggcau

SEQ ID NO: 45813 - RNA, 22 nt, Human
aucagagcccggcaauuuauuu

SEQ ID NO: 45814 - RNA, 22 nt, Human
aucagaggaaauuaacucucuc

SEQ ID NO: 45815 - RNA, 20 nt, Human
aucagaggauagggaagugg

SEQ ID NO: 45816 - RNA, 22 nt, Human
aucagagucagaggcuagagcu

SEQ ID NO: 45817 - RNA, 20 nt, Human
aucagcaacugccacucagu

SEQ ID NO: 45818 - RNA, 22 nt, Human
aucagcaagacuaggggaauac

SEQ ID NO: 45819 - RNA, 22 nt, Human
aucagcaagcaugguuaggugu

SEQ ID NO: 45820 - RNA, 22 nt, Human
aucagcaagcauuuauugagug

SEQ ID NO: 45821 - RNA, 22 nt, Human
aucagcagaugcucaaugaaca

SEQ ID NO: 45822 - RNA, 22 nt, Human
aucagcaggaagggcaccuuua

SEQ ID NO: 45823 - RNA, 22 nt, Human
aucagcaggugcugguggagac

SEQ ID NO: 45824 - RNA, 22 nt, Human
aucagcagugaguggcuuucau

SEQ ID NO: 45825 - RNA, 22 nt, Human
aucagcaucggguggugguggg

SEQ ID NO: 45826 - RNA, 22 nt, Human
aucagcuagauaagucaagcaa

SEQ ID NO: 45827 - RNA, 22 nt, Human
aucagcuauuaugugaagaaag

SEQ ID NO: 45828 - RNA, 22 nt, Human
aucagcuggaacaagugucuga

SEQ ID NO: 45829 - RNA, 22 nt, Human
aucagcuuaauucucaacaggu

SEQ ID NO: 45830 - RNA, 22 nt, Human
aucagcuucauaaaguugguca

SEQ ID NO: 45831 - RNA, 22 nt, Human
aucagcuuggaccaauaagaug

SEQ ID NO: 45832 - RNA, 22 nt, Human
aucaggaaauacuuauuuauaa

SEQ ID NO: 45833 - RNA, 19 nt, Human
aucaggaacaaggcugauc

SEQ ID NO: 45834 - RNA, 22 nt, Human
aucaggaacguucauggacugu

SEQ ID NO: 45835 - RNA, 22 nt, Human
aucaggauagugguuaccuggg

SEQ ID NO: 45836 - RNA, 22 nt, Human
aucaggaucacagaaacuuuua

SEQ ID NO: 45837 - RNA, 22 nt, Human
aucaggauccaccuugagccug

SEQ ID NO: 45838 - RNA, 22 nt, Human
aucaggaucugcaucauaagaa

SEQ ID NO: 45839 - RNA, 22 nt, Human
aucaggaugacaacugcugggu

SEQ ID NO: 45840 - RNA, 22 nt, Human
aucaggaugacuauaaggcugc

SEQ ID NO: 45841 - RNA, 22 nt, Human
aucaggaugcugucaguuacca

SEQ ID NO: 45842 - RNA, 22 nt, Human
aucaggauggguuuggcuuagg

SEQ ID NO: 45843 - RNA, 22 nt, Human
aucaggauuauuaaaucuggau

SEQ ID NO: 45844 - RNA, 22 nt, Human
aucagguagauuuaauauucug

SEQ ID NO: 45845 - RNA, 22 nt, Human
aucaggugaugcucugguuccc

SEQ ID NO: 45846 - RNA, 22 nt, Human
aucuuagagagucguguuuugu

SEQ ID NO: 45847 - RNA, 22 nt, Human
aucuuaggguucuguuuuuaag

SEQ ID NO: 45848 - RNA, 22 nt, Human
aucuuauuuaacacagcaaaac

SEQ ID NO: 45849 - RNA, 22 nt, Human
aucuucaagggaagaaagagua

SEQ ID NO: 45850 - RNA, 22 nt, Human
aucuucagcgagguuuccuuuc

SEQ ID NO: 45851 - RNA, 22 nt, Human
aucuuccaggugccggggguca

SEQ ID NO: 45852 - RNA, 22 nt, Human
aucuucuacuuugccaaucagg

SEQ ID NO: 45853 - RNA, 22 nt, Human
aucuucucauguguaaugaggu

SEQ ID NO: 45854 - RNA, 22 nt, Human
aucuucugauuuauggagcaau

SEQ ID NO: 45855 - RNA, 22 nt, Human
aucuugaaauacuuucuagaau

SEQ ID NO: 45856 - RNA, 22 nt, Human
aucuugcugcuacaaagugccc

SEQ ID NO: 45857 - RNA, 22 nt, Human
aucuuggauugacuggcucugc

SEQ ID NO: 45858 - RNA, 22 nt, Human
aucuuggauuggagaaagaagu

SEQ ID NO: 45859 - RNA, 19 nt, Human
aucuugggaaaugguaacu

SEQ ID NO: 45860 - RNA, 20 nt, Human
aucuugggauugagauugcc

SEQ ID NO: 45861 - RNA, 22 nt, Human
aucuugugcugacaaaacacau

SEQ ID NO: 45862 - RNA, 22 nt, Human
aucuuguuaaaaugcagaaacu

SEQ ID NO: 45863 - RNA, 22 nt, Human
aucuuguuaaagugcagauuuu

SEQ ID NO: 45864 - RNA, 22 nt, Human
aucuuuaaagacaugugaacuu

SEQ ID NO: 45865 - RNA, 22 nt, Human
aucuuuacuuucagugcugagc

SEQ ID NO: 45866 - RNA, 22 nt, Human
aucuuuagacaggaagcaauca

SEQ ID NO: 45867 - RNA, 22 nt, Human
aggauaauaauaaucucguuua

SEQ ID NO: 45868 - RNA, 22 nt, Human
aggauagaagccccauguucuu

SEQ ID NO: 45869 - RNA, 20 nt, Human
aggauagcaugcaagugaga

SEQ ID NO: 45870 - RNA, 23 nt, Human
aggauaugacuugucugccaacc

SEQ ID NO: 45871 - RNA, 22 nt, Human
aggaucagggugguggaaguca

SEQ ID NO: 45872 - RNA, 22 nt, Human
aggauccuguauggagaagcug

SEQ ID NO: 45873 - RNA, 22 nt, Human
aggaucuuauguaauaauuaug

SEQ ID NO: 45874 - RNA, 22 nt, Human
aggaugacuggaacccaaguga

SEQ ID NO: 45875 - RNA, 22 nt, Human
aggaugaggcuggacacuucuu

SEQ ID NO: 45876 - RNA, 22 nt, Human
aggauggaauuagguagcaagu

SEQ ID NO: 45877 - RNA, 19 nt, Human
aggauggagcaggcgguga

SEQ ID NO: 45878 - RNA, 20 nt, Human
aggauggcaagcaagugcau

SEQ ID NO: 45879 - RNA, 22 nt, Human
aggauggcgauucgagcaccuc

SEQ ID NO: 45880 - RNA, 22 nt, Human
aggaugugaguggacacagucc

SEQ ID NO: 45881 - RNA, 22 nt, Human
aggauguggucuguuuucugag

SEQ ID NO: 45882 - RNA, 22 nt, Human
aggauguucgggucacauagcc

SEQ ID NO: 45883 - RNA, 22 nt, Human
aggauucagaauguaugcagug

SEQ ID NO: 45884 - RNA, 22 nt, Human
aggauucgggcauaaagccauu

SEQ ID NO: 45885 - RNA, 22 nt, Human
aggauuuaccgucauuuagucu

SEQ ID NO: 45886 - RNA, 22 nt, Human
aggauuuaccuccagcuaggcu

SEQ ID NO: 45887 - RNA, 20 nt, Human
aggauuuacuacuaccugcu

SEQ ID NO: 45888 - RNA, 21 nt, Human
aggauuuacuauuaacugugu

SEQ ID NO: 45889 - RNA, 22 nt, Human
aggauuuagcaugaaaugugaa

SEQ ID NO: 45890 - RNA, 22 nt, Human
aggauuuaggagcuggcuaacg

SEQ ID NO: 45891 - RNA, 22 nt, Human
aggauuuauuacaagccauggu

SEQ ID NO: 45892 - RNA, 22 nt, Human
aggauuuauuggugggaaguua

SEQ ID NO: 45893 - RNA, 22 nt, Human
aggauuucccauauagcuccau

SEQ ID NO: 45894 - RNA, 21 nt, Human
aggauuucugucauuucagau

SEQ ID NO: 45895 - RNA, 22 nt, Human
aggauuugaaauauuuaguaaa

SEQ ID NO: 45896 - RNA, 22 nt, Human
aggauuuguugaguuuuagugg

SEQ ID NO: 45897 - RNA, 22 nt, Human
aggauuuguuuauaggucuuaa

SEQ ID NO: 45898 - RNA, 22 nt, Human
aggcaaauccagauuuuuccac

SEQ ID NO: 45899 - RNA, 22 nt, Human
aggcaacaugacucacuugcac

SEQ ID NO: 45900 - RNA, 22 nt, Human
aggcaacaugggccaggcagaa

SEQ ID NO: 45901 - RNA, 20 nt, Human
aggcaacucaaguuuuugcc

SEQ ID NO: 45902 - RNA, 22 nt, Human
aggcaacugacaguuucugcuu

SEQ ID NO: 45903 - RNA, 22 nt, Human
aggcaacuuuuggggaugaugg

SEQ ID NO: 45904 - RNA, 22 nt, Human
aggcaagcauuuaaccacucau

SEQ ID NO: 45905 - RNA, 22 nt, Human
aggcaagccgugccugucucaa

SEQ ID NO: 45906 - RNA, 22 nt, Human
aggcaagcgcagaagcggagga

SEQ ID NO: 45907 - RNA, 22 nt, Human
aggcaagggggcgccaccuucc

SEQ ID NO: 45908 - RNA, 23 nt, Human
aggcaauacaaggcaucucugga

SEQ ID NO: 45909 - RNA, 22 nt, Human
aggcaauagguuccucaucuuu

SEQ ID NO: 45910 - RNA, 22 nt, Human
aggcaaucaguguagaguaaca

SEQ ID NO: 45911 - RNA, 22 nt, Human
aggcaauuguuuguguaauagg

SEQ ID NO: 45912 - RNA, 22 nt, Human
aggcacaaaagcagggugacca

SEQ ID NO: 45913 - RNA, 19 nt, Human
aggcacaauucugagaagc

SEQ ID NO: 45914 - RNA, 22 nt, Human
aggcacagaauggcauucagug

SEQ ID NO: 45915 - RNA, 22 nt, Human
aggcacaggccucagcacccag

SEQ ID NO: 45916 - RNA, 22 nt, Human
aggcacaguuucauccccgggc

SEQ ID NO: 45917 - RNA, 22 nt, Human
aggcaccgcuccucaguccaga

SEQ ID NO: 45918 - RNA, 22 nt, Human
aggcaccucuuaggcugcuacu

SEQ ID NO: 45919 - RNA, 17 nt, Human
aggcaccucuuccugcu

SEQ ID NO: 45920 - RNA, 22 nt, Human
aggcaccuggaucuuggaauuc

SEQ ID NO: 45921 - RNA, 22 nt, Human
aggcaccuugcgguccagugaa

SEQ ID NO: 45922 - RNA, 22 nt, Human
aggcacguggcgccaggaguga

SEQ ID NO: 45923 - RNA, 23 nt, Human
aggcacucgacagaaauauugga

SEQ ID NO: 45924 - RNA, 22 nt, Human
aggcacugaagaacucuuuuug

SEQ ID NO: 45925 - RNA, 22 nt, Human
aggcacugacaauucuggacug

SEQ ID NO: 45926 - RNA, 22 nt, Human
aggcacugcagauuacaggcgc

SEQ ID NO: 45927 - RNA, 22 nt, Human
aggcacugugcagucccaagca

SEQ ID NO: 45928 - RNA, 21 nt, Human
aggcacuguuugugguuuggg

SEQ ID NO: 45929 - RNA, 21 nt, Human
aggcacuuaaccaauguuagc

SEQ ID NO: 45930 - RNA, 22 nt, Human
aggcacuuaaccuacuaacuga

SEQ ID NO: 45931 - RNA, 22 nt, Human
aggcacuuugaaauuuggagcu

SEQ ID NO: 45932 - RNA, 22 nt, Human
aggcacuuuuugcauuuuagaa

SEQ ID NO: 45933 - RNA, 22 nt, Human
aggcagaaaauagucauccaaa

SEQ ID NO: 45934 - RNA, 22 nt, Human
aggcagaagccagccagggucc

SEQ ID NO: 45935 - RNA, 22 nt, Human
aggcagagagcaguggccgucu

SEQ ID NO: 45936 - RNA, 20 nt, Human
aggcagagcgcacuuuuaga

SEQ ID NO: 45937 - RNA, 22 nt, Human
aggcagagcugauguucuguga

SEQ ID NO: 45938 - RNA, 22 nt, Human
aggcagagcuggguuuugaaau

SEQ ID NO: 45939 - RNA, 22 nt, Human
aggcagaggaaggguggauuug

SEQ ID NO: 45940 - RNA, 19 nt, Human
aggcagaggcuuggcuagc

SEQ ID NO: 45941 - RNA, 22 nt, Human
aggcagaucaguacaggguuaa

SEQ ID NO: 45942 - RNA, 22 nt, Human
aggcagauuacuugaggccagg

SEQ ID NO: 45943 - RNA, 22 nt, Human
aggcagcagagguugaggaaag

SEQ ID NO: 45944 - RNA, 18 nt, Human
aggcagcagcaucuucuc

SEQ ID NO: 45945 - RNA, 19 nt, Human
aggcagcaggccagggaug

SEQ ID NO: 45946 - RNA, 23 nt, Human
aggcagcagguuguccaggguga

SEQ ID NO: 45947 - RNA, 22 nt, Human
aggcagcaugggccccagcucc

SEQ ID NO: 45948 - RNA, 16 nt, Human
aggcagcauguuagug

SEQ ID NO: 45949 - RNA, 19 nt, Human
aggcagcauucuggggcuu

SEQ ID NO: 45950 - RNA, 22 nt, Human
aggcagcauuugaauccagguc

SEQ ID NO: 45951 - RNA, 22 nt, Human
aggcagccagauggcagccugc

SEQ ID NO: 45952 - RNA, 22 nt, Human
aggcagccaguucagguuucuu

SEQ ID NO: 45953 - RNA, 22 nt, Human
aggcagccaucugcaggaagga

SEQ ID NO: 45954 - RNA, 22 nt, Human
aggcagccauuaccaagggcau

SEQ ID NO: 45955 - RNA, 22 nt, Human
aggccugggucucgugccuacc

SEQ ID NO: 45956 - RNA, 22 nt, Human
aggccuggugugccggaugcag

SEQ ID NO: 45957 - RNA, 22 nt, Human
aggccuguaguuccucuuucca

SEQ ID NO: 45958 - RNA, 22 nt, Human
aggccugucccagcugaggacg

SEQ ID NO: 45959 - RNA, 22 nt, Human
aggccugucuggggcucagcca

SEQ ID NO: 45960 - RNA, 22 nt, Human
aggccuguuuccuuggguugcu

SEQ ID NO: 45961 - RNA, 22 nt, Human
aggccuuuguggagcucauggc

SEQ ID NO: 45962 - RNA, 16 nt, Human
aggcgaagguucauuu

SEQ ID NO: 45963 - RNA, 23 nt, Human
aggcgagcucuucuccagcacgu

SEQ ID NO: 45964 - RNA, 22 nt, Human
aggcgcagcacgugagaguugg

SEQ ID NO: 45965 - RNA, 22 nt, Human
aggcggcuccgggagugugggc

SEQ ID NO: 45966 - RNA, 22 nt, Human
aggcgguggccaaggagcggga

SEQ ID NO: 45967 - RNA, 19 nt, Human
aggcuaaagagucuugcgu

SEQ ID NO: 45968 - RNA, 22 nt, Human
aggcuaaggagugugaugcuca

SEQ ID NO: 45969 - RNA, 22 nt, Human
aggcuaagugggugucagggcc

SEQ ID NO: 45970 - RNA, 22 nt, Human
aggcuaauauggcacaugaaca

SEQ ID NO: 45971 - RNA, 22 nt, Human
aggcuagcuguuucagggcuag

SEQ ID NO: 45972 - RNA, 22 nt, Human
aggcuaggaacagcccggcccu

SEQ ID NO: 45973 - RNA, 22 nt, Human
aggcuaggggaacacuagaauc

SEQ ID NO: 45974 - RNA, 22 nt, Human
aggcuaggguaacagauguggc

SEQ ID NO: 45975 - RNA, 22 nt, Human
aggcuagucaagucaagcagug

SEQ ID NO: 45976 - RNA, 22 nt, Human
aggcuaugauauuauugagaca

SEQ ID NO: 45977 - RNA, 20 nt, Human
aggcucacucaccuugugga

SEQ ID NO: 45978 - RNA, 22 nt, Human
aggcucagacaggaaaaguaac

SEQ ID NO: 45979 - RNA, 20 nt, Human
aggcucagagcaguaguaca

SEQ ID NO: 45980 - RNA, 22 nt, Human
aggcucagauccuuguguccug

SEQ ID NO: 45981 - RNA, 22 nt, Human
aggcucagcaucugauucauau

SEQ ID NO: 45982 - RNA, 22 nt, Human
aggcucagcugguggugaucgc

SEQ ID NO: 45983 - RNA, 22 nt, Human
aggcucagggacucccucccuc

SEQ ID NO: 45984 - RNA, 22 nt, Human
aggcucaggugccucauucaca

SEQ ID NO: 45985 - RNA, 22 nt, Human
aggcucaucugagcagaaaccu

SEQ ID NO: 45986 - RNA, 22 nt, Human
aucuuuagagucaucugagugu

SEQ ID NO: 45987 - RNA, 22 nt, Human
aucuuuagugugaauuuauuga

SEQ ID NO: 45988 - RNA, 21 nt, Human
aucuuuauuacgcagagaaga

SEQ ID NO: 45989 - RNA, 22 nt, Human
aucuuuauuuauugagcacuua

SEQ ID NO: 45990 - RNA, 22 nt, Human
aucuuucaaucaggaaaaaucu

SEQ ID NO: 45991 - RNA, 22 nt, Human
aucuuucagagcuccaucaggg

SEQ ID NO: 45992 - RNA, 22 nt, Human
aucuuucagggccauuuguauu

SEQ ID NO: 45993 - RNA, 22 nt, Human
aucuuucaguuucauaccaauu

SEQ ID NO: 45994 - RNA, 22 nt, Human
aucuuucaucucuauuauuuga

SEQ ID NO: 45995 - RNA, 22 nt, Human
aucuuucuuauuugaagaaaga

SEQ ID NO: 45996 - RNA, 22 nt, Human
aucuuugaucuuuauugcuaag

SEQ ID NO: 45997 - RNA, 22 nt, Human
aucuuugcccagagacucagcc

SEQ ID NO: 45998 - RNA, 22 nt, Human
aucuuugcuauuguaaaucacg

SEQ ID NO: 45999 - RNA, 22 nt, Human
aucuuuggggcauccaggaaaa

SEQ ID NO: 46000 - RNA, 22 nt, Human
aucuuuggguacaaacuugccu

SEQ ID NO: 46001 - RNA, 22 nt, Human
aucuuuggugcaugauacuuug

SEQ ID NO: 46002 - RNA, 20 nt, Human
aucuuugucucuguaguugu

SEQ ID NO: 46003 - RNA, 22 nt, Human
aucuuugugaaucucaacuugg

SEQ ID NO: 46004 - RNA, 22 nt, Human
aucuuuguuaucucagaucuug

SEQ ID NO: 46005 - RNA, 22 nt, Human
aucuuuguuuugaugcagaucu

SEQ ID NO: 46006 - RNA, 22 nt, Human
augaaaacggaccagagcuauu

SEQ ID NO: 46007 - RNA, 22 nt, Human
augaaaacuuuagccucauuag

SEQ ID NO: 46008 - RNA, 22 nt, Human
augaaaauucuaugcaggccag

SEQ ID NO: 46009 - RNA, 22 nt, Human
augaaacacacacgcgcauacu

SEQ ID NO: 46010 - RNA, 22 nt, Human
augaaacaguguguauagcaaa

SEQ ID NO: 46011 - RNA, 22 nt, Human
augaaacucuaacuuaacaagu

SEQ ID NO: 46012 - RNA, 22 nt, Human
augaaacucuagcuuucagcac

SEQ ID NO: 46013 - RNA, 22 nt, Human
augaaagugaagguuuacuaag

SEQ ID NO: 46014 - RNA, 22 nt, Human
augaaauaaauacccacacaua

SEQ ID NO: 46015 - RNA, 22 nt, Human
augaaauaucuugaagaaauuc

SEQ ID NO: 46016 - RNA, 22 nt, Human
augaaauauucuuugguaagaa

SEQ ID NO: 46017 - RNA, 22 nt, Human
augaaaugaaguuggccuggcu

SEQ ID NO: 46018 - RNA, 22 nt, Human
augaaauggugguuuuccauuu

SEQ ID NO: 46019 - RNA, 22 nt, Human
augaaauguauucagauaugua

SEQ ID NO: 46020 - RNA, 22 nt, Human
augaaauguuggucccaaucgc

SEQ ID NO: 46021 - RNA, 22 nt, Human
augaaauuugaccaauuauuua

SEQ ID NO: 46022 - RNA, 22 nt, Human
augaacaaaaacaaggccuguu

SEQ ID NO: 46023 - RNA, 22 nt, Human
augaacaagagagggaagauuc

SEQ ID NO: 46024 - RNA, 22 nt, Human
augaacaaucuguugacuucug

SEQ ID NO: 46025 - RNA, 22 nt, Human
augaacacaauacgugcaugca

SEQ ID NO: 46026 - RNA, 22 nt, Human
augaacacauguacacauuucu

SEQ ID NO: 46027 - RNA, 18 nt, Human
augaacacugagcugaau

SEQ ID NO: 46028 - RNA, 22 nt, Human
augaacaucggaaaugagacug

SEQ ID NO: 46029 - RNA, 22 nt, Human
augaaccuugauuuguucaucu

SEQ ID NO: 46030 - RNA, 22 nt, Human
augaacuaucaucaguuccacc

SEQ ID NO: 46031 - RNA, 22 nt, Human
augaagacuauuugaaggugcc

SEQ ID NO: 46032 - RNA, 22 nt, Human
augaagauaagaccaggcugga

SEQ ID NO: 46033 - RNA, 22 nt, Human
augaagaugguucaacuggccu

SEQ ID NO: 46034 - RNA, 22 nt, Human
augaagaugugaaggcuggauu

SEQ ID NO: 46035 - RNA, 22 nt, Human
augaagauuucccagagacaug

SEQ ID NO: 46036 - RNA, 22 nt, Human
augaagcaauuagaaacuugaa

SEQ ID NO: 46037 - RNA, 22 nt, Human
augaagcagaauuucccacucu

SEQ ID NO: 46038 - RNA, 22 nt, Human
augaagcagauuuauuacucac

SEQ ID NO: 46039 - RNA, 22 nt, Human
augaagcauuacaggaugacag

SEQ ID NO: 46040 - RNA, 22 nt, Human
augaaggauagggcaaaauuuu

SEQ ID NO: 46041 - RNA, 22 nt, Human
augaauaaaacauuuuaaucag

SEQ ID NO: 46042 - RNA, 22 nt, Human
augaauaaguaaacuccuuugg

SEQ ID NO: 46043 - RNA, 22 nt, Human
augaaucaagugagaacagcau

SEQ ID NO: 46044 - RNA, 22 nt, Human
augaauccagcaaacagugagg

SEQ ID NO: 46045 - RNA, 22 nt, Human
augaaucuguuuuuugucaaua

SEQ ID NO: 46046 - RNA, 22 nt, Human
augaaugaaauacagaguacuu

SEQ ID NO: 46047 - RNA, 22 nt, Human
augaaugaagaacaucugugcc

SEQ ID NO: 46048 - RNA, 22 nt, Human
augaaugaaugagaguagguca

SEQ ID NO: 46049 - RNA, 22 nt, Human
augaaugacugucuacuuuggg

SEQ ID NO: 46050 - RNA, 22 nt, Human
augaaugauuuuauguaaauga

SEQ ID NO: 46051 - RNA, 22 nt, Human
augaaugcaauauuuuaugaca

SEQ ID NO: 46052 - RNA, 22 nt, Human
augaaugcagcacuguuuuucu

SEQ ID NO: 46053 - RNA, 22 nt, Human
augaaugcaugcuuauuuugca

SEQ ID NO: 46054 - RNA, 22 nt, Human
augaaugcuuauuaaauugaaa

SEQ ID NO: 46055 - RNA, 22 nt, Human
augacaaaauaaauggucucug

SEQ ID NO: 46056 - RNA, 22 nt, Human
augacaaaaugaaugcagcuag

SEQ ID NO: 46057 - RNA, 22 nt, Human
augacaagggaggguccugcua

SEQ ID NO: 46058 - RNA, 22 nt, Human
augacacaauuuuagagcugaa

SEQ ID NO: 46059 - RNA, 22 nt, Human
augacacuguccuaguaaggaa

SEQ ID NO: 46060 - RNA, 22 nt, Human
augacagaugcuguggggaggu

SEQ ID NO: 46061 - RNA, 22 nt, Human
augacaggaauaacuaugaugg

SEQ ID NO: 46062 - RNA, 22 nt, Human
augacagugggucuugcaaaga

SEQ ID NO: 46063 - RNA, 22 nt, Human
augacaguucuacacuuaaucu

SEQ ID NO: 46064 - RNA, 22 nt, Human
agguaaauucagcagugacauu

SEQ ID NO: 46065 - RNA, 22 nt, Human
agguaacacuacuuaguauacu

SEQ ID NO: 46066 - RNA, 22 nt, Human
agguaacuagcauuagcuucug

SEQ ID NO: 46067 - RNA, 22 nt, Human
agguaagcaugguggcugcugu

SEQ ID NO: 46068 - RNA, 22 nt, Human
agguaaggaaauugaggcaauu

SEQ ID NO: 46069 - RNA, 22 nt, Human
agguaaggcuguaagcuaagcc

SEQ ID NO: 46070 - RNA, 22 nt, Human
agguaaggggcucccaaguacc

SEQ ID NO: 46071 - RNA, 22 nt, Human
agguaaggggcucccaaguccc

SEQ ID NO: 46072 - RNA, 22 nt, Human
agguaagggucacaguucauau

SEQ ID NO: 46073 - RNA, 22 nt, Human
agguaauuuuguguuaaugauu

SEQ ID NO: 46074 - RNA, 18 nt, Human
agguacacauacuucuca

SEQ ID NO: 46075 - RNA, 22 nt, Human
agguacagaugaaagucuaguu

SEQ ID NO: 46076 - RNA, 22 nt, Human
agguacagcaauauaagagguc

SEQ ID NO: 46077 - RNA, 22 nt, Human
agguacagggugaaaguuuaug

SEQ ID NO: 46078 - RNA, 21 nt, Human
agguacaggucuugugagucu

SEQ ID NO: 46079 - RNA, 23 nt, Human
agguacauauacuuggaggucag

SEQ ID NO: 46080 - RNA, 22 nt, Human
agguacauguuccagauacgua

SEQ ID NO: 46081 - RNA, 22 nt, Human
agguaccauaugcgggagcaac

SEQ ID NO: 46082 - RNA, 22 nt, Human
agguagaucaacuggggaggga

SEQ ID NO: 46083 - RNA, 22 nt, Human
agguagcuggugcugggcuccu

SEQ ID NO: 46084 - RNA, 22 nt, Human
agguaggauggguggagaugau

SEQ ID NO: 46085 - RNA, 22 nt, Human
agguaggggguuugggaacugc

SEQ ID NO: 46086 - RNA, 22 nt, Human
agguaggguuaauggagauaua

SEQ ID NO: 46087 - RNA, 22 nt, Human
agguagguuaaauuucuuuauc

SEQ ID NO: 46088 - RNA, 22 nt, Human
agguauaagucucauuucuguu

SEQ ID NO: 46089 - RNA, 22 nt, Human
agguaucugguaagaggcagac

SEQ ID NO: 46090 - RNA, 22 nt, Human
agguaugugggugagaggagga

SEQ ID NO: 46091 - RNA, 22 nt, Human
agguauucagagagaugcuuuu

SEQ ID NO: 46092 - RNA, 22 nt, Human
agguauuucauggagcaagcag

SEQ ID NO: 46093 - RNA, 22 nt, Human
agguauuuccuuuaaagaaacu

SEQ ID NO: 46094 - RNA, 22 nt, Human
agguauuugucucagauugggu

SEQ ID NO: 46095 - RNA, 22 nt, Human
agguauuuguuacagcagcacc

SEQ ID NO: 46096 - RNA, 22 nt, Human
agguauuuuaaguccaccagag

SEQ ID NO: 46097 - RNA, 22 nt, Human
agguauuuuauagauaaguaaa

SEQ ID NO: 46098 - RNA, 22 nt, Human
aggucaagggcaagagugaggu

SEQ ID NO: 46099 - RNA, 22 nt, Human
aggucacaggcuuugaaaucaa

SEQ ID NO: 46100 - RNA, 22 nt, Human
aggucacaggguugaaguacuu

SEQ ID NO: 46101 - RNA, 22 nt, Human
aggucaccauggcaugcuccac

SEQ ID NO: 46102 - RNA, 22 nt, Human
aggucacccguuugacuaucca

SEQ ID NO: 46103 - RNA, 22 nt, Human
augcauauugauuauagauuca

SEQ ID NO: 46104 - RNA, 21 nt, Human
augcauauuuuaaguuguguc

SEQ ID NO: 46105 - RNA, 22 nt, Human
augcaucacuaaauagugccgu

SEQ ID NO: 46106 - RNA, 19 nt, Human
augcaucugcauugacagg

SEQ ID NO: 46107 - RNA, 22 nt, Human
augcaucuuuucaagguauuuc

SEQ ID NO: 46108 - RNA, 22 nt, Human
augcaugaaagaauccaagccu

SEQ ID NO: 46109 - RNA, 22 nt, Human
augcaugaugaacuugcuuuca

SEQ ID NO: 46110 - RNA, 21 nt, Human
augcauguuccauaaaguggg

SEQ ID NO: 46111 - RNA, 22 nt, Human
augcauucagcggaaugcuuag

SEQ ID NO: 46112 - RNA, 22 nt, Human
augcauucuggaaaguagcaau

SEQ ID NO: 46113 - RNA, 22 nt, Human
augcauugcugcuuucaaaaca

SEQ ID NO: 46114 - RNA, 22 nt, Human
augcauugcuugaggguaggaa

SEQ ID NO: 46115 - RNA, 22 nt, Human
augcauuguaugaaaggaaaua

SEQ ID NO: 46116 - RNA, 22 nt, Human
augcauugucugguuucauuuu

SEQ ID NO: 46117 - RNA, 19 nt, Human
augcauuguuugaaguuga

SEQ ID NO: 46118 - RNA, 22 nt, Human
augcauuugacgggauauauuu

SEQ ID NO: 46119 - RNA, 22 nt, Human
augccaaagauguuugauagaa

SEQ ID NO: 46120 - RNA, 22 nt, Human
augccaaagcccaaguucauca

SEQ ID NO: 46121 - RNA, 22 nt, Human
augccaaagggagcacuuuggg

SEQ ID NO: 46122 - RNA, 20 nt, Human
augccaagcuaucuagaauc

SEQ ID NO: 46123 - RNA, 22 nt, Human
augccaagcucuaucccugacc

SEQ ID NO: 46124 - RNA, 21 nt, Human
augccaagucuuaaugagggc

SEQ ID NO: 46125 - RNA, 22 nt, Human
augccagaagagucugcaggga

SEQ ID NO: 46126 - RNA, 23 nt, Human
augccaggcugccuggccagccu

SEQ ID NO: 46127 - RNA, 22 nt, Human
augccaggcuguuuggccucag

SEQ ID NO: 46128 - RNA, 22 nt, Human
augccagggucauccccugggu

SEQ ID NO: 46129 - RNA, 22 nt, Human
augccagucaaagaagaugaca

SEQ ID NO: 46130 - RNA, 22 nt, Human
augccaguguuauaaauagaua

SEQ ID NO: 46131 - RNA, 22 nt, Human
augccauugcuuuaaaauuaag

SEQ ID NO: 46132 - RNA, 22 nt, Human
augccauuuuauacucauucaa

SEQ ID NO: 46133 - RNA, 22 nt, Human
augcccaaugucacaauuuuug

SEQ ID NO: 46134 - RNA, 22 nt, Human
augcccaggcccauaccuagau

SEQ ID NO: 46135 - RNA, 22 nt, Human
augcccucuguuucccaaggcc

SEQ ID NO: 46136 - RNA, 23 nt, Human
augcccugugcagaaauguggaa

SEQ ID NO: 46137 - RNA, 20 nt, Human
augccucuaauuuugcaaac

SEQ ID NO: 46138 - RNA, 22 nt, Human
augccuggucccaccucuaggu

SEQ ID NO: 46139 - RNA, 22 nt, Human
augccuguaaucccagugcuuu

SEQ ID NO: 46140 - RNA, 22 nt, Human
augccuguuugaaauuggaccu

SEQ ID NO: 46141 - RNA, 22 nt, Human
augccuuauuccaacaaucuag

SEQ ID NO: 46142 - RNA, 22 nt, Human
augccuuucccaacaggguggg

SEQ ID NO: 46143 - RNA, 22 nt, Human
augccuuucuuuggugcagguu

SEQ ID NO: 46144 - RNA, 20 nt, Human
augccuuugauagucaggcu

SEQ ID NO: 46145 - RNA, 22 nt, Human
augccuuuggagaauccaacau

SEQ ID NO: 46146 - RNA, 22 nt, Human
augcggagccccaagcuugaag

SEQ ID NO: 46147 - RNA, 22 nt, Human
augcguguuuguauacacacaa

SEQ ID NO: 46148 - RNA, 22 nt, Human
augcuaaaugcuggggguacau

SEQ ID NO: 46149 - RNA, 22 nt, Human
augcuaaauguuaauguuaccu

SEQ ID NO: 46150 - RNA, 22 nt, Human
augcuacaacauuaucuggggu

SEQ ID NO: 46151 - RNA, 22 nt, Human
augcuacaggagccccacuuag

SEQ ID NO: 46152 - RNA, 18 nt, Human
augcuacaggcagguguc

SEQ ID NO: 46153 - RNA, 22 nt, Human
augcuacuauccuucugcuuaa

SEQ ID NO: 46154 - RNA, 23 nt, Human
augcuagcugugccaacaccaua

SEQ ID NO: 46155 - RNA, 22 nt, Human
augcuauaaacucuaggucauu

SEQ ID NO: 46156 - RNA, 22 nt, Human
augcuauacucaaagaaauuca

SEQ ID NO: 46157 - RNA, 22 nt, Human
augcucaguagcuggcugaccc

SEQ ID NO: 46158 - RNA, 22 nt, Human
augcucauuuuauugagaauga

SEQ ID NO: 46159 - RNA, 22 nt, Human
augcuccaccuuuugcaggaac

SEQ ID NO: 46160 - RNA, 22 nt, Human
augcuccagugugaugcuucau

SEQ ID NO: 46161 - RNA, 22 nt, Human
augcucuaagcuuagugaggca

SEQ ID NO: 46162 - RNA, 18 nt, Human
augcucuagucuuuccug

SEQ ID NO: 46163 - RNA, 22 nt, Human
augcucucuguccugcucagag

SEQ ID NO: 46164 - RNA, 22 nt, Human
augcucuggaguacgugaaauu

SEQ ID NO: 46165 - RNA, 22 nt, Human
augcucugggcuuuugaagugg

SEQ ID NO: 46166 - RNA, 22 nt, Human
augcugaaaauuggauuugaau

SEQ ID NO: 46167 - RNA, 22 nt, Human
augcugacuucucucugcagug

SEQ ID NO: 46168 - RNA, 22 nt, Human
augcugagacuggagcagcugg

SEQ ID NO: 46169 - RNA, 22 nt, Human
augcugagguguguuuaauuua

SEQ ID NO: 46170 - RNA, 22 nt, Human
augcugaucuguaauaagauuu

SEQ ID NO: 46171 - RNA, 22 nt, Human
augcugcagucaggccagauug

SEQ ID NO: 46172 - RNA, 22 nt, Human
augcuggauugagagcaagggg

SEQ ID NO: 46173 - RNA, 21 nt, Human
auuagaagguauuuagggccu

SEQ ID NO: 46174 - RNA, 22 nt, Human
auuagaaugaaguauaggauuu

SEQ ID NO: 46175 - RNA, 22 nt, Human
auuagaaugcaggguucauugu

SEQ ID NO: 46176 - RNA, 23 nt, Human
auuagacacuuuggguugucuuc

SEQ ID NO: 46177 - RNA, 22 nt, Human
auuagagaaauguugccaagau

SEQ ID NO: 46178 - RNA, 22 nt, Human
auuagagcaguaauuguggcag

SEQ ID NO: 46179 - RNA, 22 nt, Human
auuagagcuguuagugaagugc

SEQ ID NO: 46180 - RNA, 22 nt, Human
auuagagguuguuuuguaaaga

SEQ ID NO: 46181 - RNA, 22 nt, Human
auuagauauuugcuguuggauu

SEQ ID NO: 46182 - RNA, 22 nt, Human
auuagcaacauggugaauaugu

SEQ ID NO: 46183 - RNA, 22 nt, Human
auuagcaaguuguuauccuuug

SEQ ID NO: 46184 - RNA, 22 nt, Human
auuagcaauugugcaucuagua

SEQ ID NO: 46185 - RNA, 22 nt, Human
auuagccuuaauaauuuagaag

SEQ ID NO: 46186 - RNA, 22 nt, Human
auuagcuguugugaaaggggug

SEQ ID NO: 46187 - RNA, 22 nt, Human
auuagcuuaucccauuucugaa

SEQ ID NO: 46188 - RNA, 22 nt, Human
auuagcuuuaaaccacagcagu

SEQ ID NO: 46189 - RNA, 22 nt, Human
auuagcuuuauuugaaauagga

SEQ ID NO: 46190 - RNA, 22 nt, Human
auuaggaaauguguugcaagca

SEQ ID NO: 46191 - RNA, 22 nt, Human
auuaggauguuccuaugcacau

SEQ ID NO: 46192 - RNA, 22 nt, Human
auuaggauuugguauggucaua

SEQ ID NO: 46193 - RNA, 22 nt, Human
auuaggcaauucugggcaucuc

SEQ ID NO: 46194 - RNA, 22 nt, Human
auuaggugggguuguuacuguu

SEQ ID NO: 46195 - RNA, 22 nt, Human
auuagguugagguacucagagc

SEQ ID NO: 46196 - RNA, 22 nt, Human
auuagucaguauuuguuugcca

SEQ ID NO: 46197 - RNA, 22 nt, Human
auuagucuacugucuaauaaau

SEQ ID NO: 46198 - RNA, 22 nt, Human
auuagugauaugugacuagacc

SEQ ID NO: 46199 - RNA, 20 nt, Human
auuagugcaucuggacaugc

SEQ ID NO: 46200 - RNA, 22 nt, Human
auuaguguacaucucacacgca

SEQ ID NO: 46201 - RNA, 22 nt, Human
auuagugucugugaauaauucu

SEQ ID NO: 46202 - RNA, 22 nt, Human
auuaguguggacccuaauuuaa

SEQ ID NO: 46203 - RNA, 22 nt, Human
auuaguguguaggcuggaaaaa

SEQ ID NO: 46204 - RNA, 22 nt, Human
auuaguguuguaagaagcugcc

SEQ ID NO: 46205 - RNA, 22 nt, Human
auuaguugggguggagaaggau

SEQ ID NO: 46206 - RNA, 22 nt, Human
auuauaaagaacaugugugugg

SEQ ID NO: 46207 - RNA, 22 nt, Human
auuauaaauauuuucuaggggu

SEQ ID NO: 46208 - RNA, 22 nt, Human
auuauaggcuugagccaccgug

SEQ ID NO: 46209 - RNA, 22 nt, Human
auuauauuugaaagguuggaag

SEQ ID NO: 46210 - RNA, 22 nt, Human
auuaucagaaauucaaagggug

SEQ ID NO: 46211 - RNA, 23 nt, Human
auuauccagugcacuucacagcu

SEQ ID NO: 46212 - RNA, 22 nt, Human
auuaucuugauaaaauggcagu

SEQ ID NO: 46213 - RNA, 22 nt, Human
auuaugaaguugagggacccug

SEQ ID NO: 46214 - RNA, 22 nt, Human
auuaugcugguuuacacauuuu

SEQ ID NO: 46215 - RNA, 22 nt, Human
auuauggacaucaaauaacucu

SEQ ID NO: 46216 - RNA, 22 nt, Human
auuauggguauaacacaguuau

SEQ ID NO: 46217 - RNA, 22 nt, Human
auuauguauuugguauaguuug

SEQ ID NO: 46218 - RNA, 22 nt, Human
auuaugucuuuagauauuuggu

SEQ ID NO: 46219 - RNA, 22 nt, Human
auuauuaaaauguguuucucuu

SEQ ID NO: 46220 - RNA, 21 nt, Human
auuauuauaaagaccacaggg

SEQ ID NO: 46221 - RNA, 22 nt, Human
auuauuauaaagugcaugaccu

SEQ ID NO: 46222 - RNA, 22 nt, Human
auuauuaugguugcucuuuucc

SEQ ID NO: 46223 - RNA, 22 nt, Human
auuauucaauguuauuucagug

SEQ ID NO: 46224 - RNA, 22 nt, Human
auuauucauggucuuccacaau

SEQ ID NO: 46225 - RNA, 22 nt, Human
auuauucauugguaggcaagcu

SEQ ID NO: 46226 - RNA, 22 nt, Human
auuauugcugacaugguguuga

SEQ ID NO: 46227 - RNA, 22 nt, Human
auuauuuauccucuuggucuau

SEQ ID NO: 46228 - RNA, 22 nt, Human
auuauuucucacucacauaaua

SEQ ID NO: 46229 - RNA, 22 nt, Human
auuauuugcuuggcucaucuaa

SEQ ID NO: 46230 - RNA, 15 nt, Human
auuauuugugcucag

SEQ ID NO: 46231 - RNA, 22 nt, Human
auucaaacaggaagaaaucauu

SEQ ID NO: 46232 - RNA, 22 nt, Human
auucaaaguacuagcuauuuuu

SEQ ID NO: 46233 - RNA, 22 nt, Human
auucaaauuaaguuaauucagc

SEQ ID NO: 46234 - RNA, 22 nt, Human
auucaagagcccauguuuccug

SEQ ID NO: 46235 - RNA, 22 nt, Human
auucaagagcuggcuuugaaau

SEQ ID NO: 46236 - RNA, 22 nt, Human
auucaagaggaacaaugaagau

SEQ ID NO: 46237 - RNA, 22 nt, Human
auucaagcugaauggugacaga

SEQ ID NO: 46238 - RNA, 22 nt, Human
auucaagguuuauucaguuuag

SEQ ID NO: 46239 - RNA, 22 nt, Human
auucaauaaauaugcuacaugg

SEQ ID NO: 46240 - RNA, 22 nt, Human
auucacaaaaugauauagauac

SEQ ID NO: 46241 - RNA, 22 nt, Human
aguaaacaggcaugauaguguu

SEQ ID NO: 46242 - RNA, 22 nt, Human
aguaaacauuuucauauuuucu

SEQ ID NO: 46243 - RNA, 22 nt, Human
aguaaauuucugcauguguacu

SEQ ID NO: 46244 - RNA, 22 nt, Human
aguaacacaagagguccuugcg

SEQ ID NO: 46245 - RNA, 22 nt, Human
aguaacaggauccaaagaaugu

SEQ ID NO: 46246 - RNA, 22 nt, Human
aguaacaguaacaucuuccuag

SEQ ID NO: 46247 - RNA, 22 nt, Human
aguaacaugcuaauuugauuau

SEQ ID NO: 46248 - RNA, 21 nt, Human
aguaacauuuuguuguuuaca

SEQ ID NO: 46249 - RNA, 22 nt, Human
aguaacuaugcuugagaaucag

SEQ ID NO: 46250 - RNA, 22 nt, Human
aguaacucuccuuugacauauu

SEQ ID NO: 46251 - RNA, 20 nt, Human
aguaacuuagcaacucuagg

SEQ ID NO: 46252 - RNA, 22 nt, Human
aguaaggcaaugccacuaagau

SEQ ID NO: 46253 - RNA, 22 nt, Human
aguaaggcauuuuucauguuua

SEQ ID NO: 46254 - RNA, 22 nt, Human
aguaagugagucacugugcugg

SEQ ID NO: 46255 - RNA, 22 nt, Human
aguaaucaauuuuucgguggau

SEQ ID NO: 46256 - RNA, 22 nt, Human
aguaaugaagauuuguugcaca

SEQ ID NO: 46257 - RNA, 22 nt, Human
aguacaacauuagaguaucuua

SEQ ID NO: 46258 - RNA, 22 nt, Human
aguacaauuuaaugaagauagc

SEQ ID NO: 46259 - RNA, 22 nt, Human
aguacacacaguagaauagagu

SEQ ID NO: 46260 - RNA, 22 nt, Human
aguacaguuauaaguggucuug

SEQ ID NO: 46261 - RNA, 22 nt, Human
aguacaugcagaacuaacagau

SEQ ID NO: 46262 - RNA, 23 nt, Human
aguacauuugacccaaauaagcu

SEQ ID NO: 46263 - RNA, 22 nt, Human
aguaccaugcuuccugacuggu

SEQ ID NO: 46264 - RNA, 22 nt, Human
aguaccugauuucacagaccag

SEQ ID NO: 46265 - RNA, 20 nt, Human
aguaccuuuuguauguuacc

SEQ ID NO: 46266 - RNA, 22 nt, Human
aguacugucagcaggguguuga

SEQ ID NO: 46267 - RNA, 22 nt, Human
aguacuuuuuugauaucugagu

SEQ ID NO: 46268 - RNA, 22 nt, Human
aguagacauuuugcaacaucug

SEQ ID NO: 46269 - RNA, 22 nt, Human
aguagaggccaggccucccugg

SEQ ID NO: 46270 - RNA, 22 nt, Human
aguagauucucauugaucuggu

SEQ ID NO: 46271 - RNA, 22 nt, Human
aguagauuucugcugaagcuuu

SEQ ID NO: 46272 - RNA, 22 nt, Human
aguagauuuuugaauguaaguu

SEQ ID NO: 46273 - RNA, 22 nt, Human
aguagcagaaggucuugaaggg

SEQ ID NO: 46274 - RNA, 20 nt, Human
aguagcaguaauauggaaga

SEQ ID NO: 46275 - RNA, 22 nt, Human
aguagcagugacagcugaggua

SEQ ID NO: 46276 - RNA, 20 nt, Human
aguaggggaaugcaagagca

SEQ ID NO: 46277 - RNA, 22 nt, Human
aguaguggcuuccuggagugcu

SEQ ID NO: 46278 - RNA, 22 nt, Human
aguaguggggccaggguuugaa

SEQ ID NO: 46279 - RNA, 22 nt, Human
aguauaaagugguuuucagcac

SEQ ID NO: 46280 - RNA, 22 nt, Human
aguauaauuagauaucaaaagu

SEQ ID NO: 46281 - RNA, 22 nt, Human
aguauaauuuacauuugguauu

SEQ ID NO: 46282 - RNA, 23 nt, Human
agucucagcuggaaacauguguc

SEQ ID NO: 46283 - RNA, 22 nt, Human
agucucaucaggcauguaguca

SEQ ID NO: 46284 - RNA, 22 nt, Human
agucuccacacuggcagaugcc

SEQ ID NO: 46285 - RNA, 22 nt, Human
agucuccacccaugacaguaca

SEQ ID NO: 46286 - RNA, 22 nt, Human
agucuccagaaauauagcagug

SEQ ID NO: 46287 - RNA, 22 nt, Human
agucuccucuuuccuuguuauu

SEQ ID NO: 46288 - RNA, 22 nt, Human
agucucuccacauuguuauaaa

SEQ ID NO: 46289 - RNA, 22 nt, Human
agucucugggcaugguugugac

SEQ ID NO: 46290 - RNA, 22 nt, Human
agucucuggggaggaguggaaa

SEQ ID NO: 46291 - RNA, 20 nt, Human
agucucuguagugccugaga

SEQ ID NO: 46292 - RNA, 22 nt, Human
agucucuuaauuuuuucuaagu

SEQ ID NO: 46293 - RNA, 22 nt, Human
agucucuuacccaagcagaaug

SEQ ID NO: 46294 - RNA, 22 nt, Human
agucucuuauucccuauugcug

SEQ ID NO: 46295 - RNA, 22 nt, Human
agucucuuccucaugcauaugu

SEQ ID NO: 46296 - RNA, 22 nt, Human
agucucuuccuucaaggcuggu

SEQ ID NO: 46297 - RNA, 22 nt, Human
agucucuuucuaaauaagguca

SEQ ID NO: 46298 - RNA, 22 nt, Human
agucucuuuugcgaagaguguu

SEQ ID NO: 46299 - RNA, 22 nt, Human
agucucuuuugguuccaaaaau

SEQ ID NO: 46300 - RNA, 22 nt, Human
agucugaaggcaaucugcugac

SEQ ID NO: 46301 - RNA, 22 nt, Human
agucugaaguagucuuuagugu

SEQ ID NO: 46302 - RNA, 22 nt, Human
agucugacuuggccaggagcug

SEQ ID NO: 46303 - RNA, 22 nt, Human
agucugagucuaaaggcuugag

SEQ ID NO: 46304 - RNA, 22 nt, Human
agucugcaggcugugauuuuuu

SEQ ID NO: 46305 - RNA, 22 nt, Human
agucugcauucacagcaauuau

SEQ ID NO: 46306 - RNA, 20 nt, Human
agucugccugcuccuucucc

SEQ ID NO: 46307 - RNA, 22 nt, Human
agucuggaccugcugggucucc

SEQ ID NO: 46308 - RNA, 19 nt, Human
agucuggaguaaaaggaau

SEQ ID NO: 46309 - RNA, 20 nt, Human
agucuggcaugaugcaggca

SEQ ID NO: 46310 - RNA, 22 nt, Human
agucugggauguauaaacugaa

SEQ ID NO: 46311 - RNA, 22 nt, Human
agucugguagaggaagaggccu

SEQ ID NO: 46312 - RNA, 22 nt, Human
agucugguauuggucuuuaauc

SEQ ID NO: 46313 - RNA, 22 nt, Human
agucuggucuguucauggguca

SEQ ID NO: 46314 - RNA, 22 nt, Human
agucuggugagaacauaaauag

SEQ ID NO: 46315 - RNA, 19 nt, Human
agucugguggcgugcaugu

SEQ ID NO: 46316 - RNA, 22 nt, Human
agucuggugguauuuuguagug

SEQ ID NO: 46317 - RNA, 22 nt, Human
agucugucagucauucuaacaa

SEQ ID NO: 46318 - RNA, 19 nt, Human
agucugucugcuuucccuc

SEQ ID NO: 46319 - RNA, 22 nt, Human
agucugugaacuuggcagggaa

SEQ ID NO: 46320 - RNA, 22 nt, Human
agucugugacucauuggaucuc

SEQ ID NO: 46321 - RNA, 22 nt, Human
agucugugagugauguaccugc

SEQ ID NO: 46322 - RNA, 22 nt, Human
agucugugcuguuggugaggau

SEQ ID NO: 46323 - RNA, 23 nt, Human
agucugugcuuggugggagggcc

SEQ ID NO: 46324 - RNA, 22 nt, Human
agucugugugaaugugggcuuu

SEQ ID NO: 46325 - RNA, 22 nt, Human
agucuuaacuaugcaaguacua

SEQ ID NO: 46326 - RNA, 23 nt, Human
agucuuacugucccagaacaggg

SEQ ID NO: 46327 - RNA, 22 nt, Human
agucuuagauaagugaccaaug

SEQ ID NO: 46328 - RNA, 22 nt, Human
agucuuagauuuuauuuugguc

SEQ ID NO: 46329 - RNA, 22 nt, Human
agucuuaguaugguuuuagguu

SEQ ID NO: 46330 - RNA, 22 nt, Human
agucuuaugguuaaauagaugc

SEQ ID NO: 46331 - RNA, 22 nt, Human
agucuuaugugauuuaucuuuc

SEQ ID NO: 46332 - RNA, 22 nt, Human
agucuucagcagccuucucagg

SEQ ID NO: 46333 - RNA, 22 nt, Human
agucuucagcauagcauauggc

SEQ ID NO: 46334 - RNA, 22 nt, Human
agucuucuagcuggguuugguu

SEQ ID NO: 46335 - RNA, 22 nt, Human
agucuucucauuucacaugcuu

SEQ ID NO: 46336 - RNA, 22 nt, Human
agucuucuggguguuuccagag

SEQ ID NO: 46337 - RNA, 19 nt, Human
agucuuguauuuuucaagc

SEQ ID NO: 46338 - RNA, 18 nt, Human
agucuuguucuguugccc

SEQ ID NO: 46339 - RNA, 22 nt, Human
agucuuuacauguguuauauau

SEQ ID NO: 46340 - RNA, 22 nt, Human
agucuuuagagucuuaguguuu

SEQ ID NO: 46341 - RNA, 22 nt, Human
agucuuugaaguucugacagag

SEQ ID NO: 46342 - RNA, 22 nt, Human
agucuuugguuauaagagacag

SEQ ID NO: 46343 - RNA, 22 nt, Human
agugaaacagagcacagcaugc

SEQ ID NO: 46344 - RNA, 22 nt, Human
agugaaaggaaaaacugauauu

SEQ ID NO: 46345 - RNA, 22 nt, Human
agugaaagguugagaauauucu

SEQ ID NO: 46346 - RNA, 22 nt, Human
agugaaauagcauuuaugaagc

SEQ ID NO: 46347 - RNA, 22 nt, Human
agugaaaugacugaaucagaua

SEQ ID NO: 46348 - RNA, 19 nt, Human
agugaaauggaguauucaa

SEQ ID NO: 46349 - RNA, 21 nt, Human
agugaaauugcaucagaggga

SEQ ID NO: 46350 - RNA, 22 nt, Human
agugaacaaagguagugagcau

SEQ ID NO: 46351 - RNA, 22 nt, Human
agugaacaaggaugccaccucu

SEQ ID NO: 46352 - RNA, 22 nt, Human
agugaacaaguuaagaacacua

SEQ ID NO: 46353 - RNA, 22 nt, Human
agugaacaguuuggaacacaug

SEQ ID NO: 46354 - RNA, 22 nt, Human
agugaagaggaaguggggcaca

SEQ ID NO: 46355 - RNA, 23 nt, Human
agugaagcugguuagugaugacc

SEQ ID NO: 46356 - RNA, 22 nt, Human
agugaagguuuacagggccccu

SEQ ID NO: 46357 - RNA, 22 nt, Human
agugaauacaugucacucagca

SEQ ID NO: 46358 - RNA, 22 nt, Human
agugaauauuuuuagacaccca

SEQ ID NO: 46359 - RNA, 23 nt, Human
agugcucccaggaccuggggcag

SEQ ID NO: 46360 - RNA, 22 nt, Human
agugcuccuauggaucaguugu

SEQ ID NO: 46361 - RNA, 22 nt, Human
agugcucugaucuccuuggguu

SEQ ID NO: 46362 - RNA, 21 nt, Human
agugcugaaaaagcaugucuc

SEQ ID NO: 46363 - RNA, 22 nt, Human
agugcugaacauagaauggaca

SEQ ID NO: 46364 - RNA, 22 nt, Human
agugcugaagacuggcuaggga

SEQ ID NO: 46365 - RNA, 22 nt, Human
agugcugagugauugcaaagga

SEQ ID NO: 46366 - RNA, 22 nt, Human
agugcuggguacuguucccauu

SEQ ID NO: 46367 - RNA, 22 nt, Human
agugcuguaacaacuuauuugg

SEQ ID NO: 46368 - RNA, 22 nt, Human
agugcuguccaguuucacaggu

SEQ ID NO: 46369 - RNA, 20 nt, Human
agugcuguggcugaauaaga

SEQ ID NO: 46370 - RNA, 22 nt, Human
agugcuuaauagauguccagca

SEQ ID NO: 46371 - RNA, 22 nt, Human
agugcuuucagugugcucuuuu

SEQ ID NO: 46372 - RNA, 22 nt, Human
agugcuuuccuucuugugacau

SEQ ID NO: 46373 - RNA, 22 nt, Human
agugcuuucuugcuccaucagu

SEQ ID NO: 46374 - RNA, 22 nt, Human
agugcuuugagcguuugaaaag

SEQ ID NO: 46375 - RNA, 22 nt, Human
agugcuuuuauuauauacagga

SEQ ID NO: 46376 - RNA, 22 nt, Human
aguggacaaccaugcugagauu

SEQ ID NO: 46377 - RNA, 22 nt, Human
aguggacauucugcacuuggag

SEQ ID NO: 46378 - RNA, 22 nt, Human
aguggacucuucccagugcuug

SEQ ID NO: 46379 - RNA, 22 nt, Human
aguggacuuuuaguauccuuau

SEQ ID NO: 46380 - RNA, 22 nt, Human
aguggagaccccacuucuacau

SEQ ID NO: 46381 - RNA, 22 nt, Human
aguggaguugaguugauggauu

SEQ ID NO: 46382 - RNA, 22 nt, Human
aguggcaaaagcaggcuuaggc

SEQ ID NO: 46383 - RNA, 22 nt, Human
aguggcaagucaaugauaguga

SEQ ID NO: 46384 - RNA, 22 nt, Human
aguggcagaagccaagucugca

SEQ ID NO: 46385 - RNA, 22 nt, Human
aguggcagacacaaugugggca

SEQ ID NO: 46386 - RNA, 22 nt, Human
aguggcagaguugaauaauuga

SEQ ID NO: 46387 - RNA, 19 nt, Human
aguggcagaucuggaagua

SEQ ID NO: 46388 - RNA, 22 nt, Human
aguggcaggaucucgguucacu

SEQ ID NO: 46389 - RNA, 17 nt, Human
aguggcaggcagauggg

SEQ ID NO: 46390 - RNA, 20 nt, Human
aguggcaggcgaucauuacu

SEQ ID NO: 46391 - RNA, 22 nt, Human
gcaaacauuuggucuagugugu

SEQ ID NO: 46392 - RNA, 22 nt, Human
gcaaacuguuggaguagagucu

SEQ ID NO: 46393 - RNA, 22 nt, Human
gcaaagaaagccaaggucuaac

SEQ ID NO: 46394 - RNA, 22 nt, Human
gcaaagauauuagaauagagua

SEQ ID NO: 46395 - RNA, 22 nt, Human
gcaaagcagucuucugugccua

SEQ ID NO: 46396 - RNA, 22 nt, Human
gcaaaggcuagagacacaggga

SEQ ID NO: 46397 - RNA, 22 nt, Human
gcaaagggaaaguggcaggguc

SEQ ID NO: 46398 - RNA, 22 nt, Human
gcaaaguauuaaccaacaggau

SEQ ID NO: 46399 - RNA, 22 nt, Human
gcaaaguauuaaguauuaaguu

SEQ ID NO: 46400 - RNA, 22 nt, Human
gcaaaguuccuacuuuacugga

SEQ ID NO: 46401 - RNA, 22 nt, Human
gcaaauagaagauucuguugac

SEQ ID NO: 46402 - RNA, 21 nt, Human
gcaaaugaguuaacuaacuca

SEQ ID NO: 46403 - RNA, 22 nt, Human
gcaaaugcuaaaguguagagac

SEQ ID NO: 46404 - RNA, 20 nt, Human
gcaaauggaucccacaagcc

SEQ ID NO: 46405 - RNA, 22 nt, Human
gcaaauucaacagcacauucuc

SEQ ID NO: 46406 - RNA, 22 nt, Human
gcaacaaguguaaacaugcauu

SEQ ID NO: 46407 - RNA, 18 nt, Human
gcaacagaucaacagaaa

SEQ ID NO: 46408 - RNA, 22 nt, Human
gcaacagcauucucauugacau

SEQ ID NO: 46409 - RNA, 22 nt, Human
gcaacagcccagguucugugug

SEQ ID NO: 46410 - RNA, 17 nt, Human
gcaaccagcccccaucu

SEQ ID NO: 46411 - RNA, 20 nt, Human
gcaacucacccacagcagcu

SEQ ID NO: 46412 - RNA, 22 nt, Human
gcaacugugauuuguuaucuug

SEQ ID NO: 46413 - RNA, 22 nt, Human
gcaacuuuagaaaaaucuauaa

SEQ ID NO: 46414 - RNA, 22 nt, Human
gcaacuuuagggccagcaagua

SEQ ID NO: 46415 - RNA, 22 nt, Human
ggucacacaccaggaccugcag

SEQ ID NO: 46416 - RNA, 22 nt, Human
ggucacauucugaggaaucagg

SEQ ID NO: 46417 - RNA, 22 nt, Human
ggucacuccaccuucuccaccu

SEQ ID NO: 46418 - RNA, 22 nt, Human
ggucacugagcuguaauucugu

SEQ ID NO: 46419 - RNA, 23 nt, Human
ggucacuggcaagcagugcagag

SEQ ID NO: 46420 - RNA, 20 nt, Human
ggucacuguggcugcaggau

SEQ ID NO: 46421 - RNA, 22 nt, Human
ggucacuucagauaacuggugu

SEQ ID NO: 46422 - RNA, 22 nt, Human
ggucacuucuuucaucgaaacu

SEQ ID NO: 46423 - RNA, 22 nt, Human
ggucagaacaagcaaauaauag

SEQ ID NO: 46424 - RNA, 22 nt, Human
ggucagaaggauucugggaaau

SEQ ID NO: 46425 - RNA, 22 nt, Human
ggucagaagugcaaaaucaguu

SEQ ID NO: 46426 - RNA, 22 nt, Human
ggucagaggggauuccuuggga

SEQ ID NO: 46427 - RNA, 22 nt, Human
ggucagagggugggcugccugu

SEQ ID NO: 46428 - RNA, 20 nt, Human
ggucagccuggggcuccagg

SEQ ID NO: 46429 - RNA, 22 nt, Human
ggucagccuuggauuugguagc

SEQ ID NO: 46430 - RNA, 22 nt, Human
ggucagcucuuugggcuggugg

SEQ ID NO: 46431 - RNA, 22 nt, Human
ggucaggguauaaucaagugag

SEQ ID NO: 46432 - RNA, 22 nt, Human
ggucagguggcuucuguccucu

SEQ ID NO: 46433 - RNA, 22 nt, Human
ggucaguggcaggggguacuuc

SEQ ID NO: 46434 - RNA, 22 nt, Human
ggucaguguacacaugugcagg

SEQ ID NO: 46435 - RNA, 22 nt, Human
ggucaugcugugaaucagugcu

SEQ ID NO: 46436 - RNA, 22 nt, Human
ggucauugaaaucagaaggguu

SEQ ID NO: 46437 - RNA, 22 nt, Human
ggucauugucagagccuguacu

SEQ ID NO: 46438 - RNA, 22 nt, Human
gguccaaggcucgguggcgggg

SEQ ID NO: 46439 - RNA, 22 nt, Human
gguccaccuccaagcuggggac

SEQ ID NO: 46440 - RNA, 22 nt, Human
gguccagaagcugguaggguag

SEQ ID NO: 46441 - RNA, 22 nt, Human
gguccagggaacuuugaaggau

SEQ ID NO: 46442 - RNA, 22 nt, Human
gguccaggggguagauauguga

SEQ ID NO: 46443 - RNA, 22 nt, Human
gguccagguauguggugugaau

SEQ ID NO: 46444 - RNA, 22 nt, Human
gguccagguccugugacagcag

SEQ ID NO: 46445 - RNA, 22 nt, Human
gguccagguuugcucuacuugu

SEQ ID NO: 46446 - RNA, 22 nt, Human
ggucccagcugcucaagaggcu

SEQ ID NO: 46447 - RNA, 22 nt, Human
ggucccaggaaucuguguucua

SEQ ID NO: 46448 - RNA, 22 nt, Human
ggucccaggcucccucuugucc

SEQ ID NO: 46449 - RNA, 22 nt, Human
ggucccaguccucucccugcua

SEQ ID NO: 46450 - RNA, 22 nt, Human
ggucccaguugcccaggucagg

SEQ ID NO: 46451 - RNA, 22 nt, Human
ggucccugaagaugccugagga

SEQ ID NO: 46452 - RNA, 22 nt, Human
ggucccugcccaaagcccuugg

SEQ ID NO: 46453 - RNA, 22 nt, Human
ggucccugcccaccugggagcu

SEQ ID NO: 46454 - RNA, 22 nt, Human
ggucccugcugaagccuuggug

SEQ ID NO: 46455 - RNA, 22 nt, Human
ggucccugguucccucugagcu

SEQ ID NO: 46456 - RNA, 18 nt, Human
gguccugaaugccugcua

SEQ ID NO: 46457 - RNA, 22 nt, Human
gguccugaguaccuauguuuau

SEQ ID NO: 46458 - RNA, 22 nt, Human
gguccuggaaguguaaguggca

SEQ ID NO: 46459 - RNA, 18 nt, Human
gguccugggccuggcuca

SEQ ID NO: 46460 - RNA, 22 nt, Human
gguccugucugacaucacugcu

SEQ ID NO: 46461 - RNA, 22 nt, Human
ggucgagucacuuguugccuuu

SEQ ID NO: 46462 - RNA, 22 nt, Human
ggucgucucagucugacugaag

SEQ ID NO: 46463 - RNA, 22 nt, Human
ggucuaaaaugagucuuccuag

SEQ ID NO: 46464 - RNA, 22 nt, Human
ggucuagaugaaauuaaauguu

SEQ ID NO: 46465 - RNA, 22 nt, Human
ggucucagaucuuuauuaaggc

SEQ ID NO: 46466 - RNA, 22 nt, Human
ggucucagugaaggagugugcu

SEQ ID NO: 46467 - RNA, 19 nt, Human
ggucucagugcagcugcag

SEQ ID NO: 46468 - RNA, 22 nt, Human
ggucuccaaagcugcauugaug

SEQ ID NO: 46469 - RNA, 22 nt, Human
ggucuccauuccuucaucucac

SEQ ID NO: 46470 - RNA, 22 nt, Human
ggucuccugaggcugccacacc

SEQ ID NO: 46471 - RNA, 22 nt, Human
ggucucugaacuuccacugcgc

SEQ ID NO: 46472 - RNA, 20 nt, Human
ggucucugacagcugguugc

SEQ ID NO: 46473 - RNA, 22 nt, Human
ggucucugacuuagagauggau

SEQ ID NO: 46474 - RNA, 22 nt, Human
ggucucugagugaggaccuggg

SEQ ID NO: 46475 - RNA, 22 nt, Human
ggucucugcucagaugccacuu

SEQ ID NO: 46476 - RNA, 22 nt, Human
ggucucuggccuuggagauuga

SEQ ID NO: 46477 - RNA, 22 nt, Human
ggucucugucacugaguggccc

SEQ ID NO: 46478 - RNA, 22 nt, Human
ggucugaaauuaugucacugcu

SEQ ID NO: 46479 - RNA, 22 nt, Human
ggucugagagccacugaauccc

SEQ ID NO: 46480 - RNA, 22 nt, Human
ggucugagguuugggauucacu

SEQ ID NO: 46481 - RNA, 22 nt, Human
ggucugaguagagggcuggcga

SEQ ID NO: 46482 - RNA, 22 nt, Human
ggucugagugggcaggggccgg

SEQ ID NO: 46483 - RNA, 22 nt, Human
ggucugaguggggccugagauu

SEQ ID NO: 46484 - RNA, 22 nt, Human
ggucuggaagcgucccaaaggu

SEQ ID NO: 46485 - RNA, 22 nt, Human
ggucuggaauaagguccaggaa

SEQ ID NO: 46486 - RNA, 22 nt, Human
ggucuggagcuaaucuuguugg

SEQ ID NO: 46487 - RNA, 22 nt, Human
ggucuggccucgggcaccccca

SEQ ID NO: 46488 - RNA, 22 nt, Human
ggucuggccuggcauucuaugg

SEQ ID NO: 46489 - RNA, 17 nt, Human
ggucuggggccauuggc

SEQ ID NO: 46490 - RNA, 22 nt, Human
ggucugugugcuuugggaagug

SEQ ID NO: 46491 - RNA, 21 nt, Human
ggucuucaaagcuuuuacgau

SEQ ID NO: 46492 - RNA, 22 nt, Human
ggucuucagcuuugcaugucuu

SEQ ID NO: 46493 - RNA, 22 nt, Human
ggugaagccagggcaucaauau

SEQ ID NO: 46494 - RNA, 22 nt, Human
ggugaagcguauuuguggagcu

SEQ ID NO: 46495 - RNA, 22 nt, Human
ggugaaguaauaccagguguac

SEQ ID NO: 46496 - RNA, 22 nt, Human
ggugacagccgcuugcccugua

SEQ ID NO: 46497 - RNA, 22 nt, Human
ggugacagccgcuuggcgcuag

SEQ ID NO: 46498 - RNA, 22 nt, Human
ggugacagugguuaaaauuugu

SEQ ID NO: 46499 - RNA, 22 nt, Human
ggugacauaguuacuucaggcu

SEQ ID NO: 46500 - RNA, 22 nt, Human
gcagcuguucagcuggccagau

SEQ ID NO: 46501 - RNA, 22 nt, Human
gcagcuuggauuucuguaguuu

SEQ ID NO: 46502 - RNA, 22 nt, Human
gcagcuuuaaacauuggaaaua

SEQ ID NO: 46503 - RNA, 22 nt, Human
gcagcuuuaaucugaauaagua

SEQ ID NO: 46504 - RNA, 22 nt, Human
gcagcuuucuacuuccuacagc

SEQ ID NO: 46505 - RNA, 22 nt, Human
gcagcuuugucacggagugucg

SEQ ID NO: 46506 - RNA, 18 nt, Human
gcagcuuuugauucaccc

SEQ ID NO: 46507 - RNA, 22 nt, Human
gcagcuuuuuggaugucaguua

SEQ ID NO: 46508 - RNA, 22 nt, Human
gcaggaagcauagaagaaugcc

SEQ ID NO: 46509 - RNA, 22 nt, Human
gcaggaagccuuaccaagccca

SEQ ID NO: 46510 - RNA, 22 nt, Human
gcaggaagggaaagguugacuc

SEQ ID NO: 46511 - RNA, 22 nt, Human
gcaggaaucuaacccaaggaga

SEQ ID NO: 46512 - RNA, 22 nt, Human
gcaggacaaaauuuccagggug

SEQ ID NO: 46513 - RNA, 16 nt, Human
gcaggacacucagaca

SEQ ID NO: 46514 - RNA, 22 nt, Human
gcaggaccaggcacgagggcca

SEQ ID NO: 46515 - RNA, 22 nt, Human
gcaggacuuuguggaugaugga

SEQ ID NO: 46516 - RNA, 22 nt, Human
gcaggagcugcucuccugacga

SEQ ID NO: 46517 - RNA, 22 nt, Human
gcaggagcuggaaagugauguu

SEQ ID NO: 46518 - RNA, 16 nt, Human
gcaggaguaccacuug

SEQ ID NO: 46519 - RNA, 22 nt, Human
gcaggaguaucuauacauuaaa

SEQ ID NO: 46520 - RNA, 22 nt, Human
gcaggagucacugacuuggucc

SEQ ID NO: 46521 - RNA, 22 nt, Human
gcaggaguggagaccaugggga

SEQ ID NO: 46522 - RNA, 22 nt, Human
gcaggaguguauuugcauguaa

SEQ ID NO: 46523 - RNA, 22 nt, Human
gcaggaguuaaaauauguaaug

SEQ ID NO: 46524 - RNA, 22 nt, Human
gcaggaguuaggguaaaaauga

SEQ ID NO: 46525 - RNA, 22 nt, Human
gcaggaguucaauugcccauga

SEQ ID NO: 46526 - RNA, 22 nt, Human
gcaggaugagugaguacauuua

SEQ ID NO: 46527 - RNA, 22 nt, Human
gcaggaugggagcuucacucug

SEQ ID NO: 46528 - RNA, 22 nt, Human
gcaggaugggagcuucacuuug

SEQ ID NO: 46529 - RNA, 22 nt, Human
gcaggauggguguagcccagca

SEQ ID NO: 46530 - RNA, 22 nt, Human
gcaggcacuccuaggaccauca

SEQ ID NO: 46531 - RNA, 22 nt, Human
gcaggcagguggcaucuuguga

SEQ ID NO: 46532 - RNA, 22 nt, Human
gcaggcaguuauuuaguagaau

SEQ ID NO: 46533 - RNA, 22 nt, Human
gcagcuguagaggggagaaaga

SEQ ID NO: 46534 - RNA, 22 nt, Human
gcagcugucacuuucacaaugc

SEQ ID NO: 46535 - RNA, 22 nt, Human
gcagcugucauuuacaacaggg

SEQ ID NO: 46536 - RNA, 22 nt, Human
gcagcugugggccucggagagc

SEQ ID NO: 46537 - RNA, 22 nt, Human
gcagcuucaguaggugaagaca

SEQ ID NO: 46538 - RNA, 23 nt, Human
gcagcuugugguuuaguagaggg

SEQ ID NO: 46539 - RNA, 22 nt, Human
gcagcuuuaaaggaggcucuga

SEQ ID NO: 46540 - RNA, 22 nt, Human
gcagcuuuguaaaguaugaagc

SEQ ID NO: 46541 - RNA, 22 nt, Human
gcaggaacccagacaaccaggg

SEQ ID NO: 46542 - RNA, 23 nt, Human
gcaggaacucaggguaggcagca

SEQ ID NO: 46543 - RNA, 22 nt, Human
gcaggaacuugggugaagucag

SEQ ID NO: 46544 - RNA, 22 nt, Human
gcaggaagaggcucgaagcccc

SEQ ID NO: 46545 - RNA, 22 nt, Human
gcaggaagaugagcucagguaa

SEQ ID NO: 46546 - RNA, 22 nt, Human
gcaggaauauaguauuucgagg

SEQ ID NO: 46547 - RNA, 22 nt, Human
gcaggacauucagugaaugggc

SEQ ID NO: 46548 - RNA, 22 nt, Human
gcaggaccucuggaugcaaugc

SEQ ID NO: 46549 - RNA, 22 nt, Human
gcaggacuugaauccaggcagu

SEQ ID NO: 46550 - RNA, 22 nt, Human
gcaggagaacaaagcaagcugc

SEQ ID NO: 46551 - RNA, 18 nt, Human
gcaggagauggguggggu

SEQ ID NO: 46552 - RNA, 22 nt, Human
gcaggagcagucaggggcagcu

SEQ ID NO: 46553 - RNA, 22 nt, Human
gcaggagccacuucagggaugc

SEQ ID NO: 46554 - RNA, 22 nt, Human
gcaggagccaggccgagcuggu

SEQ ID NO: 46555 - RNA, 22 nt, Human
gcaggagccagggauuccagga

SEQ ID NO: 46556 - RNA, 22 nt, Human
gcaggagcccuggcauguucuu

SEQ ID NO: 46557 - RNA, 22 nt, Human
gcaggaggagcauuaacugagc

SEQ ID NO: 46558 - RNA, 22 nt, Human
gcaggaggccagguaugcuuua

SEQ ID NO: 46559 - RNA, 22 nt, Human
gcaggagucagcccuaccuuga

SEQ ID NO: 46560 - RNA, 22 nt, Human
gcaggagugacauggaugugga

SEQ ID NO: 46561 - RNA, 22 nt, Human
gcaggaguuagagguuuaaucu

SEQ ID NO: 46562 - RNA, 23 nt, Human
gcaggaguuccuggacuccagga

SEQ ID NO: 46563 - RNA, 22 nt, Human
gcaggaugccagggcagcagcg

SEQ ID NO: 46564 - RNA, 22 nt, Human
gcaggaugguggaaggccugcu

SEQ ID NO: 46565 - RNA, 19 nt, Human
gcaggcacagcccugggug

SEQ ID NO: 46566 - RNA, 22 nt, Human
gcaggcaccggguugcuccccu

SEQ ID NO: 46567 - RNA, 22 nt, Human
gcaggcaccucguggaguggaa

SEQ ID NO: 46568 - RNA, 17 nt, Human
gcaggcacugcugccug

SEQ ID NO: 46569 - RNA, 15 nt, Human
gcaggcagaucaccg

SEQ ID NO: 46570 - RNA, 22 nt, Human
gcaggcagaucaccugucagga

SEQ ID NO: 46571 - RNA, 22 nt, Human
gcaggcaggaaggacuaaguaa

SEQ ID NO: 46572 - RNA, 22 nt, Human
gcaggcaggagcccaacugccu

SEQ ID NO: 46573 - RNA, 22 nt, Human
gcaggcaggcuuccuugaacug

SEQ ID NO: 46574 - RNA, 20 nt, Human
gcaggcagggaaugggggug

SEQ ID NO: 46575 - RNA, 22 nt, Human
gcaggccacugucuccucuggg

SEQ ID NO: 46576 - RNA, 22 nt, Human
gcaggccagcugugcagauggg

SEQ ID NO: 46577 - RNA, 20 nt, Human
gcaggcccucucucuagucu

SEQ ID NO: 46578 - RNA, 22 nt, Human
gcaggccuaagagaaggcauug

SEQ ID NO: 46579 - RNA, 18 nt, Human
gcaggccuagaacuuggu

SEQ ID NO: 46580 - RNA, 22 nt, Human
gcaggccucuaauucaccgcag

SEQ ID NO: 46581 - RNA, 22 nt, Human
gcaggccugacuguagggggca

SEQ ID NO: 46582 - RNA, 22 nt, Human
gcaggccugguuuacaugguag

SEQ ID NO: 46583 - RNA, 22 nt, Human
gcaggccuuuaucccugccuca

SEQ ID NO: 46584 - RNA, 14 nt, Human
gcaggcggaucacu

SEQ ID NO: 46585 - RNA, 22 nt, Human
gcaggcguguuucacgugccag

SEQ ID NO: 46586 - RNA, 22 nt, Human
gcaggcuaugaguuucucacca

SEQ ID NO: 46587 - RNA, 22 nt, Human
gcaggcucccuugcagagcagg

SEQ ID NO: 46588 - RNA, 22 nt, Human
gcaggcugaaacucggggucua

SEQ ID NO: 46589 - RNA, 22 nt, Human
gcaggcugaguugggaaaccaa

SEQ ID NO: 46590 - RNA, 21 nt, Human
gcaggcuggucaaaccucagu

SEQ ID NO: 46591 - RNA, 22 nt, Human
gcaggcugugaggcucagaugg

SEQ ID NO: 46592 - RNA, 22 nt, Human
gcaggcugugguauguugggca

SEQ ID NO: 46593 - RNA, 22 nt, Human
gcaggcuucucucuucccuacc

SEQ ID NO: 46594 - RNA, 22 nt, Human
gcaggcuugcccggccuccuuc

SEQ ID NO: 46595 - RNA, 22 nt, Human
gcaggcuuugacuuggggcagc

SEQ ID NO: 46596 - RNA, 22 nt, Human
gcagggaaacaggugcuaagga

SEQ ID NO: 46597 - RNA, 22 nt, Human
gcagggaagaucuuggagcugc

SEQ ID NO: 46598 - RNA, 22 nt, Human
gcagggaaguuugaucuuuuuc

SEQ ID NO: 46599 - RNA, 22 nt, Human
gcagggacaucuuugucuagua

SEQ ID NO: 46600 - RNA, 22 nt, Human
gcagggaccagggccagaucca

SEQ ID NO: 46601 - RNA, 21 nt, Human
gcagggaccgcgacuucuggg

SEQ ID NO: 46602 - RNA, 22 nt, Human
gcagggaccugccacugcuguc

SEQ ID NO: 46603 - RNA, 22 nt, Human
gcagggauugugcagggggcua

SEQ ID NO: 46604 - RNA, 22 nt, Human
gcagggcaaauguggaaaggag

SEQ ID NO: 46605 - RNA, 22 nt, Human
gcagggcacacaagaaugauaa

SEQ ID NO: 46606 - RNA, 22 nt, Human
gcagggcagagggagaaucucu

SEQ ID NO: 46607 - RNA, 22 nt, Human
gcagggcaguaagagcuagagu

SEQ ID NO: 46608 - RNA, 22 nt, Human
gcagggcaugggcccugucugc

SEQ ID NO: 46609 - RNA, 22 nt, Human
gcagggccagggcucaggcugu

SEQ ID NO: 46610 - RNA, 22 nt, Human
gugggagcuucaucaagcaguu

SEQ ID NO: 46611 - RNA, 22 nt, Human
gugggagcuuuggcaucaggcu

SEQ ID NO: 46612 - RNA, 22 nt, Human
gugggaguggagcucagcaugu

SEQ ID NO: 46613 - RNA, 22 nt, Human
gugggaguggggaagcagagug

SEQ ID NO: 46614 - RNA, 22 nt, Human
gugggcagaggagagaacauua

SEQ ID NO: 46615 - RNA, 22 nt, Human
gugggcagauacauuugauaug

SEQ ID NO: 46616 - RNA, 22 nt, Human
gugggcaggagugagcaacagg

SEQ ID NO: 46617 - RNA, 22 nt, Human
gugggcaggcccuaggcgauuu

SEQ ID NO: 46618 - RNA, 22 nt, Human
gugggcaguggggucuucugcc

SEQ ID NO: 46619 - RNA, 22 nt, Human
gugggcaguuggugauucucgu

SEQ ID NO: 46620 - RNA, 19 nt, Human
gugggccaggcagaaggcu

SEQ ID NO: 46621 - RNA, 22 nt, Human
gugggccaguuccucacaggua

SEQ ID NO: 46622 - RNA, 22 nt, Human
gugggccucuugaggguggcua

SEQ ID NO: 46623 - RNA, 22 nt, Human
gugggccugaugcugccaugag

SEQ ID NO: 46624 - RNA, 22 nt, Human
gugggcugcauguuuacuauuc

SEQ ID NO: 46625 - RNA, 22 nt, Human
gugggcuggagcaaugauuuca

SEQ ID NO: 46626 - RNA, 22 nt, Human
gugggcuuguuuugaugagauc

SEQ ID NO: 46627 - RNA, 22 nt, Human
guggggagcagccuuagccccu

SEQ ID NO: 46628 - RNA, 22 nt, Human
guggggcugcuuaggcugcgca

SEQ ID NO: 46629 - RNA, 22 nt, Human
gugggggcaggcagugcuagga

SEQ ID NO: 46630 - RNA, 22 nt, Human
guggggucucucuguaccuccc

SEQ ID NO: 46631 - RNA, 22 nt, Human
gugggucuggcuuugaggguca

SEQ ID NO: 46632 - RNA, 22 nt, Human
gugggugauguacuggaggcca

SEQ ID NO: 46633 - RNA, 22 nt, Human
guggguggaucaccugagguca

SEQ ID NO: 46634 - RNA, 22 nt, Human
gugggugugagugacggcgucc

SEQ ID NO: 46635 - RNA, 22 nt, Human
guggguguggaacugugagacc

SEQ ID NO: 46636 - RNA, 22 nt, Human
gugggugugguucguuuaagac

SEQ ID NO: 46637 - RNA, 22 nt, Human
gugguauuuaugacagugcccg

SEQ ID NO: 46638 - RNA, 22 nt, Human
guggucagaaaucucaguggca

SEQ ID NO: 46639 - RNA, 22 nt, Human
guggucagccccggugagcccu

SEQ ID NO: 46640 - RNA, 22 nt, Human
guggucagugguacaguuugaa

SEQ ID NO: 46641 - RNA, 22 nt, Human
gugguccucauaauucagugag

SEQ ID NO: 46642 - RNA, 22 nt, Human
gugguccugaguagcuuuagaa

SEQ ID NO: 46643 - RNA, 18 nt, Human
guggucuuucugucuucu

SEQ ID NO: 46644 - RNA, 22 nt, Human
guggugcaggaagcaucuggcu

SEQ ID NO: 46645 - RNA, 22 nt, Human
guggugcaggugucacugcaga

SEQ ID NO: 46646 - RNA, 22 nt, Human
guggugcauccuugaguaagcu

SEQ ID NO: 46647 - RNA, 22 nt, Human
guggugcaugcaugcauaugua

SEQ ID NO: 46648 - RNA, 22 nt, Human
guggugugugcuuagggcuagg

SEQ ID NO: 46649 - RNA, 21 nt, Human
gugguuauuuucauuagcauc

SEQ ID NO: 46650 - RNA, 22 nt, Human
gugguucagugucauauuaacg

SEQ ID NO: 46651 - RNA, 22 nt, Human
gugguuguuuccagguuugaaa

SEQ ID NO: 46652 - RNA, 22 nt, Human
gugguuuguuuuauuccuggaa

SEQ ID NO: 46653 - RNA, 22 nt, Human
gugguuuuacaaagagaaagau

SEQ ID NO: 46654 - RNA, 19 nt, Human
gugguuuucugaggagucu

SEQ ID NO: 46655 - RNA, 22 nt, Human
gugguuuugccauuacaaguaa

SEQ ID NO: 46656 - RNA, 22 nt, Human
gugguuuugcuuuaugagugaa

SEQ ID NO: 46657 - RNA, 22 nt, Human
gugguuuuuagauuucuacagu

SEQ ID NO: 46658 - RNA, 22 nt, Human
guguaaacacccuuacuguggc

SEQ ID NO: 46659 - RNA, 18 nt, Human
guguaaacagccauugag

SEQ ID NO: 46660 - RNA, 22 nt, Human
guguacaaaaugucuccaugga

SEQ ID NO: 46661 - RNA, 22 nt, Human
guguacacuugaacugacgguu

SEQ ID NO: 46662 - RNA, 22 nt, Human
guguacaggaugacuguacuua

SEQ ID NO: 46663 - RNA, 22 nt, Human
guguaguauaagguuaaaaccu

SEQ ID NO: 46664 - RNA, 22 nt, Human
guguauaacuaucuaucuagua

SEQ ID NO: 46665 - RNA, 22 nt, Human
guguauaauaaugugagcuaaa

SEQ ID NO: 46666 - RNA, 22 nt, Human
guguaucaaagcacagacuuca

SEQ ID NO: 46667 - RNA, 22 nt, Human
guguaugauuucaaauggcuag

SEQ ID NO: 46668 - RNA, 22 nt, Human
guguauggacacaugucauguu

SEQ ID NO: 46669 - RNA, 19 nt, Human
guguauguaaguugugagg

SEQ ID NO: 46670 - RNA, 22 nt, Human
guguauguguuuauagggaggu

SEQ ID NO: 46671 - RNA, 22 nt, Human
gugucaaauccacuccucuuuu

SEQ ID NO: 46672 - RNA, 22 nt, Human
gugucaauaaauagcggugugg

SEQ ID NO: 46673 - RNA, 22 nt, Human
gugucaaugagguuuauuuuug

SEQ ID NO: 46674 - RNA, 22 nt, Human
gugucacaggcccagcucuuca

SEQ ID NO: 46675 - RNA, 22 nt, Human
gugucaggcagucagcauggag

SEQ ID NO: 46676 - RNA, 22 nt, Human
gugucaggggcagccaggaaau

SEQ ID NO: 46677 - RNA, 20 nt, Human
gugucaguaaauauuaugug

SEQ ID NO: 46678 - RNA, 22 nt, Human
gugucaugggguuuguuauaca

SEQ ID NO: 46679 - RNA, 23 nt, Human
gugucauuacuguaauuauugug

SEQ ID NO: 46680 - RNA, 22 nt, Human
guguccagaugaggagacgaug

SEQ ID NO: 46681 - RNA, 22 nt, Human
guguccagcguggaaugagggu

SEQ ID NO: 46682 - RNA, 22 nt, Human
guguccagucauagcccagggc

SEQ ID NO: 46683 - RNA, 22 nt, Human
guguccaucucuguaugcugcu

SEQ ID NO: 46684 - RNA, 22 nt, Human
gugucccaggagaggagacaau

SEQ ID NO: 46685 - RNA, 22 nt, Human
guguccucuuauugcucuuggc

SEQ ID NO: 46686 - RNA, 22 nt, Human
guguccugagugaggccuggcc

SEQ ID NO: 46687 - RNA, 23 nt, Human
gccugccugaccugugcaaaguc

SEQ ID NO: 46688 - RNA, 22 nt, Human
gccugccugcugucaucugccu

SEQ ID NO: 46689 - RNA, 22 nt, Human
gccugccuggagcuugagguga

SEQ ID NO: 46690 - RNA, 22 nt, Human
gccugcucugaguguggggggu

SEQ ID NO: 46691 - RNA, 22 nt, Human
gccugcugaagccagagugugu

SEQ ID NO: 46692 - RNA, 22 nt, Human
gccugcugcauccaggcuauug

SEQ ID NO: 46693 - RNA, 23 nt, Human
gccugcugucacagcgggcccag

SEQ ID NO: 46694 - RNA, 22 nt, Human
gccugcuguuaacugcaggaau

SEQ ID NO: 46695 - RNA, 22 nt, Human
gccugcuuugugccugaucuuu

SEQ ID NO: 46696 - RNA, 22 nt, Human
gccuggacaccgcccuugcaga

SEQ ID NO: 46697 - RNA, 23 nt, Human
gccuggagaaaagcugcaguuca

SEQ ID NO: 46698 - RNA, 22 nt, Human
gccuggagcccaguguggggcu

SEQ ID NO: 46699 - RNA, 22 nt, Human
gccuggagccucagcaaggagg

SEQ ID NO: 46700 - RNA, 22 nt, Human
gccuggagcucuccacuugggg

SEQ ID NO: 46701 - RNA, 22 nt, Human
gccuggagggcucuagagaggc

SEQ ID NO: 46702 - RNA, 22 nt, Human
gccuggaggggacagucucugg

SEQ ID NO: 46703 - RNA, 22 nt, Human
gccuggaguagcauggcaagcc

SEQ ID NO: 46704 - RNA, 20 nt, Human
gccuggaguuaguuuuccuu

SEQ ID NO: 46705 - RNA, 22 nt, Human
gccuggaguucagccaaguccc

SEQ ID NO: 46706 - RNA, 22 nt, Human
gccuggaguugaaacuauuauu

SEQ ID NO: 46707 - RNA, 22 nt, Human
gccuggcaccacagccuuucag

SEQ ID NO: 46708 - RNA, 22 nt, Human
gccuggcacucaaucaucugcu

SEQ ID NO: 46709 - RNA, 22 nt, Human
gccuggcacucacugaagaggc

SEQ ID NO: 46710 - RNA, 22 nt, Human
gccuggcaggccucaugagggg

SEQ ID NO: 46711 - RNA, 22 nt, Human
gccuggcaguugacaguuugcu

SEQ ID NO: 46712 - RNA, 17 nt, Human
gccuggcccagccuggc

SEQ ID NO: 46713 - RNA, 22 nt, Human
gccuggcccagggcuccgcagg

SEQ ID NO: 46714 - RNA, 22 nt, Human
gccuggcccagggcucuuguug

SEQ ID NO: 46715 - RNA, 22 nt, Human
gccuggccgcuccgagcuccgc

SEQ ID NO: 46716 - RNA, 22 nt, Human
gccuggcucacagagcagccuu

SEQ ID NO: 46717 - RNA, 22 nt, Human
gccuggcucccucugcagcucc

SEQ ID NO: 46718 - RNA, 22 nt, Human
gccuggcuccuaaggacuggcu

SEQ ID NO: 46719 - RNA, 22 nt, Human
gugugcaugcauagacaccaca

SEQ ID NO: 46720 - RNA, 22 nt, Human
gugugcauguauauacuuuuau

SEQ ID NO: 46721 - RNA, 22 nt, Human
gugugccacugccugaggaccc

SEQ ID NO: 46722 - RNA, 22 nt, Human
gugugcccuggcuccagcacca

SEQ ID NO: 46723 - RNA, 22 nt, Human
gugugccuaugaguggugaaca

SEQ ID NO: 46724 - RNA, 22 nt, Human
gugugccucgccaagcugucgg

SEQ ID NO: 46725 - RNA, 22 nt, Human
gugugccugacaugaugguuaa

SEQ ID NO: 46726 - RNA, 22 nt, Human
gugugcgcuggugcuuggucaa

SEQ ID NO: 46727 - RNA, 18 nt, Human
gugugcucagagagugag

SEQ ID NO: 46728 - RNA, 22 nt, Human
gugugcugagugacugucauca

SEQ ID NO: 46729 - RNA, 22 nt, Human
gugugcugcccaacucgcagau

SEQ ID NO: 46730 - RNA, 22 nt, Human
guguggaaacagagagggcaac

SEQ ID NO: 46731 - RNA, 22 nt, Human
guguggcaccuccuuuccagcu

SEQ ID NO: 46732 - RNA, 22 nt, Human
guguggccaauuaugggcauuc

SEQ ID NO: 46733 - RNA, 20 nt, Human
guguggccaggagcugcgcu

SEQ ID NO: 46734 - RNA, 22 nt, Human
guguggcccugcguccugaguc

SEQ ID NO: 46735 - RNA, 22 nt, Human
guguggcuagaagugucuuguu

SEQ ID NO: 46736 - RNA, 22 nt, Human
guguggcugaaaucaaggcagg

SEQ ID NO: 46737 - RNA, 22 nt, Human
guguggcugugggagauguuca

SEQ ID NO: 46738 - RNA, 22 nt, Human
guguggcuugggugaggcgccu

SEQ ID NO: 46739 - RNA, 22 nt, Human
gugugggacgggugaguggcca

SEQ ID NO: 46740 - RNA, 22 nt, Human
gugugggcuaugugcgugggca

SEQ ID NO: 46741 - RNA, 18 nt, Human
gugugggcuccuccgagu

SEQ ID NO: 46742 - RNA, 22 nt, Human
guguggggagcugcagccacau

SEQ ID NO: 46743 - RNA, 22 nt, Human
guguggggcucagugggaaugu

SEQ ID NO: 46744 - RNA, 22 nt, Human
gugugggugggacaucaucuuu

SEQ ID NO: 46745 - RNA, 22 nt, Human
guguguaaaccuccaaucuggg

SEQ ID NO: 46746 - RNA, 22 nt, Human
guguguauuuaaaggauaguug

SEQ ID NO: 46747 - RNA, 22 nt, Human
guguguccaggcgggagucaag

SEQ ID NO: 46748 - RNA, 22 nt, Human
gugugucccuacaacagcuuca

SEQ ID NO: 46749 - RNA, 21 nt, Human
gugugucuaauguaguggaaa

SEQ ID NO: 46750 - RNA, 22 nt, Human
gugugugcaagagguuuauuga

SEQ ID NO: 46751 - RNA, 23 nt, Human
guguguggaaagugcaugggccu

SEQ ID NO: 46752 - RNA, 22 nt, Human
guguguggaaaguuuuccaugg

SEQ ID NO: 46753 - RNA, 22 nt, Human
guguguggacgucugagcccag

SEQ ID NO: 46754 - RNA, 22 nt, Human
guguguguauauauacacacac

SEQ ID NO: 46755 - RNA, 22 nt, Human
guguguguaucugccuaucaca

SEQ ID NO: 46756 - RNA, 22 nt, Human
gugugugugcauauaacauaua

SEQ ID NO: 46757 - RNA, 22 nt, Human
gugugugugcaucucuuuuauu

SEQ ID NO: 46758 - RNA, 22 nt, Human
guguguguguaaaaauccagag

SEQ ID NO: 46759 - RNA, 22 nt, Human
guguguucagcaagagguaagg

SEQ ID NO: 46760 - RNA, 22 nt, Human
guguguucccguuuccuucacu

SEQ ID NO: 46761 - RNA, 22 nt, Human
guguuaaaugcaaucacaugca

SEQ ID NO: 46762 - RNA, 22 nt, Human
guguuaauuauuggugaauaga

SEQ ID NO: 46763 - RNA, 22 nt, Human
guguuacuaaaauuugauucuu

SEQ ID NO: 46764 - RNA, 23 nt, Human
guguuacuaaagaugaacauuua

SEQ ID NO: 46765 - RNA, 23 nt, Human
guguuacucugauaggugcuuuu

SEQ ID NO: 46766 - RNA, 22 nt, Human
guguuacuuaauuagaaucugc

SEQ ID NO: 46767 - RNA, 22 nt, Human
guguuacuugccauacagaaaa

SEQ ID NO: 46768 - RNA, 22 nt, Human
guguucaucccaaugcugauag

SEQ ID NO: 46769 - RNA, 22 nt, Human
guguucauggaugucaauuuga

SEQ ID NO: 46770 - RNA, 22 nt, Human
guguucauugcuagugaggugu

SEQ ID NO: 46771 - RNA, 22 nt, Human
guguuccauguuugagguaguu

SEQ ID NO: 46772 - RNA, 22 nt, Human
guguucugcagaccagcaucau

SEQ ID NO: 46773 - RNA, 22 nt, Human
guguucugggaugauuguagug

SEQ ID NO: 46774 - RNA, 22 nt, Human
guguucuuuauuuagugaugcu

SEQ ID NO: 46775 - RNA, 22 nt, Human
guguugaugacauuuuagaaac

SEQ ID NO: 46776 - RNA, 21 nt, Human
guguuggcauauggugguuga

SEQ ID NO: 46777 - RNA, 22 nt, Human
guguuuaacaucugguuuauac

SEQ ID NO: 46778 - RNA, 22 nt, Human
guguuuaauagguagcugaauc

SEQ ID NO: 46779 - RNA, 22 nt, Human
guguuuaaugcagaugugggug

SEQ ID NO: 46780 - RNA, 22 nt, Human
guguuuagugugcagacaugca

SEQ ID NO: 46781 - RNA, 22 nt, Human
guguuuauaggagugaaugcug

SEQ ID NO: 46782 - RNA, 22 nt, Human
guguuuccccuccuggagaagg

SEQ ID NO: 46783 - RNA, 22 nt, Human
guguuuccucacuucucugacu

SEQ ID NO: 46784 - RNA, 22 nt, Human
guguuuccucuagaagccaugg

SEQ ID NO: 46785 - RNA, 22 nt, Human
guguuuguuuagugcagagaga

SEQ ID NO: 46786 - RNA, 22 nt, Human
guguuuuaagaaagaagcucag

SEQ ID NO: 46787 - RNA, 22 nt, Human
guguuuucucuccagcaggcag

SEQ ID NO: 46788 - RNA, 22 nt, Human
guuaaacaagcuggacacugaa

SEQ ID NO: 46789 - RNA, 22 nt, Human
guuaaacugaaaggcucguuca

SEQ ID NO: 46790 - RNA, 22 nt, Human
guuaaagaagaauaguuccuuu

SEQ ID NO: 46791 - RNA, 22 nt, Human
guuaaauucgaugauggauaaa

SEQ ID NO: 46792 - RNA, 22 nt, Human
guuaacaacacugugagugcug

SEQ ID NO: 46793 - RNA, 22 nt, Human
guuaacauaggcuuagggguuu

SEQ ID NO: 46794 - RNA, 22 nt, Human
guuaacauucaauuaaacaguc

SEQ ID NO: 46795 - RNA, 22 nt, Human
guuaacuuucaggugcauguuu

SEQ ID NO: 46796 - RNA, 21 nt, Human
guuaagccuugaggugauugu

SEQ ID NO: 46797 - RNA, 22 nt, Human
guuaaggcugagcaggacacug

SEQ ID NO: 46798 - RNA, 22 nt, Human
guuaaguaaacuaugauuuauc

SEQ ID NO: 46799 - RNA, 23 nt, Human
guuaauaaugaacacuuucuccc

SEQ ID NO: 46800 - RNA, 22 nt, Human
guuaauguuaucugaagacagu

SEQ ID NO: 46801 - RNA, 18 nt, Human
guuaauuuugaaguucau

SEQ ID NO: 46802 - RNA, 22 nt, Human
guuacaaacucaggugccaaaa

SEQ ID NO: 46803 - RNA, 22 nt, Human
guuacaaaggucauaaaagugu

SEQ ID NO: 46804 - RNA, 22 nt, Human
gcguggguccaagaaucuguga

SEQ ID NO: 46805 - RNA, 22 nt, Human
gcguguaugcaggucugugcag

SEQ ID NO: 46806 - RNA, 22 nt, Human
gcguuauuuccugucugauuuc

SEQ ID NO: 46807 - RNA, 22 nt, Human
gcuaaaaggagcacuagagauu

SEQ ID NO: 46808 - RNA, 22 nt, Human
gcuaaaguuuccgucuuucauu

SEQ ID NO: 46809 - RNA, 22 nt, Human
gcuaaauaaucuucuucugaca

SEQ ID NO: 46810 - RNA, 22 nt, Human
gcuaaauuuaagccuuucuccu

SEQ ID NO: 46811 - RNA, 22 nt, Human
gcuaagaaggccauaucagaga

SEQ ID NO: 46812 - RNA, 22 nt, Human
gcuaagaggcuauaucuuucuc

SEQ ID NO: 46813 - RNA, 22 nt, Human
gcuaagggaggcaugccguggu

SEQ ID NO: 46814 - RNA, 22 nt, Human
gcuaagggauaggcugccuccu

SEQ ID NO: 46815 - RNA, 22 nt, Human
gcuaaucaauguuaaggcugug

SEQ ID NO: 46816 - RNA, 22 nt, Human
gcuaaugauagcaagauaaaca

SEQ ID NO: 46817 - RNA, 22 nt, Human
gcuacacaaaaggagagugagu

SEQ ID NO: 46818 - RNA, 22 nt, Human
gcuacacaauagcguucacuua

SEQ ID NO: 46819 - RNA, 23 nt, Human
gcuacagcugacugucauucccu

SEQ ID NO: 46820 - RNA, 22 nt, Human
gcuacaggagcugucacaugcu

SEQ ID NO: 46821 - RNA, 20 nt, Human
gcuaccagaacaaggccauu

SEQ ID NO: 46822 - RNA, 22 nt, Human
gcuacccugggaaucucccuca

SEQ ID NO: 46823 - RNA, 19 nt, Human
gcuacugaggcccaggacc

SEQ ID NO: 46824 - RNA, 22 nt, Human
gcuacugauugaccuuggagag

SEQ ID NO: 46825 - RNA, 17 nt, Human
gcuacugguuaccucua

SEQ ID NO: 46826 - RNA, 22 nt, Human
gcuagaaaaugaaagauaauuu

SEQ ID NO: 46827 - RNA, 22 nt, Human
gcuagcagagugcauccuucua

SEQ ID NO: 46828 - RNA, 22 nt, Human
gcugcuuugugaaaaucauuca

SEQ ID NO: 46829 - RNA, 22 nt, Human
gcugcuuuucacagagacaaga

SEQ ID NO: 46830 - RNA, 22 nt, Human
gcugcuuuuuggauuuggcaca

SEQ ID NO: 46831 - RNA, 22 nt, Human
gcuggaaaugaauggagaggug

SEQ ID NO: 46832 - RNA, 22 nt, Human
gcuggaagggaggcccagccgg

SEQ ID NO: 46833 - RNA, 22 nt, Human
gcuggacaggccacauggagga

SEQ ID NO: 46834 - RNA, 22 nt, Human
gcuggaccaggugugcacaggc

SEQ ID NO: 46835 - RNA, 22 nt, Human
gcuggacucaggggacucaggg

SEQ ID NO: 46836 - RNA, 22 nt, Human
gcuggacuuagagguggaaaag

SEQ ID NO: 46837 - RNA, 22 nt, Human
gcuggagaaacugcagcugagg

SEQ ID NO: 46838 - RNA, 22 nt, Human
gcuggagaacccaggaggaaga

SEQ ID NO: 46839 - RNA, 22 nt, Human
gcuggagaccucagagaaccca

SEQ ID NO: 46840 - RNA, 22 nt, Human
gcuggagaggggucacucugag

SEQ ID NO: 46841 - RNA, 22 nt, Human
gcuggagauacugcucaguauc

SEQ ID NO: 46842 - RNA, 22 nt, Human
gcuggagauaguaggauccaua

SEQ ID NO: 46843 - RNA, 22 nt, Human
gcuggagccauuggcuuggccu

SEQ ID NO: 46844 - RNA, 22 nt, Human
gcuggagcgugauccuugaucu

SEQ ID NO: 46845 - RNA, 22 nt, Human
gcuggagcuugagaggacaggg

SEQ ID NO: 46846 - RNA, 22 nt, Human
gcuggaggaucacuugagccca

SEQ ID NO: 46847 - RNA, 22 nt, Human
gcugguccucaagggcacagcc

SEQ ID NO: 46848 - RNA, 22 nt, Human
gcuggugagauuuuauguuucc

SEQ ID NO: 46849 - RNA, 22 nt, Human
gcuggugagcaaaggagaagga

SEQ ID NO: 46850 - RNA, 22 nt, Human
gcuggugcauuagcugcaguuc

SEQ ID NO: 46851 - RNA, 22 nt, Human
gcuggugccuuguuguuguuac

SEQ ID NO: 46852 - RNA, 22 nt, Human
gcuggugcucugggcccugagg

SEQ ID NO: 46853 - RNA, 22 nt, Human
gcugguggcagagacaucaggu

SEQ ID NO: 46854 - RNA, 22 nt, Human
gcugguggcagagcuccgcggc

SEQ ID NO: 46855 - RNA, 22 nt, Human
gcuggugguaaggaggaaaaag

SEQ ID NO: 46856 - RNA, 22 nt, Human
gcugguggugggccaguucugu

SEQ ID NO: 46857 - RNA, 22 nt, Human
gcuggugguuaccgugcuaaug

SEQ ID NO: 46858 - RNA, 22 nt, Human
gcugguuagaaaacagagcuca

SEQ ID NO: 46859 - RNA, 22 nt, Human
gcugguuaggugagggugcgcc

SEQ ID NO: 46860 - RNA, 22 nt, Human
gcuguaacuuuuucauuuucaa

SEQ ID NO: 46861 - RNA, 22 nt, Human
gcuguagguaaggauggcaaag

SEQ ID NO: 46862 - RNA, 22 nt, Human
gcuguaggucauuuaaucaccu

SEQ ID NO: 46863 - RNA, 22 nt, Human
gcuguaugaguucauguguaga

SEQ ID NO: 46864 - RNA, 22 nt, Human
gcuguauuggaacacauccaug

SEQ ID NO: 46865 - RNA, 22 nt, Human
gcuguauuuauuuucuaggguu

SEQ ID NO: 46866 - RNA, 22 nt, Human
gcugucacacaugggaucucag

SEQ ID NO: 46867 - RNA, 22 nt, Human
gcugucacucaccaggccugca

SEQ ID NO: 46868 - RNA, 22 nt, Human
gcugucacuggcauguuccggg

SEQ ID NO: 46869 - RNA, 22 nt, Human
gcugucagcgcccaaggagcuc

SEQ ID NO: 46870 - RNA, 22 nt, Human
gcugucaguuuuacccacagac

SEQ ID NO: 46871 - RNA, 22 nt, Human
gcuguccagagcaugggagcaa

SEQ ID NO: 46872 - RNA, 22 nt, Human
gcuguccagcuccagccagcca

SEQ ID NO: 46873 - RNA, 22 nt, Human
gcuguccauccacuucccagcg

SEQ ID NO: 46874 - RNA, 22 nt, Human
gcuguccaugucuggccucagu

SEQ ID NO: 46875 - RNA, 23 nt, Human
gcuguccccaugcuccaucccug

SEQ ID NO: 46876 - RNA, 22 nt, Human
gcugucccgaaccccugguaau

SEQ ID NO: 46877 - RNA, 22 nt, Human
gcugucccuuucacaagguuuu

SEQ ID NO: 46878 - RNA, 22 nt, Human
gcuguccucugaucucuggagg

SEQ ID NO: 46879 - RNA, 22 nt, Human
gcuguccuggggagggagaaug

SEQ ID NO: 46880 - RNA, 22 nt, Human
gcugucucauacaaggcccugc

SEQ ID NO: 46881 - RNA, 22 nt, Human
gcugucuccauagcuguguguc

SEQ ID NO: 46882 - RNA, 21 nt, Human
gcugucuccuccuugcaccag

SEQ ID NO: 46883 - RNA, 21 nt, Human
gcugucucuggcuccugggaa

SEQ ID NO: 46884 - RNA, 22 nt, Human
gcugucugacuccaaguuggag

SEQ ID NO: 46885 - RNA, 22 nt, Human
gcugucugcaagccaggaaaug

SEQ ID NO: 46886 - RNA, 22 nt, Human
gcugucugcugggucgcucagg

SEQ ID NO: 46887 - RNA, 20 nt, Human
gcugucuggauuagaagccu

SEQ ID NO: 46888 - RNA, 22 nt, Human
gcugucuggguugagggcccug

SEQ ID NO: 46889 - RNA, 23 nt, Human
gcugucugucaucucugcgggag

SEQ ID NO: 46890 - RNA, 22 nt, Human
gcugucugucucugugacuuaa

SEQ ID NO: 46891 - RNA, 22 nt, Human
gcugucuucacuuccugguuuc

SEQ ID NO: 46892 - RNA, 22 nt, Human
gcugucuuuccccugcuccaga

SEQ ID NO: 46893 - RNA, 22 nt, Human
gcugugagaaacagggaguguc

SEQ ID NO: 46894 - RNA, 22 nt, Human
gcugugagccgcugcugagcau

SEQ ID NO: 46895 - RNA, 22 nt, Human
gcugugagugagcugccuaggc

SEQ ID NO: 46896 - RNA, 22 nt, Human
gcugugaguggaguucugugcu

SEQ ID NO: 46897 - RNA, 22 nt, Human
gcugugcagccaagugccucug

SEQ ID NO: 46898 - RNA, 22 nt, Human
gcuguggaguacagagcugguu

SEQ ID NO: 46899 - RNA, 22 nt, Human
gcuguggcaauguuuauaauua

SEQ ID NO: 46900 - RNA, 22 nt, Human
gcuguggccaacaaaccacuuu

SEQ ID NO: 46901 - RNA, 22 nt, Human
gcuguggccgggcccaggccgc

SEQ ID NO: 46902 - RNA, 20 nt, Human
gcuguggccgugccagacuc

SEQ ID NO: 46903 - RNA, 22 nt, Human
gcuguggccuaguuuguuauau

SEQ ID NO: 46904 - RNA, 22 nt, Human
gcuguggccuccagcacucccc

SEQ ID NO: 46905 - RNA, 22 nt, Human
gcuguggcuuucuguuucuguu

SEQ ID NO: 46906 - RNA, 19 nt, Human
gcugugggacagcagggug

SEQ ID NO: 46907 - RNA, 22 nt, Human
gcugugggccauggccaaguga

SEQ ID NO: 46908 - RNA, 22 nt, Human
gcuguggguacaaauacacaau

SEQ ID NO: 46909 - RNA, 22 nt, Human
gcuguggguuccuggcauuuga

SEQ ID NO: 46910 - RNA, 22 nt, Human
gcuguggguuuccaauccugga

SEQ ID NO: 46911 - RNA, 22 nt, Human
gcuguguaggauccuguuguau

SEQ ID NO: 46912 - RNA, 22 nt, Human
gcuguguccaggugggggugac

SEQ ID NO: 46913 - RNA, 22 nt, Human
gcugugucuguuuuacgucaag

SEQ ID NO: 46914 - RNA, 22 nt, Human
gcugugugcucacguaguggaa

SEQ ID NO: 46915 - RNA, 22 nt, Human
gcuguguggcaaagggauuaca

SEQ ID NO: 46916 - RNA, 22 nt, Human
gcuguguguucaauaaugugau

SEQ ID NO: 46917 - RNA, 22 nt, Human
gcuguguuuuauguuagguuaa

SEQ ID NO: 46918 - RNA, 23 nt, Human
gcuguuagauuuaauaagcauuu

SEQ ID NO: 46919 - RNA, 22 nt, Human
gcuguucacaucuggaccauuu

SEQ ID NO: 46920 - RNA, 20 nt, Human
gcuguucacauuauuaguag

SEQ ID NO: 46921 - RNA, 22 nt, Human
gcuguucacauuuugggccaaa

SEQ ID NO: 46922 - RNA, 22 nt, Human
gcuguucuagcuucaguuucgc

SEQ ID NO: 46923 - RNA, 22 nt, Human
gcuguucuaggagcugugagca

SEQ ID NO: 46924 - RNA, 18 nt, Human
gcuguucuucgcacuggc

SEQ ID NO: 46925 - RNA, 22 nt, Human
gcuguucuuuggucaaagguau

SEQ ID NO: 46926 - RNA, 20 nt, Human
gcuguugccaguacagaugg

SEQ ID NO: 46927 - RNA, 23 nt, Human
gcuguuucacaacagccguguuu

SEQ ID NO: 46928 - RNA, 22 nt, Human
gcuguuucggccuccuggggaa

SEQ ID NO: 46929 - RNA, 22 nt, Human
gcuguuucuaccagaagaauca

SEQ ID NO: 46930 - RNA, 17 nt, Human
gcuguuucuccagaagu

SEQ ID NO: 46931 - RNA, 22 nt, Human
gcuguuucucuugagucaaaau

SEQ ID NO: 46932 - RNA, 22 nt, Human
gcuguuucugaguagcuaggcu

SEQ ID NO: 46933 - RNA, 22 nt, Human
gcuguuucugguucuguuccua

SEQ ID NO: 46934 - RNA, 22 nt, Human
gcuuaaaagccacuuagucuau

SEQ ID NO: 46935 - RNA, 22 nt, Human
gcuuaaaauccaugauuuuuac

SEQ ID NO: 46936 - RNA, 22 nt, Human
gcuuaaaucccaaugcuagacc

SEQ ID NO: 46937 - RNA, 23 nt, Human
gcuguacaggaaccaguuuggag

SEQ ID NO: 46938 - RNA, 19 nt, Human
gcuguacaguaaggagaca

SEQ ID NO: 46939 - RNA, 22 nt, Human
gcuguagauggacuggcaucca

SEQ ID NO: 46940 - RNA, 22 nt, Human
gcuguaggaagacagaaugcag

SEQ ID NO: 46941 - RNA, 19 nt, Human
gcuguauuaaagauacaug

SEQ ID NO: 46942 - RNA, 22 nt, Human
gcuguauucaacagugaaaaga

SEQ ID NO: 46943 - RNA, 22 nt, Human
gcuguauuuauaugaaggcaug

SEQ ID NO: 46944 - RNA, 22 nt, Human
gcugucacaaauuggguucuuu

SEQ ID NO: 46945 - RNA, 22 nt, Human
gcugucacaagcaucuggggca

SEQ ID NO: 46946 - RNA, 22 nt, Human
gcugucacacauggccccagcu

SEQ ID NO: 46947 - RNA, 22 nt, Human
gcugucagucacauuguuacag

SEQ ID NO: 46948 - RNA, 22 nt, Human
gcugucagugaggugagacaug

SEQ ID NO: 46949 - RNA, 20 nt, Human
gcugucccaggccaaagggc

SEQ ID NO: 46950 - RNA, 22 nt, Human
gcugucccgcugacuuccagcu

SEQ ID NO: 46951 - RNA, 22 nt, Human
gcuguccugggaacaggcacua

SEQ ID NO: 46952 - RNA, 22 nt, Human
gcuguccuuccuggcuggggug

SEQ ID NO: 46953 - RNA, 23 nt, Human
gcugucgccagagccccaccuac

SEQ ID NO: 46954 - RNA, 22 nt, Human
gcugucgugugcaagugacaga

SEQ ID NO: 46955 - RNA, 22 nt, Human
gcugucucaugggugcuagucc

SEQ ID NO: 46956 - RNA, 22 nt, Human
gcugucucgccugacacuggcu

SEQ ID NO: 46957 - RNA, 22 nt, Human
gcugucucucccaggauccaug

SEQ ID NO: 46958 - RNA, 20 nt, Human
gcugucugacaguucccaga

SEQ ID NO: 46959 - RNA, 19 nt, Human
gcugucugaugcugagguc

SEQ ID NO: 46960 - RNA, 22 nt, Human
gcugucugcaucucuagagcuu

SEQ ID NO: 46961 - RNA, 22 nt, Human
gcugucuggcauggcguggcug

SEQ ID NO: 46962 - RNA, 22 nt, Human
gcugucugggaggccuccacuu

SEQ ID NO: 46963 - RNA, 22 nt, Human
gcugucugggaugucacugcug

SEQ ID NO: 46964 - RNA, 22 nt, Human
gcugucugggugcccaaaagaa

SEQ ID NO: 46965 - RNA, 22 nt, Human
gcuucauuaauagaauuaguau

SEQ ID NO: 46966 - RNA, 22 nt, Human
gcuucauuugagaaccucugug

SEQ ID NO: 46967 - RNA, 20 nt, Human
gcuucauuugcaagucuagu

SEQ ID NO: 46968 - RNA, 22 nt, Human
gcuuccagaccccagucccuca

SEQ ID NO: 46969 - RNA, 22 nt, Human
gcuuccagacgaucauguaaga

SEQ ID NO: 46970 - RNA, 22 nt, Human
gcuuccagagagccccgccugg

SEQ ID NO: 46971 - RNA, 19 nt, Human
gcuuccagcacugcaggag

SEQ ID NO: 46972 - RNA, 22 nt, Human
gcuuccagccuuuucuccucug

SEQ ID NO: 46973 - RNA, 22 nt, Human
gcuuccaguccucagaggcugg

SEQ ID NO: 46974 - RNA, 22 nt, Human
gcuuccaucuaugucuucauca

SEQ ID NO: 46975 - RNA, 19 nt, Human
gcuucccaccagccagccc

SEQ ID NO: 46976 - RNA, 22 nt, Human
gcuuccccuccaagcacugccu

SEQ ID NO: 46977 - RNA, 22 nt, Human
gcuuccuaaaugcacagggcag

SEQ ID NO: 46978 - RNA, 17 nt, Human
gcuuccucaugcaguuc

SEQ ID NO: 46979 - RNA, 22 nt, Human
gcuuccucccugcugcucacua

SEQ ID NO: 46980 - RNA, 22 nt, Human
gcuuccuccuggaggucacuca

SEQ ID NO: 46981 - RNA, 22 nt, Human
gcuuccucgcugggcagaggca

SEQ ID NO: 46982 - RNA, 22 nt, Human
gcuuccugagacaacauugagu

SEQ ID NO: 46983 - RNA, 22 nt, Human
gcuuccugauauucauacuguu

SEQ ID NO: 46984 - RNA, 22 nt, Human
gcuuccuggaacaacuguugcu

SEQ ID NO: 46985 - RNA, 22 nt, Human
gcuuccuguauccuccuguacc

SEQ ID NO: 46986 - RNA, 22 nt, Human
gcuuccuguccaggccccacau

SEQ ID NO: 46987 - RNA, 17 nt, Human
gcuuccugugcugggga

SEQ ID NO: 46988 - RNA, 22 nt, Human
gcuucuaaccugcuuccuguag

SEQ ID NO: 46989 - RNA, 22 nt, Human
gcuucuaauuuuuuacagaaua

SEQ ID NO: 46990 - RNA, 22 nt, Human
gcuucuaucccuccacugcacu

SEQ ID NO: 46991 - RNA, 22 nt, Human
gcuucuauuacuacuuugagau

SEQ ID NO: 46992 - RNA, 22 nt, Human
gcuucuccagaccuucaucccc

SEQ ID NO: 46993 - RNA, 22 nt, Human
gcuucuccucccgcucccaggc

SEQ ID NO: 46994 - RNA, 22 nt, Human
gcuucucggggagguuagccag

SEQ ID NO: 46995 - RNA, 22 nt, Human
gcuucucucucagacugcaagc

SEQ ID NO: 46996 - RNA, 22 nt, Human
gcuucucuggccugcagggcau

SEQ ID NO: 46997 - RNA, 22 nt, Human
gcuucucuuaaugccuggcuuu

SEQ ID NO: 46998 - RNA, 22 nt, Human
gcuucugaugucagacuucugg

SEQ ID NO: 46999 - RNA, 22 nt, Human
gcuucugcagagccguccugag

SEQ ID NO: 47000 - RNA, 22 nt, Human
gcuucugccuugcacuuuguca

SEQ ID NO: 47001 - RNA, 22 nt, Human
gcuucugcgcacgcuucuuccc

SEQ ID NO: 47002 - RNA, 22 nt, Human
gcuucuggaagcugcuucugcc

SEQ ID NO: 47003 - RNA, 22 nt, Human
gcuucugggcaccugaacagga

SEQ ID NO: 47004 - RNA, 22 nt, Human
gcuucugugguugucacgacua

SEQ ID NO: 47005 - RNA, 22 nt, Human
gcuucuugccuguguagagaau

SEQ ID NO: 47006 - RNA, 22 nt, Human
gcuucuuuggcaacccugacau

SEQ ID NO: 47007 - RNA, 22 nt, Human
gcuugacuaggcucuggcgaca

SEQ ID NO: 47008 - RNA, 22 nt, Human
gcuugaugauaccuaggagaug

SEQ ID NO: 47009 - RNA, 22 nt, Human
gcuugcagugguuggcaugacc

SEQ ID NO: 47010 - RNA, 22 nt, Human
gcuugcaugauauggcaucugg

SEQ ID NO: 47011 - RNA, 22 nt, Human
gcuugcauucuggaucuauggu

SEQ ID NO: 47012 - RNA, 20 nt, Human
gcuugcccacaucugcacug

SEQ ID NO: 47013 - RNA, 17 nt, Human
gcuugccuugucuuccu

SEQ ID NO: 47014 - RNA, 19 nt, Human
gcuugcuggcgggggucug

SEQ ID NO: 47015 - RNA, 22 nt, Human
gcuugcuggugccugcaggcuc

SEQ ID NO: 47016 - RNA, 22 nt, Human
gcuuggaguagaaugcauucuu

SEQ ID NO: 47017 - RNA, 22 nt, Human
gcuuggcacacuuggaccugag

SEQ ID NO: 47018 - RNA, 22 nt, Human
gcuuggcagcaacaggcauccc

SEQ ID NO: 47019 - RNA, 22 nt, Human
gcuuggcaggucugggauuguu

SEQ ID NO: 47020 - RNA, 18 nt, Human
gcuuggcugcagagagag

SEQ ID NO: 47021 - RNA, 22 nt, Human
gcuuggcuggagaaaguuaccu

SEQ ID NO: 47022 - RNA, 22 nt, Human
gcuuggcugugagcuuugcugu

SEQ ID NO: 47023 - RNA, 22 nt, Human
gcuuggcuguguucaagggcgg

SEQ ID NO: 47024 - RNA, 22 nt, Human
gcuuggcuuugucuuguucacu

SEQ ID NO: 47025 - RNA, 22 nt, Human
gcuugggagaggcuuccucuuu

SEQ ID NO: 47026 - RNA, 22 nt, Human
gcuugggaggcaagcauuccau

SEQ ID NO: 47027 - RNA, 22 nt, Human
gcuugggcuuaacuguagguuc

SEQ ID NO: 47028 - RNA, 22 nt, Human
gcuuguuugugccucugcagaa

SEQ ID NO: 47029 - RNA, 22 nt, Human
gcuuuaaaccucuacucugucc

SEQ ID NO: 47030 - RNA, 22 nt, Human
gcuuuaagucucaguuuguuag

SEQ ID NO: 47031 - RNA, 22 nt, Human
gcuuuaaugcuucguggggcca

SEQ ID NO: 47032 - RNA, 22 nt, Human
gcuuuacacagaugaauauuuc

SEQ ID NO: 47033 - RNA, 22 nt, Human
gcuuuacagagaaaguuugccu

SEQ ID NO: 47034 - RNA, 22 nt, Human
gcuuuacagggcacaaagggag

SEQ ID NO: 47035 - RNA, 22 nt, Human
gcuuuacauuuuggaaagguga

SEQ ID NO: 47036 - RNA, 22 nt, Human
gcuuuagaaaugaguaaauuag

SEQ ID NO: 47037 - RNA, 22 nt, Human
gcuuuagaaauguaggagauac

SEQ ID NO: 47038 - RNA, 22 nt, Human
gcuuuagaagacacucuguuuu

SEQ ID NO: 47039 - RNA, 22 nt, Human
gcuuuagacauaaaguucuuca

SEQ ID NO: 47040 - RNA, 22 nt, Human
gcuuuagauacucccaaugucc

SEQ ID NO: 47041 - RNA, 22 nt, Human
gcuuuauagcccuauuacauga

SEQ ID NO: 47042 - RNA, 22 nt, Human
gcuuuaugagugaggcaggaua

SEQ ID NO: 47043 - RNA, 22 nt, Human
gcuuuaugugaguagcacuguc

SEQ ID NO: 47044 - RNA, 17 nt, Human
gcuuuccuugccccucc

SEQ ID NO: 47045 - RNA, 22 nt, Human
gcuuucugccugggcuccauuu

SEQ ID NO: 47046 - RNA, 22 nt, Human
gcuuucuggagccugggggaac

SEQ ID NO: 47047 - RNA, 22 nt, Human
ggagugaguacuggaguagcug

SEQ ID NO: 47048 - RNA, 22 nt, Human
ggaguggcacucugaggcgggg

SEQ ID NO: 47049 - RNA, 22 nt, Human
ggaguggcagcgaggaucagau

SEQ ID NO: 47050 - RNA, 22 nt, Human
ggaguggcagcuaggcugucag

SEQ ID NO: 47051 - RNA, 22 nt, Human
ggaguggcaggccacagugcug

SEQ ID NO: 47052 - RNA, 22 nt, Human
ggaguggccacgacugggagau

SEQ ID NO: 47053 - RNA, 19 nt, Human
ggaguggguaguuaguggu

SEQ ID NO: 47054 - RNA, 22 nt, Human
ggagugugauuguucucuguua

SEQ ID NO: 47055 - RNA, 22 nt, Human
ggaguuaaggccuaagaaauag

SEQ ID NO: 47056 - RNA, 22 nt, Human
ggaguucaaaucuuuuggaucu

SEQ ID NO: 47057 - RNA, 22 nt, Human
ggaguucacugugcaggcucug

SEQ ID NO: 47058 - RNA, 22 nt, Human
ggaguugauuuuggauauauua

SEQ ID NO: 47059 - RNA, 22 nt, Human
ggaguuggaggcuccagggaac

SEQ ID NO: 47060 - RNA, 22 nt, Human
ggauaaucugggagaaaacuga

SEQ ID NO: 47061 - RNA, 23 nt, Human
ggauacaaagauuaauaguagag

SEQ ID NO: 47062 - RNA, 22 nt, Human
ggauacagcggcuucugcgcga

SEQ ID NO: 47063 - RNA, 22 nt, Human
ggauaggaauugagaugcuauu

SEQ ID NO: 47064 - RNA, 17 nt, Human
ggauagugcugggcugg

SEQ ID NO: 47065 - RNA, 22 nt, Human
ggauaguucuggauauuuuaag

SEQ ID NO: 47066 - RNA, 22 nt, Human
ggaucaaagggaaccuguuagg

SEQ ID NO: 47067 - RNA, 22 nt, Human
ggauccaguccagggcugugug

SEQ ID NO: 47068 - RNA, 22 nt, Human
ggaucugggcucugccaaucag

SEQ ID NO: 47069 - RNA, 22 nt, Human
ggaucugggguagagcaguggg

SEQ ID NO: 47070 - RNA, 22 nt, Human
ggaucugguuacguaagagucu

SEQ ID NO: 47071 - RNA, 22 nt, Human
ggaucuguuuugccucugaggg

SEQ ID NO: 47072 - RNA, 22 nt, Human
ggaucuucagccagcaggugcc

SEQ ID NO: 47073 - RNA, 22 nt, Human
ggaucuuuaaguucuuuuccau

SEQ ID NO: 47074 - RNA, 22 nt, Human
ggaugaggaagauuacugagaa

SEQ ID NO: 47075 - RNA, 22 nt, Human
ggaugcaggaacacagcgaccu

SEQ ID NO: 47076 - RNA, 22 nt, Human
ggaugcaggggcagcagagccu

SEQ ID NO: 47077 - RNA, 22 nt, Human
ggaugcugcuaucaggcuucga

SEQ ID NO: 47078 - RNA, 22 nt, Human
ggaugcugcugcacauccugca

SEQ ID NO: 47079 - RNA, 22 nt, Human
ggaugcuggggaccaaucucug

SEQ ID NO: 47080 - RNA, 22 nt, Human
ggaugcuuagguuguuuuauua

SEQ ID NO: 47081 - RNA, 22 nt, Human
ggauggcauguugggcucuguu

SEQ ID NO: 47082 - RNA, 22 nt, Human
ggauggccuucuugcucaggaa

SEQ ID NO: 47083 - RNA, 22 nt, Human
ggaugggaacuugguagggcau

SEQ ID NO: 47084 - RNA, 23 nt, Human
ggaugggcaagccuagugccuac

SEQ ID NO: 47085 - RNA, 22 nt, Human
ggaugggcccgggacggcgcug

SEQ ID NO: 47086 - RNA, 22 nt, Human
ggaugggugacuuugggcaaug

SEQ ID NO: 47087 - RNA, 22 nt, Human
ggaugucuuuacuuugggauuu

SEQ ID NO: 47088 - RNA, 22 nt, Human
ggaugugaaucugggcugagac

SEQ ID NO: 47089 - RNA, 22 nt, Human
ggauuaacagcuccuggguggu

SEQ ID NO: 47090 - RNA, 22 nt, Human
ggauucagugucuguuaauagu

SEQ ID NO: 47091 - RNA, 22 nt, Human
ggauucugccuuguugcuucaa

SEQ ID NO: 47092 - RNA, 22 nt, Human
ggauugagagcacugguagcug

SEQ ID NO: 47093 - RNA, 22 nt, Human
ggauuuccagcuucauugucua

SEQ ID NO: 47094 - RNA, 22 nt, Human
ggauuucuuccuuccucagaag

SEQ ID NO: 47095 - RNA, 22 nt, Human
ggauuugaauuguugaaaugau

SEQ ID NO: 47096 - RNA, 21 nt, Human
ggauuuuaaaaacugcaccug

SEQ ID NO: 47097 - RNA, 22 nt, Human
ggcaaaaaccacaauuacuuuu

SEQ ID NO: 47098 - RNA, 22 nt, Human
ggcaaagcggcccuguggccag

SEQ ID NO: 47099 - RNA, 22 nt, Human
ggcaaauuugucuuaagacacc

SEQ ID NO: 47100 - RNA, 22 nt, Human
ggcaacaacuggacauagcugg

SEQ ID NO: 47101 - RNA, 22 nt, Human
ggcaacaugaugucaaccagga

SEQ ID NO: 47102 - RNA, 22 nt, Human
ggcaacaugggaaaauuaaccu

SEQ ID NO: 47103 - RNA, 22 nt, Human
ggcaacauucuccagauccuuu

SEQ ID NO: 47104 - RNA, 22 nt, Human
ggcaaggccugcagcucagugu

SEQ ID NO: 47105 - RNA, 22 nt, Human
ggcaaggguugaagauaaggua

SEQ ID NO: 47106 - RNA, 22 nt, Human
ggcaaguauuugugcaucuaca

SEQ ID NO: 47107 - RNA, 22 nt, Human
ggcaagugauccuggagcaccg

SEQ ID NO: 47108 - RNA, 22 nt, Human
ggcaagugcuuccccaaccaca

SEQ ID NO: 47109 - RNA, 22 nt, Human
ggcaagugguagaacaucugag

SEQ ID NO: 47110 - RNA, 22 nt, Human
ggcaauaaaaguauccaguuuc

SEQ ID NO: 47111 - RNA, 23 nt, Human
ggcaauaacgagcuugucucuga

SEQ ID NO: 47112 - RNA, 22 nt, Human
ggcaauaguuguggguucuuua

SEQ ID NO: 47113 - RNA, 22 nt, Human
ggcaauauggugaaaccccauc

SEQ ID NO: 47114 - RNA, 22 nt, Human
ggcaauuacguauuagucaugu

SEQ ID NO: 47115 - RNA, 22 nt, Human
ggcaauuuggucauuuguauug

SEQ ID NO: 47116 - RNA, 22 nt, Human
ggcacacagcggaauuugcucu

SEQ ID NO: 47117 - RNA, 22 nt, Human
uaugaacacacuuuggaaguga

SEQ ID NO: 47118 - RNA, 22 nt, Human
uaugaagaaaucuuugaaaauc

SEQ ID NO: 47119 - RNA, 19 nt, Human
uaugaagaauguggcaaag

SEQ ID NO: 47120 - RNA, 22 nt, Human
uaugaagacaaugauagcauga

SEQ ID NO: 47121 - RNA, 20 nt, Human
uaugaagacucaaguagggc

SEQ ID NO: 47122 - RNA, 20 nt, Human
uaugaagauaugugaacagc

SEQ ID NO: 47123 - RNA, 22 nt, Human
uaugaagcucucacuguguguc

SEQ ID NO: 47124 - RNA, 22 nt, Human
uaugaagcuuugaaaagcuuac

SEQ ID NO: 47125 - RNA, 22 nt, Human
uaugaaggauacaccucugauu

SEQ ID NO: 47126 - RNA, 22 nt, Human
uaugaauauaccacaauuuagg

SEQ ID NO: 47127 - RNA, 22 nt, Human
uaugaaugcuccaguaacuuuc

SEQ ID NO: 47128 - RNA, 22 nt, Human
uaugacaaagagaggcccaugc

SEQ ID NO: 47129 - RNA, 22 nt, Human
uaugacaagaaauacagaggua

SEQ ID NO: 47130 - RNA, 19 nt, Human
uaugacaaguacuaguucu

SEQ ID NO: 47131 - RNA, 22 nt, Human
uaugacaaugugggccuaaggg

SEQ ID NO: 47132 - RNA, 22 nt, Human
uaugacaccauuuuggucagug

SEQ ID NO: 47133 - RNA, 22 nt, Human
uaugacagcaaauauccaugag

SEQ ID NO: 47134 - RNA, 22 nt, Human
uaugacagugaaaaaaaucaga

SEQ ID NO: 47135 - RNA, 22 nt, Human
uaugacaugugaucucaagagg

SEQ ID NO: 47136 - RNA, 22 nt, Human
uaugaccuuaggaagcaagaag

SEQ ID NO: 47137 - RNA, 22 nt, Human
uaugagaaaggagaaugacuuu

SEQ ID NO: 47138 - RNA, 22 nt, Human
uaugagaaauuauaccuagguu

SEQ ID NO: 47139 - RNA, 22 nt, Human
uaugagaagaacaggugacuuu

SEQ ID NO: 47140 - RNA, 22 nt, Human
uaugagauaaauggugcccccu

SEQ ID NO: 47141 - RNA, 22 nt, Human
uaugagauaauagauguguaaa

SEQ ID NO: 47142 - RNA, 22 nt, Human
uaugagaucccuuuuccuagag

SEQ ID NO: 47143 - RNA, 20 nt, Human
uaugagauuugaccucaaca

SEQ ID NO: 47144 - RNA, 19 nt, Human
uaugagcugacaaaggccu

SEQ ID NO: 47145 - RNA, 22 nt, Human
uaugagcuuccaguguugcaug

SEQ ID NO: 47146 - RNA, 17 nt, Human
uaugaggcaguuuguga

SEQ ID NO: 47147 - RNA, 22 nt, Human
uaugagguagguauuauacuua

SEQ ID NO: 47148 - RNA, 22 nt, Human
uaugaguacugugaacgagaau

SEQ ID NO: 47149 - RNA, 22 nt, Human
uaugaguggcguagagguaggg

SEQ ID NO: 47150 - RNA, 22 nt, Human
uaugauaaccuguuguaguuug

SEQ ID NO: 47151 - RNA, 23 nt, Human
uaugauccuccacaccuucucuc

SEQ ID NO: 47152 - RNA, 22 nt, Human
uaugcaaacuaaguuguuuccu

SEQ ID NO: 47153 - RNA, 22 nt, Human
uaugcaaagccacccagggacg

SEQ ID NO: 47154 - RNA, 22 nt, Human
uaugcaaaucauuagauuuccu

SEQ ID NO: 47155 - RNA, 22 nt, Human
uaugcaacagcauuauuacaau

SEQ ID NO: 47156 - RNA, 22 nt, Human
aguggcaggcggagauguagga

SEQ ID NO: 47157 - RNA, 22 nt, Human
aguggcaguagaugagcugguu

SEQ ID NO: 47158 - RNA, 22 nt, Human
aguggcaucccuuuaacagggu

SEQ ID NO: 47159 - RNA, 22 nt, Human
aguggccacuagaagcucagcu

SEQ ID NO: 47160 - RNA, 22 nt, Human
aguggcggggauuagcaguguu

SEQ ID NO: 47161 - RNA, 22 nt, Human
aguggcugauuacaaacugagu

SEQ ID NO: 47162 - RNA, 22 nt, Human
aguggcugcuggaguggagaug

SEQ ID NO: 47163 - RNA, 22 nt, Human
aguggcugcuucugguugcucc

SEQ ID NO: 47164 - RNA, 22 nt, Human
aguggcuggagccccaggcugg

SEQ ID NO: 47165 - RNA, 22 nt, Human
aguggcuguacuauuuuuucau

SEQ ID NO: 47166 - RNA, 21 nt, Human
aguggcugucaagggggccuu

SEQ ID NO: 47167 - RNA, 22 nt, Human
agugggagaaugaauaagggcc

SEQ ID NO: 47168 - RNA, 22 nt, Human
agugggagagaagcaaguagua

SEQ ID NO: 47169 - RNA, 21 nt, Human
agugggauacuggaagguaga

SEQ ID NO: 47170 - RNA, 22 nt, Human
agugggccaaauggaggcaagu

SEQ ID NO: 47171 - RNA, 22 nt, Human
agugggccuuagaagguucccu

SEQ ID NO: 47172 - RNA, 22 nt, Human
agugggcugguggcagggagaa

SEQ ID NO: 47173 - RNA, 22 nt, Human
agugggcuuacugagggagugu

SEQ ID NO: 47174 - RNA, 22 nt, Human
aguggggagguccaggccaccc

SEQ ID NO: 47175 - RNA, 22 nt, Human
agugggguccucaguaugguuc

SEQ ID NO: 47176 - RNA, 22 nt, Human
agugggugagcuuggucuagau

SEQ ID NO: 47177 - RNA, 20 nt, Human
agugggugaugaaggaauag

SEQ ID NO: 47178 - RNA, 22 nt, Human
aguggguggcgcagaggaggaa

SEQ ID NO: 47179 - RNA, 22 nt, Human
agugguaacuaaguccugcuua

SEQ ID NO: 47180 - RNA, 22 nt, Human
agugguauaagucugaagauca

SEQ ID NO: 47181 - RNA, 22 nt, Human
aguggucuccccaguagaauaa

SEQ ID NO: 47182 - RNA, 22 nt, Human
aguggugaggggcaugugugau

SEQ ID NO: 47183 - RNA, 22 nt, Human
aguggugauaaccgcuaucaua

SEQ ID NO: 47184 - RNA, 22 nt, Human
aguggugcuagguggaauauag

SEQ ID NO: 47185 - RNA, 22 nt, Human
aguggugcugcgcgcggagcuc

SEQ ID NO: 47186 - RNA, 22 nt, Human
agugguucaguuuuggucuggc

SEQ ID NO: 47187 - RNA, 22 nt, Human
agugguucuugaucuguagagu

SEQ ID NO: 47188 - RNA, 22 nt, Human
aguguaagugaucauugauagu

SEQ ID NO: 47189 - RNA, 22 nt, Human
aguguacaagaccuuauuguug

SEQ ID NO: 47190 - RNA, 20 nt, Human
aguguacagacacuagaaau

SEQ ID NO: 47191 - RNA, 22 nt, Human
aguguacaguuuguaguacuac

SEQ ID NO: 47192 - RNA, 22 nt, Human
aguguacauaguuaggaacauc

SEQ ID NO: 47193 - RNA, 22 nt, Human
aguguacaucagaacauaucaa

SEQ ID NO: 47194 - RNA, 22 nt, Human
aguguacauguacacauuagua

SEQ ID NO: 47195 - RNA, 22 nt, Human
aguguacauucuguuugaggua

SEQ ID NO: 47196 - RNA, 22 nt, Human
aguguagacauaggucuggucu

SEQ ID NO: 47197 - RNA, 22 nt, Human
aguguauaugugcugagaaacg

SEQ ID NO: 47198 - RNA, 22 nt, Human
aguguaugaacuuaagagagag

SEQ ID NO: 47199 - RNA, 22 nt, Human
aguguaugugaaacuuuccaaa

SEQ ID NO: 47200 - RNA, 22 nt, Human
aguguauuaaugcuccaggagu

SEQ ID NO: 47201 - RNA, 22 nt, Human
aguguauuaguuguccagcagu

SEQ ID NO: 47202 - RNA, 22 nt, Human
aguguauuaugcagcggagguc

SEQ ID NO: 47203 - RNA, 22 nt, Human
aguguauugauuggaacagccu

SEQ ID NO: 47204 - RNA, 22 nt, Human
aguguauugucucacaguucuu

SEQ ID NO: 47205 - RNA, 22 nt, Human
aguguauuugccuauaaaaaug

SEQ ID NO: 47206 - RNA, 20 nt, Human
aguguauuuggguagagugu

SEQ ID NO: 47207 - RNA, 22 nt, Human
agugucaaaugugugccaagcu

SEQ ID NO: 47208 - RNA, 22 nt, Human
agugucaaauuaaauaaucugg

SEQ ID NO: 47209 - RNA, 22 nt, Human
agugucaaguacaugguaguga

SEQ ID NO: 47210 - RNA, 22 nt, Human
agugucacaaaccugccuugua

SEQ ID NO: 47211 - RNA, 19 nt, Human
agugucagaauucauugaa

SEQ ID NO: 47212 - RNA, 22 nt, Human
agugucauaugccacugcaucc

SEQ ID NO: 47213 - RNA, 19 nt, Human
agugucaucagcuacucag

SEQ ID NO: 47214 - RNA, 21 nt, Human
agugucauuugaucauuguua

SEQ ID NO: 47215 - RNA, 22 nt, Human
agugucauuuuguccaucuucu

SEQ ID NO: 47216 - RNA, 22 nt, Human
aguguccccuccaagggccugg

SEQ ID NO: 47217 - RNA, 22 nt, Human
aguguccuccucugggagccag

SEQ ID NO: 47218 - RNA, 22 nt, Human
aguguccuugagguuccuagga

SEQ ID NO: 47219 - RNA, 21 nt, Human
aguguccuugaucuugccuug

SEQ ID NO: 47220 - RNA, 22 nt, Human
aguguccuugauuccuguuguu

SEQ ID NO: 47221 - RNA, 21 nt, Human
agugucucuggaagcacgugu

SEQ ID NO: 47222 - RNA, 22 nt, Human
agugucugaaccaccggggcau

SEQ ID NO: 47223 - RNA, 22 nt, Human
agugucugaaccugcaguggga

SEQ ID NO: 47224 - RNA, 22 nt, Human
agugucugaacugggugcugac

SEQ ID NO: 47225 - RNA, 22 nt, Human
agugucugaagccucagcccga

SEQ ID NO: 47226 - RNA, 21 nt, Human
agugucugagcgcugcuucug

SEQ ID NO: 47227 - RNA, 22 nt, Human
agugucugaugcacaguugucc

SEQ ID NO: 47228 - RNA, 22 nt, Human
agugucugccaacugcaugguc

SEQ ID NO: 47229 - RNA, 22 nt, Human
agugucugccagcugccaggug

SEQ ID NO: 47230 - RNA, 22 nt, Human
agugucugccuauuuuucaagc

SEQ ID NO: 47231 - RNA, 22 nt, Human
agugucugcggcggggaggcgg

SEQ ID NO: 47232 - RNA, 18 nt, Human
agugucuggauauuuggg

SEQ ID NO: 47233 - RNA, 20 nt, Human
agugucuggauuuuguaacc

SEQ ID NO: 47234 - RNA, 20 nt, Human
agugucugggccucaggccc

SEQ ID NO: 47235 - RNA, 22 nt, Human
auucuguauuucuaauaagauc

SEQ ID NO: 47236 - RNA, 21 nt, Human
auucugucaucccagcuacuu

SEQ ID NO: 47237 - RNA, 22 nt, Human
auucuguguguacugagauggg

SEQ ID NO: 47238 - RNA, 22 nt, Human
auucuuaauuccaaagacugag

SEQ ID NO: 47239 - RNA, 22 nt, Human
auucuuacaaagcagagucugu

SEQ ID NO: 47240 - RNA, 22 nt, Human
auucuuacaaaugaaacugcaa

SEQ ID NO: 47241 - RNA, 22 nt, Human
auucuucacaccuguuccuguu

SEQ ID NO: 47242 - RNA, 22 nt, Human
auucuucaucagagaugcacua

SEQ ID NO: 47243 - RNA, 23 nt, Human
auucuucauuaucuucuagaaaa

SEQ ID NO: 47244 - RNA, 22 nt, Human
auucuucuaauaugaucguguu

SEQ ID NO: 47245 - RNA, 22 nt, Human
auucuucucccuuagggcccag

SEQ ID NO: 47246 - RNA, 19 nt, Human
auucuucucuuccugcugu

SEQ ID NO: 47247 - RNA, 22 nt, Human
auucuugcaguauacaacuacu

SEQ ID NO: 47248 - RNA, 22 nt, Human
auucuuggcccguccucacgca

SEQ ID NO: 47249 - RNA, 21 nt, Human
auucuuggcuuagcucucugg

SEQ ID NO: 47250 - RNA, 22 nt, Human
auucuuguaaauuuugugugaa

SEQ ID NO: 47251 - RNA, 22 nt, Human
auucuuuaguuggcuucuugcc

SEQ ID NO: 47252 - RNA, 22 nt, Human
auucuuugaacaguuuuccugu

SEQ ID NO: 47253 - RNA, 21 nt, Human
auucuuugaugugcaauaagu

SEQ ID NO: 47254 - RNA, 22 nt, Human
auucuuuucccaacugcuuuaa

SEQ ID NO: 47255 - RNA, 22 nt, Human
auucuuuuuuaaggaauagaac

SEQ ID NO: 47256 - RNA, 22 nt, Human
auugaaaaauucacaauucugg

SEQ ID NO: 47257 - RNA, 22 nt, Human
auugaaaaugacauuugugccc

SEQ ID NO: 47258 - RNA, 22 nt, Human
auugaaagaguuuucugcugca

SEQ ID NO: 47259 - RNA, 22 nt, Human
auugaaagcauggauuuggauu

SEQ ID NO: 47260 - RNA, 22 nt, Human
auugaacagaaaccaucagagu

SEQ ID NO: 47261 - RNA, 22 nt, Human
auugaacauacauauccacacc

SEQ ID NO: 47262 - RNA, 22 nt, Human
auugaacucugcaggagcugcc

SEQ ID NO: 47263 - RNA, 22 nt, Human
auugaacuguagucuucugucu

SEQ ID NO: 47264 - RNA, 22 nt, Human
auugaacugucuuugaagaaau

SEQ ID NO: 47265 - RNA, 22 nt, Human
aguaauaaacucuuuuuaucuc

SEQ ID NO: 47266 - RNA, 22 nt, Human
aguaaugaauacgguauuugaa

SEQ ID NO: 47267 - RNA, 21 nt, Human
aguacaaaaauuccuuucuca

SEQ ID NO: 47268 - RNA, 22 nt, Human
aguacaaaaugcagcaucauca

SEQ ID NO: 47269 - RNA, 22 nt, Human
aguacaaagugcuccugguucu

SEQ ID NO: 47270 - RNA, 22 nt, Human
aguacaaguagaaugcuacaag

SEQ ID NO: 47271 - RNA, 22 nt, Human
aguacaagugaugugguaaaaa

SEQ ID NO: 47272 - RNA, 20 nt, Human
aguacaauguaugauucaga

SEQ ID NO: 47273 - RNA, 22 nt, Human
aguacaauuauauuuagauggu

SEQ ID NO: 47274 - RNA, 22 nt, Human
aguacacagaguuauuuugugu

SEQ ID NO: 47275 - RNA, 22 nt, Human
aguacacuggcaaauguggugg

SEQ ID NO: 47276 - RNA, 22 nt, Human
aguacauauugaguggugauau

SEQ ID NO: 47277 - RNA, 21 nt, Human
aguacaucucaaauguaaauc

SEQ ID NO: 47278 - RNA, 22 nt, Human
aguacaugugguccuggccaga

SEQ ID NO: 47279 - RNA, 22 nt, Human
aguacauuuauuaaugguaaaa

SEQ ID NO: 47280 - RNA, 22 nt, Human
aguacccuagggugggagcuca

SEQ ID NO: 47281 - RNA, 22 nt, Human
aguaccuuugcauggauuuuuu

SEQ ID NO: 47282 - RNA, 22 nt, Human
aguacuuagaaaguuaauauaa

SEQ ID NO: 47283 - RNA, 22 nt, Human
aguacuuucuuccgagagagaa

SEQ ID NO: 47284 - RNA, 22 nt, Human
aguacuuugcacuuugcucaga

SEQ ID NO: 47285 - RNA, 22 nt, Human
aguacuuuuuguucaauugugc

SEQ ID NO: 47286 - RNA, 22 nt, Human
aguagaaagaaggcacugggcc

SEQ ID NO: 47287 - RNA, 22 nt, Human
aguagaaaguugcaggaggaau

SEQ ID NO: 47288 - RNA, 22 nt, Human
aguagaaauguaagaaggauua

SEQ ID NO: 47289 - RNA, 22 nt, Human
aguagaauguucuaugucaaug

SEQ ID NO: 47290 - RNA, 22 nt, Human
aguagacagacagaacacagcc

SEQ ID NO: 47291 - RNA, 22 nt, Human
aguagacaugagcaaugauaau

SEQ ID NO: 47292 - RNA, 22 nt, Human
aguagauagauucuaagcacua

SEQ ID NO: 47293 - RNA, 22 nt, Human
aguagcaauggcucugagcuau

SEQ ID NO: 47294 - RNA, 22 nt, Human
aguagcaccagggaagcagggc

SEQ ID NO: 47295 - RNA, 22 nt, Human
aguagcaguuuggcugaauuua

SEQ ID NO: 47296 - RNA, 22 nt, Human
aguaggcagaaguggcauucgg

SEQ ID NO: 47297 - RNA, 22 nt, Human
aguaggcauugugaaacugcau

SEQ ID NO: 47298 - RNA, 22 nt, Human
aguaggguguugcuauaacaag

SEQ ID NO: 47299 - RNA, 22 nt, Human
aguagucacuucacccauccca

SEQ ID NO: 47300 - RNA, 22 nt, Human
aguagucacuucuauuaauggc

SEQ ID NO: 47301 - RNA, 22 nt, Human
aguagucagcagauaauauagg

SEQ ID NO: 47302 - RNA, 18 nt, Human
aguaguggguuuagcuuc

SEQ ID NO: 47303 - RNA, 22 nt, Human
aguaguuuccauuucugaguuu

SEQ ID NO: 47304 - RNA, 22 nt, Human
aguaguuugggcagugacagau

SEQ ID NO: 47305 - RNA, 22 nt, Human
aguauacaguaaugacauaucu

SEQ ID NO: 47306 - RNA, 22 nt, Human
aguauacugaaaguaaauauga

SEQ ID NO: 47307 - RNA, 22 nt, Human
aguauauaguggcgcuguaugc

SEQ ID NO: 47308 - RNA, 22 nt, Human
aguauauugcucuuaaucauag

SEQ ID NO: 47309 - RNA, 22 nt, Human
aguauauugguguuauuccuca

SEQ ID NO: 47310 - RNA, 22 nt, Human
aguauauuuaccauuggguggg

SEQ ID NO: 47311 - RNA, 22 nt, Human
aguaucaaagggcaugugguua

SEQ ID NO: 47312 - RNA, 22 nt, Human
aguaucagcagagcuuaaaaga

SEQ ID NO: 47313 - RNA, 21 nt, Human
aguaucauaaugaauaguucu

SEQ ID NO: 47314 - RNA, 22 nt, Human
aguaucauguuggaauuaauca

SEQ ID NO: 47315 - RNA, 22 nt, Human
aguaucucaaagugguuuaugg

SEQ ID NO: 47316 - RNA, 22 nt, Human
aguaugaaaguuaaucaauuua

SEQ ID NO: 47317 - RNA, 22 nt, Human
aguaugaagaauacauagauga

SEQ ID NO: 47318 - RNA, 22 nt, Human
aguaugaagauuauaauuuuuc

SEQ ID NO: 47319 - RNA, 22 nt, Human
aguaugaauacagauuuucucu

SEQ ID NO: 47320 - RNA, 22 nt, Human
aguaugaauugcuuugccugua

SEQ ID NO: 47321 - RNA, 22 nt, Human
aguauguggcacagaauuucuu

SEQ ID NO: 47322 - RNA, 21 nt, Human
aguauguguuagggauaauuu

SEQ ID NO: 47323 - RNA, 22 nt, Human
aguauuacccucagaacuugau

SEQ ID NO: 47324 - RNA, 23 nt, Human
aguauucaaaaggcaagcuauau

SEQ ID NO: 47325 - RNA, 22 nt, Human
aguauuguaaacuuccuaagga

SEQ ID NO: 47326 - RNA, 22 nt, Human
aguauuuagagacacaagaugg

SEQ ID NO: 47327 - RNA, 22 nt, Human
aguauuuagcauagugguuagu

SEQ ID NO: 47328 - RNA, 22 nt, Human
aguauuucuucauaugauuacu

SEQ ID NO: 47329 - RNA, 22 nt, Human
aguauuugaagauguugaguac

SEQ ID NO: 47330 - RNA, 22 nt, Human
aguauuuguggauuuguauugg

SEQ ID NO: 47331 - RNA, 22 nt, Human
aguauuuguugaaugagugaau

SEQ ID NO: 47332 - RNA, 22 nt, Human
agucaaacaaauguuuauugag

SEQ ID NO: 47333 - RNA, 22 nt, Human
agucaaaugaguaaauauauaa

SEQ ID NO: 47334 - RNA, 22 nt, Human
agucaacacauuaaaccuaggg

SEQ ID NO: 47335 - RNA, 22 nt, Human
agucaacauuugagaugcaaug

SEQ ID NO: 47336 - RNA, 20 nt, Human
agucacaggccuggaacaug

SEQ ID NO: 47337 - RNA, 22 nt, Human
agucacaggguacacaaggauu

SEQ ID NO: 47338 - RNA, 22 nt, Human
agucacagguucuugggauuag

SEQ ID NO: 47339 - RNA, 22 nt, Human
agucacaguuccuacccaguaa

SEQ ID NO: 47340 - RNA, 22 nt, Human
agucacaguuucccugagagag

SEQ ID NO: 47341 - RNA, 22 nt, Human
agucacauagaaguggguuuaa

SEQ ID NO: 47342 - RNA, 22 nt, Human
agucacaucgauuauaaaauuu

SEQ ID NO: 47343 - RNA, 23 nt, Human
agucacaucuuagcagccagguc

SEQ ID NO: 47344 - RNA, 22 nt, Human
agucacaugagcacuaauuagg

SEQ ID NO: 47345 - RNA, 22 nt, Human
agucacaugcauuuucuucaau

SEQ ID NO: 47346 - RNA, 22 nt, Human
agucacucugcuacaugacagc

SEQ ID NO: 47347 - RNA, 22 nt, Human
agucacugagauggugaggcua

SEQ ID NO: 47348 - RNA, 22 nt, Human
agugucuggugagggcucucuc

SEQ ID NO: 47349 - RNA, 22 nt, Human
agugucugugaggggaauuccu

SEQ ID NO: 47350 - RNA, 22 nt, Human
agugucuguguuuucuauugcu

SEQ ID NO: 47351 - RNA, 22 nt, Human
agugucuguuacgcuugcagaa

SEQ ID NO: 47352 - RNA, 22 nt, Human
agugucuguugcuuuugcagug

SEQ ID NO: 47353 - RNA, 22 nt, Human
agugucuucaugauguggcagc

SEQ ID NO: 47354 - RNA, 22 nt, Human
agugucuuuauagacugacaau

SEQ ID NO: 47355 - RNA, 22 nt, Human
agugucuuugucaaauuacagg

SEQ ID NO: 47356 - RNA, 22 nt, Human
agugugagcccuggaguggugc

SEQ ID NO: 47357 - RNA, 22 nt, Human
agugugagccuacaggccaaag

SEQ ID NO: 47358 - RNA, 22 nt, Human
agugugagcuaauagcagagcc

SEQ ID NO: 47359 - RNA, 22 nt, Human
agugugagugcucauguccauc

SEQ ID NO: 47360 - RNA, 22 nt, Human
agugugcauuugcagaagaccc

SEQ ID NO: 47361 - RNA, 22 nt, Human
agugugcucaauucaagucuuu

SEQ ID NO: 47362 - RNA, 22 nt, Human
aguguggagcaucgagggcaga

SEQ ID NO: 47363 - RNA, 22 nt, Human
aguguggagccacugaguggcu

SEQ ID NO: 47364 - RNA, 17 nt, Human
aguguggcccugguuaa

SEQ ID NO: 47365 - RNA, 22 nt, Human
aguguggggucaccggcccagg

SEQ ID NO: 47366 - RNA, 23 nt, Human
aguguguaagguacuuugcugcu

SEQ ID NO: 47367 - RNA, 22 nt, Human
aguguguaaugccaggggcugc

SEQ ID NO: 47368 - RNA, 22 nt, Human
aguguguaauucagugcccagc

SEQ ID NO: 47369 - RNA, 22 nt, Human
aguguguagcacaugguaagca

SEQ ID NO: 47370 - RNA, 22 nt, Human
agugugucuuauccugggagaa

SEQ ID NO: 47371 - RNA, 17 nt, Human
agugugugaaauggugg

SEQ ID NO: 47372 - RNA, 22 nt, Human
agugugugaccuuuuaauuuaa

SEQ ID NO: 47373 - RNA, 21 nt, Human
agugugugauaggcaggaaga

SEQ ID NO: 47374 - RNA, 22 nt, Human
agugagauguguaaucaggggu

SEQ ID NO: 47375 - RNA, 20 nt, Human
agugagauugcugcucuagc

SEQ ID NO: 47376 - RNA, 23 nt, Human
agugagcagcuguagggcaagga

SEQ ID NO: 47377 - RNA, 22 nt, Human
agugagcaucuucaggagccaa

SEQ ID NO: 47378 - RNA, 22 nt, Human
agugagggacuagugcugggga

SEQ ID NO: 47379 - RNA, 22 nt, Human
agugaggggcagcugagugggc

SEQ ID NO: 47380 - RNA, 22 nt, Human
agugaggucauacuggagaggg

SEQ ID NO: 47381 - RNA, 22 nt, Human
agugaguauuuguugagugcua

SEQ ID NO: 47382 - RNA, 22 nt, Human
agugaguggagagcucuagguu

SEQ ID NO: 47383 - RNA, 22 nt, Human
agugaguggauguaggaauugg

SEQ ID NO: 47384 - RNA, 19 nt, Human
agugaguggggaaggcccu

SEQ ID NO: 47385 - RNA, 22 nt, Human
agugauauuagcaaaugguuau

SEQ ID NO: 47386 - RNA, 22 nt, Human
agugauggagcuuccucugcua

SEQ ID NO: 47387 - RNA, 22 nt, Human
agugauggcaucggguccagca

SEQ ID NO: 47388 - RNA, 22 nt, Human
agugauggggcccugcacugau

SEQ ID NO: 47389 - RNA, 22 nt, Human
agugaugucacaaacuauggug

SEQ ID NO: 47390 - RNA, 22 nt, Human
agugauuaauuguaaaaauucu

SEQ ID NO: 47391 - RNA, 22 nt, Human
agugauuagaaaguacacuugg

SEQ ID NO: 47392 - RNA, 22 nt, Human
agugauucuuuaaagugguauu

SEQ ID NO: 47393 - RNA, 22 nt, Human
agugauuugaggauuauugcuc

SEQ ID NO: 47394 - RNA, 22 nt, Human
agugauuugcaguauuuacuaa

SEQ ID NO: 47395 - RNA, 22 nt, Human
agugcaaaauucagaagcaauu

SEQ ID NO: 47396 - RNA, 22 nt, Human
agugcaaagggcuguugagaag

SEQ ID NO: 47397 - RNA, 22 nt, Human
agugcaacagcaguucucuuua

SEQ ID NO: 47398 - RNA, 20 nt, Human
agugcaagaaagcacagcug

SEQ ID NO: 47399 - RNA, 22 nt, Human
agugcaauguguacagaaaaau

SEQ ID NO: 47400 - RNA, 22 nt, Human
agugcagaggcugggaaaugcu

SEQ ID NO: 47401 - RNA, 22 nt, Human
agugcagcaugaagcacaugug

SEQ ID NO: 47402 - RNA, 22 nt, Human
agugcagcaugcuggggaggcu

SEQ ID NO: 47403 - RNA, 22 nt, Human
agugcagcuuauaaagcaucaa

SEQ ID NO: 47404 - RNA, 22 nt, Human
agugcaggccccaggccaggcc

SEQ ID NO: 47405 - RNA, 22 nt, Human
agugcaguaaaugggcauuaug

SEQ ID NO: 47406 - RNA, 22 nt, Human
agugcagugaugaauaaugguu

SEQ ID NO: 47407 - RNA, 22 nt, Human
agugcagugguuaggagccagg

SEQ ID NO: 47408 - RNA, 22 nt, Human
agugcauacccuucuaaaaagu

SEQ ID NO: 47409 - RNA, 22 nt, Human
agugcauagggggaugcacagc

SEQ ID NO: 47410 - RNA, 22 nt, Human
agugcaugaaagcauacaaggc

SEQ ID NO: 47411 - RNA, 22 nt, Human
agugcauuccuggggaagaagc

SEQ ID NO: 47412 - RNA, 22 nt, Human
agugccaaaucgagggcucuga

SEQ ID NO: 47413 - RNA, 23 nt, Human
agugccagggagaucaggacgga

SEQ ID NO: 47414 - RNA, 22 nt, Human
agugccaguuaauaagaaaugg

SEQ ID NO: 47415 - RNA, 22 nt, Human
agugcccaccucucuucagcua

SEQ ID NO: 47416 - RNA, 22 nt, Human
agugcccggacaacuggacaga

SEQ ID NO: 47417 - RNA, 22 nt, Human
agugcccugcuggggcaggaga

SEQ ID NO: 47418 - RNA, 22 nt, Human
agugcccuggacggcggcccca

SEQ ID NO: 47419 - RNA, 22 nt, Human
agugcccugucacuggaacuga

SEQ ID NO: 47420 - RNA, 22 nt, Human
agugccucuugucuacgguuuu

SEQ ID NO: 47421 - RNA, 22 nt, Human
agugccuggaccccaugacaua

SEQ ID NO: 47422 - RNA, 22 nt, Human
agugccuuggguauuuugagua

SEQ ID NO: 47423 - RNA, 22 nt, Human
agugcgugguuuacagcuaguu

SEQ ID NO: 47424 - RNA, 22 nt, Human
agugcuauaaagguagaccaca

SEQ ID NO: 47425 - RNA, 22 nt, Human
agugcucaccugucaggucaag

SEQ ID NO: 47426 - RNA, 23 nt, Human
agugcucagggcauuaggcuaga

SEQ ID NO: 47427 - RNA, 22 nt, Human
agugcuccaaagguuggucauu

SEQ ID NO: 47428 - RNA, 22 nt, Human
agugcuggaaagggacggagga

SEQ ID NO: 47429 - RNA, 22 nt, Human
agugcuggagggaggcagguuc

SEQ ID NO: 47430 - RNA, 22 nt, Human
agugcugucuccuucccccggg

SEQ ID NO: 47431 - RNA, 22 nt, Human
agugcuuaaaacccugcacuag

SEQ ID NO: 47432 - RNA, 22 nt, Human
agugcuuauaccaaagacucuu

SEQ ID NO: 47433 - RNA, 22 nt, Human
agugcuuuaccuagauaauguu

SEQ ID NO: 47434 - RNA, 22 nt, Human
agugcuuuauguuguugugcaa

SEQ ID NO: 47435 - RNA, 22 nt, Human
aguggagaagaggauggucucc

SEQ ID NO: 47436 - RNA, 22 nt, Human
aguggagcaggcggcgcucacu

SEQ ID NO: 47437 - RNA, 22 nt, Human
aguggagcuuuuccuaucagag

SEQ ID NO: 47438 - RNA, 22 nt, Human
aguggagguuacagcuguacau

SEQ ID NO: 47439 - RNA, 22 nt, Human
aguggagguuauugaguuaagg

SEQ ID NO: 47440 - RNA, 22 nt, Human
aguggagugaguggcagaagga

SEQ ID NO: 47441 - RNA, 22 nt, Human
aguggauggucacugauccagu

SEQ ID NO: 47442 - RNA, 22 nt, Human
aguggcagaacuaccuuuuuau

SEQ ID NO: 47443 - RNA, 22 nt, Human
aguggcagaagucacuggguag

SEQ ID NO: 47444 - RNA, 22 nt, Human
aguggcagacagagacaguacc

SEQ ID NO: 47445 - RNA, 22 nt, Human
aguggcagagaccccagccagc

SEQ ID NO: 47446 - RNA, 22 nt, Human
aguggcagagccaagauaugau

SEQ ID NO: 47447 - RNA, 22 nt, Human
aguggcagagccaaguagagcc

SEQ ID NO: 47448 - RNA, 22 nt, Human
aguggcagagguugacugcagu

SEQ ID NO: 47449 - RNA, 22 nt, Human
aguggcagaucucuggucugga

SEQ ID NO: 47450 - RNA, 22 nt, Human
aguggcagguguuucguggugc

SEQ ID NO: 47451 - RNA, 22 nt, Human
aguggcaguggaaagcacacgg

SEQ ID NO: 47452 - RNA, 22 nt, Human
aguggcaguggggcagggcccu

SEQ ID NO: 47453 - RNA, 22 nt, Human
aguggcaguuugggagcuacag

SEQ ID NO: 47454 - RNA, 22 nt, Human
aguggcaguuuuauauuucaug

SEQ ID NO: 47455 - RNA, 22 nt, Human
aguggcaucaaaucaagguuug

SEQ ID NO: 47456 - RNA, 22 nt, Human
aguggcaucuaaguuuuagaaa

SEQ ID NO: 47457 - RNA, 22 nt, Human
aguggcauuuuaauggauguca

SEQ ID NO: 47458 - RNA, 22 nt, Human
aguggccaccaugccagcucuc

SEQ ID NO: 47459 - RNA, 22 nt, Human
aguggccacugacuuggaaauc

SEQ ID NO: 47460 - RNA, 22 nt, Human
aguggccagcagccuagccuag

SEQ ID NO: 47461 - RNA, 22 nt, Human
aguggccagugcugcucugggg

SEQ ID NO: 47462 - RNA, 22 nt, Human
aguggcuaauaacagcuaaaca

SEQ ID NO: 47463 - RNA, 22 nt, Human
aguggcucuccaagaagucaca

SEQ ID NO: 47464 - RNA, 22 nt, Human
aguggcugcuaugaucaggaca

SEQ ID NO: 47465 - RNA, 22 nt, Human
aguggcugcugacuuuaauaca

SEQ ID NO: 47466 - RNA, 22 nt, Human
aguugggauucuugguucuggg

SEQ ID NO: 47467 - RNA, 19 nt, Human
aguuggggcagggaagaga

SEQ ID NO: 47468 - RNA, 22 nt, Human
aguuguaagagacagauauaaa

SEQ ID NO: 47469 - RNA, 22 nt, Human
aguugucagucaaagacauuug

SEQ ID NO: 47470 - RNA, 22 nt, Human
aguugucccggucuagccacuu

SEQ ID NO: 47471 - RNA, 22 nt, Human
aguuuaacuuuguaaacgugag

SEQ ID NO: 47472 - RNA, 22 nt, Human
aguuuacaaaguuucacuguuc

SEQ ID NO: 47473 - RNA, 22 nt, Human
aguuuacacuuuugauucuuau

SEQ ID NO: 47474 - RNA, 22 nt, Human
aguuuacauauuugucggaguc

SEQ ID NO: 47475 - RNA, 21 nt, Human
aguuuagaccaagccuuucca

SEQ ID NO: 47476 - RNA, 22 nt, Human
aguuuaggcaggcuccuauggu

SEQ ID NO: 47477 - RNA, 22 nt, Human
aguuuaugaaacacagauuuga

SEQ ID NO: 47478 - RNA, 22 nt, Human
aguuuauguagaauuggcaaua

SEQ ID NO: 47479 - RNA, 22 nt, Human
aguuuauucucuggucuuagua

SEQ ID NO: 47480 - RNA, 22 nt, Human
aguuucaauucuuuucacaaag

SEQ ID NO: 47481 - RNA, 22 nt, Human
aguuucacagaggguuagacgc

SEQ ID NO: 47482 - RNA, 22 nt, Human
aguuucacuaaggucugugugu

SEQ ID NO: 47483 - RNA, 22 nt, Human
auaauggauucagaaccgucaa

SEQ ID NO: 47484 - RNA, 22 nt, Human
auaauggccgggggcugaaugc

SEQ ID NO: 47485 - RNA, 22 nt, Human
auaauggcuucugaguauuagg

SEQ ID NO: 47486 - RNA, 22 nt, Human
auaauguacaacugcuuuuaau

SEQ ID NO: 47487 - RNA, 22 nt, Human
auaaugucugcagagccacaca

SEQ ID NO: 47488 - RNA, 22 nt, Human
auaaugugauauuucauuuaca

SEQ ID NO: 47489 - RNA, 20 nt, Human
auaauuacauagagauugcc

SEQ ID NO: 47490 - RNA, 16 nt, Human
auaauuacugcuacuu

SEQ ID NO: 47491 - RNA, 22 nt, Human
aguuuggaaaaugagacaagga

SEQ ID NO: 47492 - RNA, 22 nt, Human
aguuuggaagagaaaaauauuu

SEQ ID NO: 47493 - RNA, 22 nt, Human
aguuuggaagucaggcuuuucu

SEQ ID NO: 47494 - RNA, 22 nt, Human
aguuuguaaguucauuaugagu

SEQ ID NO: 47495 - RNA, 22 nt, Human
aguuuguaauaaugaaggaagu

SEQ ID NO: 47496 - RNA, 22 nt, Human
aguuuguaugccaacagcaaag

SEQ ID NO: 47497 - RNA, 22 nt, Human
aguuuuaagaugcgcuucuguu

SEQ ID NO: 47498 - RNA, 22 nt, Human
aguuuuaugcaguguucugaua

SEQ ID NO: 47499 - RNA, 22 nt, Human
aguuuuauguucacagaaggau

SEQ ID NO: 47500 - RNA, 22 nt, Human
aguuuucacacucaccaaaagg

SEQ ID NO: 47501 - RNA, 22 nt, Human
aguuuucauuaccaugcugcaa

SEQ ID NO: 47502 - RNA, 22 nt, Human
aguuuuccuuuauugaguacca

SEQ ID NO: 47503 - RNA, 22 nt, Human
aguuuucucuguguucugcuua

SEQ ID NO: 47504 - RNA, 22 nt, Human
aguuuucugauguguagugaga

SEQ ID NO: 47505 - RNA, 22 nt, Human
aguuuucugggaucacuggaau

SEQ ID NO: 47506 - RNA, 22 nt, Human
aguuuucuguucuacaauuuga

SEQ ID NO: 47507 - RNA, 22 nt, Human
aguuuuguaauucucaaaaaua

SEQ ID NO: 47508 - RNA, 22 nt, Human
aguuuuucuccccuggcuucau

SEQ ID NO: 47509 - RNA, 19 nt, Human
aguuuuuggaaauccugcu

SEQ ID NO: 47510 - RNA, 22 nt, Human
auaaaaaugagggcgguagcua

SEQ ID NO: 47511 - RNA, 22 nt, Human
auaaaagucugcuuauuugggc

SEQ ID NO: 47512 - RNA, 22 nt, Human
auaaaaucaacuggcuccaguu

SEQ ID NO: 47513 - RNA, 22 nt, Human
auaaacaagacuggccaacuuu

SEQ ID NO: 47514 - RNA, 22 nt, Human
auaaacagccugcccaaauugg

SEQ ID NO: 47515 - RNA, 22 nt, Human
auaaacagcuccauuuagugcc

SEQ ID NO: 47516 - RNA, 22 nt, Human
auaaacaguaaaugugagcagu

SEQ ID NO: 47517 - RNA, 22 nt, Human
auaaaccagaaguaaaagcuac

SEQ ID NO: 47518 - RNA, 22 nt, Human
auaaacugaagggaacacugag

SEQ ID NO: 47519 - RNA, 23 nt, Human
auaaacugucaaaagccagcccu

SEQ ID NO: 47520 - RNA, 22 nt, Human
auaaacuugagucucagaguau

SEQ ID NO: 47521 - RNA, 22 nt, Human
auaaagauagaaugcuuuccug

SEQ ID NO: 47522 - RNA, 22 nt, Human
auaaagcaagcauaccauuaag

SEQ ID NO: 47523 - RNA, 22 nt, Human
auaaagcaugcuuguuuggaga

SEQ ID NO: 47524 - RNA, 22 nt, Human
auaaagcuauuccucucuuuuu

SEQ ID NO: 47525 - RNA, 22 nt, Human
auaaaggcaacaccaggguaug

SEQ ID NO: 47526 - RNA, 17 nt, Human
auaaaggcaaguauuau

SEQ ID NO: 47527 - RNA, 22 nt, Human
auaaagucucauggguaaaugu

SEQ ID NO: 47528 - RNA, 18 nt, Human
auaaagugcuaauaaugg

SEQ ID NO: 47529 - RNA, 22 nt, Human
auaaaguggaaguguuaaaggg

SEQ ID NO: 47530 - RNA, 22 nt, Human
auaaaguuuaaaagucaauagu

SEQ ID NO: 47531 - RNA, 19 nt, Human
auaaauaaaaagugggaga

SEQ ID NO: 47532 - RNA, 22 nt, Human
auaaaucuauuggacaugugug

SEQ ID NO: 47533 - RNA, 23 nt, Human
auaaauuacuaucucccuagagc

SEQ ID NO: 47534 - RNA, 22 nt, Human
auaaauugugcuuuugacaucu

SEQ ID NO: 47535 - RNA, 22 nt, Human
auaaauuuucuugcuguacuua

SEQ ID NO: 47536 - RNA, 20 nt, Human
auaacaaggcucugcaagcu

SEQ ID NO: 47537 - RNA, 22 nt, Human
auaacaugagccagauugaaag

SEQ ID NO: 47538 - RNA, 22 nt, Human
auaaccaugauuaaucuaagaa

SEQ ID NO: 47539 - RNA, 22 nt, Human
auaaccuaggaggguagaggua

SEQ ID NO: 47540 - RNA, 20 nt, Human
auaaccugcccagaggauga

SEQ ID NO: 47541 - RNA, 22 nt, Human
auaaccuuggcuaguauugugc

SEQ ID NO: 47542 - RNA, 22 nt, Human
auaacgaaggcugaugcgggau

SEQ ID NO: 47543 - RNA, 22 nt, Human
auaacuuagaguaggcaaaagu

SEQ ID NO: 47544 - RNA, 22 nt, Human
auaacuucaucaaauaggcaca

SEQ ID NO: 47545 - RNA, 22 nt, Human
auaacuugauguuauuugucca

SEQ ID NO: 47546 - RNA, 22 nt, Human
auaagacacgcaaauagguacg

SEQ ID NO: 47547 - RNA, 22 nt, Human
auaagacacgccccacucacuc

SEQ ID NO: 47548 - RNA, 22 nt, Human
auaagaggaauuacagaagagg

SEQ ID NO: 47549 - RNA, 22 nt, Human
auaagagucuuguuuucuuauu

SEQ ID NO: 47550 - RNA, 22 nt, Human
auaagaugagaucagcuuucug

SEQ ID NO: 47551 - RNA, 23 nt, Human
auaagccuuuucuuucugcccca

SEQ ID NO: 47552 - RNA, 22 nt, Human
auaagcucuggacagccacauu

SEQ ID NO: 47553 - RNA, 22 nt, Human
auaagcuuccuguuagaaaccg

SEQ ID NO: 47554 - RNA, 22 nt, Human
auaagcuuugcuggagagaccu

SEQ ID NO: 47555 - RNA, 22 nt, Human
auaagcuuuugauucacuucag

SEQ ID NO: 47556 - RNA, 22 nt, Human
auaaggaaguugcagaagugga

SEQ ID NO: 47557 - RNA, 22 nt, Human
auaaggaaugauguaucaguuu

SEQ ID NO: 47558 - RNA, 22 nt, Human
auaaggaauuuagaauagggaa

SEQ ID NO: 47559 - RNA, 22 nt, Human
auaaggcaagcugucaguuugu

SEQ ID NO: 47560 - RNA, 22 nt, Human
auaaggcacacauagauagggu

SEQ ID NO: 47561 - RNA, 22 nt, Human
auaaggcagugacuucaucuau

SEQ ID NO: 47562 - RNA, 22 nt, Human
auaagguauaaggccuauuuuu

SEQ ID NO: 47563 - RNA, 22 nt, Human
auaaguucagguaaagaaauca

SEQ ID NO: 47564 - RNA, 22 nt, Human
auaaguuugucuuuguaaagau

SEQ ID NO: 47565 - RNA, 22 nt, Human
auaauaacaccugaauaggaaa

SEQ ID NO: 47566 - RNA, 22 nt, Human
auaauaaugaaagccacugugu

SEQ ID NO: 47567 - RNA, 23 nt, Human
auaauaauuauggcagcaaagug

SEQ ID NO: 47568 - RNA, 22 nt, Human
auaauagcuaacacagagugcu

SEQ ID NO: 47569 - RNA, 22 nt, Human
auaauaucgcuccuuuuuuuga

SEQ ID NO: 47570 - RNA, 22 nt, Human
auaaucauuuuaauuagugguu

SEQ ID NO: 47571 - RNA, 22 nt, Human
auaauccugcuuuuucacuauu

SEQ ID NO: 47572 - RNA, 22 nt, Human
auaaucuguggaugguuuugag

SEQ ID NO: 47573 - RNA, 22 nt, Human
auaaucuuucuuuuccagauag

SEQ ID NO: 47574 - RNA, 22 nt, Human
auaaugaaauaugaggaagguc

SEQ ID NO: 47575 - RNA, 22 nt, Human
auaaugacauucuuagacugga

SEQ ID NO: 47576 - RNA, 22 nt, Human
auaaugagcuuuugaauacuga

SEQ ID NO: 47577 - RNA, 22 nt, Human
auaaugcgccucagaaaacaga

SEQ ID NO: 47578 - RNA, 22 nt, Human
auaaugcugggagaaauuguua

SEQ ID NO: 47579 - RNA, 22 nt, Human
auaauggcuugugguguuauuc

SEQ ID NO: 47580 - RNA, 21 nt, Human
auaauguacaaaaacugucuu

SEQ ID NO: 47581 - RNA, 22 nt, Human
auaauuaggucuuauaacgucu

SEQ ID NO: 47582 - RNA, 22 nt, Human
auaauugugggcagugugauau

SEQ ID NO: 47583 - RNA, 22 nt, Human
auaauuuaaauuaguaugugau

SEQ ID NO: 47584 - RNA, 22 nt, Human
auaauuuaauuuucacaguggu

SEQ ID NO: 47585 - RNA, 20 nt, Human
auaauuuacccugcaccacu

SEQ ID NO: 47586 - RNA, 22 nt, Human
auaauuuacuaagcucuaccuu

SEQ ID NO: 47587 - RNA, 22 nt, Human
auacaaaaauuagccgggagua

SEQ ID NO: 47588 - RNA, 22 nt, Human
auacaaagacaaaucucaaucu

SEQ ID NO: 47589 - RNA, 20 nt, Human
auacaaagagauugauguau

SEQ ID NO: 47590 - RNA, 22 nt, Human
auacaaaguauuaauccuggau

SEQ ID NO: 47591 - RNA, 22 nt, Human
auacaaauccucugggauggua

SEQ ID NO: 47592 - RNA, 22 nt, Human
auagcaagcguucccaagccac

SEQ ID NO: 47593 - RNA, 22 nt, Human
auagcaauuaagcuccagaauu

SEQ ID NO: 47594 - RNA, 22 nt, Human
auagcaauuugcccaauuaccu

SEQ ID NO: 47595 - RNA, 22 nt, Human
auagcacaucacuccagugagu

SEQ ID NO: 47596 - RNA, 22 nt, Human
auagcacuuauuguaugcugag

SEQ ID NO: 47597 - RNA, 22 nt, Human
auagcagcauuucuuccaagga

SEQ ID NO: 47598 - RNA, 22 nt, Human
auagcauacauguuguuacuug

SEQ ID NO: 47599 - RNA, 22 nt, Human
auagcauauaaguuauaaaacu

SEQ ID NO: 47600 - RNA, 22 nt, Human
auagccaggagaugauggggga

SEQ ID NO: 47601 - RNA, 22 nt, Human
auagcuucagaauugagauauc

SEQ ID NO: 47602 - RNA, 22 nt, Human
auaggacagcagacaauuagua

SEQ ID NO: 47603 - RNA, 22 nt, Human
auaggaugauaaaauuagaaac

SEQ ID NO: 47604 - RNA, 22 nt, Human
auaggcaagcacaaagucagga

SEQ ID NO: 47605 - RNA, 22 nt, Human
auaggcagacucuuuuuggagg

SEQ ID NO: 47606 - RNA, 22 nt, Human
auaggcuuggcuuauucuuggg

SEQ ID NO: 47607 - RNA, 22 nt, Human
auagggccuaaaaaguauugcu

SEQ ID NO: 47608 - RNA, 22 nt, Human
auaauuaucucagacacuuguu

SEQ ID NO: 47609 - RNA, 22 nt, Human
auaauucagguuuucuggcaca

SEQ ID NO: 47610 - RNA, 22 nt, Human
auaauugaugaggcuuuggaca

SEQ ID NO: 47611 - RNA, 22 nt, Human
auaauuuggcuuccuagaugua

SEQ ID NO: 47612 - RNA, 22 nt, Human
auacaaaauauauacuggagac

SEQ ID NO: 47613 - RNA, 17 nt, Human
auacaaagccauaaacc

SEQ ID NO: 47614 - RNA, 22 nt, Human
auacaaagcuaaauaugguuuc

SEQ ID NO: 47615 - RNA, 22 nt, Human
auacaaaguauugauccugagu

SEQ ID NO: 47616 - RNA, 22 nt, Human
auacaacuuuacaugcaauucc

SEQ ID NO: 47617 - RNA, 22 nt, Human
auacaagacucagcacagacgg

SEQ ID NO: 47618 - RNA, 18 nt, Human
auacaagcucuguuacuu

SEQ ID NO: 47619 - RNA, 22 nt, Human
auacaagugagaaaacugaaga

SEQ ID NO: 47620 - RNA, 22 nt, Human
auacaaguucucauguguaucu

SEQ ID NO: 47621 - RNA, 22 nt, Human
auacaauccagccauugccaca

SEQ ID NO: 47622 - RNA, 22 nt, Human
auacaaugaaguauagaugaaa

SEQ ID NO: 47623 - RNA, 22 nt, Human
auacaaugggugcaaagaugug

SEQ ID NO: 47624 - RNA, 22 nt, Human
auacacacaaucagguuuugua

SEQ ID NO: 47625 - RNA, 22 nt, Human
auacacacugcuauccuuuuuu

SEQ ID NO: 47626 - RNA, 22 nt, Human
auacacagcgaugagaggaggc

SEQ ID NO: 47627 - RNA, 22 nt, Human
auacacauauguguguauaugu

SEQ ID NO: 47628 - RNA, 15 nt, Human
auacacaugagggag

SEQ ID NO: 47629 - RNA, 22 nt, Human
auacacgugccauguuggugug

SEQ ID NO: 47630 - RNA, 22 nt, Human
auacacguguguguacaugcac

SEQ ID NO: 47631 - RNA, 22 nt, Human
auacacugaguccuuuucucau

SEQ ID NO: 47632 - RNA, 22 nt, Human
auacacuggacaucauugcauu

SEQ ID NO: 47633 - RNA, 22 nt, Human
auacacuguucacuagaucuuc

SEQ ID NO: 47634 - RNA, 22 nt, Human
auacagaaaaguggauagccag

SEQ ID NO: 47635 - RNA, 22 nt, Human
auacagaacaagccucaccucc

SEQ ID NO: 47636 - RNA, 21 nt, Human
auacagaacauugauccaaga

SEQ ID NO: 47637 - RNA, 22 nt, Human
auacagaagaacuauagccacu

SEQ ID NO: 47638 - RNA, 22 nt, Human
auacagaaguuuuccacuuauu

SEQ ID NO: 47639 - RNA, 22 nt, Human
auacagaauucacuacaguuuc

SEQ ID NO: 47640 - RNA, 18 nt, Human
auacagagaccucaagga

SEQ ID NO: 47641 - RNA, 19 nt, Human
auacagagcuuccuaauuu

SEQ ID NO: 47642 - RNA, 22 nt, Human
auacagaugagaucaggcauaa

SEQ ID NO: 47643 - RNA, 22 nt, Human
auacagaugggucagauuucau

SEQ ID NO: 47644 - RNA, 22 nt, Human
auacagauguugaauguuauau

SEQ ID NO: 47645 - RNA, 22 nt, Human
auacagcuuucuuucacaugag

SEQ ID NO: 47646 - RNA, 22 nt, Human
auacaggugugagggucucuuu

SEQ ID NO: 47647 - RNA, 22 nt, Human
auacaguaaccacauucuauag

SEQ ID NO: 47648 - RNA, 19 nt, Human
auacaguaagguguuugcc

SEQ ID NO: 47649 - RNA, 22 nt, Human
auacaguaauugcccugcaaug

SEQ ID NO: 47650 - RNA, 22 nt, Human
auacaguauaacuaauaaaccc

SEQ ID NO: 47651 - RNA, 22 nt, Human
auacagugcacaaccugugcag

SEQ ID NO: 47652 - RNA, 17 nt, Human
auacaguuuauuuuaca

SEQ ID NO: 47653 - RNA, 22 nt, Human
auacauacauguacacauaaau

SEQ ID NO: 47654 - RNA, 22 nt, Human
auacauaggagaauaacuucag

SEQ ID NO: 47655 - RNA, 22 nt, Human
auacauauaugguacuuccugg

SEQ ID NO: 47656 - RNA, 22 nt, Human
auacaucuuccuuuuaaaaugc

SEQ ID NO: 47657 - RNA, 22 nt, Human
auacaucuugucagauucaugu

SEQ ID NO: 47658 - RNA, 22 nt, Human
auacaugacagcauagcauccu

SEQ ID NO: 47659 - RNA, 19 nt, Human
auacaugcauuuacaugcu

SEQ ID NO: 47660 - RNA, 22 nt, Human
auacaugcuuggguguagugcg

SEQ ID NO: 47661 - RNA, 22 nt, Human
auacauggaagaugcuuagcac

SEQ ID NO: 47662 - RNA, 22 nt, Human
auacauuccuacugacuagcua

SEQ ID NO: 47663 - RNA, 22 nt, Human
auaccauuuccauguuacauua

SEQ ID NO: 47664 - RNA, 22 nt, Human
auacccuuuacaggaacagcaa

SEQ ID NO: 47665 - RNA, 22 nt, Human
auaccuguguauccacaagcgu

SEQ ID NO: 47666 - RNA, 22 nt, Human
auaccuuuuacucauuauccau

SEQ ID NO: 47667 - RNA, 22 nt, Human
auacuaagcccaagaacacaug

SEQ ID NO: 47668 - RNA, 22 nt, Human
auacuaagcucauuacauuuug

SEQ ID NO: 47669 - RNA, 22 nt, Human
auacuacaagguaugugcuaaa

SEQ ID NO: 47670 - RNA, 22 nt, Human
auacuacacuaugcauggaugu

SEQ ID NO: 47671 - RNA, 22 nt, Human
auacuacauuauuagagccugg

SEQ ID NO: 47672 - RNA, 21 nt, Human
auacuacauuucucugacuuu

SEQ ID NO: 47673 - RNA, 22 nt, Human
auacuacauuugaaaauugcag

SEQ ID NO: 47674 - RNA, 22 nt, Human
auacucaauuuguuggaaagca

SEQ ID NO: 47675 - RNA, 22 nt, Human
auacucuuuaugacauuccagc

SEQ ID NO: 47676 - RNA, 22 nt, Human
auacugaauuagguaaagcaua

SEQ ID NO: 47677 - RNA, 22 nt, Human
auacuguuggcuuuggugaugg

SEQ ID NO: 47678 - RNA, 22 nt, Human
auacuguuucucuucuacauga

SEQ ID NO: 47679 - RNA, 22 nt, Human
auacuuaguuuuaauccauuag

SEQ ID NO: 47680 - RNA, 22 nt, Human
auacuucaacauaucagucaga

SEQ ID NO: 47681 - RNA, 22 nt, Human
auacuucaugcuucaugucugu

SEQ ID NO: 47682 - RNA, 22 nt, Human
auacuuccugcuucccugaucu

SEQ ID NO: 47683 - RNA, 22 nt, Human
auacuucucaugggcucugagc

SEQ ID NO: 47684 - RNA, 22 nt, Human
auacuucuuuaagaguaagucu

SEQ ID NO: 47685 - RNA, 21 nt, Human
auacuuugaauuacagccuug

SEQ ID NO: 47686 - RNA, 22 nt, Human
auagaaaacagauguccuuaaa

SEQ ID NO: 47687 - RNA, 22 nt, Human
auagaaauggcagcuggugcua

SEQ ID NO: 47688 - RNA, 22 nt, Human
auagaaauguauuuuggacuag

SEQ ID NO: 47689 - RNA, 22 nt, Human
auagaacagaaacagaugcaca

SEQ ID NO: 47690 - RNA, 22 nt, Human
auagaaccuguugugaaauuca

SEQ ID NO: 47691 - RNA, 22 nt, Human
auagaacuccaucccucugacc

SEQ ID NO: 47692 - RNA, 22 nt, Human
auagaagauagcuuuuguuucu

SEQ ID NO: 47693 - RNA, 22 nt, Human
auagaagcugauaaacuacuuc

SEQ ID NO: 47694 - RNA, 22 nt, Human
auagaagcuuuuaaauaacagg

SEQ ID NO: 47695 - RNA, 22 nt, Human
auagaauaaggcacagauucuu

SEQ ID NO: 47696 - RNA, 22 nt, Human
auagaauagcauagaaaauuga

SEQ ID NO: 47697 - RNA, 22 nt, Human
auagaaucuuuguaaaacacuu

SEQ ID NO: 47698 - RNA, 22 nt, Human
auagaauuuguacuuguagaac

SEQ ID NO: 47699 - RNA, 22 nt, Human
auagacacagcuaugauuugag

SEQ ID NO: 47700 - RNA, 22 nt, Human
auagacauagccguaauuuauu

SEQ ID NO: 47701 - RNA, 22 nt, Human
auaugggggggcgugcagagga

SEQ ID NO: 47702 - RNA, 22 nt, Human
auaugguaagaguauauuuacu

SEQ ID NO: 47703 - RNA, 22 nt, Human
auauguacacuuacguuacaaa

SEQ ID NO: 47704 - RNA, 22 nt, Human
auauguauagccagucuuuagg

SEQ ID NO: 47705 - RNA, 22 nt, Human
auauguccaccuguaugcuaaa

SEQ ID NO: 47706 - RNA, 22 nt, Human
auaugucgcuacaucauuagau

SEQ ID NO: 47707 - RNA, 22 nt, Human
auaugugaaguggguuauuuug

SEQ ID NO: 47708 - RNA, 22 nt, Human
auaugugaaugauaucacuuug

SEQ ID NO: 47709 - RNA, 22 nt, Human
auauguguacgugcaguauaua

SEQ ID NO: 47710 - RNA, 20 nt, Human
auauguguacguguauacau

SEQ ID NO: 47711 - RNA, 22 nt, Human
auauguguauuugguuagccua

SEQ ID NO: 47712 - RNA, 22 nt, Human
auaugugucgugcuacugccca

SEQ ID NO: 47713 - RNA, 22 nt, Human
auauguuagggaacaauuugag

SEQ ID NO: 47714 - RNA, 22 nt, Human
auauuaagaugcuauugguuuu

SEQ ID NO: 47715 - RNA, 22 nt, Human
auauuaauuauuuacacaugag

SEQ ID NO: 47716 - RNA, 22 nt, Human
auauuaggugcucaauacaugc

SEQ ID NO: 47717 - RNA, 22 nt, Human
auauuagguuggugcaaaagua

SEQ ID NO: 47718 - RNA, 22 nt, Human
auauuaugcuaagggaaauaag

SEQ ID NO: 47719 - RNA, 22 nt, Human
auauuauucuaguaacagugau

SEQ ID NO: 47720 - RNA, 22 nt, Human
auauuauuuucccuggaguugu

SEQ ID NO: 47721 - RNA, 22 nt, Human
auauucaagugaggauggcuaa

SEQ ID NO: 47722 - RNA, 22 nt, Human
auauuccuguuuuuaacacuuu

SEQ ID NO: 47723 - RNA, 22 nt, Human
auauucucugcugcuuuugugu

SEQ ID NO: 47724 - RNA, 22 nt, Human
auauugaacccuacagacugua

SEQ ID NO: 47725 - RNA, 20 nt, Human
auauugcaaggaagcuggau

SEQ ID NO: 47726 - RNA, 22 nt, Human
auauugcaauagaugcaucauu

SEQ ID NO: 47727 - RNA, 22 nt, Human
auagggcugccaucacagaaga

SEQ ID NO: 47728 - RNA, 22 nt, Human
auagguccaaggagaggucuuu

SEQ ID NO: 47729 - RNA, 22 nt, Human
auaggugugugguucauggccc

SEQ ID NO: 47730 - RNA, 22 nt, Human
auaguaacuggcauguuuauga

SEQ ID NO: 47731 - RNA, 22 nt, Human
auaguacauggguguccucaca

SEQ ID NO: 47732 - RNA, 22 nt, Human
auaguacuccaccaguacaugu

SEQ ID NO: 47733 - RNA, 22 nt, Human
auagucaaccuuguaauuagcc

SEQ ID NO: 47734 - RNA, 22 nt, Human
auagucacucuguuagguguuu

SEQ ID NO: 47735 - RNA, 22 nt, Human
auagucuuagaucagauaaagu

SEQ ID NO: 47736 - RNA, 21 nt, Human
auagugauagauaacugaguu

SEQ ID NO: 47737 - RNA, 22 nt, Human
auagugucagaaaaucauaaga

SEQ ID NO: 47738 - RNA, 22 nt, Human
auagugucuuucuucacaggca

SEQ ID NO: 47739 - RNA, 22 nt, Human
auaguguuguauguacagucug

SEQ ID NO: 47740 - RNA, 22 nt, Human
auaguuaugcucuagacaagaa

SEQ ID NO: 47741 - RNA, 22 nt, Human
auaguucacuaauagcaaaagc

SEQ ID NO: 47742 - RNA, 22 nt, Human
auaguuuaaggaacuaugcgau

SEQ ID NO: 47743 - RNA, 22 nt, Human
auaguuuccauugcugaccaaa

SEQ ID NO: 47744 - RNA, 22 nt, Human
auaguuugcuuuaauacaacug

SEQ ID NO: 47745 - RNA, 22 nt, Human
auaguuuugcugucagguccua

SEQ ID NO: 47746 - RNA, 22 nt, Human
auauaaagagcuuaguauagug

SEQ ID NO: 47747 - RNA, 22 nt, Human
auauaacauacauacagaaaag

SEQ ID NO: 47748 - RNA, 22 nt, Human
auauaaguguguggcuguuagu

SEQ ID NO: 47749 - RNA, 22 nt, Human
auauaaguuaguggucauguuu

SEQ ID NO: 47750 - RNA, 22 nt, Human
auauaaugauuuucuggugagu

SEQ ID NO: 47751 - RNA, 22 nt, Human
auauacacagagcuuaugguga

SEQ ID NO: 47752 - RNA, 22 nt, Human
auauacacaucuuuuuaaauau

SEQ ID NO: 47753 - RNA, 22 nt, Human
auauacacuguuucaguugaag

SEQ ID NO: 47754 - RNA, 22 nt, Human
auauacaguauguacugugguu

SEQ ID NO: 47755 - RNA, 20 nt, Human
auauaccaucccacaacagg

SEQ ID NO: 47756 - RNA, 22 nt, Human
auauacugaggagacuuuauau

SEQ ID NO: 47757 - RNA, 22 nt, Human
auauacuguaggccacuauaag

SEQ ID NO: 47758 - RNA, 22 nt, Human
auauacuguguuccauggacca

SEQ ID NO: 47759 - RNA, 22 nt, Human
auauagaauacacagggaaagu

SEQ ID NO: 47760 - RNA, 22 nt, Human
auauagaucaaaugaugcuaau

SEQ ID NO: 47761 - RNA, 22 nt, Human
auauagauuccaugguuccuuu

SEQ ID NO: 47762 - RNA, 19 nt, Human
auauagcauuauucaauuu

SEQ ID NO: 47763 - RNA, 22 nt, Human
auauagcugagggguauuauaa

SEQ ID NO: 47764 - RNA, 22 nt, Human
auauaggcagaaaggaaggcaa

SEQ ID NO: 47765 - RNA, 20 nt, Human
auauaggcauaguaaaauga

SEQ ID NO: 47766 - RNA, 22 nt, Human
auauaguuggguuucauucuac

SEQ ID NO: 47767 - RNA, 22 nt, Human
auauauaaccuggauaaggcuu

SEQ ID NO: 47768 - RNA, 22 nt, Human
auauauacuuugacacauucug

SEQ ID NO: 47769 - RNA, 22 nt, Human
auauauaucgaguucaugucuc

SEQ ID NO: 47770 - RNA, 22 nt, Human
auauaucugcaguacugaagaa

SEQ ID NO: 47771 - RNA, 22 nt, Human
auauaugaagaagucuugauua

SEQ ID NO: 47772 - RNA, 22 nt, Human
auauaugcauguguacuuaugu

SEQ ID NO: 47773 - RNA, 19 nt, Human
auauauguauacaaugugg

SEQ ID NO: 47774 - RNA, 22 nt, Human
auauaugugcaggcucacacau

SEQ ID NO: 47775 - RNA, 22 nt, Human
auauauuacaaaagaggaagga

SEQ ID NO: 47776 - RNA, 22 nt, Human
auauauuguaucuuucaugggg

SEQ ID NO: 47777 - RNA, 22 nt, Human
auauauuuugaauagccucugu

SEQ ID NO: 47778 - RNA, 22 nt, Human
auauauuuugcggucacguggc

SEQ ID NO: 47779 - RNA, 22 nt, Human
auauauuuuuugagacagaguc

SEQ ID NO: 47780 - RNA, 22 nt, Human
auaucaaacgaaguuauuuuaa

SEQ ID NO: 47781 - RNA, 22 nt, Human
auaucaaagcuaguggaaauuu

SEQ ID NO: 47782 - RNA, 22 nt, Human
auaucacaggaaaggaagauac

SEQ ID NO: 47783 - RNA, 22 nt, Human
auaucacagguguuuaccugau

SEQ ID NO: 47784 - RNA, 22 nt, Human
auaucauucugauguauaucuu

SEQ ID NO: 47785 - RNA, 22 nt, Human
auauccaccauucugcaccuuc

SEQ ID NO: 47786 - RNA, 22 nt, Human
auauccuuuucggaagagcagc

SEQ ID NO: 47787 - RNA, 22 nt, Human
auaucuaggcugaauguaaaau

SEQ ID NO: 47788 - RNA, 21 nt, Human
auaucuucuucaaaccacuca

SEQ ID NO: 47789 - RNA, 22 nt, Human
auaucuuggccccaggauuuua

SEQ ID NO: 47790 - RNA, 22 nt, Human
auaucuuuuagagcaagcuugu

SEQ ID NO: 47791 - RNA, 22 nt, Human
auaugaaaauguuuuagcugua

SEQ ID NO: 47792 - RNA, 22 nt, Human
auaugaaaguaagcaugugugu

SEQ ID NO: 47793 - RNA, 22 nt, Human
auaugacagaauguguguguau

SEQ ID NO: 47794 - RNA, 22 nt, Human
auaugagaauuggaaaauauca

SEQ ID NO: 47795 - RNA, 22 nt, Human
auaugaguugauuuuuagaaua

SEQ ID NO: 47796 - RNA, 22 nt, Human
auaugaguuucccacuucugga

SEQ ID NO: 47797 - RNA, 22 nt, Human
auaugauuccacuauuguaugg

SEQ ID NO: 47798 - RNA, 22 nt, Human
auaugauuguccuuagcaaauu

SEQ ID NO: 47799 - RNA, 22 nt, Human
auaugcacacucugcccacaga

SEQ ID NO: 47800 - RNA, 22 nt, Human
auaugcacauacauacauaggu

SEQ ID NO: 47801 - RNA, 22 nt, Human
auaugcacgcauacacacauaa

SEQ ID NO: 47802 - RNA, 22 nt, Human
auaugcauucauacuuagugga

SEQ ID NO: 47803 - RNA, 22 nt, Human
auaugcuauguauguaaaugag

SEQ ID NO: 47804 - RNA, 22 nt, Human
auaugcuuccaaguuauuccac

SEQ ID NO: 47805 - RNA, 22 nt, Human
auaugcuugacucuuucacauc

SEQ ID NO: 47806 - RNA, 22 nt, Human
auaugcuuugggauuagaucau

SEQ ID NO: 47807 - RNA, 22 nt, Human
auauggaagagccugggaauuu

SEQ ID NO: 47808 - RNA, 18 nt, Human
auauggaaugccuggcua

SEQ ID NO: 47809 - RNA, 22 nt, Human
auauggaaugguaaucuacaau

SEQ ID NO: 47810 - RNA, 22 nt, Human
aucuguguguugaguucucagc

SEQ ID NO: 47811 - RNA, 22 nt, Human
aucuguuauugaauaggugcua

SEQ ID NO: 47812 - RNA, 23 nt, Human
aucuguucaucugacacagauuc

SEQ ID NO: 47813 - RNA, 22 nt, Human
aucuguucuucaaaauauuaca

SEQ ID NO: 47814 - RNA, 22 nt, Human
aucuguuguuuuucaccaccca

SEQ ID NO: 47815 - RNA, 22 nt, Human
aucuuacauucccucaccauuu

SEQ ID NO: 47816 - RNA, 22 nt, Human
aucuuagaaguuugauaaaauc

SEQ ID NO: 47817 - RNA, 23 nt, Human
aucuuagcauagacuugaguccc

SEQ ID NO: 47818 - RNA, 22 nt, Human
aucuuaugagacccauaaagau

SEQ ID NO: 47819 - RNA, 22 nt, Human
aucuucaaagcacaucguuugu

SEQ ID NO: 47820 - RNA, 22 nt, Human
aucuucaacaacaaauugccuc

SEQ ID NO: 47821 - RNA, 22 nt, Human
aucuucaacucagagagugcug

SEQ ID NO: 47822 - RNA, 22 nt, Human
aucuucaacuuuggggcugccu

SEQ ID NO: 47823 - RNA, 22 nt, Human
aucuucaauauuuuuguguaga

SEQ ID NO: 47824 - RNA, 16 nt, Human
aucuuccaaaguuauu

SEQ ID NO: 47825 - RNA, 22 nt, Human
aucuucccaggcuggggagagg

SEQ ID NO: 47826 - RNA, 22 nt, Human
aucuucuauagauauucugaag

SEQ ID NO: 47827 - RNA, 22 nt, Human
aucuucuucaaggaucuggagc

SEQ ID NO: 47828 - RNA, 22 nt, Human
aucuugaagguucuaccauaca

SEQ ID NO: 47829 - RNA, 22 nt, Human
aucuugaaugaaugacucuuua

SEQ ID NO: 47830 - RNA, 22 nt, Human
aucuugaucaaggcuaucauga

SEQ ID NO: 47831 - RNA, 22 nt, Human
aucuugggaauuuuccaggagu

SEQ ID NO: 47832 - RNA, 18 nt, Human
aucuuguuuuuggauuaa

SEQ ID NO: 47833 - RNA, 22 nt, Human
aucuuuacaagaaauucuuuua

SEQ ID NO: 47834 - RNA, 22 nt, Human
aucuuuacaguguaagugcaga

SEQ ID NO: 47835 - RNA, 22 nt, Human
aucuuuagauuagaaacucuaa

SEQ ID NO: 47836 - RNA, 19 nt, Human
aucuuuagcaacuuucaaa

SEQ ID NO: 47837 - RNA, 22 nt, Human
aucuuuaggaaccuaaccuauu

SEQ ID NO: 47838 - RNA, 19 nt, Human
aucuuuagggauguggcuu

SEQ ID NO: 47839 - RNA, 22 nt, Human
aucuuuagucaggcguggguau

SEQ ID NO: 47840 - RNA, 22 nt, Human
aucuuugaugacuaaugcuuug

SEQ ID NO: 47841 - RNA, 22 nt, Human
aucuuuggaucgcucccccuuc

SEQ ID NO: 47842 - RNA, 22 nt, Human
aucuuugggcaaugaugaggga

SEQ ID NO: 47843 - RNA, 22 nt, Human
aucuuugguacuauucuuauca

SEQ ID NO: 47844 - RNA, 22 nt, Human
aucuuuguugcucucauuucug

SEQ ID NO: 47845 - RNA, 22 nt, Human
aucuuuuacauuacugcccaga

SEQ ID NO: 47846 - RNA, 22 nt, Human
aucuuuuaugagcguucugaca

SEQ ID NO: 47847 - RNA, 22 nt, Human
aucuuuuuaucuguuuggaaca

SEQ ID NO: 47848 - RNA, 22 nt, Human
augaaaaguucgaucuagaagg

SEQ ID NO: 47849 - RNA, 22 nt, Human
augaaaauguacauguguauaa

SEQ ID NO: 47850 - RNA, 22 nt, Human
augaaaauugacagcggaagua

SEQ ID NO: 47851 - RNA, 22 nt, Human
augaaacaaaccucuauggagu

SEQ ID NO: 47852 - RNA, 22 nt, Human
augaaacagaguacuuaauaua

SEQ ID NO: 47853 - RNA, 22 nt, Human
augaaacagugaauuagucaag

SEQ ID NO: 47854 - RNA, 23 nt, Human
augaaacaucacaaugguaccau

SEQ ID NO: 47855 - RNA, 22 nt, Human
augaaacaugagaaauggagag

SEQ ID NO: 47856 - RNA, 22 nt, Human
augaaagcacgugggaagauaa

SEQ ID NO: 47857 - RNA, 22 nt, Human
augaaagcucagugcacugaca

SEQ ID NO: 47858 - RNA, 22 nt, Human
augaaaguaccuguaauauguu

SEQ ID NO: 47859 - RNA, 23 nt, Human
augaaaguucuuaaaaugucaug

SEQ ID NO: 47860 - RNA, 22 nt, Human
augaaaugagucaaugcgacua

SEQ ID NO: 47861 - RNA, 23 nt, Human
augaaaugauacuuuauucacug

SEQ ID NO: 47862 - RNA, 22 nt, Human
cagaggucuccaucacccuccu

SEQ ID NO: 47863 - RNA, 22 nt, Human
cagaggucugaugcgucccugc

SEQ ID NO: 47864 - RNA, 22 nt, Human
cagaggugcauacaggucauua

SEQ ID NO: 47865 - RNA, 22 nt, Human
cagaguacauaggagcaaauca

SEQ ID NO: 47866 - RNA, 22 nt, Human
cagaguaucccuuuagaauuaa

SEQ ID NO: 47867 - RNA, 22 nt, Human
cagagucaauguccaagaagcu

SEQ ID NO: 47868 - RNA, 22 nt, Human
cagagucagcuagucuugggau

SEQ ID NO: 47869 - RNA, 22 nt, Human
cagagucauaucagagaauaug

SEQ ID NO: 47870 - RNA, 22 nt, Human
cagagucauugacuuccaggag

SEQ ID NO: 47871 - RNA, 22 nt, Human
cagaguccugcaccagcuccag

SEQ ID NO: 47872 - RNA, 22 nt, Human
cagagucuggacugcaggcucc

SEQ ID NO: 47873 - RNA, 17 nt, Human
cagagucugucugcauc

SEQ ID NO: 47874 - RNA, 22 nt, Human
cagagugaacagugggaugugc

SEQ ID NO: 47875 - RNA, 22 nt, Human
cagagugagggccugcaccugc

SEQ ID NO: 47876 - RNA, 22 nt, Human
cagagugauaaauauagaaauu

SEQ ID NO: 47877 - RNA, 22 nt, Human
cagaguggaguuuuucagcggg

SEQ ID NO: 47878 - RNA, 22 nt, Human
cagaguggcgacccccucagcu

SEQ ID NO: 47879 - RNA, 18 nt, Human
cagagugggccaagagac

SEQ ID NO: 47880 - RNA, 16 nt, Human
cagaguguaaacagga

SEQ ID NO: 47881 - RNA, 22 nt, Human
cagaguguuucuuugggugggu

SEQ ID NO: 47882 - RNA, 22 nt, Human
cagaguuuaaacaaaugaaaua

SEQ ID NO: 47883 - RNA, 22 nt, Human
cagaguuucgguaagcauagaa

SEQ ID NO: 47884 - RNA, 22 nt, Human
cagauaaauagauagauaaacu

SEQ ID NO: 47885 - RNA, 22 nt, Human
cagauaauccaaguaguuuuca

SEQ ID NO: 47886 - RNA, 22 nt, Human
cagauacagcuagcuccguggc

SEQ ID NO: 47887 - RNA, 22 nt, Human
cagauacuguaaaauuucagua

SEQ ID NO: 47888 - RNA, 22 nt, Human
cagauagaaugcaagaccucuc

SEQ ID NO: 47889 - RNA, 22 nt, Human
cagauauaaauggaugugguag

SEQ ID NO: 47890 - RNA, 22 nt, Human
cagauauauuuuauuuggucaa

SEQ ID NO: 47891 - RNA, 22 nt, Human
cagauaugcugagacuccugug

SEQ ID NO: 47892 - RNA, 22 nt, Human
cagauauuaggagcucaauaau

SEQ ID NO: 47893 - RNA, 22 nt, Human
cagaucaaacaaaauggguuag

SEQ ID NO: 47894 - RNA, 22 nt, Human
cagaucauaacagauacauaga

SEQ ID NO: 47895 - RNA, 22 nt, Human
cagaucaugggacugucucagc

SEQ ID NO: 47896 - RNA, 22 nt, Human
cagauccacccuuguagugaca

SEQ ID NO: 47897 - RNA, 22 nt, Human
cagaucuagagcuuuuccaucu

SEQ ID NO: 47898 - RNA, 22 nt, Human
cagaucugagccaagcucgaug

SEQ ID NO: 47899 - RNA, 22 nt, Human
cagaucugcuccucuguccaug

SEQ ID NO: 47900 - RNA, 22 nt, Human
cagaucuguaguaaaagaucuc

SEQ ID NO: 47901 - RNA, 22 nt, Human
cagaugaagaucauagaauagu

SEQ ID NO: 47902 - RNA, 22 nt, Human
cagaugaaguuugccuagagcu

SEQ ID NO: 47903 - RNA, 18 nt, Human
cagaugagaugcaaucuc

SEQ ID NO: 47904 - RNA, 22 nt, Human
cagaugaggcaaccucauugcu

SEQ ID NO: 47905 - RNA, 23 nt, Human
cagaugagguuggcagcaugguc

SEQ ID NO: 47906 - RNA, 22 nt, Human
cagaugcaggucugcucaccug

SEQ ID NO: 47907 - RNA, 22 nt, Human
cagaugcuuuugauucuggggu

SEQ ID NO: 47908 - RNA, 22 nt, Human
cagauggaaggcauagagguuu

SEQ ID NO: 47909 - RNA, 22 nt, Human
cagauggaggauaaaacaugca

SEQ ID NO: 47910 - RNA, 22 nt, Human
cagauggcacagauuuagagug

SEQ ID NO: 47911 - RNA, 22 nt, Human
cagauggcauuuccuuucuggc

SEQ ID NO: 47912 - RNA, 19 nt, Human
cagauggccaccuacuugc

SEQ ID NO: 47913 - RNA, 22 nt, Human
cagauguaaucugacagcugga

SEQ ID NO: 47914 - RNA, 22 nt, Human
cagauguaauuacucaagucaa

SEQ ID NO: 47915 - RNA, 22 nt, Human
cagauguacaugaagggcaaug

SEQ ID NO: 47916 - RNA, 22 nt, Human
cagauuaagugcucaacagugu

SEQ ID NO: 47917 - RNA, 22 nt, Human
cagauucugcagucaacuugcu

SEQ ID NO: 47918 - RNA, 22 nt, Human
cagauucuucauugccccauuc

SEQ ID NO: 47919 - RNA, 22 nt, Human
auggccucuagcugagaccaau

SEQ ID NO: 47920 - RNA, 22 nt, Human
auggccugaugcaccuguccca

SEQ ID NO: 47921 - RNA, 22 nt, Human
auggccugcagugcugccacag

SEQ ID NO: 47922 - RNA, 22 nt, Human
auggcuaauacgccacuggaca

SEQ ID NO: 47923 - RNA, 18 nt, Human
auggcucaggaauggcuu

SEQ ID NO: 47924 - RNA, 21 nt, Human
auggcucaggccaucaaugga

SEQ ID NO: 47925 - RNA, 22 nt, Human
auggcuccauccuguugcuagu

SEQ ID NO: 47926 - RNA, 22 nt, Human
auggcucucuagggcccagguu

SEQ ID NO: 47927 - RNA, 22 nt, Human
auggcucucuccuuacugcugc

SEQ ID NO: 47928 - RNA, 22 nt, Human
auggcucucuugaccuaggcac

SEQ ID NO: 47929 - RNA, 19 nt, Human
auggcucugggaucacugc

SEQ ID NO: 47930 - RNA, 22 nt, Human
auggcugcagagaccugaagaa

SEQ ID NO: 47931 - RNA, 22 nt, Human
auggcugcagccggcccugcgc

SEQ ID NO: 47932 - RNA, 22 nt, Human
auggcugcccacguuggugcuu

SEQ ID NO: 47933 - RNA, 22 nt, Human
auggcugccccaaauuguugcu

SEQ ID NO: 47934 - RNA, 22 nt, Human
auggcugccuagaggugagaug

SEQ ID NO: 47935 - RNA, 22 nt, Human
auggcugccuuaauucuucagc

SEQ ID NO: 47936 - RNA, 22 nt, Human
auggcugcucuggauggagucc

SEQ ID NO: 47937 - RNA, 22 nt, Human
auggcuggcacuggccuggguu

SEQ ID NO: 47938 - RNA, 22 nt, Human
auggcuggcauccaggugggcu

SEQ ID NO: 47939 - RNA, 22 nt, Human
auggcugggauuuccuuugcgu

SEQ ID NO: 47940 - RNA, 22 nt, Human
auggcuggucucccauggaaaa

SEQ ID NO: 47941 - RNA, 22 nt, Human
auggcuggugauacuggaguga

SEQ ID NO: 47942 - RNA, 21 nt, Human
auggcugguggcucagccucc

SEQ ID NO: 47943 - RNA, 22 nt, Human
auggcuguagucaucugaaggc

SEQ ID NO: 47944 - RNA, 22 nt, Human
auggcugugaaggucacacccu

SEQ ID NO: 47945 - RNA, 22 nt, Human
auggcugugagacaaagagcug

SEQ ID NO: 47946 - RNA, 19 nt, Human
auggcuguguuccaguaaa

SEQ ID NO: 47947 - RNA, 22 nt, Human
auggcuguuuugugacuucuca

SEQ ID NO: 47948 - RNA, 22 nt, Human
auggcuuaugaauaacaguagg

SEQ ID NO: 47949 - RNA, 22 nt, Human
auggcuuccaaggcccuccgug

SEQ ID NO: 47950 - RNA, 22 nt, Human
auggcuucgaguauauacauag

SEQ ID NO: 47951 - RNA, 22 nt, Human
auggcuucuagcauugucacaa

SEQ ID NO: 47952 - RNA, 18 nt, Human
auggcuucugaguggagg

SEQ ID NO: 47953 - RNA, 22 nt, Human
auggcuucugucuuggaaacuu

SEQ ID NO: 47954 - RNA, 22 nt, Human
auggcuugauagaaagcuaguu

SEQ ID NO: 47955 - RNA, 22 nt, Human
auggcuuuguuccaauaaaacu

SEQ ID NO: 47956 - RNA, 22 nt, Human
augggacacguuuuaaggaaaa

SEQ ID NO: 47957 - RNA, 22 nt, Human
augggagaggguaggaauuacu

SEQ ID NO: 47958 - RNA, 22 nt, Human
augggagccaucgcauuugcug

SEQ ID NO: 47959 - RNA, 22 nt, Human
augggaggaucacuugaggcca

SEQ ID NO: 47960 - RNA, 22 nt, Human
augggaggcagacacuaaguuc

SEQ ID NO: 47961 - RNA, 22 nt, Human
augggaggcagcagagcccagc

SEQ ID NO: 47962 - RNA, 22 nt, Human
augggagugugguuagagaccu

SEQ ID NO: 47963 - RNA, 22 nt, Human
augggaugaucaccugagcuca

SEQ ID NO: 47964 - RNA, 22 nt, Human
augggcagacagggagcucacg

SEQ ID NO: 47965 - RNA, 22 nt, Human
augggcagaguggggacaggaa

SEQ ID NO: 47966 - RNA, 22 nt, Human
augggcaggcacuggcucucag

SEQ ID NO: 47967 - RNA, 22 nt, Human
augggcaggccucucauuucug

SEQ ID NO: 47968 - RNA, 22 nt, Human
augggcagggcaguguauaaga

SEQ ID NO: 47969 - RNA, 18 nt, Human
augggcagguaagaucca

SEQ ID NO: 47970 - RNA, 22 nt, Human
augggcaguaacaguggcaguc

SEQ ID NO: 47971 - RNA, 16 nt, Human
augggcagugaggaag

SEQ ID NO: 47972 - RNA, 22 nt, Human
augggccaaguaaacauucuca

SEQ ID NO: 47973 - RNA, 22 nt, Human
augggccacacacgauugggug

SEQ ID NO: 47974 - RNA, 22 nt, Human
augggccagcaccauguuaagc

SEQ ID NO: 47975 - RNA, 22 nt, Human
augggccaggcuugggaugaca

SEQ ID NO: 47976 - RNA, 21 nt, Human
augggccagggauacagagag

SEQ ID NO: 47977 - RNA, 22 nt, Human
augggccuguuccuaugcuggu

SEQ ID NO: 47978 - RNA, 22 nt, Human
augggcugaaagaguaagcugu

SEQ ID NO: 47979 - RNA, 22 nt, Human
augggcugacccagucguggca

SEQ ID NO: 47980 - RNA, 22 nt, Human
cagcagcagacauuugaucuuc

SEQ ID NO: 47981 - RNA, 22 nt, Human
cagcagcagccccaggaagguu

SEQ ID NO: 47982 - RNA, 22 nt, Human
cagcagcaguggcugcagaaca

SEQ ID NO: 47983 - RNA, 22 nt, Human
cagcagcaugaauucgagccac

SEQ ID NO: 47984 - RNA, 22 nt, Human
cagcagcauugcucuggauucc

SEQ ID NO: 47985 - RNA, 20 nt, Human
cagcagccaaacuucuauuc

SEQ ID NO: 47986 - RNA, 22 nt, Human
cagcagccacuagagggcucac

SEQ ID NO: 47987 - RNA, 22 nt, Human
cagcagccauguaccacacuca

SEQ ID NO: 47988 - RNA, 22 nt, Human
cagcagccgagagggggcucug

SEQ ID NO: 47989 - RNA, 22 nt, Human
cagcagccucaaguuuauuuuc

SEQ ID NO: 47990 - RNA, 22 nt, Human
cagcagccuccacucgccccac

SEQ ID NO: 47991 - RNA, 22 nt, Human
cagcagccugccuugggagcuu

SEQ ID NO: 47992 - RNA, 22 nt, Human
cagcagcuaccugcucuugugg

SEQ ID NO: 47993 - RNA, 22 nt, Human
cagcagcugcaaauggaaacag

SEQ ID NO: 47994 - RNA, 23 nt, Human
cagcagcugccugguuuuuuggu

SEQ ID NO: 47995 - RNA, 22 nt, Human
cagcagcugguuauaccugugg

SEQ ID NO: 47996 - RNA, 22 nt, Human
cagcaggacccaggaauccugc

SEQ ID NO: 47997 - RNA, 22 nt, Human
cagcaggacguccaagugcuau

SEQ ID NO: 47998 - RNA, 22 nt, Human
cagcaggauaugguggagagag

SEQ ID NO: 47999 - RNA, 22 nt, Human
cagcaggauuugaaaggaagag

SEQ ID NO: 48000 - RNA, 22 nt, Human
cagcaggcaggugggccaaguc

SEQ ID NO: 48001 - RNA, 22 nt, Human
cagcaggcucugaguggcugcc

SEQ ID NO: 48002 - RNA, 22 nt, Human
cagcagggcccccgggugcgcc

SEQ ID NO: 48003 - RNA, 22 nt, Human
cagcaggggugucauuguaguu

SEQ ID NO: 48004 - RNA, 22 nt, Human
cagcaggguuaagugacucacc

SEQ ID NO: 48005 - RNA, 22 nt, Human
cagcaggugcugccugucaccc

SEQ ID NO: 48006 - RNA, 22 nt, Human
cagcagguggacacacucaccu

SEQ ID NO: 48007 - RNA, 22 nt, Human
cagcagguucuacgggugagau

SEQ ID NO: 48008 - RNA, 22 nt, Human
cagcaguagucucuguggcuuu

SEQ ID NO: 48009 - RNA, 22 nt, Human
cagcagucaggcaaaugggagg

SEQ ID NO: 48010 - RNA, 22 nt, Human
cagcagucccugcaguggggaa

SEQ ID NO: 48011 - RNA, 22 nt, Human
cagcaguggaacuacccaggga

SEQ ID NO: 48012 - RNA, 22 nt, Human
cagcaguguacaaggugucaga

SEQ ID NO: 48013 - RNA, 22 nt, Human
cagcagugucuccagcaucaca

SEQ ID NO: 48014 - RNA, 21 nt, Human
cagcagugugucugagcuaga

SEQ ID NO: 48015 - RNA, 22 nt, Human
cagcaguugaaauugacaugug

SEQ ID NO: 48016 - RNA, 22 nt, Human
cagcaguuuccuaugguucagc

SEQ ID NO: 48017 - RNA, 22 nt, Human
cagcaguuuugaaguguggaga

SEQ ID NO: 48018 - RNA, 22 nt, Human
cagcauaggacaggguuucauc

SEQ ID NO: 48019 - RNA, 22 nt, Human
cagcaucccagagcccagagcu

SEQ ID NO: 48020 - RNA, 22 nt, Human
cagcaucucacuucccagaagg

SEQ ID NO: 48021 - RNA, 22 nt, Human
cagcaucuccugugcagaggga

SEQ ID NO: 48022 - RNA, 22 nt, Human
cagcaucuggauuuccuccacu

SEQ ID NO: 48023 - RNA, 22 nt, Human
cagcaucuguauccuaggcuga

SEQ ID NO: 48024 - RNA, 22 nt, Human
cagcaucuguucccaacgagau

SEQ ID NO: 48025 - RNA, 22 nt, Human
cagcaucuguuggauggauaag

SEQ ID NO: 48026 - RNA, 22 nt, Human
cagcaucuuucucuucuggagu

SEQ ID NO: 48027 - RNA, 22 nt, Human
cagcaugacagucugcagcaga

SEQ ID NO: 48028 - RNA, 22 nt, Human
ucaguaguuuugaucugagcag

SEQ ID NO: 48029 - RNA, 22 nt, Human
ucaguauagcuucuaaacuaac

SEQ ID NO: 48030 - RNA, 22 nt, Human
ucaguaucuacuaucuugauga

SEQ ID NO: 48031 - RNA, 22 nt, Human
ucagucaugaccauggggugga

SEQ ID NO: 48032 - RNA, 21 nt, Human
ucagucauugccuccuucugg

SEQ ID NO: 48033 - RNA, 22 nt, Human
ucaguccacuaagacccuuguu

SEQ ID NO: 48034 - RNA, 22 nt, Human
ucaguccaggauugggagugac

SEQ ID NO: 48035 - RNA, 22 nt, Human
ucaguccccagaugugugcugu

SEQ ID NO: 48036 - RNA, 22 nt, Human
ucagucccuaaggauaugggcu

SEQ ID NO: 48037 - RNA, 21 nt, Human
ucagucccuggguguguccca

SEQ ID NO: 48038 - RNA, 22 nt, Human
ucagucccuuaaagguggcagc

SEQ ID NO: 48039 - RNA, 22 nt, Human
ucagucccuucuccaggucagc

SEQ ID NO: 48040 - RNA, 22 nt, Human
ucaguccuauccaaacuauaua

SEQ ID NO: 48041 - RNA, 22 nt, Human
ucaguccucacuugguucuaag

SEQ ID NO: 48042 - RNA, 23 nt, Human
ucaguccuguaggggcuccaggu

SEQ ID NO: 48043 - RNA, 21 nt, Human
ucaguccuguuagccuuuggg

SEQ ID NO: 48044 - RNA, 22 nt, Human
ucagucucuggggcuucuguuu

SEQ ID NO: 48045 - RNA, 17 nt, Human
ucagucucuguccugga

SEQ ID NO: 48046 - RNA, 23 nt, Human
ucagucuucccugucaguaauag

SEQ ID NO: 48047 - RNA, 22 nt, Human
ucagucuucuagcaaauccagg

SEQ ID NO: 48048 - RNA, 22 nt, Human
ucagucuugcuucucuuggguc

SEQ ID NO: 48049 - RNA, 22 nt, Human
ucagucuuucccucccucaguu

SEQ ID NO: 48050 - RNA, 22 nt, Human
ucagucuuugcuuaugacaaua

SEQ ID NO: 48051 - RNA, 22 nt, Human
ucagugaaaugcauauucuucg

SEQ ID NO: 48052 - RNA, 22 nt, Human
ucagugaaccuucuguggcagg

SEQ ID NO: 48053 - RNA, 20 nt, Human
ucagugauuaucucugagug

SEQ ID NO: 48054 - RNA, 23 nt, Human
ucagugcaaaaauaggauuuugg

SEQ ID NO: 48055 - RNA, 22 nt, Human
ucagugcagggugggagagaga

SEQ ID NO: 48056 - RNA, 22 nt, Human
ucagugcaucacagaacuuugu

SEQ ID NO: 48057 - RNA, 22 nt, Human
ucagugccaauucugccauggg

SEQ ID NO: 48058 - RNA, 22 nt, Human
ucagugccaguuugcuccuucu

SEQ ID NO: 48059 - RNA, 22 nt, Human
ucagugcucaggggagccgagg

SEQ ID NO: 48060 - RNA, 22 nt, Human
ucagugcuuauauucugagccu

SEQ ID NO: 48061 - RNA, 22 nt, Human
ucagugcuuuugagaagcuccu

SEQ ID NO: 48062 - RNA, 22 nt, Human
ucaguggucuaggcaauauaua

SEQ ID NO: 48063 - RNA, 22 nt, Human
ucaguggucuuggcugauuguu

SEQ ID NO: 48064 - RNA, 21 nt, Human
ucaguguauuuaagaauguug

SEQ ID NO: 48065 - RNA, 22 nt, Human
ucagugucacaggaugcuaugc

SEQ ID NO: 48066 - RNA, 22 nt, Human
ucagugucauaucaagaagaug

SEQ ID NO: 48067 - RNA, 22 nt, Human
ucaguguccggagccugagugc

SEQ ID NO: 48068 - RNA, 22 nt, Human
ucagugucuauagauaagguuu

SEQ ID NO: 48069 - RNA, 22 nt, Human
ucagugucugugggcaggaugg

SEQ ID NO: 48070 - RNA, 22 nt, Human
ucagugucuucucuuuccuacc

SEQ ID NO: 48071 - RNA, 22 nt, Human
ucagugugacugauggcuuuau

SEQ ID NO: 48072 - RNA, 22 nt, Human
ucagugugaggucuuccacccg

SEQ ID NO: 48073 - RNA, 22 nt, Human
ucagugugaguaccaugcucag

SEQ ID NO: 48074 - RNA, 23 nt, Human
ucagugugcaagaauggagaagc

SEQ ID NO: 48075 - RNA, 22 nt, Human
ucaguguggguaagcaugcugu

SEQ ID NO: 48076 - RNA, 22 nt, Human
ucaguguguuauucuacuuuca

SEQ ID NO: 48077 - RNA, 22 nt, Human
ucaguguuaaucagugguaccu

SEQ ID NO: 48078 - RNA, 22 nt, Human
ucaguguuagacaaguuuggaa

SEQ ID NO: 48079 - RNA, 22 nt, Human
ucaguguucuggauuuggggca

SEQ ID NO: 48080 - RNA, 22 nt, Human
ucaguguucuuauuuaauuagg

SEQ ID NO: 48081 - RNA, 22 nt, Human
ucaguguuggagauaauugcac

SEQ ID NO: 48082 - RNA, 22 nt, Human
ucaguguuggucaagaaucagu

SEQ ID NO: 48083 - RNA, 22 nt, Human
ucaguguuuacaugcauccuug

SEQ ID NO: 48084 - RNA, 22 nt, Human
ucaguguuuccuagagcauaua

SEQ ID NO: 48085 - RNA, 22 nt, Human
ucaguguuuccugugguacagc

SEQ ID NO: 48086 - RNA, 22 nt, Human
ucaguuaacaacuauuuauuga

SEQ ID NO: 48087 - RNA, 20 nt, Human
ucaguuaaguugcugaaucu

SEQ ID NO: 48088 - RNA, 22 nt, Human
ucaguuaauauggguaaagcau

SEQ ID NO: 48089 - RNA, 22 nt, Human
ucaguuaccugacagugguuau

SEQ ID NO: 48090 - RNA, 22 nt, Human
ucaguuacucaacagaggugga

SEQ ID NO: 48091 - RNA, 22 nt, Human
ucaguuacucugauguccugug

SEQ ID NO: 48092 - RNA, 22 nt, Human
ucaguuagggccucagaagaca

SEQ ID NO: 48093 - RNA, 23 nt, Human
ucaguuauuggugauaaagcugg

SEQ ID NO: 48094 - RNA, 22 nt, Human
ucaguucaguauacacuauucu

SEQ ID NO: 48095 - RNA, 21 nt, Human
ucaguuccuaagggaggccgc

SEQ ID NO: 48096 - RNA, 22 nt, Human
ucaguucuaagugcuuuacaug

SEQ ID NO: 48097 - RNA, 22 nt, Human
ucaguucugcuagaaaaacagu

SEQ ID NO: 48098 - RNA, 22 nt, Human
ucaguugcaugggaaguucaga

SEQ ID NO: 48099 - RNA, 22 nt, Human
ucaguugcuagaagggggaacc

SEQ ID NO: 48100 - RNA, 22 nt, Human
ucaguugcuguguaauguuuuc

SEQ ID NO: 48101 - RNA, 22 nt, Human
ucaguuuagaguuauuuaaucu

SEQ ID NO: 48102 - RNA, 22 nt, Human
ucaguuuauagauauugcugau

SEQ ID NO: 48103 - RNA, 22 nt, Human
ucaguuuccugguuuugacauu

SEQ ID NO: 48104 - RNA, 22 nt, Human
ucaguuucuccaucgcuccagu

SEQ ID NO: 48105 - RNA, 22 nt, Human
ucaguuucuuuacucauagaau

SEQ ID NO: 48106 - RNA, 22 nt, Human
ucaguuugaauguuagcacagu

SEQ ID NO: 48107 - RNA, 22 nt, Human
ucaguuuuuaaaugauauaauu

SEQ ID NO: 48108 - RNA, 22 nt, Human
ucaguuuuuaagaguuaugcga

SEQ ID NO: 48109 - RNA, 22 nt, Human
ucauaaaaguacucauguucau

SEQ ID NO: 48110 - RNA, 22 nt, Human
ucauaaagauacuaagugaguu

SEQ ID NO: 48111 - RNA, 22 nt, Human
ucauaaagcucuuccaaaugua

SEQ ID NO: 48112 - RNA, 22 nt, Human
ucauaaagugaaggaugauggg

SEQ ID NO: 48113 - RNA, 22 nt, Human
ucauaaaguuacccaaauuuua

SEQ ID NO: 48114 - RNA, 22 nt, Human
ucauaaauauuugugggggcuu

SEQ ID NO: 48115 - RNA, 22 nt, Human
ucauaaaugcagugucauaaau

SEQ ID NO: 48116 - RNA, 22 nt, Human
ucauaaauuaucuauuuggcua

SEQ ID NO: 48117 - RNA, 22 nt, Human
ucauaacacuggugauuaagaa

SEQ ID NO: 48118 - RNA, 22 nt, Human
ucauaacaggcugagaggauuu

SEQ ID NO: 48119 - RNA, 22 nt, Human
ucauaauuguauacauuuaugg

SEQ ID NO: 48120 - RNA, 22 nt, Human
ucauacaacuaagaguuucaga

SEQ ID NO: 48121 - RNA, 22 nt, Human
ucauacaagaucacuuuggcca

SEQ ID NO: 48122 - RNA, 22 nt, Human
ucauacacaagagcauguaaca

SEQ ID NO: 48123 - RNA, 20 nt, Human
ucauacacaugagcaugcag

SEQ ID NO: 48124 - RNA, 22 nt, Human
ucauagaaauggaaaguauauu

SEQ ID NO: 48125 - RNA, 22 nt, Human
ucauagaagcaccagaagauau

SEQ ID NO: 48126 - RNA, 22 nt, Human
ucauagaagcacucagcucccu

SEQ ID NO: 48127 - RNA, 22 nt, Human
ucauagaugugcugugcacaaa

SEQ ID NO: 48128 - RNA, 22 nt, Human
ucauaguuauggagauuaagga

SEQ ID NO: 48129 - RNA, 22 nt, Human
ucauauaagagcuuuagaguca

SEQ ID NO: 48130 - RNA, 22 nt, Human
ucauauacugccuuguagauua

SEQ ID NO: 48131 - RNA, 22 nt, Human
ucauauuuauauguuggcacag

SEQ ID NO: 48132 - RNA, 22 nt, Human
ucauauuucaaaauggcuggag

SEQ ID NO: 48133 - RNA, 22 nt, Human
ucaucaaaggauugcaugauuu

SEQ ID NO: 48134 - RNA, 22 nt, Human
ucaucacaauuuuaugacccuc

SEQ ID NO: 48135 - RNA, 22 nt, Human
ucaucacauguguagucauccc

SEQ ID NO: 48136 - RNA, 22 nt, Human
ucaucacuguaucauugauaga

SEQ ID NO: 48137 - RNA, 22 nt, Human
gggagcaguuaaaaugauuccu

SEQ ID NO: 48138 - RNA, 22 nt, Human
gggagccaaggagagaggccuu

SEQ ID NO: 48139 - RNA, 22 nt, Human
gggagccagccauccagaaccu

SEQ ID NO: 48140 - RNA, 22 nt, Human
gggagccccaccucggugcccg

SEQ ID NO: 48141 - RNA, 22 nt, Human
gggagcuauuuauagaggcuga

SEQ ID NO: 48142 - RNA, 21 nt, Human
gggagcugacagcagcacggc

SEQ ID NO: 48143 - RNA, 22 nt, Human
gggagcugaccugcagguuccc

SEQ ID NO: 48144 - RNA, 22 nt, Human
gggagcugagggaccucugugg

SEQ ID NO: 48145 - RNA, 22 nt, Human
gggagcugccaccaccccuggg

SEQ ID NO: 48146 - RNA, 21 nt, Human
gggagcuggaaacugggugac

SEQ ID NO: 48147 - RNA, 20 nt, Human
gggagcuggaauugucuuag

SEQ ID NO: 48148 - RNA, 22 nt, Human
gggagcuggaucgcgcgcccgg

SEQ ID NO: 48149 - RNA, 22 nt, Human
gggagcuggccuacuauuagau

SEQ ID NO: 48150 - RNA, 22 nt, Human
gggagcuggcggauuccccagg

SEQ ID NO: 48151 - RNA, 22 nt, Human
gggagcuguaguccagauaccg

SEQ ID NO: 48152 - RNA, 22 nt, Human
gggagcugucaucaguguuguc

SEQ ID NO: 48153 - RNA, 23 nt, Human
gggagcuguggugaaaagaggug

SEQ ID NO: 48154 - RNA, 22 nt, Human
gggaggaaagagaaguggucca

SEQ ID NO: 48155 - RNA, 21 nt, Human
gggaggaagcugcuucucucu

SEQ ID NO: 48156 - RNA, 22 nt, Human
gggaggaaugcaacuuauuuag

SEQ ID NO: 48157 - RNA, 22 nt, Human
gggaggacgguccagggcaaag

SEQ ID NO: 48158 - RNA, 22 nt, Human
ucauccugaagaaccugcuucc

SEQ ID NO: 48159 - RNA, 22 nt, Human
ucauccuuuugcaugggaaggc

SEQ ID NO: 48160 - RNA, 22 nt, Human
ucaucucaaaacccaaggggca

SEQ ID NO: 48161 - RNA, 22 nt, Human
ucaucucuagacaggaggcugg

SEQ ID NO: 48162 - RNA, 22 nt, Human
ucaucucuuuuguauugggguu

SEQ ID NO: 48163 - RNA, 22 nt, Human
ucaucugaaauuguauauguag

SEQ ID NO: 48164 - RNA, 22 nt, Human
ucaucugaccacuuuaucucuc

SEQ ID NO: 48165 - RNA, 22 nt, Human
ucaucugaggcaccagagcaua

SEQ ID NO: 48166 - RNA, 22 nt, Human
ucaucugagguuugaggcaguu

SEQ ID NO: 48167 - RNA, 23 nt, Human
ucaucuguaacagccuaugaaau

SEQ ID NO: 48168 - RNA, 22 nt, Human
ucaucugucccaggcuuuuuuc

SEQ ID NO: 48169 - RNA, 22 nt, Human
ucaucugucugagagacuucug

SEQ ID NO: 48170 - RNA, 22 nt, Human
ucaucuguuauuuaugccugag

SEQ ID NO: 48171 - RNA, 22 nt, Human
ucaucuguucauacacaugcgu

SEQ ID NO: 48172 - RNA, 22 nt, Human
ucaucuuaggugaugagacagu

SEQ ID NO: 48173 - RNA, 22 nt, Human
ucaucuuccucauuucuccagg

SEQ ID NO: 48174 - RNA, 22 nt, Human
ucaucuuuaccccuugcuucaa

SEQ ID NO: 48175 - RNA, 22 nt, Human
ucaugaaaauagaucagaaauu

SEQ ID NO: 48176 - RNA, 20 nt, Human
ucaugaagccuacaaacauc

SEQ ID NO: 48177 - RNA, 22 nt, Human
ucaugaaucguggaaugauuua

SEQ ID NO: 48178 - RNA, 22 nt, Human
ucaugacaucuguuuaucucaa

SEQ ID NO: 48179 - RNA, 18 nt, Human
ucaugaggaaggagaaga

SEQ ID NO: 48180 - RNA, 22 nt, Human
ucaugaguggauuaauauggcu

SEQ ID NO: 48181 - RNA, 22 nt, Human
ucaugauuuccugguuaaggac

SEQ ID NO: 48182 - RNA, 22 nt, Human
ucaugcaacaacacauucuggc

SEQ ID NO: 48183 - RNA, 22 nt, Human
ucaugcaaggcugaaacauggu

SEQ ID NO: 48184 - RNA, 19 nt, Human
ucaugcaaucagugaacug

SEQ ID NO: 48185 - RNA, 22 nt, Human
ucaugcaaugagucaggaggca

SEQ ID NO: 48186 - RNA, 19 nt, Human
ucaugcacuuugauguaac

SEQ ID NO: 48187 - RNA, 23 nt, Human
ucaugcagccuggaaccucccag

SEQ ID NO: 48188 - RNA, 22 nt, Human
ucaugcaggaccaccccagcau

SEQ ID NO: 48189 - RNA, 22 nt, Human
ucaugcaggcagccuuuaguaa

SEQ ID NO: 48190 - RNA, 22 nt, Human
ucaugccagcuuugcuuguccc

SEQ ID NO: 48191 - RNA, 17 nt, Human
ucaugcccaacuauuac

SEQ ID NO: 48192 - RNA, 22 nt, Human
ucaugccugauuauguuacuca

SEQ ID NO: 48193 - RNA, 21 nt, Human
ucauggaaguaacaaacauau

SEQ ID NO: 48194 - RNA, 22 nt, Human
ucauggauggccgggaggugau

SEQ ID NO: 48195 - RNA, 22 nt, Human
ucauggcacuuagugucucaaa

SEQ ID NO: 48196 - RNA, 22 nt, Human
ucauggcauuguuaaggguuuu

SEQ ID NO: 48197 - RNA, 22 nt, Human
ucauggcuaaugcaguauauuc

SEQ ID NO: 48198 - RNA, 22 nt, Human
ucauggcugaaacaguaacaca

SEQ ID NO: 48199 - RNA, 20 nt, Human
ucauggcugcugagagguuc

SEQ ID NO: 48200 - RNA, 22 nt, Human
ucauggggaaagcccgcccuca

SEQ ID NO: 48201 - RNA, 22 nt, Human
ucaugggugcuccagguggcug

SEQ ID NO: 48202 - RNA, 22 nt, Human
ucaugguucaugaguguccuuu

SEQ ID NO: 48203 - RNA, 22 nt, Human
ucauguaaguauagaaagcagu

SEQ ID NO: 48204 - RNA, 21 nt, Human
ucauguaaugcaugaaguaaa

SEQ ID NO: 48205 - RNA, 22 nt, Human
ucauguacauguaagucagaaa

SEQ ID NO: 48206 - RNA, 22 nt, Human
ucauguauuugugauagaugac

SEQ ID NO: 48207 - RNA, 22 nt, Human
ucaugucaguuucuucuauaaa

SEQ ID NO: 48208 - RNA, 19 nt, Human
ucaugucucucaucuguga

SEQ ID NO: 48209 - RNA, 23 nt, Human
ucauguggaaaaggaucuggucu

SEQ ID NO: 48210 - RNA, 22 nt, Human
ucauguguguuucauguaugga

SEQ ID NO: 48211 - RNA, 22 nt, Human
ucauguugaauuaucguuccca

SEQ ID NO: 48212 - RNA, 22 nt, Human
ucauguuuuaguaaagugaagg

SEQ ID NO: 48213 - RNA, 22 nt, Human
ucauguuuuugccauaugacuc

SEQ ID NO: 48214 - RNA, 22 nt, Human
ucauuaaauguuuguugugcca

SEQ ID NO: 48215 - RNA, 22 nt, Human
ucauuaagaaaugaggaguccc

SEQ ID NO: 48216 - RNA, 20 nt, Human
ucauuacagugcuaagaugu

SEQ ID NO: 48217 - RNA, 22 nt, Human
ucauuacaucuuggccaaaacu

SEQ ID NO: 48218 - RNA, 22 nt, Human
ucauuauucucuuuaauguucu

SEQ ID NO: 48219 - RNA, 22 nt, Human
ucauucacugcccagcagugua

SEQ ID NO: 48220 - RNA, 22 nt, Human
ucauucagagagaauguuccag

SEQ ID NO: 48221 - RNA, 19 nt, Human
ucauucaggaccaguggau

SEQ ID NO: 48222 - RNA, 22 nt, Human
ucauucauaaaaauuaguuggc

SEQ ID NO: 48223 - RNA, 22 nt, Human
ucauucauugcuuacccugugu

SEQ ID NO: 48224 - RNA, 22 nt, Human
ucauuccuuauccguaucuuuu

SEQ ID NO: 48225 - RNA, 22 nt, Human
ucauucucagacucuuggccuc

SEQ ID NO: 48226 - RNA, 22 nt, Human
ucauucuggaugacuuucuaga

SEQ ID NO: 48227 - RNA, 22 nt, Human
ucauucuugcguaugccauggu

SEQ ID NO: 48228 - RNA, 19 nt, Human
ucauugaacauaauuacuu

SEQ ID NO: 48229 - RNA, 22 nt, Human
ucauugaagacuuacuggcuuc

SEQ ID NO: 48230 - RNA, 22 nt, Human
ucauugaagcauuuuguguauu

SEQ ID NO: 48231 - RNA, 22 nt, Human
ucauugaauauggggccauaca

SEQ ID NO: 48232 - RNA, 22 nt, Human
ucauugaauucuggggguugag

SEQ ID NO: 48233 - RNA, 22 nt, Human
ucauugagcuguauggacacaa

SEQ ID NO: 48234 - RNA, 22 nt, Human
ucauugcaccccagucccagcu

SEQ ID NO: 48235 - RNA, 22 nt, Human
ucauugcacuccagccugggca

SEQ ID NO: 48236 - RNA, 22 nt, Human
ucauugcagcuucagguguuca

SEQ ID NO: 48237 - RNA, 22 nt, Human
ucauugcaguagggagagaccc

SEQ ID NO: 48238 - RNA, 22 nt, Human
ucauugcauuuauucacuggca

SEQ ID NO: 48239 - RNA, 22 nt, Human
ucauuguuauguuuugcugucu

SEQ ID NO: 48240 - RNA, 22 nt, Human
ucauuguugacauaccaagagc

SEQ ID NO: 48241 - RNA, 21 nt, Human
ucauuguugcaugguaggggg

SEQ ID NO: 48242 - RNA, 19 nt, Human
ucauuguugguuugucggg

SEQ ID NO: 48243 - RNA, 22 nt, Human
ucauuuacaugucuuucucuga

SEQ ID NO: 48244 - RNA, 19 nt, Human
ucauuuacgguuuugauga

SEQ ID NO: 48245 - RNA, 22 nt, Human
ucauuuacuguaggagugaacc

SEQ ID NO: 48246 - RNA, 22 nt, Human
gugaaauuguauuuggcauuga

SEQ ID NO: 48247 - RNA, 19 nt, Human
gugaacaaggagaauggga

SEQ ID NO: 48248 - RNA, 22 nt, Human
gugaacaaggagacuacaacuu

SEQ ID NO: 48249 - RNA, 22 nt, Human
gugaacaguucauuuuaucaug

SEQ ID NO: 48250 - RNA, 22 nt, Human
gugaacugcugaguuuuaucau

SEQ ID NO: 48251 - RNA, 22 nt, Human
gugaacuuccagaugauaaaca

SEQ ID NO: 48252 - RNA, 22 nt, Human
gugaagagcuguugcagagauu

SEQ ID NO: 48253 - RNA, 22 nt, Human
gugaagaugccucaggugaccc

SEQ ID NO: 48254 - RNA, 22 nt, Human
gugaaggauaaggaucuaaauu

SEQ ID NO: 48255 - RNA, 22 nt, Human
gugaaggcagccaucgacaguu

SEQ ID NO: 48256 - RNA, 22 nt, Human
gugaaggccguccuuggggacu

SEQ ID NO: 48257 - RNA, 22 nt, Human
gugaaggcugugugaaaguucu

SEQ ID NO: 48258 - RNA, 22 nt, Human
gugaaggcuugacgucaucagg

SEQ ID NO: 48259 - RNA, 22 nt, Human
gugaagguagacugggcuuccu

SEQ ID NO: 48260 - RNA, 22 nt, Human
gugaagguggggagccucaguu

SEQ ID NO: 48261 - RNA, 22 nt, Human
gugaaguuuuaguauauguaga

SEQ ID NO: 48262 - RNA, 22 nt, Human
gugaauaaaacaccugccaaga

SEQ ID NO: 48263 - RNA, 22 nt, Human
gugaauaacuuucuauguuaau

SEQ ID NO: 48264 - RNA, 22 nt, Human
gugaauaaucacccuucuggau

SEQ ID NO: 48265 - RNA, 22 nt, Human
gugaauaugaucuuauuuggaa

SEQ ID NO: 48266 - RNA, 21 nt, Human
gugaauaugcagcagaggcag

SEQ ID NO: 48267 - RNA, 22 nt, Human
gugaaugacauauuuuguacug

SEQ ID NO: 48268 - RNA, 22 nt, Human
gugaauuuaguuuguaagaagg

SEQ ID NO: 48269 - RNA, 22 nt, Human
gugacaaaugcaaauugggcug

SEQ ID NO: 48270 - RNA, 22 nt, Human
gugacaauauuagcucaggggc

SEQ ID NO: 48271 - RNA, 22 nt, Human
gugacacugguuuagguaugua

SEQ ID NO: 48272 - RNA, 22 nt, Human
gugacagagugagacccugucu

SEQ ID NO: 48273 - RNA, 22 nt, Human
gugacagaguuuuagaucucau

SEQ ID NO: 48274 - RNA, 22 nt, Human
gugacagauuauagggagcguu

SEQ ID NO: 48275 - RNA, 22 nt, Human
gugacaugguuugccgucccug

SEQ ID NO: 48276 - RNA, 22 nt, Human
gugacauugcuaggaacagauu

SEQ ID NO: 48277 - RNA, 22 nt, Human
gugacauuuauuagaugcuuac

SEQ ID NO: 48278 - RNA, 22 nt, Human
gugaccagacagagucuagccc

SEQ ID NO: 48279 - RNA, 22 nt, Human
gugaccagugaugcugaggagu

SEQ ID NO: 48280 - RNA, 22 nt, Human
gugaccauaauagauuaugagu

SEQ ID NO: 48281 - RNA, 22 nt, Human
gugaccauccugguaaugaauc

SEQ ID NO: 48282 - RNA, 22 nt, Human
gugaccauuugacauauccuug

SEQ ID NO: 48283 - RNA, 23 nt, Human
gugacccaaggaccuuccagaau

SEQ ID NO: 48284 - RNA, 22 nt, Human
gugacccagaggcugacuaaca

SEQ ID NO: 48285 - RNA, 22 nt, Human
gugacgugcagguguggccagc

SEQ ID NO: 48286 - RNA, 22 nt, Human
gugacucucacuuuaccugacu

SEQ ID NO: 48287 - RNA, 22 nt, Human
gugacucuccacuaguaugaaa

SEQ ID NO: 48288 - RNA, 22 nt, Human
gugacuguuguuugcuacgugc

SEQ ID NO: 48289 - RNA, 22 nt, Human
gugagaaauggaacuucauacg

SEQ ID NO: 48290 - RNA, 22 nt, Human
gugagacacgugugugaccugg

SEQ ID NO: 48291 - RNA, 22 nt, Human
gugagacucgccuuuguguagc

SEQ ID NO: 48292 - RNA, 22 nt, Human
gugagagaaauuggagggaaug

SEQ ID NO: 48293 - RNA, 22 nt, Human
gugagagguuccuguuagaacu

SEQ ID NO: 48294 - RNA, 22 nt, Human
gugagcagggcaggacugggga

SEQ ID NO: 48295 - RNA, 22 nt, Human
gugagcaguggccaggguccua

SEQ ID NO: 48296 - RNA, 22 nt, Human
gugagccauucuacuccuaacc

SEQ ID NO: 48297 - RNA, 22 nt, Human
gugagccgaguauaguucauag

SEQ ID NO: 48298 - RNA, 22 nt, Human
gugagcguggucuucugugggu

SEQ ID NO: 48299 - RNA, 22 nt, Human
gugagcuuugugguaaugaagu

SEQ ID NO: 48300 - RNA, 22 nt, Human
gugaggauacuuaagagaacac

SEQ ID NO: 48301 - RNA, 22 nt, Human
gugaggaucaaaugaaauagca

SEQ ID NO: 48302 - RNA, 22 nt, Human
gugaggauugcucuggagaauu

SEQ ID NO: 48303 - RNA, 22 nt, Human
gugaggcagagaugccaaaacu

SEQ ID NO: 48304 - RNA, 22 nt, Human
gugagggauaauaugcgggguu

SEQ ID NO: 48305 - RNA, 22 nt, Human
gugagggcagaacccccaggcc

SEQ ID NO: 48306 - RNA, 22 nt, Human
gugaggggaguaaagccauguu

SEQ ID NO: 48307 - RNA, 22 nt, Human
gugaggggucuggacgcacagu

SEQ ID NO: 48308 - RNA, 22 nt, Human
gugagguaaaaucgguaagaug

SEQ ID NO: 48309 - RNA, 22 nt, Human
gugagguacaauuuuauacccu

SEQ ID NO: 48310 - RNA, 23 nt, Human
gugagguauauugaaaucaugcu

SEQ ID NO: 48311 - RNA, 22 nt, Human
gguaacaguuacaguaacagua

SEQ ID NO: 48312 - RNA, 22 nt, Human
gguaauaaaauugugucaaaca

SEQ ID NO: 48313 - RNA, 22 nt, Human
gguaauaagaucuguuacaugg

SEQ ID NO: 48314 - RNA, 17 nt, Human
gguacaaacccauuuuu

SEQ ID NO: 48315 - RNA, 23 nt, Human
gguaccagcacagaguggagagg

SEQ ID NO: 48316 - RNA, 22 nt, Human
gguagaaagauggaacguugaa

SEQ ID NO: 48317 - RNA, 22 nt, Human
gguagaaauaaucuucaggcug

SEQ ID NO: 48318 - RNA, 19 nt, Human
gguagaagggaaguguuuu

SEQ ID NO: 48319 - RNA, 23 nt, Human
gguagagccgcgcccugggggaa

SEQ ID NO: 48320 - RNA, 22 nt, Human
gguagcacauugcauuaggaga

SEQ ID NO: 48321 - RNA, 22 nt, Human
gguagcguuaucaauuugagug

SEQ ID NO: 48322 - RNA, 22 nt, Human
gguaggcacuggugggaagaga

SEQ ID NO: 48323 - RNA, 22 nt, Human
gguagggaaggcucugcgggga

SEQ ID NO: 48324 - RNA, 22 nt, Human
gguagggcaaaguagggcaccu

SEQ ID NO: 48325 - RNA, 22 nt, Human
gguagucaguguuaguuugauu

SEQ ID NO: 48326 - RNA, 22 nt, Human
gguaguucuucauggguuucau

SEQ ID NO: 48327 - RNA, 22 nt, Human
gguauacaagagcaauuuaggg

SEQ ID NO: 48328 - RNA, 22 nt, Human
gguauacugcaugacauugggg

SEQ ID NO: 48329 - RNA, 22 nt, Human
gguaugaauucacuacuuccaa

SEQ ID NO: 48330 - RNA, 21 nt, Human
gguauucugugucaccuuugg

SEQ ID NO: 48331 - RNA, 22 nt, Human
ggucaaaguugaagaagggcau

SEQ ID NO: 48332 - RNA, 22 nt, Human
ggucacaccccaaguacauucg

SEQ ID NO: 48333 - RNA, 19 nt, Human
ggucacagggguuacaagg

SEQ ID NO: 48334 - RNA, 22 nt, Human
ggucacaucuaaauggagcauu

SEQ ID NO: 48335 - RNA, 22 nt, Human
ggucacaugagaugcugcccuc

SEQ ID NO: 48336 - RNA, 22 nt, Human
ggucacaugcggggcuguagcc

SEQ ID NO: 48337 - RNA, 22 nt, Human
ggucacaugguugagcuugauc

SEQ ID NO: 48338 - RNA, 22 nt, Human
ggucacccaugaucacaucacc

SEQ ID NO: 48339 - RNA, 18 nt, Human
ggucacugagaugcuacu

SEQ ID NO: 48340 - RNA, 22 nt, Human
ggucacuggucucugcuuccau

SEQ ID NO: 48341 - RNA, 22 nt, Human
ggucagagaaaaguaggguguu

SEQ ID NO: 48342 - RNA, 22 nt, Human
ggucagagaugaggucuaaagu

SEQ ID NO: 48343 - RNA, 22 nt, Human
ggucagagccguuagcauucag

SEQ ID NO: 48344 - RNA, 22 nt, Human
ggucagaggaggaauaggacau

SEQ ID NO: 48345 - RNA, 22 nt, Human
ggucagcaauuuggacugggcu

SEQ ID NO: 48346 - RNA, 19 nt, Human
ggucagcaguuuagggucu

SEQ ID NO: 48347 - RNA, 22 nt, Human
ggucagcaucugguugagggca

SEQ ID NO: 48348 - RNA, 22 nt, Human
ggucagccccugcucaaggccg

SEQ ID NO: 48349 - RNA, 22 nt, Human
ggucaggaaaagacuccccaga

SEQ ID NO: 48350 - RNA, 19 nt, Human
ggucaggaauuugacaaua

SEQ ID NO: 48351 - RNA, 21 nt, Human
ggucagggggugccuccaggu

SEQ ID NO: 48352 - RNA, 22 nt, Human
ggucagugccuaucaugugggc

SEQ ID NO: 48353 - RNA, 22 nt, Human
ggucagugcgauuucccacucc

SEQ ID NO: 48354 - RNA, 22 nt, Human
ggucagugcugccagagugacc

SEQ ID NO: 48355 - RNA, 18 nt, Human
gguggcggggauggaggu

SEQ ID NO: 48356 - RNA, 22 nt, Human
gguggcucacgccuguaagccc

SEQ ID NO: 48357 - RNA, 22 nt, Human
gguggcucagugucaggcccug

SEQ ID NO: 48358 - RNA, 22 nt, Human
gguggcucggccagugcaggcc

SEQ ID NO: 48359 - RNA, 22 nt, Human
gguggcucguuuuucuugaaag

SEQ ID NO: 48360 - RNA, 19 nt, Human
gguggcucucccucaggga

SEQ ID NO: 48361 - RNA, 22 nt, Human
gguggcucuguugucaacugau

SEQ ID NO: 48362 - RNA, 22 nt, Human
gguggcugcaauggcuaacuuc

SEQ ID NO: 48363 - RNA, 22 nt, Human
gguggcugugagcauuauguga

SEQ ID NO: 48364 - RNA, 22 nt, Human
ggugggacagguaggaguggcu

SEQ ID NO: 48365 - RNA, 22 nt, Human
ggugggaguggaacguggaaga

SEQ ID NO: 48366 - RNA, 22 nt, Human
ggugggagugggcacaguuacg

SEQ ID NO: 48367 - RNA, 22 nt, Human
ggugggcacauucagucucugu

SEQ ID NO: 48368 - RNA, 22 nt, Human
ggugggcacccgagacuggauc

SEQ ID NO: 48369 - RNA, 22 nt, Human
ggugggcaggucacucugccuc

SEQ ID NO: 48370 - RNA, 22 nt, Human
gguggggccagggcuccaaccu

SEQ ID NO: 48371 - RNA, 22 nt, Human
gguggggucacgacagagggaa

SEQ ID NO: 48372 - RNA, 22 nt, Human
ggugggguuuuaggcugcugca

SEQ ID NO: 48373 - RNA, 22 nt, Human
ggugguguuuggaaggaggugc

SEQ ID NO: 48374 - RNA, 22 nt, Human
gguguaagaugucagcugagca

SEQ ID NO: 48375 - RNA, 22 nt, Human
gguguauaccuacacauuuuug

SEQ ID NO: 48376 - RNA, 17 nt, Human
gguguauggggagggaa

SEQ ID NO: 48377 - RNA, 22 nt, Human
ggugucacaggaggccgugugg

SEQ ID NO: 48378 - RNA, 22 nt, Human
ggugucagccugggagccuagc

SEQ ID NO: 48379 - RNA, 22 nt, Human
ggugucaggaaaaucucagugu

SEQ ID NO: 48380 - RNA, 20 nt, Human
ggugucagggccaugccugg

SEQ ID NO: 48381 - RNA, 22 nt, Human
ggugucaguugcucaucagagu

SEQ ID NO: 48382 - RNA, 21 nt, Human
gguguccagaggaguccccag

SEQ ID NO: 48383 - RNA, 22 nt, Human
gguguccuacagggccgcaggc

SEQ ID NO: 48384 - RNA, 19 nt, Human
gguguccuagagauaagag

SEQ ID NO: 48385 - RNA, 22 nt, Human
gguguccucacuauagcaaguc

SEQ ID NO: 48386 - RNA, 22 nt, Human
gguguccuucguccgcuggcau

SEQ ID NO: 48387 - RNA, 22 nt, Human
gguguccuugcagaaggcggcg

SEQ ID NO: 48388 - RNA, 22 nt, Human
gguguccuuguugaacgaaaau

SEQ ID NO: 48389 - RNA, 22 nt, Human
ggugucuggacagugagccagg

SEQ ID NO: 48390 - RNA, 22 nt, Human
ggugugaaauguucaguguuac

SEQ ID NO: 48391 - RNA, 22 nt, Human
ggugugccuggggcuuagcugc

SEQ ID NO: 48392 - RNA, 22 nt, Human
gguguggcugugaguuuuugau

SEQ ID NO: 48393 - RNA, 22 nt, Human
ggugugggggcagcucugauau

SEQ ID NO: 48394 - RNA, 22 nt, Human
ggugugggucagcuuuauuaau

SEQ ID NO: 48395 - RNA, 22 nt, Human
ggugugguuugaagggagaugg

SEQ ID NO: 48396 - RNA, 18 nt, Human
gguguguaacguguuuuc

SEQ ID NO: 48397 - RNA, 22 nt, Human
ggugugucugccaggaacugca

SEQ ID NO: 48398 - RNA, 22 nt, Human
ggugugugaggagucacuuagu

SEQ ID NO: 48399 - RNA, 22 nt, Human
gguguguguggauuagcaugcc

SEQ ID NO: 48400 - RNA, 22 nt, Human
gguguuaaacaugauccauuac

SEQ ID NO: 48401 - RNA, 22 nt, Human
gguguucuuaguggcacuggca

SEQ ID NO: 48402 - RNA, 22 nt, Human
gguguugcaguugaagacuggu

SEQ ID NO: 48403 - RNA, 22 nt, Human
gguguugggcucacugguccuu

SEQ ID NO: 48404 - RNA, 22 nt, Human
gguguuguacauucuguggauu

SEQ ID NO: 48405 - RNA, 19 nt, Human
gguguuucuucauuuucca

SEQ ID NO: 48406 - RNA, 22 nt, Human
gguuaaaaauaauuuacuuggc

SEQ ID NO: 48407 - RNA, 21 nt, Human
gguuacaacaguuaaacagag

SEQ ID NO: 48408 - RNA, 22 nt, Human
gguuacauggaagaaauauaau

SEQ ID NO: 48409 - RNA, 19 nt, Human
gguuaccagugugucuggc

SEQ ID NO: 48410 - RNA, 22 nt, Human
gguuacucaagccugccuucuc

SEQ ID NO: 48411 - RNA, 22 nt, Human
gguuagagggcaugcgaucuuu

SEQ ID NO: 48412 - RNA, 22 nt, Human
gguuauauaauucagugcuuuc

SEQ ID NO: 48413 - RNA, 19 nt, Human
gguuauuugaggguuaaga

SEQ ID NO: 48414 - RNA, 23 nt, Human
gguuauuugcauccuguaauuau

SEQ ID NO: 48415 - RNA, 22 nt, Human
gguuauuuugguugucuaaggc

SEQ ID NO: 48416 - RNA, 22 nt, Human
gguucacuccgaucucugccuc

SEQ ID NO: 48417 - RNA, 22 nt, Human
gguucacucucaagucugccua

SEQ ID NO: 48418 - RNA, 22 nt, Human
gguucagggaugugggugaugc

SEQ ID NO: 48419 - RNA, 17 nt, Human
gguucaguucugcauuc

SEQ ID NO: 48420 - RNA, 23 nt, Human
gguuccaggaacacagccugaug

SEQ ID NO: 48421 - RNA, 22 nt, Human
gguuccaggcauggcaggaugu

SEQ ID NO: 48422 - RNA, 22 nt, Human
gguuccuucugaggucccugua

SEQ ID NO: 48423 - RNA, 22 nt, Human
gguucuaggauuaggaggccca

SEQ ID NO: 48424 - RNA, 22 nt, Human
gguucucuaacuuugacuggag

SEQ ID NO: 48425 - RNA, 22 nt, Human
gguucugaaguggucccauucc

SEQ ID NO: 48426 - RNA, 22 nt, Human
gguucuuuggcagucugauuga

SEQ ID NO: 48427 - RNA, 22 nt, Human
gguucuuuguauauaucacuuu

SEQ ID NO: 48428 - RNA, 22 nt, Human
gguugaauaucuuuauguuggu

SEQ ID NO: 48429 - RNA, 16 nt, Human
ggugucagauguccag

SEQ ID NO: 48430 - RNA, 22 nt, Human
ggugucagugaagguagaguuu

SEQ ID NO: 48431 - RNA, 22 nt, Human
ggugucagugagagcacaguac

SEQ ID NO: 48432 - RNA, 21 nt, Human
ggugucaguuuuggucauuag

SEQ ID NO: 48433 - RNA, 22 nt, Human
gguguccaucaggcugugcuuc

SEQ ID NO: 48434 - RNA, 22 nt, Human
ggugucccaggccagcugugug

SEQ ID NO: 48435 - RNA, 22 nt, Human
gguguccuacugcuugguugcu

SEQ ID NO: 48436 - RNA, 22 nt, Human
gguguccuugcuccuucagcuu

SEQ ID NO: 48437 - RNA, 22 nt, Human
ggugucucagcugcuggcaggg

SEQ ID NO: 48438 - RNA, 22 nt, Human
ggugucugaugguggcuucuca

SEQ ID NO: 48439 - RNA, 22 nt, Human
ggugucugcuucccuccagcug

SEQ ID NO: 48440 - RNA, 22 nt, Human
ggugucugugauggcauauaac

SEQ ID NO: 48441 - RNA, 19 nt, Human
ggugugccaaaugggaaug

SEQ ID NO: 48442 - RNA, 22 nt, Human
ggugugccacuucacugagcag

SEQ ID NO: 48443 - RNA, 22 nt, Human
ggugugcuugggcuucgcaggg

SEQ ID NO: 48444 - RNA, 22 nt, Human
gguguggaucaucugaggucag

SEQ ID NO: 48445 - RNA, 22 nt, Human
ggugugggaacuacagguuuuu

SEQ ID NO: 48446 - RNA, 22 nt, Human
gguguggggagguucugcuucu

SEQ ID NO: 48447 - RNA, 22 nt, Human
ggugugggggcaaguuugagau

SEQ ID NO: 48448 - RNA, 22 nt, Human
gguguuaacaaagauugaaaug

SEQ ID NO: 48449 - RNA, 22 nt, Human
gguguuggaacauggugagauu

SEQ ID NO: 48450 - RNA, 22 nt, Human
gguguugggagagcugguuuug

SEQ ID NO: 48451 - RNA, 21 nt, Human
gguuaaaagacacaucuguuu

SEQ ID NO: 48452 - RNA, 20 nt, Human
gguuacauugucuacaugug

SEQ ID NO: 48453 - RNA, 22 nt, Human
gguuaggaucagauccuggagg

SEQ ID NO: 48454 - RNA, 22 nt, Human
gguuaucauaguuguuaucagg

SEQ ID NO: 48455 - RNA, 22 nt, Human
gguuauuaguuucaccuggacu

SEQ ID NO: 48456 - RNA, 22 nt, Human
gguuauuuuugauucuguggau

SEQ ID NO: 48457 - RNA, 22 nt, Human
gguucacacuuucaugauuuca

SEQ ID NO: 48458 - RNA, 22 nt, Human
gguucauucugaagucuucagc

SEQ ID NO: 48459 - RNA, 22 nt, Human
gguuccaccuggcgagggguau

SEQ ID NO: 48460 - RNA, 22 nt, Human
gguuccagaccacggguguucu

SEQ ID NO: 48461 - RNA, 22 nt, Human
gguuccagaguauuucauuuca

SEQ ID NO: 48462 - RNA, 22 nt, Human
gguuccagagugggcugggaaa

SEQ ID NO: 48463 - RNA, 22 nt, Human
gguuccugaucguugucucucu

SEQ ID NO: 48464 - RNA, 22 nt, Human
gguucuagugacacugaauuga

SEQ ID NO: 48465 - RNA, 20 nt, Human
ucugaacacaauauaucccc

SEQ ID NO: 48466 - RNA, 22 nt, Human
ucugaacaugaugucaucugga

SEQ ID NO: 48467 - RNA, 22 nt, Human
ucugaacauggcuuccucuuca

SEQ ID NO: 48468 - RNA, 22 nt, Human
guuguacagcauccagugcaga

SEQ ID NO: 48469 - RNA, 22 nt, Human
guugucuuagucagaaauaugc

SEQ ID NO: 48470 - RNA, 22 nt, Human
guugugcaaccaucaccaccau

SEQ ID NO: 48471 - RNA, 22 nt, Human
guugugcaccacuguugauuga

SEQ ID NO: 48472 - RNA, 22 nt, Human
guugugcagucagacugccugg

SEQ ID NO: 48473 - RNA, 22 nt, Human
guuguugaucacaugcauaucu

SEQ ID NO: 48474 - RNA, 22 nt, Human
guuuaauuuuagguugucaagc

SEQ ID NO: 48475 - RNA, 21 nt, Human
guuuacaaggcuuugcuccug

SEQ ID NO: 48476 - RNA, 22 nt, Human
guuuacacauaacuccuaucaa

SEQ ID NO: 48477 - RNA, 18 nt, Human
guuuacacauucuagaaa

SEQ ID NO: 48478 - RNA, 22 nt, Human
guuuacauguacucauuauacu

SEQ ID NO: 48479 - RNA, 22 nt, Human
guuuacauugcuguuugugucu

SEQ ID NO: 48480 - RNA, 22 nt, Human
guuuacugucuugcacagugca

SEQ ID NO: 48481 - RNA, 22 nt, Human
guuuacuguuaaccaacgaaug

SEQ ID NO: 48482 - RNA, 22 nt, Human
guuuagaauggcaaaauuaagu

SEQ ID NO: 48483 - RNA, 22 nt, Human
guuuagaccaaucauaauuuau

SEQ ID NO: 48484 - RNA, 22 nt, Human
guuuagaugagauuuuagaaca

SEQ ID NO: 48485 - RNA, 22 nt, Human
guuuauaaauucugcuuuuguu

SEQ ID NO: 48486 - RNA, 22 nt, Human
guuuauauucaacggaguaucu

SEQ ID NO: 48487 - RNA, 21 nt, Human
guuuaugaaucuuguccugcu

SEQ ID NO: 48488 - RNA, 22 nt, Human
guuuaugaauugcauucccuuu

SEQ ID NO: 48489 - RNA, 22 nt, Human
guuuauuauucaacuucauguu

SEQ ID NO: 48490 - RNA, 22 nt, Human
guuucaaaaugaugcuguaacu

SEQ ID NO: 48491 - RNA, 22 nt, Human
guuucaaagucagaaaaggagg

SEQ ID NO: 48492 - RNA, 22 nt, Human
guuucaauuugacccaaaucuu

SEQ ID NO: 48493 - RNA, 22 nt, Human
guuucacacauccugcacauag

SEQ ID NO: 48494 - RNA, 22 nt, Human
guuucacagggccauggaggaa

SEQ ID NO: 48495 - RNA, 22 nt, Human
guuucacagucugcagaauuuu

SEQ ID NO: 48496 - RNA, 22 nt, Human
guuucagaaaugguuuaugcaa

SEQ ID NO: 48497 - RNA, 22 nt, Human
guuucagaguuagugcuggcug

SEQ ID NO: 48498 - RNA, 22 nt, Human
guuucagauauauuuguacuua

SEQ ID NO: 48499 - RNA, 22 nt, Human
guuucaugccauuuccagauug

SEQ ID NO: 48500 - RNA, 22 nt, Human
guuucauggagagcugaauauu

SEQ ID NO: 48501 - RNA, 22 nt, Human
guuucauuaccugacccaugag

SEQ ID NO: 48502 - RNA, 22 nt, Human
guuuccacuuauaugguaccua

SEQ ID NO: 48503 - RNA, 22 nt, Human
guuuccagagaucauuuacaua

SEQ ID NO: 48504 - RNA, 22 nt, Human
guuuccagcuuucugaugcuug

SEQ ID NO: 48505 - RNA, 22 nt, Human
guuuccaggaaggguugggagg

SEQ ID NO: 48506 - RNA, 22 nt, Human
guuuccaggcugggcagcgagc

SEQ ID NO: 48507 - RNA, 22 nt, Human
guuuccauauuuuuagugccaa

SEQ ID NO: 48508 - RNA, 22 nt, Human
guuuccaucuccaggacauaau

SEQ ID NO: 48509 - RNA, 22 nt, Human
guuuccuacacuguaguauuau

SEQ ID NO: 48510 - RNA, 22 nt, Human
guuuccuauguccauugaggga

SEQ ID NO: 48511 - RNA, 22 nt, Human
guuuccugaaguuauuucaucc

SEQ ID NO: 48512 - RNA, 22 nt, Human
guuuccugacuguggaauuaua

SEQ ID NO: 48513 - RNA, 22 nt, Human
guuuccugaugugggagaucuu

SEQ ID NO: 48514 - RNA, 22 nt, Human
guuuccuggaaacugcuccacu

SEQ ID NO: 48515 - RNA, 22 nt, Human
guuucuaagcacaugugagugu

SEQ ID NO: 48516 - RNA, 22 nt, Human
guuucuaagggagagcugccag

SEQ ID NO: 48517 - RNA, 22 nt, Human
guuucucaacaugcuuucuaac

SEQ ID NO: 48518 - RNA, 22 nt, Human
guuucucaagcuugaaugcaca

SEQ ID NO: 48519 - RNA, 22 nt, Human
guuucucacaaggcugcaaucc

SEQ ID NO: 48520 - RNA, 22 nt, Human
guuucucacuuccaguagccaa

SEQ ID NO: 48521 - RNA, 22 nt, Human
guuucucagcaugucaguacaa

SEQ ID NO: 48522 - RNA, 22 nt, Human
guuucucaguuuggucugcaga

SEQ ID NO: 48523 - RNA, 22 nt, Human
guuucucuguaccucuguccca

SEQ ID NO: 48524 - RNA, 22 nt, Human
guuucugauucuagaggcaggc

SEQ ID NO: 48525 - RNA, 22 nt, Human
guuucuggcgccggggcaggcc

SEQ ID NO: 48526 - RNA, 22 nt, Human
guuucuguaagacugaauugac

SEQ ID NO: 48527 - RNA, 22 nt, Human
guuucuuaaguuacaaaaucuu

SEQ ID NO: 48528 - RNA, 22 nt, Human
guuucuuaccacuuggaccucu

SEQ ID NO: 48529 - RNA, 22 nt, Human
guuucuuagacagacauuaucu

SEQ ID NO: 48530 - RNA, 22 nt, Human
guuucuuauuugcagguugcuu

SEQ ID NO: 48531 - RNA, 22 nt, Human
guuugaaagaccaauuagauuu

SEQ ID NO: 48532 - RNA, 22 nt, Human
guuugaaaguggcaaguccuug

SEQ ID NO: 48533 - RNA, 22 nt, Human
guuugaaaugucugcaagggaa

SEQ ID NO: 48534 - RNA, 22 nt, Human
guuugacacggugcgucuucag

SEQ ID NO: 48535 - RNA, 22 nt, Human
guuugacacugagauaaauaaa

SEQ ID NO: 48536 - RNA, 22 nt, Human
guuugauuugauccggagagau

SEQ ID NO: 48537 - RNA, 22 nt, Human
guuugcauuuauuagucuucug

SEQ ID NO: 48538 - RNA, 22 nt, Human
guuugcauuucuugaacuauau

SEQ ID NO: 48539 - RNA, 18 nt, Human
guuugcuacauucacuug

SEQ ID NO: 48540 - RNA, 22 nt, Human
guuuggauagugagagauacuu

SEQ ID NO: 48541 - RNA, 22 nt, Human
guuuggcaguuuuagagugcaa

SEQ ID NO: 48542 - RNA, 22 nt, Human
guuuggcaucucacuuaaaccg

SEQ ID NO: 48543 - RNA, 22 nt, Human
guuuggcucugggugccugugc

SEQ ID NO: 48544 - RNA, 22 nt, Human
guuuggugacacauaguuugau

SEQ ID NO: 48545 - RNA, 22 nt, Human
guuuggugagcagcuuggguau

SEQ ID NO: 48546 - RNA, 22 nt, Human
guuuggugagcuaagauuauuu

SEQ ID NO: 48547 - RNA, 22 nt, Human
guuuguaauuaccucuuuugac

SEQ ID NO: 48548 - RNA, 22 nt, Human
guuugucccacuucuggcagaa

SEQ ID NO: 48549 - RNA, 22 nt, Human
guuuguguaacaugaugaugau

SEQ ID NO: 48550 - RNA, 22 nt, Human
guuugugucaaugacuucugca

SEQ ID NO: 48551 - RNA, 22 nt, Human
guuuguucacuaugacuguggu

SEQ ID NO: 48552 - RNA, 20 nt, Human
guuuuaaggcacaggccuuu

SEQ ID NO: 48553 - RNA, 21 nt, Human
guuuuaagggagaaaaccuag

SEQ ID NO: 48554 - RNA, 22 nt, Human
guuuuauaggcuguugcuauau

SEQ ID NO: 48555 - RNA, 20 nt, Human
guuuuaugccaguucugugu

SEQ ID NO: 48556 - RNA, 22 nt, Human
guuuuauuggaacacagccaug

SEQ ID NO: 48557 - RNA, 22 nt, Human
guuuuauuuccaugagagaccg

SEQ ID NO: 48558 - RNA, 22 nt, Human
guuuuccacuggauuguuugga

SEQ ID NO: 48559 - RNA, 22 nt, Human
guuuuccauggaggucugaccu

SEQ ID NO: 48560 - RNA, 22 nt, Human
guuuuccugagcccagagaugc

SEQ ID NO: 48561 - RNA, 22 nt, Human
guuuuccuucucagccauugcc

SEQ ID NO: 48562 - RNA, 22 nt, Human
guuuucucaggaugguguguac

SEQ ID NO: 48563 - RNA, 22 nt, Human
guuuucugauuagcaaaucuga

SEQ ID NO: 48564 - RNA, 22 nt, Human
guuuucugccgguggugggcuc

SEQ ID NO: 48565 - RNA, 22 nt, Human
guuuucugccugaaggugacca

SEQ ID NO: 48566 - RNA, 22 nt, Human
guuuucuggcaguuauuccuua

SEQ ID NO: 48567 - RNA, 21 nt, Human
guuuucuuugauagagggaag

SEQ ID NO: 48568 - RNA, 22 nt, Human
guuuugaaaugaaagaaccaag

SEQ ID NO: 48569 - RNA, 22 nt, Human
guuuugaagaagaccuugaaac

SEQ ID NO: 48570 - RNA, 22 nt, Human
guuuugaauacuacuagaacuu

SEQ ID NO: 48571 - RNA, 22 nt, Human
guuuugcagagugcaauaaauc

SEQ ID NO: 48572 - RNA, 22 nt, Human
guuuuggagucaggcuuagaug

SEQ ID NO: 48573 - RNA, 19 nt, Human
guuuuguuugcagaacuua

SEQ ID NO: 48574 - RNA, 22 nt, Human
uaccaaauguaaucauucuaau

SEQ ID NO: 48575 - RNA, 21 nt, Human
uaccaagaaguuugggaaagc

SEQ ID NO: 48576 - RNA, 22 nt, Human
uaccaagucaucuauucccaug

SEQ ID NO: 48577 - RNA, 22 nt, Human
uaccaccuccauccuccuuuca

SEQ ID NO: 48578 - RNA, 22 nt, Human
uaccacuacauuugcuaauggc

SEQ ID NO: 48579 - RNA, 22 nt, Human
uaccagccucuguugggggugg

SEQ ID NO: 48580 - RNA, 22 nt, Human
uaccagcuuccuucaagaugug

SEQ ID NO: 48581 - RNA, 22 nt, Human
uaccaguaauguaacuuugcaa

SEQ ID NO: 48582 - RNA, 22 nt, Human
uaccaguugauguuuuaaauag

SEQ ID NO: 48583 - RNA, 22 nt, Human
uaccaugaucaggcucauccuu

SEQ ID NO: 48584 - RNA, 22 nt, Human
uaccaugauguuugaguuacua

SEQ ID NO: 48585 - RNA, 22 nt, Human
uaccauuuacuugaaaauaaaa

SEQ ID NO: 48586 - RNA, 22 nt, Human
uaccauuucuacauaucuuguc

SEQ ID NO: 48587 - RNA, 22 nt, Human
uacccagcaaucccuagagguu

SEQ ID NO: 48588 - RNA, 22 nt, Human
uacccaggggcugagcagaggu

SEQ ID NO: 48589 - RNA, 22 nt, Human
uacccagugcaacuggagucuc

SEQ ID NO: 48590 - RNA, 22 nt, Human
uacccaguuccacacacugaug

SEQ ID NO: 48591 - RNA, 22 nt, Human
uaccccaagagugucugccaug

SEQ ID NO: 48592 - RNA, 22 nt, Human
uaccuagaccaguuacaaugca

SEQ ID NO: 48593 - RNA, 22 nt, Human
uaccucucggggucuguuugug

SEQ ID NO: 48594 - RNA, 23 nt, Human
uaccugaaguaagcauucaucca

SEQ ID NO: 48595 - RNA, 22 nt, Human
uaccugagaagaaacccguguu

SEQ ID NO: 48596 - RNA, 22 nt, Human
uaccuggauaucauucauucuc

SEQ ID NO: 48597 - RNA, 22 nt, Human
uaccuguggcuuguuggaugga

SEQ ID NO: 48598 - RNA, 22 nt, Human
uaccuugaaaagaaggugcuca

SEQ ID NO: 48599 - RNA, 22 nt, Human
uaccuugaaccccaagcuuugc

SEQ ID NO: 48600 - RNA, 20 nt, Human
uaccuugaaccuccaccugg

SEQ ID NO: 48601 - RNA, 22 nt, Human
uaccuuggaggccaagcaguuu

SEQ ID NO: 48602 - RNA, 22 nt, Human
uaccuugggcuauuaucuuuga

SEQ ID NO: 48603 - RNA, 22 nt, Human
uaccuugugagcuuucuaacau

SEQ ID NO: 48604 - RNA, 22 nt, Human
uaccuuugaucuggaauuuuaa

SEQ ID NO: 48605 - RNA, 22 nt, Human
uaccuuuugcuuauuaugacac

SEQ ID NO: 48606 - RNA, 22 nt, Human
uacgaauccuguggaugaaugu

SEQ ID NO: 48607 - RNA, 22 nt, Human
uacgugcacucauaccugaaau

SEQ ID NO: 48608 - RNA, 22 nt, Human
uacguguguucguguaagcacu

SEQ ID NO: 48609 - RNA, 22 nt, Human
uacguuuuaaacacggagccag

SEQ ID NO: 48610 - RNA, 22 nt, Human
uacuaaacccucgauggaucuu

SEQ ID NO: 48611 - RNA, 22 nt, Human
uacuaaguagcagaacuaagaa

SEQ ID NO: 48612 - RNA, 22 nt, Human
uacuacaaggccgaagcucuca

SEQ ID NO: 48613 - RNA, 22 nt, Human
uacuagaaccucacaacaaucc

SEQ ID NO: 48614 - RNA, 22 nt, Human
uacuagaaugccacuguuagug

SEQ ID NO: 48615 - RNA, 22 nt, Human
uacuagcuaacauucucaccaa

SEQ ID NO: 48616 - RNA, 22 nt, Human
uacuaggcaauuauguaaauaa

SEQ ID NO: 48617 - RNA, 22 nt, Human
uacuauaacuucgaaguccugg

SEQ ID NO: 48618 - RNA, 22 nt, Human
uacuaucucuucuaacuucaga

SEQ ID NO: 48619 - RNA, 22 nt, Human
uacuauuuugacaugaaauuga

SEQ ID NO: 48620 - RNA, 22 nt, Human
uacuauuuuugcaacguauaca

SEQ ID NO: 48621 - RNA, 22 nt, Human
uacucaaaaaguuaugaaucau

SEQ ID NO: 48622 - RNA, 22 nt, Human
uacucaaacucacuaagacaga

SEQ ID NO: 48623 - RNA, 22 nt, Human
uacucaauuucuuauggguuuc

SEQ ID NO: 48624 - RNA, 22 nt, Human
guucuucaggcugagcagagag

SEQ ID NO: 48625 - RNA, 22 nt, Human
guucuucaucuuaaccaucugu

SEQ ID NO: 48626 - RNA, 22 nt, Human
guucuucccuuuggggauugug

SEQ ID NO: 48627 - RNA, 21 nt, Human
guucuugcaggauuuccuucc

SEQ ID NO: 48628 - RNA, 22 nt, Human
guucuuugacuccaagaaagua

SEQ ID NO: 48629 - RNA, 22 nt, Human
guugaaacuuaguugaaauuua

SEQ ID NO: 48630 - RNA, 22 nt, Human
guugaaagaucauguggcugcc

SEQ ID NO: 48631 - RNA, 22 nt, Human
guugaaagaugucuugguuccc

SEQ ID NO: 48632 - RNA, 19 nt, Human
guugaaaguaggugagggu

SEQ ID NO: 48633 - RNA, 22 nt, Human
guugaaauccuaacccccuagu

SEQ ID NO: 48634 - RNA, 22 nt, Human
guugaaaugagggauuaaucag

SEQ ID NO: 48635 - RNA, 21 nt, Human
guugaauauccauguaugugu

SEQ ID NO: 48636 - RNA, 22 nt, Human
guugaguguugugcaugcacca

SEQ ID NO: 48637 - RNA, 22 nt, Human
guugaugaaaaugaauugcaug

SEQ ID NO: 48638 - RNA, 22 nt, Human
guugcacaguuccucaagcagg

SEQ ID NO: 48639 - RNA, 22 nt, Human
guugcagacacuccacagucga

SEQ ID NO: 48640 - RNA, 22 nt, Human
guugcagacggggugcacugaa

SEQ ID NO: 48641 - RNA, 22 nt, Human
guugcagcaucacugcugagug

SEQ ID NO: 48642 - RNA, 22 nt, Human
guugccaggggcugcugucacc

SEQ ID NO: 48643 - RNA, 23 nt, Human
guugccuuugcaucuucauccau

SEQ ID NO: 48644 - RNA, 22 nt, Human
guugcugaaggcaugccagaga

SEQ ID NO: 48645 - RNA, 22 nt, Human
guugcuucucuuaaguccagcu

SEQ ID NO: 48646 - RNA, 22 nt, Human
guugcuuuacagcuggugacag

SEQ ID NO: 48647 - RNA, 20 nt, Human
guugcuuuagucugguuugg

SEQ ID NO: 48648 - RNA, 22 nt, Human
guuggaauuugcucauccauuu

SEQ ID NO: 48649 - RNA, 22 nt, Human
guuggcacuucauaauaugaaa

SEQ ID NO: 48650 - RNA, 22 nt, Human
guuggcagaaagcuuucgaucg

SEQ ID NO: 48651 - RNA, 22 nt, Human
guuggccauuaauuggaggaca

SEQ ID NO: 48652 - RNA, 22 nt, Human
guuggcucauuuuauagacagc

SEQ ID NO: 48653 - RNA, 22 nt, Human
guuggcuuugcucucuguccua

SEQ ID NO: 48654 - RNA, 22 nt, Human
guugggaaggugaacaugaugc

SEQ ID NO: 48655 - RNA, 22 nt, Human
guugggcuuauguaauuuuaag

SEQ ID NO: 48656 - RNA, 22 nt, Human
guugguccuuugagcaagaucc

SEQ ID NO: 48657 - RNA, 22 nt, Human
guuggugaugccacacauauuu

SEQ ID NO: 48658 - RNA, 22 nt, Human
guugguuagauuuccucacuuu

SEQ ID NO: 48659 - RNA, 22 nt, Human
guuguacagcauuccauauagg

SEQ ID NO: 48660 - RNA, 22 nt, Human
guuguauucuucaauaucagag

SEQ ID NO: 48661 - RNA, 22 nt, Human
guugugaauagugccgcaauaa

SEQ ID NO: 48662 - RNA, 22 nt, Human
guuguucucccuaacaauuacu

SEQ ID NO: 48663 - RNA, 22 nt, Human
guuguuuguaaugacaggagac

SEQ ID NO: 48664 - RNA, 22 nt, Human
guuuaacaucugugaagcugcu

SEQ ID NO: 48665 - RNA, 22 nt, Human
guuuaacauuguaccaacaccu

SEQ ID NO: 48666 - RNA, 22 nt, Human
guuuaaccauugcauauccaua

SEQ ID NO: 48667 - RNA, 22 nt, Human
guuuaaguuucagaagcuaaga

SEQ ID NO: 48668 - RNA, 22 nt, Human
guuuaaucagaggaauuauaga

SEQ ID NO: 48669 - RNA, 22 nt, Human
guuuacaaauauuuuaaauggu

SEQ ID NO: 48670 - RNA, 22 nt, Human
guuuacacuccaggcuggggug

SEQ ID NO: 48671 - RNA, 22 nt, Human
guuuacaugcagaaaaucaaug

SEQ ID NO: 48672 - RNA, 22 nt, Human
guuuacauguuuuucucuuaca

SEQ ID NO: 48673 - RNA, 22 nt, Human
guuuacauuaaguauuagcauc

SEQ ID NO: 48674 - RNA, 18 nt, Human
guuuacauuacugaauag

SEQ ID NO: 48675 - RNA, 22 nt, Human
guuuacuggagaagaugaccug

SEQ ID NO: 48676 - RNA, 22 nt, Human
guuuagauuucaugaagacacu

SEQ ID NO: 48677 - RNA, 20 nt, Human
guuuauacagaagaccccaa

SEQ ID NO: 48678 - RNA, 22 nt, Human
guuuauacagugcaugguguua

SEQ ID NO: 48679 - RNA, 22 nt, Human
guuuauaugaacuucauaccca

SEQ ID NO: 48680 - RNA, 22 nt, Human
guuuaucacaauaaauaauucu

SEQ ID NO: 48681 - RNA, 22 nt, Human
guuuauuauacaacaaaagcua

SEQ ID NO: 48682 - RNA, 22 nt, Human
guuuauucuucagcaacaucug

SEQ ID NO: 48683 - RNA, 22 nt, Human
uacuuguucuuucaagagauag

SEQ ID NO: 48684 - RNA, 22 nt, Human
uacuuuaaaaacugauaauuca

SEQ ID NO: 48685 - RNA, 22 nt, Human
uacuuuaucagcgucaaaggua

SEQ ID NO: 48686 - RNA, 22 nt, Human
uacuuucaguuucagcugaagu

SEQ ID NO: 48687 - RNA, 22 nt, Human
uacuuucuagcucuccccaguu

SEQ ID NO: 48688 - RNA, 22 nt, Human
uacuuucuuucccaagaggugg

SEQ ID NO: 48689 - RNA, 22 nt, Human
uacuuugaccaccaucugauua

SEQ ID NO: 48690 - RNA, 22 nt, Human
uacuuugagaugaugcugaucg

SEQ ID NO: 48691 - RNA, 22 nt, Human
uacuuugcggcgcggaggagca

SEQ ID NO: 48692 - RNA, 22 nt, Human
uacuuuggaagaguucauacag

SEQ ID NO: 48693 - RNA, 22 nt, Human
uacuuuggggacaauauggaau

SEQ ID NO: 48694 - RNA, 22 nt, Human
uacuuugguugaauauguaaug

SEQ ID NO: 48695 - RNA, 22 nt, Human
uacuuugucauucuaaccuucc

SEQ ID NO: 48696 - RNA, 22 nt, Human
uacuuuuaaaauucacagguau

SEQ ID NO: 48697 - RNA, 22 nt, Human
uacuuuuagccuauuugauucu

SEQ ID NO: 48698 - RNA, 22 nt, Human
uacuuuucauaaugaagcagca

SEQ ID NO: 48699 - RNA, 22 nt, Human
uacuuuuccuggaaccacugcu

SEQ ID NO: 48700 - RNA, 22 nt, Human
uacuuuuugucucuuugaaugu

SEQ ID NO: 48701 - RNA, 22 nt, Human
uagaaaaguaugggacugacau

SEQ ID NO: 48702 - RNA, 22 nt, Human
uagaaaccaucucacugcucag

SEQ ID NO: 48703 - RNA, 22 nt, Human
uagaaacucaggauacucuucc

SEQ ID NO: 48704 - RNA, 22 nt, Human
uagaaagagcuuugcuuccuuu

SEQ ID NO: 48705 - RNA, 22 nt, Human
uagaaagcagaaaccaucagag

SEQ ID NO: 48706 - RNA, 22 nt, Human
uagaaagcaguugugggggcuc

SEQ ID NO: 48707 - RNA, 22 nt, Human
uagaaagcaugcaaguuugaug

SEQ ID NO: 48708 - RNA, 22 nt, Human
uagaaagcccuguguucacugc

SEQ ID NO: 48709 - RNA, 22 nt, Human
uagaaagcguuaaaucuacaga

SEQ ID NO: 48710 - RNA, 22 nt, Human
uagaaaguaaacacgaagucuc

SEQ ID NO: 48711 - RNA, 22 nt, Human
uagaaaguaaaucaguuuuauu

SEQ ID NO: 48712 - RNA, 21 nt, Human
uagaaaucagcuggugccucu

SEQ ID NO: 48713 - RNA, 22 nt, Human
uagaaauccccagucucauagu

SEQ ID NO: 48714 - RNA, 20 nt, Human
uagaaaucuuauaaaagacu

SEQ ID NO: 48715 - RNA, 22 nt, Human
uagaaaucuuguuacuaugugu

SEQ ID NO: 48716 - RNA, 22 nt, Human
uagaaaugauugguugagcucu

SEQ ID NO: 48717 - RNA, 22 nt, Human
uagaaaugcaguguacuguguc

SEQ ID NO: 48718 - RNA, 22 nt, Human
uagaaauguuagauguauugag

SEQ ID NO: 48719 - RNA, 22 nt, Human
uagaacacuugaccacugcucc

SEQ ID NO: 48720 - RNA, 22 nt, Human
uagaacagaguuccagugauca

SEQ ID NO: 48721 - RNA, 22 nt, Human
uagaacaugacuuauuuuugga

SEQ ID NO: 48722 - RNA, 22 nt, Human
uagaacaugugaaaauauagcc

SEQ ID NO: 48723 - RNA, 22 nt, Human
uagaaccaccuucuccuuuacc

SEQ ID NO: 48724 - RNA, 19 nt, Human
uagaaccuggauuucagga

SEQ ID NO: 48725 - RNA, 22 nt, Human
uagaacuaaagaacaacuuuga

SEQ ID NO: 48726 - RNA, 19 nt, Human
uagaacugaggacuugcau

SEQ ID NO: 48727 - RNA, 22 nt, Human
uagaacuucuuacagcuaaguu

SEQ ID NO: 48728 - RNA, 22 nt, Human
uagaacuugaaugugaaaucag

SEQ ID NO: 48729 - RNA, 22 nt, Human
uagaagaaagugaagcugggga

SEQ ID NO: 48730 - RNA, 22 nt, Human
uagaagaacaugucaaacuaua

SEQ ID NO: 48731 - RNA, 22 nt, Human
uagaagagacauagccuguggu

SEQ ID NO: 48732 - RNA, 22 nt, Human
uagaagauucuaaaguggagag

SEQ ID NO: 48733 - RNA, 19 nt, Human
uagaagcacuaggcaaacu

SEQ ID NO: 48734 - RNA, 22 nt, Human
uagaagcagcaggacucauggu

SEQ ID NO: 48735 - RNA, 22 nt, Human
uagaagcaguaauagaaauagg

SEQ ID NO: 48736 - RNA, 22 nt, Human
uagaaggcccauucauuuguuc

SEQ ID NO: 48737 - RNA, 22 nt, Human
uagaagucucucaagaaacaua

SEQ ID NO: 48738 - RNA, 22 nt, Human
uagaagugaaagacuugauguc

SEQ ID NO: 48739 - RNA, 22 nt, Human
uagaauacuagugaagucaucg

SEQ ID NO: 48740 - RNA, 22 nt, Human
uagaaucaagcaguagagcaga

SEQ ID NO: 48741 - RNA, 22 nt, Human
ugaaaugcuucucugaaaauac

SEQ ID NO: 48742 - RNA, 22 nt, Human
ugaaauguaaauaggacuagaa

SEQ ID NO: 48743 - RNA, 22 nt, Human
ugaaaugucuuugcaauugaaa

SEQ ID NO: 48744 - RNA, 22 nt, Human
ugaaauguguaauguggaugcc

SEQ ID NO: 48745 - RNA, 22 nt, Human
ugaaauuagaaauauguauggg

SEQ ID NO: 48746 - RNA, 22 nt, Human
ugaacaacugcaaaaaucucca

SEQ ID NO: 48747 - RNA, 21 nt, Human
ugaacacagauuugucugauu

SEQ ID NO: 48748 - RNA, 22 nt, Human
ugaacacaguucugaugagcuu

SEQ ID NO: 48749 - RNA, 22 nt, Human
ugaacacauuucuggccaauuu

SEQ ID NO: 48750 - RNA, 19 nt, Human
ugaacagagaggacucugg

SEQ ID NO: 48751 - RNA, 22 nt, Human
ugaacagauguggagguaccuu

SEQ ID NO: 48752 - RNA, 23 nt, Human
ugaacaguaugugggacauugag

SEQ ID NO: 48753 - RNA, 22 nt, Human
ugaacagucauuuagaaugugc

SEQ ID NO: 48754 - RNA, 22 nt, Human
ugaacagugggcaugugaagac

SEQ ID NO: 48755 - RNA, 22 nt, Human
ugaacagugguucaugucacgg

SEQ ID NO: 48756 - RNA, 22 nt, Human
ugaacaguguaucuagaucaug

SEQ ID NO: 48757 - RNA, 22 nt, Human
ugaacaugcuguugauggccug

SEQ ID NO: 48758 - RNA, 22 nt, Human
ugaacauuggcacaaggcagca

SEQ ID NO: 48759 - RNA, 22 nt, Human
ugaacauugucacauuccuagc

SEQ ID NO: 48760 - RNA, 22 nt, Human
ugaaccacaugcaaagugaaua

SEQ ID NO: 48761 - RNA, 22 nt, Human
ugaaccaucuggcuccagaaga

SEQ ID NO: 48762 - RNA, 22 nt, Human
ugaaccuuuugcuaagaaguua

SEQ ID NO: 48763 - RNA, 22 nt, Human
ugaacuccaaauacugcugauu

SEQ ID NO: 48764 - RNA, 21 nt, Human
ugaacucuggucaucuucauu

SEQ ID NO: 48765 - RNA, 22 nt, Human
ugaacuguacaucccuaaccua

SEQ ID NO: 48766 - RNA, 22 nt, Human
ugaacuuacaaauuaaaagacu

SEQ ID NO: 48767 - RNA, 22 nt, Human
ugaacuuagugggaauaucucu

SEQ ID NO: 48768 - RNA, 22 nt, Human
ugaacuuuuucucuacgggcca

SEQ ID NO: 48769 - RNA, 22 nt, Human
ugaagaaacgcagagagguagg

SEQ ID NO: 48770 - RNA, 22 nt, Human
ugaagaagccaauugguaggcu

SEQ ID NO: 48771 - RNA, 22 nt, Human
ugaagaaugugaauugguagcu

SEQ ID NO: 48772 - RNA, 22 nt, Human
ugaagaauguugcagugagcau

SEQ ID NO: 48773 - RNA, 22 nt, Human
ugaagacaaagucaggcccaga

SEQ ID NO: 48774 - RNA, 22 nt, Human
ugaagacaguuuuacucaugag

SEQ ID NO: 48775 - RNA, 22 nt, Human
ugaagacuuugcucuuaaccac

SEQ ID NO: 48776 - RNA, 20 nt, Human
ugaagagugcgcacauugcc

SEQ ID NO: 48777 - RNA, 22 nt, Human
ugaagauaaauuguacugaaga

SEQ ID NO: 48778 - RNA, 17 nt, Human
ugaagaugcauggcagc

SEQ ID NO: 48779 - RNA, 22 nt, Human
ugaagauuuucggguacuugau

SEQ ID NO: 48780 - RNA, 22 nt, Human
ugaagauuuuguagcuuucagc

SEQ ID NO: 48781 - RNA, 22 nt, Human
ugaagcaagauagaaagcugcu

SEQ ID NO: 48782 - RNA, 22 nt, Human
ugaagcacagaccugggcauca

SEQ ID NO: 48783 - RNA, 22 nt, Human
ugaagcacauuucuugagauga

SEQ ID NO: 48784 - RNA, 22 nt, Human
ugaagcagagaauuugacaguc

SEQ ID NO: 48785 - RNA, 22 nt, Human
ugaagcagagugaaggugaauu

SEQ ID NO: 48786 - RNA, 22 nt, Human
ugaagcagauggucuggucauu

SEQ ID NO: 48787 - RNA, 19 nt, Human
ugaagcagcaaacucucag

SEQ ID NO: 48788 - RNA, 22 nt, Human
ugaagcagcaccauuuuagagc

SEQ ID NO: 48789 - RNA, 20 nt, Human
ugaagcagccuugauucugu

SEQ ID NO: 48790 - RNA, 22 nt, Human
ugaagcaggaaacuucuuguuu

SEQ ID NO: 48791 - RNA, 22 nt, Human
ugaagcaguuacuggguguuaa

SEQ ID NO: 48792 - RNA, 21 nt, Human
augcauggauuucagugagag

SEQ ID NO: 48793 - RNA, 22 nt, Human
augcauguauuaucuagaugag

SEQ ID NO: 48794 - RNA, 22 nt, Human
augcauguauucaugugugaca

SEQ ID NO: 48795 - RNA, 22 nt, Human
augcaugugugaauuauuugac

SEQ ID NO: 48796 - RNA, 22 nt, Human
augcaugugugagagcaagagg

SEQ ID NO: 48797 - RNA, 22 nt, Human
augcauguguguuuacaugcuu

SEQ ID NO: 48798 - RNA, 22 nt, Human
augcauguuaagcucuuaaaau

SEQ ID NO: 48799 - RNA, 22 nt, Human
augcauguuuauagggugcuuc

SEQ ID NO: 48800 - RNA, 22 nt, Human
augcauucaugaagauugcaca

SEQ ID NO: 48801 - RNA, 22 nt, Human
augcauucauucauucuuucua

SEQ ID NO: 48802 - RNA, 22 nt, Human
augcauuggucagggucuuagg

SEQ ID NO: 48803 - RNA, 22 nt, Human
augcauuguaacgaugugcaca

SEQ ID NO: 48804 - RNA, 22 nt, Human
augccaagaaucauaugccagg

SEQ ID NO: 48805 - RNA, 22 nt, Human
augccaagcuucagcugaaacu

SEQ ID NO: 48806 - RNA, 22 nt, Human
augccaaguacaggcacugcuc

SEQ ID NO: 48807 - RNA, 22 nt, Human
augccaaguaugauucacaugu

SEQ ID NO: 48808 - RNA, 22 nt, Human
augccaauaaauguuaauaucu

SEQ ID NO: 48809 - RNA, 22 nt, Human
augccacauaaccaguucacuu

SEQ ID NO: 48810 - RNA, 22 nt, Human
augccacugacauggacaauuu

SEQ ID NO: 48811 - RNA, 22 nt, Human
augccagacauuaacgacuaug

SEQ ID NO: 48812 - RNA, 22 nt, Human
augccagcuauagacuuguuau

SEQ ID NO: 48813 - RNA, 22 nt, Human
augccaggaacaaacaguggug

SEQ ID NO: 48814 - RNA, 22 nt, Human
augccaggagauggagcagagu

SEQ ID NO: 48815 - RNA, 22 nt, Human
augccaggccccacgcugggca

SEQ ID NO: 48816 - RNA, 22 nt, Human
augccagggucccuucagagau

SEQ ID NO: 48817 - RNA, 22 nt, Human
augccagguacagggguagggu

SEQ ID NO: 48818 - RNA, 22 nt, Human
augccaucaaugacagaguuag

SEQ ID NO: 48819 - RNA, 22 nt, Human
augccauuguauauucauugau

SEQ ID NO: 48820 - RNA, 22 nt, Human
augccccaggaggugccaucca

SEQ ID NO: 48821 - RNA, 22 nt, Human
augcccgauaccuaguuaacuc

SEQ ID NO: 48822 - RNA, 22 nt, Human
augcccugaaagauucaaaggc

SEQ ID NO: 48823 - RNA, 22 nt, Human
augcccugcaucaagugacacu

SEQ ID NO: 48824 - RNA, 22 nt, Human
augcccugccaagcaggcuaaa

SEQ ID NO: 48825 - RNA, 22 nt, Human
augcccugcucucgggaaggga

SEQ ID NO: 48826 - RNA, 22 nt, Human
augcccugcugcuggggcagug

SEQ ID NO: 48827 - RNA, 22 nt, Human
augcccuggacuagcuauacuu

SEQ ID NO: 48828 - RNA, 22 nt, Human
augcccugggagugcuguacca

SEQ ID NO: 48829 - RNA, 22 nt, Human
augcccugugacucuccuggac

SEQ ID NO: 48830 - RNA, 22 nt, Human
augcccugugguucaugugaga

SEQ ID NO: 48831 - RNA, 22 nt, Human
augcccuuaugccagaggcaau

SEQ ID NO: 48832 - RNA, 22 nt, Human
augcccuucaacgugaggauuu

SEQ ID NO: 48833 - RNA, 22 nt, Human
augccugcuuacuccaggugcu

SEQ ID NO: 48834 - RNA, 22 nt, Human
augccuggacuguaucccagau

SEQ ID NO: 48835 - RNA, 22 nt, Human
augccugucucagggucuguuu

SEQ ID NO: 48836 - RNA, 22 nt, Human
augccuuaaggcgagauacuua

SEQ ID NO: 48837 - RNA, 22 nt, Human
augccuuuaagagauacugagg

SEQ ID NO: 48838 - RNA, 22 nt, Human
augcgagugaugcagaguggcu

SEQ ID NO: 48839 - RNA, 22 nt, Human
augcggugaauugacuguuucu

SEQ ID NO: 48840 - RNA, 22 nt, Human
augcgugcagggguccuccugg

SEQ ID NO: 48841 - RNA, 22 nt, Human
augcuaaaaacuugaucauuau

SEQ ID NO: 48842 - RNA, 22 nt, Human
augcuaaauccagaagcaguca

SEQ ID NO: 48843 - RNA, 22 nt, Human
augcuaaauggccaguaccaaa

SEQ ID NO: 48844 - RNA, 22 nt, Human
augcuaaugagcuaaggagucc

SEQ ID NO: 48845 - RNA, 22 nt, Human
augcuacagcccucuuugcaua

SEQ ID NO: 48846 - RNA, 22 nt, Human
augcuacaggaagacgucaggc

SEQ ID NO: 48847 - RNA, 22 nt, Human
augcuacaggauucuccuuauc

SEQ ID NO: 48848 - RNA, 22 nt, Human
augcuauuuaccacacaucauu

SEQ ID NO: 48849 - RNA, 22 nt, Human
augcuauuuuacauaggaaugg

SEQ ID NO: 48850 - RNA, 22 nt, Human
augcucuagagcucuuuucacu

SEQ ID NO: 48851 - RNA, 22 nt, Human
augcucuauaaauaugacaugu

SEQ ID NO: 48852 - RNA, 22 nt, Human
augcugaaauuuauugguaagg

SEQ ID NO: 48853 - RNA, 22 nt, Human
augcugaagaguucaugauuau

SEQ ID NO: 48854 - RNA, 22 nt, Human
augcugaauaguucacucuucu

SEQ ID NO: 48855 - RNA, 21 nt, Human
augcugaaucuuguugugcuc

SEQ ID NO: 48856 - RNA, 22 nt, Human
augcugaaugaaagaaauuagu

SEQ ID NO: 48857 - RNA, 22 nt, Human
augcugacagacuauuaacuau

SEQ ID NO: 48858 - RNA, 22 nt, Human
augcugagaaaccugucuggca

SEQ ID NO: 48859 - RNA, 22 nt, Human
augcugagcagagcugacaugc

SEQ ID NO: 48860 - RNA, 18 nt, Human
augcugcccucugagggu

SEQ ID NO: 48861 - RNA, 16 nt, Human
augcugcuauuagagg

SEQ ID NO: 48862 - RNA, 22 nt, Human
augcugggaaacugaaaggaau

SEQ ID NO: 48863 - RNA, 22 nt, Human
augccuggacugacaugcacug

SEQ ID NO: 48864 - RNA, 22 nt, Human
augccuggauuugggacucaaa

SEQ ID NO: 48865 - RNA, 22 nt, Human
augccuuugccacagauuagga

SEQ ID NO: 48866 - RNA, 22 nt, Human
augcgcuuugugugaagcagug

SEQ ID NO: 48867 - RNA, 22 nt, Human
augcgugugugcaaaccauugc

SEQ ID NO: 48868 - RNA, 22 nt, Human
augcuaaagcuuugcuuucauu

SEQ ID NO: 48869 - RNA, 22 nt, Human
augcuaaauaacugguuugacu

SEQ ID NO: 48870 - RNA, 22 nt, Human
augcuaaggcccaggagaaaau

SEQ ID NO: 48871 - RNA, 22 nt, Human
augcuaauguuuguggaagaua

SEQ ID NO: 48872 - RNA, 22 nt, Human
augcuacacuauuugcugagca

SEQ ID NO: 48873 - RNA, 22 nt, Human
augcuacagaguuugaauaugu

SEQ ID NO: 48874 - RNA, 22 nt, Human
augcuacagcaucucucaucag

SEQ ID NO: 48875 - RNA, 22 nt, Human
augcuacauagauacaaaaaug

SEQ ID NO: 48876 - RNA, 22 nt, Human
augcuacauuuugguuuauaaa

SEQ ID NO: 48877 - RNA, 22 nt, Human
augcuacgaaugagagcauaua

SEQ ID NO: 48878 - RNA, 22 nt, Human
augcuaucuucagcaccuaggg

SEQ ID NO: 48879 - RNA, 22 nt, Human
augcucacuucagagaagauga

SEQ ID NO: 48880 - RNA, 22 nt, Human
augcuccuuggcuucaaagcca

SEQ ID NO: 48881 - RNA, 22 nt, Human
augcucuacuuacggcuuucag

SEQ ID NO: 48882 - RNA, 22 nt, Human
augcucuagacauacuggcuau

SEQ ID NO: 48883 - RNA, 17 nt, Human
augcucuauagucagug

SEQ ID NO: 48884 - RNA, 23 nt, Human
augcucuauuugggauaugacag

SEQ ID NO: 48885 - RNA, 22 nt, Human
augcucugggcaggagcccugg

SEQ ID NO: 48886 - RNA, 23 nt, Human
augcucugggcugugggaccugc

SEQ ID NO: 48887 - RNA, 22 nt, Human
augcucuugaggcuaaagacau

SEQ ID NO: 48888 - RNA, 22 nt, Human
augcugaaccuuaacuuggagc

SEQ ID NO: 48889 - RNA, 22 nt, Human
augcugaacugagauguaacuu

SEQ ID NO: 48890 - RNA, 22 nt, Human
augcugaaggugaauugacaau

SEQ ID NO: 48891 - RNA, 22 nt, Human
augcugaauauuagccucauga

SEQ ID NO: 48892 - RNA, 22 nt, Human
augcugaauugaugcgagggag

SEQ ID NO: 48893 - RNA, 22 nt, Human
augcugagauccucaggccaga

SEQ ID NO: 48894 - RNA, 22 nt, Human
augcugaggacaaagagaucaa

SEQ ID NO: 48895 - RNA, 22 nt, Human
augcugagguuguuguccuauu

SEQ ID NO: 48896 - RNA, 22 nt, Human
augcugcacaagccacauguag

SEQ ID NO: 48897 - RNA, 22 nt, Human
augcuggcagccgagugcucca

SEQ ID NO: 48898 - RNA, 22 nt, Human
augcugggaagacaagguggag

SEQ ID NO: 48899 - RNA, 22 nt, Human
augcuggucucauuggguuagg

SEQ ID NO: 48900 - RNA, 22 nt, Human
augcugucgaaaccaaacaucu

SEQ ID NO: 48901 - RNA, 22 nt, Human
auggaaagcuaagccauuuacc

SEQ ID NO: 48902 - RNA, 22 nt, Human
auggaaaggcuguggaaacuua

SEQ ID NO: 48903 - RNA, 22 nt, Human
auggaaaugauggaacauuaaa

SEQ ID NO: 48904 - RNA, 22 nt, Human
auggaaauguaacuucugauuc

SEQ ID NO: 48905 - RNA, 22 nt, Human
auggaacaugaauuaauauggu

SEQ ID NO: 48906 - RNA, 22 nt, Human
auggaacugaucaggagugcca

SEQ ID NO: 48907 - RNA, 22 nt, Human
auggaagaaagagacaauuuga

SEQ ID NO: 48908 - RNA, 22 nt, Human
auggaaggcuuuaugacucaaa

SEQ ID NO: 48909 - RNA, 22 nt, Human
auggaagguccuacagagcgca

SEQ ID NO: 48910 - RNA, 22 nt, Human
auggaaguuggaaccauucaua

SEQ ID NO: 48911 - RNA, 22 nt, Human
auggaaugcucccuggggacau

SEQ ID NO: 48912 - RNA, 22 nt, Human
auggaaugggaagcagagccau

SEQ ID NO: 48913 - RNA, 22 nt, Human
auggaauugaagacagcauagg

SEQ ID NO: 48914 - RNA, 22 nt, Human
auggaauuuggacuggaagucc

SEQ ID NO: 48915 - RNA, 22 nt, Human
auggaauuuggagauuaggcau

SEQ ID NO: 48916 - RNA, 22 nt, Human
auggacaaauguaaggcauaau

SEQ ID NO: 48917 - RNA, 22 nt, Human
auggacaaugccaauacaguuu

SEQ ID NO: 48918 - RNA, 22 nt, Human
auggacaaugugaaacuacaag

SEQ ID NO: 48919 - RNA, 22 nt, Human
auggacagacacuggccuucug

SEQ ID NO: 48920 - RNA, 22 nt, Human
auggacagcaacuggaagcuuc

SEQ ID NO: 48921 - RNA, 22 nt, Human
auggacaggcugagcuuccuca

SEQ ID NO: 48922 - RNA, 22 nt, Human
auggacagguggauagguggau

SEQ ID NO: 48923 - RNA, 22 nt, Human
auggacauuugaguuauuucca

SEQ ID NO: 48924 - RNA, 22 nt, Human
auggacuuaagagucagaagcu

SEQ ID NO: 48925 - RNA, 22 nt, Human
auggagcaaauggggcugcagg

SEQ ID NO: 48926 - RNA, 22 nt, Human
auggagcacacgccaucacaua

SEQ ID NO: 48927 - RNA, 22 nt, Human
auggagcagcagaaggggcuug

SEQ ID NO: 48928 - RNA, 22 nt, Human
auggagccauuccugaagacuu

SEQ ID NO: 48929 - RNA, 22 nt, Human
auggagcugugugaauauucau

SEQ ID NO: 48930 - RNA, 22 nt, Human
auggagguggaagaaugaguua

SEQ ID NO: 48931 - RNA, 22 nt, Human
auggagugguacuuacuuggcu

SEQ ID NO: 48932 - RNA, 22 nt, Human
auggaguguggccaggcaguaa

SEQ ID NO: 48933 - RNA, 22 nt, Human
auggauaaauacuuggugguau

SEQ ID NO: 48934 - RNA, 22 nt, Human
auggauaacccaguucauuucu

SEQ ID NO: 48935 - RNA, 22 nt, Human
auggauaagaacaaauaucuga

SEQ ID NO: 48936 - RNA, 22 nt, Human
auggauggaacucugcuguggu

SEQ ID NO: 48937 - RNA, 22 nt, Human
auggauggccugagcacagcug

SEQ ID NO: 48938 - RNA, 22 nt, Human
auggaugggauauugcuugcca

SEQ ID NO: 48939 - RNA, 22 nt, Human
auggcaaaaauuaacagaucaa

SEQ ID NO: 48940 - RNA, 22 nt, Human
auggcaagcaagcugaagagau

SEQ ID NO: 48941 - RNA, 22 nt, Human
auggcacagauguucugauuau

SEQ ID NO: 48942 - RNA, 22 nt, Human
auggcaccuuccccagagcuca

SEQ ID NO: 48943 - RNA, 22 nt, Human
auggcagaccugggcuggagaa

SEQ ID NO: 48944 - RNA, 22 nt, Human
auggcagagaacaaagcaacaa

SEQ ID NO: 48945 - RNA, 22 nt, Human
auggcagaguccuaagccuuua

SEQ ID NO: 48946 - RNA, 22 nt, Human
auggcagauccacaguuugaag

SEQ ID NO: 48947 - RNA, 22 nt, Human
auggcagcaaagaggccuucuu

SEQ ID NO: 48948 - RNA, 19 nt, Human
auggcagcagcagcucucc

SEQ ID NO: 48949 - RNA, 22 nt, Human
auggcagcagggcuugauuaug

SEQ ID NO: 48950 - RNA, 22 nt, Human
auggcagccaguguuggaggaa

SEQ ID NO: 48951 - RNA, 22 nt, Human
auggcagcccacgauggcaaug

SEQ ID NO: 48952 - RNA, 22 nt, Human
auggcagccugagcagaggaau

SEQ ID NO: 48953 - RNA, 22 nt, Human
auggcaguacguugaaaauuuu

SEQ ID NO: 48954 - RNA, 22 nt, Human
auggcaguauuuguaucacaga

SEQ ID NO: 48955 - RNA, 22 nt, Human
auggcagucagagacaggcaga

SEQ ID NO: 48956 - RNA, 22 nt, Human
auggcaguggaaugggaugagu

SEQ ID NO: 48957 - RNA, 22 nt, Human
auggcaguuucacucugggauu

SEQ ID NO: 48958 - RNA, 22 nt, Human
auggcauuguuuauagauugca

SEQ ID NO: 48959 - RNA, 22 nt, Human
auggcauuugaaucugucuuuu

SEQ ID NO: 48960 - RNA, 22 nt, Human
auggcauuugucaagauaagua

SEQ ID NO: 48961 - RNA, 22 nt, Human
auggccaacugaaaugaaagau

SEQ ID NO: 48962 - RNA, 22 nt, Human
auggccaagcaugccuguggcc

SEQ ID NO: 48963 - RNA, 22 nt, Human
auggccaagcuuacucuguugu

SEQ ID NO: 48964 - RNA, 22 nt, Human
auggccagcaagguagggcaau

SEQ ID NO: 48965 - RNA, 22 nt, Human
auggccagcaaguucagaauuu

SEQ ID NO: 48966 - RNA, 22 nt, Human
auggccagccacuccugauggc

SEQ ID NO: 48967 - RNA, 22 nt, Human
auggccagcucagagcacucag

SEQ ID NO: 48968 - RNA, 22 nt, Human
auggccagucuguuggacagca

SEQ ID NO: 48969 - RNA, 22 nt, Human
auggcccaaaaccuccucccuc

SEQ ID NO: 48970 - RNA, 22 nt, Human
auggcccacucuggucccggca

SEQ ID NO: 48971 - RNA, 22 nt, Human
auggcccagacucagacuggug

SEQ ID NO: 48972 - RNA, 22 nt, Human
auggcccucaguccuuccuugg

SEQ ID NO: 48973 - RNA, 22 nt, Human
auggcccugcuaccacuuuucu

SEQ ID NO: 48974 - RNA, 22 nt, Human
auggcccuggcccagaccccac

SEQ ID NO: 48975 - RNA, 22 nt, Human
auggcccuuuauuccuucuucc

SEQ ID NO: 48976 - RNA, 22 nt, Human
auggccuggggagcaugggaag

SEQ ID NO: 48977 - RNA, 22 nt, Human
auggccuggggauuccugagca

SEQ ID NO: 48978 - RNA, 22 nt, Human
auggccuuucucaguggugcuu

SEQ ID NO: 48979 - RNA, 17 nt, Human
auggcucaccugugggc

SEQ ID NO: 48980 - RNA, 22 nt, Human
auggcagccuguggacagucaa

SEQ ID NO: 48981 - RNA, 22 nt, Human
auggcagcuuucauuguccaca

SEQ ID NO: 48982 - RNA, 22 nt, Human
auggcaggaugagacaacaauu

SEQ ID NO: 48983 - RNA, 22 nt, Human
auggcagggcacagcucuaguu

SEQ ID NO: 48984 - RNA, 22 nt, Human
auggcagggcagccucucagag

SEQ ID NO: 48985 - RNA, 22 nt, Human
auggcagugauaggcuagugau

SEQ ID NO: 48986 - RNA, 22 nt, Human
auggcaguugcccagccaaucc

SEQ ID NO: 48987 - RNA, 22 nt, Human
auggcauuaggaccaugagccu

SEQ ID NO: 48988 - RNA, 22 nt, Human
auggcauugaguaaagucagua

SEQ ID NO: 48989 - RNA, 22 nt, Human
auggcauugcaagggcaggagg

SEQ ID NO: 48990 - RNA, 22 nt, Human
auggccaaaucuaaacuguugg

SEQ ID NO: 48991 - RNA, 22 nt, Human
auggccaagaauauuucucaac

SEQ ID NO: 48992 - RNA, 22 nt, Human
auggccaagaucacagacuuca

SEQ ID NO: 48993 - RNA, 22 nt, Human
auggccaagcauauacagauug

SEQ ID NO: 48994 - RNA, 21 nt, Human
auggccacuauggugcagcag

SEQ ID NO: 48995 - RNA, 22 nt, Human
auggccagcccuucccgcagcu

SEQ ID NO: 48996 - RNA, 22 nt, Human
auggccagccugguacuuggca

SEQ ID NO: 48997 - RNA, 22 nt, Human
auggccagcuagcacuugcauu

SEQ ID NO: 48998 - RNA, 22 nt, Human
auggccaggcaccucuggcuga

SEQ ID NO: 48999 - RNA, 22 nt, Human
auggccagggccaaaagagaug

SEQ ID NO: 49000 - RNA, 22 nt, Human
auggccagucaagccucuggcu

SEQ ID NO: 49001 - RNA, 22 nt, Human
auggccaguguugagaucaggc

SEQ ID NO: 49002 - RNA, 22 nt, Human
auggccaugccaguuuacagcc

SEQ ID NO: 49003 - RNA, 22 nt, Human
auggcccaggccuccuguggcu

SEQ ID NO: 49004 - RNA, 22 nt, Human
auggcccugaccuugaugaccu

SEQ ID NO: 49005 - RNA, 22 nt, Human
auggcccugcugguuugaucgu

SEQ ID NO: 49006 - RNA, 22 nt, Human
auggccuccgacccaugacgug

SEQ ID NO: 49007 - RNA, 22 nt, Human
auggccuggccagagcucugcu

SEQ ID NO: 49008 - RNA, 22 nt, Human
auggccuuagugaugauuaaua

SEQ ID NO: 49009 - RNA, 22 nt, Human
auggccuuggcugcagagacau

SEQ ID NO: 49010 - RNA, 22 nt, Human
auuagcaacucuuauguaagca

SEQ ID NO: 49011 - RNA, 22 nt, Human
auuagcaacugucuugaaaaca

SEQ ID NO: 49012 - RNA, 22 nt, Human
auuagcaaucacgcagucauuu

SEQ ID NO: 49013 - RNA, 22 nt, Human
auuagcaauugcccugugcaau

SEQ ID NO: 49014 - RNA, 22 nt, Human
auuagcagcuuucuggucucua

SEQ ID NO: 49015 - RNA, 22 nt, Human
auuagcauaaguguucggugca

SEQ ID NO: 49016 - RNA, 22 nt, Human
auuagcauugcuacucucaaga

SEQ ID NO: 49017 - RNA, 22 nt, Human
auuagcuauaugcuaugugcca

SEQ ID NO: 49018 - RNA, 20 nt, Human
auuagcucaggugaggucau

SEQ ID NO: 49019 - RNA, 22 nt, Human
auuagcuuaggcaugaagagaa

SEQ ID NO: 49020 - RNA, 22 nt, Human
auuagcuuaguguuuccguaau

SEQ ID NO: 49021 - RNA, 21 nt, Human
auuagcuucaaaagcuugucu

SEQ ID NO: 49022 - RNA, 22 nt, Human
auuagcuuuaaagacuuugauu

SEQ ID NO: 49023 - RNA, 22 nt, Human
auuagcuuugguggaaaggagu

SEQ ID NO: 49024 - RNA, 22 nt, Human
auuaggaagaggaugucagcau

SEQ ID NO: 49025 - RNA, 20 nt, Human
auuaggauuuuaggucauca

SEQ ID NO: 49026 - RNA, 22 nt, Human
auuaggcacuagaaugucaauu

SEQ ID NO: 49027 - RNA, 22 nt, Human
auuaggcauucaugcagcuccu

SEQ ID NO: 49028 - RNA, 22 nt, Human
auuaggcauucugaaugagguc

SEQ ID NO: 49029 - RNA, 22 nt, Human
auuagggcuggaugcaaggaaa

SEQ ID NO: 49030 - RNA, 22 nt, Human
auuagguaaucuuuagauacac

SEQ ID NO: 49031 - RNA, 22 nt, Human
auuagguuagugugcaagagaa

SEQ ID NO: 49032 - RNA, 22 nt, Human
auuaguaaaacauuguauaugu

SEQ ID NO: 49033 - RNA, 22 nt, Human
auuaguagcacacagagaucag

SEQ ID NO: 49034 - RNA, 22 nt, Human
auuaguagcuguaauaacuggg

SEQ ID NO: 49035 - RNA, 22 nt, Human
auuaguaguaguuagcagccuc

SEQ ID NO: 49036 - RNA, 22 nt, Human
auuagucuucucauuuggaucc

SEQ ID NO: 49037 - RNA, 22 nt, Human
auuagugucauguugaggacuu

SEQ ID NO: 49038 - RNA, 22 nt, Human
auuaguuuggugcaaaaguaau

SEQ ID NO: 49039 - RNA, 22 nt, Human
auuauaaaccuuugaggguggg

SEQ ID NO: 49040 - RNA, 22 nt, Human
auuauacaaggcuggugccuaa

SEQ ID NO: 49041 - RNA, 22 nt, Human
auuauacauuuuguguagagau

SEQ ID NO: 49042 - RNA, 22 nt, Human
auuauauaaaauucuggaagcu

SEQ ID NO: 49043 - RNA, 22 nt, Human
auuaucagccgucccacuacau

SEQ ID NO: 49044 - RNA, 22 nt, Human
auuauccagcaccaaugucaga

SEQ ID NO: 49045 - RNA, 22 nt, Human
auuauccucagaaaacauguga

SEQ ID NO: 49046 - RNA, 22 nt, Human
auuaugcucaccuggcaacuug

SEQ ID NO: 49047 - RNA, 22 nt, Human
auuauggacguuaauuuuggaa

SEQ ID NO: 49048 - RNA, 22 nt, Human
auuauggagaaauauguacagg

SEQ ID NO: 49049 - RNA, 22 nt, Human
auuauguaacugugguucagca

SEQ ID NO: 49050 - RNA, 22 nt, Human
auuauuacuccugauuguacug

SEQ ID NO: 49051 - RNA, 22 nt, Human
auuauuauauagggaaaguccc

SEQ ID NO: 49052 - RNA, 21 nt, Human
auuauuauuucuguguccagc

SEQ ID NO: 49053 - RNA, 22 nt, Human
auuauucaaauucccacuauac

SEQ ID NO: 49054 - RNA, 22 nt, Human
auuauucaaucauauuaaaagu

SEQ ID NO: 49055 - RNA, 22 nt, Human
auuauucucuggaggaaagauu

SEQ ID NO: 49056 - RNA, 22 nt, Human
auuauucuugagguguuuauug

SEQ ID NO: 49057 - RNA, 22 nt, Human
auuauugucaucuuaaucuuaa

SEQ ID NO: 49058 - RNA, 22 nt, Human
auuauuguguaaaaugaggcuu

SEQ ID NO: 49059 - RNA, 22 nt, Human
auuauuguuuuaauaguagaga

SEQ ID NO: 49060 - RNA, 22 nt, Human
auuauuuguguccacagaauac

SEQ ID NO: 49061 - RNA, 22 nt, Human
auucaaaccucauuuauuguuc

SEQ ID NO: 49062 - RNA, 22 nt, Human
auucaaagagcugccagaacug

SEQ ID NO: 49063 - RNA, 22 nt, Human
auucaaagaucaugaucucuac

SEQ ID NO: 49064 - RNA, 22 nt, Human
auucaaaguaauaaccagaacu

SEQ ID NO: 49065 - RNA, 22 nt, Human
auucaaaguagaugaaguuuca

SEQ ID NO: 49066 - RNA, 21 nt, Human
auucaacuagaugauuauuuc

SEQ ID NO: 49067 - RNA, 22 nt, Human
auucaacuguaaacuuguucac

SEQ ID NO: 49068 - RNA, 22 nt, Human
auucaacuuacaaaggagaaga

SEQ ID NO: 49069 - RNA, 22 nt, Human
auucaaguaaacacugaaggaa

SEQ ID NO: 49070 - RNA, 22 nt, Human
auucaaguacaguuuucuucuu

SEQ ID NO: 49071 - RNA, 22 nt, Human
auucacaacaaaaggauaugag

SEQ ID NO: 49072 - RNA, 16 nt, Human
auucacaaggcaucgg

SEQ ID NO: 49073 - RNA, 22 nt, Human
auucacaaguucuagggauuag

SEQ ID NO: 49074 - RNA, 22 nt, Human
auucacaauagcagcuugcaug

SEQ ID NO: 49075 - RNA, 22 nt, Human
auucacagaauaguuuuaccag

SEQ ID NO: 49076 - RNA, 20 nt, Human
auucacaggcacaaaacccu

SEQ ID NO: 49077 - RNA, 22 nt, Human
auucacagggacaaugggagag

SEQ ID NO: 49078 - RNA, 22 nt, Human
auucacagggcuuuccgcaugg

SEQ ID NO: 49079 - RNA, 22 nt, Human
auucacaguuuccucauauucu

SEQ ID NO: 49080 - RNA, 20 nt, Human
auucacauauaccagggagg

SEQ ID NO: 49081 - RNA, 19 nt, Human
auucacaucccugggaagg

SEQ ID NO: 49082 - RNA, 15 nt, Human
auucacauugcuuca

SEQ ID NO: 49083 - RNA, 22 nt, Human
auucacauuuuauuucacugga

SEQ ID NO: 49084 - RNA, 20 nt, Human
auucaccaaaucaucccagg

SEQ ID NO: 49085 - RNA, 22 nt, Human
auucacuagguugcaaaacugu

SEQ ID NO: 49086 - RNA, 22 nt, Human
auucacuguggguccuuuggau

SEQ ID NO: 49087 - RNA, 22 nt, Human
auucagaaagauaugccugguu

SEQ ID NO: 49088 - RNA, 20 nt, Human
auucagaauaggcauguaaa

SEQ ID NO: 49089 - RNA, 22 nt, Human
auucagaauuuuggggagcuaa

SEQ ID NO: 49090 - RNA, 22 nt, Human
auucagaucauauuuauagcuu

SEQ ID NO: 49091 - RNA, 22 nt, Human
auucagcacaucuuuguacagc

SEQ ID NO: 49092 - RNA, 22 nt, Human
auucagcaguuccugcuucagu

SEQ ID NO: 49093 - RNA, 22 nt, Human
auucagcaugcaauuagguaau

SEQ ID NO: 49094 - RNA, 22 nt, Human
auucagcauuggcaccauggau

SEQ ID NO: 49095 - RNA, 22 nt, Human
auucagcucugaaucagcagac

SEQ ID NO: 49096 - RNA, 22 nt, Human
auucagucaaaaaugauggaga

SEQ ID NO: 49097 - RNA, 22 nt, Human
auucagucaaaccacuggucau

SEQ ID NO: 49098 - RNA, 22 nt, Human
auucagugggugcucagcacaa

SEQ ID NO: 49099 - RNA, 22 nt, Human
auucaguuagaucauccuaauu

SEQ ID NO: 49100 - RNA, 22 nt, Human
auucaguuaguagauuugguca

SEQ ID NO: 49101 - RNA, 22 nt, Human
auucaguuccuugaggguauag

SEQ ID NO: 49102 - RNA, 22 nt, Human
auucaguucuaaggucagugcc

SEQ ID NO: 49103 - RNA, 22 nt, Human
auucauagcucaguacagacuc

SEQ ID NO: 49104 - RNA, 22 nt, Human
auucauaucauagaguuauuga

SEQ ID NO: 49105 - RNA, 22 nt, Human
auucaugugccacuggugaaca

SEQ ID NO: 49106 - RNA, 22 nt, Human
auucauuagccacuaacuagca

SEQ ID NO: 49107 - RNA, 22 nt, Human
auucauuuagagggauuaagca

SEQ ID NO: 49108 - RNA, 22 nt, Human
auuccacaagaccauaaauuag

SEQ ID NO: 49109 - RNA, 22 nt, Human
auuccacagcuacguuuugagc

SEQ ID NO: 49110 - RNA, 22 nt, Human
auuccacaguguguggugagga

SEQ ID NO: 49111 - RNA, 22 nt, Human
auuccacauaggccuucaugac

SEQ ID NO: 49112 - RNA, 22 nt, Human
auuccagagagguucuggaggu

SEQ ID NO: 49113 - RNA, 22 nt, Human
cagguuccaguugcagggacuu

SEQ ID NO: 49114 - RNA, 22 nt, Human
cagguucuggguccuggguccu

SEQ ID NO: 49115 - RNA, 22 nt, Human
cagguucuuaaguaacagcaca

SEQ ID NO: 49116 - RNA, 22 nt, Human
cagguucuuguuucaaacagac

SEQ ID NO: 49117 - RNA, 22 nt, Human
cagguugguauucaucuccaca

SEQ ID NO: 49118 - RNA, 22 nt, Human
caguaaauacauaucagagaag

SEQ ID NO: 49119 - RNA, 22 nt, Human
auucauguagugauugagucac

SEQ ID NO: 49120 - RNA, 22 nt, Human
auucauuuagguauucacuuac

SEQ ID NO: 49121 - RNA, 19 nt, Human
auucauuuuugccuucuaa

SEQ ID NO: 49122 - RNA, 22 nt, Human
auuccaaaaggauguuagaaug

SEQ ID NO: 49123 - RNA, 22 nt, Human
auuccaaaggcuggccuggagg

SEQ ID NO: 49124 - RNA, 22 nt, Human
auuccacacaguaauacucaau

SEQ ID NO: 49125 - RNA, 22 nt, Human
auuccacaggacuaccaaugug

SEQ ID NO: 49126 - RNA, 22 nt, Human
auuccacaggagcugguuuucu

SEQ ID NO: 49127 - RNA, 22 nt, Human
auuccacagugccuuccgugaa

SEQ ID NO: 49128 - RNA, 20 nt, Human
auuccacuuauaugaggucc

SEQ ID NO: 49129 - RNA, 21 nt, Human
auuccacuuuuccuucaggga

SEQ ID NO: 49130 - RNA, 22 nt, Human
auuccagauguuacugaaaggc

SEQ ID NO: 49131 - RNA, 22 nt, Human
auuccaggacuaaaggaacagc

SEQ ID NO: 49132 - RNA, 20 nt, Human
auuccauaguuggcacuuuu

SEQ ID NO: 49133 - RNA, 22 nt, Human
auuccauuacagaucuuuuccu

SEQ ID NO: 49134 - RNA, 22 nt, Human
auucccaccaacaauguacagg

SEQ ID NO: 49135 - RNA, 22 nt, Human
auucccaccaagcaggccaugc

SEQ ID NO: 49136 - RNA, 22 nt, Human
auucccaccugaaaaagguagg

SEQ ID NO: 49137 - RNA, 22 nt, Human
auucccacuagcucuuuauaga

SEQ ID NO: 49138 - RNA, 22 nt, Human
auuccugaagaagguauguugc

SEQ ID NO: 49139 - RNA, 22 nt, Human
auuccugacugcuagucauuca

SEQ ID NO: 49140 - RNA, 22 nt, Human
auuccugacuguuagaguuugc

SEQ ID NO: 49141 - RNA, 22 nt, Human
auuccugauuaacgaccuuuca

SEQ ID NO: 49142 - RNA, 22 nt, Human
auuccuuggcauucuggacuug

SEQ ID NO: 49143 - RNA, 22 nt, Human
auuccuugggaauuauugaaug

SEQ ID NO: 49144 - RNA, 22 nt, Human
auuccuuguuucacugaaaagg

SEQ ID NO: 49145 - RNA, 22 nt, Human
auucuaacacaugcucuaagaa

SEQ ID NO: 49146 - RNA, 23 nt, Human
auucuaagaugugaucuuauaac

SEQ ID NO: 49147 - RNA, 22 nt, Human
auucuaagcacgcugaagucuu

SEQ ID NO: 49148 - RNA, 22 nt, Human
auucuaagucuuguucacauuc

SEQ ID NO: 49149 - RNA, 22 nt, Human
auucuaagugcuuguggugguu

SEQ ID NO: 49150 - RNA, 22 nt, Human
auucuaauggcagagacuccug

SEQ ID NO: 49151 - RNA, 22 nt, Human
auucuaauuaguucuacauguu

SEQ ID NO: 49152 - RNA, 22 nt, Human
auucuacaacccaauaauaauu

SEQ ID NO: 49153 - RNA, 22 nt, Human
auucuacugcaaauccugacca

SEQ ID NO: 49154 - RNA, 22 nt, Human
auucuagaacagagguuucuaa

SEQ ID NO: 49155 - RNA, 22 nt, Human
auucuagaguuucaauccaagg

SEQ ID NO: 49156 - RNA, 22 nt, Human
auucuagauaagaaaagggcug

SEQ ID NO: 49157 - RNA, 22 nt, Human
auucuagccaaccaucugagau

SEQ ID NO: 49158 - RNA, 22 nt, Human
auucuagcucaucuacuuucca

SEQ ID NO: 49159 - RNA, 22 nt, Human
auucuaggcuugaaacaugaag

SEQ ID NO: 49160 - RNA, 22 nt, Human
auucuauagacagaaggucaau

SEQ ID NO: 49161 - RNA, 22 nt, Human
auucucaaagccagagucaacg

SEQ ID NO: 49162 - RNA, 22 nt, Human
auucucaauggcuacuuucaua

SEQ ID NO: 49163 - RNA, 20 nt, Human
auucucacauggcuccgggc

SEQ ID NO: 49164 - RNA, 17 nt, Human
auucucaguguacagug

SEQ ID NO: 49165 - RNA, 22 nt, Human
auucuccacacauccagaccuu

SEQ ID NO: 49166 - RNA, 22 nt, Human
auucucuagucucuuccauaaa

SEQ ID NO: 49167 - RNA, 22 nt, Human
auucucucuucugcugcccgug

SEQ ID NO: 49168 - RNA, 22 nt, Human
auucucugaagucuuucagggc

SEQ ID NO: 49169 - RNA, 22 nt, Human
auucucugccauugcgguggau

SEQ ID NO: 49170 - RNA, 22 nt, Human
auucucugcugcacugauaaca

SEQ ID NO: 49171 - RNA, 22 nt, Human
auucucuguagauggcuugaga

SEQ ID NO: 49172 - RNA, 22 nt, Human
auucucugugucugcuuuccca

SEQ ID NO: 49173 - RNA, 22 nt, Human
auucucuguucaaggaugguga

SEQ ID NO: 49174 - RNA, 22 nt, Human
auucucuguuuccaagaugaaa

SEQ ID NO: 49175 - RNA, 22 nt, Human
auucugagaggcacaaugugga

SEQ ID NO: 49176 - RNA, 22 nt, Human
auucugagcuacuaauuaggca

SEQ ID NO: 49177 - RNA, 21 nt, Human
auucugagucuuggggucuca

SEQ ID NO: 49178 - RNA, 22 nt, Human
auucugaguuagagucagccag

SEQ ID NO: 49179 - RNA, 22 nt, Human
auucugauaucuuauucuagcu

SEQ ID NO: 49180 - RNA, 22 nt, Human
auucugauucauuaggucuagg

SEQ ID NO: 49181 - RNA, 22 nt, Human
auucugccucacaggcagcugg

SEQ ID NO: 49182 - RNA, 22 nt, Human
auucugcucaugagcucccggg

SEQ ID NO: 49183 - RNA, 20 nt, Human
auucugcuuucugauagagc

SEQ ID NO: 49184 - RNA, 22 nt, Human
auucuggacaaugagaaacugg

SEQ ID NO: 49185 - RNA, 22 nt, Human
auucugggucugggugugauca

SEQ ID NO: 49186 - RNA, 22 nt, Human
auucugggugacuacgugauca

SEQ ID NO: 49187 - RNA, 22 nt, Human
auucuggguuugcuguacaaag

SEQ ID NO: 49188 - RNA, 17 nt, Human
auucuguaagguuggau

SEQ ID NO: 49189 - RNA, 22 nt, Human
auucuguaauugaacuguguug

SEQ ID NO: 49190 - RNA, 22 nt, Human
auucuguauggggaaacuagag

SEQ ID NO: 49191 - RNA, 22 nt, Human
auucuguauuuggauauaaggg

SEQ ID NO: 49192 - RNA, 22 nt, Human
auucugucagaucuuacuggau

SEQ ID NO: 49193 - RNA, 22 nt, Human
auucugucauuucaagaaaaac

SEQ ID NO: 49194 - RNA, 22 nt, Human
auucuuaaauuuaggucuguga

SEQ ID NO: 49195 - RNA, 22 nt, Human
auucuuauuuaaauagagucug

SEQ ID NO: 49196 - RNA, 22 nt, Human
auucuucaaagagugucaaagu

SEQ ID NO: 49197 - RNA, 22 nt, Human
auucuucacauggauaggaucu

SEQ ID NO: 49198 - RNA, 22 nt, Human
auucuucaccugagucagucua

SEQ ID NO: 49199 - RNA, 22 nt, Human
auucuucauacagacaaguccu

SEQ ID NO: 49200 - RNA, 22 nt, Human
auucuucaucacuaccuuguga

SEQ ID NO: 49201 - RNA, 22 nt, Human
auucuugauauagauaguuaau

SEQ ID NO: 49202 - RNA, 22 nt, Human
auucuugcuucacacuccucug

SEQ ID NO: 49203 - RNA, 19 nt, Human
auucuuggugcaccuugua

SEQ ID NO: 49204 - RNA, 19 nt, Human
auucuuguuaagugucauc

SEQ ID NO: 49205 - RNA, 17 nt, Human
auucuuugaugucucug

SEQ ID NO: 49206 - RNA, 22 nt, Human
auucuuuggacaauaaguggug

SEQ ID NO: 49207 - RNA, 19 nt, Human
auucuuugguguccauuuc

SEQ ID NO: 49208 - RNA, 22 nt, Human
auucuuuuaaauggcaguagua

SEQ ID NO: 49209 - RNA, 22 nt, Human
auugaaaauauaauucuaggag

SEQ ID NO: 49210 - RNA, 22 nt, Human
auugaaagauuuugggcucaug

SEQ ID NO: 49211 - RNA, 22 nt, Human
auugaaagcacaaagaacaagu

SEQ ID NO: 49212 - RNA, 22 nt, Human
auugaaaggcaaaguaggaagc

SEQ ID NO: 49213 - RNA, 22 nt, Human
auugaacagaaaaacucagaga

SEQ ID NO: 49214 - RNA, 22 nt, Human
auugaacagcccagguuuaccu

SEQ ID NO: 49215 - RNA, 22 nt, Human
auugaacauuguucuaggaggc

SEQ ID NO: 49216 - RNA, 22 nt, Human
auugaacugaauccuggauugc

SEQ ID NO: 49217 - RNA, 22 nt, Human
auugaagauucugacaucagaa

SEQ ID NO: 49218 - RNA, 22 nt, Human
auugaauagcugcuuguuguau

SEQ ID NO: 49219 - RNA, 22 nt, Human
auugaaucugcacuaguauuuu

SEQ ID NO: 49220 - RNA, 22 nt, Human
auugacaaaucugaacauacgg

SEQ ID NO: 49221 - RNA, 22 nt, Human
auugacaagaaagauauuuuua

SEQ ID NO: 49222 - RNA, 22 nt, Human
auugacaagugagcugggcugc

SEQ ID NO: 49223 - RNA, 22 nt, Human
auugacaauuagcccuuaggug

SEQ ID NO: 49224 - RNA, 22 nt, Human
auugacaauucuaugcagagca

SEQ ID NO: 49225 - RNA, 22 nt, Human
auugacagaaaauuggauggca

SEQ ID NO: 49226 - RNA, 22 nt, Human
auugacagcaggggcugucacu

SEQ ID NO: 49227 - RNA, 22 nt, Human
auugacauguaggcuacaagga

SEQ ID NO: 49228 - RNA, 22 nt, Human
auuuagacaccagcuuguaagg

SEQ ID NO: 49229 - RNA, 22 nt, Human
auuuagacauguaucugauagc

SEQ ID NO: 49230 - RNA, 22 nt, Human
auuuagagaauaagacauaaau

SEQ ID NO: 49231 - RNA, 22 nt, Human
auuuagagugaaacauuaugca

SEQ ID NO: 49232 - RNA, 22 nt, Human
auuuagcuuucucucacuggug

SEQ ID NO: 49233 - RNA, 22 nt, Human
auuuaggaauguucugcacaaa

SEQ ID NO: 49234 - RNA, 22 nt, Human
auuuagguagcugucuaagugu

SEQ ID NO: 49235 - RNA, 22 nt, Human
auuuaguagagaaauuaagaaa

SEQ ID NO: 49236 - RNA, 22 nt, Human
cauaacuugguguuggaaacug

SEQ ID NO: 49237 - RNA, 22 nt, Human
cauaagaaauaaugaugaugac

SEQ ID NO: 49238 - RNA, 22 nt, Human
cauaagaaauuuaacagaacuu

SEQ ID NO: 49239 - RNA, 22 nt, Human
cauaagaauauuccauccuuug

SEQ ID NO: 49240 - RNA, 22 nt, Human
cauaagaaucuuccagggcaug

SEQ ID NO: 49241 - RNA, 22 nt, Human
cauaaguugcagagggugcauu

SEQ ID NO: 49242 - RNA, 19 nt, Human
cauaauacaguggaucuga

SEQ ID NO: 49243 - RNA, 22 nt, Human
cauaauauacuacauugaugaa

SEQ ID NO: 49244 - RNA, 22 nt, Human
cauaauccauuugcacugcaga

SEQ ID NO: 49245 - RNA, 22 nt, Human
cauaaucccccauuugugacau

SEQ ID NO: 49246 - RNA, 22 nt, Human
cauaaugugugucauacagacu

SEQ ID NO: 49247 - RNA, 22 nt, Human
cauaauuaggcaguugaucauu

SEQ ID NO: 49248 - RNA, 22 nt, Human
cauaauuugugguaguggggga

SEQ ID NO: 49249 - RNA, 18 nt, Human
cauaauuuucuuucuuua

SEQ ID NO: 49250 - RNA, 22 nt, Human
cauaauuuuuuuaagucagaac

SEQ ID NO: 49251 - RNA, 22 nt, Human
cauacaagcgugcaugugcuug

SEQ ID NO: 49252 - RNA, 22 nt, Human
cauacaaucaaguucuuuauua

SEQ ID NO: 49253 - RNA, 19 nt, Human
cauacaauuaccauaggau

SEQ ID NO: 49254 - RNA, 22 nt, Human
cauacauaugcauguguguaua

SEQ ID NO: 49255 - RNA, 22 nt, Human
cauacauauguggaugucauau

SEQ ID NO: 49256 - RNA, 22 nt, Human
cauacauugcucauucaguauc

SEQ ID NO: 49257 - RNA, 21 nt, Human
cauaccauucucuaagcaaaa

SEQ ID NO: 49258 - RNA, 22 nt, Human
cauaccuuucucaagcacaugu

SEQ ID NO: 49259 - RNA, 22 nt, Human
cauacucacuguuguaucuucg

SEQ ID NO: 49260 - RNA, 22 nt, Human
cauacuuugggauaagagugga

SEQ ID NO: 49261 - RNA, 22 nt, Human
cauacuuuugcccugacauucu

SEQ ID NO: 49262 - RNA, 22 nt, Human
cauagaauaugugugauuguua

SEQ ID NO: 49263 - RNA, 22 nt, Human
cauagacaaagaucagaagagu

SEQ ID NO: 49264 - RNA, 22 nt, Human
cauagacauugauagguuauau

SEQ ID NO: 49265 - RNA, 22 nt, Human
cauagauagagguuccuaauag

SEQ ID NO: 49266 - RNA, 22 nt, Human
cauaggcucuucagagaacuga

SEQ ID NO: 49267 - RNA, 22 nt, Human
cauaguaagugcauaauaaaug

SEQ ID NO: 49268 - RNA, 22 nt, Human
cauaguuauaaggcaacacugu

SEQ ID NO: 49269 - RNA, 22 nt, Human
cauaguuuuagguagaaacugg

SEQ ID NO: 49270 - RNA, 22 nt, Human
cauauacacuuccaccucugug

SEQ ID NO: 49271 - RNA, 20 nt, Human
cauauauaccuagaagugga

SEQ ID NO: 49272 - RNA, 22 nt, Human
cauauaucuaccugcaauugca

SEQ ID NO: 49273 - RNA, 22 nt, Human
cauaucauaggucuuggauaau

SEQ ID NO: 49274 - RNA, 22 nt, Human
cauaucauuugcuuauaaaucu

SEQ ID NO: 49275 - RNA, 22 nt, Human
cauauccagguuucuuugguuu

SEQ ID NO: 49276 - RNA, 22 nt, Human
cauaucuuaugguuuucuaagu

SEQ ID NO: 49277 - RNA, 22 nt, Human
cauauguauuucucauaauuag

SEQ ID NO: 49278 - RNA, 22 nt, Human
cauauucuuuaagcaaugcucu

SEQ ID NO: 49279 - RNA, 22 nt, Human
cauauugcugucauugucccuc

SEQ ID NO: 49280 - RNA, 22 nt, Human
caucaaagcuuuuuucuguguu

SEQ ID NO: 49281 - RNA, 22 nt, Human
caucaaaguugguauauuugca

SEQ ID NO: 49282 - RNA, 22 nt, Human
caucaaauacuacauggguugg

SEQ ID NO: 49283 - RNA, 20 nt, Human
caucaacaccuugucagccu

SEQ ID NO: 49284 - RNA, 22 nt, Human
caucaaguagguccuuucaaga

SEQ ID NO: 49285 - RNA, 19 nt, Human
caucaaguggaguaucucg

SEQ ID NO: 49286 - RNA, 22 nt, Human
caucaauaggguuugaaagcaa

SEQ ID NO: 49287 - RNA, 22 nt, Human
caucacaaauguaauaaugucu

SEQ ID NO: 49288 - RNA, 22 nt, Human
caucacaugccuaucaugagcu

SEQ ID NO: 49289 - RNA, 19 nt, Human
caucacauggucugaugaa

SEQ ID NO: 49290 - RNA, 21 nt, Human
caucacauuacucaaaguccu

SEQ ID NO: 49291 - RNA, 22 nt, Human
caucacauuagucucaagagaa

SEQ ID NO: 49292 - RNA, 22 nt, Human
caucacugcuucuaaaauggug

SEQ ID NO: 49293 - RNA, 22 nt, Human
caucacugucaccaucuuuccu

SEQ ID NO: 49294 - RNA, 22 nt, Human
caucacuuuuaaaggugaucga

SEQ ID NO: 49295 - RNA, 20 nt, Human
caucagaaauccugacccac

SEQ ID NO: 49296 - RNA, 22 nt, Human
caucagaacaaaucgguuaaga

SEQ ID NO: 49297 - RNA, 22 nt, Human
caucagaaggaaggacgauuau

SEQ ID NO: 49298 - RNA, 22 nt, Human
caucagaauagcucuguggaua

SEQ ID NO: 49299 - RNA, 22 nt, Human
caucagaauguuauggggggcu

SEQ ID NO: 49300 - RNA, 22 nt, Human
caucagagucagagcucuuucu

SEQ ID NO: 49301 - RNA, 22 nt, Human
caucagcagucacaugaugcug

SEQ ID NO: 49302 - RNA, 22 nt, Human
caucagcucuucauucuugauu

SEQ ID NO: 49303 - RNA, 22 nt, Human
caucaggaaaggacgucuagcc

SEQ ID NO: 49304 - RNA, 22 nt, Human
caucaggacagcuucuuuucac

SEQ ID NO: 49305 - RNA, 20 nt, Human
caucaggacccucaguuuuu

SEQ ID NO: 49306 - RNA, 22 nt, Human
caucaggauaaguuccaggugg

SEQ ID NO: 49307 - RNA, 22 nt, Human
caucaguaaggcaacauagcuu

SEQ ID NO: 49308 - RNA, 18 nt, Human
caucaguauccacuaggu

SEQ ID NO: 49309 - RNA, 23 nt, Human
caucagugagggggaaucacuaa

SEQ ID NO: 49310 - RNA, 22 nt, Human
caucagugcggcaucugucauc

SEQ ID NO: 49311 - RNA, 22 nt, Human
caucagugguaacugaaugguu

SEQ ID NO: 49312 - RNA, 22 nt, Human
caucaguguguugccuugcuca

SEQ ID NO: 49313 - RNA, 22 nt, Human
caucaguguuggcuucucagag

SEQ ID NO: 49314 - RNA, 22 nt, Human
caucaguuuuagaggggugaaa

SEQ ID NO: 49315 - RNA, 22 nt, Human
caucauauauuucuacaagugc

SEQ ID NO: 49316 - RNA, 22 nt, Human
caucauauggaauuuaaaguca

SEQ ID NO: 49317 - RNA, 22 nt, Human
caucaucucucccccaggccug

SEQ ID NO: 49318 - RNA, 22 nt, Human
caucaugccccgcuacagugca

SEQ ID NO: 49319 - RNA, 19 nt, Human
caucauuaucaguucacug

SEQ ID NO: 49320 - RNA, 22 nt, Human
caucauugaacacuucuuccug

SEQ ID NO: 49321 - RNA, 23 nt, Human
caucauuguuaugggugcuacua

SEQ ID NO: 49322 - RNA, 22 nt, Human
caucauuuaauuauaggggcug

SEQ ID NO: 49323 - RNA, 22 nt, Human
caucauuucacuuagaugaagu

SEQ ID NO: 49324 - RNA, 22 nt, Human
caucauuuuauuaaccaagaaa

SEQ ID NO: 49325 - RNA, 22 nt, Human
cauccaaacucucauuaucugu

SEQ ID NO: 49326 - RNA, 22 nt, Human
cauccaauguccuauuaagacu

SEQ ID NO: 49327 - RNA, 22 nt, Human
cauccacuagaaugacagaguu

SEQ ID NO: 49328 - RNA, 22 nt, Human
cauccagaguccaaggcugggc

SEQ ID NO: 49329 - RNA, 22 nt, Human
cauccagggcagccauggccug

SEQ ID NO: 49330 - RNA, 22 nt, Human
cauccauaugaggcacauuggu

SEQ ID NO: 49331 - RNA, 22 nt, Human
cauccauucauuaauucuaaag

SEQ ID NO: 49332 - RNA, 22 nt, Human
caucccugcccucaugccuaua

SEQ ID NO: 49333 - RNA, 22 nt, Human
caucccugcugguggaaggggu

SEQ ID NO: 49334 - RNA, 22 nt, Human
caucccugucugccacucugaa

SEQ ID NO: 49335 - RNA, 22 nt, Human
cauccugaaagaaacauuuccu

SEQ ID NO: 49336 - RNA, 22 nt, Human
cauccugaagaagccgcacugu

SEQ ID NO: 49337 - RNA, 22 nt, Human
auuuggaacuuauaauaaguuu

SEQ ID NO: 49338 - RNA, 22 nt, Human
auuuggaagguuuacaaagaga

SEQ ID NO: 49339 - RNA, 22 nt, Human
auuuggaauagcuguagaaaua

SEQ ID NO: 49340 - RNA, 22 nt, Human
auuuggagacaggauuuuucag

SEQ ID NO: 49341 - RNA, 21 nt, Human
auuuggcaaaggcgaugcaca

SEQ ID NO: 49342 - RNA, 22 nt, Human
auuuggcaaauaauuugagggu

SEQ ID NO: 49343 - RNA, 22 nt, Human
auuuggcauaggcagaggccca

SEQ ID NO: 49344 - RNA, 22 nt, Human
auuuggcuaccaugaggauggg

SEQ ID NO: 49345 - RNA, 22 nt, Human
auuuggcuauugaauuauuccu

SEQ ID NO: 49346 - RNA, 22 nt, Human
auuuggcuguaguaacuggauc

SEQ ID NO: 49347 - RNA, 22 nt, Human
auuugggaaugugcauuauacu

SEQ ID NO: 49348 - RNA, 22 nt, Human
auuugggaguugcuagugaguu

SEQ ID NO: 49349 - RNA, 22 nt, Human
auuuggggcucaccagggcuga

SEQ ID NO: 49350 - RNA, 21 nt, Human
auuuggucaaggacaacucug

SEQ ID NO: 49351 - RNA, 22 nt, Human
auuuggucccuuguuguguccc

SEQ ID NO: 49352 - RNA, 22 nt, Human
auuugguguuguuuggagccua

SEQ ID NO: 49353 - RNA, 22 nt, Human
auugcuguggaaauauaagaug

SEQ ID NO: 49354 - RNA, 22 nt, Human
auugcuugaauuaccauguaau

SEQ ID NO: 49355 - RNA, 22 nt, Human
auugcuuuagaaagaaaaauau

SEQ ID NO: 49356 - RNA, 22 nt, Human
auugcuuuuagugaaauuauau

SEQ ID NO: 49357 - RNA, 22 nt, Human
auugcuuuuccuuaacacaugc

SEQ ID NO: 49358 - RNA, 22 nt, Human
auuggaaauacaguagaaaaau

SEQ ID NO: 49359 - RNA, 22 nt, Human
auuggaacggcuccgcgucuga

SEQ ID NO: 49360 - RNA, 22 nt, Human
auuggaacugauugaugauaau

SEQ ID NO: 49361 - RNA, 22 nt, Human
auuggaauggcuuugcaugucc

SEQ ID NO: 49362 - RNA, 21 nt, Human
auuggcacaccuuuuauugga

SEQ ID NO: 49363 - RNA, 22 nt, Human
auuggcacugcacaugauugcu

SEQ ID NO: 49364 - RNA, 22 nt, Human
auuggcagggccagcaucuccc

SEQ ID NO: 49365 - RNA, 22 nt, Human
auuggcaguuagugacgaggcu

SEQ ID NO: 49366 - RNA, 22 nt, Human
auuggccugaaacugguucagc

SEQ ID NO: 49367 - RNA, 22 nt, Human
auuggcuuucuuuugugaaaau

SEQ ID NO: 49368 - RNA, 22 nt, Human
auugggcuuuauguaggggaag

SEQ ID NO: 49369 - RNA, 22 nt, Human
auuggucuccacuuguuuuaga

SEQ ID NO: 49370 - RNA, 22 nt, Human
auuggucucugcuaaagggagg

SEQ ID NO: 49371 - RNA, 22 nt, Human
auuggugcucuggcacauuccu

SEQ ID NO: 49372 - RNA, 22 nt, Human
auuguaaaguacuguguacaau

SEQ ID NO: 49373 - RNA, 22 nt, Human
auuguaagagguuuggcugugu

SEQ ID NO: 49374 - RNA, 22 nt, Human
auuguacagaugagguaaguga

SEQ ID NO: 49375 - RNA, 22 nt, Human
auuguacagcucugagaggggg

SEQ ID NO: 49376 - RNA, 22 nt, Human
auuguacuacaccauaguacug

SEQ ID NO: 49377 - RNA, 22 nt, Human
auuguauaacagcauguauuuu

SEQ ID NO: 49378 - RNA, 22 nt, Human
auuguauacaagcuuaauuguu

SEQ ID NO: 49379 - RNA, 22 nt, Human
auuguaucuugucauuaugcau

SEQ ID NO: 49380 - RNA, 22 nt, Human
auuguauuuaggagaaaagggu

SEQ ID NO: 49381 - RNA, 22 nt, Human
auuguauuuccagcuugaaugu

SEQ ID NO: 49382 - RNA, 20 nt, Human
auugucagccuucagaggag

SEQ ID NO: 49383 - RNA, 22 nt, Human
auugucaguuuaauauagucaa

SEQ ID NO: 49384 - RNA, 22 nt, Human
auugucauuccagucauuguua

SEQ ID NO: 49385 - RNA, 22 nt, Human
auuguccaucuccacauuaaug

SEQ ID NO: 49386 - RNA, 22 nt, Human
auuguccuaucucagugccaug

SEQ ID NO: 49387 - RNA, 22 nt, Human
auugucuaauugacuuggugug

SEQ ID NO: 49388 - RNA, 22 nt, Human
auugucucuuucaauaacuugu

SEQ ID NO: 49389 - RNA, 22 nt, Human
auugucuuacauacuguggagg

SEQ ID NO: 49390 - RNA, 22 nt, Human
auugucuuagucagcucggacu

SEQ ID NO: 49391 - RNA, 22 nt, Human
auugucuucuggucuuaucuuu

SEQ ID NO: 49392 - RNA, 22 nt, Human
auugucuuggaaccaaggucuu

SEQ ID NO: 49393 - RNA, 22 nt, Human
auugucuuuaaccucugagggg

SEQ ID NO: 49394 - RNA, 22 nt, Human
auugucuuuccacugagaaguu

SEQ ID NO: 49395 - RNA, 22 nt, Human
auugucuuuggugcuuccagga

SEQ ID NO: 49396 - RNA, 20 nt, Human
auugugaauacugcauaugu

SEQ ID NO: 49397 - RNA, 22 nt, Human
auugugauuagagaauauagag

SEQ ID NO: 49398 - RNA, 22 nt, Human
auugugcaaauauuaucuguag

SEQ ID NO: 49399 - RNA, 22 nt, Human
auugugcaccaccuuguggcag

SEQ ID NO: 49400 - RNA, 22 nt, Human
auugugcagauaguaauuagga

SEQ ID NO: 49401 - RNA, 22 nt, Human
auugugcagcucugcucuuauu

SEQ ID NO: 49402 - RNA, 22 nt, Human
auugugcaucuacugugugcag

SEQ ID NO: 49403 - RNA, 22 nt, Human
auuguguccucauugaccuuca

SEQ ID NO: 49404 - RNA, 22 nt, Human
auuguguuugaaugaggcucca

SEQ ID NO: 49405 - RNA, 22 nt, Human
auuguuaacuauagcaucuggu

SEQ ID NO: 49406 - RNA, 22 nt, Human
auuguuaauaacuauuacauug

SEQ ID NO: 49407 - RNA, 18 nt, Human
auuguuaauagaguacuu

SEQ ID NO: 49408 - RNA, 21 nt, Human
auuguuaguaauaguccacac

SEQ ID NO: 49409 - RNA, 22 nt, Human
auuguucaauguaauaauuuug

SEQ ID NO: 49410 - RNA, 22 nt, Human
auuguucagaguagggcucugu

SEQ ID NO: 49411 - RNA, 22 nt, Human
auuguucuaaggguuuaauuaa

SEQ ID NO: 49412 - RNA, 21 nt, Human
auuguucuggaggaaaggauu

SEQ ID NO: 49413 - RNA, 22 nt, Human
auuguucuggauauuuacauug

SEQ ID NO: 49414 - RNA, 22 nt, Human
auuguugacuugauuacucaac

SEQ ID NO: 49415 - RNA, 20 nt, Human
auuguugcugcugcuguuga

SEQ ID NO: 49416 - RNA, 22 nt, Human
auuguuuaaagauacaucccug

SEQ ID NO: 49417 - RNA, 20 nt, Human
auuguuucauuuaauguaca

SEQ ID NO: 49418 - RNA, 22 nt, Human
auuguuuccccggaauuauuca

SEQ ID NO: 49419 - RNA, 23 nt, Human
auuguuuuuggcucucagggaau

SEQ ID NO: 49420 - RNA, 22 nt, Human
auuuaaaugcuuaagaggguuu

SEQ ID NO: 49421 - RNA, 22 nt, Human
auuuaagggauuuggagaccaa

SEQ ID NO: 49422 - RNA, 22 nt, Human
auuuacagccuugccaucuaua

SEQ ID NO: 49423 - RNA, 22 nt, Human
auuuacauuccauggugguuac

SEQ ID NO: 49424 - RNA, 22 nt, Human
auuuaccagcugugcacugaua

SEQ ID NO: 49425 - RNA, 22 nt, Human
auuuacugagguaaauaaacug

SEQ ID NO: 49426 - RNA, 21 nt, Human
auuuagaaggaaauuuugcaa

SEQ ID NO: 49427 - RNA, 22 nt, Human
auuuagcaagaguacaaaauaa

SEQ ID NO: 49428 - RNA, 17 nt, Human
auuuagcaaguagacag

SEQ ID NO: 49429 - RNA, 22 nt, Human
auuuagucuguaacaguacagu

SEQ ID NO: 49430 - RNA, 22 nt, Human
auuuagugaaacccauaaagca

SEQ ID NO: 49431 - RNA, 22 nt, Human
auuuaguguauucuaauaugug

SEQ ID NO: 49432 - RNA, 22 nt, Human
auuuaguguguauugcuauuau

SEQ ID NO: 49433 - RNA, 22 nt, Human
auuuaugacaaccaaagaguga

SEQ ID NO: 49434 - RNA, 22 nt, Human
auuuaugacagaagauaugcug

SEQ ID NO: 49435 - RNA, 22 nt, Human
auuuaugacguguucggucaau

SEQ ID NO: 49436 - RNA, 22 nt, Human
auuuaugacuggugaauagaac

SEQ ID NO: 49437 - RNA, 22 nt, Human
auuuaugauagcugcauuaaag

SEQ ID NO: 49438 - RNA, 22 nt, Human
auuuaugauuagccuauuguug

SEQ ID NO: 49439 - RNA, 22 nt, Human
auuuaugcaucccagcauguga

SEQ ID NO: 49440 - RNA, 22 nt, Human
auuuauuccuuuauggcuggag

SEQ ID NO: 49441 - RNA, 22 nt, Human
auuuauugagacuuaacaaccc

SEQ ID NO: 49442 - RNA, 22 nt, Human
auuuauugagagggaggggaau

SEQ ID NO: 49443 - RNA, 22 nt, Human
auuuauugguuugcauggugaa

SEQ ID NO: 49444 - RNA, 22 nt, Human
auuucaagggguccuugcuugg

SEQ ID NO: 49445 - RNA, 22 nt, Human
auuucacaucuaucucagauuu

SEQ ID NO: 49446 - RNA, 22 nt, Human
caaugacauggauaaucauauu

SEQ ID NO: 49447 - RNA, 22 nt, Human
caaugauagauuuuacaaauua

SEQ ID NO: 49448 - RNA, 22 nt, Human
caaugcugugcuccucaugagg

SEQ ID NO: 49449 - RNA, 22 nt, Human
caaugcuucugagggaauuaca

SEQ ID NO: 49450 - RNA, 22 nt, Human
caaugguugauuaaaauuuagc

SEQ ID NO: 49451 - RNA, 22 nt, Human
caauguaucaaccagaaaguuc

SEQ ID NO: 49452 - RNA, 22 nt, Human
caaugucugggagaccugugau

SEQ ID NO: 49453 - RNA, 22 nt, Human
caauguguguguuuuucucaac

SEQ ID NO: 49454 - RNA, 22 nt, Human
caauguguuugcauauuaaaau

SEQ ID NO: 49455 - RNA, 22 nt, Human
caauguuuucaacugacaagua

SEQ ID NO: 49456 - RNA, 21 nt, Human
caauuacagauggcucagggg

SEQ ID NO: 49457 - RNA, 22 nt, Human
caauuacugguccacagaaauu

SEQ ID NO: 49458 - RNA, 22 nt, Human
caauuagcugguacugacagga

SEQ ID NO: 49459 - RNA, 22 nt, Human
caauuauucagugacuuaagag

SEQ ID NO: 49460 - RNA, 22 nt, Human
caauucaaaccagucugucucu

SEQ ID NO: 49461 - RNA, 19 nt, Human
caauucugcaacacugucc

SEQ ID NO: 49462 - RNA, 22 nt, Human
caauucuuggagaagaagcaua

SEQ ID NO: 49463 - RNA, 22 nt, Human
caauugaacagaugaguuaaau

SEQ ID NO: 49464 - RNA, 22 nt, Human
caauugcuuuguggaagccuuu

SEQ ID NO: 49465 - RNA, 22 nt, Human
caauuucaaugaggccacaggg

SEQ ID NO: 49466 - RNA, 22 nt, Human
caauuucacuaauaauauuuac

SEQ ID NO: 49467 - RNA, 23 nt, Human
caauuucauaugauucuaccuaa

SEQ ID NO: 49468 - RNA, 22 nt, Human
caauuucaucuugugcuucaau

SEQ ID NO: 49469 - RNA, 22 nt, Human
caauuucaugccauguauugcu

SEQ ID NO: 49470 - RNA, 22 nt, Human
caauuucauuaauagauauaga

SEQ ID NO: 49471 - RNA, 22 nt, Human
caauuuccuucauagaugacug

SEQ ID NO: 49472 - RNA, 22 nt, Human
caauuucuaacauuccauggau

SEQ ID NO: 49473 - RNA, 22 nt, Human
caauuucuggaacuaauucuga

SEQ ID NO: 49474 - RNA, 22 nt, Human
caauuucugggccucacacaag

SEQ ID NO: 49475 - RNA, 22 nt, Human
caauuugcccuguuaaauuuuc

SEQ ID NO: 49476 - RNA, 22 nt, Human
caauuuuacucuuccucuucca

SEQ ID NO: 49477 - RNA, 22 nt, Human
caauuuuauugguccaaauaca

SEQ ID NO: 49478 - RNA, 22 nt, Human
caauuuucaauuccuucagaua

SEQ ID NO: 49479 - RNA, 22 nt, Human
caauuuuuguacuuauaguacu

SEQ ID NO: 49480 - RNA, 22 nt, Human
caauuuuuuccaugcucuuaca

SEQ ID NO: 49481 - RNA, 22 nt, Human
cacaaaauaucaagcacuuuua

SEQ ID NO: 49482 - RNA, 22 nt, Human
cacaaagcccucccugcgccag

SEQ ID NO: 49483 - RNA, 22 nt, Human
cacaaauccaauuuaauucugg

SEQ ID NO: 49484 - RNA, 22 nt, Human
cacaaaugacugaaacgacugu

SEQ ID NO: 49485 - RNA, 22 nt, Human
cacaacuuuaggaaccacauuc

SEQ ID NO: 49486 - RNA, 22 nt, Human
cacaagacuuauuuguguagaa

SEQ ID NO: 49487 - RNA, 22 nt, Human
cacaagagagugcgcguugcaa

SEQ ID NO: 49488 - RNA, 22 nt, Human
caagggcagauagcugguccaa

SEQ ID NO: 49489 - RNA, 22 nt, Human
caagggcagcagccucaagcgg

SEQ ID NO: 49490 - RNA, 22 nt, Human
caagggcaggagaggauggaug

SEQ ID NO: 49491 - RNA, 22 nt, Human
caagggccaucugagggcacug

SEQ ID NO: 49492 - RNA, 22 nt, Human
caagggcucuaagucacaagau

SEQ ID NO: 49493 - RNA, 22 nt, Human
caagggcugaacacagguuuca

SEQ ID NO: 49494 - RNA, 22 nt, Human
caagggcugcuaucagcuacug

SEQ ID NO: 49495 - RNA, 22 nt, Human
caagggggcaggaucacacuug

SEQ ID NO: 49496 - RNA, 22 nt, Human
caagggugaaggcuccuccagg

SEQ ID NO: 49497 - RNA, 22 nt, Human
caagggugguauugggagcaua

SEQ ID NO: 49498 - RNA, 22 nt, Human
caaggguucugugccuccugcu

SEQ ID NO: 49499 - RNA, 22 nt, Human
caaggucagcgugaaguucugu

SEQ ID NO: 49500 - RNA, 22 nt, Human
caaggucccagccccucuuggc

SEQ ID NO: 49501 - RNA, 22 nt, Human
caagguuuugcuuguaagggaa

SEQ ID NO: 49502 - RNA, 22 nt, Human
caaguacaaaaugauauuuagu

SEQ ID NO: 49503 - RNA, 22 nt, Human
caaguacugugauagcugaagu

SEQ ID NO: 49504 - RNA, 22 nt, Human
caaguaugagaaagcuauuacc

SEQ ID NO: 49505 - RNA, 22 nt, Human
caagucaagcaugcccuuauuu

SEQ ID NO: 49506 - RNA, 22 nt, Human
caagucacuuaugugcagauau

SEQ ID NO: 49507 - RNA, 22 nt, Human
caaguccaggucaauuuaaagc

SEQ ID NO: 49508 - RNA, 22 nt, Human
caaguccucgcuucuagcugug

SEQ ID NO: 49509 - RNA, 22 nt, Human
caaguccucugguuucaaauag

SEQ ID NO: 49510 - RNA, 22 nt, Human
caaguccuuagaugguucuuug

SEQ ID NO: 49511 - RNA, 22 nt, Human
caagugagccuccucuuuuuaa

SEQ ID NO: 49512 - RNA, 22 nt, Human
caagugucuucaaaggcuaaaa

SEQ ID NO: 49513 - RNA, 19 nt, Human
caaguuaaaaugaggucau

SEQ ID NO: 49514 - RNA, 22 nt, Human
caaguuauggcuucccaguagg

SEQ ID NO: 49515 - RNA, 22 nt, Human
caaguuauuucauuggaacaau

SEQ ID NO: 49516 - RNA, 22 nt, Human
caaguucacaugcauccuugcu

SEQ ID NO: 49517 - RNA, 20 nt, Human
caaguucaccuucuccucuc

SEQ ID NO: 49518 - RNA, 22 nt, Human
caaguucacguugcuuuuugag

SEQ ID NO: 49519 - RNA, 21 nt, Human
caaguucagaagguugggcug

SEQ ID NO: 49520 - RNA, 22 nt, Human
caaguucauuguagcauuauug

SEQ ID NO: 49521 - RNA, 22 nt, Human
caaguucuacugggacaucagu

SEQ ID NO: 49522 - RNA, 19 nt, Human
caaguucuggagauuaggg

SEQ ID NO: 49523 - RNA, 22 nt, Human
caaguucuuaacucugagcagc

SEQ ID NO: 49524 - RNA, 22 nt, Human
caaguugcucugccucuguagg

SEQ ID NO: 49525 - RNA, 22 nt, Human
caaguuuacuacuaccugugug

SEQ ID NO: 49526 - RNA, 22 nt, Human
caauaauauccugugcuguuug

SEQ ID NO: 49527 - RNA, 18 nt, Human
caauagaaacaguaggaa

SEQ ID NO: 49528 - RNA, 22 nt, Human
caauagauguuuuugcuuacca

SEQ ID NO: 49529 - RNA, 22 nt, Human
caauaucagguccgcguaaguc

SEQ ID NO: 49530 - RNA, 22 nt, Human
caaucacuccacaauaugguuc

SEQ ID NO: 49531 - RNA, 21 nt, Human
caaucacuuuugcaccaagcu

SEQ ID NO: 49532 - RNA, 22 nt, Human
caaucccaucaccaucugcucu

SEQ ID NO: 49533 - RNA, 22 nt, Human
caaugaaaaugaggacuccugu

SEQ ID NO: 49534 - RNA, 22 nt, Human
caaugaaauugagauccagaga

SEQ ID NO: 49535 - RNA, 22 nt, Human
caaugacaucucccugcucuaa

SEQ ID NO: 49536 - RNA, 22 nt, Human
caaugauggcuaggcagcugcu

SEQ ID NO: 49537 - RNA, 22 nt, Human
caaugauucugcaacugugugc

SEQ ID NO: 49538 - RNA, 20 nt, Human
caaugcacacagcugcuucu

SEQ ID NO: 49539 - RNA, 22 nt, Human
caaugcacauggacaucaggcu

SEQ ID NO: 49540 - RNA, 22 nt, Human
caaugcuaggcagauccugcgu

SEQ ID NO: 49541 - RNA, 22 nt, Human
caaugcuucaggcuccuuauag

SEQ ID NO: 49542 - RNA, 22 nt, Human
caaugcuuuauuuccuccccuu

SEQ ID NO: 49543 - RNA, 22 nt, Human
caauggcacugcccaaagagaa

SEQ ID NO: 49544 - RNA, 22 nt, Human
caauggccucccaagcaggggg

SEQ ID NO: 49545 - RNA, 22 nt, Human
caaugucuaguuucccaaaucc

SEQ ID NO: 49546 - RNA, 22 nt, Human
caaugugucaggaaaagggcca

SEQ ID NO: 49547 - RNA, 22 nt, Human
caauguuuuuccuuccuuaaua

SEQ ID NO: 49548 - RNA, 22 nt, Human
caauuacuuuugcaccaauaua

SEQ ID NO: 49549 - RNA, 22 nt, Human
caauuagaggaggaagcucaua

SEQ ID NO: 49550 - RNA, 22 nt, Human
caauucaaaugcauaguucaca

SEQ ID NO: 49551 - RNA, 22 nt, Human
caauucaauggcaaaguauugu

SEQ ID NO: 49552 - RNA, 22 nt, Human
caauucaucuggguagguagcc

SEQ ID NO: 49553 - RNA, 22 nt, Human
caauucugaggccugcuuuguu

SEQ ID NO: 49554 - RNA, 22 nt, Human
caauucugcaagugacugaccu

SEQ ID NO: 49555 - RNA, 22 nt, Human
uacagguggaucacuaguauag

SEQ ID NO: 49556 - RNA, 22 nt, Human
uacaguaacuggaauucuucuu

SEQ ID NO: 49557 - RNA, 22 nt, Human
uacaguaaugugucccugcagg

SEQ ID NO: 49558 - RNA, 22 nt, Human
uacaguaguaucuucauuuguu

SEQ ID NO: 49559 - RNA, 22 nt, Human
uacaguaucuucuggcaagcau

SEQ ID NO: 49560 - RNA, 18 nt, Human
uacaguauuuucucgccu

SEQ ID NO: 49561 - RNA, 20 nt, Human
uacagucagggcacaggcag

SEQ ID NO: 49562 - RNA, 22 nt, Human
uacagugacuggacuuugucau

SEQ ID NO: 49563 - RNA, 22 nt, Human
uacagugagacuggcucaggga

SEQ ID NO: 49564 - RNA, 22 nt, Human
uacagugaggugguuuccuuua

SEQ ID NO: 49565 - RNA, 22 nt, Human
uacagugauuucuacugguguu

SEQ ID NO: 49566 - RNA, 22 nt, Human
uacagugcauagaggcaugaua

SEQ ID NO: 49567 - RNA, 22 nt, Human
uacagugcuugguaucuaguaa

SEQ ID NO: 49568 - RNA, 22 nt, Human
uacaguguauguauuuguaggu

SEQ ID NO: 49569 - RNA, 22 nt, Human
uacaguuaaaaaguucaauggu

SEQ ID NO: 49570 - RNA, 22 nt, Human
uacaguuacccuggaaagaaau

SEQ ID NO: 49571 - RNA, 22 nt, Human
uacaguuacgcugagaaacgaa

SEQ ID NO: 49572 - RNA, 22 nt, Human
uacaguucuuugaaggaucuag

SEQ ID NO: 49573 - RNA, 22 nt, Human
uacauaauaaggggcauggugu

SEQ ID NO: 49574 - RNA, 22 nt, Human
uacauacaagcauucaauuuua

SEQ ID NO: 49575 - RNA, 22 nt, Human
uacauacacaaaugcugaaugg

SEQ ID NO: 49576 - RNA, 22 nt, Human
uacauacauguauguguguauu

SEQ ID NO: 49577 - RNA, 22 nt, Human
uacauacuccauaaugacagca

SEQ ID NO: 49578 - RNA, 22 nt, Human
uacauacuuuuucuugcaagca

SEQ ID NO: 49579 - RNA, 22 nt, Human
uacauagcuccuagugaugcau

SEQ ID NO: 49580 - RNA, 22 nt, Human
uacauaguauucacauuguuuu

SEQ ID NO: 49581 - RNA, 22 nt, Human
uacauauagacaguuacucuag

SEQ ID NO: 49582 - RNA, 22 nt, Human
uacauauccaggcugagaagau

SEQ ID NO: 49583 - RNA, 22 nt, Human
uacauaugaacuuuauaacuug

SEQ ID NO: 49584 - RNA, 22 nt, Human
uacauaugaguucguucuaugc

SEQ ID NO: 49585 - RNA, 22 nt, Human
uacauauucaacguucaguauu

SEQ ID NO: 49586 - RNA, 22 nt, Human
uacauauucuaccccuuuuucu

SEQ ID NO: 49587 - RNA, 22 nt, Human
uacaucaagauaaaaacuguca

SEQ ID NO: 49588 - RNA, 22 nt, Human
uacaucaaggaacaccugguau

SEQ ID NO: 49589 - RNA, 21 nt, Human
uacaucaugcuacuucucuga

SEQ ID NO: 49590 - RNA, 22 nt, Human
uacaucauggugagcaggaggc

SEQ ID NO: 49591 - RNA, 22 nt, Human
uacaucauguaagcagaaucau

SEQ ID NO: 49592 - RNA, 22 nt, Human
uacauccaaaugaauuagaauu

SEQ ID NO: 49593 - RNA, 19 nt, Human
uacauccucuuccucuuug

SEQ ID NO: 49594 - RNA, 22 nt, Human
uacaucuagccuuacaauuauu

SEQ ID NO: 49595 - RNA, 22 nt, Human
uacaucuaucuagaugcucaga

SEQ ID NO: 49596 - RNA, 22 nt, Human
uacaucuuugucuaugaccagc

SEQ ID NO: 49597 - RNA, 22 nt, Human
uacaugaagaaaauuaagcagu

SEQ ID NO: 49598 - RNA, 22 nt, Human
uacaugaauuugagucagagga

SEQ ID NO: 49599 - RNA, 19 nt, Human
uacaugcagcaggcacgca

SEQ ID NO: 49600 - RNA, 18 nt, Human
uacaugcauaaaugaagc

SEQ ID NO: 49601 - RNA, 23 nt, Human
uacaugcuauaauuucacccuca

SEQ ID NO: 49602 - RNA, 19 nt, Human
uacaugcucuugguucagg

SEQ ID NO: 49603 - RNA, 22 nt, Human
uacaugcuucuauaugugaagu

SEQ ID NO: 49604 - RNA, 22 nt, Human
uacauggugguggcacuugacu

SEQ ID NO: 49605 - RNA, 22 nt, Human
uacaugguuggcccauucuucu

SEQ ID NO: 49606 - RNA, 22 nt, Human
uacauguaagacaugagacucu

SEQ ID NO: 49607 - RNA, 22 nt, Human
uacauguacaugcauagguaga

SEQ ID NO: 49608 - RNA, 22 nt, Human
uacauguauguuuaucuugaga

SEQ ID NO: 49609 - RNA, 22 nt, Human
uacaugucuacaugcauuuuug

SEQ ID NO: 49610 - RNA, 22 nt, Human
uacaugugcuggguucuuggcc

SEQ ID NO: 49611 - RNA, 22 nt, Human
uacaugugguagggagggcagu

SEQ ID NO: 49612 - RNA, 22 nt, Human
uacauguucaaauuugucuuuc

SEQ ID NO: 49613 - RNA, 22 nt, Human
uacauguuuacuccaagucagg

SEQ ID NO: 49614 - RNA, 22 nt, Human
uacauuaacuuacguccacaug

SEQ ID NO: 49615 - RNA, 22 nt, Human
uacauuauccugucuuuguccu

SEQ ID NO: 49616 - RNA, 22 nt, Human
uacauuauuucaucagucaucu

SEQ ID NO: 49617 - RNA, 20 nt, Human
uacauucaaaacaaacucug

SEQ ID NO: 49618 - RNA, 22 nt, Human
uacauucaaacgauuuauugau

SEQ ID NO: 49619 - RNA, 22 nt, Human
uacauucaacaugucacuaugu

SEQ ID NO: 49620 - RNA, 15 nt, Human
uacauucauuuccac

SEQ ID NO: 49621 - RNA, 22 nt, Human
uacauuccaaaggaaacuggcu

SEQ ID NO: 49622 - RNA, 22 nt, Human
uacauuccacaagcauugcuuu

SEQ ID NO: 49623 - RNA, 22 nt, Human
uacauucccccaauuaccaaug

SEQ ID NO: 49624 - RNA, 22 nt, Human
uacauucuggaaaggcacagac

SEQ ID NO: 49625 - RNA, 22 nt, Human
uacauugaaagucauuuaaucc

SEQ ID NO: 49626 - RNA, 21 nt, Human
uacauugaagaaugggaauga

SEQ ID NO: 49627 - RNA, 21 nt, Human
uacauugacuacaaauaaagc

SEQ ID NO: 49628 - RNA, 22 nt, Human
uacauugacucucugucccuaa

SEQ ID NO: 49629 - RNA, 22 nt, Human
uacauugaguauuauuuagcca

SEQ ID NO: 49630 - RNA, 22 nt, Human
uacauugcuuucuaauacaucu

SEQ ID NO: 49631 - RNA, 22 nt, Human
uacauuguacuuacaaauagug

SEQ ID NO: 49632 - RNA, 22 nt, Human
uacauugugauguuucaauaca

SEQ ID NO: 49633 - RNA, 22 nt, Human
uacauuguguuaaaacagaaga

SEQ ID NO: 49634 - RNA, 21 nt, Human
uacauuugagagcuauaagcu

SEQ ID NO: 49635 - RNA, 22 nt, Human
uacauuugcuuugauuuucagc

SEQ ID NO: 49636 - RNA, 22 nt, Human
uaccaaagaauauuuuaaauag

SEQ ID NO: 49637 - RNA, 22 nt, Human
uaccaagguaguggagacagaa

SEQ ID NO: 49638 - RNA, 22 nt, Human
uaccaaguguauuaugcuuugu

SEQ ID NO: 49639 - RNA, 22 nt, Human
uaccaauucuauuuuggauuga

SEQ ID NO: 49640 - RNA, 22 nt, Human
uaccacaguuuaucuauucagc

SEQ ID NO: 49641 - RNA, 22 nt, Human
uaccaccucaaccucaucugac

SEQ ID NO: 49642 - RNA, 22 nt, Human
uaccagcaacuggaagucagau

SEQ ID NO: 49643 - RNA, 22 nt, Human
uaccagcaaugcuagucaacuc

SEQ ID NO: 49644 - RNA, 22 nt, Human
uaccagcaauguaugaguguuu

SEQ ID NO: 49645 - RNA, 22 nt, Human
uaccagccucaguugugagccc

SEQ ID NO: 49646 - RNA, 22 nt, Human
uaccaggaauggggucaccguc

SEQ ID NO: 49647 - RNA, 22 nt, Human
uaccaggagcccccuucugguc

SEQ ID NO: 49648 - RNA, 22 nt, Human
uaccaggaguuacaggcagcag

SEQ ID NO: 49649 - RNA, 22 nt, Human
uaccagggaacagggauauuaa

SEQ ID NO: 49650 - RNA, 22 nt, Human
uaccaguaauugcuugugcugu

SEQ ID NO: 49651 - RNA, 22 nt, Human
uaccauaacguaaugaacuuga

SEQ ID NO: 49652 - RNA, 19 nt, Human
uaccauguugacuuuccug

SEQ ID NO: 49653 - RNA, 22 nt, Human
uaccauuauucacaugaucuuu

SEQ ID NO: 49654 - RNA, 22 nt, Human
uacaagaagaggcagagcugga

SEQ ID NO: 49655 - RNA, 22 nt, Human
uacaagaaggauggagcccacu

SEQ ID NO: 49656 - RNA, 22 nt, Human
uacaagaaugucuuaaaagcuc

SEQ ID NO: 49657 - RNA, 22 nt, Human
uacaagacgagggaaguucuuu

SEQ ID NO: 49658 - RNA, 22 nt, Human
uacaagagacaccagggaggcu

SEQ ID NO: 49659 - RNA, 22 nt, Human
uacaagauaagaauuggcaagg

SEQ ID NO: 49660 - RNA, 22 nt, Human
uacaagcucgggcagcucauua

SEQ ID NO: 49661 - RNA, 22 nt, Human
uacaagcugacccugaagauga

SEQ ID NO: 49662 - RNA, 22 nt, Human
uacaagcuuuuguguauaaaug

SEQ ID NO: 49663 - RNA, 22 nt, Human
uacaaggaaaauuuuauaguaa

SEQ ID NO: 49664 - RNA, 22 nt, Human
uaugagaauaaucugguaaaua

SEQ ID NO: 49665 - RNA, 23 nt, Human
uaugagaauuaagugcgagugcc

SEQ ID NO: 49666 - RNA, 22 nt, Human
uaugagcaagaguuugugaagg

SEQ ID NO: 49667 - RNA, 22 nt, Human
uaugagcagacagugguuuuac

SEQ ID NO: 49668 - RNA, 22 nt, Human
uaugagcuuuggaaugagaaac

SEQ ID NO: 49669 - RNA, 22 nt, Human
uaugagguauuacaggaaauau

SEQ ID NO: 49670 - RNA, 20 nt, Human
uaugaguauuacuuucagga

SEQ ID NO: 49671 - RNA, 22 nt, Human
uaugaguuguggcuuagucaca

SEQ ID NO: 49672 - RNA, 22 nt, Human
uaugauaugcacuuuaucagaa

SEQ ID NO: 49673 - RNA, 22 nt, Human
uaugauuuguagacauuugauu

SEQ ID NO: 49674 - RNA, 22 nt, Human
uaugcaacaucugguagaaauc

SEQ ID NO: 49675 - RNA, 22 nt, Human
uaugcacaauaugaucuauuug

SEQ ID NO: 49676 - RNA, 22 nt, Human
uaugcacacaucgcagcaggaa

SEQ ID NO: 49677 - RNA, 22 nt, Human
uaugcacaccuggguccuuguc

SEQ ID NO: 49678 - RNA, 22 nt, Human
uaugcacagaaguuugcugaau

SEQ ID NO: 49679 - RNA, 22 nt, Human
uaugcagugagcacuauuuaua

SEQ ID NO: 49680 - RNA, 22 nt, Human
uaugcauacaaugagauauucc

SEQ ID NO: 49681 - RNA, 22 nt, Human
uaugcauaugaccccaagcuug

SEQ ID NO: 49682 - RNA, 22 nt, Human
uaugcaugugguauaugcuuau

SEQ ID NO: 49683 - RNA, 22 nt, Human
uaugccaaggaucaauauguau

SEQ ID NO: 49684 - RNA, 22 nt, Human
uaugccagacugugagcuucuu

SEQ ID NO: 49685 - RNA, 22 nt, Human
uaugccagcacuuagaugagau

SEQ ID NO: 49686 - RNA, 22 nt, Human
uaugcuaacugggggaaaagag

SEQ ID NO: 49687 - RNA, 22 nt, Human
uaugcuacuagaaauaaaaugg

SEQ ID NO: 49688 - RNA, 22 nt, Human
uaugcuauucuucagaguguuc

SEQ ID NO: 49689 - RNA, 22 nt, Human
uaugcuauuuuaaugaagaugu

SEQ ID NO: 49690 - RNA, 22 nt, Human
uaugcucuccucccagucccag

SEQ ID NO: 49691 - RNA, 22 nt, Human
uaugcugugcuagauacaauau

SEQ ID NO: 49692 - RNA, 22 nt, Human
uaugcuuucauucauaugugag

SEQ ID NO: 49693 - RNA, 22 nt, Human
uaugcuuugaaaaugugcugaa

SEQ ID NO: 49694 - RNA, 22 nt, Human
uaugcuuugauuuccucagcug

SEQ ID NO: 49695 - RNA, 22 nt, Human
uauggaaacuaauucauuuuuc

SEQ ID NO: 49696 - RNA, 22 nt, Human
uauggacaucugaaguugcaga

SEQ ID NO: 49697 - RNA, 22 nt, Human
uauggaugaguuccugaggagu

SEQ ID NO: 49698 - RNA, 22 nt, Human
uauggauguuuaucuacaggcu

SEQ ID NO: 49699 - RNA, 22 nt, Human
uauggcauaucugggagacucu

SEQ ID NO: 49700 - RNA, 23 nt, Human
uauggcaugguacuuccagcaga

SEQ ID NO: 49701 - RNA, 22 nt, Human
uauggcauuuuguaagggcuug

SEQ ID NO: 49702 - RNA, 22 nt, Human
uauggccaaucggguggacgcc

SEQ ID NO: 49703 - RNA, 22 nt, Human
uauggcuuaaaauuucagcaug

SEQ ID NO: 49704 - RNA, 22 nt, Human
uauggcuucauugugcuccgca

SEQ ID NO: 49705 - RNA, 22 nt, Human
uauggcuucugggccaaauuua

SEQ ID NO: 49706 - RNA, 22 nt, Human
uauggcuugaguuucagacuau

SEQ ID NO: 49707 - RNA, 20 nt, Human
uauggcuuggcaaagcuuca

SEQ ID NO: 49708 - RNA, 22 nt, Human
uauggcuuuaaauugaaggagu

SEQ ID NO: 49709 - RNA, 22 nt, Human
uauggcuuucuccauagggcag

SEQ ID NO: 49710 - RNA, 22 nt, Human
uauggcuuuuggcuucucucug

SEQ ID NO: 49711 - RNA, 22 nt, Human
uauggguaggguuugauaagau

SEQ ID NO: 49712 - RNA, 22 nt, Human
uauggguauaaacagguccuaa

SEQ ID NO: 49713 - RNA, 22 nt, Human
uauggguaucaaugacaaacau

SEQ ID NO: 49714 - RNA, 21 nt, Human
uaugguaaccagacaagaaug

SEQ ID NO: 49715 - RNA, 22 nt, Human
uaugguuauccucaaaagagga

SEQ ID NO: 49716 - RNA, 22 nt, Human
uauguaaguugcaaaugaagga

SEQ ID NO: 49717 - RNA, 22 nt, Human
uauguacaagcacacaugugac

SEQ ID NO: 49718 - RNA, 22 nt, Human
uauguacaaucagcaguucaua

SEQ ID NO: 49719 - RNA, 22 nt, Human
uauguacacuuaaguuugagaa

SEQ ID NO: 49720 - RNA, 22 nt, Human
uauguacagggauagaacuuga

SEQ ID NO: 49721 - RNA, 22 nt, Human
uauguacaguccuuaacuuaaa

SEQ ID NO: 49722 - RNA, 22 nt, Human
uauguacaucguugaauucaaa

SEQ ID NO: 49723 - RNA, 22 nt, Human
uauguacauggagagcaauuga

SEQ ID NO: 49724 - RNA, 22 nt, Human
uauguacauguuaaagggcaaa

SEQ ID NO: 49725 - RNA, 22 nt, Human
uauguacuuuccugggaauguu

SEQ ID NO: 49726 - RNA, 22 nt, Human
uauguagaugucauauaaauug

SEQ ID NO: 49727 - RNA, 22 nt, Human
uauguagucaaguggauauaug

SEQ ID NO: 49728 - RNA, 22 nt, Human
uauguauaaaugcaugugugga

SEQ ID NO: 49729 - RNA, 22 nt, Human
uauguauaaucacagaguguca

SEQ ID NO: 49730 - RNA, 22 nt, Human
uauguauagagucuuuuaaauu

SEQ ID NO: 49731 - RNA, 22 nt, Human
uauguauaugguagaaguaugu

SEQ ID NO: 49732 - RNA, 22 nt, Human
uauguauucucagauuuacuaa

SEQ ID NO: 49733 - RNA, 22 nt, Human
uaugucaaaaaagauuauguuu

SEQ ID NO: 49734 - RNA, 22 nt, Human
uaugucaaaguuaagaaauagg

SEQ ID NO: 49735 - RNA, 22 nt, Human
uaugucaacugugcugguuaau

SEQ ID NO: 49736 - RNA, 22 nt, Human
uaugucaugucuuagagaauga

SEQ ID NO: 49737 - RNA, 22 nt, Human
uaugucugcuugguuuuggaau

SEQ ID NO: 49738 - RNA, 22 nt, Human
uaugucuggcauguuguaauua

SEQ ID NO: 49739 - RNA, 22 nt, Human
uaugucuucgucaccuaucuca

SEQ ID NO: 49740 - RNA, 22 nt, Human
uaugucuugaaaugagaagcca

SEQ ID NO: 49741 - RNA, 22 nt, Human
uaugucuuuugcuugcaaauag

SEQ ID NO: 49742 - RNA, 20 nt, Human
uaugugauuuucucaucaau

SEQ ID NO: 49743 - RNA, 22 nt, Human
uaugugcaguuugcucuuaaca

SEQ ID NO: 49744 - RNA, 22 nt, Human
uauguggccauucuguuugugu

SEQ ID NO: 49745 - RNA, 22 nt, Human
uauguguaaucauaucugauac

SEQ ID NO: 49746 - RNA, 22 nt, Human
uaugugucccuugguguagcaa

SEQ ID NO: 49747 - RNA, 22 nt, Human
uauguguccuaagcaaucaucc

SEQ ID NO: 49748 - RNA, 22 nt, Human
uauguguggagccagccuggag

SEQ ID NO: 49749 - RNA, 16 nt, Human
uaugugugugggagug

SEQ ID NO: 49750 - RNA, 22 nt, Human
uauguguuugacacccugcaag

SEQ ID NO: 49751 - RNA, 22 nt, Human
uauguuaaauguuugauguuua

SEQ ID NO: 49752 - RNA, 22 nt, Human
uauguuaacauguuaggaacug

SEQ ID NO: 49753 - RNA, 22 nt, Human
uauguuacaaaguuuuucuaaa

SEQ ID NO: 49754 - RNA, 22 nt, Human
uauguuacuucuguaucugcuu

SEQ ID NO: 49755 - RNA, 22 nt, Human
uauguucagaagaagaaugggg

SEQ ID NO: 49756 - RNA, 22 nt, Human
uauguucaucuggugcaucagu

SEQ ID NO: 49757 - RNA, 22 nt, Human
uauguucuagacuuuugcugug

SEQ ID NO: 49758 - RNA, 22 nt, Human
uauguucucugcucuaggaugu

SEQ ID NO: 49759 - RNA, 22 nt, Human
uauguucugacucuacauggga

SEQ ID NO: 49760 - RNA, 22 nt, Human
uauguucugucuguacagauuu

SEQ ID NO: 49761 - RNA, 22 nt, Human
uauguucuuuacaucugugcaa

SEQ ID NO: 49762 - RNA, 22 nt, Human
uauguugagcauucagugaucu

SEQ ID NO: 49763 - RNA, 22 nt, Human
uauguugaucauagguaaaaga

SEQ ID NO: 49764 - RNA, 22 nt, Human
uauguuuaguauccauuuucag

SEQ ID NO: 49765 - RNA, 22 nt, Human
uauguuucugggcuugauauuu

SEQ ID NO: 49766 - RNA, 22 nt, Human
uauguuuuucaagugcacacua

SEQ ID NO: 49767 - RNA, 22 nt, Human
uauuaaagggaaguuaugcaug

SEQ ID NO: 49768 - RNA, 22 nt, Human
uauuaaauguuauuuggguugu

SEQ ID NO: 49769 - RNA, 22 nt, Human
ugcagagccccagauuggagag

SEQ ID NO: 49770 - RNA, 20 nt, Human
ugcagagcuggcuggcuccu

SEQ ID NO: 49771 - RNA, 22 nt, Human
ugcagaggcauuuauugaugua

SEQ ID NO: 49772 - RNA, 22 nt, Human
ugcagaggcuggcucgccgggu

SEQ ID NO: 49773 - RNA, 22 nt, Human
uaguaaaugugaaaugugggga

SEQ ID NO: 49774 - RNA, 22 nt, Human
uaguaagccucuccagagacag

SEQ ID NO: 49775 - RNA, 19 nt, Human
uaguacaaaagcagccaua

SEQ ID NO: 49776 - RNA, 19 nt, Human
uaguacacacucuaauucc

SEQ ID NO: 49777 - RNA, 22 nt, Human
uaguacacucuguaaguuuaaa

SEQ ID NO: 49778 - RNA, 22 nt, Human
uaguacagagacacuggaggaa

SEQ ID NO: 49779 - RNA, 22 nt, Human
uaguacaguuccaucaaagcag

SEQ ID NO: 49780 - RNA, 22 nt, Human
uaguacuacguuuucuacuauc

SEQ ID NO: 49781 - RNA, 22 nt, Human
uaguagaauccaaaccaacagu

SEQ ID NO: 49782 - RNA, 22 nt, Human
uaguagcaaaacucaucucuuu

SEQ ID NO: 49783 - RNA, 22 nt, Human
uaguauaauuguucuggaauca

SEQ ID NO: 49784 - RNA, 22 nt, Human
uaguauaucuuuaguacauagu

SEQ ID NO: 49785 - RNA, 22 nt, Human
uaguauauuuuguugcaauuca

SEQ ID NO: 49786 - RNA, 22 nt, Human
uaguauucagcuucucaggcaa

SEQ ID NO: 49787 - RNA, 20 nt, Human
uaguauuugcauaaggauag

SEQ ID NO: 49788 - RNA, 22 nt, Human
uagucaaaagcuucacucggaa

SEQ ID NO: 49789 - RNA, 22 nt, Human
uagucaaaccucagaauacccc

SEQ ID NO: 49790 - RNA, 22 nt, Human
uagucaacuagugagcauaugg

SEQ ID NO: 49791 - RNA, 22 nt, Human
uagucacaggaaguuucaaugu

SEQ ID NO: 49792 - RNA, 22 nt, Human
uagucacaugaucacaggaucg

SEQ ID NO: 49793 - RNA, 22 nt, Human
uagucaccuuuggcaccugcaa

SEQ ID NO: 49794 - RNA, 22 nt, Human
uagucaguaugaaauugcucaa

SEQ ID NO: 49795 - RNA, 22 nt, Human
uagucaguugggucuaguggca

SEQ ID NO: 49796 - RNA, 22 nt, Human
uagucauucuccuuacaaagcc

SEQ ID NO: 49797 - RNA, 22 nt, Human
uaguccagguuaaucccugccu

SEQ ID NO: 49798 - RNA, 22 nt, Human
uaguccauugauuagcucauuu

SEQ ID NO: 49799 - RNA, 22 nt, Human
uaguccauuuucacacugcuga

SEQ ID NO: 49800 - RNA, 22 nt, Human
uaguccugaccagcuggauguu

SEQ ID NO: 49801 - RNA, 22 nt, Human
uagucucuaggaggggaaaaga

SEQ ID NO: 49802 - RNA, 19 nt, Human
uagucuuuauucuuaauuu

SEQ ID NO: 49803 - RNA, 22 nt, Human
uagucuuucauuuggagcauuu

SEQ ID NO: 49804 - RNA, 22 nt, Human
uagucuuuugagaaguauaucu

SEQ ID NO: 49805 - RNA, 22 nt, Human
uagucuuuuuaauaaauaaugc

SEQ ID NO: 49806 - RNA, 22 nt, Human
uagugaaagucaaagacagcua

SEQ ID NO: 49807 - RNA, 22 nt, Human
uagugaaaugagaauguaugac

SEQ ID NO: 49808 - RNA, 22 nt, Human
uagugaauuccuaauaggaaga

SEQ ID NO: 49809 - RNA, 22 nt, Human
uagugauuaaaggcagaauguu

SEQ ID NO: 49810 - RNA, 22 nt, Human
ucagccagaaagugauuuucag

SEQ ID NO: 49811 - RNA, 22 nt, Human
ucagccagagggggcaaaggaa

SEQ ID NO: 49812 - RNA, 22 nt, Human
ucagccagcucuuggacucuga

SEQ ID NO: 49813 - RNA, 22 nt, Human
ucagccaggcagcccccugguc

SEQ ID NO: 49814 - RNA, 22 nt, Human
ucagccaggcccuaagagauug

SEQ ID NO: 49815 - RNA, 22 nt, Human
ucagccagugccuugaucuugc

SEQ ID NO: 49816 - RNA, 22 nt, Human
ucagccaguuaagucaagaaau

SEQ ID NO: 49817 - RNA, 22 nt, Human
ucagccaguuugauucuauuug

SEQ ID NO: 49818 - RNA, 22 nt, Human
ucagccauggugagagugagag

SEQ ID NO: 49819 - RNA, 22 nt, Human
ucagcccaacccugcacaagga

SEQ ID NO: 49820 - RNA, 22 nt, Human
ucagcccaguuuuaucaucugu

SEQ ID NO: 49821 - RNA, 19 nt, Human
ucagcccaucagacucaca

SEQ ID NO: 49822 - RNA, 22 nt, Human
ucagcccugggcuuccucaugg

SEQ ID NO: 49823 - RNA, 22 nt, Human
ucagccucucugaguccagacc

SEQ ID NO: 49824 - RNA, 23 nt, Human
ucagccucuuaggacuucucacc

SEQ ID NO: 49825 - RNA, 22 nt, Human
ucagccugcgucauggugacac

SEQ ID NO: 49826 - RNA, 18 nt, Human
ucagccuguugucugccu

SEQ ID NO: 49827 - RNA, 20 nt, Human
ucagccuucucauccugggg

SEQ ID NO: 49828 - RNA, 22 nt, Human
ucagcuauugaggguggugagu

SEQ ID NO: 49829 - RNA, 22 nt, Human
ucagcucacucugcuuccuggg

SEQ ID NO: 49830 - RNA, 22 nt, Human
ucagcuccagaguugcacagug

SEQ ID NO: 49831 - RNA, 22 nt, Human
ucagcuccucaugcaggggaua

SEQ ID NO: 49832 - RNA, 22 nt, Human
ucagcucugccuguggaggcac

SEQ ID NO: 49833 - RNA, 22 nt, Human
ucagcucuguuuugaguggaac

SEQ ID NO: 49834 - RNA, 20 nt, Human
ucagcucuuagaggucgcuu

SEQ ID NO: 49835 - RNA, 22 nt, Human
ucagcugagcuccagcucauag

SEQ ID NO: 49836 - RNA, 22 nt, Human
ucagcugcaguuucacaagcac

SEQ ID NO: 49837 - RNA, 22 nt, Human
ucagcugccuuucccaugcuag

SEQ ID NO: 49838 - RNA, 22 nt, Human
ucagcugcgacaggggccugag

SEQ ID NO: 49839 - RNA, 22 nt, Human
ucagcugcucaaauuuauguca

SEQ ID NO: 49840 - RNA, 22 nt, Human
ucagcugcucuguugagcugaa

SEQ ID NO: 49841 - RNA, 22 nt, Human
ucagcuggggcccccucugucc

SEQ ID NO: 49842 - RNA, 18 nt, Human
ucagcuggguuucugggu

SEQ ID NO: 49843 - RNA, 22 nt, Human
ucagcuguguaucccagggccu

SEQ ID NO: 49844 - RNA, 22 nt, Human
ucagcuucacccagaguuguag

SEQ ID NO: 49845 - RNA, 22 nt, Human
ucagcuucagaucagcuagaga

SEQ ID NO: 49846 - RNA, 22 nt, Human
ucagcuuccucugugguuccag

SEQ ID NO: 49847 - RNA, 21 nt, Human
ucagcuugcuucauuauuaug

SEQ ID NO: 49848 - RNA, 22 nt, Human
ucagcuugugggucagccucug

SEQ ID NO: 49849 - RNA, 22 nt, Human
ucagcuuucuauguugcuaaac

SEQ ID NO: 49850 - RNA, 22 nt, Human
ucagcuuucucaaagaagcugg

SEQ ID NO: 49851 - RNA, 21 nt, Human
ucagcuuugcaacugcacauc

SEQ ID NO: 49852 - RNA, 22 nt, Human
ucagcuuuuuacaugugaaaua

SEQ ID NO: 49853 - RNA, 22 nt, Human
ucaggaaacuacaguugaacua

SEQ ID NO: 49854 - RNA, 22 nt, Human
ucaggaaagaguaauguauaca

SEQ ID NO: 49855 - RNA, 22 nt, Human
ucaggaaagaguguauccauca

SEQ ID NO: 49856 - RNA, 22 nt, Human
ucaggaaagaguuagaugauua

SEQ ID NO: 49857 - RNA, 22 nt, Human
ucaggaaagguuuguugaaugg

SEQ ID NO: 49858 - RNA, 22 nt, Human
ucaggaaauggugauuugguug

SEQ ID NO: 49859 - RNA, 22 nt, Human
ucaggaaaugucccagguugug

SEQ ID NO: 49860 - RNA, 22 nt, Human
ucaggaacacaggggcccaugc

SEQ ID NO: 49861 - RNA, 22 nt, Human
ucaggaacccccgcugggugaa

SEQ ID NO: 49862 - RNA, 22 nt, Human
ucaggaacuucuaggaaagcug

SEQ ID NO: 49863 - RNA, 22 nt, Human
ucaggaagaaagaagggagugu

SEQ ID NO: 49864 - RNA, 22 nt, Human
ucaggaagaagacggggcagga

SEQ ID NO: 49865 - RNA, 22 nt, Human
ucaggaagccacuccacagaga

SEQ ID NO: 49866 - RNA, 22 nt, Human
ucaggaagcucuugcugauucu

SEQ ID NO: 49867 - RNA, 22 nt, Human
ucaggaaggcacuugguguguu

SEQ ID NO: 49868 - RNA, 22 nt, Human
ucaggaagugccuaggcuggcc

SEQ ID NO: 49869 - RNA, 19 nt, Human
ucaggaaguugaugaggug

SEQ ID NO: 49870 - RNA, 22 nt, Human
ucaggaaguuuugaaucaacug

SEQ ID NO: 49871 - RNA, 22 nt, Human
ucaggacaaccuguuuucagac

SEQ ID NO: 49872 - RNA, 22 nt, Human
ucaggacagagaucagaacuuc

SEQ ID NO: 49873 - RNA, 22 nt, Human
ucaggacaguucccugcaaauu

SEQ ID NO: 49874 - RNA, 22 nt, Human
ucaggacauuugucagcaggag

SEQ ID NO: 49875 - RNA, 22 nt, Human
ucaggagaaaauaucaggaagu

SEQ ID NO: 49876 - RNA, 22 nt, Human
ucaggagaaagccaauuagagu

SEQ ID NO: 49877 - RNA, 22 nt, Human
ucaggagacuggcagugcccac

SEQ ID NO: 49878 - RNA, 22 nt, Human
ucaggagagagaaauuggggcu

SEQ ID NO: 49879 - RNA, 21 nt, Human
ucaggagagcccaucuacaaa

SEQ ID NO: 49880 - RNA, 22 nt, Human
ucaggagaguguucaguggagg

SEQ ID NO: 49881 - RNA, 22 nt, Human
ucaggagcaacaucuuugaauc

SEQ ID NO: 49882 - RNA, 22 nt, Human
ucaguaaaagggugcuuuacuc

SEQ ID NO: 49883 - RNA, 22 nt, Human
ucaguaaaauaaaacaugggac

SEQ ID NO: 49884 - RNA, 22 nt, Human
ucaguaaaauuacagaucuaca

SEQ ID NO: 49885 - RNA, 22 nt, Human
ucaguaaacagguuuaaguccu

SEQ ID NO: 49886 - RNA, 22 nt, Human
ucaguaaaggggaggugauggg

SEQ ID NO: 49887 - RNA, 22 nt, Human
ucaguaaagucucuagagggua

SEQ ID NO: 49888 - RNA, 22 nt, Human
ucaguaaauaacucagaugcuc

SEQ ID NO: 49889 - RNA, 22 nt, Human
ucaguaaaugaaugaauauaug

SEQ ID NO: 49890 - RNA, 22 nt, Human
ucaguaaaugagcaaaaauuuc

SEQ ID NO: 49891 - RNA, 23 nt, Human
ucaguaaaugguaaagucucuuc

SEQ ID NO: 49892 - RNA, 22 nt, Human
ucaguaaccuuuagcacaguug

SEQ ID NO: 49893 - RNA, 22 nt, Human
ucaguaacuggguugaagcuag

SEQ ID NO: 49894 - RNA, 22 nt, Human
ucaguaacuuacuuauucaccu

SEQ ID NO: 49895 - RNA, 22 nt, Human
ucaguaacuucaugaccaagca

SEQ ID NO: 49896 - RNA, 22 nt, Human
ucaguaauauucuuuaaaauac

SEQ ID NO: 49897 - RNA, 23 nt, Human
ucaguaccacagcugcaugaccu

SEQ ID NO: 49898 - RNA, 18 nt, Human
ucaguacugcagagagaa

SEQ ID NO: 49899 - RNA, 22 nt, Human
ucaguacuucaguagauggagc

SEQ ID NO: 49900 - RNA, 22 nt, Human
ucaguacuucccauucugagcu

SEQ ID NO: 49901 - RNA, 22 nt, Human
ucaguaucaggcuggaauuaag

SEQ ID NO: 49902 - RNA, 22 nt, Human
ucaguaucaugcgguagccaug

SEQ ID NO: 49903 - RNA, 18 nt, Human
ucaguauuaccucaggca

SEQ ID NO: 49904 - RNA, 22 nt, Human
ucagucaccuugacuauagcug

SEQ ID NO: 49905 - RNA, 22 nt, Human
ucagucacuuuugccugcuaca

SEQ ID NO: 49906 - RNA, 22 nt, Human
ucagucaucccagcuuucaucu

SEQ ID NO: 49907 - RNA, 22 nt, Human
ucagucauuguccuuaaaacac

SEQ ID NO: 49908 - RNA, 22 nt, Human
ucaguccaggggcugugauguc

SEQ ID NO: 49909 - RNA, 22 nt, Human
ucaguccugaugacaggcccaa

SEQ ID NO: 49910 - RNA, 22 nt, Human
ucagucuauccagcucagaucc

SEQ ID NO: 49911 - RNA, 22 nt, Human
ucagucuucaaaucugagucgu

SEQ ID NO: 49912 - RNA, 22 nt, Human
ucagucuucccuccagugcaac

SEQ ID NO: 49913 - RNA, 22 nt, Human
ucagucuucuaaagggaugcaa

SEQ ID NO: 49914 - RNA, 22 nt, Human
ucagucuuuuucucuuaaguac

SEQ ID NO: 49915 - RNA, 22 nt, Human
ucagugaaugagauaacuuuag

SEQ ID NO: 49916 - RNA, 23 nt, Human
ucagugauguugaaccuagcagu

SEQ ID NO: 49917 - RNA, 22 nt, Human
ucagugcaaaaaaugggcuaga

SEQ ID NO: 49918 - RNA, 22 nt, Human
ucagugcacaaugacgguggcu

SEQ ID NO: 49919 - RNA, 22 nt, Human
ucagugcacccaauucucucca

SEQ ID NO: 49920 - RNA, 22 nt, Human
ucagugcagaauagugaugcau

SEQ ID NO: 49921 - RNA, 22 nt, Human
ucagugcaguagaacuuuaguu

SEQ ID NO: 49922 - RNA, 22 nt, Human
ucagugcauuaauaauaucagu

SEQ ID NO: 49923 - RNA, 22 nt, Human
ucagugcauucauggguggcug

SEQ ID NO: 49924 - RNA, 22 nt, Human
ucagugcuccuaaagugaaugc

SEQ ID NO: 49925 - RNA, 22 nt, Human
ucagugcugccauggcagggcc

SEQ ID NO: 49926 - RNA, 22 nt, Human
ucaguggaacugucugggugag

SEQ ID NO: 49927 - RNA, 22 nt, Human
ucaguggagcuaagcaugagau

SEQ ID NO: 49928 - RNA, 22 nt, Human
ucaguggaguauggaugaaguc

SEQ ID NO: 49929 - RNA, 22 nt, Human
ugcugucuguuuacuggcuaua

SEQ ID NO: 49930 - RNA, 22 nt, Human
ugcugugacagagucucaugga

SEQ ID NO: 49931 - RNA, 22 nt, Human
ugcugugagaccauuuguugag

SEQ ID NO: 49932 - RNA, 22 nt, Human
ugcugugcaaaggugaugugag

SEQ ID NO: 49933 - RNA, 22 nt, Human
ugcugugcuggcggcagaggcc

SEQ ID NO: 49934 - RNA, 22 nt, Human
ugcugugggcaguacauaagcu

SEQ ID NO: 49935 - RNA, 22 nt, Human
ugcuguguaaaaggugauugaa

SEQ ID NO: 49936 - RNA, 20 nt, Human
ugcuguguggcccagcauga

SEQ ID NO: 49937 - RNA, 22 nt, Human
ugcuguguuaaauacaagcaug

SEQ ID NO: 49938 - RNA, 22 nt, Human
ugcuguguuacugagauccggc

SEQ ID NO: 49939 - RNA, 22 nt, Human
ugcuguuauacuuagcugguua

SEQ ID NO: 49940 - RNA, 22 nt, Human
ugcuguuaucacauuuuguaaa

SEQ ID NO: 49941 - RNA, 22 nt, Human
ugcuguuucauuuuccucaucc

SEQ ID NO: 49942 - RNA, 22 nt, Human
ugcuuaaaaacaguaugguagu

SEQ ID NO: 49943 - RNA, 22 nt, Human
ugcuuaaaauaguucauuuuug

SEQ ID NO: 49944 - RNA, 22 nt, Human
ugcuuaaaaugaugauuauuuu

SEQ ID NO: 49945 - RNA, 22 nt, Human
ugcuuaaaauuuuccaaggauu

SEQ ID NO: 49946 - RNA, 22 nt, Human
ugcuuaaacauacuauuuauau

SEQ ID NO: 49947 - RNA, 22 nt, Human
ugcuuaauagugcacugguuuc

SEQ ID NO: 49948 - RNA, 22 nt, Human
ugcuuaaucaagaagccuauuu

SEQ ID NO: 49949 - RNA, 22 nt, Human
ugcuuaauccaaccuggcugac

SEQ ID NO: 49950 - RNA, 19 nt, Human
ugcuuaauuccuaguaggu

SEQ ID NO: 49951 - RNA, 19 nt, Human
ugcuuaccaucugugcugg

SEQ ID NO: 49952 - RNA, 22 nt, Human
ugcuuagaaucuggacuuguug

SEQ ID NO: 49953 - RNA, 22 nt, Human
ugcuuagacgucaaguacagcc

SEQ ID NO: 49954 - RNA, 22 nt, Human
ugcuuagaugaggcagcaggag

SEQ ID NO: 49955 - RNA, 22 nt, Human
ugcuuauuaaacaugcauauuc

SEQ ID NO: 49956 - RNA, 22 nt, Human
ugcuucaaaaaguuguuagagg

SEQ ID NO: 49957 - RNA, 22 nt, Human
ugcuucaaggccaugucaagcu

SEQ ID NO: 49958 - RNA, 22 nt, Human
ugcuucacuggcuccacauagg

SEQ ID NO: 49959 - RNA, 19 nt, Human
ugcuucagaaauagaaagc

SEQ ID NO: 49960 - RNA, 22 nt, Human
ugcuucagugcucugagccugu

SEQ ID NO: 49961 - RNA, 22 nt, Human
ugcuucaugaggcugagagaag

SEQ ID NO: 49962 - RNA, 22 nt, Human
ugcuucauuuccuuauauugua

SEQ ID NO: 49963 - RNA, 22 nt, Human
ugcuucauuuugacuuagccag

SEQ ID NO: 49964 - RNA, 22 nt, Human
ugcuuccaauucaaaucugugg

SEQ ID NO: 49965 - RNA, 22 nt, Human
ugcuuccacuaaugagcugugu

SEQ ID NO: 49966 - RNA, 22 nt, Human
ugcuuccagccuucccaaugcu

SEQ ID NO: 49967 - RNA, 22 nt, Human
ugcuuccuucccguucuucucc

SEQ ID NO: 49968 - RNA, 22 nt, Human
ugcuucgcccccuggugcagcu

SEQ ID NO: 49969 - RNA, 22 nt, Human
ugcuucucagccugucuggaaa

SEQ ID NO: 49970 - RNA, 22 nt, Human
ugcuucucccaaccagggccug

SEQ ID NO: 49971 - RNA, 22 nt, Human
ugcuucucuguucuaacccuug

SEQ ID NO: 49972 - RNA, 22 nt, Human
ugcuucugaacucagcaugugg

SEQ ID NO: 49973 - RNA, 22 nt, Human
ugcuucugacuaagcugcauga

SEQ ID NO: 49974 - RNA, 22 nt, Human
ugcuucugacugggucaguuga

SEQ ID NO: 49975 - RNA, 22 nt, Human
ugcuucugcaacuugaauguac

SEQ ID NO: 49976 - RNA, 22 nt, Human
ugcuucugcauucaauguugga

SEQ ID NO: 49977 - RNA, 22 nt, Human
ugcuucugggcaaaugugugug

SEQ ID NO: 49978 - RNA, 19 nt, Human
ugcuucuggggcuucucca

SEQ ID NO: 49979 - RNA, 22 nt, Human
ugcuucuggguaggccucagga

SEQ ID NO: 49980 - RNA, 17 nt, Human
ugcuucuguauugcugg

SEQ ID NO: 49981 - RNA, 22 nt, Human
ugcuucuuuaugauguaugauu

SEQ ID NO: 49982 - RNA, 19 nt, Human
ugcuugccugccuuuccca

SEQ ID NO: 49983 - RNA, 22 nt, Human
ugcuuggcuucauuuaaguuuu

SEQ ID NO: 49984 - RNA, 21 nt, Human
ugcuugggggcuucaggagcu

SEQ ID NO: 49985 - RNA, 22 nt, Human
ugcuugucaggauaagcucugg

SEQ ID NO: 49986 - RNA, 22 nt, Human
ugcuugucucagauaaaacuau

SEQ ID NO: 49987 - RNA, 22 nt, Human
ugcuugucucucugugcccacu

SEQ ID NO: 49988 - RNA, 22 nt, Human
ugcuugucuucaggauuauggu

SEQ ID NO: 49989 - RNA, 22 nt, Human
ugcuugugacagaacugugucc

SEQ ID NO: 49990 - RNA, 22 nt, Human
ugcuuuaaaccauggaugugag

SEQ ID NO: 49991 - RNA, 22 nt, Human
ucagagcacuuggcucauggca

SEQ ID NO: 49992 - RNA, 22 nt, Human
ucagagccccuccgcuguccca

SEQ ID NO: 49993 - RNA, 22 nt, Human
ucagagcucaugagcagagcca

SEQ ID NO: 49994 - RNA, 20 nt, Human
ucagagcugcaggagagaaa

SEQ ID NO: 49995 - RNA, 22 nt, Human
ucagagcuucaccuguuacauu

SEQ ID NO: 49996 - RNA, 22 nt, Human
ucagaggaaagggaacauaguc

SEQ ID NO: 49997 - RNA, 22 nt, Human
ucagaggaaaggucagauggcu

SEQ ID NO: 49998 - RNA, 22 nt, Human
ucagaggaagccuuggugggag

SEQ ID NO: 49999 - RNA, 22 nt, Human
ucagaggaauaaugcugcauuu

SEQ ID NO: 50000 - RNA, 22 nt, Human
ucagaggaauuugcuuuucaug

SEQ ID NO: 50001 - RNA, 22 nt, Human
ucagaggacgcacuaggguugu

SEQ ID NO: 50002 - RNA, 22 nt, Human
ucagaggagcugcagaacgcug

SEQ ID NO: 50003 - RNA, 22 nt, Human
ucagaggauagaaauacuuauu

SEQ ID NO: 50004 - RNA, 22 nt, Human
ucagaggcaaagaacuuuauua

SEQ ID NO: 50005 - RNA, 22 nt, Human
ucagaggccuugguuaugguau

SEQ ID NO: 50006 - RNA, 22 nt, Human
ucagaggcucacugucuacuuu

SEQ ID NO: 50007 - RNA, 22 nt, Human
ucagaggcugcauuuuuaucca

SEQ ID NO: 50008 - RNA, 22 nt, Human
ucagaggcuuucaauguguuuu

SEQ ID NO: 50009 - RNA, 22 nt, Human
ucagagguggccccugcccuca

SEQ ID NO: 50010 - RNA, 22 nt, Human
ucagagguuacccaugggacag

SEQ ID NO: 50011 - RNA, 22 nt, Human
ucagaguauuucauucuuaggu

SEQ ID NO: 50012 - RNA, 22 nt, Human
ucagagucuaaauagaagaaua

SEQ ID NO: 50013 - RNA, 22 nt, Human
ucagagucuuggcaauagguua

SEQ ID NO: 50014 - RNA, 21 nt, Human
ucagaguggaagacaguuuga

SEQ ID NO: 50015 - RNA, 22 nt, Human
ucagagugguagccuauuuucu

SEQ ID NO: 50016 - RNA, 22 nt, Human
ucagagugugacuuggucauga

SEQ ID NO: 50017 - RNA, 22 nt, Human
ucagaguuccucauagauccag

SEQ ID NO: 50018 - RNA, 22 nt, Human
ucagaguuggcaguaaaacaca

SEQ ID NO: 50019 - RNA, 22 nt, Human
ucagaguuucugauuuaguagg

SEQ ID NO: 50020 - RNA, 22 nt, Human
ucagauaauuaaucaugaaauu

SEQ ID NO: 50021 - RNA, 22 nt, Human
ucagaucaggaugcagcaacau

SEQ ID NO: 50022 - RNA, 22 nt, Human
ucagaucauggaucuauuacuu

SEQ ID NO: 50023 - RNA, 22 nt, Human
ucagauccgagugugccaagga

SEQ ID NO: 50024 - RNA, 22 nt, Human
ucagaucuaauuggauuauuau

SEQ ID NO: 50025 - RNA, 22 nt, Human
ucagaugcccuuuguuuuagac

SEQ ID NO: 50026 - RNA, 22 nt, Human
ucagaugcuaaagauggaauua

SEQ ID NO: 50027 - RNA, 22 nt, Human
ucagaugcuuagugacuacaca

SEQ ID NO: 50028 - RNA, 22 nt, Human
ucagauggaggcaauguuaccu

SEQ ID NO: 50029 - RNA, 22 nt, Human
ucagauggcacacagagccugc

SEQ ID NO: 50030 - RNA, 18 nt, Human
ucagauuuaacuguaucc

SEQ ID NO: 50031 - RNA, 22 nt, Human
ucagauuuauguggcuaggcuc

SEQ ID NO: 50032 - RNA, 22 nt, Human
ucagauuucugaaagcccucuc

SEQ ID NO: 50033 - RNA, 22 nt, Human
ucagauuuguccuacuaggcac

SEQ ID NO: 50034 - RNA, 22 nt, Human
ucagauuuuccacagacuggaa

SEQ ID NO: 50035 - RNA, 20 nt, Human
ucagauuuuucuaacuuuga

SEQ ID NO: 50036 - RNA, 22 nt, Human
ucagcaaaauguggcuagugcu

SEQ ID NO: 50037 - RNA, 22 nt, Human
ucagcaaacauugauuggacuu

SEQ ID NO: 50038 - RNA, 22 nt, Human
ucagcaacuauuuaucaaauuc

SEQ ID NO: 50039 - RNA, 22 nt, Human
ucagcaaguauuuucugaaugc

SEQ ID NO: 50040 - RNA, 22 nt, Human
ucagcaauaugauaggcuuugu

SEQ ID NO: 50041 - RNA, 22 nt, Human
ucagcaauccucccacaggugg

SEQ ID NO: 50042 - RNA, 22 nt, Human
ucagcaaugagaacuggcauuu

SEQ ID NO: 50043 - RNA, 22 nt, Human
ucagcaaugugauacugugcaa

SEQ ID NO: 50044 - RNA, 22 nt, Human
ucagcacuauacauuuugaaua

SEQ ID NO: 50045 - RNA, 22 nt, Human
ucagcacucgcuaccuaguaaa

SEQ ID NO: 50046 - RNA, 22 nt, Human
ucagcacugaaauucuucacau

SEQ ID NO: 50047 - RNA, 22 nt, Human
ucagcacuuugaagcagaagga

SEQ ID NO: 50048 - RNA, 22 nt, Human
ucagcacuuuuacucucuuugc

SEQ ID NO: 50049 - RNA, 22 nt, Human
ucagcagaaaggcacuagauga

SEQ ID NO: 50050 - RNA, 22 nt, Human
ucagcagaauguggcaugucac

SEQ ID NO: 50051 - RNA, 22 nt, Human
ucagcagacaguuagcuauauu

SEQ ID NO: 50052 - RNA, 22 nt, Human
ucagcagagcgagaccaaguca

SEQ ID NO: 50053 - RNA, 22 nt, Human
ucagcagaguuucaucuuggga

SEQ ID NO: 50054 - RNA, 21 nt, Human
ucagcagcuuuugcagucccu

SEQ ID NO: 50055 - RNA, 21 nt, Human
ucagcaggcaccagaaggcug

SEQ ID NO: 50056 - RNA, 22 nt, Human
ucagcaggcagaaaucugcaga

SEQ ID NO: 50057 - RNA, 22 nt, Human
ucagcaggcucugguugaccau

SEQ ID NO: 50058 - RNA, 17 nt, Human
ucagcaggggccaagcu

SEQ ID NO: 50059 - RNA, 22 nt, Human
ucagcaggggccguugggugga

SEQ ID NO: 50060 - RNA, 22 nt, Human
ucagcaggguuugacuucuaau

SEQ ID NO: 50061 - RNA, 22 nt, Human
ucagcaggugccucagauucuu

SEQ ID NO: 50062 - RNA, 22 nt, Human
ucagcagguggugggcagguga

SEQ ID NO: 50063 - RNA, 22 nt, Human
ucagcaguugcccccucccagc

SEQ ID NO: 50064 - RNA, 21 nt, Human
ucagcauccugagcuguccuc

SEQ ID NO: 50065 - RNA, 22 nt, Human
ucagcaucucaaccuucucuac

SEQ ID NO: 50066 - RNA, 22 nt, Human
ucagcauguacuucuccuccau

SEQ ID NO: 50067 - RNA, 22 nt, Human
ucagcauuccugaagacaagca

SEQ ID NO: 50068 - RNA, 22 nt, Human
ucagccacuucccucuggucag

SEQ ID NO: 50069 - RNA, 22 nt, Human
ucagccagagguggaugaguca

SEQ ID NO: 50070 - RNA, 20 nt, Human
ucagccagcuaacaugggga

SEQ ID NO: 50071 - RNA, 22 nt, Human
ucagccaggcacaauggcagcu

SEQ ID NO: 50072 - RNA, 22 nt, Human
ucagccaggccaccuucagcuu

SEQ ID NO: 50073 - RNA, 22 nt, Human
ucagccagggcucuggccucag

SEQ ID NO: 50074 - RNA, 22 nt, Human
ucagccagugugcaccuggagu

SEQ ID NO: 50075 - RNA, 23 nt, Human
ucagcccacaucuagucauuagc

SEQ ID NO: 50076 - RNA, 18 nt, Human
ucagcccagagcccaguu

SEQ ID NO: 50077 - RNA, 22 nt, Human
ucagcccaggaaugagccuucu

SEQ ID NO: 50078 - RNA, 22 nt, Human
ucagcccaguuaagaaccuguu

SEQ ID NO: 50079 - RNA, 22 nt, Human
ucagcccggguucgcaaacacu

SEQ ID NO: 50080 - RNA, 22 nt, Human
ucagaagcaggagugugcacaa

SEQ ID NO: 50081 - RNA, 22 nt, Human
ucagaagccgggcagguuuugg

SEQ ID NO: 50082 - RNA, 22 nt, Human
ucagaagccuugauuaucuaga

SEQ ID NO: 50083 - RNA, 22 nt, Human
ucagaaggaugugcagguggca

SEQ ID NO: 50084 - RNA, 20 nt, Human
ucagaaggcuccagagcaga

SEQ ID NO: 50085 - RNA, 22 nt, Human
ucagaagguuuuuagcaaagga

SEQ ID NO: 50086 - RNA, 22 nt, Human
ucagaaguagcuccccuucauu

SEQ ID NO: 50087 - RNA, 22 nt, Human
ucagaaguccaauaccauggga

SEQ ID NO: 50088 - RNA, 22 nt, Human
ucagaagucccagaauucacau

SEQ ID NO: 50089 - RNA, 22 nt, Human
ucagaagucccuugcaucuuag

SEQ ID NO: 50090 - RNA, 22 nt, Human
ucagaaguugagauauucaggg

SEQ ID NO: 50091 - RNA, 22 nt, Human
ucagaaguugauaaaguaguug

SEQ ID NO: 50092 - RNA, 20 nt, Human
ucagaaguuuccuggagcau

SEQ ID NO: 50093 - RNA, 23 nt, Human
ucagaaguuugguuguaacaugg

SEQ ID NO: 50094 - RNA, 22 nt, Human
ucagaauauauucauguuguca

SEQ ID NO: 50095 - RNA, 22 nt, Human
ucagaaucgguggggccaggaa

SEQ ID NO: 50096 - RNA, 22 nt, Human
ucagaaucuuucuagagucuag

SEQ ID NO: 50097 - RNA, 22 nt, Human
ucagaauggcccauaaauaguc

SEQ ID NO: 50098 - RNA, 22 nt, Human
ucagaauuacacagggccuuga

SEQ ID NO: 50099 - RNA, 22 nt, Human
ucagaauucagagggagugggg

SEQ ID NO: 50100 - RNA, 22 nt, Human
ucagcagacauuauuuucuggc

SEQ ID NO: 50101 - RNA, 22 nt, Human
ucagcagacuaggcagauuacu

SEQ ID NO: 50102 - RNA, 22 nt, Human
ucagcaggcacaccaaaaacug

SEQ ID NO: 50103 - RNA, 22 nt, Human
ucagcagggaggcucugugccc

SEQ ID NO: 50104 - RNA, 22 nt, Human
ucagcagggcauacugagccua

SEQ ID NO: 50105 - RNA, 22 nt, Human
ucagcagggccaugcucucucu

SEQ ID NO: 50106 - RNA, 22 nt, Human
ucagcagucacauguuguccca

SEQ ID NO: 50107 - RNA, 22 nt, Human
ucagcaguggcucucaugcagu

SEQ ID NO: 50108 - RNA, 22 nt, Human
ucagcaguggguccugagggug

SEQ ID NO: 50109 - RNA, 22 nt, Human
ucagcaguucaaccccgucaga

SEQ ID NO: 50110 - RNA, 22 nt, Human
ucagcaguuuuauaugcagcuu

SEQ ID NO: 50111 - RNA, 17 nt, Human
ucagcauacacagagaa

SEQ ID NO: 50112 - RNA, 22 nt, Human
ucagcaucacgugguccgagaa

SEQ ID NO: 50113 - RNA, 22 nt, Human
ucagcauucuuuacaaggauga

SEQ ID NO: 50114 - RNA, 22 nt, Human
ucagcauuguggcagagaaugg

SEQ ID NO: 50115 - RNA, 22 nt, Human
ucagcauuucagaaguggcaua

SEQ ID NO: 50116 - RNA, 22 nt, Human
ucagccaagcagccaucaucug

SEQ ID NO: 50117 - RNA, 22 nt, Human
ucagccagcauuaccccugacu

SEQ ID NO: 50118 - RNA, 22 nt, Human
ucagccaguauuugagugcuca

SEQ ID NO: 50119 - RNA, 22 nt, Human
ucagccaguuuguuuauuccgg

SEQ ID NO: 50120 - RNA, 22 nt, Human
ucagccaugucaggggaaugac

SEQ ID NO: 50121 - RNA, 22 nt, Human
ucagcccaccugguguggggcu

SEQ ID NO: 50122 - RNA, 22 nt, Human
ucagcccagaccaccucauugc

SEQ ID NO: 50123 - RNA, 19 nt, Human
ucagcccaggcugggaagc

SEQ ID NO: 50124 - RNA, 22 nt, Human
ucagcccagggacagaggcccc

SEQ ID NO: 50125 - RNA, 22 nt, Human
ucagcccaggucacguaaucaa

SEQ ID NO: 50126 - RNA, 22 nt, Human
ucagccccacggggucagccaa

SEQ ID NO: 50127 - RNA, 22 nt, Human
ucagcccuagaaagucuaagca

SEQ ID NO: 50128 - RNA, 22 nt, Human
ucagcccugaggacagaggcag

SEQ ID NO: 50129 - RNA, 22 nt, Human
ucagcccuggcacugucuccca

SEQ ID NO: 50130 - RNA, 22 nt, Human
ucagcccuuccuggagcuuuua

SEQ ID NO: 50131 - RNA, 22 nt, Human
ucagcccuugauguuugggggu

SEQ ID NO: 50132 - RNA, 22 nt, Human
ucagccuacacuccaacagcau

SEQ ID NO: 50133 - RNA, 22 nt, Human
ucagccucagguguucagauuu

SEQ ID NO: 50134 - RNA, 22 nt, Human
ucagccuggugauuccucuguc

SEQ ID NO: 50135 - RNA, 20 nt, Human
ucagccuugaaugcuugaaa

SEQ ID NO: 50136 - RNA, 22 nt, Human
ucagccuugcuucuggacuggu

SEQ ID NO: 50137 - RNA, 22 nt, Human
ucagccuuguggcccugcucca

SEQ ID NO: 50138 - RNA, 16 nt, Human
ucagcuauagggauug

SEQ ID NO: 50139 - RNA, 17 nt, Human
ucagcucagagcaccug

SEQ ID NO: 50140 - RNA, 22 nt, Human
ucagcuccuauacuuuguccug

SEQ ID NO: 50141 - RNA, 22 nt, Human
ucagcuccucagagccucaguu

SEQ ID NO: 50142 - RNA, 22 nt, Human
ucagcucugcaaggucaccucc

SEQ ID NO: 50143 - RNA, 22 nt, Human
ucagcucuguguacaguuagca

SEQ ID NO: 50144 - RNA, 22 nt, Human
ucagcugcagcaggcaccauuu

SEQ ID NO: 50145 - RNA, 22 nt, Human
ucagcugcauaagucaccuugc

SEQ ID NO: 50146 - RNA, 22 nt, Human
ucagcugccccaguggccccag

SEQ ID NO: 50147 - RNA, 22 nt, Human
ucagcugccucucccuggaaga

SEQ ID NO: 50148 - RNA, 22 nt, Human
ucagcuggaagauggugcagaa

SEQ ID NO: 50149 - RNA, 22 nt, Human
ucagcuggagacugcucaauga

SEQ ID NO: 50150 - RNA, 22 nt, Human
ucagcuggcagguucugggaag

SEQ ID NO: 50151 - RNA, 22 nt, Human
ucagcugggaaguucucgcuug

SEQ ID NO: 50152 - RNA, 22 nt, Human
ucagcuggugccacucagucaa

SEQ ID NO: 50153 - RNA, 21 nt, Human
ucagcuguagagauuacauuc

SEQ ID NO: 50154 - RNA, 22 nt, Human
ucagcuguaucagaaauacaau

SEQ ID NO: 50155 - RNA, 22 nt, Human
ucagcuguccgcagcccacuuc

SEQ ID NO: 50156 - RNA, 22 nt, Human
ucagcuuauauuuuuaguguaa

SEQ ID NO: 50157 - RNA, 23 nt, Human
ucagcuucauugucuucuauggc

SEQ ID NO: 50158 - RNA, 22 nt, Human
ucagcuucccuaucugaccaua

SEQ ID NO: 50159 - RNA, 22 nt, Human
ucagcuucucaaaauggcuuag

SEQ ID NO: 50160 - RNA, 22 nt, Human
ucagcuucuuucacuuaacaug

SEQ ID NO: 50161 - RNA, 21 nt, Human
ucagcuugaaucuagagauag

SEQ ID NO: 50162 - RNA, 22 nt, Human
ucagcuugcuaaaagggcaucu

SEQ ID NO: 50163 - RNA, 22 nt, Human
ucagcuuuccuugcuuuagauu

SEQ ID NO: 50164 - RNA, 22 nt, Human
ucagcuuucucucgccaucagg

SEQ ID NO: 50165 - RNA, 22 nt, Human
ucagcuuuggucacauugaguu

SEQ ID NO: 50166 - RNA, 22 nt, Human
ucagcuuuugucagaaauugua

SEQ ID NO: 50167 - RNA, 21 nt, Human
ucaggaaacaccucuuaagga

SEQ ID NO: 50168 - RNA, 22 nt, Human
ucaggaaagaagaugcucagug

SEQ ID NO: 50169 - RNA, 22 nt, Human
ucaggaaagccuagaagagaac

SEQ ID NO: 50170 - RNA, 22 nt, Human
ucaggaaagcugcggucaccug

SEQ ID NO: 50171 - RNA, 22 nt, Human
ucaggaaauacaagugacauca

SEQ ID NO: 50172 - RNA, 22 nt, Human
ucaggaaauuaaacacuugaaa

SEQ ID NO: 50173 - RNA, 22 nt, Human
ucaggaacagcagggaggaaag

SEQ ID NO: 50174 - RNA, 22 nt, Human
ucaggaacauaaugugagucag

SEQ ID NO: 50175 - RNA, 22 nt, Human
ucaggaacccuggucuccugcu

SEQ ID NO: 50176 - RNA, 22 nt, Human
ucaggaagaaauucuguaucuu

SEQ ID NO: 50177 - RNA, 21 nt, Human
ucaggaagagcuucucccacu

SEQ ID NO: 50178 - RNA, 22 nt, Human
ucaggaagcauccugagguguc

SEQ ID NO: 50179 - RNA, 22 nt, Human
ucaggaagcuacugccagcagc

SEQ ID NO: 50180 - RNA, 22 nt, Human
ucaggaagggcucagucugugc

SEQ ID NO: 50181 - RNA, 22 nt, Human
ucaggaaguugaggcguagaga

SEQ ID NO: 50182 - RNA, 22 nt, Human
ucaggaaugaggauaaacauug

SEQ ID NO: 50183 - RNA, 22 nt, Human
ucaggacaacaagacuuguuua

SEQ ID NO: 50184 - RNA, 22 nt, Human
ucaggacaauagugauuuuuac

SEQ ID NO: 50185 - RNA, 22 nt, Human
ucaggacacccugugcuuccuu

SEQ ID NO: 50186 - RNA, 22 nt, Human
ucaggacacuuggcacaagguc

SEQ ID NO: 50187 - RNA, 22 nt, Human
ucaggacuucauuaccucaggu

SEQ ID NO: 50188 - RNA, 22 nt, Human
ucaggagaaggcaauguggaaa

SEQ ID NO: 50189 - RNA, 22 nt, Human
ucaggagacaaagggugcggag

SEQ ID NO: 50190 - RNA, 18 nt, Human
ucaggagacacagacgca

SEQ ID NO: 50191 - RNA, 22 nt, Human
ucaggagcagccuuggagagcg

SEQ ID NO: 50192 - RNA, 22 nt, Human
ucaggagcagggggaagcucug

SEQ ID NO: 50193 - RNA, 22 nt, Human
ucaggagcugcauuauccugug

SEQ ID NO: 50194 - RNA, 22 nt, Human
ucaggagcuuagaugcuuugac

SEQ ID NO: 50195 - RNA, 22 nt, Human
ucaggagcuugguagugugauu

SEQ ID NO: 50196 - RNA, 22 nt, Human
ucaggaggacagauaaggauag

SEQ ID NO: 50197 - RNA, 22 nt, Human
ucaggaggccgugugcucagug

SEQ ID NO: 50198 - RNA, 23 nt, Human
ucagggacaugaugugucauauc

SEQ ID NO: 50199 - RNA, 22 nt, Human
ucagggacauuuagacacugau

SEQ ID NO: 50200 - RNA, 22 nt, Human
ucagggacuaggugcugccuga

SEQ ID NO: 50201 - RNA, 22 nt, Human
ucagggagccuggacuucaagg

SEQ ID NO: 50202 - RNA, 19 nt, Human
ucagggaguuuacagcaug

SEQ ID NO: 50203 - RNA, 22 nt, Human
ucagggauuaaggucaaaggug

SEQ ID NO: 50204 - RNA, 22 nt, Human
ucagggcaagauugguuaauaa

SEQ ID NO: 50205 - RNA, 22 nt, Human
ucagggcacaggccuguggguu

SEQ ID NO: 50206 - RNA, 16 nt, Human
ucagggcagaauggca

SEQ ID NO: 50207 - RNA, 21 nt, Human
ucagggcagcugcucuucaga

SEQ ID NO: 50208 - RNA, 21 nt, Human
ucagggcagugggagguuccu

SEQ ID NO: 50209 - RNA, 22 nt, Human
uguaaaaggaaaucaaagcacu

SEQ ID NO: 50210 - RNA, 23 nt, Human
uguaaaaugggguaguguuacca

SEQ ID NO: 50211 - RNA, 22 nt, Human
uguaaaccagggucauccuuag

SEQ ID NO: 50212 - RNA, 23 nt, Human
uguaaaccauuuugcaucccaug

SEQ ID NO: 50213 - RNA, 22 nt, Human
uguaaacuagggcugauaaggg

SEQ ID NO: 50214 - RNA, 22 nt, Human
uguaaacugaggguagcugauu

SEQ ID NO: 50215 - RNA, 22 nt, Human
uguaaacugcuucucaccaagg

SEQ ID NO: 50216 - RNA, 22 nt, Human
uguaaagagaaugguauaugga

SEQ ID NO: 50217 - RNA, 22 nt, Human
uguaaauaauuccuaggcuuuu

SEQ ID NO: 50218 - RNA, 20 nt, Human
uguaaauaggcauuguaguu

SEQ ID NO: 50219 - RNA, 22 nt, Human
uguaaaugaaguaugcuuuacu

SEQ ID NO: 50220 - RNA, 22 nt, Human
uguaaauggucagauaaaccua

SEQ ID NO: 50221 - RNA, 22 nt, Human
uguaaaugugaauuuccuuuuc

SEQ ID NO: 50222 - RNA, 22 nt, Human
uguaaauuggaaaucaaucaag

SEQ ID NO: 50223 - RNA, 23 nt, Human
uguaaauuuuguagucacauuuu

SEQ ID NO: 50224 - RNA, 22 nt, Human
uguaacaaaauaccuuggauug

SEQ ID NO: 50225 - RNA, 22 nt, Human
uguaacaaauacccuugaaguu

SEQ ID NO: 50226 - RNA, 22 nt, Human
uguaacaacauuugauuuuuag

SEQ ID NO: 50227 - RNA, 22 nt, Human
uguaacaaguaauccaugggag

SEQ ID NO: 50228 - RNA, 21 nt, Human
uguaacaaguucccuagguga

SEQ ID NO: 50229 - RNA, 22 nt, Human
uguaacaaugaauauagugacu

SEQ ID NO: 50230 - RNA, 22 nt, Human
uguaacaauuucuuacuauugu

SEQ ID NO: 50231 - RNA, 22 nt, Human
uguaacacucaaucuguuuaac

SEQ ID NO: 50232 - RNA, 22 nt, Human
uguaacagagcuuuuuuauagc

SEQ ID NO: 50233 - RNA, 22 nt, Human
uguaacaguaguuacuauucuu

SEQ ID NO: 50234 - RNA, 22 nt, Human
uguaaccugacugcuuugcucu

SEQ ID NO: 50235 - RNA, 22 nt, Human
uguaacuguggucuagggacug

SEQ ID NO: 50236 - RNA, 20 nt, Human
uguaagaaguaggaggguua

SEQ ID NO: 50237 - RNA, 22 nt, Human
uguaagauucuaagaguuaaug

SEQ ID NO: 50238 - RNA, 22 nt, Human
uguaaggaggaaaauuaguggu

SEQ ID NO: 50239 - RNA, 22 nt, Human
uguaaggugcucauguauuucu

SEQ ID NO: 50240 - RNA, 22 nt, Human
uguaaguaguaauggaaggaca

SEQ ID NO: 50241 - RNA, 22 nt, Human
uccauuuucuaaguaucacuua

SEQ ID NO: 50242 - RNA, 22 nt, Human
ucccaaauauaaugcaagagac

SEQ ID NO: 50243 - RNA, 21 nt, Human
ucccaagaauaugcauaaguu

SEQ ID NO: 50244 - RNA, 22 nt, Human
ucccaagaccuggcauccaagu

SEQ ID NO: 50245 - RNA, 22 nt, Human
ucccaagacgaugugcuuggcc

SEQ ID NO: 50246 - RNA, 22 nt, Human
ucccaagagcaagaacuugcug

SEQ ID NO: 50247 - RNA, 22 nt, Human
ucccaagauuagguuggaaagg

SEQ ID NO: 50248 - RNA, 22 nt, Human
ucccaagauuauugagggaggg

SEQ ID NO: 50249 - RNA, 22 nt, Human
ucccaagcccuggaugccucag

SEQ ID NO: 50250 - RNA, 21 nt, Human
ucccaagcugcuggcucagcu

SEQ ID NO: 50251 - RNA, 22 nt, Human
ucccaaggccucuaguugauua

SEQ ID NO: 50252 - RNA, 22 nt, Human
ucccacacagcccgcucaccgg

SEQ ID NO: 50253 - RNA, 22 nt, Human
ucccacagggcuucucuguaca

SEQ ID NO: 50254 - RNA, 22 nt, Human
ucccacagugaaguucaugaua

SEQ ID NO: 50255 - RNA, 22 nt, Human
ucccacauaugcaauccugaau

SEQ ID NO: 50256 - RNA, 22 nt, Human
ucccaccaggugaccauuucau

SEQ ID NO: 50257 - RNA, 22 nt, Human
ucccaccccuugacucuuuaag

SEQ ID NO: 50258 - RNA, 22 nt, Human
ucccacucccaggcaggccucu

SEQ ID NO: 50259 - RNA, 22 nt, Human
ucccacugcuuugcucugcuca

SEQ ID NO: 50260 - RNA, 21 nt, Human
ucccacuggcccagggcucca

SEQ ID NO: 50261 - RNA, 22 nt, Human
ucccacugugaauccaaggccu

SEQ ID NO: 50262 - RNA, 22 nt, Human
ucccagaaguccagccaugggc

SEQ ID NO: 50263 - RNA, 22 nt, Human
ucccagagauuuccucuccuuc

SEQ ID NO: 50264 - RNA, 22 nt, Human
ucccagagcagaugugcuaaag

SEQ ID NO: 50265 - RNA, 22 nt, Human
ucccagagcaguacuccaggag

SEQ ID NO: 50266 - RNA, 22 nt, Human
ucccagagcccaaguuggagag

SEQ ID NO: 50267 - RNA, 22 nt, Human
ucccagaggcaguugguaacuu

SEQ ID NO: 50268 - RNA, 22 nt, Human
ucccagaggcuccagucucuau

SEQ ID NO: 50269 - RNA, 19 nt, Human
ucccagagucuagagguug

SEQ ID NO: 50270 - RNA, 22 nt, Human
ucccagagucuucuccuguaau

SEQ ID NO: 50271 - RNA, 22 nt, Human
ucccagagugugggcaucaagg

SEQ ID NO: 50272 - RNA, 22 nt, Human
ucccagauucuucugugugggc

SEQ ID NO: 50273 - RNA, 22 nt, Human
ucccagcaagaaaggggguggc

SEQ ID NO: 50274 - RNA, 22 nt, Human
ucccagcacuguaauucuuugg

SEQ ID NO: 50275 - RNA, 22 nt, Human
ucccagcagagccagcaagccg

SEQ ID NO: 50276 - RNA, 22 nt, Human
ucccagcagaugagcugaccua

SEQ ID NO: 50277 - RNA, 22 nt, Human
ucccagcaggaguccaguuccc

SEQ ID NO: 50278 - RNA, 22 nt, Human
ucccagcauuaaugccugucag

SEQ ID NO: 50279 - RNA, 22 nt, Human
ucccagcccagacuucuccagu

SEQ ID NO: 50280 - RNA, 22 nt, Human
ucccagccggugccuggguccc

SEQ ID NO: 50281 - RNA, 22 nt, Human
ucccagccugacagugcaucaa

SEQ ID NO: 50282 - RNA, 22 nt, Human
ucccaggaaaacacucgaggac

SEQ ID NO: 50283 - RNA, 19 nt, Human
ucccaggaagcaaauguca

SEQ ID NO: 50284 - RNA, 22 nt, Human
ucccaggaaugucugaaaguga

SEQ ID NO: 50285 - RNA, 22 nt, Human
ucccaggagcaccuuuugagcc

SEQ ID NO: 50286 - RNA, 22 nt, Human
ucccaggaggugcuuccuagga

SEQ ID NO: 50287 - RNA, 22 nt, Human
ucccaggauguuggcggcaggu

SEQ ID NO: 50288 - RNA, 22 nt, Human
ucccaggccauaaaacucagag

SEQ ID NO: 50289 - RNA, 22 nt, Human
ucccagggcacucacccucccu

SEQ ID NO: 50290 - RNA, 22 nt, Human
ucccagggcagcuguccagaag

SEQ ID NO: 50291 - RNA, 22 nt, Human
ucccagggggaugaacacugcc

SEQ ID NO: 50292 - RNA, 22 nt, Human
ucccaggguccucuucuggaau

SEQ ID NO: 50293 - RNA, 21 nt, Human
ucccagggucuuaugggaugu

SEQ ID NO: 50294 - RNA, 22 nt, Human
ucccagggugaaaugcaguagg

SEQ ID NO: 50295 - RNA, 22 nt, Human
ucccagggugcgccugcccucg

SEQ ID NO: 50296 - RNA, 22 nt, Human
ucccagugagaugaaacaggua

SEQ ID NO: 50297 - RNA, 20 nt, Human
ucccaucacgccugugccag

SEQ ID NO: 50298 - RNA, 22 nt, Human
ucccaucacuagcaucugcacc

SEQ ID NO: 50299 - RNA, 22 nt, Human
ucccaucagucauugguugagg

SEQ ID NO: 50300 - RNA, 23 nt, Human
ucccaucuauugugaucaaugcc

SEQ ID NO: 50301 - RNA, 22 nt, Human
ucccauggucuauauagaggca

SEQ ID NO: 50302 - RNA, 22 nt, Human
ucccauguaagaaggagacagg

SEQ ID NO: 50303 - RNA, 22 nt, Human
ucccauguuaccaaggagucac

SEQ ID NO: 50304 - RNA, 22 nt, Human
ucccauugccauagauaggaca

SEQ ID NO: 50305 - RNA, 22 nt, Human
uccccaaaauacauggacgugu

SEQ ID NO: 50306 - RNA, 22 nt, Human
uccccacacagauacagaguag

SEQ ID NO: 50307 - RNA, 22 nt, Human
uccccacacuuucacuccuggc

SEQ ID NO: 50308 - RNA, 22 nt, Human
uccccacagcagaagaucugag

SEQ ID NO: 50309 - RNA, 21 nt, Human
uccccacauuucuaaacagac

SEQ ID NO: 50310 - RNA, 22 nt, Human
uccccaccccagaacuacuagg

SEQ ID NO: 50311 - RNA, 22 nt, Human
uccccagaggaauaugagauug

SEQ ID NO: 50312 - RNA, 22 nt, Human
uccccagaugacaucaaaaggc

SEQ ID NO: 50313 - RNA, 22 nt, Human
uccccagauucaugucugcugu

SEQ ID NO: 50314 - RNA, 22 nt, Human
uccccaggaaauucugauucuu

SEQ ID NO: 50315 - RNA, 22 nt, Human
uccccaggagcaaugauucagu

SEQ ID NO: 50316 - RNA, 22 nt, Human
uccccaggaguuuuacuuugca

SEQ ID NO: 50317 - RNA, 22 nt, Human
uccccaggggccugggcacagu

SEQ ID NO: 50318 - RNA, 22 nt, Human
cacaggagaaaggggaagcucg

SEQ ID NO: 50319 - RNA, 22 nt, Human
cacaggagaacccacagauucu

SEQ ID NO: 50320 - RNA, 22 nt, Human
cacaggagagcugggaggugcc

SEQ ID NO: 50321 - RNA, 22 nt, Human
cacaggagagguuaaugggggc

SEQ ID NO: 50322 - RNA, 18 nt, Human
cacaggagccacacucac

SEQ ID NO: 50323 - RNA, 22 nt, Human
cacaggagggagcgggcagcca

SEQ ID NO: 50324 - RNA, 23 nt, Human
cacaggcagaaaucaagacggua

SEQ ID NO: 50325 - RNA, 20 nt, Human
cacaggccccaagaccugua

SEQ ID NO: 50326 - RNA, 22 nt, Human
cacaggccugucucuuucuaac

SEQ ID NO: 50327 - RNA, 18 nt, Human
cacaggcucccagugagg

SEQ ID NO: 50328 - RNA, 22 nt, Human
cacaggcuccggccuugcagcc

SEQ ID NO: 50329 - RNA, 22 nt, Human
cacaggcucuucucacuugauu

SEQ ID NO: 50330 - RNA, 22 nt, Human
cacaggcugggaagccuaggcc

SEQ ID NO: 50331 - RNA, 22 nt, Human
cacaggcuuccaguccccagcu

SEQ ID NO: 50332 - RNA, 21 nt, Human
cacaggcuucuauacacaaug

SEQ ID NO: 50333 - RNA, 22 nt, Human
cacagggaaccaaggcugggcc

SEQ ID NO: 50334 - RNA, 22 nt, Human
cacagggaggacaucaacagug

SEQ ID NO: 50335 - RNA, 22 nt, Human
cacagggaggcagccaugcucc

SEQ ID NO: 50336 - RNA, 22 nt, Human
cacagggaguuacagaagcacu

SEQ ID NO: 50337 - RNA, 22 nt, Human
cacagggcagagaccugggugc

SEQ ID NO: 50338 - RNA, 22 nt, Human
cacagggcaggccccaggccuc

SEQ ID NO: 50339 - RNA, 22 nt, Human
cacagggcuaaaugaaggguug

SEQ ID NO: 50340 - RNA, 22 nt, Human
cacagggcuuugauggcugagu

SEQ ID NO: 50341 - RNA, 22 nt, Human
cacaggggcaaacuguagggga

SEQ ID NO: 50342 - RNA, 22 nt, Human
cacagguacauccuuaucccca

SEQ ID NO: 50343 - RNA, 22 nt, Human
cacaggugcuccucggggagcu

SEQ ID NO: 50344 - RNA, 22 nt, Human
cacagguggcuccaaguuagag

SEQ ID NO: 50345 - RNA, 22 nt, Human
cacagguguaugaauaugucca

SEQ ID NO: 50346 - RNA, 22 nt, Human
cacaggugugugccuuaucaaa

SEQ ID NO: 50347 - RNA, 23 nt, Human
cacagguguuucaucuucucagu

SEQ ID NO: 50348 - RNA, 22 nt, Human
cacagguuagguauuauacuau

SEQ ID NO: 50349 - RNA, 22 nt, Human
cacagguucaccucagguaggu

SEQ ID NO: 50350 - RNA, 22 nt, Human
cacaguaacuggcguguaguaa

SEQ ID NO: 50351 - RNA, 22 nt, Human
cacaguaagaaaugaagaggua

SEQ ID NO: 50352 - RNA, 20 nt, Human
cacaguauucuuccuuaaaa

SEQ ID NO: 50353 - RNA, 22 nt, Human
cacagucaauguagaaauauga

SEQ ID NO: 50354 - RNA, 22 nt, Human
cacagucuccucucuuagccug

SEQ ID NO: 50355 - RNA, 22 nt, Human
cacagucuuaucccaaccacca

SEQ ID NO: 50356 - RNA, 22 nt, Human
cacagugaauuucaaguguugu

SEQ ID NO: 50357 - RNA, 18 nt, Human
cacagugacuucugauac

SEQ ID NO: 50358 - RNA, 22 nt, Human
cacagugauugauuuuuacuuu

SEQ ID NO: 50359 - RNA, 22 nt, Human
cacagugcucggguuuuauguc

SEQ ID NO: 50360 - RNA, 22 nt, Human
cacaguguagacuaauaauaga

SEQ ID NO: 50361 - RNA, 22 nt, Human
cacaguguaguuaaugugacau

SEQ ID NO: 50362 - RNA, 22 nt, Human
cacaguuagcuccagucuuagc

SEQ ID NO: 50363 - RNA, 22 nt, Human
cacaguuauauguucacaagga

SEQ ID NO: 50364 - RNA, 22 nt, Human
cacaguugucugauuucuuccu

SEQ ID NO: 50365 - RNA, 22 nt, Human
cacauaaauggugccauguuuu

SEQ ID NO: 50366 - RNA, 22 nt, Human
cacauaauaaauguuccugaug

SEQ ID NO: 50367 - RNA, 22 nt, Human
cacauacaaggcacacuggagg

SEQ ID NO: 50368 - RNA, 19 nt, Human
cacauacagaaaagaguaa

SEQ ID NO: 50369 - RNA, 22 nt, Human
cacauacaugcacaccuaaaua

SEQ ID NO: 50370 - RNA, 22 nt, Human
cacauauaugaaaugaggaauu

SEQ ID NO: 50371 - RNA, 22 nt, Human
cacagguggcuucuuucaucuu

SEQ ID NO: 50372 - RNA, 17 nt, Human
cacaggugugguuugag

SEQ ID NO: 50373 - RNA, 22 nt, Human
cacagguucaaauucaggucgc

SEQ ID NO: 50374 - RNA, 22 nt, Human
cacaguaacuccugaccccucg

SEQ ID NO: 50375 - RNA, 22 nt, Human
cacaguaagguaucccagugaa

SEQ ID NO: 50376 - RNA, 22 nt, Human
cacaguacgcacccgauacaug

SEQ ID NO: 50377 - RNA, 22 nt, Human
cacaguacuuaauucucuaaau

SEQ ID NO: 50378 - RNA, 22 nt, Human
cacaguauucacugggcagauu

SEQ ID NO: 50379 - RNA, 22 nt, Human
cacaguccagacuccuggaguu

SEQ ID NO: 50380 - RNA, 22 nt, Human
cacaguccuacagagaucagag

SEQ ID NO: 50381 - RNA, 22 nt, Human
cacaguccugccagagggccuu

SEQ ID NO: 50382 - RNA, 22 nt, Human
cacagugaagcaugcagacauc

SEQ ID NO: 50383 - RNA, 22 nt, Human
cacagugacagcuauacagaga

SEQ ID NO: 50384 - RNA, 22 nt, Human
cacagugaguauuuaguaccua

SEQ ID NO: 50385 - RNA, 22 nt, Human
cacagugcaaucggccacaaau

SEQ ID NO: 50386 - RNA, 22 nt, Human
cacagugcacuaagcuccgggg

SEQ ID NO: 50387 - RNA, 22 nt, Human
cacaguggaaacagcuaagccu

SEQ ID NO: 50388 - RNA, 22 nt, Human
cacaguggcaaaggggcuuggg

SEQ ID NO: 50389 - RNA, 22 nt, Human
cacaguggcagguguggguugu

SEQ ID NO: 50390 - RNA, 22 nt, Human
cacaguggcuuugcuggucucg

SEQ ID NO: 50391 - RNA, 22 nt, Human
cacaguguggcaaauuucaacu

SEQ ID NO: 50392 - RNA, 22 nt, Human
cacaguguuugauuuaggggcc

SEQ ID NO: 50393 - RNA, 22 nt, Human
cacaguugaggucugguuguuu

SEQ ID NO: 50394 - RNA, 22 nt, Human
cacaguuuaugaucucagugaa

SEQ ID NO: 50395 - RNA, 22 nt, Human
cacaguuucaauaauuauucuu

SEQ ID NO: 50396 - RNA, 22 nt, Human
cacaguuucugaacacuuugca

SEQ ID NO: 50397 - RNA, 22 nt, Human
cacaguuugggucuccggggca

SEQ ID NO: 50398 - RNA, 22 nt, Human
cacaguuugguuuugcuguaau

SEQ ID NO: 50399 - RNA, 22 nt, Human
cacaguuuuaucuuauacugau

SEQ ID NO: 50400 - RNA, 22 nt, Human
cacauacauacguauguauaca

SEQ ID NO: 50401 - RNA, 22 nt, Human
cacauacauucauguuacucua

SEQ ID NO: 50402 - RNA, 22 nt, Human
cacauacugagaaucacaccca

SEQ ID NO: 50403 - RNA, 22 nt, Human
cacauauaaccuagacaaggcc

SEQ ID NO: 50404 - RNA, 22 nt, Human
cacauauaugggccccugaggg

SEQ ID NO: 50405 - RNA, 22 nt, Human
cacauauuguaguucaccagga

SEQ ID NO: 50406 - RNA, 22 nt, Human
cacauauuugaugaagcuuugu

SEQ ID NO: 50407 - RNA, 22 nt, Human
cacaucagguagaccuacagag

SEQ ID NO: 50408 - RNA, 22 nt, Human
cacaucauucaauggugauauu

SEQ ID NO: 50409 - RNA, 22 nt, Human
cacaucccuggaguuacccagu

SEQ ID NO: 50410 - RNA, 22 nt, Human
cacauccuucagcugagcccag

SEQ ID NO: 50411 - RNA, 22 nt, Human
cacaucugcucugggcagcacu

SEQ ID NO: 50412 - RNA, 22 nt, Human
cacaugaagaccuaauuggauu

SEQ ID NO: 50413 - RNA, 22 nt, Human
cacaugaaggcuggggucguga

SEQ ID NO: 50414 - RNA, 22 nt, Human
cacaugacacuauuuuguucua

SEQ ID NO: 50415 - RNA, 22 nt, Human
cacaugaucacuucuugaaaau

SEQ ID NO: 50416 - RNA, 22 nt, Human
cacaugcaguuuuccagcaguc

SEQ ID NO: 50417 - RNA, 22 nt, Human
cacaugcauaccuauguguaua

SEQ ID NO: 50418 - RNA, 22 nt, Human
cacaugcaucacgacuuccuuu

SEQ ID NO: 50419 - RNA, 22 nt, Human
cacaugcaugccaggcucacag

SEQ ID NO: 50420 - RNA, 22 nt, Human
cacaugcauuggcaaaagugua

SEQ ID NO: 50421 - RNA, 22 nt, Human
cacaugcccagaacuucucauu

SEQ ID NO: 50422 - RNA, 22 nt, Human
cacaugcuagaauaaaucucca

SEQ ID NO: 50423 - RNA, 22 nt, Human
cacaugcucauuggcacuguuc

SEQ ID NO: 50424 - RNA, 22 nt, Human
cacaugcuccauacagaauggg

SEQ ID NO: 50425 - RNA, 20 nt, Human
cacaugcuguguguuucucu

SEQ ID NO: 50426 - RNA, 22 nt, Human
cacauggcagaaucaugcaucu

SEQ ID NO: 50427 - RNA, 22 nt, Human
cacaggagcuguggggcagugu

SEQ ID NO: 50428 - RNA, 22 nt, Human
cacaggaggaggccagagcgua

SEQ ID NO: 50429 - RNA, 22 nt, Human
cacaggaggcaaugguaagauu

SEQ ID NO: 50430 - RNA, 22 nt, Human
cacaggaguuaacauaauuaag

SEQ ID NO: 50431 - RNA, 22 nt, Human
cacaggcaccccugacugcuca

SEQ ID NO: 50432 - RNA, 22 nt, Human
cacaggcacgccucuggccagg

SEQ ID NO: 50433 - RNA, 22 nt, Human
cacaggcaggagguucuccagu

SEQ ID NO: 50434 - RNA, 18 nt, Human
cacaggcaggugauaggu

SEQ ID NO: 50435 - RNA, 20 nt, Human
cacaggccuugugagcagac

SEQ ID NO: 50436 - RNA, 20 nt, Human
cacaggcuauaugagagcca

SEQ ID NO: 50437 - RNA, 20 nt, Human
cacaggcuuacaguuuagau

SEQ ID NO: 50438 - RNA, 22 nt, Human
cacaggcuuuucugacauaggc

SEQ ID NO: 50439 - RNA, 19 nt, Human
cacagggagaccacauguc

SEQ ID NO: 50440 - RNA, 22 nt, Human
cacagggcagugauuguccaca

SEQ ID NO: 50441 - RNA, 22 nt, Human
cacagggccuggggcagcugcu

SEQ ID NO: 50442 - RNA, 22 nt, Human
cacagggccuugugugacugca

SEQ ID NO: 50443 - RNA, 22 nt, Human
cacagggcuucucauggggugc

SEQ ID NO: 50444 - RNA, 22 nt, Human
cacaggguuguucugaggauuc

SEQ ID NO: 50445 - RNA, 22 nt, Human
cacagguccuuccugcccuggg

SEQ ID NO: 50446 - RNA, 22 nt, Human
cacaggugccaucucuucaugg

SEQ ID NO: 50447 - RNA, 22 nt, Human
cacagguguccaauaccugcuu

SEQ ID NO: 50448 - RNA, 22 nt, Human
cacagguguguccuggucuugu

SEQ ID NO: 50449 - RNA, 22 nt, Human
cacagguguucuugcagugaaa

SEQ ID NO: 50450 - RNA, 22 nt, Human
cacagguuagcagcuugaaacu

SEQ ID NO: 50451 - RNA, 22 nt, Human
cacagguugggggaguugauaa

SEQ ID NO: 50452 - RNA, 22 nt, Human
cacagguuucaaggauaagaug

SEQ ID NO: 50453 - RNA, 22 nt, Human
cacagguuugacaaggauaaaa

SEQ ID NO: 50454 - RNA, 22 nt, Human
cacaguaaccccaggacuggga

SEQ ID NO: 50455 - RNA, 22 nt, Human
cacaguacugcuuugggaugug

SEQ ID NO: 50456 - RNA, 22 nt, Human
cacaguaucccucuuucucccc

SEQ ID NO: 50457 - RNA, 22 nt, Human
cacaguaucuuuugaguaagca

SEQ ID NO: 50458 - RNA, 22 nt, Human
cacaguauuuguuuuucugagu

SEQ ID NO: 50459 - RNA, 23 nt, Human
cacagucauuuacuuugccauca

SEQ ID NO: 50460 - RNA, 22 nt, Human
cacagucccauucgagaguaau

SEQ ID NO: 50461 - RNA, 22 nt, Human
cacagucccgugcuuaccaugu

SEQ ID NO: 50462 - RNA, 22 nt, Human
cacagucucuguugcugggacc

SEQ ID NO: 50463 - RNA, 22 nt, Human
cacagugaacauucugucaggg

SEQ ID NO: 50464 - RNA, 22 nt, Human
cacagugacuggcacauaguaa

SEQ ID NO: 50465 - RNA, 22 nt, Human
cacagugagcugggcaucaguu

SEQ ID NO: 50466 - RNA, 22 nt, Human
cacagugcaugaugggcagaag

SEQ ID NO: 50467 - RNA, 22 nt, Human
cacagugcgaaagaaacccagc

SEQ ID NO: 50468 - RNA, 22 nt, Human
cacaguuucuauaggucagaau

SEQ ID NO: 50469 - RNA, 22 nt, Human
cacaguuugcauaggaaaaaca

SEQ ID NO: 50470 - RNA, 22 nt, Human
cacaguuugguauagaagugau

SEQ ID NO: 50471 - RNA, 22 nt, Human
cacaguuuugcccagggcuucu

SEQ ID NO: 50472 - RNA, 22 nt, Human
cacaguuuugucuugguuucca

SEQ ID NO: 50473 - RNA, 22 nt, Human
cacauaauacauguuccacuua

SEQ ID NO: 50474 - RNA, 22 nt, Human
cacauaaucaccaaguccuuuc

SEQ ID NO: 50475 - RNA, 22 nt, Human
cacauacaaugguguuauuugg

SEQ ID NO: 50476 - RNA, 22 nt, Human
cacauagauaggcagaagaaca

SEQ ID NO: 50477 - RNA, 22 nt, Human
cacauauaccagccgcgguacg

SEQ ID NO: 50478 - RNA, 23 nt, Human
cacauauagcagccacuaagguc

SEQ ID NO: 50479 - RNA, 22 nt, Human
cacauccgaggagggugagaug

SEQ ID NO: 50480 - RNA, 22 nt, Human
cacaugaacaugcuggaaaagc

SEQ ID NO: 50481 - RNA, 22 nt, Human
cacaugaagagagucuaguaau

SEQ ID NO: 50482 - RNA, 22 nt, Human
cacaugaauucacauguauuuu

SEQ ID NO: 50483 - RNA, 23 nt, Human
cacaugaccugaccuaggcuagg

SEQ ID NO: 50484 - RNA, 19 nt, Human
cacaugagggcugagggac

SEQ ID NO: 50485 - RNA, 22 nt, Human
cacaugaggugacuuccaagcu

SEQ ID NO: 50486 - RNA, 22 nt, Human
cacaugaucgucaugugaaagu

SEQ ID NO: 50487 - RNA, 22 nt, Human
cacaugcaaguccucaguucua

SEQ ID NO: 50488 - RNA, 22 nt, Human
cacaugcaggagccaauguaca

SEQ ID NO: 50489 - RNA, 21 nt, Human
cacaugcaugcacagguugua

SEQ ID NO: 50490 - RNA, 22 nt, Human
cacauggaagagauacagugag

SEQ ID NO: 50491 - RNA, 16 nt, Human
cacauauauuuauaug

SEQ ID NO: 50492 - RNA, 22 nt, Human
cacaucaagcauccaugaguuu

SEQ ID NO: 50493 - RNA, 22 nt, Human
cacaucauagagacucaaucca

SEQ ID NO: 50494 - RNA, 22 nt, Human
cacauccuaucagucacgguuu

SEQ ID NO: 50495 - RNA, 22 nt, Human
cacauccuucauacucagcucu

SEQ ID NO: 50496 - RNA, 22 nt, Human
cacaucuacugaaugagcagug

SEQ ID NO: 50497 - RNA, 22 nt, Human
cacaucuacugauauuccagga

SEQ ID NO: 50498 - RNA, 22 nt, Human
cacaucuauggagacagagagu

SEQ ID NO: 50499 - RNA, 22 nt, Human
cacaucugcgcucugccucaua

SEQ ID NO: 50500 - RNA, 22 nt, Human
cacaucuggguucucuucuuca

SEQ ID NO: 50501 - RNA, 22 nt, Human
cacaucuuccagaguagcuaaa

SEQ ID NO: 50502 - RNA, 22 nt, Human
cacaugaagauucaacuggaug

SEQ ID NO: 50503 - RNA, 22 nt, Human
cacaugaauugaugccaagugc

SEQ ID NO: 50504 - RNA, 22 nt, Human
cacaugaccacucuuuacuucu

SEQ ID NO: 50505 - RNA, 22 nt, Human
cacaugagacaauuaaagacuu

SEQ ID NO: 50506 - RNA, 22 nt, Human
cacaugagguggagaugaauga

SEQ ID NO: 50507 - RNA, 22 nt, Human
cacaugagugagaacaugcagu

SEQ ID NO: 50508 - RNA, 23 nt, Human
cacaugcaggcaguggccuucaa

SEQ ID NO: 50509 - RNA, 22 nt, Human
cacaugcaguuuacgucacuga

SEQ ID NO: 50510 - RNA, 22 nt, Human
cacaugcauaaggauaauuacu

SEQ ID NO: 50511 - RNA, 22 nt, Human
cacaugcuuagauuucagugga

SEQ ID NO: 50512 - RNA, 22 nt, Human
cacaugcuucuuuugauuauga

SEQ ID NO: 50513 - RNA, 23 nt, Human
cacauggaggaccguucuuauaa

SEQ ID NO: 50514 - RNA, 23 nt, Human
cacauggauuaaaugagaccaca

SEQ ID NO: 50515 - RNA, 22 nt, Human
cacauggccuguguggccagac

SEQ ID NO: 50516 - RNA, 22 nt, Human
cacauguacagaagcaggcugg

SEQ ID NO: 50517 - RNA, 22 nt, Human
cacauguccuggcgcugagccc

SEQ ID NO: 50518 - RNA, 17 nt, Human
cacaugucuacauggau

SEQ ID NO: 50519 - RNA, 22 nt, Human
cacaugugcaaauacugaggcu

SEQ ID NO: 50520 - RNA, 22 nt, Human
cacauguuugcuacauuuuucu

SEQ ID NO: 50521 - RNA, 22 nt, Human
cacauucacauuuuucccucua

SEQ ID NO: 50522 - RNA, 22 nt, Human
cacauucagguggcauguuaga

SEQ ID NO: 50523 - RNA, 22 nt, Human
cacauucaucaguguuguacug

SEQ ID NO: 50524 - RNA, 22 nt, Human
cacauucauggaguuugccugu

SEQ ID NO: 50525 - RNA, 22 nt, Human
cacauuccccagagcuggggcu

SEQ ID NO: 50526 - RNA, 22 nt, Human
cacauuccuggugcucagcagc

SEQ ID NO: 50527 - RNA, 22 nt, Human
cacauugaaaugacccaauaau

SEQ ID NO: 50528 - RNA, 22 nt, Human
cacauugaacuugucugguggg

SEQ ID NO: 50529 - RNA, 22 nt, Human
cacauuguagagauuagaaaga

SEQ ID NO: 50530 - RNA, 22 nt, Human
cacauuuaaaaaauccacgauc

SEQ ID NO: 50531 - RNA, 22 nt, Human
cacauuuaagugcuuguucaga

SEQ ID NO: 50532 - RNA, 22 nt, Human
cacauuuacauauaaaacuuuc

SEQ ID NO: 50533 - RNA, 18 nt, Human
cacauuuaccuggcuccc

SEQ ID NO: 50534 - RNA, 22 nt, Human
cacauuuagguuccuauagcca

SEQ ID NO: 50535 - RNA, 22 nt, Human
cacauuuaucucucuccgguga

SEQ ID NO: 50536 - RNA, 23 nt, Human
cagaggcaucggauucaacauca

SEQ ID NO: 50537 - RNA, 22 nt, Human
cagaggcauuacugaaaaggug

SEQ ID NO: 50538 - RNA, 22 nt, Human
cagaggccaguggacaagggcc

SEQ ID NO: 50539 - RNA, 22 nt, Human
cagaggccuucaauacucauuu

SEQ ID NO: 50540 - RNA, 22 nt, Human
cagaggcugaugugggaugggc

SEQ ID NO: 50541 - RNA, 22 nt, Human
cagaggcuuauaccugauuagg

SEQ ID NO: 50542 - RNA, 22 nt, Human
cagagggaaaaggggaguaaua

SEQ ID NO: 50543 - RNA, 22 nt, Human
cagagggacaguguaaugcaua

SEQ ID NO: 50544 - RNA, 22 nt, Human
cagagggaguuucugagguugc

SEQ ID NO: 50545 - RNA, 22 nt, Human
cagagggcacaugguuuccuca

SEQ ID NO: 50546 - RNA, 22 nt, Human
cagagggcacucggagugacau

SEQ ID NO: 50547 - RNA, 22 nt, Human
cagagggcucaguccugcugga

SEQ ID NO: 50548 - RNA, 22 nt, Human
cagaggguggaggccaggcucu

SEQ ID NO: 50549 - RNA, 22 nt, Human
cagaggguugaugugaggcuua

SEQ ID NO: 50550 - RNA, 22 nt, Human
cagagguacagccauugaagau

SEQ ID NO: 50551 - RNA, 22 nt, Human
cagagguauuuugauaaacgcc

SEQ ID NO: 50552 - RNA, 19 nt, Human
cagaggugauauaugccca

SEQ ID NO: 50553 - RNA, 21 nt, Human
cagagguggccugaccucuga

SEQ ID NO: 50554 - RNA, 23 nt, Human
cagaggugucagugcccaguguc

SEQ ID NO: 50555 - RNA, 22 nt, Human
cagagguguuggugaauggaga

SEQ ID NO: 50556 - RNA, 22 nt, Human
cagagguugagcaaaaaugaua

SEQ ID NO: 50557 - RNA, 20 nt, Human
cagaguaauuauuacccuuu

SEQ ID NO: 50558 - RNA, 22 nt, Human
cagaguacugggagaacagaag

SEQ ID NO: 50559 - RNA, 22 nt, Human
cagagucaugggccgucaggca

SEQ ID NO: 50560 - RNA, 22 nt, Human
cagagucucugggaggcugggu

SEQ ID NO: 50561 - RNA, 22 nt, Human
cagagugauggcaccugcuggg

SEQ ID NO: 50562 - RNA, 22 nt, Human
cagaguggcacucugcuggaug

SEQ ID NO: 50563 - RNA, 22 nt, Human
cagaguggcagucccaggccca

SEQ ID NO: 50564 - RNA, 22 nt, Human
cagagugggcugucagccacca

SEQ ID NO: 50565 - RNA, 22 nt, Human
cagaguggugcaagggcagugu

SEQ ID NO: 50566 - RNA, 22 nt, Human
cagaguguauucugcaguugca

SEQ ID NO: 50567 - RNA, 22 nt, Human
cagaguuugcaagggcagaagc

SEQ ID NO: 50568 - RNA, 22 nt, Human
cagaguuuuauguaugcaugua

SEQ ID NO: 50569 - RNA, 22 nt, Human
cagauaaaauuaauauuaccaa

SEQ ID NO: 50570 - RNA, 22 nt, Human
cagauaaaggcuuacuaguagu

SEQ ID NO: 50571 - RNA, 22 nt, Human
cagauaacacaaagaaaugggc

SEQ ID NO: 50572 - RNA, 22 nt, Human
cagauacagguuuuuguuagau

SEQ ID NO: 50573 - RNA, 22 nt, Human
cagauagcaaauggguaagcua

SEQ ID NO: 50574 - RNA, 22 nt, Human
cagauagcguuugagagcauaa

SEQ ID NO: 50575 - RNA, 22 nt, Human
cagauaugauaggauuagcaca

SEQ ID NO: 50576 - RNA, 23 nt, Human
cagaucauauauccagcuguaag

SEQ ID NO: 50577 - RNA, 18 nt, Human
cagauccaggcagcuauu

SEQ ID NO: 50578 - RNA, 22 nt, Human
cagauccaucucucagaaagag

SEQ ID NO: 50579 - RNA, 22 nt, Human
cagauccuuaggacaaccaucc

SEQ ID NO: 50580 - RNA, 21 nt, Human
cagaucuguagguacuaccau

SEQ ID NO: 50581 - RNA, 22 nt, Human
cagaugaacugugacugaaaau

SEQ ID NO: 50582 - RNA, 19 nt, Human
cagaugagaaaagugaggu

SEQ ID NO: 50583 - RNA, 22 nt, Human
cagaugaggggcauauaacaau

SEQ ID NO: 50584 - RNA, 22 nt, Human
cagaugcugcuauuucacccug

SEQ ID NO: 50585 - RNA, 22 nt, Human
cagaugcuuguuggcuggucuc

SEQ ID NO: 50586 - RNA, 22 nt, Human
cagauggagucccguggaguuc

SEQ ID NO: 50587 - RNA, 22 nt, Human
cagauggcagggcagcucugca

SEQ ID NO: 50588 - RNA, 22 nt, Human
cagauggcugccuucuugcugu

SEQ ID NO: 50589 - RNA, 20 nt, Human
cagaugggacguggaggagu

SEQ ID NO: 50590 - RNA, 22 nt, Human
cagauguauaugcauaaaaagu

SEQ ID NO: 50591 - RNA, 22 nt, Human
cagaugugagcuggggagagug

SEQ ID NO: 50592 - RNA, 22 nt, Human
cagaugugauucuucccucagc

SEQ ID NO: 50593 - RNA, 22 nt, Human
cagaugugcaugaugggaaggg

SEQ ID NO: 50594 - RNA, 22 nt, Human
cagauguggaaugcagcaggcu

SEQ ID NO: 50595 - RNA, 22 nt, Human
cagauuaacacggagcuuaaca

SEQ ID NO: 50596 - RNA, 22 nt, Human
cagauucacuaauagcuggccu

SEQ ID NO: 50597 - RNA, 22 nt, Human
cagauuccaguuuguggcuccc

SEQ ID NO: 50598 - RNA, 22 nt, Human
cagauuccggucaucucuccuu

SEQ ID NO: 50599 - RNA, 22 nt, Human
cagauucuuaauuuaugggauu

SEQ ID NO: 50600 - RNA, 22 nt, Human
cagauuuaccuaacuccaaguu

SEQ ID NO: 50601 - RNA, 22 nt, Human
cagauuuacucccugcugcugc

SEQ ID NO: 50602 - RNA, 22 nt, Human
cagauuuagaguggggcuugga

SEQ ID NO: 50603 - RNA, 22 nt, Human
cagauuuaggcuuaguccaagc

SEQ ID NO: 50604 - RNA, 22 nt, Human
cagauuucuauuucaaauacau

SEQ ID NO: 50605 - RNA, 22 nt, Human
cagcaaagcuuaauuuauaucu

SEQ ID NO: 50606 - RNA, 21 nt, Human
cagcaaaucauugggcagacu

SEQ ID NO: 50607 - RNA, 22 nt, Human
cagcaaccuaaauccacuaacu

SEQ ID NO: 50608 - RNA, 22 nt, Human
cagcaacggaaaauacacauag

SEQ ID NO: 50609 - RNA, 22 nt, Human
cagcaacugugccugacacaca

SEQ ID NO: 50610 - RNA, 22 nt, Human
cagcaacuuaggcagaacaucu

SEQ ID NO: 50611 - RNA, 22 nt, Human
cagcaagacaggauucccgugg

SEQ ID NO: 50612 - RNA, 21 nt, Human
cagcaagacauguuuaucaag

SEQ ID NO: 50613 - RNA, 22 nt, Human
cagcaaggacugggcaugugaa

SEQ ID NO: 50614 - RNA, 22 nt, Human
cagcaaggccauuggaugcagu

SEQ ID NO: 50615 - RNA, 22 nt, Human
cagcaagggauaaacaaggacg

SEQ ID NO: 50616 - RNA, 22 nt, Human
cagcaauaacucaaagccauuu

SEQ ID NO: 50617 - RNA, 22 nt, Human
cagcaauaguguguuuguuuca

SEQ ID NO: 50618 - RNA, 22 nt, Human
cagcacaauuuucaggagucca

SEQ ID NO: 50619 - RNA, 22 nt, Human
cagcacagcugaggggcugucu

SEQ ID NO: 50620 - RNA, 22 nt, Human
cagcacaggaagugggccuuca

SEQ ID NO: 50621 - RNA, 22 nt, Human
cagcacaggcaggggaacuaua

SEQ ID NO: 50622 - RNA, 22 nt, Human
cagcacaggucaguuuuuuaag

SEQ ID NO: 50623 - RNA, 23 nt, Human
cagcacaguacauuuccugucuc

SEQ ID NO: 50624 - RNA, 22 nt, Human
cagcacaguagaguaguuguaa

SEQ ID NO: 50625 - RNA, 22 nt, Human
cagcacaguccuuugcuuacug

SEQ ID NO: 50626 - RNA, 22 nt, Human
ccuagagucucucugcaggagu

SEQ ID NO: 50627 - RNA, 22 nt, Human
ccuagaugggauggcggccggg

SEQ ID NO: 50628 - RNA, 22 nt, Human
ccuagcaauaaagauaucauuu

SEQ ID NO: 50629 - RNA, 22 nt, Human
ccuaggaagcugagauugcagu

SEQ ID NO: 50630 - RNA, 22 nt, Human
ccuaggagagggaaaaucuagg

SEQ ID NO: 50631 - RNA, 22 nt, Human
ccuaggcaagaguuggugugga

SEQ ID NO: 50632 - RNA, 20 nt, Human
ccuaggcaugcugagucucc

SEQ ID NO: 50633 - RNA, 19 nt, Human
ccuaggcauuguccaaggg

SEQ ID NO: 50634 - RNA, 22 nt, Human
ccuaggcccuaggcuuccauca

SEQ ID NO: 50635 - RNA, 22 nt, Human
ccuaggcuuguuuucaucagcu

SEQ ID NO: 50636 - RNA, 22 nt, Human
ccuagggagccugagagcagug

SEQ ID NO: 50637 - RNA, 22 nt, Human
ccuaguuuucauucagcagccu

SEQ ID NO: 50638 - RNA, 22 nt, Human
ccuauacaggcuucuuuacaug

SEQ ID NO: 50639 - RNA, 22 nt, Human
ccucaaaucuuuagaguuauuu

SEQ ID NO: 50640 - RNA, 20 nt, Human
ccucaagcagacugacagcu

SEQ ID NO: 50641 - RNA, 22 nt, Human
ccucacagcuuuucaaagugga

SEQ ID NO: 50642 - RNA, 22 nt, Human
ccucacaguguucgugucagau

SEQ ID NO: 50643 - RNA, 22 nt, Human
ccucacccagucaccuaggugg

SEQ ID NO: 50644 - RNA, 22 nt, Human
ccucagaauaguccucagauca

SEQ ID NO: 50645 - RNA, 22 nt, Human
cagaggcuggauggacuugccu

SEQ ID NO: 50646 - RNA, 22 nt, Human
cagaggcuggcggccgccccga

SEQ ID NO: 50647 - RNA, 22 nt, Human
cagaggcuguguaggcagacug

SEQ ID NO: 50648 - RNA, 22 nt, Human
cagaggcuuggcauuaucaugc

SEQ ID NO: 50649 - RNA, 22 nt, Human
cagagggacaguaugaugaaag

SEQ ID NO: 50650 - RNA, 22 nt, Human
cagagggaucaucuuccugaag

SEQ ID NO: 50651 - RNA, 22 nt, Human
cagagggcucggcggccgcucc

SEQ ID NO: 50652 - RNA, 22 nt, Human
cagagggcugcccugaguucgu

SEQ ID NO: 50653 - RNA, 22 nt, Human
cagaggggcugacacccuuggc

SEQ ID NO: 50654 - RNA, 22 nt, Human
cagagggugugaaggggaugaa

SEQ ID NO: 50655 - RNA, 22 nt, Human
cagagguacaagcuaaguuggg

SEQ ID NO: 50656 - RNA, 22 nt, Human
cagagguagaaggcaugcagug

SEQ ID NO: 50657 - RNA, 22 nt, Human
cagagguagccgagugcaaucg

SEQ ID NO: 50658 - RNA, 22 nt, Human
cagaggucaagaucugaaguga

SEQ ID NO: 50659 - RNA, 22 nt, Human
cagaggucccuguucuuaagga

SEQ ID NO: 50660 - RNA, 22 nt, Human
cagaggugcuggagugaguccu

SEQ ID NO: 50661 - RNA, 22 nt, Human
cagagguggggaguauuucaag

SEQ ID NO: 50662 - RNA, 22 nt, Human
cagagguuaccuagagcaagaa

SEQ ID NO: 50663 - RNA, 22 nt, Human
cagaguaaaccugucaucaaga

SEQ ID NO: 50664 - RNA, 22 nt, Human
cagagucagagcaccugggauu

SEQ ID NO: 50665 - RNA, 22 nt, Human
cagagucaguauugaauugaaa

SEQ ID NO: 50666 - RNA, 22 nt, Human
cagagucccagaugccccuccu

SEQ ID NO: 50667 - RNA, 22 nt, Human
cagaguccuggacacagagaca

SEQ ID NO: 50668 - RNA, 19 nt, Human
cagaguccuugaccagucc

SEQ ID NO: 50669 - RNA, 22 nt, Human
cagagugaaaacugagcucaaa

SEQ ID NO: 50670 - RNA, 22 nt, Human
cagagugaaauaggggaucaag

SEQ ID NO: 50671 - RNA, 22 nt, Human
cagagugcauggugcuguucau

SEQ ID NO: 50672 - RNA, 22 nt, Human
cagaguggagaaagcauuuagu

SEQ ID NO: 50673 - RNA, 22 nt, Human
cagaguggagauguguguggaa

SEQ ID NO: 50674 - RNA, 22 nt, Human
cagaguguaucuguguaagcau

SEQ ID NO: 50675 - RNA, 22 nt, Human
cagaguguugaccauaagccca

SEQ ID NO: 50676 - RNA, 19 nt, Human
cagaguuacauggcugugg

SEQ ID NO: 50677 - RNA, 22 nt, Human
cagaguuuuaucauacguggau

SEQ ID NO: 50678 - RNA, 22 nt, Human
cagaguuuugugaacaacuugg

SEQ ID NO: 50679 - RNA, 22 nt, Human
cagauaacugaaauaucauacc

SEQ ID NO: 50680 - RNA, 22 nt, Human
cagauagcaauuugggcagggg

SEQ ID NO: 50681 - RNA, 22 nt, Human
cagauaggaaaagcuaggcaua

SEQ ID NO: 50682 - RNA, 22 nt, Human
cagauauauuuuccuuauuagg

SEQ ID NO: 50683 - RNA, 22 nt, Human
cagauauguggauucuauuagc

SEQ ID NO: 50684 - RNA, 22 nt, Human
cagaucuaucuguugauggugc

SEQ ID NO: 50685 - RNA, 22 nt, Human
cagaucuguuugccagaucagc

SEQ ID NO: 50686 - RNA, 22 nt, Human
cagaucuuguacucauuauuga

SEQ ID NO: 50687 - RNA, 22 nt, Human
cagaugaacuaggcugcacuug

SEQ ID NO: 50688 - RNA, 22 nt, Human
cagaugaaggccugaaugucua

SEQ ID NO: 50689 - RNA, 22 nt, Human
cagaugaaguauuacagacauu

SEQ ID NO: 50690 - RNA, 22 nt, Human
cagaugagaguggccaggguuc

SEQ ID NO: 50691 - RNA, 22 nt, Human
cagaugaggacagaugacuggg

SEQ ID NO: 50692 - RNA, 22 nt, Human
cagaugagggcuggaggugagc

SEQ ID NO: 50693 - RNA, 22 nt, Human
cagaugcagcaaaaugacaggc

SEQ ID NO: 50694 - RNA, 22 nt, Human
cagaugcuaaguuaucagcagg

SEQ ID NO: 50695 - RNA, 22 nt, Human
cagaugcuauagugcugccaua

SEQ ID NO: 50696 - RNA, 22 nt, Human
cagaugcugccugggaaugucu

SEQ ID NO: 50697 - RNA, 22 nt, Human
cagaugcugcucaccugauuau

SEQ ID NO: 50698 - RNA, 22 nt, Human
cagaugcugguaugggggaggu

SEQ ID NO: 50699 - RNA, 22 nt, Human
cagaugcuucgugggugagcac

SEQ ID NO: 50700 - RNA, 22 nt, Human
cagauggaacacagaaaggaga

SEQ ID NO: 50701 - RNA, 16 nt, Human
cagauggaucuaacuc

SEQ ID NO: 50702 - RNA, 22 nt, Human
cagauggauuuuguaggcugau

SEQ ID NO: 50703 - RNA, 20 nt, Human
cagauggcacgucagggcau

SEQ ID NO: 50704 - RNA, 22 nt, Human
cagauggggcaaggccaucugu

SEQ ID NO: 50705 - RNA, 22 nt, Human
cagaugugccuccagggcuuug

SEQ ID NO: 50706 - RNA, 22 nt, Human
cagauguuugucuauaugcuuu

SEQ ID NO: 50707 - RNA, 19 nt, Human
cagauguuuucaguucauu

SEQ ID NO: 50708 - RNA, 22 nt, Human
cagauuaguugugcuauggccu

SEQ ID NO: 50709 - RNA, 22 nt, Human
cagauucucacuguauucaggu

SEQ ID NO: 50710 - RNA, 22 nt, Human
cagauucuccaggggcugcaga

SEQ ID NO: 50711 - RNA, 22 nt, Human
cagauucugaagucuagcugcu

SEQ ID NO: 50712 - RNA, 22 nt, Human
cagauucugggcccagcuuguc

SEQ ID NO: 50713 - RNA, 22 nt, Human
cagauuuaggucacuagaauuu

SEQ ID NO: 50714 - RNA, 22 nt, Human
cagauuuauuuuacauccuuca

SEQ ID NO: 50715 - RNA, 22 nt, Human
cagauuucaaggaggcacucca

SEQ ID NO: 50716 - RNA, 22 nt, Human
cagauuucagcucauauauuau

SEQ ID NO: 50717 - RNA, 22 nt, Human
cagauuuggggucuccuguuag

SEQ ID NO: 50718 - RNA, 22 nt, Human
cagcaaaacagccguugccugg

SEQ ID NO: 50719 - RNA, 22 nt, Human
cagcaaaggggaugcguccuaa

SEQ ID NO: 50720 - RNA, 22 nt, Human
cagcaaagguagaagcacagga

SEQ ID NO: 50721 - RNA, 22 nt, Human
cagcaaaguaagcugacaugua

SEQ ID NO: 50722 - RNA, 22 nt, Human
cagcaaauuuuaauacugcuuu

SEQ ID NO: 50723 - RNA, 22 nt, Human
cagcaacucuccugugcucaaa

SEQ ID NO: 50724 - RNA, 22 nt, Human
cagcaacuggucauugcucucc

SEQ ID NO: 50725 - RNA, 22 nt, Human
cagcaagacuucagggcuuggu

SEQ ID NO: 50726 - RNA, 22 nt, Human
cagcaagagaggcagggcaaau

SEQ ID NO: 50727 - RNA, 22 nt, Human
cagcaagauggugaaugagacg

SEQ ID NO: 50728 - RNA, 21 nt, Human
cagcaaggaagucgaguaggu

SEQ ID NO: 50729 - RNA, 22 nt, Human
cagcaagggauaaagaguuacu

SEQ ID NO: 50730 - RNA, 22 nt, Human
cagcaagucauccaggaugaug

SEQ ID NO: 50731 - RNA, 22 nt, Human
cagcaagugauggaaaucagag

SEQ ID NO: 50732 - RNA, 19 nt, Human
cagcaauaaugccagaugg

SEQ ID NO: 50733 - RNA, 22 nt, Human
cagcaauggcaggcggagagug

SEQ ID NO: 50734 - RNA, 22 nt, Human
cagcacacagugacucgcaccu

SEQ ID NO: 50735 - RNA, 22 nt, Human
cagcacagcuggcucuggaagc

SEQ ID NO: 50736 - RNA, 22 nt, Human
cagcacaguacaaggcacggau

SEQ ID NO: 50737 - RNA, 21 nt, Human
cagcacaguacugggucuugc

SEQ ID NO: 50738 - RNA, 22 nt, Human
cagcacagugcagaugcugacu

SEQ ID NO: 50739 - RNA, 22 nt, Human
cagcacaguuucccccaugagc

SEQ ID NO: 50740 - RNA, 22 nt, Human
cagcaccccuccuggcuaugaa

SEQ ID NO: 50741 - RNA, 22 nt, Human
cagcaccugcucuuagacacgg

SEQ ID NO: 50742 - RNA, 22 nt, Human
cagcagaaaauaccuguaacuc

SEQ ID NO: 50743 - RNA, 22 nt, Human
ccucuggccaucccccauuaag

SEQ ID NO: 50744 - RNA, 22 nt, Human
ccucuggcuguaccacuggcac

SEQ ID NO: 50745 - RNA, 22 nt, Human
ccucuggcuuacuguuggguuu

SEQ ID NO: 50746 - RNA, 22 nt, Human
ccucuggggguccucagagucu

SEQ ID NO: 50747 - RNA, 22 nt, Human
ccucuggggugagugggccacu

SEQ ID NO: 50748 - RNA, 22 nt, Human
ccucugggugggaggccgggcg

SEQ ID NO: 50749 - RNA, 18 nt, Human
ccucuggguuuuguuccc

SEQ ID NO: 50750 - RNA, 22 nt, Human
ccucuguaguaagagaacauau

SEQ ID NO: 50751 - RNA, 22 nt, Human
ccucuguccuggggaguggagc

SEQ ID NO: 50752 - RNA, 22 nt, Human
ccucugugccucguguccucug

SEQ ID NO: 50753 - RNA, 22 nt, Human
ccucugugcuuuguccagccuc

SEQ ID NO: 50754 - RNA, 22 nt, Human
cagcagaguuuggcuucuaaug

SEQ ID NO: 50755 - RNA, 22 nt, Human
cagcagaucaauguagaauauu

SEQ ID NO: 50756 - RNA, 22 nt, Human
cagcagauuugggaaacacugu

SEQ ID NO: 50757 - RNA, 22 nt, Human
cagcagcaacaauagcggucac

SEQ ID NO: 50758 - RNA, 22 nt, Human
cagcagcaccuauuauaguguu

SEQ ID NO: 50759 - RNA, 22 nt, Human
cagcagcagauucagcgucugg

SEQ ID NO: 50760 - RNA, 22 nt, Human
cagcagcaggcgcacggccguc

SEQ ID NO: 50761 - RNA, 22 nt, Human
cagcagcaguguucuagaaucu

SEQ ID NO: 50762 - RNA, 22 nt, Human
cagcagcaucaggucugugguu

SEQ ID NO: 50763 - RNA, 22 nt, Human
cagcagccagacaagauacauc

SEQ ID NO: 50764 - RNA, 19 nt, Human
cagcagccagggggccccu

SEQ ID NO: 50765 - RNA, 20 nt, Human
cagcagccauucuaguagua

SEQ ID NO: 50766 - RNA, 22 nt, Human
cagcagcccuuuggcugaacug

SEQ ID NO: 50767 - RNA, 22 nt, Human
cagcagcuaaggcauguuccug

SEQ ID NO: 50768 - RNA, 22 nt, Human
cagcagcuacuuggagcagcag

SEQ ID NO: 50769 - RNA, 22 nt, Human
cagcagcuagaggaagggcaga

SEQ ID NO: 50770 - RNA, 22 nt, Human
cagcagcucagucucucaguag

SEQ ID NO: 50771 - RNA, 22 nt, Human
cagcagcugacuccaagagagc

SEQ ID NO: 50772 - RNA, 22 nt, Human
cagcagcugggaaggaggcuga

SEQ ID NO: 50773 - RNA, 22 nt, Human
cagcagcuuugccaagucagcc

SEQ ID NO: 50774 - RNA, 22 nt, Human
cagcaggaaagacaucugagca

SEQ ID NO: 50775 - RNA, 22 nt, Human
cagcaggaaguacuagcuuuga

SEQ ID NO: 50776 - RNA, 23 nt, Human
cagcaggagggugccugggcugc

SEQ ID NO: 50777 - RNA, 22 nt, Human
cagcaggcccaggugcugguga

SEQ ID NO: 50778 - RNA, 22 nt, Human
cagcaggcggcccgcgggcccg

SEQ ID NO: 50779 - RNA, 20 nt, Human
cagcaggcuauggggcaccc

SEQ ID NO: 50780 - RNA, 22 nt, Human
cagcaggcugcgauugcucauu

SEQ ID NO: 50781 - RNA, 22 nt, Human
cagcagggggcagcgcagauca

SEQ ID NO: 50782 - RNA, 22 nt, Human
cagcaggguagguuguaucagu

SEQ ID NO: 50783 - RNA, 22 nt, Human
cagcaggucccacugagggccc

SEQ ID NO: 50784 - RNA, 22 nt, Human
cagcagguccugggcguggccu

SEQ ID NO: 50785 - RNA, 22 nt, Human
cagcaggucugcauuugagguc

SEQ ID NO: 50786 - RNA, 22 nt, Human
cagcaggugcaggugcggccgc

SEQ ID NO: 50787 - RNA, 22 nt, Human
cagcagguguccuuuuggugga

SEQ ID NO: 50788 - RNA, 22 nt, Human
cagcaguacuucucagagguau

SEQ ID NO: 50789 - RNA, 22 nt, Human
cagcagucaggccugugggaga

SEQ ID NO: 50790 - RNA, 22 nt, Human
cagcagugaugugugaggguuc

SEQ ID NO: 50791 - RNA, 22 nt, Human
cagcagugcuucagugugagau

SEQ ID NO: 50792 - RNA, 22 nt, Human
cagcaguggcugcaggcagcug

SEQ ID NO: 50793 - RNA, 22 nt, Human
cagcaguguggaagcugagggg

SEQ ID NO: 50794 - RNA, 22 nt, Human
cagcaguucacacuuaacaagu

SEQ ID NO: 50795 - RNA, 22 nt, Human
cagcaguuguuucggauuggga

SEQ ID NO: 50796 - RNA, 22 nt, Human
cagcauacugcaucaaaugagg

SEQ ID NO: 50797 - RNA, 22 nt, Human
cagcauagcugauuaaggcaaa

SEQ ID NO: 50798 - RNA, 22 nt, Human
cagcaucaccaacuugagcaau

SEQ ID NO: 50799 - RNA, 22 nt, Human
cagcaucaccgccauuucugau

SEQ ID NO: 50800 - RNA, 22 nt, Human
cagcauccguucucaggacuga

SEQ ID NO: 50801 - RNA, 22 nt, Human
cagcauccuuugcugguuuccc

SEQ ID NO: 50802 - RNA, 22 nt, Human
cagcaucguguggaaaguggua

SEQ ID NO: 50803 - RNA, 22 nt, Human
cagcaucucugccugccugcaa

SEQ ID NO: 50804 - RNA, 22 nt, Human
cagcaucucugggagaagcauc

SEQ ID NO: 50805 - RNA, 22 nt, Human
cagcaucucuuuuugcauuccu

SEQ ID NO: 50806 - RNA, 22 nt, Human
cagcaucuguaggacuccucuu

SEQ ID NO: 50807 - RNA, 22 nt, Human
cagcaucuguuuuucugaccca

SEQ ID NO: 50808 - RNA, 22 nt, Human
cagcaucuucaugugcaucucc

SEQ ID NO: 50809 - RNA, 22 nt, Human
cagcaucuucuccaaagcugcc

SEQ ID NO: 50810 - RNA, 22 nt, Human
cagcaugaaaaguguugcuauc

SEQ ID NO: 50811 - RNA, 22 nt, Human
cagcaugaaacaauugagccca

SEQ ID NO: 50812 - RNA, 22 nt, Human
cagcaugaauguguucguaggg

SEQ ID NO: 50813 - RNA, 22 nt, Human
cagcaugaugagugcaguuugg

SEQ ID NO: 50814 - RNA, 22 nt, Human
cagcaugcagccccuggcagcu

SEQ ID NO: 50815 - RNA, 22 nt, Human
cagcaugcccagacugagcuaa

SEQ ID NO: 50816 - RNA, 22 nt, Human
cagcauggacccaucgcugagu

SEQ ID NO: 50817 - RNA, 22 nt, Human
cagcauggggcuuggagucagc

SEQ ID NO: 50818 - RNA, 18 nt, Human
cagcauuagcagcuucca

SEQ ID NO: 50819 - RNA, 22 nt, Human
cagcauuguaagaaugaagacc

SEQ ID NO: 50820 - RNA, 22 nt, Human
cagcauuuggaggagaggcuuu

SEQ ID NO: 50821 - RNA, 22 nt, Human
cagccacuguggucuagcugca

SEQ ID NO: 50822 - RNA, 22 nt, Human
cagccagaaagucuguuaggga

SEQ ID NO: 50823 - RNA, 22 nt, Human
cagccagaaccuaggaugagcu

SEQ ID NO: 50824 - RNA, 22 nt, Human
cagccagagaggaaggaaugca

SEQ ID NO: 50825 - RNA, 22 nt, Human
cagccagaucagggcagggguu

SEQ ID NO: 50826 - RNA, 22 nt, Human
cagccagcugaauguaccauga

SEQ ID NO: 50827 - RNA, 22 nt, Human
cagccagcugucccaagugccu

SEQ ID NO: 50828 - RNA, 22 nt, Human
cagccagugguugaagaugcag

SEQ ID NO: 50829 - RNA, 22 nt, Human
cagccagugugaccgaggagga

SEQ ID NO: 50830 - RNA, 22 nt, Human
cagccauacugacaucaacaaa

SEQ ID NO: 50831 - RNA, 22 nt, Human
cagccaugagucuaagcaguuu

SEQ ID NO: 50832 - RNA, 22 nt, Human
cagcccagagccaguucccgcu

SEQ ID NO: 50833 - RNA, 22 nt, Human
cagcccagcacuaaguagauuu

SEQ ID NO: 50834 - RNA, 22 nt, Human
cagcccagcagacuguuaccac

SEQ ID NO: 50835 - RNA, 21 nt, Human
cagcccagcccauugacagug

SEQ ID NO: 50836 - RNA, 22 nt, Human
cagcccagccuugucucuuuau

SEQ ID NO: 50837 - RNA, 22 nt, Human
cagcccaggacugcagguguuu

SEQ ID NO: 50838 - RNA, 16 nt, Human
cagcccaggggcgggc

SEQ ID NO: 50839 - RNA, 19 nt, Human
cagcccagggugcuaccaa

SEQ ID NO: 50840 - RNA, 22 nt, Human
cagccccagcacuuagcugagu

SEQ ID NO: 50841 - RNA, 22 nt, Human
cagccccuuccuggcaucugga

SEQ ID NO: 50842 - RNA, 19 nt, Human
cagcccucuuaccacugug

SEQ ID NO: 50843 - RNA, 22 nt, Human
cagcccugaaacaaccuccucu

SEQ ID NO: 50844 - RNA, 22 nt, Human
cagcccugagagaaccaucuau

SEQ ID NO: 50845 - RNA, 22 nt, Human
cagcccugagcaaggcuuuuaa

SEQ ID NO: 50846 - RNA, 22 nt, Human
cagcccugaguuagcccacgga

SEQ ID NO: 50847 - RNA, 22 nt, Human
cagcccugcucuuagugucucc

SEQ ID NO: 50848 - RNA, 22 nt, Human
cagcccugggaguuggggccga

SEQ ID NO: 50849 - RNA, 22 nt, Human
cagcccugucccugagggaccu

SEQ ID NO: 50850 - RNA, 22 nt, Human
cagccucuaagcacagccucuc

SEQ ID NO: 50851 - RNA, 22 nt, Human
cagccucugagccuuggcagau

SEQ ID NO: 50852 - RNA, 18 nt, Human
cagccucugauugguugc

SEQ ID NO: 50853 - RNA, 22 nt, Human
cagccucuugcacuuugaaggc

SEQ ID NO: 50854 - RNA, 22 nt, Human
cagccucuuuccacaucaggca

SEQ ID NO: 50855 - RNA, 22 nt, Human
cagccugcagggcugccuguug

SEQ ID NO: 50856 - RNA, 22 nt, Human
cagccugcccuggaagcccagc

SEQ ID NO: 50857 - RNA, 22 nt, Human
cagccuugauggaugaggaagu

SEQ ID NO: 50858 - RNA, 22 nt, Human
cagccuuuauggaaaggccugg

SEQ ID NO: 50859 - RNA, 22 nt, Human
cagcgaggugaaggguacaagc

SEQ ID NO: 50860 - RNA, 22 nt, Human
cagcugcugccucauccacuuu

SEQ ID NO: 50861 - RNA, 22 nt, Human
cagcugcuguaacagaauacuu

SEQ ID NO: 50862 - RNA, 22 nt, Human
cagcugcuguuacugcuuauua

SEQ ID NO: 50863 - RNA, 22 nt, Human
ccuuggcaaaccagggcagcug

SEQ ID NO: 50864 - RNA, 22 nt, Human
ccuuggcaggggagaaauauau

SEQ ID NO: 50865 - RNA, 22 nt, Human
ccuuggcauguggcauguggcu

SEQ ID NO: 50866 - RNA, 22 nt, Human
ccuuggcuaggcagcggcuguc

SEQ ID NO: 50867 - RNA, 22 nt, Human
ccuuggcugaggagggagcuga

SEQ ID NO: 50868 - RNA, 23 nt, Human
caggacaugggaggaaguauggc

SEQ ID NO: 50869 - RNA, 22 nt, Human
caggacccaucagccaggcacu

SEQ ID NO: 50870 - RNA, 22 nt, Human
caggaccccauauucacugaac

SEQ ID NO: 50871 - RNA, 22 nt, Human
caggacuauguucaacagauag

SEQ ID NO: 50872 - RNA, 22 nt, Human
caggacucacuucucacauccc

SEQ ID NO: 50873 - RNA, 22 nt, Human
caggacuguauccuuggagaaa

SEQ ID NO: 50874 - RNA, 22 nt, Human
caggagaagucucuagggggug

SEQ ID NO: 50875 - RNA, 22 nt, Human
caggagacuauggcccaaggcc

SEQ ID NO: 50876 - RNA, 22 nt, Human
caggagacucagcauccaggau

SEQ ID NO: 50877 - RNA, 15 nt, Human
caggagaggaagguu

SEQ ID NO: 50878 - RNA, 22 nt, Human
caggagaggaggcuacuucuua

SEQ ID NO: 50879 - RNA, 22 nt, Human
caggagaucuuaggaauucuua

SEQ ID NO: 50880 - RNA, 22 nt, Human
caggagcaggcccaaggacaca

SEQ ID NO: 50881 - RNA, 22 nt, Human
caggagccagcugucccaacca

SEQ ID NO: 50882 - RNA, 22 nt, Human
caggagcccguugcuccggcgg

SEQ ID NO: 50883 - RNA, 22 nt, Human
caggagcuacucagguuggguu

SEQ ID NO: 50884 - RNA, 22 nt, Human
caggagcucacugucuaauggg

SEQ ID NO: 50885 - RNA, 22 nt, Human
caggagcucuuaaggaugugau

SEQ ID NO: 50886 - RNA, 22 nt, Human
caggaggaaacuggauucacuu

SEQ ID NO: 50887 - RNA, 22 nt, Human
caggaggagcuggccgccucau

SEQ ID NO: 50888 - RNA, 22 nt, Human
caggaggaggguacaccaucag

SEQ ID NO: 50889 - RNA, 20 nt, Human
caggaggcaaggucaagguc

SEQ ID NO: 50890 - RNA, 22 nt, Human
caggaggcagagguugcaguga

SEQ ID NO: 50891 - RNA, 22 nt, Human
caggaggccaacugugggacuu

SEQ ID NO: 50892 - RNA, 22 nt, Human
caggaggcgucuucaguuuguu

SEQ ID NO: 50893 - RNA, 22 nt, Human
caggaggcuuugggauccaagu

SEQ ID NO: 50894 - RNA, 22 nt, Human
caggagguugguagcaguagau

SEQ ID NO: 50895 - RNA, 22 nt, Human
caggagucccucuggccagcau

SEQ ID NO: 50896 - RNA, 22 nt, Human
caggaguccugaaaucugauga

SEQ ID NO: 50897 - RNA, 22 nt, Human
caggagucucucuugagcccag

SEQ ID NO: 50898 - RNA, 22 nt, Human
caggagugcagguggugaggca

SEQ ID NO: 50899 - RNA, 22 nt, Human
caggagugucuccacacagcaa

SEQ ID NO: 50900 - RNA, 22 nt, Human
caggauauaucucuaguguugg

SEQ ID NO: 50901 - RNA, 22 nt, Human
caggauauuaccuaauauuuga

SEQ ID NO: 50902 - RNA, 22 nt, Human
caggauccuggcugcauggacg

SEQ ID NO: 50903 - RNA, 22 nt, Human
caggaugagaggcccagggaag

SEQ ID NO: 50904 - RNA, 21 nt, Human
caggaugaugauaauucaugg

SEQ ID NO: 50905 - RNA, 22 nt, Human
caggaugcagugggacccaggg

SEQ ID NO: 50906 - RNA, 22 nt, Human
caggaugcggccugacucuaag

SEQ ID NO: 50907 - RNA, 22 nt, Human
caggauggagaguuguugguug

SEQ ID NO: 50908 - RNA, 22 nt, Human
caggauggcagagaaaagggug

SEQ ID NO: 50909 - RNA, 22 nt, Human
caggauggccccggggcugugc

SEQ ID NO: 50910 - RNA, 22 nt, Human
caggauguucaagggaccuaug

SEQ ID NO: 50911 - RNA, 22 nt, Human
caggcaagauccagaggcugcu

SEQ ID NO: 50912 - RNA, 22 nt, Human
caggcaagcaaggggucuugaa

SEQ ID NO: 50913 - RNA, 22 nt, Human
caggcaaggacucugguaauuu

SEQ ID NO: 50914 - RNA, 22 nt, Human
caggcaaggaggcacugaggga

SEQ ID NO: 50915 - RNA, 22 nt, Human
caggcaauaaaggguugguugg

SEQ ID NO: 50916 - RNA, 22 nt, Human
caggcacaagaagcaaauguua

SEQ ID NO: 50917 - RNA, 22 nt, Human
caggcacacagcacauggccug

SEQ ID NO: 50918 - RNA, 22 nt, Human
caggcacacaggcucccugggc

SEQ ID NO: 50919 - RNA, 22 nt, Human
caggcacacagggaauuuggcu

SEQ ID NO: 50920 - RNA, 22 nt, Human
caggcacacauccgugagagau

SEQ ID NO: 50921 - RNA, 22 nt, Human
caggcacacccacuggugcaga

SEQ ID NO: 50922 - RNA, 22 nt, Human
caggcacagacgcaaacuucuu

SEQ ID NO: 50923 - RNA, 22 nt, Human
caggcacagagagaauaccuuu

SEQ ID NO: 50924 - RNA, 17 nt, Human
caggcacaugaagccag

SEQ ID NO: 50925 - RNA, 22 nt, Human
caggcaccucacguggguccca

SEQ ID NO: 50926 - RNA, 22 nt, Human
caggcacucauucagagaggug

SEQ ID NO: 50927 - RNA, 22 nt, Human
caggcacugugcuagauccuug

SEQ ID NO: 50928 - RNA, 22 nt, Human
caggcacuguguuaggcacugu

SEQ ID NO: 50929 - RNA, 22 nt, Human
caggcagaagaaguggaaggac

SEQ ID NO: 50930 - RNA, 22 nt, Human
caggcagagacccucuccuaaa

SEQ ID NO: 50931 - RNA, 22 nt, Human
caggcagagugagguggucuaa

SEQ ID NO: 50932 - RNA, 22 nt, Human
caggcagaugcugacaagaguu

SEQ ID NO: 50933 - RNA, 22 nt, Human
caggcagccugagggaucuggg

SEQ ID NO: 50934 - RNA, 22 nt, Human
caggcagcucgaugccuuguug

SEQ ID NO: 50935 - RNA, 22 nt, Human
caggcagcugacugucagauau

SEQ ID NO: 50936 - RNA, 22 nt, Human
caggcagcugcgacaagagagc

SEQ ID NO: 50937 - RNA, 22 nt, Human
caggcagcugcuggguucagcc

SEQ ID NO: 50938 - RNA, 22 nt, Human
caggcaggagacauuugguugg

SEQ ID NO: 50939 - RNA, 22 nt, Human
caggcaggagaggaggauuucu

SEQ ID NO: 50940 - RNA, 22 nt, Human
caggcaguggcucacagcaacc

SEQ ID NO: 50941 - RNA, 22 nt, Human
caggcauagaagggcaagaaua

SEQ ID NO: 50942 - RNA, 22 nt, Human
caggcauguggcccagggguga

SEQ ID NO: 50943 - RNA, 22 nt, Human
caggcauugugacgaguguucu

SEQ ID NO: 50944 - RNA, 22 nt, Human
caggccaaaauucaggcauucu

SEQ ID NO: 50945 - RNA, 22 nt, Human
caggccaacugcauggugacca

SEQ ID NO: 50946 - RNA, 22 nt, Human
caggccaagccuccccagcucc

SEQ ID NO: 50947 - RNA, 22 nt, Human
caggccaauaaaugugauggcc

SEQ ID NO: 50948 - RNA, 22 nt, Human
caggccaauaucacaugcuaug

SEQ ID NO: 50949 - RNA, 22 nt, Human
caggccaauuucuugucauuua

SEQ ID NO: 50950 - RNA, 22 nt, Human
caggccacaaguuggguucaag

SEQ ID NO: 50951 - RNA, 22 nt, Human
caggccacacggcggcucccug

SEQ ID NO: 50952 - RNA, 22 nt, Human
caggccagaggcuguuguugcg

SEQ ID NO: 50953 - RNA, 22 nt, Human
caggccagcagggccuccgugg

SEQ ID NO: 50954 - RNA, 22 nt, Human
caggccagcuuccugacauccu

SEQ ID NO: 50955 - RNA, 22 nt, Human
caggccagugugcuucccaggc

SEQ ID NO: 50956 - RNA, 22 nt, Human
caggccaguuuugauuuaagcc

SEQ ID NO: 50957 - RNA, 22 nt, Human
caggccauuaccgcugagaccc

SEQ ID NO: 50958 - RNA, 22 nt, Human
caggcccacgaggcacacagag

SEQ ID NO: 50959 - RNA, 22 nt, Human
caggcccagaggccucuuccca

SEQ ID NO: 50960 - RNA, 22 nt, Human
caggcccagcccagcccuucga

SEQ ID NO: 50961 - RNA, 22 nt, Human
caggcccaggggucuggcccac

SEQ ID NO: 50962 - RNA, 22 nt, Human
caggcccauaaugcaaauauuu

SEQ ID NO: 50963 - RNA, 22 nt, Human
caggcccaugagggcagccaca

SEQ ID NO: 50964 - RNA, 21 nt, Human
caggccccaggccuggggugc

SEQ ID NO: 50965 - RNA, 22 nt, Human
caggcccucgcccgcagcgacc

SEQ ID NO: 50966 - RNA, 22 nt, Human
caggcccucugcacccucgucu

SEQ ID NO: 50967 - RNA, 22 nt, Human
caggcccugccuugagggaccu

SEQ ID NO: 50968 - RNA, 22 nt, Human
caggcccugcugcugagaccuu

SEQ ID NO: 50969 - RNA, 21 nt, Human
caggccgggugagcaggcagc

SEQ ID NO: 50970 - RNA, 22 nt, Human
caggccucccggugcacacuga

SEQ ID NO: 50971 - RNA, 22 nt, Human
caggccuccuaugagcacuagc

SEQ ID NO: 50972 - RNA, 22 nt, Human
cucccugggccucaguuucucu

SEQ ID NO: 50973 - RNA, 22 nt, Human
cucccuggucuuucccaucauu

SEQ ID NO: 50974 - RNA, 22 nt, Human
cucccugguguccccuccagga

SEQ ID NO: 50975 - RNA, 22 nt, Human
cucccuuccaaugacuaugcuu

SEQ ID NO: 50976 - RNA, 22 nt, Human
cucccuucugagccuuuuguua

SEQ ID NO: 50977 - RNA, 22 nt, Human
cuccucagaagaggguaacaca

SEQ ID NO: 50978 - RNA, 22 nt, Human
cuccucagagagcagcuugggg

SEQ ID NO: 50979 - RNA, 21 nt, Human
cuccucaggaccagccacagg

SEQ ID NO: 50980 - RNA, 22 nt, Human
cuccucagggcugguuacaugg

SEQ ID NO: 50981 - RNA, 22 nt, Human
cuccucaguugucccauggaga

SEQ ID NO: 50982 - RNA, 22 nt, Human
cuccuccacagaccuacugaau

SEQ ID NO: 50983 - RNA, 22 nt, Human
cuccuccacuaggcaaaaugug

SEQ ID NO: 50984 - RNA, 22 nt, Human
cuccucccaauugccaagugcu

SEQ ID NO: 50985 - RNA, 22 nt, Human
cuccucccugcgauugcucugc

SEQ ID NO: 50986 - RNA, 16 nt, Human
cuccucuccuucagga

SEQ ID NO: 50987 - RNA, 22 nt, Human
cuccucuggcuuccuggaggca

SEQ ID NO: 50988 - RNA, 22 nt, Human
cuccucuuuacccgcauggucu

SEQ ID NO: 50989 - RNA, 22 nt, Human
cuccugagaggaucucuguugu

SEQ ID NO: 50990 - RNA, 22 nt, Human
cuccugagggaugcuuaggcuu

SEQ ID NO: 50991 - RNA, 22 nt, Human
cuccugcaagccuccccaagca

SEQ ID NO: 50992 - RNA, 22 nt, Human
cuccugcagcccucagcagcca

SEQ ID NO: 50993 - RNA, 22 nt, Human
cuccugcaugguugugcuauug

SEQ ID NO: 50994 - RNA, 22 nt, Human
cuccugccugugggacugagga

SEQ ID NO: 50995 - RNA, 22 nt, Human
cuccugcuccugcuugcaagga

SEQ ID NO: 50996 - RNA, 22 nt, Human
cuccuggaccaccuuguggcca

SEQ ID NO: 50997 - RNA, 22 nt, Human
cuccuggagcagcaggcgcagg

SEQ ID NO: 50998 - RNA, 22 nt, Human
cuccuggaguccuuuccuauuc

SEQ ID NO: 50999 - RNA, 22 nt, Human
cuccuggaugcaggcugucugc

SEQ ID NO: 51000 - RNA, 22 nt, Human
cuccuggcacucaguguggaag

SEQ ID NO: 51001 - RNA, 22 nt, Human
cuccuggcaggcugagugaaau

SEQ ID NO: 51002 - RNA, 22 nt, Human
cuccuggccccagaucccaauc

SEQ ID NO: 51003 - RNA, 22 nt, Human
caggugcuucuguaagaaagac

SEQ ID NO: 51004 - RNA, 22 nt, Human
cagguggcaaaugaguagcauu

SEQ ID NO: 51005 - RNA, 22 nt, Human
cagguggcagaggucucuggaa

SEQ ID NO: 51006 - RNA, 19 nt, Human
cagguggcgcucuacaggg

SEQ ID NO: 51007 - RNA, 22 nt, Human
cagguggcugagcugaccuuug

SEQ ID NO: 51008 - RNA, 22 nt, Human
cagguggcuucucugcagccuu

SEQ ID NO: 51009 - RNA, 22 nt, Human
caggugggcugccucuccagcu

SEQ ID NO: 51010 - RNA, 22 nt, Human
cagguggggggcuuccgagccu

SEQ ID NO: 51011 - RNA, 22 nt, Human
cagguggguguaugaaugcaaa

SEQ ID NO: 51012 - RNA, 23 nt, Human
caggugguagagaaaaauccaga

SEQ ID NO: 51013 - RNA, 22 nt, Human
cagguggucaggcaaggacacg

SEQ ID NO: 51014 - RNA, 22 nt, Human
caggugguugagagcuguaggc

SEQ ID NO: 51015 - RNA, 22 nt, Human
caggugguuguuuggauucuaa

SEQ ID NO: 51016 - RNA, 22 nt, Human
caggugguuugauaggauaacu

SEQ ID NO: 51017 - RNA, 22 nt, Human
cagguguacacauuguguuuau

SEQ ID NO: 51018 - RNA, 22 nt, Human
caggugucagcagcacuguacu

SEQ ID NO: 51019 - RNA, 22 nt, Human
cagguguuauacaugaaauuua

SEQ ID NO: 51020 - RNA, 22 nt, Human
cagguguugucuaaagcuucag

SEQ ID NO: 51021 - RNA, 22 nt, Human
cagguguuucaaaugugaaacu

SEQ ID NO: 51022 - RNA, 22 nt, Human
cagguuaguauuuuuaguucau

SEQ ID NO: 51023 - RNA, 15 nt, Human
cagguuaguuuccag

SEQ ID NO: 51024 - RNA, 22 nt, Human
cagguucccagguccagggcuu

SEQ ID NO: 51025 - RNA, 22 nt, Human
cagguucccuugcagcuaagug

SEQ ID NO: 51026 - RNA, 22 nt, Human
cagguucuggagaugcagagau

SEQ ID NO: 51027 - RNA, 22 nt, Human
cagguuggucggcaaguacaca

SEQ ID NO: 51028 - RNA, 22 nt, Human
cagguuucauuggcagcuucau

SEQ ID NO: 51029 - RNA, 22 nt, Human
cagguuucuaguucuaagaaua

SEQ ID NO: 51030 - RNA, 22 nt, Human
caguaaacacuagcauucuugg

SEQ ID NO: 51031 - RNA, 22 nt, Human
caguaaagcauguaugucuuca

SEQ ID NO: 51032 - RNA, 22 nt, Human
caguaaauaguggagauguggg

SEQ ID NO: 51033 - RNA, 22 nt, Human
caguaaauauaggaacguggaa

SEQ ID NO: 51034 - RNA, 22 nt, Human
caguaaaugugauuuuucuugu

SEQ ID NO: 51035 - RNA, 22 nt, Human
caguaaauuuuauuugugggug

SEQ ID NO: 51036 - RNA, 22 nt, Human
caguaacacaaccacuccguga

SEQ ID NO: 51037 - RNA, 22 nt, Human
caguaacuaggacaaggaggaa

SEQ ID NO: 51038 - RNA, 22 nt, Human
caguaauaacacagaaaguuug

SEQ ID NO: 51039 - RNA, 22 nt, Human
caguaauaccccuggcucaggu

SEQ ID NO: 51040 - RNA, 22 nt, Human
caguaauagauuugagaguggu

SEQ ID NO: 51041 - RNA, 22 nt, Human
caguaaugggcaagacaauaug

SEQ ID NO: 51042 - RNA, 22 nt, Human
caguacaagaggccaccugccc

SEQ ID NO: 51043 - RNA, 23 nt, Human
caguacaauguggaaaaggagug

SEQ ID NO: 51044 - RNA, 22 nt, Human
caguacuuaacuuauaggagag

SEQ ID NO: 51045 - RNA, 22 nt, Human
caguacuugggggguucuaagu

SEQ ID NO: 51046 - RNA, 22 nt, Human
caguacuuugaagauauuuuag

SEQ ID NO: 51047 - RNA, 22 nt, Human
caguagaauuauuauaaaacau

SEQ ID NO: 51048 - RNA, 22 nt, Human
caguagacacauuaauauggaa

SEQ ID NO: 51049 - RNA, 22 nt, Human
caguagacacauuuguuuuucc

SEQ ID NO: 51050 - RNA, 22 nt, Human
caguagcaggcaggugcuuuug

SEQ ID NO: 51051 - RNA, 22 nt, Human
caguagcagggauuauuuuagg

SEQ ID NO: 51052 - RNA, 22 nt, Human
caguagcaugcaccaggagggu

SEQ ID NO: 51053 - RNA, 22 nt, Human
caguagcauguaauaaagacag

SEQ ID NO: 51054 - RNA, 22 nt, Human
caguagcccacuaguaugcagu

SEQ ID NO: 51055 - RNA, 22 nt, Human
caguagcuuacuuuucuugauc

SEQ ID NO: 51056 - RNA, 22 nt, Human
caguagugaaaagcagcccagc

SEQ ID NO: 51057 - RNA, 22 nt, Human
caguaguggggagcccaguguc

SEQ ID NO: 51058 - RNA, 22 nt, Human
caguaguguugcugagugucag

SEQ ID NO: 51059 - RNA, 22 nt, Human
caguaguuauuaguugccacug

SEQ ID NO: 51060 - RNA, 22 nt, Human
caguauacgacuaacgcaugac

SEQ ID NO: 51061 - RNA, 22 nt, Human
caguauauuuuagagaaguccc

SEQ ID NO: 51062 - RNA, 22 nt, Human
caguaugucuacuggacaaagu

SEQ ID NO: 51063 - RNA, 22 nt, Human
caguauguuuauuagaacugca

SEQ ID NO: 51064 - RNA, 22 nt, Human
caguauuugguaauuggcuacc

SEQ ID NO: 51065 - RNA, 22 nt, Human
caguauuuuuaagcugcuuugu

SEQ ID NO: 51066 - RNA, 22 nt, Human
cagucaaacuuauaggcacauu

SEQ ID NO: 51067 - RNA, 22 nt, Human
cagucaacagagagcccgucag

SEQ ID NO: 51068 - RNA, 22 nt, Human
cagucacauugcccugcauuua

SEQ ID NO: 51069 - RNA, 22 nt, Human
cagucaccaccagguggcagua

SEQ ID NO: 51070 - RNA, 22 nt, Human
cagucaccugaagacuugacca

SEQ ID NO: 51071 - RNA, 22 nt, Human
cagucacuuacaaaaauauaau

SEQ ID NO: 51072 - RNA, 22 nt, Human
cagucagucaauacucuuugag

SEQ ID NO: 51073 - RNA, 22 nt, Human
caguccaggccuggaggagcca

SEQ ID NO: 51074 - RNA, 20 nt, Human
caguccaggcugcagcaucu

SEQ ID NO: 51075 - RNA, 20 nt, Human
cagucccaauccagggccag

SEQ ID NO: 51076 - RNA, 22 nt, Human
cagucccacaagaucuccacaa

SEQ ID NO: 51077 - RNA, 22 nt, Human
cagucccagaagagccugggag

SEQ ID NO: 51078 - RNA, 22 nt, Human
cagucccagcugcucagaaggc

SEQ ID NO: 51079 - RNA, 22 nt, Human
cagucccaucucccagguggcu

SEQ ID NO: 51080 - RNA, 22 nt, Human
cagucccuaguggagcucacag

SEQ ID NO: 51081 - RNA, 22 nt, Human
caguuacagagccaguuagaga

SEQ ID NO: 51082 - RNA, 22 nt, Human
caguuacagcugcaccagagcc

SEQ ID NO: 51083 - RNA, 22 nt, Human
caguuaccaucuucagugauga

SEQ ID NO: 51084 - RNA, 22 nt, Human
caguuacucaauaauucuugcg

SEQ ID NO: 51085 - RNA, 22 nt, Human
caguuauaagacuaagcuauuc

SEQ ID NO: 51086 - RNA, 21 nt, Human
caguuauucuugaugugugug

SEQ ID NO: 51087 - RNA, 22 nt, Human
caguucaaaauuuugaagaagg

SEQ ID NO: 51088 - RNA, 22 nt, Human
caguucagcuagaagaaacaaa

SEQ ID NO: 51089 - RNA, 21 nt, Human
caguucgucuuagaaaauggc

SEQ ID NO: 51090 - RNA, 22 nt, Human
caguucuaauuaauaggaguaa

SEQ ID NO: 51091 - RNA, 22 nt, Human
caguucucuugaucgucucuug

SEQ ID NO: 51092 - RNA, 22 nt, Human
caguucugagcuuucccagaag

SEQ ID NO: 51093 - RNA, 22 nt, Human
caguucuggaguuucauucuuu

SEQ ID NO: 51094 - RNA, 22 nt, Human
caguucugguuugcagauauau

SEQ ID NO: 51095 - RNA, 22 nt, Human
caguugaaaagauuuuauucug

SEQ ID NO: 51096 - RNA, 17 nt, Human
caguugaaauguuugga

SEQ ID NO: 51097 - RNA, 22 nt, Human
caguugaggacucaccuuugaa

SEQ ID NO: 51098 - RNA, 21 nt, Human
caguugauagagaucuugagc

SEQ ID NO: 51099 - RNA, 22 nt, Human
caguugccuacuacauggcagg

SEQ ID NO: 51100 - RNA, 22 nt, Human
caguugccuguuuccuugugug

SEQ ID NO: 51101 - RNA, 22 nt, Human
caguuuaaaugagugacugcag

SEQ ID NO: 51102 - RNA, 22 nt, Human
caguuuaaccuauccauuaugu

SEQ ID NO: 51103 - RNA, 22 nt, Human
caguuuaggucauccuugcuuu

SEQ ID NO: 51104 - RNA, 22 nt, Human
caguuuauaguuguuaugugug

SEQ ID NO: 51105 - RNA, 19 nt, Human
caguuuaugcuuuggggac

SEQ ID NO: 51106 - RNA, 22 nt, Human
caguuuccuuguuuaccuacug

SEQ ID NO: 51107 - RNA, 15 nt, Human
caguuucugaucauc

SEQ ID NO: 51108 - RNA, 22 nt, Human
caguuucugggcguucacaggu

SEQ ID NO: 51109 - RNA, 22 nt, Human
caguuucuucaucugcagaauc

SEQ ID NO: 51110 - RNA, 22 nt, Human
caguuucuuggaugccaauuuc

SEQ ID NO: 51111 - RNA, 19 nt, Human
caguuuguccagaggggac

SEQ ID NO: 51112 - RNA, 22 nt, Human
caguuugugcuaggcacuauuu

SEQ ID NO: 51113 - RNA, 22 nt, Human
caguuuuacccaagcuuauuuu

SEQ ID NO: 51114 - RNA, 22 nt, Human
caguuuuagcuagagcaaacca

SEQ ID NO: 51115 - RNA, 22 nt, Human
caguuuuaggacauguggaugu

SEQ ID NO: 51116 - RNA, 22 nt, Human
caguuuuagggcaaugugaaga

SEQ ID NO: 51117 - RNA, 22 nt, Human
caguuuuaucaucugugaaaug

SEQ ID NO: 51118 - RNA, 22 nt, Human
caguuuuaugucgaauguauac

SEQ ID NO: 51119 - RNA, 22 nt, Human
caguuuuccaugacucagagag

SEQ ID NO: 51120 - RNA, 22 nt, Human
caguuuuucaaaauuacaugau

SEQ ID NO: 51121 - RNA, 22 nt, Human
cucugccaguuucuggccucag

SEQ ID NO: 51122 - RNA, 22 nt, Human
cucugcccacgucuugcccaga

SEQ ID NO: 51123 - RNA, 22 nt, Human
cucugcccgcggaugccacguc

SEQ ID NO: 51124 - RNA, 19 nt, Human
cucugcccuacagaaagcu

SEQ ID NO: 51125 - RNA, 22 nt, Human
cucugcccucgcacaucugcca

SEQ ID NO: 51126 - RNA, 19 nt, Human
cucugccucuggcuguggc

SEQ ID NO: 51127 - RNA, 22 nt, Human
cucugccugccacuguucaggc

SEQ ID NO: 51128 - RNA, 22 nt, Human
cucugccugcccaccgacccau

SEQ ID NO: 51129 - RNA, 22 nt, Human
cucugcuaagcaugaacaauua

SEQ ID NO: 51130 - RNA, 22 nt, Human
cucugcucaccagccaugugau

SEQ ID NO: 51131 - RNA, 22 nt, Human
cucugcugcccaugaugguaua

SEQ ID NO: 51132 - RNA, 22 nt, Human
cucugcuggcagcccccgggcc

SEQ ID NO: 51133 - RNA, 22 nt, Human
cucugcugguagcucauuccau

SEQ ID NO: 51134 - RNA, 22 nt, Human
cucugcuguucuuauguguccu

SEQ ID NO: 51135 - RNA, 22 nt, Human
cucugcuucauccaccacuggc

SEQ ID NO: 51136 - RNA, 22 nt, Human
cucugcuuuccucuuacacacu

SEQ ID NO: 51137 - RNA, 22 nt, Human
cucugcuuuuuagggagccuag

SEQ ID NO: 51138 - RNA, 22 nt, Human
cucuggaagaauacacuuagaa

SEQ ID NO: 51139 - RNA, 22 nt, Human
cucuggaagugauggcagguca

SEQ ID NO: 51140 - RNA, 21 nt, Human
cucuggaggcaagggagagug

SEQ ID NO: 51141 - RNA, 22 nt, Human
cucuggaggccguuggcccuua

SEQ ID NO: 51142 - RNA, 22 nt, Human
cucuggagguugagcccagcaa

SEQ ID NO: 51143 - RNA, 22 nt, Human
cucuggaguaagagcuaugaaa

SEQ ID NO: 51144 - RNA, 22 nt, Human
cucuggaguucucaugaggaac

SEQ ID NO: 51145 - RNA, 21 nt, Human
cucuggaguuugaaggcuggg

SEQ ID NO: 51146 - RNA, 22 nt, Human
cucuggauugcugugagaugcu

SEQ ID NO: 51147 - RNA, 22 nt, Human
cucuggcagagcuguagacuuc

SEQ ID NO: 51148 - RNA, 22 nt, Human
cucuggcucccgcagcccccau

SEQ ID NO: 51149 - RNA, 19 nt, Human
cucuggcuccugggcugcc

SEQ ID NO: 51150 - RNA, 22 nt, Human
cucuggcucuguugagauuugu

SEQ ID NO: 51151 - RNA, 22 nt, Human
cucuggcuggcauugcuggacu

SEQ ID NO: 51152 - RNA, 22 nt, Human
cucuggcugucccgaugagcag

SEQ ID NO: 51153 - RNA, 22 nt, Human
cucuggcuguuugcagcucaag

SEQ ID NO: 51154 - RNA, 22 nt, Human
cucuggcuuaguaugcuccaaa

SEQ ID NO: 51155 - RNA, 22 nt, Human
cucuggcuugguaaaaacuucu

SEQ ID NO: 51156 - RNA, 22 nt, Human
cucuggcuuuaaggaugccaca

SEQ ID NO: 51157 - RNA, 22 nt, Human
cucugggaauucugagcaagca

SEQ ID NO: 51158 - RNA, 22 nt, Human
cucugggaccauggcaagugcg

SEQ ID NO: 51159 - RNA, 22 nt, Human
cucugggacuagaaccccaggg

SEQ ID NO: 51160 - RNA, 17 nt, Human
cucugggcagccugggg

SEQ ID NO: 51161 - RNA, 22 nt, Human
cucugggcaggaccaguggacc

SEQ ID NO: 51162 - RNA, 22 nt, Human
cucugggccaccgcugguguau

SEQ ID NO: 51163 - RNA, 19 nt, Human
cucugggcugcaucuuggu

SEQ ID NO: 51164 - RNA, 22 nt, Human
cucugggcuucaagucagauuu

SEQ ID NO: 51165 - RNA, 22 nt, Human
cucugggguuaagcuuccaugg

SEQ ID NO: 51166 - RNA, 23 nt, Human
cucuggguccgauguccugacag

SEQ ID NO: 51167 - RNA, 22 nt, Human
cucugggucuaccuguggccag

SEQ ID NO: 51168 - RNA, 22 nt, Human
cucugggucuauaaugcagcug

SEQ ID NO: 51169 - RNA, 22 nt, Human
cucuggguucagaacagcaagc

SEQ ID NO: 51170 - RNA, 22 nt, Human
cucugguuuuucuuccauuaag

SEQ ID NO: 51171 - RNA, 22 nt, Human
cucuguauagaaaggaaacauu

SEQ ID NO: 51172 - RNA, 22 nt, Human
cucuguaugggauuuacugguu

SEQ ID NO: 51173 - RNA, 22 nt, Human
cucuguccacagguuugucccu

SEQ ID NO: 51174 - RNA, 22 nt, Human
cucuguccuugcacaguuccua

SEQ ID NO: 51175 - RNA, 22 nt, Human
cucugugaaccccuccuuucuu

SEQ ID NO: 51176 - RNA, 22 nt, Human
cucugugauuuugugagccaga

SEQ ID NO: 51177 - RNA, 22 nt, Human
cucugugcccuacugcucagcu

SEQ ID NO: 51178 - RNA, 22 nt, Human
cucugugcuuaugcuccauggg

SEQ ID NO: 51179 - RNA, 22 nt, Human
cucugugguaaaauagcaguau

SEQ ID NO: 51180 - RNA, 22 nt, Human
cucugugugguagauuccauua

SEQ ID NO: 51181 - RNA, 22 nt, Human
cucuguguuccggguugcugcu

SEQ ID NO: 51182 - RNA, 21 nt, Human
cucuguguugaggguguugag

SEQ ID NO: 51183 - RNA, 22 nt, Human
cucuguuacagcccccugccuc

SEQ ID NO: 51184 - RNA, 22 nt, Human
cucuuaaaaacuugauauauuu

SEQ ID NO: 51185 - RNA, 22 nt, Human
cucuuaaaauuaccuuugcaaa

SEQ ID NO: 51186 - RNA, 22 nt, Human
cucuuaaagaauguuccagcug

SEQ ID NO: 51187 - RNA, 20 nt, Human
cucuuaaauguaaaguaggc

SEQ ID NO: 51188 - RNA, 20 nt, Human
cucuuaauugcucacauuag

SEQ ID NO: 51189 - RNA, 22 nt, Human
cucuuacacagauuccucuagc

SEQ ID NO: 51190 - RNA, 22 nt, Human
ucuaaagagaguggguacaugu

SEQ ID NO: 51191 - RNA, 22 nt, Human
ucuaaauguaucacaucuggau

SEQ ID NO: 51192 - RNA, 22 nt, Human
ucuaaaugucaguacagaauga

SEQ ID NO: 51193 - RNA, 22 nt, Human
ucuaacagaaauucugacaaaa

SEQ ID NO: 51194 - RNA, 19 nt, Human
ucuaacagcuuucauucua

SEQ ID NO: 51195 - RNA, 22 nt, Human
ucuaacauugaauggcugauua

SEQ ID NO: 51196 - RNA, 22 nt, Human
ucuaaccuuguggucugcuggu

SEQ ID NO: 51197 - RNA, 22 nt, Human
ucuaacuaacuacaguaagagg

SEQ ID NO: 51198 - RNA, 22 nt, Human
ucuaacuuguauguauaguuuu

SEQ ID NO: 51199 - RNA, 22 nt, Human
ucuaagaaagauuaagaaauuu

SEQ ID NO: 51200 - RNA, 21 nt, Human
ucuaagaacaugauucucccu

SEQ ID NO: 51201 - RNA, 22 nt, Human
ucuaagaauugaaguggcucuu

SEQ ID NO: 51202 - RNA, 22 nt, Human
ucuaagaucuacuauacaugug

SEQ ID NO: 51203 - RNA, 22 nt, Human
ucuaagcagaacugaagcucug

SEQ ID NO: 51204 - RNA, 22 nt, Human
ucuaagccuaggaaaugaguuu

SEQ ID NO: 51205 - RNA, 22 nt, Human
ucuaaggagcgcuccagaaaaa

SEQ ID NO: 51206 - RNA, 22 nt, Human
ucuaaggucaggggaaaguuug

SEQ ID NO: 51207 - RNA, 22 nt, Human
ucuaaguuuggugauuaccaau

SEQ ID NO: 51208 - RNA, 22 nt, Human
ucuaauaaauaaaugcucuagg

SEQ ID NO: 51209 - RNA, 22 nt, Human
ucuaaucuacaaaaggaaauuc

SEQ ID NO: 51210 - RNA, 20 nt, Human
ucuaauuaaaauugucuagu

SEQ ID NO: 51211 - RNA, 22 nt, Human
ucuaauuccauuaaauugaugu

SEQ ID NO: 51212 - RNA, 22 nt, Human
ucuaauugaaucuaagcauguu

SEQ ID NO: 51213 - RNA, 23 nt, Human
ucuacaaagcugugucaggaccc

SEQ ID NO: 51214 - RNA, 22 nt, Human
ucuacaaugagaaaugaucagu

SEQ ID NO: 51215 - RNA, 22 nt, Human
ucuacacugggggcuuugagca

SEQ ID NO: 51216 - RNA, 22 nt, Human
ucuacacuguagaauuauaagg

SEQ ID NO: 51217 - RNA, 22 nt, Human
ucuacagagagucauagacuca

SEQ ID NO: 51218 - RNA, 22 nt, Human
ucuacaggguaaggggcuugcc

SEQ ID NO: 51219 - RNA, 22 nt, Human
ucuacagggucagaguuucaug

SEQ ID NO: 51220 - RNA, 22 nt, Human
ucuacagucaaguuauauugcu

SEQ ID NO: 51221 - RNA, 22 nt, Human
ucuacaguguuugguuugagga

SEQ ID NO: 51222 - RNA, 22 nt, Human
ucuacauuuucacaaggucucc

SEQ ID NO: 51223 - RNA, 22 nt, Human
ucuaccuggaguccguuguuaa

SEQ ID NO: 51224 - RNA, 22 nt, Human
ucuacuauguuucuuaaauaga

SEQ ID NO: 51225 - RNA, 17 nt, Human
ucuacuccugaaggaag

SEQ ID NO: 51226 - RNA, 22 nt, Human
ucuacugcacuggugucucauc

SEQ ID NO: 51227 - RNA, 22 nt, Human
ucuacuguggaggcaaauccuu

SEQ ID NO: 51228 - RNA, 22 nt, Human
ucuacuucuccuucauuuccca

SEQ ID NO: 51229 - RNA, 22 nt, Human
ucuagaaaaacaaaguaucuga

SEQ ID NO: 51230 - RNA, 22 nt, Human
ucuagaaacagguuucuagaaa

SEQ ID NO: 51231 - RNA, 22 nt, Human
ucuagaaauuuugccuuguauu

SEQ ID NO: 51232 - RNA, 22 nt, Human
ucuagaagggugccgaucuuag

SEQ ID NO: 51233 - RNA, 22 nt, Human
ucuagaaguccaaaguuaaaua

SEQ ID NO: 51234 - RNA, 22 nt, Human
ucuagaauagauucugcugauc

SEQ ID NO: 51235 - RNA, 22 nt, Human
ucuagaaugacaugcaagagua

SEQ ID NO: 51236 - RNA, 22 nt, Human
ucuagaauucccuuuugacaau

SEQ ID NO: 51237 - RNA, 22 nt, Human
ucuagagaaaaaacucaaguga

SEQ ID NO: 51238 - RNA, 22 nt, Human
ucuagagaaguuuccuuuugaa

SEQ ID NO: 51239 - RNA, 22 nt, Human
ucuagagauacauuggucauuu

SEQ ID NO: 51240 - RNA, 22 nt, Human
ucuagagauuggacuuccuaga

SEQ ID NO: 51241 - RNA, 22 nt, Human
ucuagauguacugcugaagagu

SEQ ID NO: 51242 - RNA, 22 nt, Human
ucuagcagguggcggccagcga

SEQ ID NO: 51243 - RNA, 22 nt, Human
ucuagcaucuaauuauggaauc

SEQ ID NO: 51244 - RNA, 22 nt, Human
ucuagcuuugagaucaguagcc

SEQ ID NO: 51245 - RNA, 22 nt, Human
ucuaggaauuucaucuaguucu

SEQ ID NO: 51246 - RNA, 22 nt, Human
ucuaggagaaccaucagggagg

SEQ ID NO: 51247 - RNA, 17 nt, Human
ucuaggagagcagagcu

SEQ ID NO: 51248 - RNA, 22 nt, Human
ucuaggagcugagaguguguac

SEQ ID NO: 51249 - RNA, 22 nt, Human
ucuaggaguugauaaaagggcu

SEQ ID NO: 51250 - RNA, 20 nt, Human
ucuaggcaggcaggcucgug

SEQ ID NO: 51251 - RNA, 22 nt, Human
ucuaggcauuguuauuacaacu

SEQ ID NO: 51252 - RNA, 22 nt, Human
ucuagggagaguuguuaugggu

SEQ ID NO: 51253 - RNA, 22 nt, Human
ucuagggggacagcuggcugug

SEQ ID NO: 51254 - RNA, 22 nt, Human
ucuagggugaugauucaggaug

SEQ ID NO: 51255 - RNA, 22 nt, Human
ucuaggguugaggccacaggga

SEQ ID NO: 51256 - RNA, 22 nt, Human
ucuagguggaugaggaacauag

SEQ ID NO: 51257 - RNA, 22 nt, Human
ucuaguccuaggagaggaguca

SEQ ID NO: 51258 - RNA, 22 nt, Human
ucuaguuagugguugauacugu

SEQ ID NO: 51259 - RNA, 22 nt, Human
ucuaguuuaagaucuguuaguc

SEQ ID NO: 51260 - RNA, 22 nt, Human
ucuaguuuuagcuugaguugca

SEQ ID NO: 51261 - RNA, 22 nt, Human
ucuauaaagggccagauaguag

SEQ ID NO: 51262 - RNA, 22 nt, Human
ucuauaauccuauuucaacugc

SEQ ID NO: 51263 - RNA, 22 nt, Human
ucuauaauggaaaguggaugug

SEQ ID NO: 51264 - RNA, 22 nt, Human
ucuauacugaugggauacuauu

SEQ ID NO: 51265 - RNA, 22 nt, Human
ucuauauuauacauccaggauu

SEQ ID NO: 51266 - RNA, 22 nt, Human
ucuauauuccagauacagauua

SEQ ID NO: 51267 - RNA, 22 nt, Human
ucuaugcuugagacagaugggg

SEQ ID NO: 51268 - RNA, 19 nt, Human
ucuaugggcuuuuuguagu

SEQ ID NO: 51269 - RNA, 22 nt, Human
ucuauggggccucacaggcacu

SEQ ID NO: 51270 - RNA, 21 nt, Human
ucuauguacgcaucuaugccu

SEQ ID NO: 51271 - RNA, 22 nt, Human
ucuaugucuccaccuucgcaga

SEQ ID NO: 51272 - RNA, 22 nt, Human
ucuaugugcccuuugugugaug

SEQ ID NO: 51273 - RNA, 22 nt, Human
ucuauuaaugauucaauagugu

SEQ ID NO: 51274 - RNA, 22 nt, Human
ucuauugcagauggaugcccuc

SEQ ID NO: 51275 - RNA, 22 nt, Human
ucuauuguaggcauguagcuug

SEQ ID NO: 51276 - RNA, 22 nt, Human
ucuauuuaggagacccugguuc

SEQ ID NO: 51277 - RNA, 22 nt, Human
uuaaacaccugucuaguguagc

SEQ ID NO: 51278 - RNA, 22 nt, Human
uuaaacauuuuugaugaucgau

SEQ ID NO: 51279 - RNA, 22 nt, Human
uuaaaccacugaguggagacua

SEQ ID NO: 51280 - RNA, 22 nt, Human
uuaaaccacuuuguugcaagua

SEQ ID NO: 51281 - RNA, 23 nt, Human
uuaaacuucagugcagaacacuc

SEQ ID NO: 51282 - RNA, 22 nt, Human
uuaaagagucuacugcacaucc

SEQ ID NO: 51283 - RNA, 22 nt, Human
uuaaagaguuuauuacuuguaa

SEQ ID NO: 51284 - RNA, 22 nt, Human
uuaaagcaguuuguauacaugg

SEQ ID NO: 51285 - RNA, 22 nt, Human
uuaaagcaugcugcuuuuccau

SEQ ID NO: 51286 - RNA, 22 nt, Human
uuaaagccugacuguggacuac

SEQ ID NO: 51287 - RNA, 22 nt, Human
uuaaagcuagguggaacaaauu

SEQ ID NO: 51288 - RNA, 22 nt, Human
uuaaagcugcugaauccuauuu

SEQ ID NO: 51289 - RNA, 22 nt, Human
uuaaagcuguagaguuacuugc

SEQ ID NO: 51290 - RNA, 22 nt, Human
uuaaagucuauguacuacacuu

SEQ ID NO: 51291 - RNA, 22 nt, Human
uuaaaguguuaacugaagcuua

SEQ ID NO: 51292 - RNA, 22 nt, Human
uuaaaguucauuaaaugagcca

SEQ ID NO: 51293 - RNA, 22 nt, Human
uuaaauagucaaaucaguggca

SEQ ID NO: 51294 - RNA, 22 nt, Human
uuaaauauuauguugucugcaa

SEQ ID NO: 51295 - RNA, 22 nt, Human
uuaaaugacgggacuggguuuu

SEQ ID NO: 51296 - RNA, 22 nt, Human
uuaaaugagauguucagauauu

SEQ ID NO: 51297 - RNA, 22 nt, Human
uuaaauuaggacucuaguucug

SEQ ID NO: 51298 - RNA, 22 nt, Human
uuaaauucauuccaacuuuuga

SEQ ID NO: 51299 - RNA, 22 nt, Human
ucugcaagcucaguucugacuu

SEQ ID NO: 51300 - RNA, 22 nt, Human
ucugcaagggcacagccaaccc

SEQ ID NO: 51301 - RNA, 22 nt, Human
ucugcaagggguucuuuaggcc

SEQ ID NO: 51302 - RNA, 22 nt, Human
ucugcaaguagaugacagugag

SEQ ID NO: 51303 - RNA, 22 nt, Human
ucugcaaguuuaucacuuggga

SEQ ID NO: 51304 - RNA, 22 nt, Human
ucugcacaauugaucauggcaa

SEQ ID NO: 51305 - RNA, 22 nt, Human
ucugcacaccgccaggcugacu

SEQ ID NO: 51306 - RNA, 22 nt, Human
ucugcacagagacccuugccag

SEQ ID NO: 51307 - RNA, 22 nt, Human
ucugcacagauucucugagaau

SEQ ID NO: 51308 - RNA, 22 nt, Human
ucugcacaggcguagguugacu

SEQ ID NO: 51309 - RNA, 22 nt, Human
ucugcacccacguaccuuggcu

SEQ ID NO: 51310 - RNA, 22 nt, Human
ucugcaccccgcagggucaggu

SEQ ID NO: 51311 - RNA, 22 nt, Human
ucugcaccuuucuuaaaaaucg

SEQ ID NO: 51312 - RNA, 22 nt, Human
ucugcagaauucgaggaagaaa

SEQ ID NO: 51313 - RNA, 22 nt, Human
ucugcagacacuggggucugga

SEQ ID NO: 51314 - RNA, 22 nt, Human
ucugcagacuugauaaccacug

SEQ ID NO: 51315 - RNA, 22 nt, Human
ucugcagagauucugggcugag

SEQ ID NO: 51316 - RNA, 17 nt, Human
ucugcagaggcaaaccu

SEQ ID NO: 51317 - RNA, 22 nt, Human
ucugcagagggagugcuggguc

SEQ ID NO: 51318 - RNA, 22 nt, Human
ucugcagcccaaagucucuuag

SEQ ID NO: 51319 - RNA, 22 nt, Human
ucugcagcgugcaggcuggugc

SEQ ID NO: 51320 - RNA, 22 nt, Human
ucugcaggccucgacaaggcca

SEQ ID NO: 51321 - RNA, 22 nt, Human
ucugcaggcucuagaugagguu

SEQ ID NO: 51322 - RNA, 22 nt, Human
ucugcagguagagcucaggaau

SEQ ID NO: 51323 - RNA, 22 nt, Human
ucugcaggucacgcuccagccu

SEQ ID NO: 51324 - RNA, 22 nt, Human
ucugcaucauuuuucagagccg

SEQ ID NO: 51325 - RNA, 22 nt, Human
ucugcaucucuuauaaaugaug

SEQ ID NO: 51326 - RNA, 22 nt, Human
ucugcaucuguguugagugccc

SEQ ID NO: 51327 - RNA, 22 nt, Human
ucugcauuacaugccauagaca

SEQ ID NO: 51328 - RNA, 22 nt, Human
ucugcauuauuggaaaguccuu

SEQ ID NO: 51329 - RNA, 22 nt, Human
ucugcauuuuuaacaagauccc

SEQ ID NO: 51330 - RNA, 22 nt, Human
ucugcauuuuuacaagaucccc

SEQ ID NO: 51331 - RNA, 22 nt, Human
ucugccacacugguucagugga

SEQ ID NO: 51332 - RNA, 22 nt, Human
ucugccaccaccuacacuagua

SEQ ID NO: 51333 - RNA, 20 nt, Human
ucugccacugcacucugccc

SEQ ID NO: 51334 - RNA, 22 nt, Human
ucugccacugugaugcaugaua

SEQ ID NO: 51335 - RNA, 22 nt, Human
ucugccacuuaccuccauguac

SEQ ID NO: 51336 - RNA, 22 nt, Human
ucugccagcaccaugauccuuc

SEQ ID NO: 51337 - RNA, 22 nt, Human
ucugccaggccugcuuccgggg

SEQ ID NO: 51338 - RNA, 22 nt, Human
ucugccaggcuuggugcuagau

SEQ ID NO: 51339 - RNA, 16 nt, Human
ucugccagggacaggc

SEQ ID NO: 51340 - RNA, 22 nt, Human
ucugccagugguuuggcccuga

SEQ ID NO: 51341 - RNA, 23 nt, Human
ucugccagugugugccaggagcc

SEQ ID NO: 51342 - RNA, 17 nt, Human
ucugccaguuuuagaau

SEQ ID NO: 51343 - RNA, 22 nt, Human
ucugcccugcagggagcaguaa

SEQ ID NO: 51344 - RNA, 22 nt, Human
ucugcccugccauucacuggaa

SEQ ID NO: 51345 - RNA, 22 nt, Human
ucugccuagugggacagcagcc

SEQ ID NO: 51346 - RNA, 22 nt, Human
ucugccugaaucucuuagaaca

SEQ ID NO: 51347 - RNA, 22 nt, Human
ucugccugagaaguggggugcc

SEQ ID NO: 51348 - RNA, 22 nt, Human
ucugccugagcagagggaggcc

SEQ ID NO: 51349 - RNA, 22 nt, Human
ucugccugaggacugacaccag

SEQ ID NO: 51350 - RNA, 22 nt, Human
ucugccugagggagcugaggaa

SEQ ID NO: 51351 - RNA, 18 nt, Human
ucugccugcagggcaucu

SEQ ID NO: 51352 - RNA, 22 nt, Human
ucugccugccagucugguccuc

SEQ ID NO: 51353 - RNA, 22 nt, Human
ucugccugccgagaacaccuac

SEQ ID NO: 51354 - RNA, 22 nt, Human
ucugccugcggcugcagguggc

SEQ ID NO: 51355 - RNA, 22 nt, Human
ucugccugcuaacuccugcacc

SEQ ID NO: 51356 - RNA, 22 nt, Human
ucugccuggacccuggugagcu

SEQ ID NO: 51357 - RNA, 22 nt, Human
ucugccuggagaguucuucucu

SEQ ID NO: 51358 - RNA, 22 nt, Human
ucugccuggauuccauucucca

SEQ ID NO: 51359 - RNA, 22 nt, Human
ucugccuggccuggagggcaca

SEQ ID NO: 51360 - RNA, 22 nt, Human
ucugccuguaauauuuggagaa

SEQ ID NO: 51361 - RNA, 22 nt, Human
ucugccugucuccuugaauugu

SEQ ID NO: 51362 - RNA, 22 nt, Human
ucugccuguggauacaugcucu

SEQ ID NO: 51363 - RNA, 22 nt, Human
ucugccuguucaagucuucuag

SEQ ID NO: 51364 - RNA, 22 nt, Human
ucugccuuagcaauugucaagg

SEQ ID NO: 51365 - RNA, 22 nt, Human
ucugccuucgcugcucccugaa

SEQ ID NO: 51366 - RNA, 22 nt, Human
ucugccuuguuugagcuuugac

SEQ ID NO: 51367 - RNA, 22 nt, Human
ucugcgugaauuugcauugugg

SEQ ID NO: 51368 - RNA, 22 nt, Human
ucugcguggcgugguucugugc

SEQ ID NO: 51369 - RNA, 22 nt, Human
ucugcguugcucacgcugggag

SEQ ID NO: 51370 - RNA, 22 nt, Human
ucugcucacauggcuccaugca

SEQ ID NO: 51371 - RNA, 22 nt, Human
ucugcugccugcagggcagaga

SEQ ID NO: 51372 - RNA, 22 nt, Human
ucugcugcuacagacucucuag

SEQ ID NO: 51373 - RNA, 22 nt, Human
ucugcuggaaaaccagggaauu

SEQ ID NO: 51374 - RNA, 20 nt, Human
ucugcuggccaaaacuucac

SEQ ID NO: 51375 - RNA, 22 nt, Human
ucugcuguacuuuuggucuguu

SEQ ID NO: 51376 - RNA, 22 nt, Human
ucugcugucuuuucugggugag

SEQ ID NO: 51377 - RNA, 22 nt, Human
ucugcugugaaaggugaauauu

SEQ ID NO: 51378 - RNA, 22 nt, Human
ucugcugugauuugcuaccugu

SEQ ID NO: 51379 - RNA, 22 nt, Human
ucugcuguguugaaugauuggu

SEQ ID NO: 51380 - RNA, 22 nt, Human
ucugcuucacuuccccaagcuu

SEQ ID NO: 51381 - RNA, 23 nt, Human
ucugcuucuguauuuuuucccau

SEQ ID NO: 51382 - RNA, 22 nt, Human
ucugcuuucaaauucacuuagu

SEQ ID NO: 51383 - RNA, 22 nt, Human
ucugcuuuuucauugacugaaa

SEQ ID NO: 51384 - RNA, 22 nt, Human
ucuggaaggggaucugugguca

SEQ ID NO: 51385 - RNA, 23 nt, Human
ucuggaaugguacucacuggagu

SEQ ID NO: 51386 - RNA, 22 nt, Human
ucuggaauuaaacucaggagac

SEQ ID NO: 51387 - RNA, 22 nt, Human
ucuggaauugcugugugaguuc

SEQ ID NO: 51388 - RNA, 22 nt, Human
ucuggaauuuucuagggcauca

SEQ ID NO: 51389 - RNA, 22 nt, Human
ucuggacauccuggagaaugac

SEQ ID NO: 51390 - RNA, 22 nt, Human
ucuggacuccaugcugccugga

SEQ ID NO: 51391 - RNA, 22 nt, Human
ucuggagaccuagcccuguugu

SEQ ID NO: 51392 - RNA, 22 nt, Human
ucuggagagaucuuccacaaca

SEQ ID NO: 51393 - RNA, 22 nt, Human
ucuggagagcagaugccucugg

SEQ ID NO: 51394 - RNA, 23 nt, Human
ugacaaagcgagacuccagcuca

SEQ ID NO: 51395 - RNA, 22 nt, Human
ugacaacaaggauccugccugg

SEQ ID NO: 51396 - RNA, 23 nt, Human
ugacaacagcucucagccauguc

SEQ ID NO: 51397 - RNA, 22 nt, Human
ugacaacaucauuuuugugugg

SEQ ID NO: 51398 - RNA, 22 nt, Human
ugacaagaagaccugguaauga

SEQ ID NO: 51399 - RNA, 22 nt, Human
ugacaagagcauucccacaccu

SEQ ID NO: 51400 - RNA, 22 nt, Human
ugacaauacagagagagcaaaa

SEQ ID NO: 51401 - RNA, 22 nt, Human
ugacaauagcgauuuaucuugc

SEQ ID NO: 51402 - RNA, 22 nt, Human
ugacaauauugagucuuagguu

SEQ ID NO: 51403 - RNA, 22 nt, Human
ugacaauggguggacaagauag

SEQ ID NO: 51404 - RNA, 22 nt, Human
ugacacaaacaagauauuugcc

SEQ ID NO: 51405 - RNA, 22 nt, Human
ugacacaauugagugguacuau

SEQ ID NO: 51406 - RNA, 22 nt, Human
ugacacagaauuuggcuaucac

SEQ ID NO: 51407 - RNA, 19 nt, Human
ugacacagcuagguuugcu

SEQ ID NO: 51408 - RNA, 22 nt, Human
ucuguugcaaugugcaugguga

SEQ ID NO: 51409 - RNA, 22 nt, Human
ucuguuuaaugggaaugauacu

SEQ ID NO: 51410 - RNA, 22 nt, Human
ucuguuuaggcaaaauagcuac

SEQ ID NO: 51411 - RNA, 22 nt, Human
ucuguuuaugugucuaaauaaa

SEQ ID NO: 51412 - RNA, 22 nt, Human
ucuguuucuuccuagccaugcu

SEQ ID NO: 51413 - RNA, 22 nt, Human
ucuguuuucucuguauuuugac

SEQ ID NO: 51414 - RNA, 23 nt, Human
ucuguuuugcaacaugugacaag

SEQ ID NO: 51415 - RNA, 22 nt, Human
ucuuaaaaguaugccaauugga

SEQ ID NO: 51416 - RNA, 22 nt, Human
ucuuaaagccaagcauaaacca

SEQ ID NO: 51417 - RNA, 22 nt, Human
ucuuaaagcuuacuucaauugu

SEQ ID NO: 51418 - RNA, 20 nt, Human
ucuuaaauccccagggccau

SEQ ID NO: 51419 - RNA, 22 nt, Human
ucuuaauucugugucuucacua

SEQ ID NO: 51420 - RNA, 22 nt, Human
ucuuaauugagaacaguguagg

SEQ ID NO: 51421 - RNA, 22 nt, Human
ucuuacauauacgucauuuagu

SEQ ID NO: 51422 - RNA, 22 nt, Human
ucuuagaaguuuauggcacgga

SEQ ID NO: 51423 - RNA, 22 nt, Human
ucuuagaugaauaaaaaguuau

SEQ ID NO: 51424 - RNA, 22 nt, Human
ucuuagcacagcuauauaaguu

SEQ ID NO: 51425 - RNA, 22 nt, Human
ucuuagcagugcugagaagaau

SEQ ID NO: 51426 - RNA, 22 nt, Human
ucuuagcauuuguuaauaccca

SEQ ID NO: 51427 - RNA, 22 nt, Human
ucuuaggaguagaauucucaca

SEQ ID NO: 51428 - RNA, 22 nt, Human
ucuuaguuguuugcugucuaac

SEQ ID NO: 51429 - RNA, 22 nt, Human
ucuuauaaaaggacucccauuu

SEQ ID NO: 51430 - RNA, 22 nt, Human
ucuuaugggaaagauguaauua

SEQ ID NO: 51431 - RNA, 22 nt, Human
ucuuauuugcaacuggcucaga

SEQ ID NO: 51432 - RNA, 22 nt, Human
ucuucaaaauauuccauccauu

SEQ ID NO: 51433 - RNA, 22 nt, Human
ucuucaaacccugguuuuguga

SEQ ID NO: 51434 - RNA, 22 nt, Human
uuccagcaggcagacaggagau

SEQ ID NO: 51435 - RNA, 22 nt, Human
uuccagccaugguuucccuaug

SEQ ID NO: 51436 - RNA, 20 nt, Human
uuccagccgccacuuccgcc

SEQ ID NO: 51437 - RNA, 22 nt, Human
uuccagccuuuauccauccaga

SEQ ID NO: 51438 - RNA, 22 nt, Human
uuccaggaaaacaguuggaagu

SEQ ID NO: 51439 - RNA, 22 nt, Human
uuccaggaacacucuguguccc

SEQ ID NO: 51440 - RNA, 22 nt, Human
uuccaggaagacaucucaggaa

SEQ ID NO: 51441 - RNA, 22 nt, Human
uuccaggacaagauguuucagg

SEQ ID NO: 51442 - RNA, 22 nt, Human
uuccaggacucguucuggcuca

SEQ ID NO: 51443 - RNA, 22 nt, Human
uuccaggagaggaaaccugauu

SEQ ID NO: 51444 - RNA, 22 nt, Human
uuccaggaugcugcugcuuuuu

SEQ ID NO: 51445 - RNA, 22 nt, Human
uuccaggaugggcuguccuacu

SEQ ID NO: 51446 - RNA, 21 nt, Human
uuccaggauugcuuauuuuua

SEQ ID NO: 51447 - RNA, 22 nt, Human
uuccaggcacaucccaacucca

SEQ ID NO: 51448 - RNA, 23 nt, Human
uuccaggcagagcagggauuaga

SEQ ID NO: 51449 - RNA, 22 nt, Human
uuccaggcgcacgucggccuua

SEQ ID NO: 51450 - RNA, 22 nt, Human
uuccaggcuauccggugaaggg

SEQ ID NO: 51451 - RNA, 22 nt, Human
uuccaggcuccugcaguuucua

SEQ ID NO: 51452 - RNA, 22 nt, Human
uuccagggcagcaagugaaugg

SEQ ID NO: 51453 - RNA, 22 nt, Human
uuccagggcuagguaaugggua

SEQ ID NO: 51454 - RNA, 22 nt, Human
uuccaggggcagcagugauggu

SEQ ID NO: 51455 - RNA, 22 nt, Human
uuccaggguuaauuuauauggu

SEQ ID NO: 51456 - RNA, 22 nt, Human
uuccaguaaugugacuuugagc

SEQ ID NO: 51457 - RNA, 22 nt, Human
uuccaguccagggcuguuucca

SEQ ID NO: 51458 - RNA, 23 nt, Human
uuccagugagacugagaggucuu

SEQ ID NO: 51459 - RNA, 22 nt, Human
uuccagugaugggcaauuuggu

SEQ ID NO: 51460 - RNA, 22 nt, Human
uuccagugugcuuuuauguuag

SEQ ID NO: 51461 - RNA, 22 nt, Human
uuccaguucccaugaggauuaa

SEQ ID NO: 51462 - RNA, 22 nt, Human
uuccaguuggagccugccuuua

SEQ ID NO: 51463 - RNA, 21 nt, Human
uuccaguuuuaauuaaauugu

SEQ ID NO: 51464 - RNA, 22 nt, Human
uuccauaacugaccgaaugcau

SEQ ID NO: 51465 - RNA, 22 nt, Human
uuccauacgacugaggucucgg

SEQ ID NO: 51466 - RNA, 20 nt, Human
uuccauagcacccugugggu

SEQ ID NO: 51467 - RNA, 22 nt, Human
uuccauauuggaaggcacaggc

SEQ ID NO: 51468 - RNA, 22 nt, Human
uuccauccauaucuuguugagg

SEQ ID NO: 51469 - RNA, 22 nt, Human
uuccauccaugucccguuucug

SEQ ID NO: 51470 - RNA, 22 nt, Human
uuccauccuaauaaaagaaguu

SEQ ID NO: 51471 - RNA, 19 nt, Human
uuccaucuaucuucuuacu

SEQ ID NO: 51472 - RNA, 22 nt, Human
uuccaugaaggagacugagaag

SEQ ID NO: 51473 - RNA, 22 nt, Human
uuccaugcaagaaguauggcuc

SEQ ID NO: 51474 - RNA, 22 nt, Human
uuccaugccuagaacaggauuc

SEQ ID NO: 51475 - RNA, 22 nt, Human
uuccaugcuaagacacgcaggg

SEQ ID NO: 51476 - RNA, 22 nt, Human
uuccaugugaguacacugugau

SEQ ID NO: 51477 - RNA, 22 nt, Human
uuccauuuuucuaacucucaga

SEQ ID NO: 51478 - RNA, 22 nt, Human
uucccaaagcuuugucugugaa

SEQ ID NO: 51479 - RNA, 22 nt, Human
uucccaauauucugcuuuuaug

SEQ ID NO: 51480 - RNA, 22 nt, Human
uucccacacuccauauaauuca

SEQ ID NO: 51481 - RNA, 22 nt, Human
uucccacagagauuacauugaa

SEQ ID NO: 51482 - RNA, 22 nt, Human
uucccacagucacugggagaag

SEQ ID NO: 51483 - RNA, 22 nt, Human
uucccagacuccacacugaggc

SEQ ID NO: 51484 - RNA, 19 nt, Human
uucccagagccaugaguga

SEQ ID NO: 51485 - RNA, 22 nt, Human
uucccagaggcaaagucuggau

SEQ ID NO: 51486 - RNA, 22 nt, Human
uucccaggacucugggugucuu

SEQ ID NO: 51487 - RNA, 22 nt, Human
uucccaggcugugcuaccagag

SEQ ID NO: 51488 - RNA, 22 nt, Human
uucccaguauuaccuucaggaa

SEQ ID NO: 51489 - RNA, 22 nt, Human
uucccagucccaagaaaagcca

SEQ ID NO: 51490 - RNA, 22 nt, Human
uucccagugaggaagcaaugca

SEQ ID NO: 51491 - RNA, 22 nt, Human
uucccaguuagucauuuuuaca

SEQ ID NO: 51492 - RNA, 22 nt, Human
uucccauagugaccgaugcuga

SEQ ID NO: 51493 - RNA, 22 nt, Human
uuccccaggggcuccugccuuu

SEQ ID NO: 51494 - RNA, 22 nt, Human
uuccccaggugauucucauggc

SEQ ID NO: 51495 - RNA, 22 nt, Human
uuccccaguaacauacauguga

SEQ ID NO: 51496 - RNA, 22 nt, Human
uuccccucucagaucuggccua

SEQ ID NO: 51497 - RNA, 22 nt, Human
uuccccuugggcuguggaggag

SEQ ID NO: 51498 - RNA, 22 nt, Human
uucccucccccagccuggcagg

SEQ ID NO: 51499 - RNA, 22 nt, Human
uucccugguuaaccauuuucug

SEQ ID NO: 51500 - RNA, 22 nt, Human
uucccuuccucacucuacuugu

SEQ ID NO: 51501 - RNA, 21 nt, Human
uucccuucugguuuugagaga

SEQ ID NO: 51502 - RNA, 22 nt, Human
uucccuugaccccagacccugg

SEQ ID NO: 51503 - RNA, 22 nt, Human
uucccuuuguuaaauuggaaga

SEQ ID NO: 51504 - RNA, 22 nt, Human
uuccggaagguucucuagaauu

SEQ ID NO: 51505 - RNA, 22 nt, Human
uuccggaauggcaggguagcuc

SEQ ID NO: 51506 - RNA, 22 nt, Human
uuccuaaaagaauacacuggau

SEQ ID NO: 51507 - RNA, 22 nt, Human
uuccuaacaaacuucagugaau

SEQ ID NO: 51508 - RNA, 22 nt, Human
uuccuaaccucuagcugcauau

SEQ ID NO: 51509 - RNA, 22 nt, Human
uuccuaaguccugccagcaguc

SEQ ID NO: 51510 - RNA, 22 nt, Human
uuccuacaucaccagggggagu

SEQ ID NO: 51511 - RNA, 22 nt, Human
uuccuauagaaagcuguguaga

SEQ ID NO: 51512 - RNA, 22 nt, Human
uuccuauggccagagucaaaga

SEQ ID NO: 51513 - RNA, 22 nt, Human
uuccuauggcucaguugcauuu

SEQ ID NO: 51514 - RNA, 20 nt, Human
uuccucaggagaggauguua

SEQ ID NO: 51515 - RNA, 22 nt, Human
uuccucaggcuucccuuugucc

SEQ ID NO: 51516 - RNA, 22 nt, Human
uuccucagggaggcuagcagua

SEQ ID NO: 51517 - RNA, 22 nt, Human
ugaagcaggaucguuugcuuca

SEQ ID NO: 51518 - RNA, 22 nt, Human
ugaagcaggugaauggaugucg

SEQ ID NO: 51519 - RNA, 22 nt, Human
ugaagccagggacugacacuuc

SEQ ID NO: 51520 - RNA, 22 nt, Human
ugaagccauaggacagaggaua

SEQ ID NO: 51521 - RNA, 22 nt, Human
ugaagccccuaagucccaggca

SEQ ID NO: 51522 - RNA, 22 nt, Human
ugaagcccugucuuauggaaga

SEQ ID NO: 51523 - RNA, 22 nt, Human
ugaagcccugugucagcuucca

SEQ ID NO: 51524 - RNA, 22 nt, Human
ugaagcuagaauguccauauuu

SEQ ID NO: 51525 - RNA, 22 nt, Human
ugaagcugccugcucacagcca

SEQ ID NO: 51526 - RNA, 22 nt, Human
ugaagcuuguauuuaaauaagu

SEQ ID NO: 51527 - RNA, 22 nt, Human
ugaagcuuuccuguggucagga

SEQ ID NO: 51528 - RNA, 22 nt, Human
ugaaggagaauuaauaggcauu

SEQ ID NO: 51529 - RNA, 22 nt, Human
ugaaggagauuuuuagggaggc

SEQ ID NO: 51530 - RNA, 22 nt, Human
ugaaggagcugauguaaggggu

SEQ ID NO: 51531 - RNA, 22 nt, Human
ugaaggcaacugagaaaaagca

SEQ ID NO: 51532 - RNA, 22 nt, Human
ugaaggcagugaguuuguguuu

SEQ ID NO: 51533 - RNA, 22 nt, Human
ugaaggcauaaaucuugggaac

SEQ ID NO: 51534 - RNA, 22 nt, Human
ugaaggccaaaagacgggcuuc

SEQ ID NO: 51535 - RNA, 17 nt, Human
ugaaggccaugaccacg

SEQ ID NO: 51536 - RNA, 23 nt, Human
ugaaggcccuggagccacgaggc

SEQ ID NO: 51537 - RNA, 22 nt, Human
ugaaggccucugguacaugcca

SEQ ID NO: 51538 - RNA, 22 nt, Human
ugaaggcugguaguuugggcug

SEQ ID NO: 51539 - RNA, 22 nt, Human
ugaaggcuuuuuaaagcauuug

SEQ ID NO: 51540 - RNA, 21 nt, Human
ugaagggguggcagugugcuu

SEQ ID NO: 51541 - RNA, 22 nt, Human
ugaaggguggcauggcaggcag

SEQ ID NO: 51542 - RNA, 22 nt, Human
ugaagguaauggaaucuccuga

SEQ ID NO: 51543 - RNA, 22 nt, Human
ugaaggugaaugucuaugggga

SEQ ID NO: 51544 - RNA, 22 nt, Human
ugaagguggcauaggagagaug

SEQ ID NO: 51545 - RNA, 19 nt, Human
ugaaguccuaaccuccagu

SEQ ID NO: 51546 - RNA, 22 nt, Human
ugaagucuauuaacugauuucu

SEQ ID NO: 51547 - RNA, 22 nt, Human
ugcacagaugggcuuguucaua

SEQ ID NO: 51548 - RNA, 22 nt, Human
ugcacagcuggcucuccuuuuc

SEQ ID NO: 51549 - RNA, 20 nt, Human
ugcacagcugugaauaggau

SEQ ID NO: 51550 - RNA, 18 nt, Human
ugcacagcugugggcugg

SEQ ID NO: 51551 - RNA, 22 nt, Human
ugcacaggaggcuguggagaag

SEQ ID NO: 51552 - RNA, 21 nt, Human
ugcacagggcccaggagagcc

SEQ ID NO: 51553 - RNA, 22 nt, Human
ugcacagugaccccuggugacu

SEQ ID NO: 51554 - RNA, 20 nt, Human
ugcacauggcagccaucuag

SEQ ID NO: 51555 - RNA, 22 nt, Human
ugcacaugugccuguggcacau

SEQ ID NO: 51556 - RNA, 22 nt, Human
ugcacauuaguguuugagaugc

SEQ ID NO: 51557 - RNA, 22 nt, Human
ugcaccauacccauuccccucu

SEQ ID NO: 51558 - RNA, 22 nt, Human
ugcaccauuuugucaggcuacu

SEQ ID NO: 51559 - RNA, 22 nt, Human
ugcaccugagaggucucugagg

SEQ ID NO: 51560 - RNA, 22 nt, Human
ugcaccuuguccauuuuuggcc

SEQ ID NO: 51561 - RNA, 22 nt, Human
ugcacguauggcaguggagccc

SEQ ID NO: 51562 - RNA, 19 nt, Human
ugcacguuggaaucaccug

SEQ ID NO: 51563 - RNA, 22 nt, Human
ugcacuauuucgccaugguugu

SEQ ID NO: 51564 - RNA, 22 nt, Human
ugcacugaauaguagacuguac

SEQ ID NO: 51565 - RNA, 22 nt, Human
ugcacugcuuugcaaagcugag

SEQ ID NO: 51566 - RNA, 22 nt, Human
ugcacuguugcuuuauaugauu

SEQ ID NO: 51567 - RNA, 22 nt, Human
ugcacuucaaaaaugucacuga

SEQ ID NO: 51568 - RNA, 22 nt, Human
ugcacuuggcugugaucucuag

SEQ ID NO: 51569 - RNA, 22 nt, Human
ugcacuuugcaggcauggaaac

SEQ ID NO: 51570 - RNA, 21 nt, Human
ugcagaaaugguuuuucuaag

SEQ ID NO: 51571 - RNA, 22 nt, Human
ugcagaaauucagaaagcauaa

SEQ ID NO: 51572 - RNA, 22 nt, Human
ugcagaacgggucuucuagcac

SEQ ID NO: 51573 - RNA, 22 nt, Human
ugcagaagaaugagcuuggagu

SEQ ID NO: 51574 - RNA, 22 nt, Human
ugcagaagaauguaggcauaag

SEQ ID NO: 51575 - RNA, 22 nt, Human
ugcagaaggaggaggaaaucca

SEQ ID NO: 51576 - RNA, 22 nt, Human
ugcagaagugagucaugaggaa

SEQ ID NO: 51577 - RNA, 22 nt, Human
ugcagaauguggacaguggguu

SEQ ID NO: 51578 - RNA, 22 nt, Human
ugcagacaagucgugggaucuu

SEQ ID NO: 51579 - RNA, 22 nt, Human
ugcagacaagugcaucuaaccc

SEQ ID NO: 51580 - RNA, 22 nt, Human
ugcagaccucccauggcugccu

SEQ ID NO: 51581 - RNA, 22 nt, Human
ugcagagaaaguguagacaggc

SEQ ID NO: 51582 - RNA, 19 nt, Human
ugcagagagaggcaaagaa

SEQ ID NO: 51583 - RNA, 22 nt, Human
ugcagagagcccugccuuccuc

SEQ ID NO: 51584 - RNA, 22 nt, Human
ugcagagaucugggcgucggcu

SEQ ID NO: 51585 - RNA, 22 nt, Human
ugcagagauuuggcucuuaaag

SEQ ID NO: 51586 - RNA, 22 nt, Human
ugcagagcuucauugcauaggc

SEQ ID NO: 51587 - RNA, 22 nt, Human
ugcagaggagcuggaaggcugg

SEQ ID NO: 51588 - RNA, 21 nt, Human
ugcagaggcacaaacaagccc

SEQ ID NO: 51589 - RNA, 22 nt, Human
ugcagaggcgccgugggugggg

SEQ ID NO: 51590 - RNA, 23 nt, Human
ugcagagggacugaagccagcuu

SEQ ID NO: 51591 - RNA, 22 nt, Human
ugcagagggagugacgguucac

SEQ ID NO: 51592 - RNA, 22 nt, Human
ugcagaggugaaagacuagcaa

SEQ ID NO: 51593 - RNA, 22 nt, Human
ugcagagguguugcugagauaa

SEQ ID NO: 51594 - RNA, 22 nt, Human
ugcagagguuugugguguugcu

SEQ ID NO: 51595 - RNA, 22 nt, Human
ugcagauaauacuagaacuuac

SEQ ID NO: 51596 - RNA, 22 nt, Human
ugcagaugagagggaguuuuua

SEQ ID NO: 51597 - RNA, 22 nt, Human
ugcagauggggaucaguggcuc

SEQ ID NO: 51598 - RNA, 22 nt, Human
ugcagcaacaagauagaauggc

SEQ ID NO: 51599 - RNA, 18 nt, Human
ugcagcaagugcuaaaua

SEQ ID NO: 51600 - RNA, 22 nt, Human
ugcagcaauguaguuugggaca

SEQ ID NO: 51601 - RNA, 22 nt, Human
ugcagcaccacaccuggcuaau

SEQ ID NO: 51602 - RNA, 22 nt, Human
ugcagcacuugccaaacuaacu

SEQ ID NO: 51603 - RNA, 22 nt, Human
ugcagcagacugaguaugagaa

SEQ ID NO: 51604 - RNA, 22 nt, Human
ugcagcagccaagguucugugc

SEQ ID NO: 51605 - RNA, 22 nt, Human
ugcagcaguguuccuuggcuug

SEQ ID NO: 51606 - RNA, 22 nt, Human
ugcagcaguuuaaugcaggguu

SEQ ID NO: 51607 - RNA, 22 nt, Human
ugcagcauauagcuuagugaug

SEQ ID NO: 51608 - RNA, 22 nt, Human
ugcagcaugcaggagaggcucu

SEQ ID NO: 51609 - RNA, 18 nt, Human
ugcagcauguucccauaa

SEQ ID NO: 51610 - RNA, 22 nt, Human
ugcagcauuauucacaguagcc

SEQ ID NO: 51611 - RNA, 22 nt, Human
ugcagcauugaaauagcuaggc

SEQ ID NO: 51612 - RNA, 23 nt, Human
ugcagccacucaggagcucagug

SEQ ID NO: 51613 - RNA, 22 nt, Human
ugcagccauuugaaaagcaguu

SEQ ID NO: 51614 - RNA, 22 nt, Human
ugcagccucucugcuucaggaa

SEQ ID NO: 51615 - RNA, 21 nt, Human
ugcagccucugcccagcagug

SEQ ID NO: 51616 - RNA, 22 nt, Human
ugcagccuugaccuccagugcu

SEQ ID NO: 51617 - RNA, 22 nt, Human
ugcagccuugccuccucccagc

SEQ ID NO: 51618 - RNA, 22 nt, Human
ugcagcuagcgugccuagugaa

SEQ ID NO: 51619 - RNA, 23 nt, Human
ugcagcucaaagauggguaaaug

SEQ ID NO: 51620 - RNA, 22 nt, Human
ugcagcucaggauucucagggc

SEQ ID NO: 51621 - RNA, 22 nt, Human
ugcagcucauauuagagagaag

SEQ ID NO: 51622 - RNA, 22 nt, Human
ugcagcucauugcuggggucug

SEQ ID NO: 51623 - RNA, 22 nt, Human
ugcagcucgggcuuaggguggg

SEQ ID NO: 51624 - RNA, 22 nt, Human
ugcagcucugaacagucaugaa

SEQ ID NO: 51625 - RNA, 22 nt, Human
ugcagcucuuacggagggcggg

SEQ ID NO: 51626 - RNA, 22 nt, Human
uugcugaacccugcccucuaau

SEQ ID NO: 51627 - RNA, 22 nt, Human
uugcugaagcugccaaaccagu

SEQ ID NO: 51628 - RNA, 22 nt, Human
uugcugaaguaugaaaaagaca

SEQ ID NO: 51629 - RNA, 22 nt, Human
uugcugaaguauugugaauccu

SEQ ID NO: 51630 - RNA, 22 nt, Human
uugcugaauugaauccuuuggu

SEQ ID NO: 51631 - RNA, 22 nt, Human
uugcugaugcccuuguccaggc

SEQ ID NO: 51632 - RNA, 22 nt, Human
uugcugauucaugauuugagaa

SEQ ID NO: 51633 - RNA, 22 nt, Human
uugcugauucuguauuuaaggu

SEQ ID NO: 51634 - RNA, 22 nt, Human
uugcuggaagguggcuggaauc

SEQ ID NO: 51635 - RNA, 19 nt, Human
uugcuggagaaaaaggaga

SEQ ID NO: 51636 - RNA, 19 nt, Human
uugcuggcauuugaucucu

SEQ ID NO: 51637 - RNA, 22 nt, Human
uugcuguaaguaucuuucuacc

SEQ ID NO: 51638 - RNA, 22 nt, Human
uugcuguaggcugauugcugaa

SEQ ID NO: 51639 - RNA, 22 nt, Human
uugcuguagggggaaaauacuu

SEQ ID NO: 51640 - RNA, 22 nt, Human
uugcugugaaaccaugggaagu

SEQ ID NO: 51641 - RNA, 22 nt, Human
uugcuguguaacuccuggccug

SEQ ID NO: 51642 - RNA, 22 nt, Human
uugcuguuuuacuuacaagcuc

SEQ ID NO: 51643 - RNA, 22 nt, Human
uugcuuagagccaaucuugauu

SEQ ID NO: 51644 - RNA, 22 nt, Human
uugcuucagagggagacacuuu

SEQ ID NO: 51645 - RNA, 22 nt, Human
uugcuucauuuugggacucuag

SEQ ID NO: 51646 - RNA, 22 nt, Human
uugcuuccaguccaagucuguu

SEQ ID NO: 51647 - RNA, 22 nt, Human
uugcuuccuggcagggcgagcg

SEQ ID NO: 51648 - RNA, 22 nt, Human
uugcuuccuuuacagaugggca

SEQ ID NO: 51649 - RNA, 18 nt, Human
uugcuucuuuucucuagg

SEQ ID NO: 51650 - RNA, 22 nt, Human
uugcuugaacccaggaagugga

SEQ ID NO: 51651 - RNA, 22 nt, Human
uugcuugcccugcagcauacuu

SEQ ID NO: 51652 - RNA, 22 nt, Human
uugcuugucuucccuuuaccuc

SEQ ID NO: 51653 - RNA, 22 nt, Human
uugcuuuaccauuugaucucua

SEQ ID NO: 51654 - RNA, 22 nt, Human
uugcuuuaccugugguauauuu

SEQ ID NO: 51655 - RNA, 22 nt, Human
uugcuuuaucucuuaugccuca

SEQ ID NO: 51656 - RNA, 22 nt, Human
uugcuuuauguguaugacuuga

SEQ ID NO: 51657 - RNA, 22 nt, Human
uugcuuuauuccuagcccuugu

SEQ ID NO: 51658 - RNA, 22 nt, Human
uugcuuuguuacugcaguuucc

SEQ ID NO: 51659 - RNA, 22 nt, Human
uugcuuuuaaucuuuguacauc

SEQ ID NO: 51660 - RNA, 22 nt, Human
uugcuuuugggaaaacaugccu

SEQ ID NO: 51661 - RNA, 22 nt, Human
uugcuuuugucucggguuugga

SEQ ID NO: 51662 - RNA, 22 nt, Human
uuggaaaaacacgauagugguu

SEQ ID NO: 51663 - RNA, 22 nt, Human
uuggaaaagcguucucuguagc

SEQ ID NO: 51664 - RNA, 22 nt, Human
uuggaaaaugaggcacagagag

SEQ ID NO: 51665 - RNA, 22 nt, Human
uuggaaacuuucaagcauaaug

SEQ ID NO: 51666 - RNA, 22 nt, Human
uuggaaauacagcaguuacuuu

SEQ ID NO: 51667 - RNA, 22 nt, Human
uuggaaauacgaguaguaucau

SEQ ID NO: 51668 - RNA, 23 nt, Human
uuggaaauggggagaacagauuc

SEQ ID NO: 51669 - RNA, 22 nt, Human
uuggaacacaauguuucuuuca

SEQ ID NO: 51670 - RNA, 22 nt, Human
uuggaacucguguuacuuguau

SEQ ID NO: 51671 - RNA, 22 nt, Human
uuggaacugauggccuucaucc

SEQ ID NO: 51672 - RNA, 22 nt, Human
uuggaagacauuaaagagagug

SEQ ID NO: 51673 - RNA, 21 nt, Human
uuggaagauaaugcuuaugau

SEQ ID NO: 51674 - RNA, 23 nt, Human
uuggaagccagacagcugugcag

SEQ ID NO: 51675 - RNA, 22 nt, Human
uuggaagccuaguuaagaugaa

SEQ ID NO: 51676 - RNA, 22 nt, Human
uuggaaggaagaaccgcgguag

SEQ ID NO: 51677 - RNA, 22 nt, Human
uuggaaggagccuaaaagagac

SEQ ID NO: 51678 - RNA, 22 nt, Human
uuggaaggagucuuuggggaug

SEQ ID NO: 51679 - RNA, 22 nt, Human
uuggaaggcugaauggccucuc

SEQ ID NO: 51680 - RNA, 22 nt, Human
uuggaagggaaccgaguuugcu

SEQ ID NO: 51681 - RNA, 23 nt, Human
uuggaagggaagagcauuugaga

SEQ ID NO: 51682 - RNA, 22 nt, Human
uuggaaggggcagaguggcugc

SEQ ID NO: 51683 - RNA, 22 nt, Human
uuggaaggugagucccuggguu

SEQ ID NO: 51684 - RNA, 22 nt, Human
uuggaauaaaaacaacucacag

SEQ ID NO: 51685 - RNA, 22 nt, Human
uuggaauagauuuguuagaaaa

SEQ ID NO: 51686 - RNA, 22 nt, Human
uuggaauagggaggcuggcaua

SEQ ID NO: 51687 - RNA, 22 nt, Human
uuggaaucauucuuaaaggucu

SEQ ID NO: 51688 - RNA, 22 nt, Human
uuggaauguuuuaauauaaauu

SEQ ID NO: 51689 - RNA, 22 nt, Human
uuggaauuaaaaggagaacuuc

SEQ ID NO: 51690 - RNA, 22 nt, Human
uuggaauucagcuugcuuauaa

SEQ ID NO: 51691 - RNA, 22 nt, Human
uuggaauugcucauaagagaga

SEQ ID NO: 51692 - RNA, 22 nt, Human
uuggaauuuagggaauauucau

SEQ ID NO: 51693 - RNA, 22 nt, Human
uuggaauuucauguaagugacu

SEQ ID NO: 51694 - RNA, 22 nt, Human
uuggaauuugcuucagcuaaua

SEQ ID NO: 51695 - RNA, 22 nt, Human
uuggaccaaggucugcucuuuc

SEQ ID NO: 51696 - RNA, 21 nt, Human
uuggaccauacaaguuaugca

SEQ ID NO: 51697 - RNA, 22 nt, Human
uuggaccaucagcuccuccugg

SEQ ID NO: 51698 - RNA, 18 nt, Human
uuggaccugugucagggc

SEQ ID NO: 51699 - RNA, 22 nt, Human
ugcucugucaagaaaagaugcc

SEQ ID NO: 51700 - RNA, 22 nt, Human
ugcugaaaacucaaccauugug

SEQ ID NO: 51701 - RNA, 23 nt, Human
ugcugaaguguuggcccugccca

SEQ ID NO: 51702 - RNA, 22 nt, Human
ugcugaaucaaaacaaagguuu

SEQ ID NO: 51703 - RNA, 22 nt, Human
ugcugaaucccacccuccagug

SEQ ID NO: 51704 - RNA, 22 nt, Human
ugcugaaugggauauguugagc

SEQ ID NO: 51705 - RNA, 22 nt, Human
ugcugaaugggugauuuuggag

SEQ ID NO: 51706 - RNA, 22 nt, Human
ugcugaauuuacauuuuuguag

SEQ ID NO: 51707 - RNA, 22 nt, Human
ugcugacuccuggcugugacac

SEQ ID NO: 51708 - RNA, 19 nt, Human
ugcugacugagcugcaaaa

SEQ ID NO: 51709 - RNA, 22 nt, Human
ugcugagacaguggauaggggc

SEQ ID NO: 51710 - RNA, 22 nt, Human
ugcugagagauuuaaagggcca

SEQ ID NO: 51711 - RNA, 22 nt, Human
ugcugagaugaauagagaccuc

SEQ ID NO: 51712 - RNA, 22 nt, Human
ugcugagcccagaacggccugg

SEQ ID NO: 51713 - RNA, 22 nt, Human
ugcugaggcauuuggacagagu

SEQ ID NO: 51714 - RNA, 22 nt, Human
ugcugaggcuagaccuggaagu

SEQ ID NO: 51715 - RNA, 22 nt, Human
ugcugagggagcaucaaagaaa

SEQ ID NO: 51716 - RNA, 22 nt, Human
ugcugaggucacggcggccaga

SEQ ID NO: 51717 - RNA, 22 nt, Human
ugcugagguuucugacuaugga

SEQ ID NO: 51718 - RNA, 21 nt, Human
ugcugaugucagagaagcaag

SEQ ID NO: 51719 - RNA, 22 nt, Human
ugcugcacucaccaacagauaa

SEQ ID NO: 51720 - RNA, 20 nt, Human
ugcugcagacagggccauug

SEQ ID NO: 51721 - RNA, 22 nt, Human
ugcugcagaucagcugaguccu

SEQ ID NO: 51722 - RNA, 22 nt, Human
ugcugcagauugcagauuaacu

SEQ ID NO: 51723 - RNA, 22 nt, Human
ugcugcagcggcauggucuuug

SEQ ID NO: 51724 - RNA, 22 nt, Human
ugcugcaggaauucucaaggga

SEQ ID NO: 51725 - RNA, 22 nt, Human
ugcugcaggccaggucguuguc

SEQ ID NO: 51726 - RNA, 22 nt, Human
ugcugcaggccuuggcugggaa

SEQ ID NO: 51727 - RNA, 22 nt, Human
ugcugcagugggauuagccuga

SEQ ID NO: 51728 - RNA, 22 nt, Human
ugcugcaguuauugaaacuaug

SEQ ID NO: 51729 - RNA, 22 nt, Human
ugcugcaguucacccugccguc

SEQ ID NO: 51730 - RNA, 20 nt, Human
ugcugcaguuucaugggacu

SEQ ID NO: 51731 - RNA, 22 nt, Human
ugcugcauuuaucuucucaaac

SEQ ID NO: 51732 - RNA, 22 nt, Human
ugcugccacauuuaaagagggg

SEQ ID NO: 51733 - RNA, 22 nt, Human
ugcugccagagagacagggacu

SEQ ID NO: 51734 - RNA, 22 nt, Human
ugcugccaggucuugcugucca

SEQ ID NO: 51735 - RNA, 22 nt, Human
ugagcccagucugucugacaug

SEQ ID NO: 51736 - RNA, 22 nt, Human
ugagcccaugcucuuucuacga

SEQ ID NO: 51737 - RNA, 22 nt, Human
ugagcccauguagcacuuccau

SEQ ID NO: 51738 - RNA, 22 nt, Human
ugagcccuaccugcucaucucc

SEQ ID NO: 51739 - RNA, 22 nt, Human
ugagcccucuucccauuuuauu

SEQ ID NO: 51740 - RNA, 21 nt, Human
ugagcccuugccucagagccc

SEQ ID NO: 51741 - RNA, 22 nt, Human
ugagccguggucucugagggug

SEQ ID NO: 51742 - RNA, 22 nt, Human
ugagccugaguucaaggcugca

SEQ ID NO: 51743 - RNA, 22 nt, Human
ugagcuaaguacucucaucaag

SEQ ID NO: 51744 - RNA, 22 nt, Human
ugagcuccuggucacaauuauc

SEQ ID NO: 51745 - RNA, 22 nt, Human
ugagcugacacccaaucauacu

SEQ ID NO: 51746 - RNA, 22 nt, Human
ugagcugaguggcaggucucag

SEQ ID NO: 51747 - RNA, 22 nt, Human
ugagcugcccccuggccugcuc

SEQ ID NO: 51748 - RNA, 19 nt, Human
ugagcugccgucuucccug

SEQ ID NO: 51749 - RNA, 22 nt, Human
ugagcuggcacuuuuccuggga

SEQ ID NO: 51750 - RNA, 22 nt, Human
ugagcugggaagagcagccaga

SEQ ID NO: 51751 - RNA, 23 nt, Human
ugagcugggccugcaggggucuc

SEQ ID NO: 51752 - RNA, 22 nt, Human
ugagcuggucacuccuucugaa

SEQ ID NO: 51753 - RNA, 22 nt, Human
ugagcugugaggguacagauau

SEQ ID NO: 51754 - RNA, 22 nt, Human
ugagcuguggugggguagagga

SEQ ID NO: 51755 - RNA, 22 nt, Human
ugagcuuauacaugugaaguca

SEQ ID NO: 51756 - RNA, 22 nt, Human
ugagcuuuguggguaaagagag

SEQ ID NO: 51757 - RNA, 22 nt, Human
ugaggaaaaugucuuauagauu

SEQ ID NO: 51758 - RNA, 22 nt, Human
ugaggaacugccagacuguuuu

SEQ ID NO: 51759 - RNA, 22 nt, Human
ugaggaagggugugacggcacc

SEQ ID NO: 51760 - RNA, 22 nt, Human
ugaggagcuucuggaaagugca

SEQ ID NO: 51761 - RNA, 22 nt, Human
ugaggagucgagaagggguaau

SEQ ID NO: 51762 - RNA, 22 nt, Human
ugaggaguuuuucuagagcuaa

SEQ ID NO: 51763 - RNA, 22 nt, Human
ugaggaugagaugagauaacac

SEQ ID NO: 51764 - RNA, 22 nt, Human
ugaggauggaaugcugugcaag

SEQ ID NO: 51765 - RNA, 22 nt, Human
ugaggauggggagauggugucu

SEQ ID NO: 51766 - RNA, 22 nt, Human
ugaggaugguguuggagagggc

SEQ ID NO: 51767 - RNA, 22 nt, Human
ugaggaugguuaaagaacauug

SEQ ID NO: 51768 - RNA, 22 nt, Human
ugaggcaaaaacacugauuagg

SEQ ID NO: 51769 - RNA, 22 nt, Human
ugaggcaacagaaagggccaau

SEQ ID NO: 51770 - RNA, 22 nt, Human
ugaggcaagggauggccccgug

SEQ ID NO: 51771 - RNA, 22 nt, Human
ugaggcaaguacuuucccuuuu

SEQ ID NO: 51772 - RNA, 22 nt, Human
ugaggcaagucucaaucuuuga

SEQ ID NO: 51773 - RNA, 22 nt, Human
ugaggcaauguccuucauccuu

SEQ ID NO: 51774 - RNA, 22 nt, Human
ugaggcacaggcagugcccccg

SEQ ID NO: 51775 - RNA, 19 nt, Human
ugaggcacaugauaagaac

SEQ ID NO: 51776 - RNA, 22 nt, Human
ugaggcaggacugagcgggaug

SEQ ID NO: 51777 - RNA, 22 nt, Human
ugaggcaggagaaucacaugaa

SEQ ID NO: 51778 - RNA, 22 nt, Human
ugaggcagggagaguggauaug

SEQ ID NO: 51779 - RNA, 22 nt, Human
ugaggcaguauucuccauucca

SEQ ID NO: 51780 - RNA, 22 nt, Human
ugaggcaguauuuuagugacuu

SEQ ID NO: 51781 - RNA, 22 nt, Human
ugaggcagucacccccuccugc

SEQ ID NO: 51782 - RNA, 22 nt, Human
ugaggcagugcugggaagccug

SEQ ID NO: 51783 - RNA, 22 nt, Human
ugaggccacaguaucagaacag

SEQ ID NO: 51784 - RNA, 22 nt, Human
ugaggccacuuccccacagccc

SEQ ID NO: 51785 - RNA, 22 nt, Human
ugaggccagaguuuuuaauucc

SEQ ID NO: 51786 - RNA, 16 nt, Human
ugaggccagccauuuc

SEQ ID NO: 51787 - RNA, 22 nt, Human
ugaggccaggcaaaggcgaucu

SEQ ID NO: 51788 - RNA, 22 nt, Human
ugaggccagucucaucacaggc

SEQ ID NO: 51789 - RNA, 22 nt, Human
ugaggccauggucuucccaguc

SEQ ID NO: 51790 - RNA, 22 nt, Human
ugaggcccaucugagauuuuga

SEQ ID NO: 51791 - RNA, 18 nt, Human
ugaggcccgcagaggugg

SEQ ID NO: 51792 - RNA, 22 nt, Human
ugaggcccucugggcugguccu

SEQ ID NO: 51793 - RNA, 22 nt, Human
ugaggccucugugccauccagg

SEQ ID NO: 51794 - RNA, 22 nt, Human
ugaggccugacagaccaagccu

SEQ ID NO: 51795 - RNA, 21 nt, Human
ugaggccugccagucucagaa

SEQ ID NO: 51796 - RNA, 22 nt, Human
ugaggccugcccuggggaaguu

SEQ ID NO: 51797 - RNA, 22 nt, Human
ugaggccugcuuggaauugaau

SEQ ID NO: 51798 - RNA, 22 nt, Human
ugaggccugucauugucuuguu

SEQ ID NO: 51799 - RNA, 22 nt, Human
ugaggcucaagaaucugcauuu

SEQ ID NO: 51800 - RNA, 22 nt, Human
ugaggcucacgaacagaagacu

SEQ ID NO: 51801 - RNA, 22 nt, Human
ugaggcucagagaagugcuguu

SEQ ID NO: 51802 - RNA, 18 nt, Human
ugaggcucagagacggug

SEQ ID NO: 51803 - RNA, 20 nt, Human
ugaggcucagagagguugag

SEQ ID NO: 51804 - RNA, 18 nt, Human
ugaggcucagcuccuggu

SEQ ID NO: 51805 - RNA, 22 nt, Human
ugaggcucauucugcaugccaa

SEQ ID NO: 51806 - RNA, 22 nt, Human
ugaggcuccagccaggccagca

SEQ ID NO: 51807 - RNA, 22 nt, Human
ugaggcucuccaagcagaugag

SEQ ID NO: 51808 - RNA, 21 nt, Human
ugaggcucuguugugccugca

SEQ ID NO: 51809 - RNA, 22 nt, Human
ugaggcugaaacuggcgauaga

SEQ ID NO: 51810 - RNA, 22 nt, Human
ugaggcugagauaucagggagg

SEQ ID NO: 51811 - RNA, 22 nt, Human
ugaggcugccuugggaagaggg

SEQ ID NO: 51812 - RNA, 22 nt, Human
ugaggcuuagagaagaugggau

SEQ ID NO: 51813 - RNA, 22 nt, Human
ugaggcuuggcaaaagaguggu

SEQ ID NO: 51814 - RNA, 22 nt, Human
ugagggaauauugauagauccg

SEQ ID NO: 51815 - RNA, 22 nt, Human
ugagggagagggcgaaaaugaa

SEQ ID NO: 51816 - RNA, 22 nt, Human
ugcugugauaauucaaugagcu

SEQ ID NO: 51817 - RNA, 22 nt, Human
ugcugugauggagaauucugga

SEQ ID NO: 51818 - RNA, 18 nt, Human
ugcugugcacagcccuau

SEQ ID NO: 51819 - RNA, 22 nt, Human
ugcugugcuccauugucuucac

SEQ ID NO: 51820 - RNA, 22 nt, Human
ugcugugcucuuuaaggugcug

SEQ ID NO: 51821 - RNA, 22 nt, Human
ugcugugggauauauguucaaa

SEQ ID NO: 51822 - RNA, 22 nt, Human
ugcuguguuccucaguuucaug

SEQ ID NO: 51823 - RNA, 22 nt, Human
ugcuguugacggacuggcugcu

SEQ ID NO: 51824 - RNA, 22 nt, Human
ugcuuaaaaaguaacugcugau

SEQ ID NO: 51825 - RNA, 22 nt, Human
ugcuuaaacacauacauacaua

SEQ ID NO: 51826 - RNA, 22 nt, Human
ugcuuaaacauccagacaguau

SEQ ID NO: 51827 - RNA, 22 nt, Human
ugcuuaaaguaguggauuguua

SEQ ID NO: 51828 - RNA, 22 nt, Human
ugcuuaaauagcuggaggcuac

SEQ ID NO: 51829 - RNA, 22 nt, Human
ugcuuaauacguauuugcugga

SEQ ID NO: 51830 - RNA, 22 nt, Human
ugcuuaauaggaguugaacauu

SEQ ID NO: 51831 - RNA, 22 nt, Human
ugcuuaauguacgugaguguac

SEQ ID NO: 51832 - RNA, 17 nt, Human
ugcuuaauuuugacugg

SEQ ID NO: 51833 - RNA, 22 nt, Human
ugcuuacaacuuuauugaggaa

SEQ ID NO: 51834 - RNA, 22 nt, Human
ugcuuaggaugcuagcaggcau

SEQ ID NO: 51835 - RNA, 22 nt, Human
ugcuuagggcuccuccaauaga

SEQ ID NO: 51836 - RNA, 22 nt, Human
ugcuuauaauguuacugacaac

SEQ ID NO: 51837 - RNA, 22 nt, Human
ugcuuaucguuuaguacauugc

SEQ ID NO: 51838 - RNA, 23 nt, Human
ugcuuauucaaaaggugcuuuca

SEQ ID NO: 51839 - RNA, 22 nt, Human
ugcuucaaaaggcagcuuaaug

SEQ ID NO: 51840 - RNA, 22 nt, Human
ugcuucaaggacacugacuuuu

SEQ ID NO: 51841 - RNA, 22 nt, Human
ugcuucaaguugaaauauucuu

SEQ ID NO: 51842 - RNA, 22 nt, Human
ugcuucacaagaauucaggacc

SEQ ID NO: 51843 - RNA, 22 nt, Human
ugcuucaggagaugucaccaug

SEQ ID NO: 51844 - RNA, 22 nt, Human
ugcuuggagaaucagucccagc

SEQ ID NO: 51845 - RNA, 18 nt, Human
ugcuuggagcauuuacca

SEQ ID NO: 51846 - RNA, 22 nt, Human
ugcuugucacauacaggagcau

SEQ ID NO: 51847 - RNA, 22 nt, Human
ugcuugucacccugccugagug

SEQ ID NO: 51848 - RNA, 20 nt, Human
ugcuugucaugcacucaggc

SEQ ID NO: 51849 - RNA, 22 nt, Human
ugcuugucccucuuuaugaugg

SEQ ID NO: 51850 - RNA, 21 nt, Human
ugcuugucugccuagaggcuu

SEQ ID NO: 51851 - RNA, 22 nt, Human
ugcuugucuucaggaaugcuga

SEQ ID NO: 51852 - RNA, 22 nt, Human
ugcuugugagaguuuuuucaga

SEQ ID NO: 51853 - RNA, 22 nt, Human
ugcuugugugagggccugggag

SEQ ID NO: 51854 - RNA, 22 nt, Human
ugcuuuaaaguauuucucgcaa

SEQ ID NO: 51855 - RNA, 22 nt, Human
ugcauuuccagauuucuggagu

SEQ ID NO: 51856 - RNA, 22 nt, Human
ugcauuugcuggggaugugauu

SEQ ID NO: 51857 - RNA, 22 nt, Human
ugcauuuggggcagacuagcag

SEQ ID NO: 51858 - RNA, 22 nt, Human
ugcauuugucuugucucaugaa

SEQ ID NO: 51859 - RNA, 22 nt, Human
ugcauuuguuaccuuauugcag

SEQ ID NO: 51860 - RNA, 22 nt, Human
ugccaaaaugggcuuuauaccg

SEQ ID NO: 51861 - RNA, 22 nt, Human
ugccaaauaugcacguguaugc

SEQ ID NO: 51862 - RNA, 19 nt, Human
ugccaaauccaugcccagg

SEQ ID NO: 51863 - RNA, 22 nt, Human
ugccaaaugccaccacagcugc

SEQ ID NO: 51864 - RNA, 22 nt, Human
ugccaaauuuguaucuuaagga

SEQ ID NO: 51865 - RNA, 22 nt, Human
ugccaaauuuucucagagaugc

SEQ ID NO: 51866 - RNA, 22 nt, Human
ugccaagaccacaauugcuuuu

SEQ ID NO: 51867 - RNA, 22 nt, Human
ugccaaggguaugggcaagaua

SEQ ID NO: 51868 - RNA, 22 nt, Human
ugccaaucuuugugauaauugc

SEQ ID NO: 51869 - RNA, 22 nt, Human
ugccaauuugccccuuugcuga

SEQ ID NO: 51870 - RNA, 22 nt, Human
ugccacacagucugguagaaua

SEQ ID NO: 51871 - RNA, 22 nt, Human
ugccacagacaggacagaacag

SEQ ID NO: 51872 - RNA, 22 nt, Human
ugccacaguuguuugugcucua

SEQ ID NO: 51873 - RNA, 22 nt, Human
ugccagaagauucucuaucaga

SEQ ID NO: 51874 - RNA, 22 nt, Human
ugccagacuuucuuaccagugu

SEQ ID NO: 51875 - RNA, 22 nt, Human
ugccagagaaucaccucuccuu

SEQ ID NO: 51876 - RNA, 22 nt, Human
ugccagagaggagaaagcauuu

SEQ ID NO: 51877 - RNA, 18 nt, Human
ugccagccgacuggccug

SEQ ID NO: 51878 - RNA, 22 nt, Human
ugccagcuacucuguaggcuga

SEQ ID NO: 51879 - RNA, 22 nt, Human
ugccagcuccugcagcuccugu

SEQ ID NO: 51880 - RNA, 22 nt, Human
ugccagcuguucccacccaaaa

SEQ ID NO: 51881 - RNA, 22 nt, Human
ugccagcuuguggucagaggcu

SEQ ID NO: 51882 - RNA, 22 nt, Human
ugccaggaagugugugggccug

SEQ ID NO: 51883 - RNA, 22 nt, Human
ugccaggagucaggccaggcag

SEQ ID NO: 51884 - RNA, 22 nt, Human
ugccaggcaacugcccagccau

SEQ ID NO: 51885 - RNA, 22 nt, Human
ugccaggcaggacccuagaacc

SEQ ID NO: 51886 - RNA, 22 nt, Human
ugccaggcagugucagauugag

SEQ ID NO: 51887 - RNA, 22 nt, Human
ugccaggccaauucuauuugac

SEQ ID NO: 51888 - RNA, 22 nt, Human
ugccaggcccagcagggcggcc

SEQ ID NO: 51889 - RNA, 22 nt, Human
ugccaggccucaggagucucca

SEQ ID NO: 51890 - RNA, 22 nt, Human
ugccaggcuaaguggaggacuu

SEQ ID NO: 51891 - RNA, 22 nt, Human
ugccaggcucaggaugucccug

SEQ ID NO: 51892 - RNA, 22 nt, Human
ugccagggacccugucggcccu

SEQ ID NO: 51893 - RNA, 22 nt, Human
ugccagggagcccugcugacca

SEQ ID NO: 51894 - RNA, 21 nt, Human
ugccagggauuuacagagccu

SEQ ID NO: 51895 - RNA, 22 nt, Human
ugccagggccauagggagucua

SEQ ID NO: 51896 - RNA, 22 nt, Human
ugccagugaaacguggucucau

SEQ ID NO: 51897 - RNA, 22 nt, Human
ugccagugucugcuaucugaga

SEQ ID NO: 51898 - RNA, 22 nt, Human
ugccauauugaugugcuguacc

SEQ ID NO: 51899 - RNA, 22 nt, Human
ugccaucucuuccucgugcugc

SEQ ID NO: 51900 - RNA, 22 nt, Human
ugccauggccuagaccugugau

SEQ ID NO: 51901 - RNA, 22 nt, Human
ugccauugggcagucauugaag

SEQ ID NO: 51902 - RNA, 19 nt, Human
ugccauuugacugaaugua

SEQ ID NO: 51903 - RNA, 22 nt, Human
ugccauuugcugguuuucugau

SEQ ID NO: 51904 - RNA, 22 nt, Human
ugcccaagauucuuacaucaug

SEQ ID NO: 51905 - RNA, 22 nt, Human
ugcccaaggauccauuggcugg

SEQ ID NO: 51906 - RNA, 20 nt, Human
ugcccacaucacucaggagu

SEQ ID NO: 51907 - RNA, 22 nt, Human
ugcccacugugucaaagaaaua

SEQ ID NO: 51908 - RNA, 18 nt, Human
ugcccagaaaagcaggga

SEQ ID NO: 51909 - RNA, 22 nt, Human
ugcccagcacugugccagucac

SEQ ID NO: 51910 - RNA, 22 nt, Human
ugcccagccaguuuaugguaau

SEQ ID NO: 51911 - RNA, 22 nt, Human
ugcccaggauugugaggucagg

SEQ ID NO: 51912 - RNA, 22 nt, Human
ugcccaggcuggaaugcagugg

SEQ ID NO: 51913 - RNA, 22 nt, Human
ugcccaggcuggagugcagagg

SEQ ID NO: 51914 - RNA, 21 nt, Human
ugcccaggggccaaccgcugc

SEQ ID NO: 51915 - RNA, 22 nt, Human
ugcccauggcaggauuucugaa

SEQ ID NO: 51916 - RNA, 22 nt, Human
ugcccauguuucucuguauccc

SEQ ID NO: 51917 - RNA, 22 nt, Human
ugcccauuauucagccauuaaa

SEQ ID NO: 51918 - RNA, 23 nt, Human
ugcccauugcaucuugguacugg

SEQ ID NO: 51919 - RNA, 20 nt, Human
ugccccaggccugcaccugc

SEQ ID NO: 51920 - RNA, 19 nt, Human
ugccccugcagucuaccca

SEQ ID NO: 51921 - RNA, 22 nt, Human
ugccccuucuacccgucucugu

SEQ ID NO: 51922 - RNA, 22 nt, Human
ugcccucauuauaagaggcuca

SEQ ID NO: 51923 - RNA, 22 nt, Human
ugcccuccacaguggcuccacc

SEQ ID NO: 51924 - RNA, 23 nt, Human
ugcccucccaaugcuucggucac

SEQ ID NO: 51925 - RNA, 22 nt, Human
ugcccucccacauuauggcugu

SEQ ID NO: 51926 - RNA, 22 nt, Human
ugcccucccuguacugucagga

SEQ ID NO: 51927 - RNA, 22 nt, Human
ugcccucuuaggucugcgcagc

SEQ ID NO: 51928 - RNA, 22 nt, Human
ugcccugaagcacccucacccu

SEQ ID NO: 51929 - RNA, 22 nt, Human
ugcccugcaugcagggagcugu

SEQ ID NO: 51930 - RNA, 22 nt, Human
ugcccugccaagacugaguggu

SEQ ID NO: 51931 - RNA, 22 nt, Human
ugcccugcccuugcuauuucua

SEQ ID NO: 51932 - RNA, 22 nt, Human
ugcccugcuaaccuugguucca

SEQ ID NO: 51933 - RNA, 22 nt, Human
ugcccuggaaccaucuacaguc

SEQ ID NO: 51934 - RNA, 22 nt, Human
ugcccuggcacacacacagcug

SEQ ID NO: 51935 - RNA, 22 nt, Human
ugcccuggcuccucccacgcug

SEQ ID NO: 51936 - RNA, 22 nt, Human
ugcccugggaggcuuuccuguu

SEQ ID NO: 51937 - RNA, 22 nt, Human
ugcccugggcuuugcuaugacu

SEQ ID NO: 51938 - RNA, 22 nt, Human
ugcccuggggucuggagcagca

SEQ ID NO: 51939 - RNA, 22 nt, Human
ugcccugucuaagcugucagua

SEQ ID NO: 51940 - RNA, 22 nt, Human
ugcccugugccagacuuccugg

SEQ ID NO: 51941 - RNA, 22 nt, Human
ugcccugugcuggaaucuuccc

SEQ ID NO: 51942 - RNA, 22 nt, Human
ugcccuuauaaaggaggccuga

SEQ ID NO: 51943 - RNA, 22 nt, Human
ugcccuugaggacagcucccag

SEQ ID NO: 51944 - RNA, 22 nt, Human
ugcccuuggguaacuugcugau

SEQ ID NO: 51945 - RNA, 22 nt, Human
ugccgccugguuucuccgcccc

SEQ ID NO: 51946 - RNA, 22 nt, Human
ugccgugcccauauugugggug

SEQ ID NO: 51947 - RNA, 23 nt, Human
ugccguguuagaaauguuuuaca

SEQ ID NO: 51948 - RNA, 22 nt, Human
ugccuacccaugguuagacaua

SEQ ID NO: 51949 - RNA, 22 nt, Human
ugccuaggcuggaaugcagugg

SEQ ID NO: 51950 - RNA, 22 nt, Human
ugccuauucaauauaugcauuu

SEQ ID NO: 51951 - RNA, 22 nt, Human
ugccucaggcaccuggcagguu

SEQ ID NO: 51952 - RNA, 22 nt, Human
ugccucagucagcuucccuggg

SEQ ID NO: 51953 - RNA, 22 nt, Human
uuugagugcccauguuucccag

SEQ ID NO: 51954 - RNA, 22 nt, Human
uuugaguugcuuauuuaauagg

SEQ ID NO: 51955 - RNA, 22 nt, Human
uuugauaagagcugcugaaacu

SEQ ID NO: 51956 - RNA, 22 nt, Human
uuugauaauuaaaaauuguagu

SEQ ID NO: 51957 - RNA, 22 nt, Human
uuugauacugagaaaaacaaau

SEQ ID NO: 51958 - RNA, 17 nt, Human
uuugauagaaucagagu

SEQ ID NO: 51959 - RNA, 19 nt, Human
uuugauagggcauaauaua

SEQ ID NO: 51960 - RNA, 22 nt, Human
uuugauaugcaaaauuauggac

SEQ ID NO: 51961 - RNA, 22 nt, Human
uuugaugaaagcuacuauuuac

SEQ ID NO: 51962 - RNA, 19 nt, Human
uuugaugagaauuuaagca

SEQ ID NO: 51963 - RNA, 22 nt, Human
uuugauucuguaaaauaacagg

SEQ ID NO: 51964 - RNA, 22 nt, Human
uuugauugucaccuaccuugca

SEQ ID NO: 51965 - RNA, 22 nt, Human
uuugauuuucagcaauaguggc

SEQ ID NO: 51966 - RNA, 22 nt, Human
uuugcaaaaugucuuguguuag

SEQ ID NO: 51967 - RNA, 22 nt, Human
uuugcaaacauucagggcucca

SEQ ID NO: 51968 - RNA, 22 nt, Human
uuugcaaacuuuccucuggacc

SEQ ID NO: 51969 - RNA, 22 nt, Human
uuugcaaagaaauuauugcugu

SEQ ID NO: 51970 - RNA, 22 nt, Human
uuugcaaaguccauugaaguua

SEQ ID NO: 51971 - RNA, 22 nt, Human
uuugcaaagugcuugcagagua

SEQ ID NO: 51972 - RNA, 22 nt, Human
uggcucugaucagauguccagu

SEQ ID NO: 51973 - RNA, 22 nt, Human
uggcucuggagcuccugggccc

SEQ ID NO: 51974 - RNA, 22 nt, Human
uggcucuggagcuggcggcuga

SEQ ID NO: 51975 - RNA, 22 nt, Human
uggcucuggcgugaagcccaga

SEQ ID NO: 51976 - RNA, 22 nt, Human
uggcucugggaaucuguugcuu

SEQ ID NO: 51977 - RNA, 21 nt, Human
uggcucuggguaggagagugc

SEQ ID NO: 51978 - RNA, 22 nt, Human
uggcucugguaacauuggguag

SEQ ID NO: 51979 - RNA, 22 nt, Human
uggcucuggugcgggcuccugc

SEQ ID NO: 51980 - RNA, 22 nt, Human
uggcucugucaaacugcacaca

SEQ ID NO: 51981 - RNA, 22 nt, Human
uggcucugugcuucuaguaucu

SEQ ID NO: 51982 - RNA, 23 nt, Human
uggcucuguggaucccucaggag

SEQ ID NO: 51983 - RNA, 21 nt, Human
uggcucuguucaauauaugga

SEQ ID NO: 51984 - RNA, 22 nt, Human
uggcucuguugagguauggauu

SEQ ID NO: 51985 - RNA, 22 nt, Human
uggcucuguuguaaagaaauuu

SEQ ID NO: 51986 - RNA, 22 nt, Human
uggcugaagugggcaggaggga

SEQ ID NO: 51987 - RNA, 22 nt, Human
uggcugaauaaaauaugguguu

SEQ ID NO: 51988 - RNA, 22 nt, Human
uggcugagaaaaugguuuuagg

SEQ ID NO: 51989 - RNA, 22 nt, Human
uggcugagagaagacggggaag

SEQ ID NO: 51990 - RNA, 16 nt, Human
uggcugagagaggguu

SEQ ID NO: 51991 - RNA, 22 nt, Human
uggcugagagcaauugacucug

SEQ ID NO: 51992 - RNA, 23 nt, Human
uggcugagauccuacuguuugcu

SEQ ID NO: 51993 - RNA, 21 nt, Human
uggcugagccaggugugugga

SEQ ID NO: 51994 - RNA, 22 nt, Human
uggcugagcucccuguguguug

SEQ ID NO: 51995 - RNA, 22 nt, Human
uggcugagggcacuaugaagcc

SEQ ID NO: 51996 - RNA, 22 nt, Human
uggcugaggucuggggcuucug

SEQ ID NO: 51997 - RNA, 22 nt, Human
uggcugagguuaugcugguugu

SEQ ID NO: 51998 - RNA, 22 nt, Human
uggcugaguguuccaaggagca

SEQ ID NO: 51999 - RNA, 22 nt, Human
uggcugcaagggcacggacccu

SEQ ID NO: 52000 - RNA, 22 nt, Human
uggcugcagaaccuccucagga

SEQ ID NO: 52001 - RNA, 22 nt, Human
uggcugcagacaccuauggcag

SEQ ID NO: 52002 - RNA, 22 nt, Human
uggcugcaggggugucugacau

SEQ ID NO: 52003 - RNA, 22 nt, Human
uggcugccgacuggcucuuggc

SEQ ID NO: 52004 - RNA, 21 nt, Human
uggcugccuacaugcugcagg

SEQ ID NO: 52005 - RNA, 22 nt, Human
uggcugccuagucccucagccu

SEQ ID NO: 52006 - RNA, 22 nt, Human
uggcugccuuucaccucaucuc

SEQ ID NO: 52007 - RNA, 22 nt, Human
uggcugcuagccagagcuucag

SEQ ID NO: 52008 - RNA, 22 nt, Human
uggcugcucaagggaggaggcu

SEQ ID NO: 52009 - RNA, 22 nt, Human
uggcugcugcagacagacagga

SEQ ID NO: 52010 - RNA, 22 nt, Human
uggcugcugcuuggucuucuuc

SEQ ID NO: 52011 - RNA, 18 nt, Human
uggcugcuggaguagggu

SEQ ID NO: 52012 - RNA, 22 nt, Human
uggcugcuuaaaauugcugcaa

SEQ ID NO: 52013 - RNA, 18 nt, Human
uggcugcuuccagguaca

SEQ ID NO: 52014 - RNA, 22 nt, Human
uggcuggaggcaugcaagcucc

SEQ ID NO: 52015 - RNA, 22 nt, Human
uggcuggagucuggugcuagcc

SEQ ID NO: 52016 - RNA, 22 nt, Human
uggcuggcgccgggcuagccac

SEQ ID NO: 52017 - RNA, 22 nt, Human
uggcuggcuagaauggaaaugu

SEQ ID NO: 52018 - RNA, 22 nt, Human
uggcuggcugucaaggaaagcc

SEQ ID NO: 52019 - RNA, 22 nt, Human
uggcuggggagccccgacuccc

SEQ ID NO: 52020 - RNA, 22 nt, Human
uggcugguuuuggugagcuccg

SEQ ID NO: 52021 - RNA, 22 nt, Human
uggcuguagaaucagagacuug

SEQ ID NO: 52022 - RNA, 22 nt, Human
uggcugucagcugccuggugcg

SEQ ID NO: 52023 - RNA, 22 nt, Human
uggcugucagucgccugcauuc

SEQ ID NO: 52024 - RNA, 22 nt, Human
uggcugugaauggcaaauaauc

SEQ ID NO: 52025 - RNA, 22 nt, Human
uggcugugauuugcacgagaug

SEQ ID NO: 52026 - RNA, 22 nt, Human
uggcugugugccaggcugucug

SEQ ID NO: 52027 - RNA, 22 nt, Human
uggcuguguuaccacuucaugu

SEQ ID NO: 52028 - RNA, 22 nt, Human
uggcuuaagauuuaugcuuuua

SEQ ID NO: 52029 - RNA, 22 nt, Human
uggcuucaaagguagcauacaa

SEQ ID NO: 52030 - RNA, 22 nt, Human
uggcuucacugcucaagugauu

SEQ ID NO: 52031 - RNA, 22 nt, Human
uggcuucagagucugaguucuu

SEQ ID NO: 52032 - RNA, 21 nt, Human
uggcuucagccauuuucucug

SEQ ID NO: 52033 - RNA, 17 nt, Human
uggcuucaggcugagca

SEQ ID NO: 52034 - RNA, 22 nt, Human
uggcuucaguuucccagucugg

SEQ ID NO: 52035 - RNA, 20 nt, Human
uggcuucauaaugguuucug

SEQ ID NO: 52036 - RNA, 22 nt, Human
uggcuucaucacucgggcugcc

SEQ ID NO: 52037 - RNA, 22 nt, Human
uggcuucauggcugugcaaucu

SEQ ID NO: 52038 - RNA, 22 nt, Human
uggcuucauuauuguuuuuccu

SEQ ID NO: 52039 - RNA, 22 nt, Human
uggcuucauucagcaugacagu

SEQ ID NO: 52040 - RNA, 22 nt, Human
uggcuucauucuccugugaaua

SEQ ID NO: 52041 - RNA, 22 nt, Human
uggcuucauucuguaguuaaaa

SEQ ID NO: 52042 - RNA, 22 nt, Human
uggcuuccagagcugcuccacc

SEQ ID NO: 52043 - RNA, 22 nt, Human
uggcuucccaggaaaggagaag

SEQ ID NO: 52044 - RNA, 22 nt, Human
uggcuuccccuaccuuccaauu

SEQ ID NO: 52045 - RNA, 17 nt, Human
uggcuucccugggccac

SEQ ID NO: 52046 - RNA, 22 nt, Human
uggcuuccgccgcgggccucgg

SEQ ID NO: 52047 - RNA, 22 nt, Human
uggcuuccuaaacugauuucca

SEQ ID NO: 52048 - RNA, 22 nt, Human
uggcuuccuccagagcaggagg

SEQ ID NO: 52049 - RNA, 22 nt, Human
uggcuuccugcacagugucugc

SEQ ID NO: 52050 - RNA, 22 nt, Human
uggcuuccugcauggauccucu

SEQ ID NO: 52051 - RNA, 22 nt, Human
uggcuucuaaaguuucuuuuag

SEQ ID NO: 52052 - RNA, 22 nt, Human
uggcuucuagcaguguugauuu

SEQ ID NO: 52053 - RNA, 22 nt, Human
uggcuucuauugcuguggcauu

SEQ ID NO: 52054 - RNA, 18 nt, Human
uggcuucuauuuuacuca

SEQ ID NO: 52055 - RNA, 22 nt, Human
uggcuucucccuacaacaugcc

SEQ ID NO: 52056 - RNA, 18 nt, Human
uggcuucugaacaacugc

SEQ ID NO: 52057 - RNA, 22 nt, Human
uggcuucugagcauugaaacgu

SEQ ID NO: 52058 - RNA, 23 nt, Human
uggcuucugccccauucucucca

SEQ ID NO: 52059 - RNA, 22 nt, Human
uggcuucugggauguguugaca

SEQ ID NO: 52060 - RNA, 22 nt, Human
uggcuucugucccugcuacauu

SEQ ID NO: 52061 - RNA, 19 nt, Human
uggcuucuucgguguuccc

SEQ ID NO: 52062 - RNA, 18 nt, Human
uggcuucuugagcuaaca

SEQ ID NO: 52063 - RNA, 22 nt, Human
cucuuacauucuuuuacuagca

SEQ ID NO: 52064 - RNA, 22 nt, Human
cucuuaguaaugccaugaagca

SEQ ID NO: 52065 - RNA, 22 nt, Human
cucuuaguuuguaaaaauaauu

SEQ ID NO: 52066 - RNA, 22 nt, Human
cucuucagguuucugcucugga

SEQ ID NO: 52067 - RNA, 22 nt, Human
cucuucaguuggucacuauucu

SEQ ID NO: 52068 - RNA, 22 nt, Human
cucuucaguuguugcauauucu

SEQ ID NO: 52069 - RNA, 22 nt, Human
cucuucccagcuccacgagagg

SEQ ID NO: 52070 - RNA, 22 nt, Human
cucuuccucucaugcggucaua

SEQ ID NO: 52071 - RNA, 22 nt, Human
cucuucuugccugaugaggcag

SEQ ID NO: 52072 - RNA, 22 nt, Human
cucuucuuggcccccaugaggg

SEQ ID NO: 52073 - RNA, 22 nt, Human
cucuucuuuaguccagaccauc

SEQ ID NO: 52074 - RNA, 22 nt, Human
cucuugcaucuguuguauuggu

SEQ ID NO: 52075 - RNA, 22 nt, Human
cucuugcugucaaagcagggua

SEQ ID NO: 52076 - RNA, 22 nt, Human
cucuugggauuugcaggcucag

SEQ ID NO: 52077 - RNA, 20 nt, Human
cucuugggcccaaagggccu

SEQ ID NO: 52078 - RNA, 22 nt, Human
cucuugguaagacauuagaggu

SEQ ID NO: 52079 - RNA, 22 nt, Human
cucuugguggguggccuguuga

SEQ ID NO: 52080 - RNA, 22 nt, Human
cucuuguuuccuuucugcaguc

SEQ ID NO: 52081 - RNA, 19 nt, Human
cucuuuacucccuugccuu

SEQ ID NO: 52082 - RNA, 22 nt, Human
cucuuuacucuguguuauuguu

SEQ ID NO: 52083 - RNA, 22 nt, Human
cucuuucaguucugauagucuc

SEQ ID NO: 52084 - RNA, 22 nt, Human
cucuuuccucagccacagucua

SEQ ID NO: 52085 - RNA, 22 nt, Human
cucuuucucgccgcccgcaguc

SEQ ID NO: 52086 - RNA, 19 nt, Human
cucuuuggagauccuugga

SEQ ID NO: 52087 - RNA, 22 nt, Human
cucuuuggauguuuaugauaag

SEQ ID NO: 52088 - RNA, 16 nt, Human
cucuuuggcuuccaag

SEQ ID NO: 52089 - RNA, 22 nt, Human
cucuuuggugcaccuugcaguc

SEQ ID NO: 52090 - RNA, 22 nt, Human
cucuuuguagccuuugcauauu

SEQ ID NO: 52091 - RNA, 22 nt, Human
cucuuuuaugugacguguguga

SEQ ID NO: 52092 - RNA, 22 nt, Human
cucuuuucaaaauuucacugca

SEQ ID NO: 52093 - RNA, 22 nt, Human
cugaaaaacgggauuuggcugg

SEQ ID NO: 52094 - RNA, 22 nt, Human
cugaaacuggaguccuuauauc

SEQ ID NO: 52095 - RNA, 20 nt, Human
cugaaagacguaacagugca

SEQ ID NO: 52096 - RNA, 22 nt, Human
cugaaagcauuaacuccacuuc

SEQ ID NO: 52097 - RNA, 22 nt, Human
cugaaaggagagcugcaaggau

SEQ ID NO: 52098 - RNA, 22 nt, Human
cugaaaggcaguggguagugug

SEQ ID NO: 52099 - RNA, 22 nt, Human
cugaaagggagaacaccaagag

SEQ ID NO: 52100 - RNA, 22 nt, Human
cugaaauauagaugugaacagu

SEQ ID NO: 52101 - RNA, 22 nt, Human
cugaaauauuuuaaucucagga

SEQ ID NO: 52102 - RNA, 22 nt, Human
cugaaauguuaaauacuuggcu

SEQ ID NO: 52103 - RNA, 23 nt, Human
cugaaauucagaugcuaaagaua

SEQ ID NO: 52104 - RNA, 22 nt, Human
cugaacacugagucuaccuccc

SEQ ID NO: 52105 - RNA, 22 nt, Human
cagggcacagaucggggcgcac

SEQ ID NO: 52106 - RNA, 22 nt, Human
cagggcagaacauauagauagu

SEQ ID NO: 52107 - RNA, 22 nt, Human
cagggcagaaggcacucuacuc

SEQ ID NO: 52108 - RNA, 22 nt, Human
cagggcaggaauuugacauugc

SEQ ID NO: 52109 - RNA, 22 nt, Human
cagggcaguaacgggaacaucu

SEQ ID NO: 52110 - RNA, 22 nt, Human
cagggcagugaagaacacacgu

SEQ ID NO: 52111 - RNA, 22 nt, Human
cagggcauaagaugaggcugua

SEQ ID NO: 52112 - RNA, 22 nt, Human
cagggcauccgugcuccaugcu

SEQ ID NO: 52113 - RNA, 22 nt, Human
cagggcaugaggugugcuucuc

SEQ ID NO: 52114 - RNA, 22 nt, Human
cagggccaagccccuuuggcug

SEQ ID NO: 52115 - RNA, 22 nt, Human
cagggccaaguuggugccuuuu

SEQ ID NO: 52116 - RNA, 22 nt, Human
cagggccacacggaagggaaca

SEQ ID NO: 52117 - RNA, 22 nt, Human
cagggccacugcaugagguuca

SEQ ID NO: 52118 - RNA, 22 nt, Human
cagggccacuguagaugaggag

SEQ ID NO: 52119 - RNA, 22 nt, Human
cagggccagagagggcuggcug

SEQ ID NO: 52120 - RNA, 22 nt, Human
cagggccauaucuugugcacca

SEQ ID NO: 52121 - RNA, 22 nt, Human
cagggcccaggccacuggguug

SEQ ID NO: 52122 - RNA, 22 nt, Human
cagggcccagucccugcuguca

SEQ ID NO: 52123 - RNA, 18 nt, Human
cagggccccagaauuauc

SEQ ID NO: 52124 - RNA, 22 nt, Human
cagggccccagggaugucugcu

SEQ ID NO: 52125 - RNA, 22 nt, Human
cagggccuccuaaggcaucuaa

SEQ ID NO: 52126 - RNA, 22 nt, Human
cagggcuagugacaccccaguc

SEQ ID NO: 52127 - RNA, 22 nt, Human
cagggcucaccacugggauccu

SEQ ID NO: 52128 - RNA, 22 nt, Human
cagggcucacucggcuggcguc

SEQ ID NO: 52129 - RNA, 22 nt, Human
cagggcugaacugagcuuguga

SEQ ID NO: 52130 - RNA, 22 nt, Human
cagggcuggauuucauuucuag

SEQ ID NO: 52131 - RNA, 22 nt, Human
cagggcugguuugucgaagaaa

SEQ ID NO: 52132 - RNA, 22 nt, Human
cagggcugucuccaaaggcccc

SEQ ID NO: 52133 - RNA, 17 nt, Human
cagggcugucugccuag

SEQ ID NO: 52134 - RNA, 22 nt, Human
cagggcuguuagcugcugcucu

SEQ ID NO: 52135 - RNA, 22 nt, Human
cagggcuuacuggaggcugcuu

SEQ ID NO: 52136 - RNA, 22 nt, Human
cagggcuucgauggauggaugg

SEQ ID NO: 52137 - RNA, 22 nt, Human
cagggcuucgugucucagugcu

SEQ ID NO: 52138 - RNA, 22 nt, Human
cagggcuucuauaccaauucau

SEQ ID NO: 52139 - RNA, 22 nt, Human
cagggcuugcaggagaaaguuu

SEQ ID NO: 52140 - RNA, 22 nt, Human
cagggcuuggaucuguggucag

SEQ ID NO: 52141 - RNA, 22 nt, Human
cagggcuuugugugccugggga

SEQ ID NO: 52142 - RNA, 22 nt, Human
caggggacaguaugguggauga

SEQ ID NO: 52143 - RNA, 22 nt, Human
caggggcaagaaugcugucagc

SEQ ID NO: 52144 - RNA, 22 nt, Human
caggggccggcuguccgugccc

SEQ ID NO: 52145 - RNA, 22 nt, Human
caggggccuggcugucuaggaa

SEQ ID NO: 52146 - RNA, 22 nt, Human
caggggcugagaaggaacgucc

SEQ ID NO: 52147 - RNA, 22 nt, Human
caggggcuuaagugacagaagg

SEQ ID NO: 52148 - RNA, 22 nt, Human
cagggggugcaggcccugugac

SEQ ID NO: 52149 - RNA, 22 nt, Human
cagggguggcugcagcagaggu

SEQ ID NO: 52150 - RNA, 22 nt, Human
cagggucaagagacuccagcag

SEQ ID NO: 52151 - RNA, 22 nt, Human
cagggucauggcaccugcacgg

SEQ ID NO: 52152 - RNA, 22 nt, Human
cagggucuuauaaggccaauuu

SEQ ID NO: 52153 - RNA, 23 nt, Human
cagggugaccaauguggccauca

SEQ ID NO: 52154 - RNA, 22 nt, Human
caggguggcacaucacagcauu

SEQ ID NO: 52155 - RNA, 22 nt, Human
caggguggcccuguggucucau

SEQ ID NO: 52156 - RNA, 22 nt, Human
caggguggggaaauagcgcccu

SEQ ID NO: 52157 - RNA, 22 nt, Human
caggguugcaugcaucuguggg

SEQ ID NO: 52158 - RNA, 22 nt, Human
caggguugggguagauaagaaa

SEQ ID NO: 52159 - RNA, 22 nt, Human
cagguaaagcuucaaaucacuu

SEQ ID NO: 52160 - RNA, 22 nt, Human
cagguaaggucacauucugaag

SEQ ID NO: 52161 - RNA, 22 nt, Human
cagguacaaagcuacugccuga

SEQ ID NO: 52162 - RNA, 22 nt, Human
cagguaggauggaagggcucaa

SEQ ID NO: 52163 - RNA, 22 nt, Human
cagguauuaauaaauggagagu

SEQ ID NO: 52164 - RNA, 20 nt, Human
cagguauuacaucugcaccu

SEQ ID NO: 52165 - RNA, 20 nt, Human
cagguauuacuuccuuuaug

SEQ ID NO: 52166 - RNA, 22 nt, Human
cagguauuuucaaggcuugugu

SEQ ID NO: 52167 - RNA, 22 nt, Human
caggucagagguagaugagaug

SEQ ID NO: 52168 - RNA, 18 nt, Human
caggucagccuggccuca

SEQ ID NO: 52169 - RNA, 22 nt, Human
cagguccaacuauuuaucugug

SEQ ID NO: 52170 - RNA, 22 nt, Human
cagguccacagcccaucacugc

SEQ ID NO: 52171 - RNA, 22 nt, Human
cagguccacggcgcccaggggu

SEQ ID NO: 52172 - RNA, 22 nt, Human
cagugagggaagaucucagcac

SEQ ID NO: 52173 - RNA, 22 nt, Human
cagugagggcccccuuccaggu

SEQ ID NO: 52174 - RNA, 21 nt, Human
cagugagguccccagccuagg

SEQ ID NO: 52175 - RNA, 17 nt, Human
cagugaucauuacauua

SEQ ID NO: 52176 - RNA, 22 nt, Human
cagugauuaaaacaugacagcc

SEQ ID NO: 52177 - RNA, 19 nt, Human
cagugauuaauucaucuua

SEQ ID NO: 52178 - RNA, 22 nt, Human
cagugcaaacucccugaggugg

SEQ ID NO: 52179 - RNA, 20 nt, Human
cagugcaacugaagaacuga

SEQ ID NO: 52180 - RNA, 22 nt, Human
cagugcaagugacugaucaagg

SEQ ID NO: 52181 - RNA, 22 nt, Human
cagugcaauauucaaaguggag

SEQ ID NO: 52182 - RNA, 22 nt, Human
cagugcagaacacauggaaaau

SEQ ID NO: 52183 - RNA, 22 nt, Human
cagugcagaggccagggaggau

SEQ ID NO: 52184 - RNA, 17 nt, Human
cagugcagauaagugag

SEQ ID NO: 52185 - RNA, 22 nt, Human
cagugcaggaagugagaugccu

SEQ ID NO: 52186 - RNA, 22 nt, Human
cagugcaggcuuguggccgcag

SEQ ID NO: 52187 - RNA, 22 nt, Human
cagugcagguuuagggcugggg

SEQ ID NO: 52188 - RNA, 22 nt, Human
cagugcagucaaggaagaacca

SEQ ID NO: 52189 - RNA, 22 nt, Human
cagugcaguuucccagaugcug

SEQ ID NO: 52190 - RNA, 22 nt, Human
cagugcauaaucuaaauggggg

SEQ ID NO: 52191 - RNA, 22 nt, Human
cagugccaaggagaaggacagc

SEQ ID NO: 52192 - RNA, 22 nt, Human
cagugccaaggcucuuggucug

SEQ ID NO: 52193 - RNA, 22 nt, Human
cagugccacaggaauggccaau

SEQ ID NO: 52194 - RNA, 21 nt, Human
cagugccagccacaggacgcc

SEQ ID NO: 52195 - RNA, 22 nt, Human
cagugccaugucugagccccua

SEQ ID NO: 52196 - RNA, 19 nt, Human
cagugcccgacgcaggucu

SEQ ID NO: 52197 - RNA, 22 nt, Human
cagugcccuuccaggacugcag

SEQ ID NO: 52198 - RNA, 22 nt, Human
cagugccucaggccagccugca

SEQ ID NO: 52199 - RNA, 22 nt, Human
cagugccucuuaagugucaccc

SEQ ID NO: 52200 - RNA, 22 nt, Human
cagugccuggauagcaacauga

SEQ ID NO: 52201 - RNA, 22 nt, Human
cagugccugucuuauucuuaca

SEQ ID NO: 52202 - RNA, 22 nt, Human
cagugcuauuuggacacaggga

SEQ ID NO: 52203 - RNA, 22 nt, Human
cagugcucccgcugccgcugug

SEQ ID NO: 52204 - RNA, 22 nt, Human
cagugcugcaucuccaugccag

SEQ ID NO: 52205 - RNA, 22 nt, Human
cagugcugcucucuguaagaga

SEQ ID NO: 52206 - RNA, 22 nt, Human
cagugcuggagauggguggaac

SEQ ID NO: 52207 - RNA, 22 nt, Human
cagugcuggaggggugcuugca

SEQ ID NO: 52208 - RNA, 22 nt, Human
cagugcuggcuguuaggacagu

SEQ ID NO: 52209 - RNA, 22 nt, Human
cagugcugggcagaggagagcg

SEQ ID NO: 52210 - RNA, 22 nt, Human
cagugcugguguaggcugacca

SEQ ID NO: 52211 - RNA, 18 nt, Human
cagugcuguuaacaguga

SEQ ID NO: 52212 - RNA, 19 nt, Human
cagugcuguucauucagug

SEQ ID NO: 52213 - RNA, 20 nt, Human
cagugcuuccuccuuucuuu

SEQ ID NO: 52214 - RNA, 22 nt, Human
cagugcuuuuuuaccuuccaac

SEQ ID NO: 52215 - RNA, 22 nt, Human
caguggaagcuggcugugaaga

SEQ ID NO: 52216 - RNA, 19 nt, Human
caguggagauuggaggagg

SEQ ID NO: 52217 - RNA, 22 nt, Human
caguggaggccuugggaccuuu

SEQ ID NO: 52218 - RNA, 22 nt, Human
caguggaugucucauaguguga

SEQ ID NO: 52219 - RNA, 22 nt, Human
caguggauuaaggagggcagcu

SEQ ID NO: 52220 - RNA, 22 nt, Human
caguggcaguuagaaaauauuc

SEQ ID NO: 52221 - RNA, 22 nt, Human
caguggcugguuagggacagga

SEQ ID NO: 52222 - RNA, 22 nt, Human
caguggcugugaccagggaccu

SEQ ID NO: 52223 - RNA, 22 nt, Human
caucaguguggcaguucacugu

SEQ ID NO: 52224 - RNA, 22 nt, Human
caucauaauaacccagacacag

SEQ ID NO: 52225 - RNA, 22 nt, Human
caucaucaaaagugacagagaa

SEQ ID NO: 52226 - RNA, 22 nt, Human
caucaucaccugcuauacgauc

SEQ ID NO: 52227 - RNA, 22 nt, Human
caucaucugugcuggagagccu

SEQ ID NO: 52228 - RNA, 22 nt, Human
caucaugaagaugagaaagcau

SEQ ID NO: 52229 - RNA, 22 nt, Human
caucaugucugcaggaaugugu

SEQ ID NO: 52230 - RNA, 22 nt, Human
caucauuaccaucauuaguagu

SEQ ID NO: 52231 - RNA, 22 nt, Human
caucauuaccuuguaaccaaua

SEQ ID NO: 52232 - RNA, 22 nt, Human
cauccaagaaaauuuucucucu

SEQ ID NO: 52233 - RNA, 22 nt, Human
cauccagaccgugccaugcugc

SEQ ID NO: 52234 - RNA, 22 nt, Human
cauccagugggacagagaaacc

SEQ ID NO: 52235 - RNA, 22 nt, Human
cauccauagccucaauaaauag

SEQ ID NO: 52236 - RNA, 22 nt, Human
cauccauucagugcaaaucaca

SEQ ID NO: 52237 - RNA, 22 nt, Human
cauccccaauuagcgcccagcu

SEQ ID NO: 52238 - RNA, 22 nt, Human
caucccugauuccuaguacagu

SEQ ID NO: 52239 - RNA, 22 nt, Human
caucccugguuccuguguuuaa

SEQ ID NO: 52240 - RNA, 22 nt, Human
cauccguugugcuguugcucuc

SEQ ID NO: 52241 - RNA, 21 nt, Human
cauccguuuauaucucugugg

SEQ ID NO: 52242 - RNA, 22 nt, Human
cauccugacccaugggagggga

SEQ ID NO: 52243 - RNA, 22 nt, Human
cauccugagaggucucucuacc

SEQ ID NO: 52244 - RNA, 22 nt, Human
cauccugguuaccccauaguca

SEQ ID NO: 52245 - RNA, 18 nt, Human
caucuacaaaugccagaa

SEQ ID NO: 52246 - RNA, 22 nt, Human
caucuagaaaaaagaccuguug

SEQ ID NO: 52247 - RNA, 23 nt, Human
caucuagcauccagugaguagug

SEQ ID NO: 52248 - RNA, 22 nt, Human
caucucacagcaaacugcugaa

SEQ ID NO: 52249 - RNA, 22 nt, Human
caucucaggucugugguucacu

SEQ ID NO: 52250 - RNA, 21 nt, Human
caucucaguggguugguggau

SEQ ID NO: 52251 - RNA, 22 nt, Human
caucucaucagugagagucagc

SEQ ID NO: 52252 - RNA, 20 nt, Human
caucuccugccuccauguuc

SEQ ID NO: 52253 - RNA, 22 nt, Human
caucucuucauuagcauuauug

SEQ ID NO: 52254 - RNA, 22 nt, Human
caucugaagagcuuugcaagag

SEQ ID NO: 52255 - RNA, 22 nt, Human
caucugaagugaauugcuuuuu

SEQ ID NO: 52256 - RNA, 22 nt, Human
caucugaauaaagacuugcaga

SEQ ID NO: 52257 - RNA, 22 nt, Human
caucugagggaaaacauguagu

SEQ ID NO: 52258 - RNA, 22 nt, Human
caucugcugacuugacaaguac

SEQ ID NO: 52259 - RNA, 22 nt, Human
caucugcuguaauuaacaagcc

SEQ ID NO: 52260 - RNA, 22 nt, Human
caucuggcagacccugccuccg

SEQ ID NO: 52261 - RNA, 22 nt, Human
caucugguuuaaaagaagaaag

SEQ ID NO: 52262 - RNA, 22 nt, Human
caucuguaggugacacaugagu

SEQ ID NO: 52263 - RNA, 22 nt, Human
caucugucuccucaucgccugu

SEQ ID NO: 52264 - RNA, 22 nt, Human
caucugucugcuguuagcugca

SEQ ID NO: 52265 - RNA, 22 nt, Human
caucuuaaaaugugucauaacu

SEQ ID NO: 52266 - RNA, 22 nt, Human
caucuuaacaggucucugaggg

SEQ ID NO: 52267 - RNA, 22 nt, Human
caucuuaauuucuaacaggcac

SEQ ID NO: 52268 - RNA, 22 nt, Human
caucuucacauauuuccaauga

SEQ ID NO: 52269 - RNA, 22 nt, Human
caucuucauuuuguccaguacu

SEQ ID NO: 52270 - RNA, 22 nt, Human
caucuugaugcuuugacagguu

SEQ ID NO: 52271 - RNA, 22 nt, Human
caucuugcuucaucugcugugu

SEQ ID NO: 52272 - RNA, 22 nt, Human
caucuugugaauuucugauucu

SEQ ID NO: 52273 - RNA, 22 nt, Human
caucuuuaaaaugggaacaaca

SEQ ID NO: 52274 - RNA, 22 nt, Human
caucuuucuuagaacuuucagu

SEQ ID NO: 52275 - RNA, 22 nt, Human
caucuuugccauaugauguaau

SEQ ID NO: 52276 - RNA, 22 nt, Human
caucuuuguaacuuccacauaa

SEQ ID NO: 52277 - RNA, 22 nt, Human
caucuuuguuuuggauauaauc

SEQ ID NO: 52278 - RNA, 22 nt, Human
caugaaauaugcuaccugucuu

SEQ ID NO: 52279 - RNA, 22 nt, Human
caugaaaucugaguauguuucc

SEQ ID NO: 52280 - RNA, 22 nt, Human
caugaaauguguuaaucucuug

SEQ ID NO: 52281 - RNA, 22 nt, Human
caugcaaaugugcuaaucugaa

SEQ ID NO: 52282 - RNA, 22 nt, Human
caugcacaaagguaagaugcgu

SEQ ID NO: 52283 - RNA, 22 nt, Human
caugcacaacauacucaagagg

SEQ ID NO: 52284 - RNA, 22 nt, Human
caugcacacacgugcauguacg

SEQ ID NO: 52285 - RNA, 18 nt, Human
caugcagagggaucugug

SEQ ID NO: 52286 - RNA, 22 nt, Human
caugcagauauuuuuauugugg

SEQ ID NO: 52287 - RNA, 22 nt, Human
caugcagcagaauaaugacuau

SEQ ID NO: 52288 - RNA, 22 nt, Human
caugcagcaggaucucauuccc

SEQ ID NO: 52289 - RNA, 22 nt, Human
caugcaggaggaaaaagcagcu

SEQ ID NO: 52290 - RNA, 22 nt, Human
caugcagugaaauugauaucca

SEQ ID NO: 52291 - RNA, 22 nt, Human
caugcagugacucagacacagg

SEQ ID NO: 52292 - RNA, 22 nt, Human
caugcagugccucuggauucuu

SEQ ID NO: 52293 - RNA, 22 nt, Human
caugcagugcuuugcgccgggc

SEQ ID NO: 52294 - RNA, 22 nt, Human
caugcaguuucucuaugcguag

SEQ ID NO: 52295 - RNA, 22 nt, Human
caugcauagccagcauuguaug

SEQ ID NO: 52296 - RNA, 22 nt, Human
caugcauauuacuagcacagca

SEQ ID NO: 52297 - RNA, 22 nt, Human
caugcaucuggucuuggaaaua

SEQ ID NO: 52298 - RNA, 22 nt, Human
caugcauggucaugcugggacu

SEQ ID NO: 52299 - RNA, 22 nt, Human
caugcauucagaaucucucaca

SEQ ID NO: 52300 - RNA, 20 nt, Human
caugccugcugguaucuggc

SEQ ID NO: 52301 - RNA, 22 nt, Human
caugccuguaaucccagcucuu

SEQ ID NO: 52302 - RNA, 22 nt, Human
caugcuaaccagagacauaaag

SEQ ID NO: 52303 - RNA, 22 nt, Human
caugcuaagucauaaaagagua

SEQ ID NO: 52304 - RNA, 22 nt, Human
caugcuaauuaauuccaccugc

SEQ ID NO: 52305 - RNA, 22 nt, Human
caugcuauuuauacauaagucu

SEQ ID NO: 52306 - RNA, 22 nt, Human
caugcucacuuuuauacuguaa

SEQ ID NO: 52307 - RNA, 22 nt, Human
caugcucuagauucucucuaau

SEQ ID NO: 52308 - RNA, 22 nt, Human
caugcucuccauuggacacaga

SEQ ID NO: 52309 - RNA, 22 nt, Human
caugcucucuggcaacuugugu

SEQ ID NO: 52310 - RNA, 22 nt, Human
caugcugugcaucuugaugacc

SEQ ID NO: 52311 - RNA, 22 nt, Human
caugcuuccuccaaacuacccu

SEQ ID NO: 52312 - RNA, 22 nt, Human
caugcuuuucaaucuaucuuaa

SEQ ID NO: 52313 - RNA, 23 nt, Human
cauggaaaacugaaagcugaccu

SEQ ID NO: 52314 - RNA, 22 nt, Human
cauggaacaaggaagauguuug

SEQ ID NO: 52315 - RNA, 22 nt, Human
cauggaacuguauaaaggcacu

SEQ ID NO: 52316 - RNA, 22 nt, Human
cauggaaugugaguuguuuagu

SEQ ID NO: 52317 - RNA, 22 nt, Human
cauggaggacccucagggagcu

SEQ ID NO: 52318 - RNA, 22 nt, Human
cauggauagaugaaugcuuaaa

SEQ ID NO: 52319 - RNA, 22 nt, Human
cauggauugaauauaaauuaga

SEQ ID NO: 52320 - RNA, 22 nt, Human
cauggcaacaacucuuuauucc

SEQ ID NO: 52321 - RNA, 22 nt, Human
cauggcacugagcagguaugca

SEQ ID NO: 52322 - RNA, 22 nt, Human
cauggcagagccugcagguggg

SEQ ID NO: 52323 - RNA, 22 nt, Human
cauggcauugcauaacggggcu

SEQ ID NO: 52324 - RNA, 22 nt, Human
cauggccacaugauaaucaagu

SEQ ID NO: 52325 - RNA, 22 nt, Human
cauggccacauuggaccgaagc

SEQ ID NO: 52326 - RNA, 22 nt, Human
cauggccaggccaagagaguac

SEQ ID NO: 52327 - RNA, 22 nt, Human
cauggccagggcagauggcagg

SEQ ID NO: 52328 - RNA, 22 nt, Human
cauggcucggggacaggaggua

SEQ ID NO: 52329 - RNA, 22 nt, Human
cauggcugaacacucagugacu

SEQ ID NO: 52330 - RNA, 19 nt, Human
cauggcugcugcuugggag

SEQ ID NO: 52331 - RNA, 22 nt, Human
cauggcugggagacggcugagg

SEQ ID NO: 52332 - RNA, 22 nt, Human
cauggcuggugcaccucuggga

SEQ ID NO: 52333 - RNA, 22 nt, Human
cauggcuugcaagcauaggaga

SEQ ID NO: 52334 - RNA, 22 nt, Human
cauggcuuggagcaggaugaga

SEQ ID NO: 52335 - RNA, 22 nt, Human
cauggcuuguaauaaauuuaua

SEQ ID NO: 52336 - RNA, 22 nt, Human
caugggcaccuuaaaaugaggc

SEQ ID NO: 52337 - RNA, 22 nt, Human
caugggcagaaguggcaucauu

SEQ ID NO: 52338 - RNA, 22 nt, Human
caugggcaguuggcagggcuca

SEQ ID NO: 52339 - RNA, 22 nt, Human
caugggcucuucuggacugcac

SEQ ID NO: 52340 - RNA, 22 nt, Human
caugggcuuuggaggcuggagg

SEQ ID NO: 52341 - RNA, 22 nt, Human
cauggggaugaggcugagacuu

SEQ ID NO: 52342 - RNA, 22 nt, Human
cauggggcccaugugcuccaag

SEQ ID NO: 52343 - RNA, 22 nt, Human
caugggguggugggcaaccuca

SEQ ID NO: 52344 - RNA, 20 nt, Human
caugguggaggagcagggcc

SEQ ID NO: 52345 - RNA, 22 nt, Human
cauguacaaggaugcucagagu

SEQ ID NO: 52346 - RNA, 22 nt, Human
cauguacacacaaagggacaau

SEQ ID NO: 52347 - RNA, 22 nt, Human
cauguauaagcgcuaggagugc

SEQ ID NO: 52348 - RNA, 22 nt, Human
cauguauaguuggaacuacauc

SEQ ID NO: 52349 - RNA, 22 nt, Human
caugucaacaggcccagaaaau

SEQ ID NO: 52350 - RNA, 22 nt, Human
caugucaagaaagagauuugaa

SEQ ID NO: 52351 - RNA, 22 nt, Human
caugucaagacugaagauccag

SEQ ID NO: 52352 - RNA, 22 nt, Human
caugucaagcuuaucucugugg

SEQ ID NO: 52353 - RNA, 22 nt, Human
caugucaauaaauauaacugca

SEQ ID NO: 52354 - RNA, 22 nt, Human
cauguccauuuaugcacagaaa

SEQ ID NO: 52355 - RNA, 22 nt, Human
caugucugccaauuuggaagga

SEQ ID NO: 52356 - RNA, 22 nt, Human
caugucuguguacacaugcaca

SEQ ID NO: 52357 - RNA, 22 nt, Human
cugccuuuggggaguuagaggg

SEQ ID NO: 52358 - RNA, 22 nt, Human
cugcgcagggguggcgccagaa

SEQ ID NO: 52359 - RNA, 22 nt, Human
cugcgugcaugucugcgugcau

SEQ ID NO: 52360 - RNA, 22 nt, Human
cugcguguuccugaagcgcgcu

SEQ ID NO: 52361 - RNA, 22 nt, Human
cugcuagcccaggaugcaggga

SEQ ID NO: 52362 - RNA, 19 nt, Human
cugcucagagcagcuccag

SEQ ID NO: 52363 - RNA, 19 nt, Human
cugcucaggucagucuguc

SEQ ID NO: 52364 - RNA, 22 nt, Human
cugcuccaagccagcccugcag

SEQ ID NO: 52365 - RNA, 22 nt, Human
cugcuccacaccguccauacuc

SEQ ID NO: 52366 - RNA, 22 nt, Human
cugcuccaccuccgggucaggc

SEQ ID NO: 52367 - RNA, 22 nt, Human
cugcuccagacaccugcagggg

SEQ ID NO: 52368 - RNA, 22 nt, Human
cugcuccaggaacagagcugcu

SEQ ID NO: 52369 - RNA, 22 nt, Human
cugcuccaggauuucaggccag

SEQ ID NO: 52370 - RNA, 22 nt, Human
cugcuccaguagccccaugugg

SEQ ID NO: 52371 - RNA, 19 nt, Human
cugcucccuccuucuggca

SEQ ID NO: 52372 - RNA, 22 nt, Human
cugcuccuccccaucaggcagc

SEQ ID NO: 52373 - RNA, 22 nt, Human
cugcucggcgcgcauggcugcc

SEQ ID NO: 52374 - RNA, 22 nt, Human
cugcucuaacugcauuaguuuu

SEQ ID NO: 52375 - RNA, 22 nt, Human
cugcucuaauaucagauagacu

SEQ ID NO: 52376 - RNA, 22 nt, Human
cugcucuagguauugaggcuaa

SEQ ID NO: 52377 - RNA, 22 nt, Human
cugcucuaggucauggguacuu

SEQ ID NO: 52378 - RNA, 22 nt, Human
cugcucuagguccauugcggga

SEQ ID NO: 52379 - RNA, 22 nt, Human
cugcucucuguuccccuggauc

SEQ ID NO: 52380 - RNA, 22 nt, Human
cugcucucuuucagagacaggu

SEQ ID NO: 52381 - RNA, 21 nt, Human
cugcucugacagugaggccag

SEQ ID NO: 52382 - RNA, 22 nt, Human
cugcucugagaggcucuuccua

SEQ ID NO: 52383 - RNA, 22 nt, Human
cugcucuggcuguguacuucag

SEQ ID NO: 52384 - RNA, 22 nt, Human
cugcucuguauaugagcaggaa

SEQ ID NO: 52385 - RNA, 22 nt, Human
cugcucuguuaauuaaacuuug

SEQ ID NO: 52386 - RNA, 22 nt, Human
cugcucuucacacuacacccgu

SEQ ID NO: 52387 - RNA, 22 nt, Human
cugcugaaguuguuggucuuuu

SEQ ID NO: 52388 - RNA, 22 nt, Human
cugcugacagcccugcuucagg

SEQ ID NO: 52389 - RNA, 22 nt, Human
cugcugagacuggcuuuguguc

SEQ ID NO: 52390 - RNA, 22 nt, Human
cuggaggucuacagugguagcu

SEQ ID NO: 52391 - RNA, 22 nt, Human
cuggaggugccuagaugagcuc

SEQ ID NO: 52392 - RNA, 22 nt, Human
cuggaggugggggcaagagugu

SEQ ID NO: 52393 - RNA, 22 nt, Human
cuggaguacaggaaucuuccca

SEQ ID NO: 52394 - RNA, 22 nt, Human
cuggagucagcaaggacgaggc

SEQ ID NO: 52395 - RNA, 22 nt, Human
cuggagucucuucuguagcuac

SEQ ID NO: 52396 - RNA, 22 nt, Human
cuggagugauacucagaaugug

SEQ ID NO: 52397 - RNA, 22 nt, Human
cuggagugcaguggcaugauca

SEQ ID NO: 52398 - RNA, 22 nt, Human
cuggaguuuuggaaaaaugcuu

SEQ ID NO: 52399 - RNA, 22 nt, Human
cuggaucaugcauugcuugucc

SEQ ID NO: 52400 - RNA, 22 nt, Human
cuggauccaacagaguuggguu

SEQ ID NO: 52401 - RNA, 21 nt, Human
cuggaucugucaucgaguuuu

SEQ ID NO: 52402 - RNA, 22 nt, Human
cuggaucuucagagaucaccag

SEQ ID NO: 52403 - RNA, 22 nt, Human
cuggauguccagguagaaguuu

SEQ ID NO: 52404 - RNA, 22 nt, Human
cuggauucaugccaggccaccc

SEQ ID NO: 52405 - RNA, 22 nt, Human
cuggauucuuucauaaaaguca

SEQ ID NO: 52406 - RNA, 22 nt, Human
cuggauuuacugaguuuuauca

SEQ ID NO: 52407 - RNA, 22 nt, Human
cuggauuuugaugagcaguuuu

SEQ ID NO: 52408 - RNA, 19 nt, Human
cuggcaaaugcuuuggcca

SEQ ID NO: 52409 - RNA, 22 nt, Human
cuggcaagugguugggauggau

SEQ ID NO: 52410 - RNA, 22 nt, Human
cuggcacaaaagaaaacugcca

SEQ ID NO: 52411 - RNA, 22 nt, Human
cuggcacacagcaggcucucag

SEQ ID NO: 52412 - RNA, 22 nt, Human
cuggcacaggauccgagaccuu

SEQ ID NO: 52413 - RNA, 22 nt, Human
cuggcacauagucagcacucaa

SEQ ID NO: 52414 - RNA, 22 nt, Human
cuggcacauuguaauauauaca

SEQ ID NO: 52415 - RNA, 22 nt, Human
cuggcacgcccacguaggcacu

SEQ ID NO: 52416 - RNA, 22 nt, Human
cuggcagacuuaccaucagaca

SEQ ID NO: 52417 - RNA, 22 nt, Human
cuggcagauagccacgccuguc

SEQ ID NO: 52418 - RNA, 22 nt, Human
cuggcagauuggggucagcagu

SEQ ID NO: 52419 - RNA, 22 nt, Human
cuggcagcagagcucaacauag

SEQ ID NO: 52420 - RNA, 22 nt, Human
cuggcagcagcuucuggaucga

SEQ ID NO: 52421 - RNA, 22 nt, Human
cuggcagcaggucacacgcaga

SEQ ID NO: 52422 - RNA, 22 nt, Human
cuggcagcauggagccugugcu

SEQ ID NO: 52423 - RNA, 22 nt, Human
cuggcagcguguuuaugaacau

SEQ ID NO: 52424 - RNA, 22 nt, Human
cuggcagcucuacucagagccu

SEQ ID NO: 52425 - RNA, 22 nt, Human
cuggcagcugcccgagaugccc

SEQ ID NO: 52426 - RNA, 22 nt, Human
cuggcagcugugugaagaacug

SEQ ID NO: 52427 - RNA, 22 nt, Human
cuggcaggaagaggaaagguca

SEQ ID NO: 52428 - RNA, 22 nt, Human
cuggcaggcggcagagcccagg

SEQ ID NO: 52429 - RNA, 22 nt, Human
cuggcaggcucucuggucgguu

SEQ ID NO: 52430 - RNA, 22 nt, Human
cuggcagggcagggguuugugc

SEQ ID NO: 52431 - RNA, 22 nt, Human
cuggcaguggggccucaguguu

SEQ ID NO: 52432 - RNA, 22 nt, Human
cuggcagugugacccuggacag

SEQ ID NO: 52433 - RNA, 21 nt, Human
cuggcaugaggagcuuuguuu

SEQ ID NO: 52434 - RNA, 22 nt, Human
cuggcaugcccaggguaugugg

SEQ ID NO: 52435 - RNA, 22 nt, Human
cuggcaugccuugggugccucu

SEQ ID NO: 52436 - RNA, 22 nt, Human
cuggcaugcuaauacagccugu

SEQ ID NO: 52437 - RNA, 22 nt, Human
cuggcauugagggucacaaggc

SEQ ID NO: 52438 - RNA, 22 nt, Human
cuggccaagcuucucuaagcag

SEQ ID NO: 52439 - RNA, 22 nt, Human
cuggccaaugccuggggaauag

SEQ ID NO: 52440 - RNA, 22 nt, Human
cuggccacaacuagcccaggac

SEQ ID NO: 52441 - RNA, 22 nt, Human
cuggccacaugugugcugagca

SEQ ID NO: 52442 - RNA, 23 nt, Human
cuggccaccaucuuucuggcuuc

SEQ ID NO: 52443 - RNA, 22 nt, Human
cuggccacugcaccucuuccuu

SEQ ID NO: 52444 - RNA, 22 nt, Human
cuggccacugguggucauaggc

SEQ ID NO: 52445 - RNA, 22 nt, Human
cuggccagagguuccucugccc

SEQ ID NO: 52446 - RNA, 22 nt, Human
cuggccaggagguaaccagaug

SEQ ID NO: 52447 - RNA, 22 nt, Human
cuggccaggcauccccugaucc

SEQ ID NO: 52448 - RNA, 22 nt, Human
cuggccaggccccuugcagggc

SEQ ID NO: 52449 - RNA, 22 nt, Human
cuggccaggcggccccugcaug

SEQ ID NO: 52450 - RNA, 17 nt, Human
cuggccaguguacuugg

SEQ ID NO: 52451 - RNA, 22 nt, Human
cuggcccagagcucuggccuuu

SEQ ID NO: 52452 - RNA, 22 nt, Human
cuggcccagucucagaguguca

SEQ ID NO: 52453 - RNA, 22 nt, Human
cuggcccauggugagcucuggg

SEQ ID NO: 52454 - RNA, 22 nt, Human
cuggcccauugccuucucucuc

SEQ ID NO: 52455 - RNA, 22 nt, Human
cuggccccaggcagccugcugg

SEQ ID NO: 52456 - RNA, 22 nt, Human
cuggccccgguuccuaaaaacc

SEQ ID NO: 52457 - RNA, 22 nt, Human
cuggcccucggaguccagcugc

SEQ ID NO: 52458 - RNA, 22 nt, Human
cuggcccugccagagaucaaca

SEQ ID NO: 52459 - RNA, 22 nt, Human
cuggcccuuaggaaaacaaagu

SEQ ID NO: 52460 - RNA, 22 nt, Human
cuggcccuucucuugcuuccug

SEQ ID NO: 52461 - RNA, 22 nt, Human
cuggccgcaguguggaguugug

SEQ ID NO: 52462 - RNA, 22 nt, Human
cuggccgccgucccaaccucga

SEQ ID NO: 52463 - RNA, 23 nt, Human
cuggccuccgacacuggccaaga

SEQ ID NO: 52464 - RNA, 19 nt, Human
cuggccuguguccugugcu

SEQ ID NO: 52465 - RNA, 21 nt, Human
cuggccuucaacugauuggau

SEQ ID NO: 52466 - RNA, 22 nt, Human
cuggccuuggugcuugcagaca

SEQ ID NO: 52467 - RNA, 22 nt, Human
cuggccuuuaaaaugaccuuau

SEQ ID NO: 52468 - RNA, 22 nt, Human
cuggcgagcaggaggcgacggc

SEQ ID NO: 52469 - RNA, 22 nt, Human
cuggcucaccuccgcuccagca

SEQ ID NO: 52470 - RNA, 22 nt, Human
cuggcucaggaaaguugcugcu

SEQ ID NO: 52471 - RNA, 23 nt, Human
cuggcucauccugguugcagugg

SEQ ID NO: 52472 - RNA, 22 nt, Human
cuggcucaugugaugagggcaa

SEQ ID NO: 52473 - RNA, 22 nt, Human
ccagaaaauauggcuaagguga

SEQ ID NO: 52474 - RNA, 22 nt, Human
ccagaaacagaugacaagcccu

SEQ ID NO: 52475 - RNA, 22 nt, Human
ccagaaagacuuuuuagguacg

SEQ ID NO: 52476 - RNA, 22 nt, Human
ccagaaagguaaacacuggauu

SEQ ID NO: 52477 - RNA, 22 nt, Human
ccagaaaguucagcugugaaug

SEQ ID NO: 52478 - RNA, 22 nt, Human
ccagaacacaguggaagaauau

SEQ ID NO: 52479 - RNA, 22 nt, Human
ccagaacugagaaaauaaauuu

SEQ ID NO: 52480 - RNA, 22 nt, Human
ccagaagaaaaagcugguauua

SEQ ID NO: 52481 - RNA, 21 nt, Human
ccagaagcugcuugcaggcua

SEQ ID NO: 52482 - RNA, 22 nt, Human
ccagaagcuucaaggagauucu

SEQ ID NO: 52483 - RNA, 22 nt, Human
ccagaaggcggagauugcagug

SEQ ID NO: 52484 - RNA, 19 nt, Human
ccagaagggcagcuaugga

SEQ ID NO: 52485 - RNA, 22 nt, Human
ccagaagucaggaaugagucuu

SEQ ID NO: 52486 - RNA, 22 nt, Human
ccagaauagaaggcagcuguca

SEQ ID NO: 52487 - RNA, 22 nt, Human
ccagaaucaucaucugaagccu

SEQ ID NO: 52488 - RNA, 22 nt, Human
ccagaaucccauugucacuuca

SEQ ID NO: 52489 - RNA, 22 nt, Human
ccagaaugugugaaauuugaug

SEQ ID NO: 52490 - RNA, 22 nt, Human
ccagaauucagaaagggcauaa

SEQ ID NO: 52491 - RNA, 22 nt, Human
ccagacaggggcuguuccugcu

SEQ ID NO: 52492 - RNA, 22 nt, Human
ccagaccacccuggccaugcac

SEQ ID NO: 52493 - RNA, 22 nt, Human
ccagaccuaaccagcuuuugua

SEQ ID NO: 52494 - RNA, 22 nt, Human
ccagaccugcaaggcugagagg

SEQ ID NO: 52495 - RNA, 21 nt, Human
ccagacuggccuaugugguag

SEQ ID NO: 52496 - RNA, 22 nt, Human
ccagacuguggaguuccuggug

SEQ ID NO: 52497 - RNA, 22 nt, Human
ccagagaaaaaugugucccugu

SEQ ID NO: 52498 - RNA, 22 nt, Human
ccagagaaaagaggccaaggau

SEQ ID NO: 52499 - RNA, 17 nt, Human
cauuuguugaucaguug

SEQ ID NO: 52500 - RNA, 22 nt, Human
cauuuguuggucagauuguagu

SEQ ID NO: 52501 - RNA, 22 nt, Human
cauuuguuuauaaguuccccag

SEQ ID NO: 52502 - RNA, 22 nt, Human
cauuuuaagaugaccugguuuc

SEQ ID NO: 52503 - RNA, 19 nt, Human
cauuuucccaucauccuuu

SEQ ID NO: 52504 - RNA, 22 nt, Human
cauuuuccucugcugguguuca

SEQ ID NO: 52505 - RNA, 22 nt, Human
cauuuucucaaugaacccucuu

SEQ ID NO: 52506 - RNA, 22 nt, Human
cauuuuggcuauuguaaauagu

SEQ ID NO: 52507 - RNA, 22 nt, Human
cauuuugugcuagacacuaugg

SEQ ID NO: 52508 - RNA, 22 nt, Human
ccaaaaauuagauacacauaua

SEQ ID NO: 52509 - RNA, 22 nt, Human
ccaaaauguuugaaugcaugug

SEQ ID NO: 52510 - RNA, 22 nt, Human
ccaaaauuaagccucuuauguu

SEQ ID NO: 52511 - RNA, 22 nt, Human
ccaaaauuauuacauuuguagg

SEQ ID NO: 52512 - RNA, 22 nt, Human
ccaaaccauccaucuccaggcu

SEQ ID NO: 52513 - RNA, 22 nt, Human
ccaaacugugucgucugcauag

SEQ ID NO: 52514 - RNA, 21 nt, Human
ccaaagaacugccauuuguca

SEQ ID NO: 52515 - RNA, 22 nt, Human
ccaaaggcggaacugagucucu

SEQ ID NO: 52516 - RNA, 22 nt, Human
ccaaaguccuuucuccaccugc

SEQ ID NO: 52517 - RNA, 22 nt, Human
ccaaauauuaacaaaguaauuu

SEQ ID NO: 52518 - RNA, 22 nt, Human
ccaaaucaggggccacaagcau

SEQ ID NO: 52519 - RNA, 22 nt, Human
ccaacagguguucuguuuuuca

SEQ ID NO: 52520 - RNA, 22 nt, Human
ccaacaguccagaugagauggu

SEQ ID NO: 52521 - RNA, 22 nt, Human
ccaagagcuucccauagcuucu

SEQ ID NO: 52522 - RNA, 22 nt, Human
ccaagaggcagaaugcagagaa

SEQ ID NO: 52523 - RNA, 22 nt, Human
ccaagaugaucuuuacaguguu

SEQ ID NO: 52524 - RNA, 22 nt, Human
ccaagcuacuuaggagucugag

SEQ ID NO: 52525 - RNA, 22 nt, Human
ccaagcugacugugcuguugug

SEQ ID NO: 52526 - RNA, 22 nt, Human
ccaagcugagcaccaucugauc

SEQ ID NO: 52527 - RNA, 17 nt, Human
ccaaggcuauuuguagu

SEQ ID NO: 52528 - RNA, 22 nt, Human
ccaaggcuggagugcaguggcg

SEQ ID NO: 52529 - RNA, 22 nt, Human
ccaaggcuucccagagaugcuc

SEQ ID NO: 52530 - RNA, 22 nt, Human
ccaagggaaggauguauaugau

SEQ ID NO: 52531 - RNA, 22 nt, Human
ccaagggcuauuuacagaacag

SEQ ID NO: 52532 - RNA, 22 nt, Human
ccaagguugagaaacuguagga

SEQ ID NO: 52533 - RNA, 22 nt, Human
ccaaguccugcugccacucuac

SEQ ID NO: 52534 - RNA, 22 nt, Human
ccaauaauucuucaaguguuuu

SEQ ID NO: 52535 - RNA, 22 nt, Human
ccaaugcagauaagacaaacac

SEQ ID NO: 52536 - RNA, 22 nt, Human
ccaauucaccuccuaugcacau

SEQ ID NO: 52537 - RNA, 23 nt, Human
ccaauucagauauuggcuugugc

SEQ ID NO: 52538 - RNA, 22 nt, Human
ccaauuuuauucuucugcaagu

SEQ ID NO: 52539 - RNA, 22 nt, Human
ccacaaggggacucguuaaaug

SEQ ID NO: 52540 - RNA, 21 nt, Human
ccacaauucuaguuacauaug

SEQ ID NO: 52541 - RNA, 22 nt, Human
ccacaauuuuaugauuuaggag

SEQ ID NO: 52542 - RNA, 22 nt, Human
ccacacagauaaguguuuucua

SEQ ID NO: 52543 - RNA, 22 nt, Human
ccacacagggggaugaguuauu

SEQ ID NO: 52544 - RNA, 22 nt, Human
ccacacagucaguuuccaagaa

SEQ ID NO: 52545 - RNA, 22 nt, Human
ccacacuaaacugcucaaacca

SEQ ID NO: 52546 - RNA, 22 nt, Human
ccacacuccccgcaggcguagg

SEQ ID NO: 52547 - RNA, 22 nt, Human
ccacagaaagccugggaagugg

SEQ ID NO: 52548 - RNA, 22 nt, Human
ccacagaaaguugucuagagua

SEQ ID NO: 52549 - RNA, 22 nt, Human
ccacagaaucgcuaguggagca

SEQ ID NO: 52550 - RNA, 22 nt, Human
ccacagaauucugucuccagga

SEQ ID NO: 52551 - RNA, 22 nt, Human
ccacagagcauuagauuucaga

SEQ ID NO: 52552 - RNA, 22 nt, Human
ccacagaggacaacugccuggc

SEQ ID NO: 52553 - RNA, 22 nt, Human
ccacagagucuuccuucucuuc

SEQ ID NO: 52554 - RNA, 22 nt, Human
ccacagauuauuucuaaacagg

SEQ ID NO: 52555 - RNA, 22 nt, Human
ccacagcaccgcugccaguccc

SEQ ID NO: 52556 - RNA, 22 nt, Human
ccacagcugaaagcagaggcuc

SEQ ID NO: 52557 - RNA, 22 nt, Human
ccacagcuucuuauaucacugg

SEQ ID NO: 52558 - RNA, 22 nt, Human
ccacaggaaguuaugaguacua

SEQ ID NO: 52559 - RNA, 22 nt, Human
ccacaggacacaacugcugacc

SEQ ID NO: 52560 - RNA, 22 nt, Human
ccacaggacaguuaaugugcag

SEQ ID NO: 52561 - RNA, 22 nt, Human
ccacagggaacaugacagccuu

SEQ ID NO: 52562 - RNA, 22 nt, Human
ccacagggcacaagggagguug

SEQ ID NO: 52563 - RNA, 22 nt, Human
ccacagggugucaucagcuuga

SEQ ID NO: 52564 - RNA, 22 nt, Human
ccacaguaaauggauucagacc

SEQ ID NO: 52565 - RNA, 22 nt, Human
ccacaguaagagauaguuuaug

SEQ ID NO: 52566 - RNA, 22 nt, Human
ccacaguagcauccaaacagua

SEQ ID NO: 52567 - RNA, 22 nt, Human
ccacaguccgggcuggcaggac

SEQ ID NO: 52568 - RNA, 22 nt, Human
ccacagucuagcuagaaggcau

SEQ ID NO: 52569 - RNA, 22 nt, Human
ccacagucuaugcaacaagguc

SEQ ID NO: 52570 - RNA, 22 nt, Human
ccacagugaguuagauugacca

SEQ ID NO: 52571 - RNA, 22 nt, Human
ccacagugaguucuguacucug

SEQ ID NO: 52572 - RNA, 22 nt, Human
ccacagugauucacuuuugaag

SEQ ID NO: 52573 - RNA, 22 nt, Human
ccacaguguggcauaaacugua

SEQ ID NO: 52574 - RNA, 22 nt, Human
ccacaguuuaggaagucacucu

SEQ ID NO: 52575 - RNA, 22 nt, Human
ccacaguuugccagccaggaau

SEQ ID NO: 52576 - RNA, 22 nt, Human
ccacaucagaaauguuuacuca

SEQ ID NO: 52577 - RNA, 22 nt, Human
ccacaucuguucuuaguucuga

SEQ ID NO: 52578 - RNA, 22 nt, Human
ccacaugaaauugcuuauauuu

SEQ ID NO: 52579 - RNA, 22 nt, Human
ccacaugugcacugcuguaugg

SEQ ID NO: 52580 - RNA, 22 nt, Human
ccacauucaccagcugcacgac

SEQ ID NO: 52581 - RNA, 22 nt, Human
ccacauucaguccaggcuugga

SEQ ID NO: 52582 - RNA, 22 nt, Human
ccacauucucauguaauccuuu

SEQ ID NO: 52583 - RNA, 22 nt, Human
ccaccagcuuugccacccugcu

SEQ ID NO: 52584 - RNA, 22 nt, Human
ccaccagcuuuggcggugacag

SEQ ID NO: 52585 - RNA, 22 nt, Human
ccaccaggcacucacagggaag

SEQ ID NO: 52586 - RNA, 22 nt, Human
ccacccagcagaggaggcaaga

SEQ ID NO: 52587 - RNA, 22 nt, Human
ccaccccuguagagggacagac

SEQ ID NO: 52588 - RNA, 22 nt, Human
ccacccugagccgcaagagcag

SEQ ID NO: 52589 - RNA, 22 nt, Human
ccacccuggacaggccucugag

SEQ ID NO: 52590 - RNA, 20 nt, Human
ccacccuguccggggcggag

SEQ ID NO: 52591 - RNA, 22 nt, Human
ccacccuuccauucuuccucuu

SEQ ID NO: 52592 - RNA, 23 nt, Human
ccaccuggacucugggcaggugc

SEQ ID NO: 52593 - RNA, 22 nt, Human
ccaccuggggccucugagucuc

SEQ ID NO: 52594 - RNA, 23 nt, Human
ccagggccccuacaccacugucc

SEQ ID NO: 52595 - RNA, 22 nt, Human
ccagggccucguguucugagug

SEQ ID NO: 52596 - RNA, 22 nt, Human
ccagggcuccccagaaguaccc

SEQ ID NO: 52597 - RNA, 22 nt, Human
ccagggcugccgcaucccuggu

SEQ ID NO: 52598 - RNA, 22 nt, Human
ccagggcugccuggccgugugu

SEQ ID NO: 52599 - RNA, 22 nt, Human
ccagggcuucaguuagugguga

SEQ ID NO: 52600 - RNA, 19 nt, Human
ccagggcuuuaaguugagg

SEQ ID NO: 52601 - RNA, 22 nt, Human
ccaggggccugugaaggugccc

SEQ ID NO: 52602 - RNA, 22 nt, Human
ccaggggcucucagggugugug

SEQ ID NO: 52603 - RNA, 22 nt, Human
ccagggguuggagguugcagug

SEQ ID NO: 52604 - RNA, 21 nt, Human
ccaggguccagcugccauggu

SEQ ID NO: 52605 - RNA, 22 nt, Human
ccagggucuucgaggcagcaau

SEQ ID NO: 52606 - RNA, 22 nt, Human
ccagggucuuggagaggagugc

SEQ ID NO: 52607 - RNA, 22 nt, Human
ccagggugaccagcuggccuag

SEQ ID NO: 52608 - RNA, 22 nt, Human
ccauuagaagauguaauagaga

SEQ ID NO: 52609 - RNA, 22 nt, Human
ccauuaguaccucuggaaaauu

SEQ ID NO: 52610 - RNA, 22 nt, Human
ccauuccaugugcuacacauaa

SEQ ID NO: 52611 - RNA, 22 nt, Human
ccauucugacaccuaauucugu

SEQ ID NO: 52612 - RNA, 22 nt, Human
ccauucugagucuuaugucuuu

SEQ ID NO: 52613 - RNA, 20 nt, Human
ccauucugggugcagucugg

SEQ ID NO: 52614 - RNA, 22 nt, Human
ccauugaauccucagcugcuag

SEQ ID NO: 52615 - RNA, 21 nt, Human
ccauugagaccauggaggagu

SEQ ID NO: 52616 - RNA, 19 nt, Human
ccauuguaaagaaaaaugu

SEQ ID NO: 52617 - RNA, 22 nt, Human
ccauuguaguaucuguuuuagu

SEQ ID NO: 52618 - RNA, 22 nt, Human
ccauuuggcaagaaagagucau

SEQ ID NO: 52619 - RNA, 22 nt, Human
ccauuugucaccucugcacucc

SEQ ID NO: 52620 - RNA, 22 nt, Human
ccauuugugcuucuucaaagca

SEQ ID NO: 52621 - RNA, 22 nt, Human
ccauuuguuguguauuaauauu

SEQ ID NO: 52622 - RNA, 22 nt, Human
ccauuuugucuccugaaaucua

SEQ ID NO: 52623 - RNA, 22 nt, Human
ccauuuuucauaaacuauccaa

SEQ ID NO: 52624 - RNA, 22 nt, Human
cccaaaaugugcauguucgaau

SEQ ID NO: 52625 - RNA, 22 nt, Human
cccaaagaaaacaguaccucag

SEQ ID NO: 52626 - RNA, 22 nt, Human
cccaaaggaaggacaaggcaga

SEQ ID NO: 52627 - RNA, 22 nt, Human
cccaacacucaccuccggauua

SEQ ID NO: 52628 - RNA, 22 nt, Human
cccaaccagaaauugacagaga

SEQ ID NO: 52629 - RNA, 22 nt, Human
cccaagaucuaggacagaaaga

SEQ ID NO: 52630 - RNA, 22 nt, Human
cccaaggaagacgcuugugaua

SEQ ID NO: 52631 - RNA, 22 nt, Human
cccaaggccuucaagccagcuc

SEQ ID NO: 52632 - RNA, 22 nt, Human
cccaauuucuuccucauuugcc

SEQ ID NO: 52633 - RNA, 20 nt, Human
cccacacccuucccacuugg

SEQ ID NO: 52634 - RNA, 22 nt, Human
cccacaggcaggugcaugggcu

SEQ ID NO: 52635 - RNA, 22 nt, Human
cccacaggcccugcugccuuga

SEQ ID NO: 52636 - RNA, 22 nt, Human
cccacaggugugagcuugcugg

SEQ ID NO: 52637 - RNA, 22 nt, Human
cccaccccuggacaggugagug

SEQ ID NO: 52638 - RNA, 22 nt, Human
cccacucuggcucccuucuagu

SEQ ID NO: 52639 - RNA, 22 nt, Human
cccacuguguugcagucuagug

SEQ ID NO: 52640 - RNA, 20 nt, Human
cccagaagcuuaacagagca

SEQ ID NO: 52641 - RNA, 22 nt, Human
cccagaaggcuugccaggaagc

SEQ ID NO: 52642 - RNA, 21 nt, Human
cccagaaguuccauggggggc

SEQ ID NO: 52643 - RNA, 22 nt, Human
cccagacauaacagcagagagg

SEQ ID NO: 52644 - RNA, 23 nt, Human
cccagaccuugugcugcccuugg

SEQ ID NO: 52645 - RNA, 22 nt, Human
cccagacucaucccugggagcu

SEQ ID NO: 52646 - RNA, 22 nt, Human
cccagacugcagagcgggcaga

SEQ ID NO: 52647 - RNA, 22 nt, Human
cccagagaauuccacauagagg

SEQ ID NO: 52648 - RNA, 22 nt, Human
cccagagagcacaggugguggg

SEQ ID NO: 52649 - RNA, 22 nt, Human
cccagagagcuuucuuugugcu

SEQ ID NO: 52650 - RNA, 20 nt, Human
cccagagcacuuuuucaugu

SEQ ID NO: 52651 - RNA, 20 nt, Human
cccagagccauagccagaca

SEQ ID NO: 52652 - RNA, 22 nt, Human
cccagagccgguggugcucaca

SEQ ID NO: 52653 - RNA, 21 nt, Human
cccagagccuagggagggcac

SEQ ID NO: 52654 - RNA, 18 nt, Human
cccagaggaaugccugga

SEQ ID NO: 52655 - RNA, 22 nt, Human
cccagaggaggaucucggcccg

SEQ ID NO: 52656 - RNA, 22 nt, Human
cccagagggaagggaaugaggu

SEQ ID NO: 52657 - RNA, 22 nt, Human
cccagaggugacaucccauucu

SEQ ID NO: 52658 - RNA, 22 nt, Human
cccagaguauuugugauguuag

SEQ ID NO: 52659 - RNA, 22 nt, Human
cccagagucaagcuuaccauua

SEQ ID NO: 52660 - RNA, 22 nt, Human
cccagagucacaugggguguuc

SEQ ID NO: 52661 - RNA, 22 nt, Human
cccagaguuggucaggggaccc

SEQ ID NO: 52662 - RNA, 22 nt, Human
cccagcacaggcaauuccauac

SEQ ID NO: 52663 - RNA, 22 nt, Human
cccagcagaccgcugugauggc

SEQ ID NO: 52664 - RNA, 23 nt, Human
cccagcagauuguaaagugucca

SEQ ID NO: 52665 - RNA, 22 nt, Human
cccagcagccuugucccuucuc

SEQ ID NO: 52666 - RNA, 22 nt, Human
cccagcagcuugcacagugcug

SEQ ID NO: 52667 - RNA, 22 nt, Human
cccagcaggaggagguugcagu

SEQ ID NO: 52668 - RNA, 22 nt, Human
cccagcaggugccaucacucug

SEQ ID NO: 52669 - RNA, 22 nt, Human
cccagcaucccagugggcagca

SEQ ID NO: 52670 - RNA, 22 nt, Human
cccagcauccucagggagcggg

SEQ ID NO: 52671 - RNA, 22 nt, Human
cccagccaaaagcaaguuuacc

SEQ ID NO: 52672 - RNA, 22 nt, Human
cccagccagccucuucccauau

SEQ ID NO: 52673 - RNA, 22 nt, Human
cccagcccacgguccugggugg

SEQ ID NO: 52674 - RNA, 22 nt, Human
cccagcccagcguucgaggggu

SEQ ID NO: 52675 - RNA, 18 nt, Human
cccagccucuccuuucua

SEQ ID NO: 52676 - RNA, 22 nt, Human
cccagccucuggauucugcccu

SEQ ID NO: 52677 - RNA, 22 nt, Human
cccagccucuggguucugccgg

SEQ ID NO: 52678 - RNA, 22 nt, Human
cccagccucuguuugcuccucu

SEQ ID NO: 52679 - RNA, 22 nt, Human
cccagccuggugcacugugggg

SEQ ID NO: 52680 - RNA, 18 nt, Human
cccagcuccacuucccuc

SEQ ID NO: 52681 - RNA, 22 nt, Human
cccagcucccugguauuugugc

SEQ ID NO: 52682 - RNA, 22 nt, Human
cccagcuccgagcuccgagccg

SEQ ID NO: 52683 - RNA, 22 nt, Human
cccagcuccuuggaugggcagg

SEQ ID NO: 52684 - RNA, 22 nt, Human
cccagcucucugcucuuagccu

SEQ ID NO: 52685 - RNA, 22 nt, Human
cccagcucugccaucuacccac

SEQ ID NO: 52686 - RNA, 22 nt, Human
cccagcucuuccugggagcuaa

SEQ ID NO: 52687 - RNA, 22 nt, Human
cccagcucuuuuagcggcaucu

SEQ ID NO: 52688 - RNA, 22 nt, Human
cccagcugcaccucuauggccu

SEQ ID NO: 52689 - RNA, 23 nt, Human
cccagcugcagacaagggagggu

SEQ ID NO: 52690 - RNA, 17 nt, Human
cccagcugcgucugagg

SEQ ID NO: 52691 - RNA, 18 nt, Human
cccagcuggugggucagu

SEQ ID NO: 52692 - RNA, 22 nt, Human
cccagcuguggcagaggccggg

SEQ ID NO: 52693 - RNA, 22 nt, Human
cccagcuucugagggggccuug

SEQ ID NO: 52694 - RNA, 19 nt, Human
cccagcuugaccaccugcu

SEQ ID NO: 52695 - RNA, 22 nt, Human
cccagcuugcccaggacugagg

SEQ ID NO: 52696 - RNA, 22 nt, Human
cccaggaaacccgaaggcgacc

SEQ ID NO: 52697 - RNA, 22 nt, Human
cccaggaaagagacugcugggu

SEQ ID NO: 52698 - RNA, 22 nt, Human
cccaggaaaguggaggcggcug

SEQ ID NO: 52699 - RNA, 22 nt, Human
cccaggaagaaauucugauuug

SEQ ID NO: 52700 - RNA, 22 nt, Human
cccaggaagaggggucaggugu

SEQ ID NO: 52701 - RNA, 22 nt, Human
cccaggaagagugaguggcauu

SEQ ID NO: 52702 - RNA, 22 nt, Human
cccaggaaggagcuguguauuu

SEQ ID NO: 52703 - RNA, 22 nt, Human
cccaggaagguggucuguggcu

SEQ ID NO: 52704 - RNA, 22 nt, Human
cccaggaaguugagacugcagu

SEQ ID NO: 52705 - RNA, 22 nt, Human
cccaggaaguugaugcagagga

SEQ ID NO: 52706 - RNA, 22 nt, Human
cccaggaaugaggggcggaggc

SEQ ID NO: 52707 - RNA, 22 nt, Human
cccaggacucggcacucuccuu

SEQ ID NO: 52708 - RNA, 22 nt, Human
cccaggagaauauaauguucuu

SEQ ID NO: 52709 - RNA, 22 nt, Human
cccaggagaauauuuuuggguc

SEQ ID NO: 52710 - RNA, 22 nt, Human
cccaggagacagaaacagaggu

SEQ ID NO: 52711 - RNA, 22 nt, Human
cccaggagaccuagaucuguuu

SEQ ID NO: 52712 - RNA, 22 nt, Human
cccaggagauaacguucccaag

SEQ ID NO: 52713 - RNA, 22 nt, Human
cccaggagaucuggaucucguc

SEQ ID NO: 52714 - RNA, 22 nt, Human
ccaggaaguaugacccaacaga

SEQ ID NO: 52715 - RNA, 22 nt, Human
ccaggacaggaguuggcuucgc

SEQ ID NO: 52716 - RNA, 22 nt, Human
ccaggacagggagacgggagcc

SEQ ID NO: 52717 - RNA, 22 nt, Human
gaaaauugaaucaguagcugau

SEQ ID NO: 52718 - RNA, 22 nt, Human
gaaacaacuacuauugauuucu

SEQ ID NO: 52719 - RNA, 22 nt, Human
gaaacacuaugccaagacaggg

SEQ ID NO: 52720 - RNA, 22 nt, Human
gaaacagcuuuaagugauacug

SEQ ID NO: 52721 - RNA, 22 nt, Human
gaaacauucagucaacaguguu

SEQ ID NO: 52722 - RNA, 22 nt, Human
gaaacauucauaugagaaaccu

SEQ ID NO: 52723 - RNA, 20 nt, Human
gaaacauuggcagcaacuga

SEQ ID NO: 52724 - RNA, 22 nt, Human
gaaaccagauaagggaggcuga

SEQ ID NO: 52725 - RNA, 22 nt, Human
gaaacccugagagguggucugg

SEQ ID NO: 52726 - RNA, 22 nt, Human
gaaacguuguggaaaauccucu

SEQ ID NO: 52727 - RNA, 22 nt, Human
gaaacugaguaggcuagagcac

SEQ ID NO: 52728 - RNA, 22 nt, Human
gaaacuguauguaguuuuuggg

SEQ ID NO: 52729 - RNA, 22 nt, Human
gaaagacucuugaugucuuugg

SEQ ID NO: 52730 - RNA, 21 nt, Human
gaaagcacagaaaggacucuu

SEQ ID NO: 52731 - RNA, 22 nt, Human
gaaagcacaguucugaccaugu

SEQ ID NO: 52732 - RNA, 22 nt, Human
gaaagcagcuaagucuuaugau

SEQ ID NO: 52733 - RNA, 22 nt, Human
gaaagcaguaaaugggucccau

SEQ ID NO: 52734 - RNA, 22 nt, Human
gaaagcaguauuuaguucuguu

SEQ ID NO: 52735 - RNA, 22 nt, Human
gaaagccauagcccagcuuuac

SEQ ID NO: 52736 - RNA, 22 nt, Human
gaaagcuaaaugaggucuuaca

SEQ ID NO: 52737 - RNA, 22 nt, Human
gaaagcugaaccaggaaccaug

SEQ ID NO: 52738 - RNA, 22 nt, Human
gaaaggaaauugagggacgcau

SEQ ID NO: 52739 - RNA, 19 nt, Human
ccuagagggaaggcaggac

SEQ ID NO: 52740 - RNA, 22 nt, Human
ccuagcagaagcugcaaugccu

SEQ ID NO: 52741 - RNA, 22 nt, Human
ccuagcagggagaggauaccug

SEQ ID NO: 52742 - RNA, 21 nt, Human
ccuaggaggcuuaauuaggcu

SEQ ID NO: 52743 - RNA, 22 nt, Human
ccuagggauguguuagccagau

SEQ ID NO: 52744 - RNA, 22 nt, Human
ccuaugccugucacucugcgcu

SEQ ID NO: 52745 - RNA, 21 nt, Human
ccuauugaauauaggaagauu

SEQ ID NO: 52746 - RNA, 22 nt, Human
ccuauugacaauucucuucucc

SEQ ID NO: 52747 - RNA, 22 nt, Human
ccucaaaggccuggcaccagaa

SEQ ID NO: 52748 - RNA, 22 nt, Human
ccucaaauaaguuuuauuuauc

SEQ ID NO: 52749 - RNA, 23 nt, Human
ccucaaauguagccuuuuuccca

SEQ ID NO: 52750 - RNA, 22 nt, Human
ccucaagaugcacugaacauau

SEQ ID NO: 52751 - RNA, 19 nt, Human
ccucaaguaugaagaggcc

SEQ ID NO: 52752 - RNA, 22 nt, Human
ccucaaguuggaaauaaaaugu

SEQ ID NO: 52753 - RNA, 22 nt, Human
ccucacacaguuaucucuucau

SEQ ID NO: 52754 - RNA, 22 nt, Human
ccucacagagcccagaugucua

SEQ ID NO: 52755 - RNA, 22 nt, Human
ccucacagucaguucuuagucu

SEQ ID NO: 52756 - RNA, 22 nt, Human
ccucacccacuacacucaaggg

SEQ ID NO: 52757 - RNA, 22 nt, Human
ccucaccucagucugggccuca

SEQ ID NO: 52758 - RNA, 22 nt, Human
ccucaccuuuucucugauugcu

SEQ ID NO: 52759 - RNA, 22 nt, Human
ccucacugaagaggugacauuu

SEQ ID NO: 52760 - RNA, 22 nt, Human
ccucacugcuauguguuugcuc

SEQ ID NO: 52761 - RNA, 22 nt, Human
ccucacugucacuuauaguggu

SEQ ID NO: 52762 - RNA, 22 nt, Human
ccucacugucaucaguaguuau

SEQ ID NO: 52763 - RNA, 22 nt, Human
ccucacuuuccuuucuccuggg

SEQ ID NO: 52764 - RNA, 22 nt, Human
ccucagaacggaaaugguuuug

SEQ ID NO: 52765 - RNA, 22 nt, Human
ccucagaagacuuuagggaaga

SEQ ID NO: 52766 - RNA, 22 nt, Human
ccucagaccccugcugagcuuc

SEQ ID NO: 52767 - RNA, 22 nt, Human
ccucagacgcaggccuaugggc

SEQ ID NO: 52768 - RNA, 22 nt, Human
ccucagacucagugcguuguga

SEQ ID NO: 52769 - RNA, 22 nt, Human
ccucagagaaagguauggcuga

SEQ ID NO: 52770 - RNA, 22 nt, Human
ccucagagaaaugucuauucaa

SEQ ID NO: 52771 - RNA, 22 nt, Human
ccucagaggcaugguuagaaua

SEQ ID NO: 52772 - RNA, 22 nt, Human
ccucagaggugaacaucagugc

SEQ ID NO: 52773 - RNA, 22 nt, Human
ccucagagguguggcaucucug

SEQ ID NO: 52774 - RNA, 22 nt, Human
ccucagcagacacgcuucucac

SEQ ID NO: 52775 - RNA, 22 nt, Human
ccucagcucccaugagaucugc

SEQ ID NO: 52776 - RNA, 22 nt, Human
ccucagcucuucccugugcaca

SEQ ID NO: 52777 - RNA, 22 nt, Human
ccucaggaaaugaauaaauggc

SEQ ID NO: 52778 - RNA, 20 nt, Human
ccucaggaugagggugagca

SEQ ID NO: 52779 - RNA, 22 nt, Human
ccucaggcagugguauggaugg

SEQ ID NO: 52780 - RNA, 22 nt, Human
ccucaggccucugccucauugg

SEQ ID NO: 52781 - RNA, 22 nt, Human
ccucaggcuagcuacugucccu

SEQ ID NO: 52782 - RNA, 22 nt, Human
ccucaggcugcucacacuuguc

SEQ ID NO: 52783 - RNA, 22 nt, Human
ccucaggcuucgucuuccaccc

SEQ ID NO: 52784 - RNA, 22 nt, Human
ccucagggccaucucugucccu

SEQ ID NO: 52785 - RNA, 22 nt, Human
ccucagucuugaauuagccaga

SEQ ID NO: 52786 - RNA, 22 nt, Human
ccucagugagaugcucagcgaa

SEQ ID NO: 52787 - RNA, 20 nt, Human
ccucaguguccuggacuggg

SEQ ID NO: 52788 - RNA, 23 nt, Human
ccucaugaaggucugcuuccugg

SEQ ID NO: 52789 - RNA, 22 nt, Human
ccucaugguacuuacuguagcu

SEQ ID NO: 52790 - RNA, 22 nt, Human
ccucauguugcucgcaucugca

SEQ ID NO: 52791 - RNA, 22 nt, Human
ccucauuaacacaaugucauuu

SEQ ID NO: 52792 - RNA, 22 nt, Human
ccuccacugcuucccagcuuug

SEQ ID NO: 52793 - RNA, 20 nt, Human
ccuccacugucacugaccug

SEQ ID NO: 52794 - RNA, 22 nt, Human
ccuccagacuuuggccauccuc

SEQ ID NO: 52795 - RNA, 22 nt, Human
ccuccagaggguuucccaugaa

SEQ ID NO: 52796 - RNA, 22 nt, Human
ccuccagcgcgauccacuccgg

SEQ ID NO: 52797 - RNA, 22 nt, Human
ccuccagucaccuggaugagaa

SEQ ID NO: 52798 - RNA, 22 nt, Human
ccucccaccauuuagagagagc

SEQ ID NO: 52799 - RNA, 23 nt, Human
ccucccaccuauuucacuuucuu

SEQ ID NO: 52800 - RNA, 22 nt, Human
ccucccaggcauugccauuuuc

SEQ ID NO: 52801 - RNA, 23 nt, Human
ccucccaggcugcgagucccgag

SEQ ID NO: 52802 - RNA, 22 nt, Human
ccuccccacccacggcuggugg

SEQ ID NO: 52803 - RNA, 22 nt, Human
ccuccccugcucagaacucugg

SEQ ID NO: 52804 - RNA, 19 nt, Human
ccuccccuuggaccagcaa

SEQ ID NO: 52805 - RNA, 22 nt, Human
ccucccugcgcuccugcggcgg

SEQ ID NO: 52806 - RNA, 22 nt, Human
ccuccucuggugcugccaaccc

SEQ ID NO: 52807 - RNA, 22 nt, Human
ccuccugcggcguccgcgcucu

SEQ ID NO: 52808 - RNA, 22 nt, Human
ccuccuggagcauuggugagga

SEQ ID NO: 52809 - RNA, 22 nt, Human
ccuccugggagagcacggaggg

SEQ ID NO: 52810 - RNA, 22 nt, Human
ccuccuggugacaaggcaaagc

SEQ ID NO: 52811 - RNA, 22 nt, Human
ccuccugguugcaaugaaaugg

SEQ ID NO: 52812 - RNA, 22 nt, Human
ccuccuguuguccugcuggggc

SEQ ID NO: 52813 - RNA, 22 nt, Human
ccuccuuccugggacagagcug

SEQ ID NO: 52814 - RNA, 22 nt, Human
ccuccuuuccuguuuuccugag

SEQ ID NO: 52815 - RNA, 22 nt, Human
ccucguccacaauccuugcaca

SEQ ID NO: 52816 - RNA, 22 nt, Human
ccucuauagaugugugcaucua

SEQ ID NO: 52817 - RNA, 22 nt, Human
ccucucagccggacugucaggc

SEQ ID NO: 52818 - RNA, 22 nt, Human
ccucucaguauugaacuuuaua

SEQ ID NO: 52819 - RNA, 22 nt, Human
ccucucccacguggcagaggcu

SEQ ID NO: 52820 - RNA, 22 nt, Human
ccucucccaggcgcggcggcag

SEQ ID NO: 52821 - RNA, 22 nt, Human
ccucuccccucccaaggcggga

SEQ ID NO: 52822 - RNA, 22 nt, Human
ccucuccuugcacccgucccgc

SEQ ID NO: 52823 - RNA, 22 nt, Human
ccucucucagcuugcugcaacu

SEQ ID NO: 52824 - RNA, 22 nt, Human
ccucucuccaagggaaauccua

SEQ ID NO: 52825 - RNA, 22 nt, Human
ccucucuccuuccuuugccaaa

SEQ ID NO: 52826 - RNA, 23 nt, Human
ugggaaauguagccuuggcauga

SEQ ID NO: 52827 - RNA, 22 nt, Human
ugggaaauguguuucuggacca

SEQ ID NO: 52828 - RNA, 19 nt, Human
ugggaacuuguuagacaug

SEQ ID NO: 52829 - RNA, 18 nt, Human
ugggaagaaauucuucuc

SEQ ID NO: 52830 - RNA, 22 nt, Human
ugggaagaggaugaggcauaug

SEQ ID NO: 52831 - RNA, 22 nt, Human
ugggaagaggcgggaggcuguu

SEQ ID NO: 52832 - RNA, 22 nt, Human
ugggaagagggguauaaagaag

SEQ ID NO: 52833 - RNA, 22 nt, Human
ugggaagcacgcucagcagaaa

SEQ ID NO: 52834 - RNA, 22 nt, Human
ugggaaggauacguuacaagau

SEQ ID NO: 52835 - RNA, 22 nt, Human
ugggaaggcagucacuguccua

SEQ ID NO: 52836 - RNA, 22 nt, Human
ugggaaguaggacagugcaguu

SEQ ID NO: 52837 - RNA, 22 nt, Human
ugggaauggaugcuaagugcua

SEQ ID NO: 52838 - RNA, 22 nt, Human
ugggaauguagaauguaaacca

SEQ ID NO: 52839 - RNA, 22 nt, Human
ugggaauguggcaaggcauaga

SEQ ID NO: 52840 - RNA, 22 nt, Human
ugggaauugaggugauugugag

SEQ ID NO: 52841 - RNA, 22 nt, Human
ugggacacacaaggucagcucu

SEQ ID NO: 52842 - RNA, 22 nt, Human
ugggacagugaccccagagguc

SEQ ID NO: 52843 - RNA, 21 nt, Human
ugggacagugauggcuccucc

SEQ ID NO: 52844 - RNA, 22 nt, Human
ugggacaugcuuggaaucuaga

SEQ ID NO: 52845 - RNA, 22 nt, Human
ugggaccagauaaagggagguc

SEQ ID NO: 52846 - RNA, 21 nt, Human
ugggaccuagcuuugcacagg

SEQ ID NO: 52847 - RNA, 16 nt, Human
ugggaccuguggccaa

SEQ ID NO: 52848 - RNA, 20 nt, Human
ugggacugacccaucugagc

SEQ ID NO: 52849 - RNA, 22 nt, Human
ugggagaacacugcucuggaug

SEQ ID NO: 52850 - RNA, 22 nt, Human
ugggagaacccagggucaggcu

SEQ ID NO: 52851 - RNA, 22 nt, Human
ugggagaagcauggggugcaga

SEQ ID NO: 52852 - RNA, 22 nt, Human
ugggagacacuggugggagcuu

SEQ ID NO: 52853 - RNA, 22 nt, Human
ugggagagagaauucccagugg

SEQ ID NO: 52854 - RNA, 22 nt, Human
ugggagagcacugcagccccgg

SEQ ID NO: 52855 - RNA, 19 nt, Human
ugggagaggcaacagagua

SEQ ID NO: 52856 - RNA, 22 nt, Human
ugggagagucuaaaaccgaggu

SEQ ID NO: 52857 - RNA, 22 nt, Human
ugggagauaauucauuguguuc

SEQ ID NO: 52858 - RNA, 22 nt, Human
ugggagauauugcuguggcugu

SEQ ID NO: 52859 - RNA, 22 nt, Human
ugggagcaaaugacugggagau

SEQ ID NO: 52860 - RNA, 22 nt, Human
ugggagcaagcuacuuagggaa

SEQ ID NO: 52861 - RNA, 22 nt, Human
ugggagcaagcuggugcuggag

SEQ ID NO: 52862 - RNA, 22 nt, Human
ugggagcacccugaggagcuuc

SEQ ID NO: 52863 - RNA, 22 nt, Human
ugggagcagccucagcuucggg

SEQ ID NO: 52864 - RNA, 22 nt, Human
ugggagcaggcugaugauaggu

SEQ ID NO: 52865 - RNA, 22 nt, Human
ugggagcccaagggagcugccg

SEQ ID NO: 52866 - RNA, 22 nt, Human
ugggagccuggcaggccagagg

SEQ ID NO: 52867 - RNA, 22 nt, Human
ugggagcugggguuggacgucu

SEQ ID NO: 52868 - RNA, 22 nt, Human
ugggaggaaugucacugagcca

SEQ ID NO: 52869 - RNA, 22 nt, Human
ugggaggcuuccagaccuugcu

SEQ ID NO: 52870 - RNA, 22 nt, Human
ugggaggugauuaaauuauggg

SEQ ID NO: 52871 - RNA, 22 nt, Human
ugggaguacuaugugauaggau

SEQ ID NO: 52872 - RNA, 22 nt, Human
ugggagucagucguucucagag

SEQ ID NO: 52873 - RNA, 22 nt, Human
ugggagugcaccugggacacga

SEQ ID NO: 52874 - RNA, 18 nt, Human
ugggagugggaguggaua

SEQ ID NO: 52875 - RNA, 22 nt, Human
ugggaguggggcauagaaggua

SEQ ID NO: 52876 - RNA, 22 nt, Human
ugggaguguucuuggcuugcuu

SEQ ID NO: 52877 - RNA, 22 nt, Human
ugggaguuuguuagaaaugcag

SEQ ID NO: 52878 - RNA, 22 nt, Human
ugggauaagguaugugaaguac

SEQ ID NO: 52879 - RNA, 22 nt, Human
ugggauagaaauuuagaacaag

SEQ ID NO: 52880 - RNA, 23 nt, Human
ugggauagaauuucauggcugcu

SEQ ID NO: 52881 - RNA, 22 nt, Human
ugggauaguagcugagagacaa

SEQ ID NO: 52882 - RNA, 22 nt, Human
ugggauauaguaaaacaugaau

SEQ ID NO: 52883 - RNA, 22 nt, Human
ugggaugagcuauauagaaagu

SEQ ID NO: 52884 - RNA, 22 nt, Human
ugggaugauagguaaguaauua

SEQ ID NO: 52885 - RNA, 22 nt, Human
uggcagagaacacacaugauuc

SEQ ID NO: 52886 - RNA, 22 nt, Human
uggcagagaaccugggcuuugu

SEQ ID NO: 52887 - RNA, 22 nt, Human
uggcagagacuccuccugggag

SEQ ID NO: 52888 - RNA, 22 nt, Human
uggcagagagacucuccuugau

SEQ ID NO: 52889 - RNA, 22 nt, Human
uggcagagagagugcagucgac

SEQ ID NO: 52890 - RNA, 22 nt, Human
uggcagagaugaagaguuguuu

SEQ ID NO: 52891 - RNA, 19 nt, Human
uggcagaggcaguuuguac

SEQ ID NO: 52892 - RNA, 21 nt, Human
uggcagagugcagucuauaca

SEQ ID NO: 52893 - RNA, 22 nt, Human
uggcagaguucgcugugccuuu

SEQ ID NO: 52894 - RNA, 22 nt, Human
uggcagauaaacaugugauaaa

SEQ ID NO: 52895 - RNA, 22 nt, Human
uggcagcaauuugugauguuga

SEQ ID NO: 52896 - RNA, 22 nt, Human
uggcagcagaacaugaaaccca

SEQ ID NO: 52897 - RNA, 22 nt, Human
uggcagcauguuauguaaggaa

SEQ ID NO: 52898 - RNA, 22 nt, Human
uggcagccugcgugaaggagcu

SEQ ID NO: 52899 - RNA, 22 nt, Human
uggcagcuacagacagagguga

SEQ ID NO: 52900 - RNA, 22 nt, Human
uggcagcuauggucuaagggcc

SEQ ID NO: 52901 - RNA, 22 nt, Human
uggcagcuccggguaggggcug

SEQ ID NO: 52902 - RNA, 22 nt, Human
uggcagcuccuggggccagcac

SEQ ID NO: 52903 - RNA, 22 nt, Human
uggcagcucuguucaacaugag

SEQ ID NO: 52904 - RNA, 22 nt, Human
uggcagcuggagggcaauggcc

SEQ ID NO: 52905 - RNA, 22 nt, Human
uggcagcuggcucugcgcaggc

SEQ ID NO: 52906 - RNA, 23 nt, Human
uggcagcuguguaagagaaagca

SEQ ID NO: 52907 - RNA, 22 nt, Human
uggcaggaaaaacauuggagau

SEQ ID NO: 52908 - RNA, 22 nt, Human
uggcaggaaaguaacagagcac

SEQ ID NO: 52909 - RNA, 22 nt, Human
uggcaggaaauacccugccuag

SEQ ID NO: 52910 - RNA, 22 nt, Human
uggcaggaaggagacucagccc

SEQ ID NO: 52911 - RNA, 20 nt, Human
uggcaggagccacuggaagc

SEQ ID NO: 52912 - RNA, 22 nt, Human
uggcaggagguuuucuccagga

SEQ ID NO: 52913 - RNA, 22 nt, Human
uggcaggaucuuugagagugaa

SEQ ID NO: 52914 - RNA, 22 nt, Human
uggcaggcugaguuggccuggu

SEQ ID NO: 52915 - RNA, 22 nt, Human
uggcagggagccaccggucaug

SEQ ID NO: 52916 - RNA, 22 nt, Human
uggcagggaguucguucacaac

SEQ ID NO: 52917 - RNA, 22 nt, Human
uggcagggaguugcaggauuuc

SEQ ID NO: 52918 - RNA, 18 nt, Human
uggcaggggcaguacgcc

SEQ ID NO: 52919 - RNA, 22 nt, Human
uggcaggguacaccuuaacacc

SEQ ID NO: 52920 - RNA, 22 nt, Human
uggcagggucuugcuguguugc

SEQ ID NO: 52921 - RNA, 22 nt, Human
uggcagguacccauuggcugua

SEQ ID NO: 52922 - RNA, 22 nt, Human
uggcagguagaguucugagaug

SEQ ID NO: 52923 - RNA, 22 nt, Human
uggcaggugccuguaaucucag

SEQ ID NO: 52924 - RNA, 22 nt, Human
uggcagguuuccuccucauagu

SEQ ID NO: 52925 - RNA, 22 nt, Human
uggcagguuucguuaaaaaugg

SEQ ID NO: 52926 - RNA, 22 nt, Human
uggcaguccagacccuggacuc

SEQ ID NO: 52927 - RNA, 22 nt, Human
uggcaguccccugugccuggaa

SEQ ID NO: 52928 - RNA, 22 nt, Human
uggcagugaaagacaauugggc

SEQ ID NO: 52929 - RNA, 22 nt, Human
uggcagugaagcugucuuuagg

SEQ ID NO: 52930 - RNA, 23 nt, Human
uggcagugcccagggagaugauc

SEQ ID NO: 52931 - RNA, 22 nt, Human
uggcaguggauaggggagcggu

SEQ ID NO: 52932 - RNA, 22 nt, Human
uggcaguggcuuugcuggugga

SEQ ID NO: 52933 - RNA, 22 nt, Human
uggcaguggugucugcacaggc

SEQ ID NO: 52934 - RNA, 22 nt, Human
uggcaguguccuacugguuggu

SEQ ID NO: 52935 - RNA, 22 nt, Human
uaacuuugaagggaauuuuacu

SEQ ID NO: 52936 - RNA, 22 nt, Human
uaacuuugagaacuuucuggug

SEQ ID NO: 52937 - RNA, 22 nt, Human
uaacuuuuacauuuggcucacu

SEQ ID NO: 52938 - RNA, 22 nt, Human
uaacuuuugugaucugucgauu

SEQ ID NO: 52939 - RNA, 21 nt, Human
uaacuuuugugccuaucuugu

SEQ ID NO: 52940 - RNA, 22 nt, Human
uaagaaacaugauuaauggcag

SEQ ID NO: 52941 - RNA, 22 nt, Human
uaagaaacauuuuuaugacagu

SEQ ID NO: 52942 - RNA, 22 nt, Human
uaagaaacuaaugcaauaagag

SEQ ID NO: 52943 - RNA, 22 nt, Human
uaagaaauuuaguuauagaaug

SEQ ID NO: 52944 - RNA, 22 nt, Human
uaagaacaagauguuccuguuu

SEQ ID NO: 52945 - RNA, 22 nt, Human
uaagaacucgugaucauuugaa

SEQ ID NO: 52946 - RNA, 22 nt, Human
uaagaacuucggacauguuauc

SEQ ID NO: 52947 - RNA, 22 nt, Human
uaagaagcaguucacaaguaaa

SEQ ID NO: 52948 - RNA, 22 nt, Human
uaagaagguaguuuccaaguca

SEQ ID NO: 52949 - RNA, 18 nt, Human
uaagaagguggcuccagc

SEQ ID NO: 52950 - RNA, 22 nt, Human
uaagaaguaccucuuuuccuga

SEQ ID NO: 52951 - RNA, 22 nt, Human
uaagaaguguugccuaaugcaa

SEQ ID NO: 52952 - RNA, 22 nt, Human
uaagaaguguuugcccagccau

SEQ ID NO: 52953 - RNA, 22 nt, Human
uaagaauaccucucagcucuuu

SEQ ID NO: 52954 - RNA, 22 nt, Human
uaagaauaguguuugccuuugg

SEQ ID NO: 52955 - RNA, 22 nt, Human
gugcuuuagguguuuggcugaa

SEQ ID NO: 52956 - RNA, 22 nt, Human
gugcuuucugcaugguuccuac

SEQ ID NO: 52957 - RNA, 19 nt, Human
gugcuuuuuaagagcucag

SEQ ID NO: 52958 - RNA, 22 nt, Human
guggaaaacugagaaaauugcu

SEQ ID NO: 52959 - RNA, 22 nt, Human
guggaaaagaaagucuuccuug

SEQ ID NO: 52960 - RNA, 22 nt, Human
guggaaauuuuaggaucaucuu

SEQ ID NO: 52961 - RNA, 22 nt, Human
guggaagaggcaagauagcucu

SEQ ID NO: 52962 - RNA, 22 nt, Human
guggaagccuaagaguagggag

SEQ ID NO: 52963 - RNA, 22 nt, Human
guggaaggaagagauggcccca

SEQ ID NO: 52964 - RNA, 22 nt, Human
guggaaggaauuaacagacuag

SEQ ID NO: 52965 - RNA, 22 nt, Human
guggaagggacugccuagagga

SEQ ID NO: 52966 - RNA, 22 nt, Human
guggaaggugcuagaacaagga

SEQ ID NO: 52967 - RNA, 22 nt, Human
guggaauuuuuaccuaugaaug

SEQ ID NO: 52968 - RNA, 22 nt, Human
guggacacaggagagagaacug

SEQ ID NO: 52969 - RNA, 22 nt, Human
guggacagcuucuaggugccag

SEQ ID NO: 52970 - RNA, 22 nt, Human
guggacuggcagugaccuuggu

SEQ ID NO: 52971 - RNA, 22 nt, Human
guggagagagugacagcaucuu

SEQ ID NO: 52972 - RNA, 23 nt, Human
guggagagauuaguaauucaccc

SEQ ID NO: 52973 - RNA, 22 nt, Human
guggagagcaaauaauuggaau

SEQ ID NO: 52974 - RNA, 22 nt, Human
guggaggaagggauucagacca

SEQ ID NO: 52975 - RNA, 22 nt, Human
guggaggacaaaagaagccuuu

SEQ ID NO: 52976 - RNA, 22 nt, Human
guggaggcagugacacaguagc

SEQ ID NO: 52977 - RNA, 22 nt, Human
guggaggguuugcaaugugcag

SEQ ID NO: 52978 - RNA, 22 nt, Human
guggagugcaacgguuggaguu

SEQ ID NO: 52979 - RNA, 22 nt, Human
guggauggacaugggcaagagg

SEQ ID NO: 52980 - RNA, 22 nt, Human
guggauggagcuggaagccauu

SEQ ID NO: 52981 - RNA, 22 nt, Human
guggauuacaagacaguugaga

SEQ ID NO: 52982 - RNA, 22 nt, Human
guggcaacaaaagagccuagug

SEQ ID NO: 52983 - RNA, 22 nt, Human
guggcagaaacuggcagaggag

SEQ ID NO: 52984 - RNA, 22 nt, Human
guggcagaaaugggacuuugag

SEQ ID NO: 52985 - RNA, 22 nt, Human
guggcagagauagaacuggaau

SEQ ID NO: 52986 - RNA, 22 nt, Human
guggcagagccaaggcuggagc

SEQ ID NO: 52987 - RNA, 22 nt, Human
guggcagaguucaggcguuugg

SEQ ID NO: 52988 - RNA, 22 nt, Human
guggcagcauggcuuuuagcug

SEQ ID NO: 52989 - RNA, 22 nt, Human
guggcagcuacauuuaaugcaa

SEQ ID NO: 52990 - RNA, 22 nt, Human
guggcagcucucuugauuuccc

SEQ ID NO: 52991 - RNA, 22 nt, Human
guggcagcugguaugcagacag

SEQ ID NO: 52992 - RNA, 22 nt, Human
guggcaggagacuggaagaugg

SEQ ID NO: 52993 - RNA, 22 nt, Human
guggcaggaucacggcucacug

SEQ ID NO: 52994 - RNA, 20 nt, Human
guggcaggcagugaaggagc

SEQ ID NO: 52995 - RNA, 22 nt, Human
guggcagggguauuccagcuga

SEQ ID NO: 52996 - RNA, 22 nt, Human
guggcagggugcucaucaugca

SEQ ID NO: 52997 - RNA, 22 nt, Human
guggcagguggagccuccugca

SEQ ID NO: 52998 - RNA, 22 nt, Human
guggcagguuccguagacagca

SEQ ID NO: 52999 - RNA, 22 nt, Human
guggcagucaucaaggacagau

SEQ ID NO: 53000 - RNA, 22 nt, Human
guggcagucggaagucaggaga

SEQ ID NO: 53001 - RNA, 22 nt, Human
guggcaguggagacccgagccu

SEQ ID NO: 53002 - RNA, 22 nt, Human
guggcaguucugugucucuugu

SEQ ID NO: 53003 - RNA, 22 nt, Human
guggcaguugcuguggcaauaa

SEQ ID NO: 53004 - RNA, 22 nt, Human
guggcaguuuugacaucacaaa

SEQ ID NO: 53005 - RNA, 22 nt, Human
guggcauucucggcaccaucug

SEQ ID NO: 53006 - RNA, 22 nt, Human
guggcauugccuucugcaggaa

SEQ ID NO: 53007 - RNA, 22 nt, Human
guggcauuugaacaaucacaua

SEQ ID NO: 53008 - RNA, 22 nt, Human
guggcauuuuagaacagcugac

SEQ ID NO: 53009 - RNA, 22 nt, Human
guggccaagagauaaaauugug

SEQ ID NO: 53010 - RNA, 22 nt, Human
guggccagaaguuaagugguua

SEQ ID NO: 53011 - RNA, 22 nt, Human
guggccagaaucuugaggccuu

SEQ ID NO: 53012 - RNA, 22 nt, Human
guggccagaggucccauguguc

SEQ ID NO: 53013 - RNA, 18 nt, Human
guggccagccuggucuug

SEQ ID NO: 53014 - RNA, 22 nt, Human
guggccaggacauugccaggca

SEQ ID NO: 53015 - RNA, 22 nt, Human
guggccaggagaccuugggcau

SEQ ID NO: 53016 - RNA, 22 nt, Human
guggccaggccgacugccaggc

SEQ ID NO: 53017 - RNA, 22 nt, Human
guggccaguggugggcgcccug

SEQ ID NO: 53018 - RNA, 22 nt, Human
guggccaucuuuggcccugacu

SEQ ID NO: 53019 - RNA, 22 nt, Human
guggcccacacagacagcaucu

SEQ ID NO: 53020 - RNA, 22 nt, Human
guggcccucugauagggucagg

SEQ ID NO: 53021 - RNA, 22 nt, Human
guggcccuuggaguugugaccu

SEQ ID NO: 53022 - RNA, 23 nt, Human
guggccuccccggaaugccucgc

SEQ ID NO: 53023 - RNA, 22 nt, Human
guggccugagcuucagaguugg

SEQ ID NO: 53024 - RNA, 19 nt, Human
guggccugcgcugggugcg

SEQ ID NO: 53025 - RNA, 22 nt, Human
guggccuggaugagcuucgaca

SEQ ID NO: 53026 - RNA, 22 nt, Human
guggccugggguuuguucugag

SEQ ID NO: 53027 - RNA, 22 nt, Human
guggccuuauuauguacaaaau

SEQ ID NO: 53028 - RNA, 22 nt, Human
guggccuuuaucuuagguaucc

SEQ ID NO: 53029 - RNA, 22 nt, Human
guggccuuucuugggcuacaga

SEQ ID NO: 53030 - RNA, 22 nt, Human
guggcucacagcaauguuuccu

SEQ ID NO: 53031 - RNA, 22 nt, Human
guggcucagcggagcucugcac

SEQ ID NO: 53032 - RNA, 22 nt, Human
guggcucuaggugagcauggag

SEQ ID NO: 53033 - RNA, 22 nt, Human
guggcucuccauugacauggaa

SEQ ID NO: 53034 - RNA, 22 nt, Human
guggcugcagagccagcaagcu

SEQ ID NO: 53035 - RNA, 22 nt, Human
guggcugcuacagagcuggagg

SEQ ID NO: 53036 - RNA, 22 nt, Human
guggcugcugguacucugggaa

SEQ ID NO: 53037 - RNA, 22 nt, Human
guggcugcuguccucucugguu

SEQ ID NO: 53038 - RNA, 22 nt, Human
guggcuggaguaugaggaaagg

SEQ ID NO: 53039 - RNA, 22 nt, Human
guggcuguauagccaagucaga

SEQ ID NO: 53040 - RNA, 22 nt, Human
guggcuucacauggcauuuggc

SEQ ID NO: 53041 - RNA, 22 nt, Human
guggcuucaucaacugugcuua

SEQ ID NO: 53042 - RNA, 22 nt, Human
guggcuuccaagacuaagucac

SEQ ID NO: 53043 - RNA, 22 nt, Human
guggcuucuggcugggccucag

SEQ ID NO: 53044 - RNA, 22 nt, Human
gugugccaggaacuggcugcug

SEQ ID NO: 53045 - RNA, 22 nt, Human
gugugccucccauuagggugua

SEQ ID NO: 53046 - RNA, 22 nt, Human
gugugccuguaucaugguaacc

SEQ ID NO: 53047 - RNA, 22 nt, Human
gugugcgccgacacagccaggu

SEQ ID NO: 53048 - RNA, 22 nt, Human
gugugcucccucugucgucaua

SEQ ID NO: 53049 - RNA, 22 nt, Human
gugugcuguuguucagguagaa

SEQ ID NO: 53050 - RNA, 22 nt, Human
guguggccucaacgggaugcaa

SEQ ID NO: 53051 - RNA, 22 nt, Human
guguggcuaggauggcuuugcu

SEQ ID NO: 53052 - RNA, 22 nt, Human
guguggcuuucuggguuuaauu

SEQ ID NO: 53053 - RNA, 22 nt, Human
gugugggcagggccgugcuccc

SEQ ID NO: 53054 - RNA, 22 nt, Human
guguggggccaggaucagggcu

SEQ ID NO: 53055 - RNA, 22 nt, Human
guguggucgaaguucucccgga

SEQ ID NO: 53056 - RNA, 22 nt, Human
gugugguggcccuccuucaggc

SEQ ID NO: 53057 - RNA, 23 nt, Human
guguguccauucgcacucuuagg

SEQ ID NO: 53058 - RNA, 22 nt, Human
gugugucccuuggaaccucagc

SEQ ID NO: 53059 - RNA, 22 nt, Human
guguguccucuuaacuauuaug

SEQ ID NO: 53060 - RNA, 22 nt, Human
gugugucugaaguugaguagac

SEQ ID NO: 53061 - RNA, 22 nt, Human
gugugucuugaccaggaucgga

SEQ ID NO: 53062 - RNA, 22 nt, Human
gugugugccaucaagagcuuuc

SEQ ID NO: 53063 - RNA, 20 nt, Human
gugugugcuccaugcaugcu

SEQ ID NO: 53064 - RNA, 22 nt, Human
guguguggcauguccuauuuug

SEQ ID NO: 53065 - RNA, 22 nt, Human
guguguggggccuucggguccu

SEQ ID NO: 53066 - RNA, 22 nt, Human
gugugugucuccgcggccguag

SEQ ID NO: 53067 - RNA, 23 nt, Human
guguguucccggaguagcucccg

SEQ ID NO: 53068 - RNA, 22 nt, Human
guguuaaccagcuaaacuuugc

SEQ ID NO: 53069 - RNA, 22 nt, Human
guguuaaugaaaaacaacucau

SEQ ID NO: 53070 - RNA, 22 nt, Human
guguuacauauaccugagcuua

SEQ ID NO: 53071 - RNA, 22 nt, Human
guguuacauauauacccacacc

SEQ ID NO: 53072 - RNA, 22 nt, Human
ucuguacuuccuuuaaacuuua

SEQ ID NO: 53073 - RNA, 20 nt, Human
ucuguagucuguggcaagac

SEQ ID NO: 53074 - RNA, 22 nt, Human
ucuguaguuuacaguauuucag

SEQ ID NO: 53075 - RNA, 22 nt, Human
ucuguauauauuaaugaaauuc

SEQ ID NO: 53076 - RNA, 22 nt, Human
ucuguaucuaauuuuacaguag

SEQ ID NO: 53077 - RNA, 22 nt, Human
ucuguauucuauggcaguuggu

SEQ ID NO: 53078 - RNA, 22 nt, Human
ucuguauuuuaagaugcuguuu

SEQ ID NO: 53079 - RNA, 22 nt, Human
ucugucaaaaguuuucaauaaa

SEQ ID NO: 53080 - RNA, 22 nt, Human
ucugucacccaggcuggagugc

SEQ ID NO: 53081 - RNA, 22 nt, Human
ucugucacuuauuaagauggau

SEQ ID NO: 53082 - RNA, 22 nt, Human
ucugucauaagugcugaaguau

SEQ ID NO: 53083 - RNA, 22 nt, Human
ucugucaucaaauaugcuuucu

SEQ ID NO: 53084 - RNA, 22 nt, Human
ucugucauccaggcuggaauau

SEQ ID NO: 53085 - RNA, 22 nt, Human
ucugucaucuguaacaggaggg

SEQ ID NO: 53086 - RNA, 22 nt, Human
ucugucauuagccuugacugua

SEQ ID NO: 53087 - RNA, 19 nt, Human
ucugucauuucuucuguac

SEQ ID NO: 53088 - RNA, 22 nt, Human
ucuguccaacacucucuagaca

SEQ ID NO: 53089 - RNA, 22 nt, Human
ucuguccacaagcacaggcucu

SEQ ID NO: 53090 - RNA, 20 nt, Human
ucuguccaccagccucgccu

SEQ ID NO: 53091 - RNA, 22 nt, Human
ucuguccagaacguacaucuug

SEQ ID NO: 53092 - RNA, 22 nt, Human
ucuguccagcucucaggagaca

SEQ ID NO: 53093 - RNA, 22 nt, Human
ucuguccauucagaauggcccu

SEQ ID NO: 53094 - RNA, 22 nt, Human
ucuguccauucagccauccauc

SEQ ID NO: 53095 - RNA, 22 nt, Human
ucuguccauuuauaagccccca

SEQ ID NO: 53096 - RNA, 22 nt, Human
ucugucucucaagggccguccu

SEQ ID NO: 53097 - RNA, 21 nt, Human
ucugucucuccacugcccugc

SEQ ID NO: 53098 - RNA, 22 nt, Human
ucugucugcaccuaagcacagu

SEQ ID NO: 53099 - RNA, 22 nt, Human
ucugucugccuugugagggcac

SEQ ID NO: 53100 - RNA, 22 nt, Human
ucugucugcucauuuaccucag

SEQ ID NO: 53101 - RNA, 22 nt, Human
ucugucugcuucacuugcauuu

SEQ ID NO: 53102 - RNA, 18 nt, Human
ucugucuguacaaguauc

SEQ ID NO: 53103 - RNA, 22 nt, Human
ucugucuguccagggcccccgc

SEQ ID NO: 53104 - RNA, 18 nt, Human
ucugucuguguugucuuu

SEQ ID NO: 53105 - RNA, 22 nt, Human
ucugucuuagcaucuuugcuca

SEQ ID NO: 53106 - RNA, 22 nt, Human
ucugucuucaucagcaugugau

SEQ ID NO: 53107 - RNA, 22 nt, Human
ucugugaaacagcucuggcaug

SEQ ID NO: 53108 - RNA, 22 nt, Human
ucugugacugauggaggcuuuu

SEQ ID NO: 53109 - RNA, 22 nt, Human
ucugugauaggaaaauaaaugg

SEQ ID NO: 53110 - RNA, 22 nt, Human
ucugugcaaguauuugacauuu

SEQ ID NO: 53111 - RNA, 22 nt, Human
ucugugcaccagaaugauauuu

SEQ ID NO: 53112 - RNA, 22 nt, Human
ucugugcaccuucuaaugagua

SEQ ID NO: 53113 - RNA, 22 nt, Human
ucugugcacugugucauuaggu

SEQ ID NO: 53114 - RNA, 22 nt, Human
ucugugcagauguagaccaguu

SEQ ID NO: 53115 - RNA, 22 nt, Human
ucugugcaggauuugaggaacc

SEQ ID NO: 53116 - RNA, 22 nt, Human
ucugugccaucagucuccagag

SEQ ID NO: 53117 - RNA, 22 nt, Human
ucugugccuucucccagacuua

SEQ ID NO: 53118 - RNA, 20 nt, Human
ucugugcuacacuccagauu

SEQ ID NO: 53119 - RNA, 22 nt, Human
ucugugcucaaguucugccucu

SEQ ID NO: 53120 - RNA, 22 nt, Human
ucugugcucuucucaguaucac

SEQ ID NO: 53121 - RNA, 22 nt, Human
ucugugcugccauccuguggcc

SEQ ID NO: 53122 - RNA, 22 nt, Human
ucugugcuggacugauuucaua

SEQ ID NO: 53123 - RNA, 19 nt, Human
ucugugcugggaggcagca

SEQ ID NO: 53124 - RNA, 19 nt, Human
ucuguggagcucagaguag

SEQ ID NO: 53125 - RNA, 22 nt, Human
ucuguggagugaccugggcuuu

SEQ ID NO: 53126 - RNA, 22 nt, Human
ucuguggaguuagacugguauc

SEQ ID NO: 53127 - RNA, 22 nt, Human
ucuguggauuuuaguguucaug

SEQ ID NO: 53128 - RNA, 21 nt, Human
ucuguggcagcaugaugaggu

SEQ ID NO: 53129 - RNA, 22 nt, Human
ucuguggcauagugcuugggaa

SEQ ID NO: 53130 - RNA, 23 nt, Human
ucuguggccccuucgccccacuc

SEQ ID NO: 53131 - RNA, 22 nt, Human
ucuguggccuguguccaagugc

SEQ ID NO: 53132 - RNA, 19 nt, Human
ucuguggcuguggggagga

SEQ ID NO: 53133 - RNA, 22 nt, Human
ucuguggcuguuaucuuuauau

SEQ ID NO: 53134 - RNA, 18 nt, Human
ucugugggaucagugagg

SEQ ID NO: 53135 - RNA, 22 nt, Human
ucugugggcauuuauaaucugg

SEQ ID NO: 53136 - RNA, 22 nt, Human
ucugugggugccuccagcagug

SEQ ID NO: 53137 - RNA, 21 nt, Human
ucugugguauggccaucuucc

SEQ ID NO: 53138 - RNA, 23 nt, Human
ucuguguagccaggucuggaggg

SEQ ID NO: 53139 - RNA, 22 nt, Human
ucuguguccugcuagcugucuu

SEQ ID NO: 53140 - RNA, 22 nt, Human
ucugugucguucugugcucugg

SEQ ID NO: 53141 - RNA, 22 nt, Human
ucugugucugcagaaguucagc

SEQ ID NO: 53142 - RNA, 22 nt, Human
ucugugugauuucagggaaguc

SEQ ID NO: 53143 - RNA, 20 nt, Human
ucugugugccaucaccuaac

SEQ ID NO: 53144 - RNA, 22 nt, Human
ucugugugggauaguuugagga

SEQ ID NO: 53145 - RNA, 22 nt, Human
ucuguguguugucaggaggauu

SEQ ID NO: 53146 - RNA, 22 nt, Human
ucuguguugagaaggaucauga

SEQ ID NO: 53147 - RNA, 22 nt, Human
ucuguuaacaggagagaaugau

SEQ ID NO: 53148 - RNA, 22 nt, Human
ucuguuagcugucaaaguguuu

SEQ ID NO: 53149 - RNA, 22 nt, Human
ucuguuauacaacaaguaacag

SEQ ID NO: 53150 - RNA, 20 nt, Human
ucuguuauuauuacauugcc

SEQ ID NO: 53151 - RNA, 22 nt, Human
ucuguuauucugucuauugcca

SEQ ID NO: 53152 - RNA, 22 nt, Human
ucuguucagaauuguaacacuc

SEQ ID NO: 53153 - RNA, 19 nt, Human
uaaguagucaaauaguaac

SEQ ID NO: 53154 - RNA, 22 nt, Human
uaaguauguuagaaaaucaagu

SEQ ID NO: 53155 - RNA, 22 nt, Human
uaaguauuggccuauagcuaga

SEQ ID NO: 53156 - RNA, 22 nt, Human
uaagucaguagaacugugguca

SEQ ID NO: 53157 - RNA, 22 nt, Human
uaagucaucacauugcagagau

SEQ ID NO: 53158 - RNA, 22 nt, Human
uaagucaucccauaacagugcu

SEQ ID NO: 53159 - RNA, 22 nt, Human
uaaguccuaauggcagaagucu

SEQ ID NO: 53160 - RNA, 22 nt, Human
uaaguccuagcuuugguaggaa

SEQ ID NO: 53161 - RNA, 22 nt, Human
uaaguccuauuccaggucucuc

SEQ ID NO: 53162 - RNA, 22 nt, Human
uaagucguggaugauucuucgg

SEQ ID NO: 53163 - RNA, 22 nt, Human
uaagugaauauuuucuucugua

SEQ ID NO: 53164 - RNA, 22 nt, Human
uaagugaauccuugagaagaaa

SEQ ID NO: 53165 - RNA, 22 nt, Human
uaagugagcccucagaguaugg

SEQ ID NO: 53166 - RNA, 22 nt, Human
uaagugaugaaagcagaugucu

SEQ ID NO: 53167 - RNA, 22 nt, Human
uaagugaugauaguaccuagaa

SEQ ID NO: 53168 - RNA, 22 nt, Human
uaagugaugucuugguuaauga

SEQ ID NO: 53169 - RNA, 21 nt, Human
uaagugcaaagagacagauac

SEQ ID NO: 53170 - RNA, 18 nt, Human
uaaguggacacaggucac

SEQ ID NO: 53171 - RNA, 22 nt, Human
uaagugggugaagaggaaauau

SEQ ID NO: 53172 - RNA, 22 nt, Human
uaagugucucucgaauuaugcu

SEQ ID NO: 53173 - RNA, 22 nt, Human
uaaguguuauuauucucacuuu

SEQ ID NO: 53174 - RNA, 19 nt, Human
uaaguguuggugaauuucu

SEQ ID NO: 53175 - RNA, 22 nt, Human
uaaguguuguuuucaagagaua

SEQ ID NO: 53176 - RNA, 22 nt, Human
uaaguuagaucuuaauuaaagu

SEQ ID NO: 53177 - RNA, 22 nt, Human
uaaguucagaguucucauuugu

SEQ ID NO: 53178 - RNA, 22 nt, Human
uaaguucugaguaaauacuguu

SEQ ID NO: 53179 - RNA, 22 nt, Human
uaaguugauuauaaccacugga

SEQ ID NO: 53180 - RNA, 22 nt, Human
uaaguuuaccacuuucagaauu

SEQ ID NO: 53181 - RNA, 22 nt, Human
uaauaagucuguuguuuaauug

SEQ ID NO: 53182 - RNA, 21 nt, Human
uaauaauuccacuacagagua

SEQ ID NO: 53183 - RNA, 22 nt, Human
uaauacacaagggccagcucuu

SEQ ID NO: 53184 - RNA, 22 nt, Human
uaauacagauacaaaggaggac

SEQ ID NO: 53185 - RNA, 22 nt, Human
uaauaccuagagaugauacaaa

SEQ ID NO: 53186 - RNA, 22 nt, Human
uaauacugaaagggaaaugucc

SEQ ID NO: 53187 - RNA, 21 nt, Human
uaauacugaaagugacaucug

SEQ ID NO: 53188 - RNA, 23 nt, Human
uaauacugcuucagaggcuuaga

SEQ ID NO: 53189 - RNA, 22 nt, Human
uaauacuuuugccuuguauuca

SEQ ID NO: 53190 - RNA, 22 nt, Human
guuagaaagugucugcuugggu

SEQ ID NO: 53191 - RNA, 22 nt, Human
guuagaauaaaaggucagagag

SEQ ID NO: 53192 - RNA, 22 nt, Human
guuagacaugcagaaucucagg

SEQ ID NO: 53193 - RNA, 22 nt, Human
guuagaccauagaaagagcauc

SEQ ID NO: 53194 - RNA, 22 nt, Human
guuagagggaaaaaucauuugc

SEQ ID NO: 53195 - RNA, 22 nt, Human
guuagcaaaauguuuuugaggc

SEQ ID NO: 53196 - RNA, 22 nt, Human
guuagcaugauuccugcucauu

SEQ ID NO: 53197 - RNA, 22 nt, Human
guuaggaauuuguuacugugua

SEQ ID NO: 53198 - RNA, 22 nt, Human
guuaggauguggggacuuuggg

SEQ ID NO: 53199 - RNA, 22 nt, Human
guuaggcagcccaagaugucag

SEQ ID NO: 53200 - RNA, 22 nt, Human
guuaggcagugugguauagcag

SEQ ID NO: 53201 - RNA, 22 nt, Human
guuaggcaugaguguguauuaa

SEQ ID NO: 53202 - RNA, 22 nt, Human
guuagugcuuauuaaauaguau

SEQ ID NO: 53203 - RNA, 22 nt, Human
guuaguuugaacuugucuaugu

SEQ ID NO: 53204 - RNA, 22 nt, Human
guuauaaaggugauaaugguca

SEQ ID NO: 53205 - RNA, 22 nt, Human
guuauaaaugacugcaaaaguu

SEQ ID NO: 53206 - RNA, 21 nt, Human
guuauacauucuauggauuug

SEQ ID NO: 53207 - RNA, 22 nt, Human
guuauacuuaugugcaaaaaua

SEQ ID NO: 53208 - RNA, 20 nt, Human
guuauaggagagggaauuau

SEQ ID NO: 53209 - RNA, 22 nt, Human
guuauauucaaaaugaggcugu

SEQ ID NO: 53210 - RNA, 22 nt, Human
guuauauugccaaguauauugu

SEQ ID NO: 53211 - RNA, 22 nt, Human
guuaucaugcuucaucaucacu

SEQ ID NO: 53212 - RNA, 22 nt, Human
guuaugaagucauucacaaaua

SEQ ID NO: 53213 - RNA, 22 nt, Human
guuauguaaucuaacacucagu

SEQ ID NO: 53214 - RNA, 22 nt, Human
guuauguacuuuuuaaaucuug

SEQ ID NO: 53215 - RNA, 22 nt, Human
guuauguaugggggccuuauga

SEQ ID NO: 53216 - RNA, 22 nt, Human
guuauucaacuugugucucuua

SEQ ID NO: 53217 - RNA, 18 nt, Human
guuauucucucugcagua

SEQ ID NO: 53218 - RNA, 22 nt, Human
guuauucucuuggccuaauuau

SEQ ID NO: 53219 - RNA, 22 nt, Human
guuauucuugguggcccugcug

SEQ ID NO: 53220 - RNA, 21 nt, Human
guuauugaccuccaggcuggc

SEQ ID NO: 53221 - RNA, 22 nt, Human
guuauuguccauuuauuuagca

SEQ ID NO: 53222 - RNA, 22 nt, Human
guuauuguguuuguucagggca

SEQ ID NO: 53223 - RNA, 22 nt, Human
guuauuuaacuuuguagcaugg

SEQ ID NO: 53224 - RNA, 22 nt, Human
guuauuuuaucucugagagguu

SEQ ID NO: 53225 - RNA, 22 nt, Human
guucaaagcuccugguacagua

SEQ ID NO: 53226 - RNA, 22 nt, Human
guucaaaggccuguggaaaggg

SEQ ID NO: 53227 - RNA, 21 nt, Human
guucaaauccugacacuacac

SEQ ID NO: 53228 - RNA, 22 nt, Human
guucaaaucucaggacuucaga

SEQ ID NO: 53229 - RNA, 22 nt, Human
guucaaauugauuuugguaaag

SEQ ID NO: 53230 - RNA, 22 nt, Human
guucaagguuuuacagagugua

SEQ ID NO: 53231 - RNA, 21 nt, Human
guucaaguauuuuuuucgcug

SEQ ID NO: 53232 - RNA, 22 nt, Human
guucaagugucaaguguuggaa

SEQ ID NO: 53233 - RNA, 22 nt, Human
guucaaguuaugccuuuacccu

SEQ ID NO: 53234 - RNA, 22 nt, Human
guucacagcaaaccuaugaacu

SEQ ID NO: 53235 - RNA, 22 nt, Human
guucacagggauccuuguugaa

SEQ ID NO: 53236 - RNA, 22 nt, Human
guucacagguucucuuucuaag

SEQ ID NO: 53237 - RNA, 22 nt, Human
guucacaguucagccuguaaca

SEQ ID NO: 53238 - RNA, 22 nt, Human
guucacaguuuuauaccugaga

SEQ ID NO: 53239 - RNA, 22 nt, Human
guucacaucacuucacugaacc

SEQ ID NO: 53240 - RNA, 22 nt, Human
guucacauuaacucaccggugc

SEQ ID NO: 53241 - RNA, 22 nt, Human
guucagauuucaugaguaauug

SEQ ID NO: 53242 - RNA, 22 nt, Human
guucagcaaguacucaguccac

SEQ ID NO: 53243 - RNA, 22 nt, Human
guucagcacaggugcucagaca

SEQ ID NO: 53244 - RNA, 22 nt, Human
guucagggagggacagaugaag

SEQ ID NO: 53245 - RNA, 22 nt, Human
guucagugguguauccccagug

SEQ ID NO: 53246 - RNA, 22 nt, Human
guucagugucucucuauuuuau

SEQ ID NO: 53247 - RNA, 22 nt, Human
guucauauuuaacuaagauagg

SEQ ID NO: 53248 - RNA, 22 nt, Human
guucaucacucagagaccuccc

SEQ ID NO: 53249 - RNA, 22 nt, Human
guucauccaugucagcguauau

SEQ ID NO: 53250 - RNA, 22 nt, Human
guucaugcuacccuuuccuaau

SEQ ID NO: 53251 - RNA, 22 nt, Human
guucauguuuguguauugcuca

SEQ ID NO: 53252 - RNA, 22 nt, Human
guucauucaaucuauuugcuuc

SEQ ID NO: 53253 - RNA, 22 nt, Human
guucauucaucaaauauuuacu

SEQ ID NO: 53254 - RNA, 22 nt, Human
guucauuuaggaaaggaagagu

SEQ ID NO: 53255 - RNA, 22 nt, Human
guucauuuuucccuaaugagua

SEQ ID NO: 53256 - RNA, 22 nt, Human
guuccaaacaagucauaaagua

SEQ ID NO: 53257 - RNA, 22 nt, Human
guuccaaagcaaaggaggugag

SEQ ID NO: 53258 - RNA, 22 nt, Human
guuccaaagucucugagcugag

SEQ ID NO: 53259 - RNA, 22 nt, Human
guuccaaaguuagaguguauug

SEQ ID NO: 53260 - RNA, 22 nt, Human
guuccaaauuuggaucuuuagg

SEQ ID NO: 53261 - RNA, 22 nt, Human
guuccaggcaagugggauagga

SEQ ID NO: 53262 - RNA, 20 nt, Human
ucuugcagcuccuguaccau

SEQ ID NO: 53263 - RNA, 22 nt, Human
ucuugcagcuucaucugcaauu

SEQ ID NO: 53264 - RNA, 22 nt, Human
ucuugcaguugcgcagugcaug

SEQ ID NO: 53265 - RNA, 22 nt, Human
ucuugcauacacuauauguaca

SEQ ID NO: 53266 - RNA, 22 nt, Human
ucuugcaugauauucuguauuu

SEQ ID NO: 53267 - RNA, 22 nt, Human
ucuugcauuucagaguucagag

SEQ ID NO: 53268 - RNA, 22 nt, Human
ucuugcuaaagaccaacacauu

SEQ ID NO: 53269 - RNA, 22 nt, Human
ucuugcugagacuggcaaguuu

SEQ ID NO: 53270 - RNA, 22 nt, Human
ucuugcuucugcucaaggggag

SEQ ID NO: 53271 - RNA, 18 nt, Human
ucuuggaguaaugaucaa

SEQ ID NO: 53272 - RNA, 22 nt, Human
ucuuggcaaauuuuugaggcuc

SEQ ID NO: 53273 - RNA, 22 nt, Human
ucuuggcaguggaauaccagga

SEQ ID NO: 53274 - RNA, 22 nt, Human
ucuuggcaugcaugggcaauca

SEQ ID NO: 53275 - RNA, 22 nt, Human
ucuuggccagaugcacuuccuc

SEQ ID NO: 53276 - RNA, 22 nt, Human
ucuuggcuauccaaguuaucca

SEQ ID NO: 53277 - RNA, 22 nt, Human
ucuuggcuccuguugucaucag

SEQ ID NO: 53278 - RNA, 22 nt, Human
ucuuggcuggucauuuaaaauc

SEQ ID NO: 53279 - RNA, 20 nt, Human
ucuuggcugugugaggacac

SEQ ID NO: 53280 - RNA, 22 nt, Human
ucuuggcuuucuccuagggaug

SEQ ID NO: 53281 - RNA, 19 nt, Human
ucuuggcuuugucuacugu

SEQ ID NO: 53282 - RNA, 22 nt, Human
ucuugggauagugucucauggc

SEQ ID NO: 53283 - RNA, 22 nt, Human
ucuugggaucucuucaccaccu

SEQ ID NO: 53284 - RNA, 22 nt, Human
ucuugggcauguguuugauuuc

SEQ ID NO: 53285 - RNA, 21 nt, Human
ucuuggggaggagggcugcac

SEQ ID NO: 53286 - RNA, 22 nt, Human
ucuugguauacgcauggcauug

SEQ ID NO: 53287 - RNA, 21 nt, Human
ucuugguuccguguguuugau

SEQ ID NO: 53288 - RNA, 22 nt, Human
ucuuguaauuaacuagaaagau

SEQ ID NO: 53289 - RNA, 22 nt, Human
ucuugucaugcccuugguaacu

SEQ ID NO: 53290 - RNA, 22 nt, Human
ucuugugcuugcagcuggggag

SEQ ID NO: 53291 - RNA, 22 nt, Human
ucuuguuaaagugaagauacug

SEQ ID NO: 53292 - RNA, 22 nt, Human
ucuuguuucuucuaagcagcag

SEQ ID NO: 53293 - RNA, 22 nt, Human
ucuuguuuggauuuugggcagu

SEQ ID NO: 53294 - RNA, 23 nt, Human
ucuuuacagcagcaggauuugga

SEQ ID NO: 53295 - RNA, 23 nt, Human
ucuuuacauacugaugaguucuc

SEQ ID NO: 53296 - RNA, 22 nt, Human
ucuuuacauaguguggacuacu

SEQ ID NO: 53297 - RNA, 22 nt, Human
ucuuuacuggaauggaacuuuc

SEQ ID NO: 53298 - RNA, 22 nt, Human
ucuuuacuuguguauuguauau

SEQ ID NO: 53299 - RNA, 23 nt, Human
ucuuuagaagaacaucagaaaug

SEQ ID NO: 53300 - RNA, 22 nt, Human
ucuuuagagccuuuccucccga

SEQ ID NO: 53301 - RNA, 22 nt, Human
ucuuuagagcucagaaauacag

SEQ ID NO: 53302 - RNA, 20 nt, Human
ucuuuagauuuaucuuaugu

SEQ ID NO: 53303 - RNA, 19 nt, Human
ucuuuagccagagcucugg

SEQ ID NO: 53304 - RNA, 22 nt, Human
ucuuuagcuagaaauacucuaa

SEQ ID NO: 53305 - RNA, 20 nt, Human
ucuuuaguuccuggcccuuu

SEQ ID NO: 53306 - RNA, 22 nt, Human
ucuuuauaaaagucauuauguc

SEQ ID NO: 53307 - RNA, 21 nt, Human
ucuuuaugacuugcccauuug

SEQ ID NO: 53308 - RNA, 22 nt, Human
uacacagaggcagcugucugcu

SEQ ID NO: 53309 - RNA, 22 nt, Human
uacacagauuucaguaucauca

SEQ ID NO: 53310 - RNA, 22 nt, Human
uacacagccuguaaugaugacu

SEQ ID NO: 53311 - RNA, 22 nt, Human
uacacaguagaguauaaugcgu

SEQ ID NO: 53312 - RNA, 22 nt, Human
uacacaguauaugggaucacag

SEQ ID NO: 53313 - RNA, 22 nt, Human
uacacaguuccauuuaagccag

SEQ ID NO: 53314 - RNA, 22 nt, Human
uacacauaaaaugcucauggua

SEQ ID NO: 53315 - RNA, 22 nt, Human
uacacauacaccaaugugguca

SEQ ID NO: 53316 - RNA, 22 nt, Human
uacacaucacuguaucuuucag

SEQ ID NO: 53317 - RNA, 22 nt, Human
uacacauccuucugaacaaccu

SEQ ID NO: 53318 - RNA, 22 nt, Human
uacacaucucugucaguaguga

SEQ ID NO: 53319 - RNA, 22 nt, Human
uacacaucuggagaagcccugu

SEQ ID NO: 53320 - RNA, 22 nt, Human
uacacaugacaguggacugaga

SEQ ID NO: 53321 - RNA, 22 nt, Human
uacacaugcucagauuccugug

SEQ ID NO: 53322 - RNA, 22 nt, Human
uacacauguauuuauguguaca

SEQ ID NO: 53323 - RNA, 22 nt, Human
uacacauuacauaauacuaucu

SEQ ID NO: 53324 - RNA, 22 nt, Human
uacaccagguguuauggucaau

SEQ ID NO: 53325 - RNA, 22 nt, Human
uacaccagguuaccaaucacug

SEQ ID NO: 53326 - RNA, 22 nt, Human
uacaccaguaucuuaagcauga

SEQ ID NO: 53327 - RNA, 22 nt, Human
uacacugagcaggaagaagugg

SEQ ID NO: 53328 - RNA, 22 nt, Human
uacacuggauuagcuguccuac

SEQ ID NO: 53329 - RNA, 22 nt, Human
uacacuguacgcucugcuucaa

SEQ ID NO: 53330 - RNA, 22 nt, Human
uacacugucagauuucgauugc

SEQ ID NO: 53331 - RNA, 22 nt, Human
uacacugugagguuuccaaggg

SEQ ID NO: 53332 - RNA, 19 nt, Human
uacacuuguaaugagcaga

SEQ ID NO: 53333 - RNA, 22 nt, Human
uacacuuguucaaacagcaaaa

SEQ ID NO: 53334 - RNA, 22 nt, Human
uacagaaaaacuggcauugaag

SEQ ID NO: 53335 - RNA, 22 nt, Human
uacagaaacagcgugguuagaa

SEQ ID NO: 53336 - RNA, 22 nt, Human
uacagaagcuuuugaaaagaug

SEQ ID NO: 53337 - RNA, 23 nt, Human
uacagaaggaguagucacuaaga

SEQ ID NO: 53338 - RNA, 22 nt, Human
uacagaaguaaauaccaaaagc

SEQ ID NO: 53339 - RNA, 22 nt, Human
uacagaaguugguuuuaguuua

SEQ ID NO: 53340 - RNA, 22 nt, Human
uacagaauauagaagcuggaag

SEQ ID NO: 53341 - RNA, 22 nt, Human
uacagaauauuucugcccugag

SEQ ID NO: 53342 - RNA, 22 nt, Human
uacagaaucuaugcuucacagu

SEQ ID NO: 53343 - RNA, 21 nt, Human
uacagaaugcgcuucagucug

SEQ ID NO: 53344 - RNA, 22 nt, Human
uacagaauguuaugaagcauag

SEQ ID NO: 53345 - RNA, 22 nt, Human
uacagacaaagugcuauagggu

SEQ ID NO: 53346 - RNA, 20 nt, Human
uacagacaugacaauaaugg

SEQ ID NO: 53347 - RNA, 22 nt, Human
uacagagacccacaagagacug

SEQ ID NO: 53348 - RNA, 22 nt, Human
uacagagacuuuauggcacaaa

SEQ ID NO: 53349 - RNA, 22 nt, Human
uacagagagauaaguguaaaag

SEQ ID NO: 53350 - RNA, 22 nt, Human
uacagagaugccgaagagugaa

SEQ ID NO: 53351 - RNA, 22 nt, Human
uacagaggagaccaaggcucag

SEQ ID NO: 53352 - RNA, 22 nt, Human
uacagaggaggugguugggagu

SEQ ID NO: 53353 - RNA, 22 nt, Human
uacagaggggacauggaagaca

SEQ ID NO: 53354 - RNA, 22 nt, Human
uacagauauagggcgagcuuag

SEQ ID NO: 53355 - RNA, 22 nt, Human
uacagauauguuccaugcaucg

SEQ ID NO: 53356 - RNA, 22 nt, Human
uacagauauuguacaguuauag

SEQ ID NO: 53357 - RNA, 21 nt, Human
uacagaugaggagaccaaggc

SEQ ID NO: 53358 - RNA, 22 nt, Human
uacagauugagguuuuuaauau

SEQ ID NO: 53359 - RNA, 22 nt, Human
uacagcaaagaaacccucaguc

SEQ ID NO: 53360 - RNA, 21 nt, Human
uacagcaacggagguuuucua

SEQ ID NO: 53361 - RNA, 22 nt, Human
uacagcacggugcauuuacuac

SEQ ID NO: 53362 - RNA, 22 nt, Human
uacagcagggcgcugugaugaa

SEQ ID NO: 53363 - RNA, 22 nt, Human
uacagcauauacagaaugaaca

SEQ ID NO: 53364 - RNA, 22 nt, Human
uacagcauugcauuuuccuuug

SEQ ID NO: 53365 - RNA, 20 nt, Human
uacagccccugcuucuguug

SEQ ID NO: 53366 - RNA, 20 nt, Human
uacagccuauucaccacaua

SEQ ID NO: 53367 - RNA, 22 nt, Human
uacagccucgaacuccugcauu

SEQ ID NO: 53368 - RNA, 22 nt, Human
uacagccuguuaccuauauuug

SEQ ID NO: 53369 - RNA, 22 nt, Human
uacagcgaaaauuuagcuugau

SEQ ID NO: 53370 - RNA, 22 nt, Human
uacagcuccaaaaaucacuguu

SEQ ID NO: 53371 - RNA, 22 nt, Human
uaagcacuuuauaugcuuuauc

SEQ ID NO: 53372 - RNA, 22 nt, Human
uaagcaguuuuucuuguauuaa

SEQ ID NO: 53373 - RNA, 21 nt, Human
uaagcauaucagauagacucu

SEQ ID NO: 53374 - RNA, 22 nt, Human
uaagcauauuccagucaugucc

SEQ ID NO: 53375 - RNA, 22 nt, Human
uaagcauuguuucugaggaugg

SEQ ID NO: 53376 - RNA, 22 nt, Human
uaagccaaaaucaggacacaga

SEQ ID NO: 53377 - RNA, 21 nt, Human
uaagccaccaugugaaaccag

SEQ ID NO: 53378 - RNA, 22 nt, Human
uaagccacuagucuguuaugaa

SEQ ID NO: 53379 - RNA, 22 nt, Human
uaagccacugagauuugggguu

SEQ ID NO: 53380 - RNA, 22 nt, Human
uaagccagauacaccacugaaa

SEQ ID NO: 53381 - RNA, 22 nt, Human
uaagccaucaucauggcuuugg

SEQ ID NO: 53382 - RNA, 22 nt, Human
uaagccugguucauaauuugcu

SEQ ID NO: 53383 - RNA, 22 nt, Human
uaaggaaaguacauguuuugac

SEQ ID NO: 53384 - RNA, 22 nt, Human
uaaggaaggggaaagacauguc

SEQ ID NO: 53385 - RNA, 22 nt, Human
uaaggacagcagcuacuuuucc

SEQ ID NO: 53386 - RNA, 22 nt, Human
uaaggacauuagaaaugaugcu

SEQ ID NO: 53387 - RNA, 22 nt, Human
uaaggaggcagucauuaucagg

SEQ ID NO: 53388 - RNA, 22 nt, Human
uaaggaggcugcugugaagaaa

SEQ ID NO: 53389 - RNA, 22 nt, Human
uaaggagggggaaugauuggca

SEQ ID NO: 53390 - RNA, 22 nt, Human
uaaggaggugcccacucucagg

SEQ ID NO: 53391 - RNA, 22 nt, Human
uaaggcaaacaggaaagcaggc

SEQ ID NO: 53392 - RNA, 22 nt, Human
uaaggcaaaggggaaguuauca

SEQ ID NO: 53393 - RNA, 22 nt, Human
uaaggcaaagugauuucuuaaa

SEQ ID NO: 53394 - RNA, 22 nt, Human
uaaggcaagagcagggucuuug

SEQ ID NO: 53395 - RNA, 22 nt, Human
uaaggcacccauguucauacag

SEQ ID NO: 53396 - RNA, 22 nt, Human
uaaggcacccuucugaguagag

SEQ ID NO: 53397 - RNA, 22 nt, Human
uaaggcaccuguccaggcuggg

SEQ ID NO: 53398 - RNA, 22 nt, Human
uaaggcagaaauaugagcaggg

SEQ ID NO: 53399 - RNA, 22 nt, Human
uaaggcagccucaggguagggu

SEQ ID NO: 53400 - RNA, 22 nt, Human
uaaggcaggaacuggcuguuuu

SEQ ID NO: 53401 - RNA, 22 nt, Human
uaaggcaggcuuucauccagag

SEQ ID NO: 53402 - RNA, 22 nt, Human
uaaggcagguagaugacuacgg

SEQ ID NO: 53403 - RNA, 22 nt, Human
uaaggcaguagugucuguaggg

SEQ ID NO: 53404 - RNA, 22 nt, Human
uaaggcaugaguuuauuucaua

SEQ ID NO: 53405 - RNA, 22 nt, Human
uaaggcaugcuagcaguaugaa

SEQ ID NO: 53406 - RNA, 22 nt, Human
uaaggcauuauagagacagccu

SEQ ID NO: 53407 - RNA, 22 nt, Human
uaaggcauucucaugcugugaa

SEQ ID NO: 53408 - RNA, 23 nt, Human
uaaggcauuuuuucuguaucagu

SEQ ID NO: 53409 - RNA, 22 nt, Human
uaaggccaaacuauuauaguuc

SEQ ID NO: 53410 - RNA, 22 nt, Human
uaaggccaaguucauauacaac

SEQ ID NO: 53411 - RNA, 22 nt, Human
uaaggccaauuacauauguuca

SEQ ID NO: 53412 - RNA, 22 nt, Human
uaaggccagcaugaaugcagca

SEQ ID NO: 53413 - RNA, 20 nt, Human
uaaggcuguuuuguauuccu

SEQ ID NO: 53414 - RNA, 22 nt, Human
uaaggcuuauauacuuagacau

SEQ ID NO: 53415 - RNA, 22 nt, Human
uaaggcuucuuggaauacugca

SEQ ID NO: 53416 - RNA, 22 nt, Human
uaaggcuuuauuuuuacaaugc

SEQ ID NO: 53417 - RNA, 17 nt, Human
uaagggggaaacggagc

SEQ ID NO: 53418 - RNA, 22 nt, Human
uaagguaauuguugcugaaauu

SEQ ID NO: 53419 - RNA, 22 nt, Human
uaaggucauggugaauaauaag

SEQ ID NO: 53420 - RNA, 22 nt, Human
uaagguuucuaguuucuaaacu

SEQ ID NO: 53421 - RNA, 22 nt, Human
uaagguuugaagaagacugagc

SEQ ID NO: 53422 - RNA, 22 nt, Human
uaagguuugcuuaucuucgccu

SEQ ID NO: 53423 - RNA, 22 nt, Human
uaagguuuguggggagcaaaag

SEQ ID NO: 53424 - RNA, 22 nt, Human
uaaguaauuugugcagagauac

SEQ ID NO: 53425 - RNA, 22 nt, Human
uaaguacauuugggaccaccug

SEQ ID NO: 53426 - RNA, 22 nt, Human
uaaguaguuuguagccccauag

SEQ ID NO: 53427 - RNA, 22 nt, Human
uaagucaggaggucuccugaca

SEQ ID NO: 53428 - RNA, 22 nt, Human
uaagucauagauuaauggccac

SEQ ID NO: 53429 - RNA, 22 nt, Human
uaagucauggagcugggauuga

SEQ ID NO: 53430 - RNA, 22 nt, Human
uaagucauuaggcugaguucaa

SEQ ID NO: 53431 - RNA, 18 nt, Human
uaagucauuuugccagca

SEQ ID NO: 53432 - RNA, 22 nt, Human
uaaguccaccucauucuucagc

SEQ ID NO: 53433 - RNA, 22 nt, Human
uaaguccaguguucucucugug

SEQ ID NO: 53434 - RNA, 22 nt, Human
uaaguccuagaugauucacaga

SEQ ID NO: 53435 - RNA, 22 nt, Human
uaagugaaauaagucagauaca

SEQ ID NO: 53436 - RNA, 22 nt, Human
uaagugagaaagacauuaacug

SEQ ID NO: 53437 - RNA, 22 nt, Human
uaagugaugaagaccuguuugg

SEQ ID NO: 53438 - RNA, 22 nt, Human
uaagugaugagcacaguaauua

SEQ ID NO: 53439 - RNA, 23 nt, Human
uaagugauuccaaguuucaggga

SEQ ID NO: 53440 - RNA, 22 nt, Human
uaagugauuuguaguauacuau

SEQ ID NO: 53441 - RNA, 22 nt, Human
uaagugcaugauugaacuuggc

SEQ ID NO: 53442 - RNA, 22 nt, Human
uaaguggaagguuauaugcuaa

SEQ ID NO: 53443 - RNA, 19 nt, Human
ugacugccucaggggugga

SEQ ID NO: 53444 - RNA, 22 nt, Human
ugacuggauugucauuacgacg

SEQ ID NO: 53445 - RNA, 22 nt, Human
ugacugugccgugccccuagga

SEQ ID NO: 53446 - RNA, 22 nt, Human
ugacuuuaaagcucacucuuuu

SEQ ID NO: 53447 - RNA, 22 nt, Human
ugacuuuagaauuuuauccaga

SEQ ID NO: 53448 - RNA, 22 nt, Human
ugacuuuagacuuagucaaguu

SEQ ID NO: 53449 - RNA, 22 nt, Human
ugacuuugugcaagugaauuau

SEQ ID NO: 53450 - RNA, 22 nt, Human
ugacuuuuggaccucacugucc

SEQ ID NO: 53451 - RNA, 22 nt, Human
ugagaaaaguguggaggucaau

SEQ ID NO: 53452 - RNA, 22 nt, Human
ugagaaaauccagaggcuaguu

SEQ ID NO: 53453 - RNA, 18 nt, Human
ugagaaacugacacaugg

SEQ ID NO: 53454 - RNA, 22 nt, Human
ugagaaagugggugccuagcaa

SEQ ID NO: 53455 - RNA, 22 nt, Human
ugagaaauuacuucagugaugg

SEQ ID NO: 53456 - RNA, 22 nt, Human
ugagaaauucgacauauauuua

SEQ ID NO: 53457 - RNA, 18 nt, Human
ugagaaccauguucauuc

SEQ ID NO: 53458 - RNA, 18 nt, Human
ugagaacuaggcauugca

SEQ ID NO: 53459 - RNA, 22 nt, Human
ugagaacugccuguauuuaucu

SEQ ID NO: 53460 - RNA, 22 nt, Human
ugagaacuugugcuauugcaca

SEQ ID NO: 53461 - RNA, 22 nt, Human
ugagaagauuugcucuucugag

SEQ ID NO: 53462 - RNA, 22 nt, Human
ugagaagcauuaggaagaacau

SEQ ID NO: 53463 - RNA, 22 nt, Human
ugagaagcccacacucuuuccu

SEQ ID NO: 53464 - RNA, 22 nt, Human
ugagaaggcucaggcuuagaga

SEQ ID NO: 53465 - RNA, 19 nt, Human
ugagaagguuuccgugggu

SEQ ID NO: 53466 - RNA, 21 nt, Human
ugagaaguaugucuucagcca

SEQ ID NO: 53467 - RNA, 22 nt, Human
ugagaauaacagccuguguucc

SEQ ID NO: 53468 - RNA, 22 nt, Human
ugagaauaagagauaguuuauu

SEQ ID NO: 53469 - RNA, 22 nt, Human
ugagaauacugcauuguuagga

SEQ ID NO: 53470 - RNA, 22 nt, Human
ugagaaucagcugcacagaggu

SEQ ID NO: 53471 - RNA, 18 nt, Human
ugagaauguaagaaaugg

SEQ ID NO: 53472 - RNA, 22 nt, Human
ugagaauuacaaaugagucaca

SEQ ID NO: 53473 - RNA, 22 nt, Human
ugagaauuugcauuucuaacaa

SEQ ID NO: 53474 - RNA, 22 nt, Human
ugagacaaaauugacagacaaa

SEQ ID NO: 53475 - RNA, 22 nt, Human
ugagacacucucgggcacauuu

SEQ ID NO: 53476 - RNA, 22 nt, Human
ugagacaggcuuccuucuuggg

SEQ ID NO: 53477 - RNA, 22 nt, Human
ugagacaguaauuguauaguuu

SEQ ID NO: 53478 - RNA, 22 nt, Human
ugagaccuguaaugagaaauug

SEQ ID NO: 53479 - RNA, 22 nt, Human
ugagaccuuaaaagguauguca

SEQ ID NO: 53480 - RNA, 22 nt, Human
uaauauguguuacugacuuuuu

SEQ ID NO: 53481 - RNA, 22 nt, Human
uaaucacaauucagaugucuua

SEQ ID NO: 53482 - RNA, 22 nt, Human
uaaucacuuuucauuaguaccu

SEQ ID NO: 53483 - RNA, 19 nt, Human
uaauccaaggcugcucuua

SEQ ID NO: 53484 - RNA, 22 nt, Human
uaauccagcgggugauugcaca

SEQ ID NO: 53485 - RNA, 22 nt, Human
uaauccguacauuauucugaac

SEQ ID NO: 53486 - RNA, 22 nt, Human
uaauccugaucaauuuuagcuu

SEQ ID NO: 53487 - RNA, 22 nt, Human
uaauccuggugaguuugaaaaa

SEQ ID NO: 53488 - RNA, 22 nt, Human
uaauccuuuaugguuuuccucc

SEQ ID NO: 53489 - RNA, 22 nt, Human
uaaucuagaacauaugagagca

SEQ ID NO: 53490 - RNA, 22 nt, Human
uaaucuagucccacauggaauu

SEQ ID NO: 53491 - RNA, 22 nt, Human
uaaucucuuuuaggacagagcc

SEQ ID NO: 53492 - RNA, 22 nt, Human
uaaucuguauuccuacuuugca

SEQ ID NO: 53493 - RNA, 22 nt, Human
uaaucuguugacuaacuuggga

SEQ ID NO: 53494 - RNA, 22 nt, Human
uaaugaacaucuuaaucugaaa

SEQ ID NO: 53495 - RNA, 22 nt, Human
uaaugacuaagcaucauuaaac

SEQ ID NO: 53496 - RNA, 22 nt, Human
uaaugagacucaauugugugug

SEQ ID NO: 53497 - RNA, 22 nt, Human
uaaugcaauuuagcaaaguuuu

SEQ ID NO: 53498 - RNA, 22 nt, Human
uaaugcaggugcccuuggguuu

SEQ ID NO: 53499 - RNA, 22 nt, Human
uaaugcaguagguauuaaagaa

SEQ ID NO: 53500 - RNA, 22 nt, Human
uaaugccacggcagggaacagc

SEQ ID NO: 53501 - RNA, 22 nt, Human
uaaugcugccaagccaugcaga

SEQ ID NO: 53502 - RNA, 22 nt, Human
uaauggagauuuagcacuuacg

SEQ ID NO: 53503 - RNA, 22 nt, Human
uaauggauuaacgucccugucg

SEQ ID NO: 53504 - RNA, 22 nt, Human
uaauggcauugauuacaugaaa

SEQ ID NO: 53505 - RNA, 22 nt, Human
uaaugguuuuuuggagacugcu

SEQ ID NO: 53506 - RNA, 22 nt, Human
uaauguaccuccagauguugua

SEQ ID NO: 53507 - RNA, 22 nt, Human
uaaugucuaugggccagauaau

SEQ ID NO: 53508 - RNA, 22 nt, Human
uaaugugauauuccuguccuuu

SEQ ID NO: 53509 - RNA, 22 nt, Human
uaaugugugucaucaguagagu

SEQ ID NO: 53510 - RNA, 22 nt, Human
uaauguuacacugcaugguuca

SEQ ID NO: 53511 - RNA, 22 nt, Human
uaauuacuggaaauuucaaaua

SEQ ID NO: 53512 - RNA, 23 nt, Human
uaauuagauguugauuccugaga

SEQ ID NO: 53513 - RNA, 22 nt, Human
uaauuaguguccagcuucugcu

SEQ ID NO: 53514 - RNA, 22 nt, Human
uaauuauaaacugcaguaggua

SEQ ID NO: 53515 - RNA, 22 nt, Human
uaauuauaacaugcuuucuggc

SEQ ID NO: 53516 - RNA, 22 nt, Human
uaauuauugucugaagaguuau

SEQ ID NO: 53517 - RNA, 22 nt, Human
uaauucagcugaacaacugugu

SEQ ID NO: 53518 - RNA, 22 nt, Human
uaauuccaaguugagacaugca

SEQ ID NO: 53519 - RNA, 22 nt, Human
uaauuccaccuuuuuccaacuu

SEQ ID NO: 53520 - RNA, 22 nt, Human
uaauuccuagaaauuauucuca

SEQ ID NO: 53521 - RNA, 22 nt, Human
uaauuccuuaagcugaagacuu

SEQ ID NO: 53522 - RNA, 22 nt, Human
uaauucuagauugacauuuuga

SEQ ID NO: 53523 - RNA, 22 nt, Human
uaauugaaaucauuucaauuca

SEQ ID NO: 53524 - RNA, 22 nt, Human
uaauugcagggagccugggggc

SEQ ID NO: 53525 - RNA, 22 nt, Human
uaauugcuaaaugaaggagaag

SEQ ID NO: 53526 - RNA, 22 nt, Human
uaauugcuauuuaaugugguga

SEQ ID NO: 53527 - RNA, 22 nt, Human
uaauugcugaacuacuaucccu

SEQ ID NO: 53528 - RNA, 22 nt, Human
uaauugcuuuauccuguuagaa

SEQ ID NO: 53529 - RNA, 22 nt, Human
uaauugucuuaggugugaugau

SEQ ID NO: 53530 - RNA, 22 nt, Human
uaauugucuuagucugugcagg

SEQ ID NO: 53531 - RNA, 22 nt, Human
uaauuuauagaauuucuuggau

SEQ ID NO: 53532 - RNA, 22 nt, Human
uaauuuaugaugcaaagaaaag

SEQ ID NO: 53533 - RNA, 22 nt, Human
uaauuuaugguauguguguaau

SEQ ID NO: 53534 - RNA, 21 nt, Human
uaauuuauucagcacaguguu

SEQ ID NO: 53535 - RNA, 22 nt, Human
uaauuuauuucaacugccaagg

SEQ ID NO: 53536 - RNA, 22 nt, Human
uaauuucuaauucauuuucagu

SEQ ID NO: 53537 - RNA, 22 nt, Human
uaauuucuagggacuaaggugc

SEQ ID NO: 53538 - RNA, 22 nt, Human
uaauuucuucaucucugcagcu

SEQ ID NO: 53539 - RNA, 20 nt, Human
uaauuugauaucuauaaguu

SEQ ID NO: 53540 - RNA, 22 nt, Human
uaauuuuaacugugcuguuugg

SEQ ID NO: 53541 - RNA, 22 nt, Human
uacaaacuaacaugucucaucc

SEQ ID NO: 53542 - RNA, 22 nt, Human
uacaaacuccgaaguuuguacc

SEQ ID NO: 53543 - RNA, 18 nt, Human
uacaaacuccuugaaggc

SEQ ID NO: 53544 - RNA, 22 nt, Human
uacaaacuuguuuuaaguaagu

SEQ ID NO: 53545 - RNA, 22 nt, Human
uacaaagagguaauugcauaua

SEQ ID NO: 53546 - RNA, 22 nt, Human
uacaaagaguuuggucucuaga

SEQ ID NO: 53547 - RNA, 22 nt, Human
uacaaagcaguuccaacacgaa

SEQ ID NO: 53548 - RNA, 22 nt, Human
uacaaagcuacucgagggcagg

SEQ ID NO: 53549 - RNA, 22 nt, Human
uacaaaggacagcagaaaaaua

SEQ ID NO: 53550 - RNA, 22 nt, Human
uacaaaggagacucuguauuua

SEQ ID NO: 53551 - RNA, 22 nt, Human
uacaaaggaguagagaaggcuu

SEQ ID NO: 53552 - RNA, 21 nt, Human
uacaaagggaaauucuggcuc

SEQ ID NO: 53553 - RNA, 22 nt, Human
uacaaaguaauguauaauaucg

SEQ ID NO: 53554 - RNA, 22 nt, Human
uacaaagucaccagcuucuugc

SEQ ID NO: 53555 - RNA, 22 nt, Human
uacaaagugaaauaauucugag

SEQ ID NO: 53556 - RNA, 22 nt, Human
uacaaagugauuuuggaauuga

SEQ ID NO: 53557 - RNA, 22 nt, Human
uacaaaguuugggguccucaaa

SEQ ID NO: 53558 - RNA, 22 nt, Human
uacaaaguuuucuuggauugag

SEQ ID NO: 53559 - RNA, 22 nt, Human
uacaaaugaccauagccacuua

SEQ ID NO: 53560 - RNA, 22 nt, Human
uacaaaugccugacacacagau

SEQ ID NO: 53561 - RNA, 22 nt, Human
uaguacaguuuaaauauuaaua

SEQ ID NO: 53562 - RNA, 22 nt, Human
uaguagcaggggguaccucuca

SEQ ID NO: 53563 - RNA, 22 nt, Human
uaguauuuaaucacuuuugucu

SEQ ID NO: 53564 - RNA, 22 nt, Human
uaguauuuauaaucaugcuuaa

SEQ ID NO: 53565 - RNA, 22 nt, Human
uaguauuuuagaaaaccaugaa

SEQ ID NO: 53566 - RNA, 22 nt, Human
uagucaaauggcagggauauuu

SEQ ID NO: 53567 - RNA, 22 nt, Human
uagucaaucaguauguauugga

SEQ ID NO: 53568 - RNA, 22 nt, Human
uagucacacaauuguguacauu

SEQ ID NO: 53569 - RNA, 22 nt, Human
uagucacuuuuuuaccaugugc

SEQ ID NO: 53570 - RNA, 22 nt, Human
uagucagggaugcaauuaugug

SEQ ID NO: 53571 - RNA, 22 nt, Human
uaguccacagacucuacagcau

SEQ ID NO: 53572 - RNA, 22 nt, Human
uaguccagaaacugagcuuaua

SEQ ID NO: 53573 - RNA, 22 nt, Human
uaguccaguaaaacagcuaacg

SEQ ID NO: 53574 - RNA, 20 nt, Human
uaguccaguaggggggcuuu

SEQ ID NO: 53575 - RNA, 22 nt, Human
uaguccauuaaauuagauucaa

SEQ ID NO: 53576 - RNA, 22 nt, Human
uaguccuuacuuacuagaauaa

SEQ ID NO: 53577 - RNA, 22 nt, Human
uaguccuuuccggcugcuauaa

SEQ ID NO: 53578 - RNA, 22 nt, Human
uagucuaagaaaucuuuacuuu

SEQ ID NO: 53579 - RNA, 19 nt, Human
uagucucugaugaggcuuu

SEQ ID NO: 53580 - RNA, 22 nt, Human
uagucuuaaguaauucauggaa

SEQ ID NO: 53581 - RNA, 22 nt, Human
uagugaauaguccaaucccgca

SEQ ID NO: 53582 - RNA, 22 nt, Human
uagugauuuccauuucaggguu

SEQ ID NO: 53583 - RNA, 20 nt, Human
uagugcaaaggcagccauag

SEQ ID NO: 53584 - RNA, 22 nt, Human
uagugcaaaggucuugcaccag

SEQ ID NO: 53585 - RNA, 22 nt, Human
uagugcaagguuuugccaacuu

SEQ ID NO: 53586 - RNA, 22 nt, Human
uagugcaaugugaggcaguacc

SEQ ID NO: 53587 - RNA, 22 nt, Human
uagugcauaacauuuaaagguc

SEQ ID NO: 53588 - RNA, 22 nt, Human
uagugccaccuuccaaguauca

SEQ ID NO: 53589 - RNA, 22 nt, Human
uacaaguuccauuuugaaagug

SEQ ID NO: 53590 - RNA, 22 nt, Human
uacaauaugugaacuuuggugu

SEQ ID NO: 53591 - RNA, 22 nt, Human
uacaauauguggccuuuuguga

SEQ ID NO: 53592 - RNA, 22 nt, Human
uacaaucacccaaagagccaga

SEQ ID NO: 53593 - RNA, 22 nt, Human
uacaaucaggauaauaauagug

SEQ ID NO: 53594 - RNA, 22 nt, Human
uacaaucaggcucuagcuucuc

SEQ ID NO: 53595 - RNA, 22 nt, Human
uacaaugcaaaauacugucugc

SEQ ID NO: 53596 - RNA, 21 nt, Human
uacaaugcacaggagagccuc

SEQ ID NO: 53597 - RNA, 22 nt, Human
uacaaugcagugaccuccuuua

SEQ ID NO: 53598 - RNA, 22 nt, Human
uacaaugcugugcauguaaugg

SEQ ID NO: 53599 - RNA, 22 nt, Human
uacaaugcuguuuguuucuacu

SEQ ID NO: 53600 - RNA, 22 nt, Human
uacaauguucgcauucucucug

SEQ ID NO: 53601 - RNA, 22 nt, Human
uacaauucuuuguaaggugguc

SEQ ID NO: 53602 - RNA, 19 nt, Human
uacaauuggcuuuccauug

SEQ ID NO: 53603 - RNA, 22 nt, Human
uacaauuuaguggugugugguu

SEQ ID NO: 53604 - RNA, 22 nt, Human
uacacaccugccugcagacucu

SEQ ID NO: 53605 - RNA, 22 nt, Human
uacacacugugauaaugaagca

SEQ ID NO: 53606 - RNA, 22 nt, Human
uacacacuuacuggagaugaag

SEQ ID NO: 53607 - RNA, 22 nt, Human
uacacagacucuucaauucaga

SEQ ID NO: 53608 - RNA, 22 nt, Human
uacacagggagagauuggaaac

SEQ ID NO: 53609 - RNA, 22 nt, Human
uacacaggggagcaugguugac

SEQ ID NO: 53610 - RNA, 22 nt, Human
uacacagugaguccucucugcc

SEQ ID NO: 53611 - RNA, 22 nt, Human
uacacaguuuugcucccaugau

SEQ ID NO: 53612 - RNA, 22 nt, Human
uacacauaggaggguaauaaaa

SEQ ID NO: 53613 - RNA, 22 nt, Human
uacacauaggucugaauaaaaa

SEQ ID NO: 53614 - RNA, 22 nt, Human
uacacauauguccauuaaucag

SEQ ID NO: 53615 - RNA, 22 nt, Human
uacacaucuggugugacugcca

SEQ ID NO: 53616 - RNA, 22 nt, Human
uacacaugaucauuuaguagca

SEQ ID NO: 53617 - RNA, 22 nt, Human
uacacauguuuggcaaguaugu

SEQ ID NO: 53618 - RNA, 22 nt, Human
uacacauuagucaagaguuuga

SEQ ID NO: 53619 - RNA, 22 nt, Human
uacacauuuugcggguacaugu

SEQ ID NO: 53620 - RNA, 22 nt, Human
uacaccagaaucucugugggga

SEQ ID NO: 53621 - RNA, 22 nt, Human
uacaccugcugagccuguccuc

SEQ ID NO: 53622 - RNA, 22 nt, Human
uacaccugggacccauccaaga

SEQ ID NO: 53623 - RNA, 22 nt, Human
uacacguguguguauguacaua

SEQ ID NO: 53624 - RNA, 20 nt, Human
uacacuaaguaugaagugcu

SEQ ID NO: 53625 - RNA, 22 nt, Human
uacacuaugggcuuuguguaau

SEQ ID NO: 53626 - RNA, 21 nt, Human
uacacucauccucucccaagg

SEQ ID NO: 53627 - RNA, 22 nt, Human
uacacugaaagagaggauugaa

SEQ ID NO: 53628 - RNA, 22 nt, Human
uacacugagaugacuuugguuu

SEQ ID NO: 53629 - RNA, 22 nt, Human
uacacuggacaggaguaggaag

SEQ ID NO: 53630 - RNA, 22 nt, Human
uacacuggccccagggcggggc

SEQ ID NO: 53631 - RNA, 22 nt, Human
uacacuggcuguuuugcagaaa

SEQ ID NO: 53632 - RNA, 22 nt, Human
uacacuggggcucugggaguga

SEQ ID NO: 53633 - RNA, 22 nt, Human
uacacugucuuagaaaggggca

SEQ ID NO: 53634 - RNA, 22 nt, Human
uacacuguuugaacuguggucg

SEQ ID NO: 53635 - RNA, 22 nt, Human
uacacuguuuuuggaaagaaga

SEQ ID NO: 53636 - RNA, 22 nt, Human
uacacuuuucaauguagucugu

SEQ ID NO: 53637 - RNA, 22 nt, Human
uacacuuuucugguuacucuug

SEQ ID NO: 53638 - RNA, 22 nt, Human
uacagaaaaacaucuggagccg

SEQ ID NO: 53639 - RNA, 22 nt, Human
uacagaaagaccucucgggaaa

SEQ ID NO: 53640 - RNA, 22 nt, Human
uacagaaagggaugauugaucu

SEQ ID NO: 53641 - RNA, 22 nt, Human
uacagaaauacugggggguucu

SEQ ID NO: 53642 - RNA, 22 nt, Human
uacagaaaucacaucgcuuuga

SEQ ID NO: 53643 - RNA, 20 nt, Human
uacagaaugcaauaaaaugg

SEQ ID NO: 53644 - RNA, 22 nt, Human
uacagagaauaauaggacaggu

SEQ ID NO: 53645 - RNA, 22 nt, Human
uacagagagagggguuaccagg

SEQ ID NO: 53646 - RNA, 22 nt, Human
uacagagagcuccggacauuca

SEQ ID NO: 53647 - RNA, 22 nt, Human
uacagagaguacagcauccaca

SEQ ID NO: 53648 - RNA, 22 nt, Human
uacagagauacucuagaucaaa

SEQ ID NO: 53649 - RNA, 22 nt, Human
uacagagauuuauugcuaaggc

SEQ ID NO: 53650 - RNA, 22 nt, Human
uacagaggcuggguuuucaggg

SEQ ID NO: 53651 - RNA, 22 nt, Human
uacagagugguuguccaacucu

SEQ ID NO: 53652 - RNA, 22 nt, Human
uacagaguguuauuacagaauc

SEQ ID NO: 53653 - RNA, 22 nt, Human
uacagauagaauuagugaguua

SEQ ID NO: 53654 - RNA, 22 nt, Human
uacagauaggaggaaucugaaa

SEQ ID NO: 53655 - RNA, 22 nt, Human
uacagauauguaugcacuuuuu

SEQ ID NO: 53656 - RNA, 22 nt, Human
uacagauuuugugaagaagugu

SEQ ID NO: 53657 - RNA, 23 nt, Human
uacagcaaggacaacauaggugg

SEQ ID NO: 53658 - RNA, 22 nt, Human
uacagcaaugccugaaauagua

SEQ ID NO: 53659 - RNA, 22 nt, Human
uacagcaaugcuacaagaugac

SEQ ID NO: 53660 - RNA, 22 nt, Human
uacagcaaugguucuaagaguc

SEQ ID NO: 53661 - RNA, 21 nt, Human
uacagcaccgaguaggcccuc

SEQ ID NO: 53662 - RNA, 22 nt, Human
uacagcacugugcauagugguu

SEQ ID NO: 53663 - RNA, 22 nt, Human
uacagcagacugaagguugugu

SEQ ID NO: 53664 - RNA, 22 nt, Human
uacagcagagugggaugcaucu

SEQ ID NO: 53665 - RNA, 22 nt, Human
uacagcauguccuuagcaaggc

SEQ ID NO: 53666 - RNA, 22 nt, Human
uacagccaucauguauguauau

SEQ ID NO: 53667 - RNA, 22 nt, Human
uacagcccaagaaguuuauacg

SEQ ID NO: 53668 - RNA, 22 nt, Human
uacagccucacauuuacuuaca

SEQ ID NO: 53669 - RNA, 22 nt, Human
uacagccuccacaggccaagug

SEQ ID NO: 53670 - RNA, 23 nt, Human
uacagcugcagaaucaggcuaag

SEQ ID NO: 53671 - RNA, 22 nt, Human
uacagcuggacugguagcugug

SEQ ID NO: 53672 - RNA, 18 nt, Human
uacagcuugaguugacug

SEQ ID NO: 53673 - RNA, 18 nt, Human
uacaggaagggguucucg

SEQ ID NO: 53674 - RNA, 22 nt, Human
uacaggaaguaaguaaugaaau

SEQ ID NO: 53675 - RNA, 22 nt, Human
uacaggagagauuuaguaauca

SEQ ID NO: 53676 - RNA, 17 nt, Human
uacaggagagcaggaac

SEQ ID NO: 53677 - RNA, 22 nt, Human
uacaggagcauggggaagggau

SEQ ID NO: 53678 - RNA, 22 nt, Human
ugaguauuuucccuaucaaugu

SEQ ID NO: 53679 - RNA, 22 nt, Human
ugagucacacauuucuucauac

SEQ ID NO: 53680 - RNA, 22 nt, Human
ugagucacagccuugccuuggu

SEQ ID NO: 53681 - RNA, 22 nt, Human
ugagucaccucucagaagccac

SEQ ID NO: 53682 - RNA, 22 nt, Human
ugagucacuaucacuuucucug

SEQ ID NO: 53683 - RNA, 22 nt, Human
ugagucaugggcuugagguuac

SEQ ID NO: 53684 - RNA, 22 nt, Human
ugaguccaccuuaguauauggg

SEQ ID NO: 53685 - RNA, 22 nt, Human
ugaguccaggugcuuaccugga

SEQ ID NO: 53686 - RNA, 22 nt, Human
ugaguccauguggaggggaggu

SEQ ID NO: 53687 - RNA, 22 nt, Human
ugaguccauugauggauaguga

SEQ ID NO: 53688 - RNA, 22 nt, Human
ugaguccuggcuuugggaugua

SEQ ID NO: 53689 - RNA, 22 nt, Human
ugagucucugcacuaaggagag

SEQ ID NO: 53690 - RNA, 22 nt, Human
ugagucuguauguccagauuua

SEQ ID NO: 53691 - RNA, 22 nt, Human
ugagucuucuuccgggauugcu

SEQ ID NO: 53692 - RNA, 22 nt, Human
ugagugaauucaaguaaagggc

SEQ ID NO: 53693 - RNA, 22 nt, Human
ugagugccuacggcacaggcgc

SEQ ID NO: 53694 - RNA, 22 nt, Human
ugagugcuaagaauaaucugca

SEQ ID NO: 53695 - RNA, 22 nt, Human
ugaguggacaccugcuucuuua

SEQ ID NO: 53696 - RNA, 22 nt, Human
ugaguggacgugaggcugagua

SEQ ID NO: 53697 - RNA, 19 nt, Human
ugagugggccccugcagac

SEQ ID NO: 53698 - RNA, 22 nt, Human
ugcaaauguguggugaggcauu

SEQ ID NO: 53699 - RNA, 22 nt, Human
ugcaaauguguuuuaaaccaaa

SEQ ID NO: 53700 - RNA, 22 nt, Human
ugcaaauuauugggccccaacu

SEQ ID NO: 53701 - RNA, 23 nt, Human
ugcaacaaugaggaaagcuacug

SEQ ID NO: 53702 - RNA, 22 nt, Human
ugcaacaggagaguucagggca

SEQ ID NO: 53703 - RNA, 22 nt, Human
ugcaacauuauuaaacuaagca

SEQ ID NO: 53704 - RNA, 22 nt, Human
ugcaagaaagguggggccaggc

SEQ ID NO: 53705 - RNA, 22 nt, Human
ugcaagaaaugugaagcuacaa

SEQ ID NO: 53706 - RNA, 22 nt, Human
ugcaagaaguccucucugggug

SEQ ID NO: 53707 - RNA, 22 nt, Human
ugcaagaauuguauacccucau

SEQ ID NO: 53708 - RNA, 22 nt, Human
ugcaagagguuggauuuuaaga

SEQ ID NO: 53709 - RNA, 23 nt, Human
ugcaagaguuccaaacuguucaa

SEQ ID NO: 53710 - RNA, 20 nt, Human
ugcaagauggguggggagaa

SEQ ID NO: 53711 - RNA, 22 nt, Human
ugcaagcacucaaugcaaacag

SEQ ID NO: 53712 - RNA, 21 nt, Human
ugcaagcagcagagauauggg

SEQ ID NO: 53713 - RNA, 19 nt, Human
ugcaagcuuuuucuuguua

SEQ ID NO: 53714 - RNA, 22 nt, Human
ugcaaggcacccacucugcuuu

SEQ ID NO: 53715 - RNA, 22 nt, Human
ugcaagggcuuagggggcugug

SEQ ID NO: 53716 - RNA, 22 nt, Human
ugcaagggugacagguugcucu

SEQ ID NO: 53717 - RNA, 22 nt, Human
ugcaaggguguuugagcugccc

SEQ ID NO: 53718 - RNA, 22 nt, Human
ugcaaguaaccaucacuaucuc

SEQ ID NO: 53719 - RNA, 22 nt, Human
ugcaaguaacuuguuugggagg

SEQ ID NO: 53720 - RNA, 22 nt, Human
ugcaauaaagugcuauaaaucc

SEQ ID NO: 53721 - RNA, 22 nt, Human
ugcaauaaguauugcuuacaug

SEQ ID NO: 53722 - RNA, 21 nt, Human
ugcaauauauauuugccugaa

SEQ ID NO: 53723 - RNA, 22 nt, Human
ugcaauaucagauucaacacau

SEQ ID NO: 53724 - RNA, 23 nt, Human
ugcaauaugucagugcaaagugg

SEQ ID NO: 53725 - RNA, 22 nt, Human
ugcaauauguugcauuguaugg

SEQ ID NO: 53726 - RNA, 22 nt, Human
ugcaauauuuuauauccaacaa

SEQ ID NO: 53727 - RNA, 22 nt, Human
ugcaaucucggcacuuugggag

SEQ ID NO: 53728 - RNA, 22 nt, Human
ugcaauguguuagaugguuuua

SEQ ID NO: 53729 - RNA, 22 nt, Human
ugcaauuaauuuacaugcuuaa

SEQ ID NO: 53730 - RNA, 22 nt, Human
ugcaauuagcguauuaguuuau

SEQ ID NO: 53731 - RNA, 21 nt, Human
ugcaauuuagacuugaacauu

SEQ ID NO: 53732 - RNA, 22 nt, Human
ugcaauuugacgucagcacagu

SEQ ID NO: 53733 - RNA, 22 nt, Human
ugcaauuuggcuuccauuuucu

SEQ ID NO: 53734 - RNA, 22 nt, Human
ugcaauuuuaauacauuagagg

SEQ ID NO: 53735 - RNA, 22 nt, Human
ugcacaaagcauucuagacgca

SEQ ID NO: 53736 - RNA, 22 nt, Human
ugcacacacacguagagaaaag

SEQ ID NO: 53737 - RNA, 22 nt, Human
ugcacacacaggagucuccucc

SEQ ID NO: 53738 - RNA, 22 nt, Human
ugcacacacaugcagagggaga

SEQ ID NO: 53739 - RNA, 22 nt, Human
ugcacacaccgugcuucacuga

SEQ ID NO: 53740 - RNA, 20 nt, Human
ugcacacagaaauuugcauu

SEQ ID NO: 53741 - RNA, 22 nt, Human
ugcacacagaugguacaugcau

SEQ ID NO: 53742 - RNA, 22 nt, Human
ugcacacauguauguauaugug

SEQ ID NO: 53743 - RNA, 22 nt, Human
ugcacacauguuuacaagcauc

SEQ ID NO: 53744 - RNA, 22 nt, Human
ugcacagacaacucuuucuaga

SEQ ID NO: 53745 - RNA, 20 nt, Human
ugcacagacaaugagcccag

SEQ ID NO: 53746 - RNA, 22 nt, Human
ugcacagacauacacauauaug

SEQ ID NO: 53747 - RNA, 22 nt, Human
ugcacagaugcuaggaggugaa

SEQ ID NO: 53748 - RNA, 22 nt, Human
ugcacagcugccuccucucugc

SEQ ID NO: 53749 - RNA, 23 nt, Human
ugcacaggacggccuuauaagua

SEQ ID NO: 53750 - RNA, 22 nt, Human
ugcacaggccuugaagggagag

SEQ ID NO: 53751 - RNA, 22 nt, Human
ugcacagggagggggccagcuc

SEQ ID NO: 53752 - RNA, 22 nt, Human
ugcacaggugagacucaggaag

SEQ ID NO: 53753 - RNA, 22 nt, Human
ugcacaggugguccaucugcac

SEQ ID NO: 53754 - RNA, 22 nt, Human
ugcacagugaccacugagcaag

SEQ ID NO: 53755 - RNA, 22 nt, Human
ugcacaguuaauaugugacaga

SEQ ID NO: 53756 - RNA, 22 nt, Human
ugcacauucacuuagguauugu

SEQ ID NO: 53757 - RNA, 22 nt, Human
ugcacauugaaugagcaaacug

SEQ ID NO: 53758 - RNA, 22 nt, Human
ugcaccaagcccagcuggagaa

SEQ ID NO: 53759 - RNA, 22 nt, Human
ugcaccaagucuggcacugaau

SEQ ID NO: 53760 - RNA, 22 nt, Human
ugcaccacccgugggaggacug

SEQ ID NO: 53761 - RNA, 22 nt, Human
ugcaccguugcacuccagagug

SEQ ID NO: 53762 - RNA, 21 nt, Human
ugcaccuguucacugcaguuc

SEQ ID NO: 53763 - RNA, 22 nt, Human
ugcaccuucauuuuaggcagcu

SEQ ID NO: 53764 - RNA, 22 nt, Human
ugcaccuuguugcuuuuacgaa

SEQ ID NO: 53765 - RNA, 22 nt, Human
ugcacgugggcucucugcucuu

SEQ ID NO: 53766 - RNA, 22 nt, Human
ugcacgugugagcauucacaug

SEQ ID NO: 53767 - RNA, 18 nt, Human
ugcacuagaugcuggcag

SEQ ID NO: 53768 - RNA, 22 nt, Human
ugcacugauguuuugccaagga

SEQ ID NO: 53769 - RNA, 22 nt, Human
ugcacuggggucccagcgcacg

SEQ ID NO: 53770 - RNA, 22 nt, Human
ugcacuguaugguaucuggaca

SEQ ID NO: 53771 - RNA, 18 nt, Human
ugcacugugcugaguggc

SEQ ID NO: 53772 - RNA, 21 nt, Human
ugcacuucaguggcuaaauuc

SEQ ID NO: 53773 - RNA, 22 nt, Human
ugcacuucauuguaaauuguac

SEQ ID NO: 53774 - RNA, 22 nt, Human
ugcacuuuauuuccucucacac

SEQ ID NO: 53775 - RNA, 22 nt, Human
ugcacuuuuauaucacucuggc

SEQ ID NO: 53776 - RNA, 22 nt, Human
ugcagaaaccaauucaaguaag

SEQ ID NO: 53777 - RNA, 22 nt, Human
ugcagaaagcauugacucuucc

SEQ ID NO: 53778 - RNA, 21 nt, Human
ugcagaaagcggcuugaagca

SEQ ID NO: 53779 - RNA, 22 nt, Human
ugcagaaauaacucauauugca

SEQ ID NO: 53780 - RNA, 22 nt, Human
ugcagaaaucacauuuaacccu

SEQ ID NO: 53781 - RNA, 22 nt, Human
ugcagaagacacaagguaacgu

SEQ ID NO: 53782 - RNA, 22 nt, Human
ugcagaagcagagccgguggcc

SEQ ID NO: 53783 - RNA, 22 nt, Human
ugcagaaggccugacauugcac

SEQ ID NO: 53784 - RNA, 20 nt, Human
ugcagaauccugugaucagu

SEQ ID NO: 53785 - RNA, 21 nt, Human
ugcagacagggacagaaugga

SEQ ID NO: 53786 - RNA, 22 nt, Human
ugcagagaccacugugccuucc

SEQ ID NO: 53787 - RNA, 22 nt, Human
ugcagagacuugugugcauuug

SEQ ID NO: 53788 - RNA, 22 nt, Human
ugcagagagaccccugggccag

SEQ ID NO: 53789 - RNA, 16 nt, Human
ugcagagagcauggug

SEQ ID NO: 53790 - RNA, 22 nt, Human
ugcagagagccagcucucucgg

SEQ ID NO: 53791 - RNA, 22 nt, Human
ugcagagaguuagggcccguau

SEQ ID NO: 53792 - RNA, 21 nt, Human
ugcagagauaucugaagcaga

SEQ ID NO: 53793 - RNA, 22 nt, Human
ugcagagauccuggacugagcg

SEQ ID NO: 53794 - RNA, 22 nt, Human
ugcagagcagcaacugcgugcg

SEQ ID NO: 53795 - RNA, 22 nt, Human
uacaggagcugcucugugauac

SEQ ID NO: 53796 - RNA, 22 nt, Human
uacaggaggauuaucaaaggau

SEQ ID NO: 53797 - RNA, 22 nt, Human
uacaggcacugaaaugcuuauu

SEQ ID NO: 53798 - RNA, 19 nt, Human
uacaggcaguuucuacaau

SEQ ID NO: 53799 - RNA, 22 nt, Human
uacaggcucuugucagacguau

SEQ ID NO: 53800 - RNA, 22 nt, Human
uacagggauuccugccgcucgc

SEQ ID NO: 53801 - RNA, 22 nt, Human
uacagggcaugugcagacacau

SEQ ID NO: 53802 - RNA, 22 nt, Human
uacagggguaacaguggggaau

SEQ ID NO: 53803 - RNA, 22 nt, Human
uacagguagagucucuaguuua

SEQ ID NO: 53804 - RNA, 22 nt, Human
uacagguagggucuauguuaga

SEQ ID NO: 53805 - RNA, 22 nt, Human
uacaggucuucugccuucacuc

SEQ ID NO: 53806 - RNA, 22 nt, Human
uacaggugcucuacagacagga

SEQ ID NO: 53807 - RNA, 22 nt, Human
uagaaaucagcaggcauaugua

SEQ ID NO: 53808 - RNA, 22 nt, Human
uagaaaucauuuagaaguauug

SEQ ID NO: 53809 - RNA, 22 nt, Human
uagaaaucuacuuagacuuucu

SEQ ID NO: 53810 - RNA, 22 nt, Human
uagaaauguaggcuuccugaca

SEQ ID NO: 53811 - RNA, 22 nt, Human
uagaacagaggguugcccagau

SEQ ID NO: 53812 - RNA, 22 nt, Human
uagaacaggaauaagggaaaua

SEQ ID NO: 53813 - RNA, 22 nt, Human
uagaacaugcucauguauaaau

SEQ ID NO: 53814 - RNA, 22 nt, Human
uagaacaugggauagaguuuuu

SEQ ID NO: 53815 - RNA, 22 nt, Human
uagaaccuccagaguggccccc

SEQ ID NO: 53816 - RNA, 22 nt, Human
uagaacuaagaguuaucauuua

SEQ ID NO: 53817 - RNA, 22 nt, Human
ugcaguuuuaucacauauauag

SEQ ID NO: 53818 - RNA, 22 nt, Human
ugcaguuuuccuucaacauugu

SEQ ID NO: 53819 - RNA, 22 nt, Human
ugcaguuuugccaggcaaugga

SEQ ID NO: 53820 - RNA, 22 nt, Human
ugcaguuuuggccauugaaggc

SEQ ID NO: 53821 - RNA, 22 nt, Human
ugcauaaacuucucugguguga

SEQ ID NO: 53822 - RNA, 22 nt, Human
ugcauaaagugccauaguauua

SEQ ID NO: 53823 - RNA, 22 nt, Human
ugcauaauacguuuccuauaac

SEQ ID NO: 53824 - RNA, 22 nt, Human
ugcauacacuucaaaugagcau

SEQ ID NO: 53825 - RNA, 22 nt, Human
ugcauacuuuuaaugacuguuu

SEQ ID NO: 53826 - RNA, 20 nt, Human
ugcauaguugcugcaguuga

SEQ ID NO: 53827 - RNA, 18 nt, Human
ugcauauacugccuaucu

SEQ ID NO: 53828 - RNA, 23 nt, Human
ugcauaucagaaauuucauaugg

SEQ ID NO: 53829 - RNA, 22 nt, Human
ugcauauuauaaagagaauuag

SEQ ID NO: 53830 - RNA, 22 nt, Human
ugcauauuguccuugauauuau

SEQ ID NO: 53831 - RNA, 22 nt, Human
ugcauauugugaaaauguagau

SEQ ID NO: 53832 - RNA, 22 nt, Human
ugcaucaaauucugaaauuagc

SEQ ID NO: 53833 - RNA, 23 nt, Human
ugcaucaauaaagccaggguuug

SEQ ID NO: 53834 - RNA, 22 nt, Human
ugcaucauuaagguacaguugg

SEQ ID NO: 53835 - RNA, 22 nt, Human
ugcaucauuuauaaugucuuug

SEQ ID NO: 53836 - RNA, 22 nt, Human
ugcaucugauucucaggcagaa

SEQ ID NO: 53837 - RNA, 22 nt, Human
ugcaucuggccuuugcuggcua

SEQ ID NO: 53838 - RNA, 22 nt, Human
ugcaucuguucagagcugucga

SEQ ID NO: 53839 - RNA, 22 nt, Human
ugcaugaacggaggguaagcug

SEQ ID NO: 53840 - RNA, 22 nt, Human
ugcaugaggacucagagcuucu

SEQ ID NO: 53841 - RNA, 22 nt, Human
ugcaugcacccagccggguauu

SEQ ID NO: 53842 - RNA, 22 nt, Human
ugcaugcacguaucugcgugug

SEQ ID NO: 53843 - RNA, 22 nt, Human
ugcaugcacuuggcuggcacgu

SEQ ID NO: 53844 - RNA, 22 nt, Human
ugcaugcagcauaugaggccuc

SEQ ID NO: 53845 - RNA, 22 nt, Human
ugcaugcaugauguuugguagc

SEQ ID NO: 53846 - RNA, 22 nt, Human
ugcauggacgugacuuggccaa

SEQ ID NO: 53847 - RNA, 22 nt, Human
ugcauggagauauacuauuuga

SEQ ID NO: 53848 - RNA, 21 nt, Human
ugcauggaggaaaguuauaga

SEQ ID NO: 53849 - RNA, 22 nt, Human
ugcauggauaaaaguauauuau

SEQ ID NO: 53850 - RNA, 22 nt, Human
ugcauggauuugacauguguac

SEQ ID NO: 53851 - RNA, 23 nt, Human
ugcauggggcuauacugcuguuc

SEQ ID NO: 53852 - RNA, 22 nt, Human
ugcaugucaaggcacucaggau

SEQ ID NO: 53853 - RNA, 23 nt, Human
ugcaugugaauucauacuuguuu

SEQ ID NO: 53854 - RNA, 22 nt, Human
ugcaugugcccacucuggcuua

SEQ ID NO: 53855 - RNA, 22 nt, Human
ugcaugugucgggccugugcua

SEQ ID NO: 53856 - RNA, 22 nt, Human
ugcaugugugacaaggacaguu

SEQ ID NO: 53857 - RNA, 19 nt, Human
ugcauguguucucccauug

SEQ ID NO: 53858 - RNA, 22 nt, Human
ugcauguguuucccagcaagcu

SEQ ID NO: 53859 - RNA, 22 nt, Human
ugcauguguuugccacagugag

SEQ ID NO: 53860 - RNA, 22 nt, Human
ugcauguuaagaaaauauugag

SEQ ID NO: 53861 - RNA, 22 nt, Human
ugcauguuucuguauguuaaug

SEQ ID NO: 53862 - RNA, 22 nt, Human
ugcauuaaaaccaucgaccauc

SEQ ID NO: 53863 - RNA, 22 nt, Human
ugcauuaaaaugugccucucuu

SEQ ID NO: 53864 - RNA, 22 nt, Human
ugcauuaagaauuucugaggau

SEQ ID NO: 53865 - RNA, 22 nt, Human
ugcauuaagcacacuuuugaau

SEQ ID NO: 53866 - RNA, 22 nt, Human
ugcauuaaggccauugaaauuu

SEQ ID NO: 53867 - RNA, 22 nt, Human
ugcauuauggcugagucucuca

SEQ ID NO: 53868 - RNA, 22 nt, Human
ugcauuauucuuuuuugguagg

SEQ ID NO: 53869 - RNA, 22 nt, Human
ugcauucaaauccugauccugc

SEQ ID NO: 53870 - RNA, 22 nt, Human
ugcauucaauacaguaagaaua

SEQ ID NO: 53871 - RNA, 22 nt, Human
ugcauucaguuggucagcuuuu

SEQ ID NO: 53872 - RNA, 19 nt, Human
ugcauugagggcugucuca

SEQ ID NO: 53873 - RNA, 22 nt, Human
ugcauugagucauuucaguaug

SEQ ID NO: 53874 - RNA, 22 nt, Human
ugcauugauagaaaaacaugga

SEQ ID NO: 53875 - RNA, 22 nt, Human
ugcauugccucuauucauuaua

SEQ ID NO: 53876 - RNA, 22 nt, Human
ugcauuggaaacucagcagcac

SEQ ID NO: 53877 - RNA, 22 nt, Human
ugcauuggucauuuagaaaaua

SEQ ID NO: 53878 - RNA, 22 nt, Human
ugcauuguugaauauuucauag

SEQ ID NO: 53879 - RNA, 22 nt, Human
ugcauuguuuagaacucuuugg

SEQ ID NO: 53880 - RNA, 18 nt, Human
ugcauuuaguacaucuag

SEQ ID NO: 53881 - RNA, 22 nt, Human
ugcauuugaguugggagcaggc

SEQ ID NO: 53882 - RNA, 22 nt, Human
ugcauuuguucagugaaauguu

SEQ ID NO: 53883 - RNA, 22 nt, Human
ugcauuuucuuccaccaauauc

SEQ ID NO: 53884 - RNA, 22 nt, Human
ugccaaaauggccaaaagcuag

SEQ ID NO: 53885 - RNA, 22 nt, Human
ugccaaauauucucuacgugcu

SEQ ID NO: 53886 - RNA, 22 nt, Human
ugccaagcuagaacguucccag

SEQ ID NO: 53887 - RNA, 22 nt, Human
ugccaaggagcuggaucagggc

SEQ ID NO: 53888 - RNA, 22 nt, Human
ugccaaguagccugcagugacu

SEQ ID NO: 53889 - RNA, 22 nt, Human
ugccaagugcuuacuuggcccu

SEQ ID NO: 53890 - RNA, 22 nt, Human
ugccaaguggagcucaggaauc

SEQ ID NO: 53891 - RNA, 22 nt, Human
ugccaauucgcagugaguauuu

SEQ ID NO: 53892 - RNA, 23 nt, Human
ugccacaagaucugugaauaaga

SEQ ID NO: 53893 - RNA, 22 nt, Human
ugccacacucacuucuguggac

SEQ ID NO: 53894 - RNA, 22 nt, Human
ugccacagagcaauucugcuga

SEQ ID NO: 53895 - RNA, 22 nt, Human
ugccacagaggugaagcccacu

SEQ ID NO: 53896 - RNA, 19 nt, Human
ugccacagauaaaaacuga

SEQ ID NO: 53897 - RNA, 22 nt, Human
ugccacagcagugcuuugacag

SEQ ID NO: 53898 - RNA, 22 nt, Human
ugccacaguuucauggauucug

SEQ ID NO: 53899 - RNA, 22 nt, Human
ugccacauggugcauuuccuag

SEQ ID NO: 53900 - RNA, 22 nt, Human
ugccaccaucuggcuguguuga

SEQ ID NO: 53901 - RNA, 22 nt, Human
ugccacccagccaggaguggga

SEQ ID NO: 53902 - RNA, 23 nt, Human
ugccacccuucucuucccagcuu

SEQ ID NO: 53903 - RNA, 22 nt, Human
ugccaccuaguggucuuuaguc

SEQ ID NO: 53904 - RNA, 22 nt, Human
ugccaccuugugcagcaggagg

SEQ ID NO: 53905 - RNA, 22 nt, Human
ugccacuggacccagaacucuu

SEQ ID NO: 53906 - RNA, 22 nt, Human
ugccacuggcucaauggugcag

SEQ ID NO: 53907 - RNA, 22 nt, Human
ugccacuggggcuaggacuguu

SEQ ID NO: 53908 - RNA, 22 nt, Human
ugccagaagugcuuuauaagug

SEQ ID NO: 53909 - RNA, 22 nt, Human
ugccagagaagacccagucacu

SEQ ID NO: 53910 - RNA, 22 nt, Human
ugccagagaguggcuggguguc

SEQ ID NO: 53911 - RNA, 22 nt, Human
ugccagagccaggcuuuaggaa

SEQ ID NO: 53912 - RNA, 22 nt, Human
ugccagcagaaauaaauacuug

SEQ ID NO: 53913 - RNA, 22 nt, Human
ugccagccagggaagcucaccc

SEQ ID NO: 53914 - RNA, 22 nt, Human
ugccagccagguucugaggcua

SEQ ID NO: 53915 - RNA, 22 nt, Human
ugccagccuccugauaucaucc

SEQ ID NO: 53916 - RNA, 22 nt, Human
uagaucuuucacuacuguguag

SEQ ID NO: 53917 - RNA, 22 nt, Human
uagaugaaaggucuagcacagu

SEQ ID NO: 53918 - RNA, 22 nt, Human
uagaugaacagaaagccacugu

SEQ ID NO: 53919 - RNA, 22 nt, Human
uagaugaaggcugagcaccugu

SEQ ID NO: 53920 - RNA, 22 nt, Human
uagaugaccuuguguuaggcaa

SEQ ID NO: 53921 - RNA, 22 nt, Human
uagaugauggaaaaaagcaaua

SEQ ID NO: 53922 - RNA, 22 nt, Human
uagaugcauagagcacagcaca

SEQ ID NO: 53923 - RNA, 22 nt, Human
uagaugcuguagaaauacuuau

SEQ ID NO: 53924 - RNA, 22 nt, Human
uagaugcuugucaguuucuguc

SEQ ID NO: 53925 - RNA, 18 nt, Human
uagauggcagucugcaga

SEQ ID NO: 53926 - RNA, 23 nt, Human
uagauguauuaagugcauuuuca

SEQ ID NO: 53927 - RNA, 22 nt, Human
uagauguuccacauauauaugu

SEQ ID NO: 53928 - RNA, 22 nt, Human
uagauguugaagucauauuugg

SEQ ID NO: 53929 - RNA, 22 nt, Human
uagauguuugagaaguuuaugu

SEQ ID NO: 53930 - RNA, 23 nt, Human
uagauguuuggggaacuuugccc

SEQ ID NO: 53931 - RNA, 22 nt, Human
uagauuaucccugauuugucca

SEQ ID NO: 53932 - RNA, 22 nt, Human
uagauucaugcaguaugcuagu

SEQ ID NO: 53933 - RNA, 22 nt, Human
uagauucauuuuagcaaaaguu

SEQ ID NO: 53934 - RNA, 22 nt, Human
ugccaggcucagccccuaucuu

SEQ ID NO: 53935 - RNA, 22 nt, Human
ugccaggcuccggaacgacagu

SEQ ID NO: 53936 - RNA, 22 nt, Human
ugccaggcugaacagggucuua

SEQ ID NO: 53937 - RNA, 20 nt, Human
ugccaggcugcacgccugcc

SEQ ID NO: 53938 - RNA, 22 nt, Human
ugccaggcugcccuccagucug

SEQ ID NO: 53939 - RNA, 22 nt, Human
ugccaggcuuagagcaggggcu

SEQ ID NO: 53940 - RNA, 22 nt, Human
ugccaggguccugagggccuug

SEQ ID NO: 53941 - RNA, 23 nt, Human
ugccaggguuuguuugugguuca

SEQ ID NO: 53942 - RNA, 22 nt, Human
ugccagugggugugcagagacu

SEQ ID NO: 53943 - RNA, 22 nt, Human
ugccaguguggaacuaggaaga

SEQ ID NO: 53944 - RNA, 22 nt, Human
ugccauccaucaguauuugugg

SEQ ID NO: 53945 - RNA, 18 nt, Human
ugccauccccagucaagu

SEQ ID NO: 53946 - RNA, 22 nt, Human
ugccauccugugucaugcucau

SEQ ID NO: 53947 - RNA, 22 nt, Human
ugccaucugaaaauuacauccu

SEQ ID NO: 53948 - RNA, 22 nt, Human
ugccaucuuccuuccucugcac

SEQ ID NO: 53949 - RNA, 22 nt, Human
ugccaucuucucuggggauguu

SEQ ID NO: 53950 - RNA, 22 nt, Human
ugccauggaaguggccagaccu

SEQ ID NO: 53951 - RNA, 22 nt, Human
ugccauggaaucaccuccagcu

SEQ ID NO: 53952 - RNA, 22 nt, Human
ugccauggauuaaguggguggc

SEQ ID NO: 53953 - RNA, 20 nt, Human
ugccaugguaacagagugug

SEQ ID NO: 53954 - RNA, 22 nt, Human
ugccauggugacugcaggaggu

SEQ ID NO: 53955 - RNA, 22 nt, Human
ugccauuuaaaaaugaccaaau

SEQ ID NO: 53956 - RNA, 22 nt, Human
ugccauuuagugcaucauuagu

SEQ ID NO: 53957 - RNA, 22 nt, Human
ugccauuuauaaccaguggccu

SEQ ID NO: 53958 - RNA, 22 nt, Human
ugccauuucucaggcuauuuca

SEQ ID NO: 53959 - RNA, 22 nt, Human
ugccauuucuuucaauauucuu

SEQ ID NO: 53960 - RNA, 22 nt, Human
ugccauuuguuacuaucaggac

SEQ ID NO: 53961 - RNA, 22 nt, Human
ugcccaaacugacauuggcagu

SEQ ID NO: 53962 - RNA, 22 nt, Human
ugcccaagcagaggagugauuc

SEQ ID NO: 53963 - RNA, 22 nt, Human
ugcccaagguggccuuuuacuc

SEQ ID NO: 53964 - RNA, 22 nt, Human
ugcccacaggaagacaccagcg

SEQ ID NO: 53965 - RNA, 22 nt, Human
ugcccacauucugaagcucccu

SEQ ID NO: 53966 - RNA, 22 nt, Human
ugcccacucuuuugauuugugu

SEQ ID NO: 53967 - RNA, 22 nt, Human
ugcccagagccucuuaccucca

SEQ ID NO: 53968 - RNA, 19 nt, Human
ugcccagaguguaugcgca

SEQ ID NO: 53969 - RNA, 22 nt, Human
ugcccagcacccagcaugaugc

SEQ ID NO: 53970 - RNA, 22 nt, Human
ugcccagccaauuuguuauguu

SEQ ID NO: 53971 - RNA, 22 nt, Human
ugcccaggaucuggcgaugcuc

SEQ ID NO: 53972 - RNA, 19 nt, Human
ugcccaggccucccaaaag

SEQ ID NO: 53973 - RNA, 22 nt, Human
ugcccaggcuucacccucagag

SEQ ID NO: 53974 - RNA, 22 nt, Human
ugcccaggguggagugcagcgg

SEQ ID NO: 53975 - RNA, 22 nt, Human
ugcccaugcaugacagauggcu

SEQ ID NO: 53976 - RNA, 22 nt, Human
ugccccagaccuacugaauggg

SEQ ID NO: 53977 - RNA, 22 nt, Human
ugcccccugguggccagagccg

SEQ ID NO: 53978 - RNA, 22 nt, Human
ugcccccuuuucuuguuacacu

SEQ ID NO: 53979 - RNA, 22 nt, Human
ugccccucuugcuggcccuguc

SEQ ID NO: 53980 - RNA, 22 nt, Human
ugccccugaugccuagaacaga

SEQ ID NO: 53981 - RNA, 19 nt, Human
ugccccuuaagaguuucuc

SEQ ID NO: 53982 - RNA, 22 nt, Human
ugcccguucauucauacuuaac

SEQ ID NO: 53983 - RNA, 22 nt, Human
ugcccucagaauugcucccugc

SEQ ID NO: 53984 - RNA, 22 nt, Human
ugcccuccuccugagcccaugu

SEQ ID NO: 53985 - RNA, 22 nt, Human
ugcccucuaggcuacaguucca

SEQ ID NO: 53986 - RNA, 22 nt, Human
ugcccucugccuccucugcaga

SEQ ID NO: 53987 - RNA, 22 nt, Human
ugcccugcagugagugcgucug

SEQ ID NO: 53988 - RNA, 22 nt, Human
ugcccugccaagaccaaguggu

SEQ ID NO: 53989 - RNA, 22 nt, Human
ugcccugccaagacucaguggu

SEQ ID NO: 53990 - RNA, 22 nt, Human
ugcccugcugugccuggagcca

SEQ ID NO: 53991 - RNA, 22 nt, Human
ugcccugcuucucuugggacag

SEQ ID NO: 53992 - RNA, 22 nt, Human
ugcccuggcauuggguuggaua

SEQ ID NO: 53993 - RNA, 22 nt, Human
ugcccuggggagcccagccagg

SEQ ID NO: 53994 - RNA, 22 nt, Human
ugcccuggugaagugcucuccu

SEQ ID NO: 53995 - RNA, 22 nt, Human
ugcccugguuacacuggagucc

SEQ ID NO: 53996 - RNA, 22 nt, Human
ugcccugucgcucacucccacc

SEQ ID NO: 53997 - RNA, 17 nt, Human
ugcccugugccuggugu

SEQ ID NO: 53998 - RNA, 22 nt, Human
ugcccuguggggauuuccagcc

SEQ ID NO: 53999 - RNA, 22 nt, Human
ugcccuguggguaucugauggc

SEQ ID NO: 54000 - RNA, 22 nt, Human
ugcccuguuccugccuccagcu

SEQ ID NO: 54001 - RNA, 22 nt, Human
ugcccuuacacauggaaaggga

SEQ ID NO: 54002 - RNA, 22 nt, Human
ugcccuuaggaaggcucaccaa

SEQ ID NO: 54003 - RNA, 22 nt, Human
ugcccuuaugaaagaggcccaa

SEQ ID NO: 54004 - RNA, 22 nt, Human
ugcccuugaaauacgcuugggg

SEQ ID NO: 54005 - RNA, 22 nt, Human
ugccgcagugcggggagggccc

SEQ ID NO: 54006 - RNA, 22 nt, Human
ugccgcgcgcccagguuaggug

SEQ ID NO: 54007 - RNA, 20 nt, Human
ugccgggcagccugaggagu

SEQ ID NO: 54008 - RNA, 22 nt, Human
ugccuaaaccauuccccuuccu

SEQ ID NO: 54009 - RNA, 22 nt, Human
ugccuacauuccuugcuuaugg

SEQ ID NO: 54010 - RNA, 22 nt, Human
ugccuacuaguacuauuuugug

SEQ ID NO: 54011 - RNA, 22 nt, Human
ugccucagagugggcuugcuau

SEQ ID NO: 54012 - RNA, 19 nt, Human
ugccucagggcuuugagga

SEQ ID NO: 54013 - RNA, 22 nt, Human
ugccucaguuucaucugcagaa

SEQ ID NO: 54014 - RNA, 22 nt, Human
ugccuccauguuucagcaucua

SEQ ID NO: 54015 - RNA, 22 nt, Human
ugccuccuucaggagggcccgg

SEQ ID NO: 54016 - RNA, 22 nt, Human
ugccucugcugcuguggcauca

SEQ ID NO: 54017 - RNA, 22 nt, Human
ugccucugugggccuuccuggc

SEQ ID NO: 54018 - RNA, 22 nt, Human
ugccucugugugcaggugagca

SEQ ID NO: 54019 - RNA, 22 nt, Human
ugccugaacaugaauaguuuau

SEQ ID NO: 54020 - RNA, 22 nt, Human
ugccugacugcugccaccacua

SEQ ID NO: 54021 - RNA, 22 nt, Human
ugccugaguuuaacccucagag

SEQ ID NO: 54022 - RNA, 22 nt, Human
ugccugcauuuuguggcuggcu

SEQ ID NO: 54023 - RNA, 22 nt, Human
ugccugcccugaaaacugccca

SEQ ID NO: 54024 - RNA, 22 nt, Human
ugccugcgaggcaugggugaga

SEQ ID NO: 54025 - RNA, 22 nt, Human
uaguccaucuugaauucaguga

SEQ ID NO: 54026 - RNA, 22 nt, Human
uagucccauuuugagguauuug

SEQ ID NO: 54027 - RNA, 22 nt, Human
uaguccucagcugaacugcugc

SEQ ID NO: 54028 - RNA, 22 nt, Human
uaguccugaccuugccaccagc

SEQ ID NO: 54029 - RNA, 22 nt, Human
uaguccuggauugguggaggca

SEQ ID NO: 54030 - RNA, 22 nt, Human
uaguccuugcugggcacagagu

SEQ ID NO: 54031 - RNA, 22 nt, Human
uaguccuuuaauaguuaaugug

SEQ ID NO: 54032 - RNA, 22 nt, Human
uagucucugcuuugcccuuggc

SEQ ID NO: 54033 - RNA, 22 nt, Human
uagucucuggagacucuagggg

SEQ ID NO: 54034 - RNA, 22 nt, Human
uagucuuccuggaagaaguguu

SEQ ID NO: 54035 - RNA, 22 nt, Human
uagugaaacaguuaucaaucug

SEQ ID NO: 54036 - RNA, 22 nt, Human
uagugaaaccugacagaucaug

SEQ ID NO: 54037 - RNA, 22 nt, Human
uagugaaauaugugcugauagc

SEQ ID NO: 54038 - RNA, 22 nt, Human
uagugauucccuaucaacccug

SEQ ID NO: 54039 - RNA, 22 nt, Human
uagugauugcugauauuccauu

SEQ ID NO: 54040 - RNA, 22 nt, Human
uagugcaacagggaaagagugu

SEQ ID NO: 54041 - RNA, 22 nt, Human
uagugcaaucucuuccucagca

SEQ ID NO: 54042 - RNA, 22 nt, Human
uagugcaauuccccauacuaac

SEQ ID NO: 54043 - RNA, 22 nt, Human
uagugcaggguuuuaagcacug

SEQ ID NO: 54044 - RNA, 22 nt, Human
uagugcagguuaauaggacuuc

SEQ ID NO: 54045 - RNA, 22 nt, Human
uagugcauaccuaacauuuuug

SEQ ID NO: 54046 - RNA, 22 nt, Human
uagugccaaagccuggugucau

SEQ ID NO: 54047 - RNA, 22 nt, Human
uagugccaucuugagcugcuuu

SEQ ID NO: 54048 - RNA, 22 nt, Human
uagugcuugagucucuccguac

SEQ ID NO: 54049 - RNA, 22 nt, Human
uagugcuuuaaguuuacagaga

SEQ ID NO: 54050 - RNA, 22 nt, Human
ucacaucuuuaggcuuacaggu

SEQ ID NO: 54051 - RNA, 22 nt, Human
ucacaugaaaugcuguaaagaa

SEQ ID NO: 54052 - RNA, 20 nt, Human
ucacaugagcuggggcaggc

SEQ ID NO: 54053 - RNA, 22 nt, Human
ucacaugcccuguauuuaccag

SEQ ID NO: 54054 - RNA, 22 nt, Human
ucacaugcugugggaucuguau

SEQ ID NO: 54055 - RNA, 22 nt, Human
ucacaugucaaaaacuacauaa

SEQ ID NO: 54056 - RNA, 22 nt, Human
ucacaugucagucuuaaacaga

SEQ ID NO: 54057 - RNA, 22 nt, Human
ucacauguguggcagugcaagu

SEQ ID NO: 54058 - RNA, 22 nt, Human
ucacauuaggaaguaauguugu

SEQ ID NO: 54059 - RNA, 18 nt, Human
ucacauuauaauguaaca

SEQ ID NO: 54060 - RNA, 22 nt, Human
ucacauugccgucugugcacuu

SEQ ID NO: 54061 - RNA, 22 nt, Human
ucacauuguaggucauuugcaa

SEQ ID NO: 54062 - RNA, 21 nt, Human
ucacauuucucauggguaaau

SEQ ID NO: 54063 - RNA, 22 nt, Human
ucacauuuuuuacuggacuuaa

SEQ ID NO: 54064 - RNA, 22 nt, Human
ucaccaaggcauuuucacagca

SEQ ID NO: 54065 - RNA, 22 nt, Human
ucaccaccagaagagcuauucu

SEQ ID NO: 54066 - RNA, 22 nt, Human
ucaccacuaggaauuguguagu

SEQ ID NO: 54067 - RNA, 22 nt, Human
ucaccacugaacagaccuuugg

SEQ ID NO: 54068 - RNA, 22 nt, Human
ucaccaggcuccuguuaagaug

SEQ ID NO: 54069 - RNA, 22 nt, Human
ucaccaggcuggaaugcagugg

SEQ ID NO: 54070 - RNA, 22 nt, Human
ucaccagggagcuuguccucug

SEQ ID NO: 54071 - RNA, 22 nt, Human
ucaccauccucaccuagaaaug

SEQ ID NO: 54072 - RNA, 22 nt, Human
ucaccauuggcaauuauaaaac

SEQ ID NO: 54073 - RNA, 22 nt, Human
ucacccaagaccaucggaagug

SEQ ID NO: 54074 - RNA, 22 nt, Human
ucacccaggauauugaagucag

SEQ ID NO: 54075 - RNA, 19 nt, Human
ucacccaggcugcuggcuc

SEQ ID NO: 54076 - RNA, 22 nt, Human
ucacccaggcuggugcgcagug

SEQ ID NO: 54077 - RNA, 22 nt, Human
ucacccaggguguuuggugucu

SEQ ID NO: 54078 - RNA, 22 nt, Human
ucacccagguccaggcucuggc

SEQ ID NO: 54079 - RNA, 22 nt, Human
ucaccccuggcccagucuugga

SEQ ID NO: 54080 - RNA, 22 nt, Human
ucacccuugauaauguucuucu

SEQ ID NO: 54081 - RNA, 22 nt, Human
ucaccucaccacccuuaugguu

SEQ ID NO: 54082 - RNA, 22 nt, Human
ucaccuguauuaauacagaacu

SEQ ID NO: 54083 - RNA, 22 nt, Human
ucacgagaggcacagaauagag

SEQ ID NO: 54084 - RNA, 23 nt, Human
ucacuaaaguguuuagugcagau

SEQ ID NO: 54085 - RNA, 21 nt, Human
ucacuacaauguucucuuaua

SEQ ID NO: 54086 - RNA, 22 nt, Human
ucacuacauuuuagacaguaaa

SEQ ID NO: 54087 - RNA, 22 nt, Human
ucacucaagcaucuacagggau

SEQ ID NO: 54088 - RNA, 22 nt, Human
ucacucagaaauagaaugaacc

SEQ ID NO: 54089 - RNA, 22 nt, Human
ucacuccucaggcuagcaucau

SEQ ID NO: 54090 - RNA, 22 nt, Human
ucacuccucauugcugcccauu

SEQ ID NO: 54091 - RNA, 22 nt, Human
ucacucugaaugguacugagga

SEQ ID NO: 54092 - RNA, 22 nt, Human
ucacucugagaggucacuggaa

SEQ ID NO: 54093 - RNA, 22 nt, Human
ucacucugcaggaaggagcagc

SEQ ID NO: 54094 - RNA, 15 nt, Human
ucacucuggaaggga

SEQ ID NO: 54095 - RNA, 22 nt, Human
ucacucugggcccuacugggcu

SEQ ID NO: 54096 - RNA, 22 nt, Human
ucacugaaaguaauucuaguga

SEQ ID NO: 54097 - RNA, 22 nt, Human
ucacugaaccagggaucucuag

SEQ ID NO: 54098 - RNA, 22 nt, Human
ucacugaacucucauagagaaa

SEQ ID NO: 54099 - RNA, 22 nt, Human
ucacugaaggaagacacuguca

SEQ ID NO: 54100 - RNA, 22 nt, Human
ucacugaagucuucaaguagga

SEQ ID NO: 54101 - RNA, 22 nt, Human
ucacugaauuucaagcuagugg

SEQ ID NO: 54102 - RNA, 22 nt, Human
ucacugacguggggcuacuuga

SEQ ID NO: 54103 - RNA, 22 nt, Human
ucacugaugcuuaugaaagugu

SEQ ID NO: 54104 - RNA, 22 nt, Human
ucacugcuauauuggauacuga

SEQ ID NO: 54105 - RNA, 22 nt, Human
ucacugcucucuaagcaucgcc

SEQ ID NO: 54106 - RNA, 22 nt, Human
ucacugcucugaaaguacaggg

SEQ ID NO: 54107 - RNA, 21 nt, Human
ucacuggacgugagccagggg

SEQ ID NO: 54108 - RNA, 22 nt, Human
ucacuggagaaaaguaauguau

SEQ ID NO: 54109 - RNA, 22 nt, Human
ucacuggauucucuuuuguucc

SEQ ID NO: 54110 - RNA, 22 nt, Human
ucacugggagaugugggaaggg

SEQ ID NO: 54111 - RNA, 22 nt, Human
ucacugggcccugaggugggac

SEQ ID NO: 54112 - RNA, 22 nt, Human
ucacuggugugagaggagcaaa

SEQ ID NO: 54113 - RNA, 22 nt, Human
ucacuguaauagguuugaagau

SEQ ID NO: 54114 - RNA, 22 nt, Human
ucacuguaccuuccauuucauu

SEQ ID NO: 54115 - RNA, 22 nt, Human
ucacuguaucauguugcacuua

SEQ ID NO: 54116 - RNA, 22 nt, Human
ucacuguaugucuuuuuuugau

SEQ ID NO: 54117 - RNA, 22 nt, Human
ucacuguauuugcugaugcaua

SEQ ID NO: 54118 - RNA, 22 nt, Human
ucacugugaauguuaucaucuu

SEQ ID NO: 54119 - RNA, 23 nt, Human
ucacugugcccauugagguagag

SEQ ID NO: 54120 - RNA, 22 nt, Human
ucacuguguccuuucugcguag

SEQ ID NO: 54121 - RNA, 22 nt, Human
ucacuuagauggggaucaucac

SEQ ID NO: 54122 - RNA, 22 nt, Human
ucacuuaggugcaaagggaacu

SEQ ID NO: 54123 - RNA, 22 nt, Human
ucacuucugaagguaguuggca

SEQ ID NO: 54124 - RNA, 22 nt, Human
ucacuugacuccaguuucuucu

SEQ ID NO: 54125 - RNA, 22 nt, Human
ucacuugacuuuccagucuugg

SEQ ID NO: 54126 - RNA, 22 nt, Human
ucacuuuacagaugggaaaacu

SEQ ID NO: 54127 - RNA, 22 nt, Human
ucacuuuagaggaaacauugag

SEQ ID NO: 54128 - RNA, 22 nt, Human
ucacuuugacagagaaaugaau

SEQ ID NO: 54129 - RNA, 22 nt, Human
ucacuuuugaucccuaugcagu

SEQ ID NO: 54130 - RNA, 22 nt, Human
ucagaaaagagaaaaucuuaua

SEQ ID NO: 54131 - RNA, 22 nt, Human
ucagaaaauaacuguuaguuug

SEQ ID NO: 54132 - RNA, 22 nt, Human
ucagaaaccccaacaauggaga

SEQ ID NO: 54133 - RNA, 22 nt, Human
ucagaaagaacacaggcaguag

SEQ ID NO: 54134 - RNA, 21 nt, Human
ucagauucucucauuuugaug

SEQ ID NO: 54135 - RNA, 22 nt, Human
ucagauuuacugcagagcagau

SEQ ID NO: 54136 - RNA, 22 nt, Human
ucagauuucuucuugcaacggc

SEQ ID NO: 54137 - RNA, 22 nt, Human
ucagauuuuccagccuuucucu

SEQ ID NO: 54138 - RNA, 17 nt, Human
ucagcaaagacaaagga

SEQ ID NO: 54139 - RNA, 22 nt, Human
ucagcaagaagcugugggcuuc

SEQ ID NO: 54140 - RNA, 22 nt, Human
ucagcaaggcugcauucucauc

SEQ ID NO: 54141 - RNA, 20 nt, Human
ucagcacagcugacaagguu

SEQ ID NO: 54142 - RNA, 22 nt, Human
ucagcaccaguuauccucaggg

SEQ ID NO: 54143 - RNA, 22 nt, Human
ucagcacugucuuuuauuugaa

SEQ ID NO: 54144 - RNA, 22 nt, Human
ucagcacuuacuaguggccuuu

SEQ ID NO: 54145 - RNA, 22 nt, Human
ucagcagaggagugucuugccc

SEQ ID NO: 54146 - RNA, 22 nt, Human
ucagcagauggguuguguuggc

SEQ ID NO: 54147 - RNA, 23 nt, Human
ucagcagcagaagugcugggaug

SEQ ID NO: 54148 - RNA, 21 nt, Human
ucagcagcaucugccuagagu

SEQ ID NO: 54149 - RNA, 22 nt, Human
ucagcaggcaccggaaguguuu

SEQ ID NO: 54150 - RNA, 22 nt, Human
ucagcaggcaggaggcaugcca

SEQ ID NO: 54151 - RNA, 22 nt, Human
ucagcaggcccauccuccaggc

SEQ ID NO: 54152 - RNA, 22 nt, Human
ucagcaggcugucagcaggggc

SEQ ID NO: 54153 - RNA, 22 nt, Human
ucagcagggagaggagaaugca

SEQ ID NO: 54154 - RNA, 22 nt, Human
ucagcagggcugggagcuguga

SEQ ID NO: 54155 - RNA, 22 nt, Human
ucagcagggcugugguguggcu

SEQ ID NO: 54156 - RNA, 22 nt, Human
ucagcaggucugaggcggggcc

SEQ ID NO: 54157 - RNA, 22 nt, Human
ucagcaggugaacaucaugcca

SEQ ID NO: 54158 - RNA, 22 nt, Human
ucagcagugcagggugaggcag

SEQ ID NO: 54159 - RNA, 22 nt, Human
ucagcauaucuugagcuucaug

SEQ ID NO: 54160 - RNA, 22 nt, Human
ucagcauauguuuggagugucc

SEQ ID NO: 54161 - RNA, 19 nt, Human
ucagcaucaauuugguccu

SEQ ID NO: 54162 - RNA, 22 nt, Human
ucagcaucaguauuguuuagga

SEQ ID NO: 54163 - RNA, 22 nt, Human
ucagcaucuacagcuuugcuau

SEQ ID NO: 54164 - RNA, 20 nt, Human
ucagcaugcuccucagacau

SEQ ID NO: 54165 - RNA, 18 nt, Human
uaguggaacugcucuggg

SEQ ID NO: 54166 - RNA, 22 nt, Human
uaguggagaggauguggagaaa

SEQ ID NO: 54167 - RNA, 22 nt, Human
uaguggaggguguagcugcugg

SEQ ID NO: 54168 - RNA, 22 nt, Human
uaguggaguagaaaccaaagaa

SEQ ID NO: 54169 - RNA, 22 nt, Human
uaguggcaaaagcauuuugggu

SEQ ID NO: 54170 - RNA, 22 nt, Human
uaguggggaaggaggacaagaa

SEQ ID NO: 54171 - RNA, 22 nt, Human
uaguguaaacuuaugcugagcc

SEQ ID NO: 54172 - RNA, 22 nt, Human
uaguguaaugacauuuagacga

SEQ ID NO: 54173 - RNA, 22 nt, Human
uaguguaugucuaacauacacu

SEQ ID NO: 54174 - RNA, 22 nt, Human
uagugucaaacagggauuagaa

SEQ ID NO: 54175 - RNA, 22 nt, Human
uagugucaaauagccugagcuu

SEQ ID NO: 54176 - RNA, 22 nt, Human
uagugucagagaaucuugguuu

SEQ ID NO: 54177 - RNA, 23 nt, Human
uagugucauccucagcuucuguu

SEQ ID NO: 54178 - RNA, 22 nt, Human
uagugucucggggcccaggauu

SEQ ID NO: 54179 - RNA, 22 nt, Human
uagugucugaaugcaccuguuu

SEQ ID NO: 54180 - RNA, 22 nt, Human
uagugugguaaauaaauguuuu

SEQ ID NO: 54181 - RNA, 22 nt, Human
uagugugguaucuucuauggaa

SEQ ID NO: 54182 - RNA, 22 nt, Human
uaguguguaugguaaugaugaa

SEQ ID NO: 54183 - RNA, 22 nt, Human
uaguuaaaccaccauucuggua

SEQ ID NO: 54184 - RNA, 22 nt, Human
uaguuaaagcccuaaauugaua

SEQ ID NO: 54185 - RNA, 22 nt, Human
uaguuaauucuuuaagaacaag

SEQ ID NO: 54186 - RNA, 22 nt, Human
uaguuacaauuaugcauggaaa

SEQ ID NO: 54187 - RNA, 22 nt, Human
uaguuacagaagauaaggguau

SEQ ID NO: 54188 - RNA, 22 nt, Human
uaguuacagaucuaggacuguu

SEQ ID NO: 54189 - RNA, 22 nt, Human
uaguuacagcaggcaggauaua

SEQ ID NO: 54190 - RNA, 22 nt, Human
uaguuacaggaguuucugaaau

SEQ ID NO: 54191 - RNA, 22 nt, Human
uaguuacauaaaguggacuguu

SEQ ID NO: 54192 - RNA, 22 nt, Human
uaguuagagaugaauuuugucu

SEQ ID NO: 54193 - RNA, 21 nt, Human
uaguucuacuucagucucaug

SEQ ID NO: 54194 - RNA, 22 nt, Human
uaguucuguguagcucaagagu

SEQ ID NO: 54195 - RNA, 22 nt, Human
uaguugaaagggauuauugugg

SEQ ID NO: 54196 - RNA, 22 nt, Human
uaguuuacucaucuauaaaaug

SEQ ID NO: 54197 - RNA, 22 nt, Human
uaguuuagcauacaucuucagg

SEQ ID NO: 54198 - RNA, 22 nt, Human
uaguuuagcuuagccuucuggu

SEQ ID NO: 54199 - RNA, 22 nt, Human
uaguuuagugaaugguuaaaga

SEQ ID NO: 54200 - RNA, 22 nt, Human
uaguuuaugcugcugcagugag

SEQ ID NO: 54201 - RNA, 22 nt, Human
uaguuuccauguuauacaguuu

SEQ ID NO: 54202 - RNA, 22 nt, Human
uaguuuccuaggcuguauuguu

SEQ ID NO: 54203 - RNA, 22 nt, Human
uaguuucuaaacugaacuguca

SEQ ID NO: 54204 - RNA, 22 nt, Human
uaguuucugaggauugaaagau

SEQ ID NO: 54205 - RNA, 22 nt, Human
uaguuucugccucggaagcuga

SEQ ID NO: 54206 - RNA, 22 nt, Human
uaguuucugguucuugcucugg

SEQ ID NO: 54207 - RNA, 22 nt, Human
uaguuucuucaccuguaaaaug

SEQ ID NO: 54208 - RNA, 22 nt, Human
uaguuuuacaucagccauuguu

SEQ ID NO: 54209 - RNA, 22 nt, Human
uaguuuuagucccauuuuacag

SEQ ID NO: 54210 - RNA, 22 nt, Human
uaguuuugauuaguauugucuu

SEQ ID NO: 54211 - RNA, 22 nt, Human
uaguuuuuucaacaaauggugc

SEQ ID NO: 54212 - RNA, 22 nt, Human
uauaaacuccucuugcauuccu

SEQ ID NO: 54213 - RNA, 22 nt, Human
uauaaagcugacucaugaaacu

SEQ ID NO: 54214 - RNA, 22 nt, Human
uauaaaucuuuguuccuagaau

SEQ ID NO: 54215 - RNA, 22 nt, Human
uauaaaugcacuuuugaaauau

SEQ ID NO: 54216 - RNA, 22 nt, Human
uauaaccuggauucuggcacua

SEQ ID NO: 54217 - RNA, 22 nt, Human
uauaacugagaagauacauagu

SEQ ID NO: 54218 - RNA, 22 nt, Human
uauaagcacauccuugacugau

SEQ ID NO: 54219 - RNA, 22 nt, Human
uauaagccauccagccuguggu

SEQ ID NO: 54220 - RNA, 22 nt, Human
uauaagccucgaugguaagccu

SEQ ID NO: 54221 - RNA, 22 nt, Human
uauaagugacagauuauccaaa

SEQ ID NO: 54222 - RNA, 22 nt, Human
uauaauccugcuucacauugaa

SEQ ID NO: 54223 - RNA, 22 nt, Human
uauaaucugguuuuauuaagag

SEQ ID NO: 54224 - RNA, 22 nt, Human
uauaauguuuuccauggacuga

SEQ ID NO: 54225 - RNA, 22 nt, Human
uauaauuuaucaugucacaguu

SEQ ID NO: 54226 - RNA, 22 nt, Human
uauacacauuacaguuucagga

SEQ ID NO: 54227 - RNA, 22 nt, Human
uauacacauuuuuaccuauagu

SEQ ID NO: 54228 - RNA, 21 nt, Human
uauacagcaaagucuggagca

SEQ ID NO: 54229 - RNA, 22 nt, Human
uauacaggaaauuuuggaacag

SEQ ID NO: 54230 - RNA, 22 nt, Human
uauacaguuugaguucuugcau

SEQ ID NO: 54231 - RNA, 22 nt, Human
uauaccaugugugcacacuccc

SEQ ID NO: 54232 - RNA, 22 nt, Human
uauacugauuugucuauacucu

SEQ ID NO: 54233 - RNA, 22 nt, Human
uauacuuuccugcaacuuugau

SEQ ID NO: 54234 - RNA, 22 nt, Human
uauagaacaaguuauuuaugcu

SEQ ID NO: 54235 - RNA, 22 nt, Human
uauagaaguaagcauugugaug

SEQ ID NO: 54236 - RNA, 22 nt, Human
uauagagguggaaacugagguu

SEQ ID NO: 54237 - RNA, 22 nt, Human
uauagagucauguuuacucuaa

SEQ ID NO: 54238 - RNA, 22 nt, Human
uauagauagacugacgauacag

SEQ ID NO: 54239 - RNA, 22 nt, Human
uauagaucuugcuauuuaagga

SEQ ID NO: 54240 - RNA, 22 nt, Human
uauagcaaaauaguuuccacac

SEQ ID NO: 54241 - RNA, 22 nt, Human
uauagcaacuccaaagagacuu

SEQ ID NO: 54242 - RNA, 22 nt, Human
uauagcaauucagaauacaugu

SEQ ID NO: 54243 - RNA, 22 nt, Human
ucauacaucuguccuggagcuc

SEQ ID NO: 54244 - RNA, 22 nt, Human
ucauacauguuguguucaaaug

SEQ ID NO: 54245 - RNA, 22 nt, Human
ucauagaaguaguauccacauu

SEQ ID NO: 54246 - RNA, 22 nt, Human
ucauagaaugaguuaaugaacu

SEQ ID NO: 54247 - RNA, 22 nt, Human
ucauagcuaagcuccagagugc

SEQ ID NO: 54248 - RNA, 22 nt, Human
ucauaggaguagcagugagagg

SEQ ID NO: 54249 - RNA, 22 nt, Human
ucauaguucuguuuugaaggau

SEQ ID NO: 54250 - RNA, 22 nt, Human
ucauaguuuaguuaguaugauu

SEQ ID NO: 54251 - RNA, 22 nt, Human
ucauauagagggcauacaaaug

SEQ ID NO: 54252 - RNA, 22 nt, Human
ucauauauuuaguugugcaaca

SEQ ID NO: 54253 - RNA, 22 nt, Human
ucauaugucacucaugggcaua

SEQ ID NO: 54254 - RNA, 22 nt, Human
ucauauuuaggccuuuaauuca

SEQ ID NO: 54255 - RNA, 22 nt, Human
ucauauuuaguucacgcucaau

SEQ ID NO: 54256 - RNA, 22 nt, Human
ucauauuuugcaaggucagcua

SEQ ID NO: 54257 - RNA, 23 nt, Human
ucaucaaacagcugcucaagaaa

SEQ ID NO: 54258 - RNA, 23 nt, Human
ucaucaaaggaaguacgugucac

SEQ ID NO: 54259 - RNA, 22 nt, Human
ucaucaaagucaaagaaugacu

SEQ ID NO: 54260 - RNA, 22 nt, Human
ucaucagagcucccccaaacgu

SEQ ID NO: 54261 - RNA, 22 nt, Human
ucaucagcuccaugagguacuc

SEQ ID NO: 54262 - RNA, 22 nt, Human
ucaucagucagaacuuaagcuu

SEQ ID NO: 54263 - RNA, 22 nt, Human
ucaucaguguccuuaucacuua

SEQ ID NO: 54264 - RNA, 22 nt, Human
ucauccaaggauuuuauugcau

SEQ ID NO: 54265 - RNA, 22 nt, Human
ucauccagagcuucauaaguaa

SEQ ID NO: 54266 - RNA, 22 nt, Human
ucauccaguucacauggugagu

SEQ ID NO: 54267 - RNA, 22 nt, Human
ucauccauacuauugagaggca

SEQ ID NO: 54268 - RNA, 22 nt, Human
ucauccaugaagagugacagaa

SEQ ID NO: 54269 - RNA, 22 nt, Human
ucauccaugucagagcauguau

SEQ ID NO: 54270 - RNA, 22 nt, Human
ucaucccuaaggacagcucugc

SEQ ID NO: 54271 - RNA, 22 nt, Human
ucauccuguauccucagaccau

SEQ ID NO: 54272 - RNA, 22 nt, Human
ucauccugucucacuuuuugcu

SEQ ID NO: 54273 - RNA, 22 nt, Human
ucaucuauuuauguagaacaag

SEQ ID NO: 54274 - RNA, 19 nt, Human
ucaucucacagggccuggc

SEQ ID NO: 54275 - RNA, 22 nt, Human
ucaucucagggcgacaucaugu

SEQ ID NO: 54276 - RNA, 22 nt, Human
ucaucugaagauugcuguucaa

SEQ ID NO: 54277 - RNA, 22 nt, Human
ucaucugggagcuuguuagaaa

SEQ ID NO: 54278 - RNA, 22 nt, Human
ucaucugugcaggacucagaag

SEQ ID NO: 54279 - RNA, 22 nt, Human
ucaucuguggcugcuuuugugc

SEQ ID NO: 54280 - RNA, 22 nt, Human
ucaucuguuucucuguaguucu

SEQ ID NO: 54281 - RNA, 22 nt, Human
ucaucuugcaguguguguucug

SEQ ID NO: 54282 - RNA, 22 nt, Human
ucaucuugcugccauugcuuua

SEQ ID NO: 54283 - RNA, 22 nt, Human
ucaucuuuccucaaaagaucca

SEQ ID NO: 54284 - RNA, 22 nt, Human
ucaucuuuguaucccuaacaca

SEQ ID NO: 54285 - RNA, 22 nt, Human
ucaugaggauuuacuagacuag

SEQ ID NO: 54286 - RNA, 22 nt, Human
ucaugagucugcaaauuaugga

SEQ ID NO: 54287 - RNA, 22 nt, Human
ucaugcaaaagacuugaacuuu

SEQ ID NO: 54288 - RNA, 22 nt, Human
ucaugcaaacucuaguccuuua

SEQ ID NO: 54289 - RNA, 22 nt, Human
ucaugcaaauacuguuccagaa

SEQ ID NO: 54290 - RNA, 22 nt, Human
ucaugcaacgauccuccaaaug

SEQ ID NO: 54291 - RNA, 22 nt, Human
ucaugcacuacauaacgauguu

SEQ ID NO: 54292 - RNA, 23 nt, Human
ucaugcagagaaggacugcuuac

SEQ ID NO: 54293 - RNA, 22 nt, Human
ucaugcagaggaaggcuaguuu

SEQ ID NO: 54294 - RNA, 22 nt, Human
ucaugcaggacuuacaagagau

SEQ ID NO: 54295 - RNA, 21 nt, Human
ucaugcaggcagaguuuggua

SEQ ID NO: 54296 - RNA, 22 nt, Human
ucaugcagugaaucuuucuugc

SEQ ID NO: 54297 - RNA, 22 nt, Human
ucaugcaguuucuuaucugcca

SEQ ID NO: 54298 - RNA, 22 nt, Human
uggaagagacacuuacauucag

SEQ ID NO: 54299 - RNA, 19 nt, Human
uggaagaggaagggaaaua

SEQ ID NO: 54300 - RNA, 22 nt, Human
uggaagaugaauaaagauucua

SEQ ID NO: 54301 - RNA, 23 nt, Human
uggaagcaaucacuguagugaau

SEQ ID NO: 54302 - RNA, 22 nt, Human
uggaagccaaggucagaaggag

SEQ ID NO: 54303 - RNA, 22 nt, Human
uggaagcucaaggcagggugag

SEQ ID NO: 54304 - RNA, 18 nt, Human
uggaagcuggcagauuuu

SEQ ID NO: 54305 - RNA, 17 nt, Human
uggaagcuucauguugg

SEQ ID NO: 54306 - RNA, 22 nt, Human
uggaaggagcuaaggaccuggg

SEQ ID NO: 54307 - RNA, 22 nt, Human
uggaaggcaacggagugagcug

SEQ ID NO: 54308 - RNA, 20 nt, Human
uggaaggcaucugcauuauu

SEQ ID NO: 54309 - RNA, 22 nt, Human
uggaaggccuguuguguccuag

SEQ ID NO: 54310 - RNA, 21 nt, Human
uggaaggcugcucugccaggg

SEQ ID NO: 54311 - RNA, 22 nt, Human
uggaaggcuuugcuguccuugc

SEQ ID NO: 54312 - RNA, 22 nt, Human
uggaagggagcuggaauuugga

SEQ ID NO: 54313 - RNA, 21 nt, Human
uggaagucuugaguagggggc

SEQ ID NO: 54314 - RNA, 22 nt, Human
uggaagugcuaaacuggagugu

SEQ ID NO: 54315 - RNA, 22 nt, Human
uggaaguggcagaggaaguggu

SEQ ID NO: 54316 - RNA, 22 nt, Human
uggaauaaagcagcuuuaguuc

SEQ ID NO: 54317 - RNA, 22 nt, Human
uggaauaaagugcuuugaucag

SEQ ID NO: 54318 - RNA, 22 nt, Human
uggaaucaguuacaugugguug

SEQ ID NO: 54319 - RNA, 22 nt, Human
uggaaucucugguaucugggga

SEQ ID NO: 54320 - RNA, 22 nt, Human
uggaaucucuuuggggacugaa

SEQ ID NO: 54321 - RNA, 22 nt, Human
uggaaucuuuaggaagcacaua

SEQ ID NO: 54322 - RNA, 22 nt, Human
uggaaugaaaauggagaucuug

SEQ ID NO: 54323 - RNA, 22 nt, Human
uggaaugaagacauguuguuug

SEQ ID NO: 54324 - RNA, 21 nt, Human
uggaaugaggcugagcagugc

SEQ ID NO: 54325 - RNA, 20 nt, Human
uggaauggguccuugaaaaa

SEQ ID NO: 54326 - RNA, 22 nt, Human
uggaauguagcaaguguuguca

SEQ ID NO: 54327 - RNA, 22 nt, Human
uggaauguauagauguuaugua

SEQ ID NO: 54328 - RNA, 23 nt, Human
uggaaugucugauucugcucuag

SEQ ID NO: 54329 - RNA, 22 nt, Human
uggaaugugcuacuguugauuu

SEQ ID NO: 54330 - RNA, 22 nt, Human
uggaauguugcauaagaucuga

SEQ ID NO: 54331 - RNA, 22 nt, Human
uggaauguugggauuuaagugu

SEQ ID NO: 54332 - RNA, 22 nt, Human
uggaauguuuuccuaaaucaga

SEQ ID NO: 54333 - RNA, 22 nt, Human
uggaauuaauaggggauauaca

SEQ ID NO: 54334 - RNA, 20 nt, Human
uggacagaauuagacacuuu

SEQ ID NO: 54335 - RNA, 22 nt, Human
uggacagagaggaaggccauuu

SEQ ID NO: 54336 - RNA, 23 nt, Human
uggacagcagcagcagugucacc

SEQ ID NO: 54337 - RNA, 22 nt, Human
uggacagccaugcaaaugagcu

SEQ ID NO: 54338 - RNA, 22 nt, Human
uggacaggcuccuagggguucc

SEQ ID NO: 54339 - RNA, 23 nt, Human
uggacaggguaacuggugguuuu

SEQ ID NO: 54340 - RNA, 22 nt, Human
uggacaguaagagaagauguag

SEQ ID NO: 54341 - RNA, 22 nt, Human
uggacaucuuagucaugucaau

SEQ ID NO: 54342 - RNA, 22 nt, Human
uggacaugagcugagugggugu

SEQ ID NO: 54343 - RNA, 22 nt, Human
uggacaugucuucuccaagaaa

SEQ ID NO: 54344 - RNA, 21 nt, Human
uggaccaaaguaauuugccuu

SEQ ID NO: 54345 - RNA, 22 nt, Human
uggaccacauagugaggccccc

SEQ ID NO: 54346 - RNA, 22 nt, Human
uggaccacucuggugcccaugu

SEQ ID NO: 54347 - RNA, 20 nt, Human
uggaccauaaacaccaggua

SEQ ID NO: 54348 - RNA, 22 nt, Human
uggaccaugagcugcagguguu

SEQ ID NO: 54349 - RNA, 22 nt, Human
uggacccaccccagggccugcu

SEQ ID NO: 54350 - RNA, 22 nt, Human
uggacccugaagcaacagggag

SEQ ID NO: 54351 - RNA, 23 nt, Human
uggacccugcacaccagcucuac

SEQ ID NO: 54352 - RNA, 22 nt, Human
uauucuugucuuuuccagaaau

SEQ ID NO: 54353 - RNA, 22 nt, Human
uauugaaauccauuacguucuu

SEQ ID NO: 54354 - RNA, 22 nt, Human
uauugaagagauaagugacaga

SEQ ID NO: 54355 - RNA, 22 nt, Human
uauugagacuuccaguauauga

SEQ ID NO: 54356 - RNA, 22 nt, Human
uauugaugcuuggauugggcca

SEQ ID NO: 54357 - RNA, 22 nt, Human
uauugauuccugcuuucugcuc

SEQ ID NO: 54358 - RNA, 22 nt, Human
uauugcagaagaaaugaaugaa

SEQ ID NO: 54359 - RNA, 22 nt, Human
uauugcaucucuucauaucugu

SEQ ID NO: 54360 - RNA, 22 nt, Human
uauugcaugugauagaggcagg

SEQ ID NO: 54361 - RNA, 22 nt, Human
uauugcauuucccacguucacu

SEQ ID NO: 54362 - RNA, 22 nt, Human
uauugcugaaaugcugaguuca

SEQ ID NO: 54363 - RNA, 22 nt, Human
uauugcugacugucuucugagu

SEQ ID NO: 54364 - RNA, 22 nt, Human
uauugcugaugcugaagggaag

SEQ ID NO: 54365 - RNA, 22 nt, Human
uauugcugccucguccaggcug

SEQ ID NO: 54366 - RNA, 22 nt, Human
uauugcuggggugggccauguu

SEQ ID NO: 54367 - RNA, 22 nt, Human
uauugcuggugcuguucugaau

SEQ ID NO: 54368 - RNA, 22 nt, Human
uauugcuguucuuuaaaugaag

SEQ ID NO: 54369 - RNA, 22 nt, Human
uauugcuuuuauuucuauggac

SEQ ID NO: 54370 - RNA, 22 nt, Human
uauuggaaggaagcaagagagg

SEQ ID NO: 54371 - RNA, 22 nt, Human
uauuggaaggcauuagugaaua

SEQ ID NO: 54372 - RNA, 22 nt, Human
uauuggaagugaacaccaggcu

SEQ ID NO: 54373 - RNA, 22 nt, Human
uauuggaccacagacuuuaagg

SEQ ID NO: 54374 - RNA, 22 nt, Human
uauuggauagcuugugcagaau

SEQ ID NO: 54375 - RNA, 22 nt, Human
uauuggucaaguugaggacccu

SEQ ID NO: 54376 - RNA, 22 nt, Human
uauuggucaauuucaccuugau

SEQ ID NO: 54377 - RNA, 22 nt, Human
uauuggucugcuuaaguggauu

SEQ ID NO: 54378 - RNA, 22 nt, Human
uauuggucuuggaagguuuugu

SEQ ID NO: 54379 - RNA, 22 nt, Human
uauuguacaugguuaugcagga

SEQ ID NO: 54380 - RNA, 22 nt, Human
uauuguacauuuccaaauugcu

SEQ ID NO: 54381 - RNA, 22 nt, Human
uauuguacugaggaauaaagcu

SEQ ID NO: 54382 - RNA, 22 nt, Human
uauuguccauggcugcuuuggu

SEQ ID NO: 54383 - RNA, 22 nt, Human
uauuguccaugugucuguuagc

SEQ ID NO: 54384 - RNA, 22 nt, Human
uauugucuucaacucuacuuuu

SEQ ID NO: 54385 - RNA, 22 nt, Human
uauugugaagggaaaaauagug

SEQ ID NO: 54386 - RNA, 22 nt, Human
uauugugaguucagacuaaaaa

SEQ ID NO: 54387 - RNA, 22 nt, Human
uauugugcauguugaauaacua

SEQ ID NO: 54388 - RNA, 22 nt, Human
uauuuacuuuuaaauugagaac

SEQ ID NO: 54389 - RNA, 22 nt, Human
uauuuagaugcauuuggauugc

SEQ ID NO: 54390 - RNA, 21 nt, Human
uauuuauuaauuuguaaggcu

SEQ ID NO: 54391 - RNA, 19 nt, Human
uauuucaaagugccgucua

SEQ ID NO: 54392 - RNA, 22 nt, Human
uauuucacaugugggaaacaua

SEQ ID NO: 54393 - RNA, 22 nt, Human
uauuucacucaguauaccauag

SEQ ID NO: 54394 - RNA, 22 nt, Human
uauuucagaguuguuuucuguc

SEQ ID NO: 54395 - RNA, 22 nt, Human
uauuucagcaagaagaaugugg

SEQ ID NO: 54396 - RNA, 22 nt, Human
uauuuccaagcugaauccaaug

SEQ ID NO: 54397 - RNA, 22 nt, Human
uauuuccacccucaguaaggaa

SEQ ID NO: 54398 - RNA, 22 nt, Human
uauuuccagaggaguauagaag

SEQ ID NO: 54399 - RNA, 22 nt, Human
uauuuccagcaguaagaagaca

SEQ ID NO: 54400 - RNA, 22 nt, Human
uauuuccaggccccacucuaga

SEQ ID NO: 54401 - RNA, 22 nt, Human
uauuuccuguggauacuuuuag

SEQ ID NO: 54402 - RNA, 22 nt, Human
uauuucucuucaaaauugaugu

SEQ ID NO: 54403 - RNA, 22 nt, Human
uauuucucuuuguagggauaua

SEQ ID NO: 54404 - RNA, 22 nt, Human
uauuucugaggcccaggaagug

SEQ ID NO: 54405 - RNA, 22 nt, Human
uauuucugauugcucaugaggc

SEQ ID NO: 54406 - RNA, 22 nt, Human
uauuucugggaguucagaaauu

SEQ ID NO: 54407 - RNA, 22 nt, Human
uauuucuguaugcauaaaagga

SEQ ID NO: 54408 - RNA, 22 nt, Human
uauuucugucagccagauaugg

SEQ ID NO: 54409 - RNA, 22 nt, Human
uauuugaagauucuucugaugu

SEQ ID NO: 54410 - RNA, 22 nt, Human
uauuugagcgaagcaguguuuu

SEQ ID NO: 54411 - RNA, 22 nt, Human
uauuugauagagauaaaugaua

SEQ ID NO: 54412 - RNA, 22 nt, Human
uauuugcaggacauagauaugg

SEQ ID NO: 54413 - RNA, 22 nt, Human
uauuugcugacagugcuggagc

SEQ ID NO: 54414 - RNA, 21 nt, Human
uauuugcugccaucuuugagg

SEQ ID NO: 54415 - RNA, 22 nt, Human
uauuugcugugcuuauuccauu

SEQ ID NO: 54416 - RNA, 22 nt, Human
uauuuggauagacagggagaug

SEQ ID NO: 54417 - RNA, 22 nt, Human
uauuuguagaauggauuaaggg

SEQ ID NO: 54418 - RNA, 22 nt, Human
uggaggcauuucuuuuuggucg

SEQ ID NO: 54419 - RNA, 22 nt, Human
uggaggcauuugauguucauaa

SEQ ID NO: 54420 - RNA, 22 nt, Human
uggaggcauuuuagguugucac

SEQ ID NO: 54421 - RNA, 22 nt, Human
uggaggccacaugaacgcugcg

SEQ ID NO: 54422 - RNA, 19 nt, Human
uggaggccaggacacaggu

SEQ ID NO: 54423 - RNA, 22 nt, Human
uggaggccggacugagaggcau

SEQ ID NO: 54424 - RNA, 19 nt, Human
uggaggccucaggaaaaga

SEQ ID NO: 54425 - RNA, 22 nt, Human
uggagggaacaaaggaguccca

SEQ ID NO: 54426 - RNA, 23 nt, Human
uggagggcagaauaacagacuac

SEQ ID NO: 54427 - RNA, 22 nt, Human
uggagggcauagcuguucuuuc

SEQ ID NO: 54428 - RNA, 22 nt, Human
uggagggcaucuguggucaggc

SEQ ID NO: 54429 - RNA, 22 nt, Human
uggagggcuaagcugagggaua

SEQ ID NO: 54430 - RNA, 22 nt, Human
uggagggcucuuucaccuggua

SEQ ID NO: 54431 - RNA, 22 nt, Human
uggagguacauaaugagagggu

SEQ ID NO: 54432 - RNA, 22 nt, Human
uggagguccugcaggauggcac

SEQ ID NO: 54433 - RNA, 22 nt, Human
uggagguccuggcuggguuuua

SEQ ID NO: 54434 - RNA, 22 nt, Human
uggaggucugcaaggcgcugga

SEQ ID NO: 54435 - RNA, 22 nt, Human
uggaggugacggggccucguug

SEQ ID NO: 54436 - RNA, 22 nt, Human
uggagguugggaugcuugugau

SEQ ID NO: 54437 - RNA, 18 nt, Human
uggagucagugacaccag

SEQ ID NO: 54438 - RNA, 20 nt, Human
uggagucaugggacacucac

SEQ ID NO: 54439 - RNA, 22 nt, Human
uggaguccgcuccaaguucucu

SEQ ID NO: 54440 - RNA, 22 nt, Human
uggaguccuuguuggaagugaa

SEQ ID NO: 54441 - RNA, 22 nt, Human
uggagucugugaugcucugggu

SEQ ID NO: 54442 - RNA, 20 nt, Human
uggaguuguucugcuagguc

SEQ ID NO: 54443 - RNA, 22 nt, Human
uggauaaaaugacauuaccuga

SEQ ID NO: 54444 - RNA, 22 nt, Human
uggauaaacucacuguaaguug

SEQ ID NO: 54445 - RNA, 23 nt, Human
uggauaaagcugugcugcauagg

SEQ ID NO: 54446 - RNA, 22 nt, Human
uggauaaauggugcuaucaccc

SEQ ID NO: 54447 - RNA, 22 nt, Human
uggauaugcccagggcacccua

SEQ ID NO: 54448 - RNA, 22 nt, Human
uggauauguuggaggugaaggu

SEQ ID NO: 54449 - RNA, 22 nt, Human
uggaucugcucuaugaacugcu

SEQ ID NO: 54450 - RNA, 21 nt, Human
uggaucugugaucuggggcac

SEQ ID NO: 54451 - RNA, 22 nt, Human
uggaucuugaugcuccaagagu

SEQ ID NO: 54452 - RNA, 20 nt, Human
uggaugcugcacguagaugg

SEQ ID NO: 54453 - RNA, 22 nt, Human
uggaugcugcugucagggaugg

SEQ ID NO: 54454 - RNA, 22 nt, Human
uggaugcuguaggacacgcucu

SEQ ID NO: 54455 - RNA, 19 nt, Human
uggauggagccugugguug

SEQ ID NO: 54456 - RNA, 22 nt, Human
uggauggaucucaagggaauua

SEQ ID NO: 54457 - RNA, 22 nt, Human
uggauggauugacgaaggcagc

SEQ ID NO: 54458 - RNA, 22 nt, Human
uggauggggcagcuuaggugug

SEQ ID NO: 54459 - RNA, 22 nt, Human
uggaugguucugggcggcagca

SEQ ID NO: 54460 - RNA, 17 nt, Human
uggaugugggaucugga

SEQ ID NO: 54461 - RNA, 22 nt, Human
uccacuggcccaccuccucagu

SEQ ID NO: 54462 - RNA, 22 nt, Human
uccacugguauccacagugggg

SEQ ID NO: 54463 - RNA, 22 nt, Human
uccacuucuauugggucuuggu

SEQ ID NO: 54464 - RNA, 22 nt, Human
uccagaaaaaguaauuuauuug

SEQ ID NO: 54465 - RNA, 22 nt, Human
uccagaaacuucauuugcaagc

SEQ ID NO: 54466 - RNA, 22 nt, Human
uccagaaacuuuuccagucuca

SEQ ID NO: 54467 - RNA, 22 nt, Human
uccagaaaguacaugggauuca

SEQ ID NO: 54468 - RNA, 21 nt, Human
uccagaccucccucuccuagc

SEQ ID NO: 54469 - RNA, 23 nt, Human
uccagacucuaaagcccuccaca

SEQ ID NO: 54470 - RNA, 19 nt, Human
uccagacuguccaggcuau

SEQ ID NO: 54471 - RNA, 22 nt, Human
uccagagaaaucuagucuuaca

SEQ ID NO: 54472 - RNA, 22 nt, Human
uccagagaauucuacgcagugc

SEQ ID NO: 54473 - RNA, 22 nt, Human
uccagagagaaaaacaagcuuu

SEQ ID NO: 54474 - RNA, 22 nt, Human
uccagagagauaguggcuaaua

SEQ ID NO: 54475 - RNA, 22 nt, Human
uccagagagccacggacagggg

SEQ ID NO: 54476 - RNA, 22 nt, Human
uccagagagguuucuccaugcu

SEQ ID NO: 54477 - RNA, 22 nt, Human
uccagagauaacuauuuaggag

SEQ ID NO: 54478 - RNA, 22 nt, Human
uccagagaucacacugggcagg

SEQ ID NO: 54479 - RNA, 22 nt, Human
uccagagauccaaagaauauga

SEQ ID NO: 54480 - RNA, 22 nt, Human
uccagagccuauauguucaacu

SEQ ID NO: 54481 - RNA, 22 nt, Human
uccagagccuuuccacccacuu

SEQ ID NO: 54482 - RNA, 22 nt, Human
uccagagcuaauucagcagcug

SEQ ID NO: 54483 - RNA, 22 nt, Human
uccagagcugagggucaguaga

SEQ ID NO: 54484 - RNA, 22 nt, Human
uccagaggugaacacccaggca

SEQ ID NO: 54485 - RNA, 22 nt, Human
uccagaguacggaagagucauc

SEQ ID NO: 54486 - RNA, 22 nt, Human
uccagaguuugagucuccuucc

SEQ ID NO: 54487 - RNA, 22 nt, Human
uccagauagaguccuguuagua

SEQ ID NO: 54488 - RNA, 19 nt, Human
uccagaugauauggauuac

SEQ ID NO: 54489 - RNA, 22 nt, Human
uccagauggauuuaagaccuaa

SEQ ID NO: 54490 - RNA, 22 nt, Human
uccagcaaagugauaggauuuc

SEQ ID NO: 54491 - RNA, 20 nt, Human
uccagcacccucacagagaa

SEQ ID NO: 54492 - RNA, 22 nt, Human
uccagcagugcucuagagcgug

SEQ ID NO: 54493 - RNA, 22 nt, Human
uccagcaugacuaguuccccau

SEQ ID NO: 54494 - RNA, 21 nt, Human
uccagccaguaaaugcucagc

SEQ ID NO: 54495 - RNA, 22 nt, Human
uccagcccacaccugaagcugg

SEQ ID NO: 54496 - RNA, 18 nt, Human
uccagcccacauuuucug

SEQ ID NO: 54497 - RNA, 22 nt, Human
uccagcccagcuccucucagaa

SEQ ID NO: 54498 - RNA, 22 nt, Human
uccagcccaucccuagccuggg

SEQ ID NO: 54499 - RNA, 22 nt, Human
uccagccccgggauguucuuca

SEQ ID NO: 54500 - RNA, 19 nt, Human
uccagccccucugugugug

SEQ ID NO: 54501 - RNA, 20 nt, Human
uccagccccugcauguugcu

SEQ ID NO: 54502 - RNA, 22 nt, Human
uccagcccuguggcuuccaccc

SEQ ID NO: 54503 - RNA, 22 nt, Human
uccagccuaauguucuucccac

SEQ ID NO: 54504 - RNA, 22 nt, Human
uccagccuaggggaacagcugc

SEQ ID NO: 54505 - RNA, 22 nt, Human
uccagccuccuauuuacccuaa

SEQ ID NO: 54506 - RNA, 17 nt, Human
uccagccuccucugcug

SEQ ID NO: 54507 - RNA, 22 nt, Human
uccagccuuccuuuucacucuc

SEQ ID NO: 54508 - RNA, 21 nt, Human
uccagccuuucccucacuucc

SEQ ID NO: 54509 - RNA, 22 nt, Human
uccagccuuucuacucacugag

SEQ ID NO: 54510 - RNA, 22 nt, Human
uccagcucaggguuggcucaag

SEQ ID NO: 54511 - RNA, 22 nt, Human
uccagcucaucugucuccauua

SEQ ID NO: 54512 - RNA, 22 nt, Human
uccagcucuaaggcugauagcc

SEQ ID NO: 54513 - RNA, 22 nt, Human
uccagcucugauucucacuagc

SEQ ID NO: 54514 - RNA, 18 nt, Human
uccagcucugccacuuac

SEQ ID NO: 54515 - RNA, 22 nt, Human
uccagcucugcugugcgccggu

SEQ ID NO: 54516 - RNA, 22 nt, Human
uccagcucuucaguucugcaaa

SEQ ID NO: 54517 - RNA, 20 nt, Human
uccagcugacauucucuuuc

SEQ ID NO: 54518 - RNA, 22 nt, Human
uccagcugagguggccucugug

SEQ ID NO: 54519 - RNA, 22 nt, Human
uccagcugcaaggggcacagcu

SEQ ID NO: 54520 - RNA, 22 nt, Human
uccagcugccaaccgggccccg

SEQ ID NO: 54521 - RNA, 22 nt, Human
uccagcuggccuaacuucaggg

SEQ ID NO: 54522 - RNA, 22 nt, Human
uccagcuggggacaugggcuuc

SEQ ID NO: 54523 - RNA, 22 nt, Human
uccagcuggggcaguggcuggg

SEQ ID NO: 54524 - RNA, 20 nt, Human
uccagcugucuuucagagac

SEQ ID NO: 54525 - RNA, 21 nt, Human
uccagcugugauuaugaaugu

SEQ ID NO: 54526 - RNA, 22 nt, Human
uccagcugugcuccaggaggug

SEQ ID NO: 54527 - RNA, 22 nt, Human
uccagcuguuccaucagcucuu

SEQ ID NO: 54528 - RNA, 19 nt, Human
uccagcuguuuugagucac

SEQ ID NO: 54529 - RNA, 22 nt, Human
uccagcuucuugacuugguggu

SEQ ID NO: 54530 - RNA, 22 nt, Human
uccagcuugacaaaugauuuua

SEQ ID NO: 54531 - RNA, 22 nt, Human
uccaggaacucuugauggugau

SEQ ID NO: 54532 - RNA, 22 nt, Human
uccaggaagcagcuacagaucc

SEQ ID NO: 54533 - RNA, 22 nt, Human
uccaggaagccacacugggccu

SEQ ID NO: 54534 - RNA, 20 nt, Human
uauuuguauuugggaaaguu

SEQ ID NO: 54535 - RNA, 22 nt, Human
uauuugucacugcacuugaaau

SEQ ID NO: 54536 - RNA, 22 nt, Human
uauuugugagacugacugaagu

SEQ ID NO: 54537 - RNA, 22 nt, Human
uauuuguuccagagauaaaaau

SEQ ID NO: 54538 - RNA, 22 nt, Human
uauuuuaucugccagaguggag

SEQ ID NO: 54539 - RNA, 22 nt, Human
uauuuucuguggaggaccagau

SEQ ID NO: 54540 - RNA, 22 nt, Human
uauuuugacgauuuuaugcaaa

SEQ ID NO: 54541 - RNA, 22 nt, Human
uauuuugcguugagucagauuu

SEQ ID NO: 54542 - RNA, 22 nt, Human
uauuuugcuuuagcugacuguu

SEQ ID NO: 54543 - RNA, 22 nt, Human
uauuuuugccucucagauaaaa

SEQ ID NO: 54544 - RNA, 22 nt, Human
ucaaaaaguugaagaguugggg

SEQ ID NO: 54545 - RNA, 22 nt, Human
ucaaaaauuuucugaggaugag

SEQ ID NO: 54546 - RNA, 22 nt, Human
ucaaaacaaucauuggaugugc

SEQ ID NO: 54547 - RNA, 22 nt, Human
ucaaaagacacaggaggcuagu

SEQ ID NO: 54548 - RNA, 22 nt, Human
ucaaaauuaaaccaacguccag

SEQ ID NO: 54549 - RNA, 22 nt, Human
ucaaaauuagugaccaaaggca

SEQ ID NO: 54550 - RNA, 22 nt, Human
ucaaacaccaucugaccuuaug

SEQ ID NO: 54551 - RNA, 22 nt, Human
ucaaacagaggaacaauuguuu

SEQ ID NO: 54552 - RNA, 22 nt, Human
ucaaacugaauuaaacacuugu

SEQ ID NO: 54553 - RNA, 22 nt, Human
ucaaagaagauuacccucccau

SEQ ID NO: 54554 - RNA, 20 nt, Human
ucaaagaagauucagcucaa

SEQ ID NO: 54555 - RNA, 22 nt, Human
ucaaagaauguuaugaggguag

SEQ ID NO: 54556 - RNA, 20 nt, Human
ucaaagacaagcucucaucc

SEQ ID NO: 54557 - RNA, 21 nt, Human
ucaaagacuggggcugugugc

SEQ ID NO: 54558 - RNA, 22 nt, Human
ucaaagagcuauucaguugugg

SEQ ID NO: 54559 - RNA, 22 nt, Human
ucaaagaugaugcugaaguuau

SEQ ID NO: 54560 - RNA, 20 nt, Human
ucaaagcaaagggagaugau

SEQ ID NO: 54561 - RNA, 19 nt, Human
ucaaagcaagcauguucug

SEQ ID NO: 54562 - RNA, 22 nt, Human
ucaaagcacuggggaaagccug

SEQ ID NO: 54563 - RNA, 22 nt, Human
ucaaaggaaacacaagcuucug

SEQ ID NO: 54564 - RNA, 22 nt, Human
ucaaaggaaacgugguccuggc

SEQ ID NO: 54565 - RNA, 22 nt, Human
ucaaaggauaacugagggcagu

SEQ ID NO: 54566 - RNA, 19 nt, Human
ucaaaggcaaggaggaacu

SEQ ID NO: 54567 - RNA, 22 nt, Human
ucaaaggguagcccagggaaga

SEQ ID NO: 54568 - RNA, 22 nt, Human
ucaaaguagggguaagccaggc

SEQ ID NO: 54569 - RNA, 22 nt, Human
ucaaaguauaauugcuuuuuug

SEQ ID NO: 54570 - RNA, 22 nt, Human
ucaaaguauaucccuucgaaac

SEQ ID NO: 54571 - RNA, 22 nt, Human
uggcaggaagcaucuauagguc

SEQ ID NO: 54572 - RNA, 22 nt, Human
uggcaggagagcgucagaucag

SEQ ID NO: 54573 - RNA, 22 nt, Human
uggcaggaggaugaggcggcua

SEQ ID NO: 54574 - RNA, 20 nt, Human
uggcaggaggcagcagugga

SEQ ID NO: 54575 - RNA, 21 nt, Human
uggcaggcagcuggaagcuug

SEQ ID NO: 54576 - RNA, 22 nt, Human
uggcaggcaggcagccuucuga

SEQ ID NO: 54577 - RNA, 19 nt, Human
uggcaggcccaggauggac

SEQ ID NO: 54578 - RNA, 22 nt, Human
uggcaggcgggagccauagagg

SEQ ID NO: 54579 - RNA, 19 nt, Human
uggcagggagaguuugaag

SEQ ID NO: 54580 - RNA, 18 nt, Human
uggcagggaggaaauaua

SEQ ID NO: 54581 - RNA, 19 nt, Human
uggcagggagugauauuag

SEQ ID NO: 54582 - RNA, 22 nt, Human
uggcaggggaggugcuugcuua

SEQ ID NO: 54583 - RNA, 22 nt, Human
uggcaggguggcaacuuuuggu

SEQ ID NO: 54584 - RNA, 19 nt, Human
uggcagguagugagcaguc

SEQ ID NO: 54585 - RNA, 18 nt, Human
uggcagguccagcugugg

SEQ ID NO: 54586 - RNA, 22 nt, Human
uggcagguggagacagcagagc

SEQ ID NO: 54587 - RNA, 22 nt, Human
uggcagguggcacagccuggga

SEQ ID NO: 54588 - RNA, 22 nt, Human
uggcagguuggccuuugguuca

SEQ ID NO: 54589 - RNA, 16 nt, Human
uggcagguuuuuaucu

SEQ ID NO: 54590 - RNA, 22 nt, Human
uggcagucauuaucgcugaguc

SEQ ID NO: 54591 - RNA, 22 nt, Human
uggcagucuuguaggcaucucc

SEQ ID NO: 54592 - RNA, 22 nt, Human
uggcagugaaccaaggcuccaa

SEQ ID NO: 54593 - RNA, 18 nt, Human
uggcagugagguaggcau

SEQ ID NO: 54594 - RNA, 23 nt, Human
uggcagugaucaaaagcuuacau

SEQ ID NO: 54595 - RNA, 18 nt, Human
uggcagugccaccuucuc

SEQ ID NO: 54596 - RNA, 22 nt, Human
uggcagugccccuugaccagug

SEQ ID NO: 54597 - RNA, 22 nt, Human
uggcagugcugcagugcccuua

SEQ ID NO: 54598 - RNA, 22 nt, Human
uggcaguggcucagagugcaga

SEQ ID NO: 54599 - RNA, 22 nt, Human
uggcagugggaauggacaaaca

SEQ ID NO: 54600 - RNA, 22 nt, Human
uggcagugguaccggcucucag

SEQ ID NO: 54601 - RNA, 22 nt, Human
uggcagugucuuaucaggagug

SEQ ID NO: 54602 - RNA, 19 nt, Human
uggcagugugggguaugaa

SEQ ID NO: 54603 - RNA, 22 nt, Human
uggcagugugugagcuguuauu

SEQ ID NO: 54604 - RNA, 22 nt, Human
uggcaguguugugccacauucc

SEQ ID NO: 54605 - RNA, 22 nt, Human
uggcaguuggaaaaacgguuug

SEQ ID NO: 54606 - RNA, 22 nt, Human
uggcaguuuucaagaguucugu

SEQ ID NO: 54607 - RNA, 22 nt, Human
uggcauauaaagauguguucaa

SEQ ID NO: 54608 - RNA, 22 nt, Human
uggcauccacaaaugcuuagau

SEQ ID NO: 54609 - RNA, 22 nt, Human
uggcauccagauacccugaggg

SEQ ID NO: 54610 - RNA, 22 nt, Human
uggcauccagccaugugauuuu

SEQ ID NO: 54611 - RNA, 22 nt, Human
uggcauccucccucaagcugaa

SEQ ID NO: 54612 - RNA, 20 nt, Human
uggcaucucucaauuguagg

SEQ ID NO: 54613 - RNA, 22 nt, Human
uggcaugaauuuagcuuuccau

SEQ ID NO: 54614 - RNA, 22 nt, Human
uggcauggccagugcugggagu

SEQ ID NO: 54615 - RNA, 22 nt, Human
uggcauggguggagagagcaca

SEQ ID NO: 54616 - RNA, 22 nt, Human
uggcauguucucuuagcagcuc

SEQ ID NO: 54617 - RNA, 22 nt, Human
uggcauguuugcuugugcauau

SEQ ID NO: 54618 - RNA, 22 nt, Human
uggcauugacgcugaccugcac

SEQ ID NO: 54619 - RNA, 22 nt, Human
uggcauuggaauuuguguugca

SEQ ID NO: 54620 - RNA, 19 nt, Human
uggcauugguccagauaaa

SEQ ID NO: 54621 - RNA, 22 nt, Human
uggcauuucaccuuucauuucc

SEQ ID NO: 54622 - RNA, 22 nt, Human
uggcauuuuccaaugauauguu

SEQ ID NO: 54623 - RNA, 22 nt, Human
uggcauuuuguagcuguguauc

SEQ ID NO: 54624 - RNA, 22 nt, Human
uggcauuuuguucaguauaugg

SEQ ID NO: 54625 - RNA, 23 nt, Human
uggccaagauaaucucaguuuuc

SEQ ID NO: 54626 - RNA, 22 nt, Human
uggccaagaugcgaccucucag

SEQ ID NO: 54627 - RNA, 20 nt, Human
uggccaccacuguauaucaa

SEQ ID NO: 54628 - RNA, 22 nt, Human
uggccacuuggcaugugugcca

SEQ ID NO: 54629 - RNA, 22 nt, Human
uggccagaguugaggggguuuc

SEQ ID NO: 54630 - RNA, 22 nt, Human
uggccagcccucuucccacacu

SEQ ID NO: 54631 - RNA, 21 nt, Human
uggccagcugcucgucuccuc

SEQ ID NO: 54632 - RNA, 21 nt, Human
uggccagcuggagucuccaca

SEQ ID NO: 54633 - RNA, 17 nt, Human
uggccaggccccgccag

SEQ ID NO: 54634 - RNA, 19 nt, Human
uggccagguacugucugcu

SEQ ID NO: 54635 - RNA, 23 nt, Human
uggccagguagaggagguaguga

SEQ ID NO: 54636 - RNA, 22 nt, Human
uggccagguugggcuuugcagc

SEQ ID NO: 54637 - RNA, 22 nt, Human
uggccaguagagcucagauagu

SEQ ID NO: 54638 - RNA, 22 nt, Human
uggccagugauuaaugacgcuu

SEQ ID NO: 54639 - RNA, 22 nt, Human
uggccagugccugccagugcag

SEQ ID NO: 54640 - RNA, 22 nt, Human
uggccaguggacuaaguucuga

SEQ ID NO: 54641 - RNA, 22 nt, Human
uggccaugacauggaggcuuug

SEQ ID NO: 54642 - RNA, 22 nt, Human
uggccaugggauagugcagggg

SEQ ID NO: 54643 - RNA, 22 nt, Human
uggcccagcccugcucuagggc

SEQ ID NO: 54644 - RNA, 22 nt, Human
uggcccaggggcucuugguguu

SEQ ID NO: 54645 - RNA, 20 nt, Human
uggcccaguggggcagggug

SEQ ID NO: 54646 - RNA, 22 nt, Human
uggccccugaggagcaucagcc

SEQ ID NO: 54647 - RNA, 22 nt, Human
uggcccgaagauccgaggguca

SEQ ID NO: 54648 - RNA, 22 nt, Human
uggcccgccggaagaagauguc

SEQ ID NO: 54649 - RNA, 17 nt, Human
uggcccuagacuccagc

SEQ ID NO: 54650 - RNA, 22 nt, Human
uggcccuauuuggaaauagagc

SEQ ID NO: 54651 - RNA, 22 nt, Human
uggcccucagcacugagaccuu

SEQ ID NO: 54652 - RNA, 22 nt, Human
uggcccugcacccagagcaguu

SEQ ID NO: 54653 - RNA, 22 nt, Human
uccaggaauagaucagagauuu

SEQ ID NO: 54654 - RNA, 22 nt, Human
uccaggacagaguagaagcagc

SEQ ID NO: 54655 - RNA, 23 nt, Human
uccaggacccugguagacacaca

SEQ ID NO: 54656 - RNA, 22 nt, Human
uccaggaccucccaggcuagag

SEQ ID NO: 54657 - RNA, 22 nt, Human
uccaggaccugacugggccugc

SEQ ID NO: 54658 - RNA, 18 nt, Human
uccaggacucugcguggc

SEQ ID NO: 54659 - RNA, 21 nt, Human
uccaggacuugagaauuccag

SEQ ID NO: 54660 - RNA, 22 nt, Human
uccaggagaaggccauccagcg

SEQ ID NO: 54661 - RNA, 22 nt, Human
uccaggagcauccaggugaagc

SEQ ID NO: 54662 - RNA, 23 nt, Human
uccaggagcaugcuggcuggcga

SEQ ID NO: 54663 - RNA, 22 nt, Human
uccaggagcucauccacgucaa

SEQ ID NO: 54664 - RNA, 22 nt, Human
uccaggaggguuuucugccuuc

SEQ ID NO: 54665 - RNA, 22 nt, Human
uccaggagguagugcuuaauuu

SEQ ID NO: 54666 - RNA, 22 nt, Human
uccaggaggugaggggaccaaa

SEQ ID NO: 54667 - RNA, 22 nt, Human
uccaggagguugagacugcagu

SEQ ID NO: 54668 - RNA, 22 nt, Human
uccaggagguuuggaggaagca

SEQ ID NO: 54669 - RNA, 22 nt, Human
uccaggaguuugaccugugggc

SEQ ID NO: 54670 - RNA, 22 nt, Human
uccaggaugcccgcuuuugcuu

SEQ ID NO: 54671 - RNA, 22 nt, Human
uccaggcaaagccuuguagacg

SEQ ID NO: 54672 - RNA, 22 nt, Human
uccaggcauaagccuugagugu

SEQ ID NO: 54673 - RNA, 16 nt, Human
uccaggcauaucugag

SEQ ID NO: 54674 - RNA, 19 nt, Human
uccaggcauccuucaggcu

SEQ ID NO: 54675 - RNA, 22 nt, Human
uccaggcaucuguauuuuuuaa

SEQ ID NO: 54676 - RNA, 22 nt, Human
uccaggcaugucugaguccuuc

SEQ ID NO: 54677 - RNA, 22 nt, Human
uccaggcauguugggaagauga

SEQ ID NO: 54678 - RNA, 22 nt, Human
uccaggccaauguagcaggccc

SEQ ID NO: 54679 - RNA, 22 nt, Human
uccaggccacgaccuccuggau

SEQ ID NO: 54680 - RNA, 22 nt, Human
uccaggccacugcagaggcucu

SEQ ID NO: 54681 - RNA, 20 nt, Human
ucccuggaggugguggcauc

SEQ ID NO: 54682 - RNA, 22 nt, Human
ucccuggagguguuugcucagg

SEQ ID NO: 54683 - RNA, 22 nt, Human
ucccuggccauuccucuaggcc

SEQ ID NO: 54684 - RNA, 22 nt, Human
ucccuggcugggggcugccuug

SEQ ID NO: 54685 - RNA, 22 nt, Human
ucccugggaaaugucaguuuca

SEQ ID NO: 54686 - RNA, 22 nt, Human
ucccugggaccggcagcucaca

SEQ ID NO: 54687 - RNA, 22 nt, Human
ucccugggacucagacauggaa

SEQ ID NO: 54688 - RNA, 22 nt, Human
ucccugggccacagcugugagc

SEQ ID NO: 54689 - RNA, 23 nt, Human
ucccugggcccgugccagcggug

SEQ ID NO: 54690 - RNA, 22 nt, Human
ucccugggcuucuccagacuug

SEQ ID NO: 54691 - RNA, 20 nt, Human
ucccuggggcccuacuuccu

SEQ ID NO: 54692 - RNA, 22 nt, Human
ucccugggguaacauuagaggg

SEQ ID NO: 54693 - RNA, 22 nt, Human
ucccuguaagguucugagauuu

SEQ ID NO: 54694 - RNA, 22 nt, Human
ucccuguccaaagucuuccuau

SEQ ID NO: 54695 - RNA, 22 nt, Human
ucccugugaaucagaagcaggu

SEQ ID NO: 54696 - RNA, 22 nt, Human
ucccugugagucaacuaaacaa

SEQ ID NO: 54697 - RNA, 22 nt, Human
ucccugugggaugaggacucug

SEQ ID NO: 54698 - RNA, 22 nt, Human
ucccuucaagauuuggggaaau

SEQ ID NO: 54699 - RNA, 22 nt, Human
ucccuuguccucuucgucacug

SEQ ID NO: 54700 - RNA, 22 nt, Human
ucccuuguccugugggaagagc

SEQ ID NO: 54701 - RNA, 22 nt, Human
ucccuuugaucacuaacagaac

SEQ ID NO: 54702 - RNA, 22 nt, Human
uccgaugcuuccagggccaccu

SEQ ID NO: 54703 - RNA, 22 nt, Human
uccgcagaggaggaguugcugu

SEQ ID NO: 54704 - RNA, 23 nt, Human
uccggcaacuucacuccucccgc

SEQ ID NO: 54705 - RNA, 22 nt, Human
uccggcagcaucuggagggaug

SEQ ID NO: 54706 - RNA, 22 nt, Human
uccgguccggguacuccucucu

SEQ ID NO: 54707 - RNA, 22 nt, Human
uccguugacagggcacuugaca

SEQ ID NO: 54708 - RNA, 22 nt, Human
uccguugacuuggaagcccuga

SEQ ID NO: 54709 - RNA, 22 nt, Human
uccguugagucagcuucggacc

SEQ ID NO: 54710 - RNA, 22 nt, Human
uccuaagaagcaugggucccaa

SEQ ID NO: 54711 - RNA, 18 nt, Human
uccuaagauuugugagaa

SEQ ID NO: 54712 - RNA, 22 nt, Human
uccuaauugcuucauguguugu

SEQ ID NO: 54713 - RNA, 22 nt, Human
uccuagaaggaucauucuagug

SEQ ID NO: 54714 - RNA, 22 nt, Human
uccuaggaauacugccugaaau

SEQ ID NO: 54715 - RNA, 22 nt, Human
uccuaggccuggccugguggau

SEQ ID NO: 54716 - RNA, 22 nt, Human
uccuagucacaggaaaauuuca

SEQ ID NO: 54717 - RNA, 18 nt, Human
uccuagugaaaugccugu

SEQ ID NO: 54718 - RNA, 22 nt, Human
uccucacacccauaccacugac

SEQ ID NO: 54719 - RNA, 22 nt, Human
uccucacagaguggcaggcaau

SEQ ID NO: 54720 - RNA, 22 nt, Human
uccucacagcaugaccaggcag

SEQ ID NO: 54721 - RNA, 22 nt, Human
uccucagaauccaaacugcagu

SEQ ID NO: 54722 - RNA, 22 nt, Human
uccucagacacccugcuggcuu

SEQ ID NO: 54723 - RNA, 22 nt, Human
uccucagacuucccuuugugua

SEQ ID NO: 54724 - RNA, 22 nt, Human
uccucagauaccuggcagauca

SEQ ID NO: 54725 - RNA, 23 nt, Human
uccucagcauguuuugucaugua

SEQ ID NO: 54726 - RNA, 22 nt, Human
uccucagcauuagcacagacau

SEQ ID NO: 54727 - RNA, 22 nt, Human
uccucagcuuugguuuacucau

SEQ ID NO: 54728 - RNA, 22 nt, Human
uccucaggaucuaggagugcuu

SEQ ID NO: 54729 - RNA, 22 nt, Human
uccucaggcugccuggaagacu

SEQ ID NO: 54730 - RNA, 22 nt, Human
uccucagggaagaugagccuca

SEQ ID NO: 54731 - RNA, 22 nt, Human
uccucagggcggccuccgucuu

SEQ ID NO: 54732 - RNA, 22 nt, Human
uccucaggucaaagcaggagaa

SEQ ID NO: 54733 - RNA, 22 nt, Human
uccucaguaaggcauggcuuug

SEQ ID NO: 54734 - RNA, 19 nt, Human
uccucagugacaaccucag

SEQ ID NO: 54735 - RNA, 22 nt, Human
uccucagugcuagccaacugcc

SEQ ID NO: 54736 - RNA, 22 nt, Human
uccucaguuuucuaguauggca

SEQ ID NO: 54737 - RNA, 22 nt, Human
uccucauagacugacugcuugc

SEQ ID NO: 54738 - RNA, 22 nt, Human
uccucaucuguaccuuggggua

SEQ ID NO: 54739 - RNA, 23 nt, Human
uccuccaaccagcagcugcauaa

SEQ ID NO: 54740 - RNA, 22 nt, Human
uccuccagaccacuucugugcg

SEQ ID NO: 54741 - RNA, 22 nt, Human
uccuccagagauuugaguuauu

SEQ ID NO: 54742 - RNA, 22 nt, Human
uccuccagcuacuaggcaaaua

SEQ ID NO: 54743 - RNA, 22 nt, Human
uccuccagggggaucuucagcc

SEQ ID NO: 54744 - RNA, 22 nt, Human
uccuccagugguacuggccaau

SEQ ID NO: 54745 - RNA, 20 nt, Human
uccucccccaccuuugcagc

SEQ ID NO: 54746 - RNA, 17 nt, Human
uccuccccgcaguugca

SEQ ID NO: 54747 - RNA, 22 nt, Human
uccucccuguaccauuccucug

SEQ ID NO: 54748 - RNA, 22 nt, Human
uccucccuucucacugggaagg

SEQ ID NO: 54749 - RNA, 22 nt, Human
uccuccucuaucagacagugcc

SEQ ID NO: 54750 - RNA, 22 nt, Human
uccuccuuuccccgcuggagcc

SEQ ID NO: 54751 - RNA, 23 nt, Human
uccuccuuuugcuugugcuuccc

SEQ ID NO: 54752 - RNA, 23 nt, Human
uccucgcaggagggagaugaugc

SEQ ID NO: 54753 - RNA, 22 nt, Human
uccucuccaugucucacgccac

SEQ ID NO: 54754 - RNA, 22 nt, Human
uccucugagacaucagguugag

SEQ ID NO: 54755 - RNA, 22 nt, Human
uccucugcuccaggcuggacuu

SEQ ID NO: 54756 - RNA, 22 nt, Human
uccucugguccugcagcagauc

SEQ ID NO: 54757 - RNA, 22 nt, Human
uccucuucagagggaccucggg

SEQ ID NO: 54758 - RNA, 22 nt, Human
uccucuucuaagcucauucagg

SEQ ID NO: 54759 - RNA, 22 nt, Human
uccucuucuguggauucccuga

SEQ ID NO: 54760 - RNA, 22 nt, Human
uccucuugggaauaccuuucua

SEQ ID NO: 54761 - RNA, 22 nt, Human
uccugaaaauaauuucacaaga

SEQ ID NO: 54762 - RNA, 22 nt, Human
uccugaaauuuguuuuaauucu

SEQ ID NO: 54763 - RNA, 22 nt, Human
uccugaacagcuccugagcaug

SEQ ID NO: 54764 - RNA, 22 nt, Human
uccugaagaacgaagucaugua

SEQ ID NO: 54765 - RNA, 22 nt, Human
uccugaagaaggcagauauuug

SEQ ID NO: 54766 - RNA, 22 nt, Human
uccugaagaggcuacacugcuu

SEQ ID NO: 54767 - RNA, 22 nt, Human
uccugaagccugagugaugacu

SEQ ID NO: 54768 - RNA, 22 nt, Human
uccugaaguauggguauggagu

SEQ ID NO: 54769 - RNA, 22 nt, Human
uccugaauccaggagaguaggg

SEQ ID NO: 54770 - RNA, 20 nt, Human
uccugaauuuccuuucugcu

SEQ ID NO: 54771 - RNA, 22 nt, Human
uccugaccacacugccuucugc

SEQ ID NO: 54772 - RNA, 22 nt, Human
uccugaccacuaggaccaggcu

SEQ ID NO: 54773 - RNA, 22 nt, Human
uccugacccaccaagucuguaa

SEQ ID NO: 54774 - RNA, 22 nt, Human
uccugaccugaacuggggucuu

SEQ ID NO: 54775 - RNA, 22 nt, Human
uccugagacaucucugcugguc

SEQ ID NO: 54776 - RNA, 22 nt, Human
uccugagagcagaguccaggug

SEQ ID NO: 54777 - RNA, 22 nt, Human
uccugagagguuuauaacgcag

SEQ ID NO: 54778 - RNA, 22 nt, Human
uccugagauaggaguugaaggc

SEQ ID NO: 54779 - RNA, 22 nt, Human
uccugagcaacacagcuaagug

SEQ ID NO: 54780 - RNA, 22 nt, Human
uccugagccccagggagguugg

SEQ ID NO: 54781 - RNA, 22 nt, Human
uccugagccugacaaucaccau

SEQ ID NO: 54782 - RNA, 22 nt, Human
uccugagcugccgcaucagcag

SEQ ID NO: 54783 - RNA, 22 nt, Human
uccugagcuucaguuucuucau

SEQ ID NO: 54784 - RNA, 22 nt, Human
uccugaggaaaguucaugaaug

SEQ ID NO: 54785 - RNA, 22 nt, Human
ucaggaggccugaguagcucua

SEQ ID NO: 54786 - RNA, 21 nt, Human
ucaggaggcucagacuccugc

SEQ ID NO: 54787 - RNA, 22 nt, Human
ucaggagggaguguggauagag

SEQ ID NO: 54788 - RNA, 22 nt, Human
ucaggagggauuguugccuauu

SEQ ID NO: 54789 - RNA, 22 nt, Human
ucaggaguaaagaagacuugac

SEQ ID NO: 54790 - RNA, 22 nt, Human
ucauucugcaucacucuugcuc

SEQ ID NO: 54791 - RNA, 22 nt, Human
ucauugaaaacucagcaucuac

SEQ ID NO: 54792 - RNA, 22 nt, Human
uggcugccugaaugcaagacag

SEQ ID NO: 54793 - RNA, 22 nt, Human
uggcugccugaucgagcaggug

SEQ ID NO: 54794 - RNA, 22 nt, Human
uggcugccuucccugcuggagg

SEQ ID NO: 54795 - RNA, 22 nt, Human
uggcugcugcucacucagccuc

SEQ ID NO: 54796 - RNA, 22 nt, Human
uggcuggaauauguggagacca

SEQ ID NO: 54797 - RNA, 22 nt, Human
uggcuggagagggucccaugag

SEQ ID NO: 54798 - RNA, 19 nt, Human
uggcuggagaucugcuacu

SEQ ID NO: 54799 - RNA, 22 nt, Human
uggcuggagcauuccuugucuu

SEQ ID NO: 54800 - RNA, 22 nt, Human
uggcuggagccccucaagagca

SEQ ID NO: 54801 - RNA, 22 nt, Human
uggcuggagcgcccuccucugc

SEQ ID NO: 54802 - RNA, 22 nt, Human
uggcuggagggacccacucaga

SEQ ID NO: 54803 - RNA, 21 nt, Human
uggcuggauagaugggaacug

SEQ ID NO: 54804 - RNA, 22 nt, Human
uggcuggauaucaggcaagggg

SEQ ID NO: 54805 - RNA, 22 nt, Human
uggcuggaugugagaucaagag

SEQ ID NO: 54806 - RNA, 22 nt, Human
uggcuggcaguaggcuaguggc

SEQ ID NO: 54807 - RNA, 22 nt, Human
uggcuggcaguuaucuuuggau

SEQ ID NO: 54808 - RNA, 22 nt, Human
uggcuggcccugggagugcaga

SEQ ID NO: 54809 - RNA, 23 nt, Human
uggcuggcgccugccucacccug

SEQ ID NO: 54810 - RNA, 22 nt, Human
uggcuggcguuggggccaguga

SEQ ID NO: 54811 - RNA, 22 nt, Human
uggcuggcuuguucacugacug

SEQ ID NO: 54812 - RNA, 22 nt, Human
uggcuggcuuucuuguauuuac

SEQ ID NO: 54813 - RNA, 22 nt, Human
uggcugggagcuggaacugggc

SEQ ID NO: 54814 - RNA, 22 nt, Human
uggcuggggccugaauccugca

SEQ ID NO: 54815 - RNA, 22 nt, Human
uggcuggucacaugguaggucu

SEQ ID NO: 54816 - RNA, 22 nt, Human
uggcugugcggccucgggcaga

SEQ ID NO: 54817 - RNA, 22 nt, Human
uggcuguggacucagauggcuc

SEQ ID NO: 54818 - RNA, 22 nt, Human
uggcugugggauaugugacuga

SEQ ID NO: 54819 - RNA, 22 nt, Human
uggcugugggaugagagccuca

SEQ ID NO: 54820 - RNA, 22 nt, Human
uggcugugucaucauagcugug

SEQ ID NO: 54821 - RNA, 22 nt, Human
uggcugugucccuguccagagu

SEQ ID NO: 54822 - RNA, 22 nt, Human
uggcuguuacucuuuucauuuc

SEQ ID NO: 54823 - RNA, 22 nt, Human
uggcuuaguucuagaaauuugg

SEQ ID NO: 54824 - RNA, 22 nt, Human
uggcuuaucacauuguccaugg

SEQ ID NO: 54825 - RNA, 18 nt, Human
uggcuucagaguaaaaug

SEQ ID NO: 54826 - RNA, 22 nt, Human
uggcuucagaucugccccggag

SEQ ID NO: 54827 - RNA, 22 nt, Human
uggcuucaggagcaccuggcuu

SEQ ID NO: 54828 - RNA, 22 nt, Human
uggcuucaguuccuguguuguu

SEQ ID NO: 54829 - RNA, 22 nt, Human
uggcuucauggcaagucuuagu

SEQ ID NO: 54830 - RNA, 21 nt, Human
uggcuucauuugcaacccacu

SEQ ID NO: 54831 - RNA, 22 nt, Human
uggcuuccagaacugagcaaca

SEQ ID NO: 54832 - RNA, 22 nt, Human
uggcuuccuaggagcccgugcu

SEQ ID NO: 54833 - RNA, 22 nt, Human
uggcuuccuguguaaugaggug

SEQ ID NO: 54834 - RNA, 22 nt, Human
uggcuuccuguuucccagaaag

SEQ ID NO: 54835 - RNA, 18 nt, Human
uggcuucucaaagcccag

SEQ ID NO: 54836 - RNA, 22 nt, Human
uggcuucucauuugcauuaaac

SEQ ID NO: 54837 - RNA, 22 nt, Human
uggcuucuccagaaaucuuggu

SEQ ID NO: 54838 - RNA, 22 nt, Human
uggcuucucccgacacccuggc

SEQ ID NO: 54839 - RNA, 22 nt, Human
uggcuucucccucugccugauu

SEQ ID NO: 54840 - RNA, 22 nt, Human
uggcuucucgccugucaucccg

SEQ ID NO: 54841 - RNA, 22 nt, Human
uggcuucucugugugagggaga

SEQ ID NO: 54842 - RNA, 18 nt, Human
uggcuucugcuagcugga

SEQ ID NO: 54843 - RNA, 19 nt, Human
uggcuucuggcaacagaug

SEQ ID NO: 54844 - RNA, 22 nt, Human
uggcuucugguuuauccuuaua

SEQ ID NO: 54845 - RNA, 22 nt, Human
uggcuucuugacuucuuggcug

SEQ ID NO: 54846 - RNA, 22 nt, Human
uggcuucuugaucuuggacuug

SEQ ID NO: 54847 - RNA, 22 nt, Human
uggcuucuugggaugggucauu

SEQ ID NO: 54848 - RNA, 22 nt, Human
uggcuugggagauucucgaacu

SEQ ID NO: 54849 - RNA, 22 nt, Human
uggcuuuacaucaaauugagua

SEQ ID NO: 54850 - RNA, 22 nt, Human
uggcuuuaggagcuauauaccu

SEQ ID NO: 54851 - RNA, 22 nt, Human
uggcuuuaggguuccuucuacc

SEQ ID NO: 54852 - RNA, 22 nt, Human
uggcuuuauacuuaagcacaau

SEQ ID NO: 54853 - RNA, 22 nt, Human
uggcuuuauccaucaucgccaa

SEQ ID NO: 54854 - RNA, 22 nt, Human
uggcuuuuguugguaccaccuu

SEQ ID NO: 54855 - RNA, 22 nt, Human
ugggaaagcugcagaaauucuc

SEQ ID NO: 54856 - RNA, 19 nt, Human
ugggaaaguaacauacaaa

SEQ ID NO: 54857 - RNA, 22 nt, Human
ugggaaaguaauugucauccuu

SEQ ID NO: 54858 - RNA, 22 nt, Human
ugggaaagucuuuauuucucuu

SEQ ID NO: 54859 - RNA, 18 nt, Human
ugggaaaguuuauagaau

SEQ ID NO: 54860 - RNA, 22 nt, Human
ugggaaauauucuaaaagucuu

SEQ ID NO: 54861 - RNA, 22 nt, Human
ugggaacaacaugcacugccac

SEQ ID NO: 54862 - RNA, 22 nt, Human
ugggaacaguagcugcugagcu

SEQ ID NO: 54863 - RNA, 22 nt, Human
ugggaagaagcagagaacugga

SEQ ID NO: 54864 - RNA, 22 nt, Human
ugggaagaguuagagacagcug

SEQ ID NO: 54865 - RNA, 22 nt, Human
ugggaagauaugagugaccaac

SEQ ID NO: 54866 - RNA, 22 nt, Human
ugggaagcuacucaugcaggca

SEQ ID NO: 54867 - RNA, 22 nt, Human
ugggaaggauaccuuggaacau

SEQ ID NO: 54868 - RNA, 22 nt, Human
ugggaagggaguuucuuggagu

SEQ ID NO: 54869 - RNA, 22 nt, Human
ugggaagggucaacagcuggaa

SEQ ID NO: 54870 - RNA, 22 nt, Human
ugggaagggucugaaucugaga

SEQ ID NO: 54871 - RNA, 22 nt, Human
ugggaaggugauuuuccaaaag

SEQ ID NO: 54872 - RNA, 22 nt, Human
ugggaagguuagcaguuuguca

SEQ ID NO: 54873 - RNA, 22 nt, Human
ugggaauagaacaagauagaga

SEQ ID NO: 54874 - RNA, 23 nt, Human
ugggaaugacaucuagagcagag

SEQ ID NO: 54875 - RNA, 23 nt, Human
ugggaauugcaggggguucugcc

SEQ ID NO: 54876 - RNA, 22 nt, Human
ugggacacccucacgccugcac

SEQ ID NO: 54877 - RNA, 22 nt, Human
ugggacagguuggagagaagca

SEQ ID NO: 54878 - RNA, 22 nt, Human
ugggacucacucuuuuggccag

SEQ ID NO: 54879 - RNA, 22 nt, Human
ugggacuuaauaugcccuugau

SEQ ID NO: 54880 - RNA, 22 nt, Human
ugggacuucaaugcaaugaggu

SEQ ID NO: 54881 - RNA, 22 nt, Human
ugggacuugccucgagggcugc

SEQ ID NO: 54882 - RNA, 20 nt, Human
ugggagaagaacacuggaac

SEQ ID NO: 54883 - RNA, 22 nt, Human
ugggagaagacguacuuuagac

SEQ ID NO: 54884 - RNA, 22 nt, Human
ugggagaagagaaauuacugcc

SEQ ID NO: 54885 - RNA, 22 nt, Human
ugggagaagcagugggacagua

SEQ ID NO: 54886 - RNA, 22 nt, Human
ugggagaaucuugcucugcuac

SEQ ID NO: 54887 - RNA, 21 nt, Human
ugggagacacagccuugagcu

SEQ ID NO: 54888 - RNA, 22 nt, Human
ugggagagauaggcuucuggac

SEQ ID NO: 54889 - RNA, 22 nt, Human
ugggagaguuuguuuagaguga

SEQ ID NO: 54890 - RNA, 22 nt, Human
ugggagauaaagcaucuguucu

SEQ ID NO: 54891 - RNA, 20 nt, Human
ugggagaugaucuccuugcu

SEQ ID NO: 54892 - RNA, 22 nt, Human
ugggagaugguucugagacuuu

SEQ ID NO: 54893 - RNA, 22 nt, Human
ugggagcaccuugagggcagaa

SEQ ID NO: 54894 - RNA, 22 nt, Human
ugggagcagccaacauggccuu

SEQ ID NO: 54895 - RNA, 22 nt, Human
ugggagcaggaagcaggaagua

SEQ ID NO: 54896 - RNA, 22 nt, Human
ugggagcaguucagguguggcu

SEQ ID NO: 54897 - RNA, 23 nt, Human
ugggagcucaagggaggcugccc

SEQ ID NO: 54898 - RNA, 22 nt, Human
ugggaggaucucuugaggccag

SEQ ID NO: 54899 - RNA, 22 nt, Human
uccaccaugauuuagcacuggc

SEQ ID NO: 54900 - RNA, 22 nt, Human
uccacccaguguuucuacaggu

SEQ ID NO: 54901 - RNA, 19 nt, Human
uccaccccagccagcucug

SEQ ID NO: 54902 - RNA, 18 nt, Human
uccaccgcgugcaccucu

SEQ ID NO: 54903 - RNA, 22 nt, Human
uccacgccaaaauuuguagcuu

SEQ ID NO: 54904 - RNA, 21 nt, Human
uccacucguauucuguuggca

SEQ ID NO: 54905 - RNA, 22 nt, Human
uccacuggaacaacucugaggc

SEQ ID NO: 54906 - RNA, 22 nt, Human
uccacuguggucccuugcugcc

SEQ ID NO: 54907 - RNA, 22 nt, Human
uccacuugcccucuucugugcu

SEQ ID NO: 54908 - RNA, 22 nt, Human
uccagaaaauucagaaauuguu

SEQ ID NO: 54909 - RNA, 22 nt, Human
uccaaauacauuuacuguauuu

SEQ ID NO: 54910 - RNA, 23 nt, Human
uccaaauaccugucaccuugucu

SEQ ID NO: 54911 - RNA, 21 nt, Human
uccaaaucccauucuguaguc

SEQ ID NO: 54912 - RNA, 22 nt, Human
uccaaauugacaguagugauua

SEQ ID NO: 54913 - RNA, 21 nt, Human
uccaacaugccugauggugcc

SEQ ID NO: 54914 - RNA, 22 nt, Human
uccaagaagagccuuucuccuc

SEQ ID NO: 54915 - RNA, 22 nt, Human
uccaagaagcucagcaaacauc

SEQ ID NO: 54916 - RNA, 22 nt, Human
uccaagaagcuuacaaucuaau

SEQ ID NO: 54917 - RNA, 23 nt, Human
uccaagaaguagggccuggacuu

SEQ ID NO: 54918 - RNA, 22 nt, Human
uccaagaaguuuauguuguuuc

SEQ ID NO: 54919 - RNA, 22 nt, Human
uccaagaauacagauuugugaa

SEQ ID NO: 54920 - RNA, 22 nt, Human
uccaagaaucagucucuuuugg

SEQ ID NO: 54921 - RNA, 22 nt, Human
uccaagaguauaguuuauuggc

SEQ ID NO: 54922 - RNA, 22 nt, Human
uccaaggaaguuugcacuauug

SEQ ID NO: 54923 - RNA, 22 nt, Human
uccaaggagucuuaaguuacau

SEQ ID NO: 54924 - RNA, 19 nt, Human
uccaaggcauggcccagug

SEQ ID NO: 54925 - RNA, 22 nt, Human
uccaagggaaacugcacuucua

SEQ ID NO: 54926 - RNA, 22 nt, Human
uccaagggcagcagccauagcc

SEQ ID NO: 54927 - RNA, 22 nt, Human
uccaagggcuuuggcgugaagu

SEQ ID NO: 54928 - RNA, 22 nt, Human
uccaaggucagcgagagucacu

SEQ ID NO: 54929 - RNA, 22 nt, Human
uccaaguucuaggaacugcugc

SEQ ID NO: 54930 - RNA, 22 nt, Human
uccaaguuucuucugcacaaca

SEQ ID NO: 54931 - RNA, 22 nt, Human
uccaauguguuuguggcaugga

SEQ ID NO: 54932 - RNA, 23 nt, Human
uccaauucaauugggucaggaag

SEQ ID NO: 54933 - RNA, 19 nt, Human
uccaauuucuauucauguu

SEQ ID NO: 54934 - RNA, 21 nt, Human
uccacaauagggaaauucacc

SEQ ID NO: 54935 - RNA, 22 nt, Human
uccacaauggcagagaaauguc

SEQ ID NO: 54936 - RNA, 22 nt, Human
uccacacuugcugucugcugag

SEQ ID NO: 54937 - RNA, 22 nt, Human
uccacagcacaaagccagugug

SEQ ID NO: 54938 - RNA, 22 nt, Human
uccacaggaaagcaccucccau

SEQ ID NO: 54939 - RNA, 22 nt, Human
uccacaggcaagucucuuggca

SEQ ID NO: 54940 - RNA, 22 nt, Human
uccacagggauguugaguucuu

SEQ ID NO: 54941 - RNA, 22 nt, Human
uccacagguaugaggccccacc

SEQ ID NO: 54942 - RNA, 22 nt, Human
uccacagguccggcaugaacag

SEQ ID NO: 54943 - RNA, 22 nt, Human
uccacagucuauuuuuagucua

SEQ ID NO: 54944 - RNA, 22 nt, Human
uccacagugguugaacuaguaa

SEQ ID NO: 54945 - RNA, 22 nt, Human
uccacagugguugaacuaguuu

SEQ ID NO: 54946 - RNA, 22 nt, Human
uccacaugacuucuaauaacug

SEQ ID NO: 54947 - RNA, 22 nt, Human
uccaccacuuccugcagccauu

SEQ ID NO: 54948 - RNA, 22 nt, Human
uccaccagagcccucuuugcgg

SEQ ID NO: 54949 - RNA, 22 nt, Human
uccaccagcagccugucagccu

SEQ ID NO: 54950 - RNA, 21 nt, Human
uccaccagcucuuccucuuca

SEQ ID NO: 54951 - RNA, 22 nt, Human
uccaccagcuucuucaccagcu

SEQ ID NO: 54952 - RNA, 22 nt, Human
uccaccaggcuccauguucagu

SEQ ID NO: 54953 - RNA, 22 nt, Human
uccacccagcacacugugguag

SEQ ID NO: 54954 - RNA, 21 nt, Human
uccacccucucugcucccagu

SEQ ID NO: 54955 - RNA, 22 nt, Human
uccacccugcuuuugucuuuga

SEQ ID NO: 54956 - RNA, 22 nt, Human
uccaccuagcauucaccuccua

SEQ ID NO: 54957 - RNA, 22 nt, Human
uccacgugagcuucgugugcag

SEQ ID NO: 54958 - RNA, 22 nt, Human
uccacugacaggugaauggaua

SEQ ID NO: 54959 - RNA, 22 nt, Human
uccacugcagcuucugauggaa

SEQ ID NO: 54960 - RNA, 22 nt, Human
uccacuuuagcaaugauugaau

SEQ ID NO: 54961 - RNA, 22 nt, Human
uccacuuuucuuccaucaucau

SEQ ID NO: 54962 - RNA, 22 nt, Human
uccagaaaauuuuacagugccu

SEQ ID NO: 54963 - RNA, 22 nt, Human
uccagaaaugcaagccaggugu

SEQ ID NO: 54964 - RNA, 19 nt, Human
uccagaagucccugagcgg

SEQ ID NO: 54965 - RNA, 22 nt, Human
uccagaauauuugggaaagaug

SEQ ID NO: 54966 - RNA, 22 nt, Human
uccagacauuuuauagcagucu

SEQ ID NO: 54967 - RNA, 22 nt, Human
uccagaccauggauggcugcaa

SEQ ID NO: 54968 - RNA, 22 nt, Human
uccagaccaugugagaggcgca

SEQ ID NO: 54969 - RNA, 22 nt, Human
uccagacucuuuaaguucauuu

SEQ ID NO: 54970 - RNA, 22 nt, Human
uccagacuguucacauuggcau

SEQ ID NO: 54971 - RNA, 22 nt, Human
uccagagaacgaugaaagcugg

SEQ ID NO: 54972 - RNA, 22 nt, Human
uccagagacuugcaugugcuug

SEQ ID NO: 54973 - RNA, 22 nt, Human
uccagagcaaaguuugcuaaca

SEQ ID NO: 54974 - RNA, 22 nt, Human
uccagagcagguggucagaagg

SEQ ID NO: 54975 - RNA, 18 nt, Human
uccagagcagucuuuggc

SEQ ID NO: 54976 - RNA, 22 nt, Human
uccagagccccagucuaguggg

SEQ ID NO: 54977 - RNA, 22 nt, Human
uccagagccugcgcacuggcug

SEQ ID NO: 54978 - RNA, 18 nt, Human
uccagagcuacuguggug

SEQ ID NO: 54979 - RNA, 22 nt, Human
uccagagcuacuugcucaacuu

SEQ ID NO: 54980 - RNA, 22 nt, Human
uccagagcugagcagucauucu

SEQ ID NO: 54981 - RNA, 22 nt, Human
uccagagcugggucugugcuca

SEQ ID NO: 54982 - RNA, 18 nt, Human
uccagagcuggugcuucu

SEQ ID NO: 54983 - RNA, 22 nt, Human
uccagagcuguaugauuuuuuu

SEQ ID NO: 54984 - RNA, 14 nt, Human
uccagagcuuuccg

SEQ ID NO: 54985 - RNA, 20 nt, Human
uccagaggccacauccagug

SEQ ID NO: 54986 - RNA, 22 nt, Human
uccagagggcgauggcuggggg

SEQ ID NO: 54987 - RNA, 22 nt, Human
uccagagucuccuguuguuguu

SEQ ID NO: 54988 - RNA, 22 nt, Human
uccagagugacaaaugacugau

SEQ ID NO: 54989 - RNA, 22 nt, Human
uccagaguuguaaguguugaca

SEQ ID NO: 54990 - RNA, 20 nt, Human
uccagauauuaagacaggca

SEQ ID NO: 54991 - RNA, 22 nt, Human
uccagaugcugcacauuccuga

SEQ ID NO: 54992 - RNA, 21 nt, Human
uccagcacagaugaccucccc

SEQ ID NO: 54993 - RNA, 22 nt, Human
uccagcacccaauguggcuaag

SEQ ID NO: 54994 - RNA, 23 nt, Human
uccagcagagccuuccaggaggg

SEQ ID NO: 54995 - RNA, 23 nt, Human
uccagcagccaagaaggguagaa

SEQ ID NO: 54996 - RNA, 22 nt, Human
uccagcagcccgaaggcccauc

SEQ ID NO: 54997 - RNA, 22 nt, Human
uccagcaguccaugugagacac

SEQ ID NO: 54998 - RNA, 22 nt, Human
uccagcauucuuagaccucuau

SEQ ID NO: 54999 - RNA, 22 nt, Human
uccagccaagccuugguagcug

SEQ ID NO: 55000 - RNA, 22 nt, Human
uccagccaaucaacuauuguuu

SEQ ID NO: 55001 - RNA, 22 nt, Human
uccagccacucagcagggauug

SEQ ID NO: 55002 - RNA, 20 nt, Human
uccagcccagguccugccug

SEQ ID NO: 55003 - RNA, 22 nt, Human
uccagccccgaggccggcgacg

SEQ ID NO: 55004 - RNA, 22 nt, Human
uccagccccuuuuacucauuca

SEQ ID NO: 55005 - RNA, 20 nt, Human
uccagcccucaugucgcuca

SEQ ID NO: 55006 - RNA, 22 nt, Human
uccagcccucuggcccgcggug

SEQ ID NO: 55007 - RNA, 20 nt, Human
uccagcccugcuucucucuu

SEQ ID NO: 55008 - RNA, 19 nt, Human
uccagcccuguucccuuuu

SEQ ID NO: 55009 - RNA, 22 nt, Human
ucucagaggugcccuggcaucu

SEQ ID NO: 55010 - RNA, 22 nt, Human
ucucagaguuuagagcugagcc

SEQ ID NO: 55011 - RNA, 22 nt, Human
ucucagcaacgauccggaguaa

SEQ ID NO: 55012 - RNA, 22 nt, Human
ucucagcacguuguuuucauug

SEQ ID NO: 55013 - RNA, 20 nt, Human
ucucagcauaagaacccuuc

SEQ ID NO: 55014 - RNA, 22 nt, Human
ucucagcucuuuuuucacagaa

SEQ ID NO: 55015 - RNA, 22 nt, Human
ucucagcugacugcuuuccucg

SEQ ID NO: 55016 - RNA, 22 nt, Human
ucucaggaaaaaucccuagcuu

SEQ ID NO: 55017 - RNA, 22 nt, Human
ucucaggacuccucuggccaua

SEQ ID NO: 55018 - RNA, 22 nt, Human
ucucaggacuuugggaagcuca

SEQ ID NO: 55019 - RNA, 22 nt, Human
ucucaggagccacagcgggagu

SEQ ID NO: 55020 - RNA, 22 nt, Human
ucucaggaguagugggauccau

SEQ ID NO: 55021 - RNA, 22 nt, Human
ucucaggcacugggugccaacu

SEQ ID NO: 55022 - RNA, 22 nt, Human
ucucaggcaugguuuguucauc

SEQ ID NO: 55023 - RNA, 22 nt, Human
ucucaggcuaccuugcacaagg

SEQ ID NO: 55024 - RNA, 22 nt, Human
ucucaggcuguguguggaggac

SEQ ID NO: 55025 - RNA, 22 nt, Human
ucucagggagggcgagucagcg

SEQ ID NO: 55026 - RNA, 18 nt, Human
ucucagggcauacccaga

SEQ ID NO: 55027 - RNA, 22 nt, Human
uccagaaacugcugagauaaga

SEQ ID NO: 55028 - RNA, 22 nt, Human
uccagaauacucugaaaucauu

SEQ ID NO: 55029 - RNA, 20 nt, Human
uccagacaucuagcucaguu

SEQ ID NO: 55030 - RNA, 22 nt, Human
uccagaccuagggcaccccagu

SEQ ID NO: 55031 - RNA, 22 nt, Human
uccagacucugucacuuccuag

SEQ ID NO: 55032 - RNA, 17 nt, Human
uccagagaggcuucccu

SEQ ID NO: 55033 - RNA, 18 nt, Human
uccagagagggagaagug

SEQ ID NO: 55034 - RNA, 20 nt, Human
uccagagaguggcaaagcuc

SEQ ID NO: 55035 - RNA, 22 nt, Human
uccagagaucucucuucccugu

SEQ ID NO: 55036 - RNA, 17 nt, Human
uccagagcacagagcuc

SEQ ID NO: 55037 - RNA, 22 nt, Human
uccagagcaugcagaucaucaa

SEQ ID NO: 55038 - RNA, 22 nt, Human
uccagagccccaauucaccucu

SEQ ID NO: 55039 - RNA, 22 nt, Human
uccagagccuucgauaagaaga

SEQ ID NO: 55040 - RNA, 22 nt, Human
uccagagccuuucugcuugaca

SEQ ID NO: 55041 - RNA, 22 nt, Human
uccagagcucugggcauagcug

SEQ ID NO: 55042 - RNA, 22 nt, Human
uccagagcuguccuacugugag

SEQ ID NO: 55043 - RNA, 22 nt, Human
uccagaggcagcugcggucagg

SEQ ID NO: 55044 - RNA, 22 nt, Human
uccagaggcuccaaagggagau

SEQ ID NO: 55045 - RNA, 22 nt, Human
uccagaggcucugagggagagu

SEQ ID NO: 55046 - RNA, 22 nt, Human
uccagaggggcagcccugugcu

SEQ ID NO: 55047 - RNA, 18 nt, Human
uccagagguguuggagcc

SEQ ID NO: 55048 - RNA, 22 nt, Human
uccagcaccuggaggcgucccc

SEQ ID NO: 55049 - RNA, 22 nt, Human
uccagcagaaccagagaccugg

SEQ ID NO: 55050 - RNA, 22 nt, Human
uccagcagaccaucaaggcuca

SEQ ID NO: 55051 - RNA, 22 nt, Human
uccagcagacucaucagcaagg

SEQ ID NO: 55052 - RNA, 22 nt, Human
uccagcagagguugauaauacc

SEQ ID NO: 55053 - RNA, 22 nt, Human
uccagcagagucucugaggggg

SEQ ID NO: 55054 - RNA, 18 nt, Human
uccagcagcauaguuucc

SEQ ID NO: 55055 - RNA, 22 nt, Human
uccagcagggaauuaguagucu

SEQ ID NO: 55056 - RNA, 22 nt, Human
uccagcagguccgagacaaguu

SEQ ID NO: 55057 - RNA, 18 nt, Human
uccagcaggucugaggug

SEQ ID NO: 55058 - RNA, 22 nt, Human
uccagcaguaaggaaaguacau

SEQ ID NO: 55059 - RNA, 20 nt, Human
uccagcaguaugcuauacuu

SEQ ID NO: 55060 - RNA, 22 nt, Human
uccagcagugcucaggacucac

SEQ ID NO: 55061 - RNA, 22 nt, Human
uccagcauguuugugcugcuga

SEQ ID NO: 55062 - RNA, 22 nt, Human
uccagcauuagaugugaaauug

SEQ ID NO: 55063 - RNA, 23 nt, Human
uccagccaaaucuggcugacagu

SEQ ID NO: 55064 - RNA, 22 nt, Human
uccagccaacugccuagggagc

SEQ ID NO: 55065 - RNA, 22 nt, Human
uccagccaccaccuugauugcc

SEQ ID NO: 55066 - RNA, 20 nt, Human
uccagccacuuccgcugguc

SEQ ID NO: 55067 - RNA, 22 nt, Human
uccagccaugacucggacagug

SEQ ID NO: 55068 - RNA, 22 nt, Human
uccagccaugcaugacaaucac

SEQ ID NO: 55069 - RNA, 22 nt, Human
uccagcccagcuguccccuuca

SEQ ID NO: 55070 - RNA, 22 nt, Human
uccagccccggcuuccuuacag

SEQ ID NO: 55071 - RNA, 22 nt, Human
uccagcccgacugggccugccg

SEQ ID NO: 55072 - RNA, 22 nt, Human
uccagcccgagggcgcugauga

SEQ ID NO: 55073 - RNA, 22 nt, Human
uccagcccucagccaaguggaa

SEQ ID NO: 55074 - RNA, 22 nt, Human
uccagcccuccugggaucacag

SEQ ID NO: 55075 - RNA, 22 nt, Human
uccagcccugcccauucucucg

SEQ ID NO: 55076 - RNA, 22 nt, Human
uccagcucaaagugcuccuguc

SEQ ID NO: 55077 - RNA, 20 nt, Human
uccagcucaguuuuuuuguc

SEQ ID NO: 55078 - RNA, 22 nt, Human
uccagcuccacagccucccugu

SEQ ID NO: 55079 - RNA, 23 nt, Human
uccagcucccuucaauggcacug

SEQ ID NO: 55080 - RNA, 20 nt, Human
uccagcuccguguucuuccu

SEQ ID NO: 55081 - RNA, 22 nt, Human
uccagcugacacuuaaggggag

SEQ ID NO: 55082 - RNA, 22 nt, Human
uccagcugacaucuccugaggg

SEQ ID NO: 55083 - RNA, 22 nt, Human
uccagcuggcccggccaugaau

SEQ ID NO: 55084 - RNA, 22 nt, Human
uccagcuggcuucggaagugga

SEQ ID NO: 55085 - RNA, 20 nt, Human
uccagcugggaacagcugau

SEQ ID NO: 55086 - RNA, 22 nt, Human
uccagcuggggccgaaguggau

SEQ ID NO: 55087 - RNA, 18 nt, Human
uccagcuugcacuuaaau

SEQ ID NO: 55088 - RNA, 22 nt, Human
uccagcuugccuggucuuuugg

SEQ ID NO: 55089 - RNA, 22 nt, Human
uccagcuuuggcucuagcuaca

SEQ ID NO: 55090 - RNA, 22 nt, Human
uccaggaaacacucaagccaug

SEQ ID NO: 55091 - RNA, 22 nt, Human
uccaggaaacagcaucucagca

SEQ ID NO: 55092 - RNA, 22 nt, Human
uccaggaaaucauaaauugcuu

SEQ ID NO: 55093 - RNA, 22 nt, Human
uccaggaacugaagccaggugu

SEQ ID NO: 55094 - RNA, 22 nt, Human
uccaggaagagguguguuggga

SEQ ID NO: 55095 - RNA, 22 nt, Human
uccaggaagcaguguuuggagc

SEQ ID NO: 55096 - RNA, 22 nt, Human
uccaggaauagucauguuuuag

SEQ ID NO: 55097 - RNA, 20 nt, Human
uccaggaaugguagaggacu

SEQ ID NO: 55098 - RNA, 22 nt, Human
uccaggaauuuccccuuuccug

SEQ ID NO: 55099 - RNA, 22 nt, Human
uccaggacagcggcaggcagau

SEQ ID NO: 55100 - RNA, 22 nt, Human
uccaggacugguucacacggug

SEQ ID NO: 55101 - RNA, 22 nt, Human
uccaggacuuagugaccuaaaa

SEQ ID NO: 55102 - RNA, 22 nt, Human
uccaggacuuggcaggagauga

SEQ ID NO: 55103 - RNA, 22 nt, Human
uccaggagaaaacugacggugg

SEQ ID NO: 55104 - RNA, 22 nt, Human
uccaggagaccagauguaggcc

SEQ ID NO: 55105 - RNA, 22 nt, Human
uccaggaggaggaaggcugcca

SEQ ID NO: 55106 - RNA, 22 nt, Human
uccaggaggccucauuuccugu

SEQ ID NO: 55107 - RNA, 22 nt, Human
uccaggaggcucugguugacgu

SEQ ID NO: 55108 - RNA, 22 nt, Human
uccaggagggauugggcugugg

SEQ ID NO: 55109 - RNA, 22 nt, Human
uccaggagggguaggcaguaug

SEQ ID NO: 55110 - RNA, 22 nt, Human
uccaggaguccuggguggcccc

SEQ ID NO: 55111 - RNA, 22 nt, Human
uccaggagugauaaggccacug

SEQ ID NO: 55112 - RNA, 22 nt, Human
uccaggagugugugcuaauggg

SEQ ID NO: 55113 - RNA, 22 nt, Human
uccaggcaaggauaauaaacau

SEQ ID NO: 55114 - RNA, 22 nt, Human
uccaggcaagggaggagcaugg

SEQ ID NO: 55115 - RNA, 22 nt, Human
uccaggcacgaggcccugugca

SEQ ID NO: 55116 - RNA, 23 nt, Human
uccaggcacgcauuucuucuagc

SEQ ID NO: 55117 - RNA, 22 nt, Human
uccaggcacuauauauacuuuu

SEQ ID NO: 55118 - RNA, 22 nt, Human
uccaggcagagcaacaaaauau

SEQ ID NO: 55119 - RNA, 22 nt, Human
uccucuuucucaacauuaguua

SEQ ID NO: 55120 - RNA, 19 nt, Human
uccugaaaacuucuggaau

SEQ ID NO: 55121 - RNA, 22 nt, Human
uccugaaauucugguugucacu

SEQ ID NO: 55122 - RNA, 22 nt, Human
uccugaagcucucuuaaggaaa

SEQ ID NO: 55123 - RNA, 22 nt, Human
uccugaaggccugaguuccacc

SEQ ID NO: 55124 - RNA, 22 nt, Human
uccugaagucacaggcucugag

SEQ ID NO: 55125 - RNA, 22 nt, Human
uccugaauuccucuuugcaucc

SEQ ID NO: 55126 - RNA, 22 nt, Human
uccugaauugaacucaguuaau

SEQ ID NO: 55127 - RNA, 22 nt, Human
uccugaauuguugagaagcagc

SEQ ID NO: 55128 - RNA, 22 nt, Human
uccugaccauuccuugucucca

SEQ ID NO: 55129 - RNA, 22 nt, Human
uccugaccucuugcucugaccu

SEQ ID NO: 55130 - RNA, 22 nt, Human
uccugacuccagguccugugug

SEQ ID NO: 55131 - RNA, 22 nt, Human
uccugacuuggcuguuggcccu

SEQ ID NO: 55132 - RNA, 22 nt, Human
uccugagaaggcacagcuugca

SEQ ID NO: 55133 - RNA, 22 nt, Human
uccugagaauagaguugcaugu

SEQ ID NO: 55134 - RNA, 22 nt, Human
uccugagagcagcugcuuugga

SEQ ID NO: 55135 - RNA, 20 nt, Human
uccugagaggcucuuggaga

SEQ ID NO: 55136 - RNA, 22 nt, Human
uccugagaggugugaggugcag

SEQ ID NO: 55137 - RNA, 22 nt, Human
uccugagauaaaucucauguga

SEQ ID NO: 55138 - RNA, 22 nt, Human
uccugagauccuuuuagggauc

SEQ ID NO: 55139 - RNA, 22 nt, Human
uccugagaugagacagugcugc

SEQ ID NO: 55140 - RNA, 23 nt, Human
uccugagaugagacagugcugcc

SEQ ID NO: 55141 - RNA, 20 nt, Human
uccugagauuuaagggguuc

SEQ ID NO: 55142 - RNA, 22 nt, Human
uccugagcaccuaugccauggc

SEQ ID NO: 55143 - RNA, 22 nt, Human
uccugagcccuguaggacccug

SEQ ID NO: 55144 - RNA, 22 nt, Human
uccugagcugacacuuggggag

SEQ ID NO: 55145 - RNA, 22 nt, Human
uccugaggaaugugaagagaac

SEQ ID NO: 55146 - RNA, 22 nt, Human
uccugagggacugguuccucgc

SEQ ID NO: 55147 - RNA, 22 nt, Human
uccugagggcgauucagcaggu

SEQ ID NO: 55148 - RNA, 22 nt, Human
uccugagggcucggggcucaug

SEQ ID NO: 55149 - RNA, 23 nt, Human
uccugaggguuucccagccuugg

SEQ ID NO: 55150 - RNA, 22 nt, Human
uccugagguuuuaaaacuauuc

SEQ ID NO: 55151 - RNA, 22 nt, Human
uccugaugauauugcucuuucu

SEQ ID NO: 55152 - RNA, 22 nt, Human
uccugauuagguuuccauagcu

SEQ ID NO: 55153 - RNA, 20 nt, Human
uccugcaaaaggacaaguuu

SEQ ID NO: 55154 - RNA, 22 nt, Human
uccugcacaccuugagcuugga

SEQ ID NO: 55155 - RNA, 22 nt, Human
uccugcacauuaguauuuuuua

SEQ ID NO: 55156 - RNA, 22 nt, Human
uccugcagcugauaaauacagu

SEQ ID NO: 55157 - RNA, 21 nt, Human
uccugcaggaggccugagagg

SEQ ID NO: 55158 - RNA, 22 nt, Human
uccugcaggggcugaggaacca

SEQ ID NO: 55159 - RNA, 22 nt, Human
uccugccaccggggguggcgau

SEQ ID NO: 55160 - RNA, 22 nt, Human
uccugccaccugcacagcuccc

SEQ ID NO: 55161 - RNA, 22 nt, Human
uccugccagcuggggcugcuuc

SEQ ID NO: 55162 - RNA, 22 nt, Human
uccugccucuugccuucuucac

SEQ ID NO: 55163 - RNA, 22 nt, Human
uccugcgagugcgcuuuugguc

SEQ ID NO: 55164 - RNA, 22 nt, Human
uccugcuagagaauaacagcac

SEQ ID NO: 55165 - RNA, 22 nt, Human
uccugcugccauuucaagugcu

SEQ ID NO: 55166 - RNA, 22 nt, Human
ugucacaauaucccaaucugcc

SEQ ID NO: 55167 - RNA, 22 nt, Human
ugucacaauuuauuucucuuga

SEQ ID NO: 55168 - RNA, 22 nt, Human
ugucacacugaccacaucugua

SEQ ID NO: 55169 - RNA, 22 nt, Human
ugucacagagcgugcaacagaa

SEQ ID NO: 55170 - RNA, 22 nt, Human
ugucacagucucgugagcaucu

SEQ ID NO: 55171 - RNA, 22 nt, Human
ugucacauauauaauguucaau

SEQ ID NO: 55172 - RNA, 21 nt, Human
ugucacauguggaugguauuu

SEQ ID NO: 55173 - RNA, 22 nt, Human
ugucacauguguggcauuuuuc

SEQ ID NO: 55174 - RNA, 21 nt, Human
ugucacauugucccugcugcu

SEQ ID NO: 55175 - RNA, 22 nt, Human
ugucaccacuggcugaaacacc

SEQ ID NO: 55176 - RNA, 22 nt, Human
ugucaccaugcgaggcuaauuu

SEQ ID NO: 55177 - RNA, 19 nt, Human
ugucaccuucugucaguuu

SEQ ID NO: 55178 - RNA, 22 nt, Human
ugucaccuugaugauggccuag

SEQ ID NO: 55179 - RNA, 22 nt, Human
ugucaccuuuacccuuuuauag

SEQ ID NO: 55180 - RNA, 22 nt, Human
ugucacuacaucauaaauauau

SEQ ID NO: 55181 - RNA, 22 nt, Human
ugucacucaaguuccaauuuac

SEQ ID NO: 55182 - RNA, 19 nt, Human
ugucacugucauggcccag

SEQ ID NO: 55183 - RNA, 22 nt, Human
ugucagaccugugauuucagca

SEQ ID NO: 55184 - RNA, 22 nt, Human
ugucagagcaaugagguucagc

SEQ ID NO: 55185 - RNA, 20 nt, Human
ugucagauaacuagcuguua

SEQ ID NO: 55186 - RNA, 22 nt, Human
ugucagaugugucuccaagugc

SEQ ID NO: 55187 - RNA, 22 nt, Human
ugucagcagaucuccugcagcc

SEQ ID NO: 55188 - RNA, 22 nt, Human
ugucagcaguaucucuaucuca

SEQ ID NO: 55189 - RNA, 22 nt, Human
ugucagcaguuuuuaguggagg

SEQ ID NO: 55190 - RNA, 22 nt, Human
ugucagcaucauuuguugaagg

SEQ ID NO: 55191 - RNA, 22 nt, Human
ugucagcauugaugaaaugugg

SEQ ID NO: 55192 - RNA, 22 nt, Human
ugucagccuugcuuuagcgguu

SEQ ID NO: 55193 - RNA, 22 nt, Human
ugucaggacacagcuuucugug

SEQ ID NO: 55194 - RNA, 22 nt, Human
ugucaggagccaccagcacucc

SEQ ID NO: 55195 - RNA, 22 nt, Human
ugucagggauuuaaagacacaa

SEQ ID NO: 55196 - RNA, 19 nt, Human
ugucaggggugugcugugc

SEQ ID NO: 55197 - RNA, 22 nt, Human
ugucagguugguuuucagagaa

SEQ ID NO: 55198 - RNA, 18 nt, Human
ugucaguaaagugacaga

SEQ ID NO: 55199 - RNA, 19 nt, Human
ugucaguaguugucuaggg

SEQ ID NO: 55200 - RNA, 22 nt, Human
ugucagugaacuggaaggccug

SEQ ID NO: 55201 - RNA, 22 nt, Human
ugucagugaccuagcacggugc

SEQ ID NO: 55202 - RNA, 22 nt, Human
ugucagugaguuaguugcaagu

SEQ ID NO: 55203 - RNA, 22 nt, Human
ugucagugguaagguugggagu

SEQ ID NO: 55204 - RNA, 22 nt, Human
ugucagugguagacccagaggu

SEQ ID NO: 55205 - RNA, 22 nt, Human
ugucaguguauacauacaguau

SEQ ID NO: 55206 - RNA, 22 nt, Human
ugucaguguuuuaugugcccuu

SEQ ID NO: 55207 - RNA, 21 nt, Human
ugucaguuauaaucaccacag

SEQ ID NO: 55208 - RNA, 22 nt, Human
ugucaguucucacuuacauaaa

SEQ ID NO: 55209 - RNA, 22 nt, Human
ugucauaaaacacaagcuguug

SEQ ID NO: 55210 - RNA, 22 nt, Human
ugucauacaugcuugagcuaca

SEQ ID NO: 55211 - RNA, 22 nt, Human
ugucauaugcugucauagccau

SEQ ID NO: 55212 - RNA, 22 nt, Human
ugucauauguugaugaaagaga

SEQ ID NO: 55213 - RNA, 23 nt, Human
ugucaucuccagacucccagugc

SEQ ID NO: 55214 - RNA, 22 nt, Human
ugucaucugaauuucucaucac

SEQ ID NO: 55215 - RNA, 22 nt, Human
ugucaucugcggguggcacugc

SEQ ID NO: 55216 - RNA, 22 nt, Human
ugucaucuuguccagccaggca

SEQ ID NO: 55217 - RNA, 22 nt, Human
ugucaugaguuauuucauagga

SEQ ID NO: 55218 - RNA, 22 nt, Human
ugucaugccaccguuucccaga

SEQ ID NO: 55219 - RNA, 22 nt, Human
ugucaugcccaggagcaaggua

SEQ ID NO: 55220 - RNA, 22 nt, Human
ugucaugcuuauguuacauacu

SEQ ID NO: 55221 - RNA, 22 nt, Human
ugucauggacuggauuucugcu

SEQ ID NO: 55222 - RNA, 22 nt, Human
ugucauggcugaaagugggggc

SEQ ID NO: 55223 - RNA, 22 nt, Human
ugucaugggcauuuauugaggg

SEQ ID NO: 55224 - RNA, 22 nt, Human
ugucaugguauuugugagcugc

SEQ ID NO: 55225 - RNA, 22 nt, Human
ugucauguguucuuaaauacau

SEQ ID NO: 55226 - RNA, 22 nt, Human
ugucauuaguuucagccauucu

SEQ ID NO: 55227 - RNA, 20 nt, Human
ugucauucuucuuucacagg

SEQ ID NO: 55228 - RNA, 22 nt, Human
uccugggcuugcuccuccagcu

SEQ ID NO: 55229 - RNA, 22 nt, Human
uccugggcuuuguuucucuccu

SEQ ID NO: 55230 - RNA, 22 nt, Human
uccuggggaggguucuggcucc

SEQ ID NO: 55231 - RNA, 22 nt, Human
uccuggggccagcacuggugga

SEQ ID NO: 55232 - RNA, 22 nt, Human
uccugggguccugacugcuucc

SEQ ID NO: 55233 - RNA, 22 nt, Human
uccuggguagagaccugaugaa

SEQ ID NO: 55234 - RNA, 22 nt, Human
uccuggguccauggcagccgaa

SEQ ID NO: 55235 - RNA, 22 nt, Human
uccugggugaaagaacaggcag

SEQ ID NO: 55236 - RNA, 23 nt, Human
uccuggguuugaauucuagucuu

SEQ ID NO: 55237 - RNA, 22 nt, Human
uccugguaggcuaugucauguc

SEQ ID NO: 55238 - RNA, 22 nt, Human
uccuggugaggacuccaagaua

SEQ ID NO: 55239 - RNA, 22 nt, Human
uccuggugcugacacccauagc

SEQ ID NO: 55240 - RNA, 19 nt, Human
uccuggugcuugacacuga

SEQ ID NO: 55241 - RNA, 18 nt, Human
uccugguggagaaguggu

SEQ ID NO: 55242 - RNA, 22 nt, Human
uccugguggugccagcugcagg

SEQ ID NO: 55243 - RNA, 22 nt, Human
uccugguguuacuaaauugaaa

SEQ ID NO: 55244 - RNA, 22 nt, Human
uccugguguuuaugucacauag

SEQ ID NO: 55245 - RNA, 20 nt, Human
uccuguccgcgccuugcguc

SEQ ID NO: 55246 - RNA, 23 nt, Human
uccugugaagccauguuuguugu

SEQ ID NO: 55247 - RNA, 22 nt, Human
uccugugacggagcgccagagg

SEQ ID NO: 55248 - RNA, 21 nt, Human
uccugugaggaccugucagug

SEQ ID NO: 55249 - RNA, 22 nt, Human
uccugugccuccaccugcuccg

SEQ ID NO: 55250 - RNA, 22 nt, Human
uccugugcuguuaauagugaua

SEQ ID NO: 55251 - RNA, 22 nt, Human
uccugugcuuuggaugcuuaga

SEQ ID NO: 55252 - RNA, 20 nt, Human
uccuguggacauugcuggcc

SEQ ID NO: 55253 - RNA, 22 nt, Human
uccuguggcguuaucaugugau

SEQ ID NO: 55254 - RNA, 22 nt, Human
uccuguggcucuguggaaccuu

SEQ ID NO: 55255 - RNA, 22 nt, Human
uccuguggcuuccacgaccuaa

SEQ ID NO: 55256 - RNA, 22 nt, Human
uccuguguuaaagggggugcua

SEQ ID NO: 55257 - RNA, 22 nt, Human
uccuguguuacccuugcaguga

SEQ ID NO: 55258 - RNA, 22 nt, Human
uccuguuuaucugugugacucg

SEQ ID NO: 55259 - RNA, 22 nt, Human
uccuuaaaggacuagaagucaa

SEQ ID NO: 55260 - RNA, 22 nt, Human
uccuuaaagugcaccuccucau

SEQ ID NO: 55261 - RNA, 22 nt, Human
uccuuaauaaguacuucauugu

SEQ ID NO: 55262 - RNA, 22 nt, Human
uccuuagcacccaccaaggacu

SEQ ID NO: 55263 - RNA, 22 nt, Human
uccuuagccagggcagcucaaa

SEQ ID NO: 55264 - RNA, 22 nt, Human
uccuuaggaaaaugaugagggg

SEQ ID NO: 55265 - RNA, 22 nt, Human
uccuuagggauuuuuccaguca

SEQ ID NO: 55266 - RNA, 22 nt, Human
uccuuagguauuuagcaugaau

SEQ ID NO: 55267 - RNA, 22 nt, Human
uccuuauagcccaagugaugga

SEQ ID NO: 55268 - RNA, 20 nt, Human
uccuucagacgacaagcaag

SEQ ID NO: 55269 - RNA, 22 nt, Human
uccuucagaggacggcagccag

SEQ ID NO: 55270 - RNA, 22 nt, Human
uccuucagcuacucaguuucca

SEQ ID NO: 55271 - RNA, 22 nt, Human
uccuucagcucucuauuuagau

SEQ ID NO: 55272 - RNA, 22 nt, Human
uccuucaggccucauucucaua

SEQ ID NO: 55273 - RNA, 22 nt, Human
uccuucaggguugaggccgacu

SEQ ID NO: 55274 - RNA, 19 nt, Human
uccuucagucagaucuggg

SEQ ID NO: 55275 - RNA, 21 nt, Human
uccuucaguucugcacuuucu

SEQ ID NO: 55276 - RNA, 22 nt, Human
uccuucccaggugucgccgccu

SEQ ID NO: 55277 - RNA, 22 nt, Human
uccuucccccucaagagaacuu

SEQ ID NO: 55278 - RNA, 22 nt, Human
uccuuccuuccugaaauuuuag

SEQ ID NO: 55279 - RNA, 22 nt, Human
uccuucugaaaaaugcacacga

SEQ ID NO: 55280 - RNA, 22 nt, Human
uccuucuuucaccucauaguca

SEQ ID NO: 55281 - RNA, 22 nt, Human
uccuucuuucccccuagucauu

SEQ ID NO: 55282 - RNA, 22 nt, Human
uccuucuuugacaaguggcaga

SEQ ID NO: 55283 - RNA, 22 nt, Human
uccuugacugugaggaacuagc

SEQ ID NO: 55284 - RNA, 22 nt, Human
ucuggcugggaagggggcccga

SEQ ID NO: 55285 - RNA, 22 nt, Human
ucuggcuguguaagguagcacc

SEQ ID NO: 55286 - RNA, 22 nt, Human
ucuggcuucaguaggguucacu

SEQ ID NO: 55287 - RNA, 23 nt, Human
ucuggcuuccaguggguucaacc

SEQ ID NO: 55288 - RNA, 22 nt, Human
ucuggcuucgcagcucccagcc

SEQ ID NO: 55289 - RNA, 22 nt, Human
ucuggcuugaacaauuagguaa

SEQ ID NO: 55290 - RNA, 22 nt, Human
ucuggcuuggcgcugcccucug

SEQ ID NO: 55291 - RNA, 22 nt, Human
ucuggcuuggguagguaguuca

SEQ ID NO: 55292 - RNA, 22 nt, Human
ucuggcuuuauuccuucacuga

SEQ ID NO: 55293 - RNA, 22 nt, Human
ucuggcuuuauuuucaucaucu

SEQ ID NO: 55294 - RNA, 21 nt, Human
ucuggcuuucauuccccuucu

SEQ ID NO: 55295 - RNA, 21 nt, Human
ucugggaaauugggaaagaag

SEQ ID NO: 55296 - RNA, 22 nt, Human
ucugggaacacacgucacuuca

SEQ ID NO: 55297 - RNA, 22 nt, Human
ucugggaacagcuuagcuccag

SEQ ID NO: 55298 - RNA, 22 nt, Human
ucugggaacauggcuuggaauc

SEQ ID NO: 55299 - RNA, 22 nt, Human
ucugggaagcugcgugccuguu

SEQ ID NO: 55300 - RNA, 22 nt, Human
ucugggaaguuggcagccagcu

SEQ ID NO: 55301 - RNA, 22 nt, Human
ucugggaaugaauaagaccugu

SEQ ID NO: 55302 - RNA, 22 nt, Human
ucugggaaugaggcccagcgau

SEQ ID NO: 55303 - RNA, 22 nt, Human
ucugggagaagcugaugugaag

SEQ ID NO: 55304 - RNA, 22 nt, Human
ucugggagacguguguugucag

SEQ ID NO: 55305 - RNA, 22 nt, Human
ucugggagagaguugauaaagg

SEQ ID NO: 55306 - RNA, 22 nt, Human
ucugggagagcugcugucagag

SEQ ID NO: 55307 - RNA, 22 nt, Human
ucugggagagucacaggcauug

SEQ ID NO: 55308 - RNA, 22 nt, Human
ucugggagagucuaacuuguuu

SEQ ID NO: 55309 - RNA, 22 nt, Human
ucugggagauccaagcagaacu

SEQ ID NO: 55310 - RNA, 22 nt, Human
ucugggagcagcucagcagauu

SEQ ID NO: 55311 - RNA, 20 nt, Human
ucugggagggacaagucucc

SEQ ID NO: 55312 - RNA, 22 nt, Human
ucugggaggucacauuggucuu

SEQ ID NO: 55313 - RNA, 22 nt, Human
ucugggaguaaggccuaggcau

SEQ ID NO: 55314 - RNA, 22 nt, Human
ucugggaguggguccaaggaau

SEQ ID NO: 55315 - RNA, 22 nt, Human
ucugggaguuucugugggagcu

SEQ ID NO: 55316 - RNA, 22 nt, Human
ucugggaugagaucagagacac

SEQ ID NO: 55317 - RNA, 22 nt, Human
ucugggcagccaugugccuggc

SEQ ID NO: 55318 - RNA, 22 nt, Human
ucugggcagccgccccauagga

SEQ ID NO: 55319 - RNA, 23 nt, Human
ucugggcauaucuagucacaucg

SEQ ID NO: 55320 - RNA, 22 nt, Human
ucugggccugucucagagcugg

SEQ ID NO: 55321 - RNA, 22 nt, Human
ucugggcucuuaguguacccuc

SEQ ID NO: 55322 - RNA, 15 nt, Human
ucugggcugugagca

SEQ ID NO: 55323 - RNA, 20 nt, Human
ucugggcuucccccagcucc

SEQ ID NO: 55324 - RNA, 18 nt, Human
ucugggcuucccgaggcu

SEQ ID NO: 55325 - RNA, 22 nt, Human
ucuggggaauguucauuucuga

SEQ ID NO: 55326 - RNA, 22 nt, Human
ucuggggacggggcccagcaau

SEQ ID NO: 55327 - RNA, 22 nt, Human
ucuggggagcagcccuggugag

SEQ ID NO: 55328 - RNA, 22 nt, Human
ucuggggagucaaagagaccug

SEQ ID NO: 55329 - RNA, 22 nt, Human
ucuggggaugagugaugucgua

SEQ ID NO: 55330 - RNA, 22 nt, Human
ucugggguuggugcuuacacca

SEQ ID NO: 55331 - RNA, 22 nt, Human
ucuggguccgggacuguggaug

SEQ ID NO: 55332 - RNA, 22 nt, Human
ucuggguccgggggugaauuga

SEQ ID NO: 55333 - RNA, 22 nt, Human
ucugggugagcugccucggguc

SEQ ID NO: 55334 - RNA, 22 nt, Human
ucugggugccacugucuguaca

SEQ ID NO: 55335 - RNA, 21 nt, Human
ucuggguguaaaucuuauuug

SEQ ID NO: 55336 - RNA, 22 nt, Human
ucuggguguagggccuggcaac

SEQ ID NO: 55337 - RNA, 22 nt, Human
uccugcagagccgcccucaggu

SEQ ID NO: 55338 - RNA, 22 nt, Human
uccugcagcauccgucgucugu

SEQ ID NO: 55339 - RNA, 22 nt, Human
uccugcagccauuagaggucaa

SEQ ID NO: 55340 - RNA, 22 nt, Human
uccugcagccuugggcuggagc

SEQ ID NO: 55341 - RNA, 22 nt, Human
uccugcagcucugagaagcauc

SEQ ID NO: 55342 - RNA, 18 nt, Human
uccugcagcuucuaugua

SEQ ID NO: 55343 - RNA, 22 nt, Human
uccugcaggccagaggggugag

SEQ ID NO: 55344 - RNA, 22 nt, Human
uccugcagguggaugauucucu

SEQ ID NO: 55345 - RNA, 19 nt, Human
uccugcagguggcuugcag

SEQ ID NO: 55346 - RNA, 22 nt, Human
uccugcagugugucuccugcac

SEQ ID NO: 55347 - RNA, 22 nt, Human
uccugcaguuacaucccagcca

SEQ ID NO: 55348 - RNA, 20 nt, Human
uccugcaguuccuaggaggg

SEQ ID NO: 55349 - RNA, 22 nt, Human
uccugccaggagugcuggcccu

SEQ ID NO: 55350 - RNA, 22 nt, Human
uccugcccagagcucuccacuc

SEQ ID NO: 55351 - RNA, 18 nt, Human
uccugccugcgggcuccc

SEQ ID NO: 55352 - RNA, 18 nt, Human
uccugccugugccccagg

SEQ ID NO: 55353 - RNA, 22 nt, Human
uccugccuugccugggacauca

SEQ ID NO: 55354 - RNA, 22 nt, Human
uccugcgguucaugcucauucu

SEQ ID NO: 55355 - RNA, 23 nt, Human
uccugcugaaagcuccagcuggc

SEQ ID NO: 55356 - RNA, 22 nt, Human
uccugcuggaaacuuccucuug

SEQ ID NO: 55357 - RNA, 22 nt, Human
uccugcuuaacauauggucaag

SEQ ID NO: 55358 - RNA, 20 nt, Human
uccugcuuccaccagagcac

SEQ ID NO: 55359 - RNA, 22 nt, Human
uccugcuuccuugucuuuagac

SEQ ID NO: 55360 - RNA, 19 nt, Human
uccugcuuucuacucugcu

SEQ ID NO: 55361 - RNA, 22 nt, Human
uccuggacaagcccuucacccu

SEQ ID NO: 55362 - RNA, 22 nt, Human
uccuggagaaacucagagaucu

SEQ ID NO: 55363 - RNA, 22 nt, Human
uccuggagagaggccuggaaga

SEQ ID NO: 55364 - RNA, 22 nt, Human
uccuggagagugggcgagcaca

SEQ ID NO: 55365 - RNA, 22 nt, Human
uccuggaggaauaaguuuucca

SEQ ID NO: 55366 - RNA, 22 nt, Human
uccuggaggagauccaaucuga

SEQ ID NO: 55367 - RNA, 22 nt, Human
uccuggaggcaaaugaagacuc

SEQ ID NO: 55368 - RNA, 22 nt, Human
uccuggaggcaaaugagcacau

SEQ ID NO: 55369 - RNA, 22 nt, Human
uccuggaggcacucgcuggggc

SEQ ID NO: 55370 - RNA, 22 nt, Human
uccuggaguaggccuuagccau

SEQ ID NO: 55371 - RNA, 20 nt, Human
uccuggagucugguuuggcu

SEQ ID NO: 55372 - RNA, 22 nt, Human
uccuggaguugucuguacucau

SEQ ID NO: 55373 - RNA, 17 nt, Human
uccuggauccauggugg

SEQ ID NO: 55374 - RNA, 22 nt, Human
uccuggauggccugcaggcggu

SEQ ID NO: 55375 - RNA, 22 nt, Human
uccuggauuuaacccuggcucu

SEQ ID NO: 55376 - RNA, 22 nt, Human
uccuggauuuagaagagccucc

SEQ ID NO: 55377 - RNA, 22 nt, Human
uccuggcacaacccuuuaccag

SEQ ID NO: 55378 - RNA, 22 nt, Human
uccuggcagagagcaugaggcc

SEQ ID NO: 55379 - RNA, 22 nt, Human
uccuggcagggaacuugucagc

SEQ ID NO: 55380 - RNA, 17 nt, Human
uccuggcaguccccugg

SEQ ID NO: 55381 - RNA, 22 nt, Human
uccuggcagugcuuguuuugga

SEQ ID NO: 55382 - RNA, 22 nt, Human
uccuggcaguucagcccccuaa

SEQ ID NO: 55383 - RNA, 22 nt, Human
uccuggcauaauggcuuugcuc

SEQ ID NO: 55384 - RNA, 22 nt, Human
uccuggccagaggacaaagcug

SEQ ID NO: 55385 - RNA, 22 nt, Human
uccuggccauaggcuauuucag

SEQ ID NO: 55386 - RNA, 22 nt, Human
uccuggcccgaucccugugaag

SEQ ID NO: 55387 - RNA, 22 nt, Human
uccuggcccggccgggccugcu

SEQ ID NO: 55388 - RNA, 22 nt, Human
uccuggccuccguucucugcau

SEQ ID NO: 55389 - RNA, 22 nt, Human
uccuggcuaacacggugacacc

SEQ ID NO: 55390 - RNA, 22 nt, Human
uccuggcuaguuuugcugaaau

SEQ ID NO: 55391 - RNA, 22 nt, Human
uccuggcucaggccccuggugc

SEQ ID NO: 55392 - RNA, 22 nt, Human
uccuggcuccagcagcucuucc

SEQ ID NO: 55393 - RNA, 17 nt, Human
uccuggcucugccacug

SEQ ID NO: 55394 - RNA, 22 nt, Human
uccuggcucugcugccuccuag

SEQ ID NO: 55395 - RNA, 22 nt, Human
uccuggcugcaccagugacccu

SEQ ID NO: 55396 - RNA, 22 nt, Human
uccuggcugccgucguccugcg

SEQ ID NO: 55397 - RNA, 22 nt, Human
uccuggcuuccugcucuuguca

SEQ ID NO: 55398 - RNA, 21 nt, Human
uccuggcuuuaugcuaccucu

SEQ ID NO: 55399 - RNA, 22 nt, Human
uccuggcuuuucuuggcucauc

SEQ ID NO: 55400 - RNA, 22 nt, Human
ugugaggaguaggcugagggug

SEQ ID NO: 55401 - RNA, 22 nt, Human
ugugaggauggaguucuacagg

SEQ ID NO: 55402 - RNA, 22 nt, Human
ugugaggaugugagcgugaacc

SEQ ID NO: 55403 - RNA, 22 nt, Human
ugugaggccucugcaggagcag

SEQ ID NO: 55404 - RNA, 22 nt, Human
ugugagguaacgcugcucuguu

SEQ ID NO: 55405 - RNA, 22 nt, Human
ugugaguaauaaagucauuuuu

SEQ ID NO: 55406 - RNA, 22 nt, Human
ugugaguacugcuauuuauaua

SEQ ID NO: 55407 - RNA, 22 nt, Human
ugugaguuauuuucaggaguuu

SEQ ID NO: 55408 - RNA, 22 nt, Human
ugugaucacaucugggcugaag

SEQ ID NO: 55409 - RNA, 22 nt, Human
ugugaucucuauaggauucaau

SEQ ID NO: 55410 - RNA, 22 nt, Human
ugugaugucagugguaucaaag

SEQ ID NO: 55411 - RNA, 22 nt, Human
ugugauuauuugauuaacaugu

SEQ ID NO: 55412 - RNA, 22 nt, Human
ugugauuucaucugaggccagg

SEQ ID NO: 55413 - RNA, 22 nt, Human
ugugcaaaauaauaaaucacug

SEQ ID NO: 55414 - RNA, 22 nt, Human
ugugcaaaguguacaaauuaau

SEQ ID NO: 55415 - RNA, 22 nt, Human
ugugcaaauuaaguagauuuuc

SEQ ID NO: 55416 - RNA, 22 nt, Human
ugugcaaucuugagcaauuuau

SEQ ID NO: 55417 - RNA, 22 nt, Human
ugugcaauuucaauuuacacag

SEQ ID NO: 55418 - RNA, 22 nt, Human
ugugcagaaacugggaaggaag

SEQ ID NO: 55419 - RNA, 22 nt, Human
ugugcagagaagccacuggggg

SEQ ID NO: 55420 - RNA, 22 nt, Human
ugugcagcaaaauagaaucuuu

SEQ ID NO: 55421 - RNA, 22 nt, Human
ugugcagugugaccagggcugc

SEQ ID NO: 55422 - RNA, 22 nt, Human
ugugcaguucaaacccguguug

SEQ ID NO: 55423 - RNA, 20 nt, Human
ugugcaugaacugagggauu

SEQ ID NO: 55424 - RNA, 22 nt, Human
ugugcauguaccuuauucugga

SEQ ID NO: 55425 - RNA, 22 nt, Human
ugugcaugucugggccuguaag

SEQ ID NO: 55426 - RNA, 22 nt, Human
ugugccagaaaauaugcugagg

SEQ ID NO: 55427 - RNA, 22 nt, Human
ugugccagaauguuuuuauaca

SEQ ID NO: 55428 - RNA, 22 nt, Human
ugugccagugccuuggguauua

SEQ ID NO: 55429 - RNA, 20 nt, Human
ugugcccaauguccagguuc

SEQ ID NO: 55430 - RNA, 22 nt, Human
ugugcccagacugccucaguga

SEQ ID NO: 55431 - RNA, 22 nt, Human
ugugcccaucccucuggagugu

SEQ ID NO: 55432 - RNA, 22 nt, Human
ugugccuacugauagagccaag

SEQ ID NO: 55433 - RNA, 22 nt, Human
ugugccucauguaucuggauga

SEQ ID NO: 55434 - RNA, 22 nt, Human
ugugccugucccgcauucuggu

SEQ ID NO: 55435 - RNA, 22 nt, Human
ugugccuucucaguccugcuca

SEQ ID NO: 55436 - RNA, 22 nt, Human
ugugcgcguguauauauguaua

SEQ ID NO: 55437 - RNA, 22 nt, Human
ugugcgcuccggcgagucagcg

SEQ ID NO: 55438 - RNA, 23 nt, Human
ugugcgugaugcuuuguugaagg

SEQ ID NO: 55439 - RNA, 22 nt, Human
ugugcgugauggaccgggccug

SEQ ID NO: 55440 - RNA, 22 nt, Human
ugugcgugguucccggggccau

SEQ ID NO: 55441 - RNA, 22 nt, Human
ugugcucagucuuuggcuggga

SEQ ID NO: 55442 - RNA, 23 nt, Human
ugugcucccaaauguaggucuau

SEQ ID NO: 55443 - RNA, 22 nt, Human
ugugcucugcaaucaguucuuu

SEQ ID NO: 55444 - RNA, 22 nt, Human
ugugcucugccccugacuguuu

SEQ ID NO: 55445 - RNA, 22 nt, Human
ugugcucuguggaucugagcaa

SEQ ID NO: 55446 - RNA, 22 nt, Human
uguguccugugaucucuagggu

SEQ ID NO: 55447 - RNA, 22 nt, Human
uguguccuuucuaaugcccaga

SEQ ID NO: 55448 - RNA, 23 nt, Human
ugugucugaggauauaugugcau

SEQ ID NO: 55449 - RNA, 20 nt, Human
ugugucuuccuuucuuuaug

SEQ ID NO: 55450 - RNA, 22 nt, Human
ugugugaacucucugauguaca

SEQ ID NO: 55451 - RNA, 22 nt, Human
ugugugaaggagccacuguuca

SEQ ID NO: 55452 - RNA, 22 nt, Human
ugugugaauggauuauucuauu

SEQ ID NO: 55453 - RNA, 20 nt, Human
ugugugaauuagggcauguu

SEQ ID NO: 55454 - RNA, 22 nt, Human
ugugugacacauugauaugugc

SEQ ID NO: 55455 - RNA, 22 nt, Human
ugugugaccuggggugagauag

SEQ ID NO: 55456 - RNA, 21 nt, Human
ugugugaccuuggacuugagc

SEQ ID NO: 55457 - RNA, 22 nt, Human
ugugugcacugccuuuugugga

SEQ ID NO: 55458 - RNA, 22 nt, Human
ugugugcagccucugucuuugg

SEQ ID NO: 55459 - RNA, 22 nt, Human
ugugugcaugcuuggggcagca

SEQ ID NO: 55460 - RNA, 22 nt, Human
ugugugcauuagcauucuaggg

SEQ ID NO: 55461 - RNA, 22 nt, Human
ugugugccagccuacgaggagc

SEQ ID NO: 55462 - RNA, 22 nt, Human
ugugugcuuaagggcugaaccu

SEQ ID NO: 55463 - RNA, 22 nt, Human
ugugugcuuauagucuaguagu

SEQ ID NO: 55464 - RNA, 22 nt, Human
uguguggccuccauaggguacu

SEQ ID NO: 55465 - RNA, 22 nt, Human
uguguggugaagcagagaugcu

SEQ ID NO: 55466 - RNA, 22 nt, Human
uguguguagaaagggcccuggu

SEQ ID NO: 55467 - RNA, 22 nt, Human
uguguguccuugaccucagugg

SEQ ID NO: 55468 - RNA, 22 nt, Human
ugugugugggcggaacggcccc

SEQ ID NO: 55469 - RNA, 20 nt, Human
uguguguguacuucuaaaua

SEQ ID NO: 55470 - RNA, 23 nt, Human
uguguguguauucuacgcaaggu

SEQ ID NO: 55471 - RNA, 22 nt, Human
uguguguuaucuuaguucaucu

SEQ ID NO: 55472 - RNA, 19 nt, Human
uguguguuuauauauguau

SEQ ID NO: 55473 - RNA, 22 nt, Human
uguguuauugccacugaagacc

SEQ ID NO: 55474 - RNA, 22 nt, Human
uguguucaaucaccaaagguau

SEQ ID NO: 55475 - RNA, 22 nt, Human
uguguucaaucccuagucucag

SEQ ID NO: 55476 - RNA, 22 nt, Human
uguguucaaugacuucaucuuu

SEQ ID NO: 55477 - RNA, 22 nt, Human
uguguucacccuagcacuuaac

SEQ ID NO: 55478 - RNA, 22 nt, Human
uguguucagaauuugcugcuuu

SEQ ID NO: 55479 - RNA, 19 nt, Human
uguguucauucaucagagg

SEQ ID NO: 55480 - RNA, 22 nt, Human
uguguucauuuaacuguucuuu

SEQ ID NO: 55481 - RNA, 22 nt, Human
uguguucuaugguucagggugg

SEQ ID NO: 55482 - RNA, 23 nt, Human
uguguucucacacagaugcagua

SEQ ID NO: 55483 - RNA, 22 nt, Human
uguguucuccaacuguagauuu

SEQ ID NO: 55484 - RNA, 22 nt, Human
uguguuggaaauagggucuuug

SEQ ID NO: 55485 - RNA, 22 nt, Human
uguguuggcugccggcacagga

SEQ ID NO: 55486 - RNA, 22 nt, Human
uguguugguagaucugaggucu

SEQ ID NO: 55487 - RNA, 22 nt, Human
uguguugugucaccuaucaugc

SEQ ID NO: 55488 - RNA, 22 nt, Human
uguguuuaaagaggaagugaga

SEQ ID NO: 55489 - RNA, 22 nt, Human
uguguuucucugaggggucccu

SEQ ID NO: 55490 - RNA, 22 nt, Human
uguguuucugagaaucccaccu

SEQ ID NO: 55491 - RNA, 21 nt, Human
uguguuugagacuauguuucc

SEQ ID NO: 55492 - RNA, 22 nt, Human
uguguuugaggcauguugcaga

SEQ ID NO: 55493 - RNA, 22 nt, Human
uguguuuuacaaauucucuuaa

SEQ ID NO: 55494 - RNA, 22 nt, Human
uguguuuugaacucaucuacug

SEQ ID NO: 55495 - RNA, 22 nt, Human
uguguuuuggaaggaacaugca

SEQ ID NO: 55496 - RNA, 22 nt, Human
uguuaaaaauucagcucuagau

SEQ ID NO: 55497 - RNA, 22 nt, Human
uguuaaacagauauugcccaca

SEQ ID NO: 55498 - RNA, 22 nt, Human
uguuaaaccuaguacagguccu

SEQ ID NO: 55499 - RNA, 22 nt, Human
uguuaaacuguauugcauaagg

SEQ ID NO: 55500 - RNA, 22 nt, Human
uguuaaaguggauaagcugaau

SEQ ID NO: 55501 - RNA, 22 nt, Human
uguuaaauguauuauguguucu

SEQ ID NO: 55502 - RNA, 22 nt, Human
uguuaacagguaacugaggcug

SEQ ID NO: 55503 - RNA, 22 nt, Human
uguuaaucaaucaacaguauua

SEQ ID NO: 55504 - RNA, 22 nt, Human
uguuacagaaauauugcuucuu

SEQ ID NO: 55505 - RNA, 22 nt, Human
uguuacaguacuacaauucugc

SEQ ID NO: 55506 - RNA, 22 nt, Human
uguuacagugacuaauguuuua

SEQ ID NO: 55507 - RNA, 22 nt, Human
uguuacucugggguugugguga

SEQ ID NO: 55508 - RNA, 22 nt, Human
uguuacugugguuaccagaagc

SEQ ID NO: 55509 - RNA, 22 nt, Human
uguuacuuggugucucuggcug

SEQ ID NO: 55510 - RNA, 22 nt, Human
uguuagaaauuauuaguaauau

SEQ ID NO: 55511 - RNA, 22 nt, Human
uguuagauauucauuaauagga

SEQ ID NO: 55512 - RNA, 22 nt, Human
uguuagcagagcagcugacaga

SEQ ID NO: 55513 - RNA, 22 nt, Human
uguuaucucagacugaguuacu

SEQ ID NO: 55514 - RNA, 22 nt, Human
uguuaucugcacguagaguuuu

SEQ ID NO: 55515 - RNA, 22 nt, Human
uguuaugaguccucauauacua

SEQ ID NO: 55516 - RNA, 22 nt, Human
uguuauucuaguggaucacguc

SEQ ID NO: 55517 - RNA, 22 nt, Human
uguuauugauaucuaaugcucu

SEQ ID NO: 55518 - RNA, 18 nt, Human
ucuauauggacauagaga

SEQ ID NO: 55519 - RNA, 22 nt, Human
ucuauauuuugaaagguauuua

SEQ ID NO: 55520 - RNA, 22 nt, Human
ucuaugaaaagucuauucauuc

SEQ ID NO: 55521 - RNA, 22 nt, Human
ucuaugaaccucugcaaugaca

SEQ ID NO: 55522 - RNA, 22 nt, Human
ucuaugaaguucagagaucuau

SEQ ID NO: 55523 - RNA, 22 nt, Human
ucuauguccuuucucccauucc

SEQ ID NO: 55524 - RNA, 22 nt, Human
ucuauuacuuaccacuaauuca

SEQ ID NO: 55525 - RNA, 21 nt, Human
ucuauucauuacaguuauuug

SEQ ID NO: 55526 - RNA, 22 nt, Human
ucuauucauucaauuuagcucu

SEQ ID NO: 55527 - RNA, 22 nt, Human
ucuauucugauaaaugcaugga

SEQ ID NO: 55528 - RNA, 22 nt, Human
ucuauuuacagaaagcagaauu

SEQ ID NO: 55529 - RNA, 22 nt, Human
ucuauuuaccaaauguaguucc

SEQ ID NO: 55530 - RNA, 22 nt, Human
ucuauuugcugguugcuucugu

SEQ ID NO: 55531 - RNA, 22 nt, Human
ucuauuuguucucaggaucauc

SEQ ID NO: 55532 - RNA, 22 nt, Human
ucucaaacuguguauuauaauu

SEQ ID NO: 55533 - RNA, 22 nt, Human
ucucaaauaggccuugguccug

SEQ ID NO: 55534 - RNA, 23 nt, Human
ucucaaauaugaucugggucauc

SEQ ID NO: 55535 - RNA, 23 nt, Human
ucucaaaucuuugcguuguaucu

SEQ ID NO: 55536 - RNA, 22 nt, Human
ucucaaauucccuuuuccuccu

SEQ ID NO: 55537 - RNA, 23 nt, Human
ucucaagccagaccaggccucgc

SEQ ID NO: 55538 - RNA, 22 nt, Human
ucucaagcuaguguuuauagua

SEQ ID NO: 55539 - RNA, 22 nt, Human
ucucaagcuuguugguauguuu

SEQ ID NO: 55540 - RNA, 22 nt, Human
ucucaaggacuuugggcacuaa

SEQ ID NO: 55541 - RNA, 18 nt, Human
ucucaaucgcugcagucu

SEQ ID NO: 55542 - RNA, 19 nt, Human
ucucaauguucagaaagcu

SEQ ID NO: 55543 - RNA, 22 nt, Human
ucucacaagcucaaggauuagu

SEQ ID NO: 55544 - RNA, 21 nt, Human
ucucacaauaugaugccagau

SEQ ID NO: 55545 - RNA, 22 nt, Human
ucucacacuucuguguugcaca

SEQ ID NO: 55546 - RNA, 22 nt, Human
ucucacagaucagcagggggcu

SEQ ID NO: 55547 - RNA, 23 nt, Human
ucucacagcgaucuaggaagagg

SEQ ID NO: 55548 - RNA, 22 nt, Human
ucucacagggcuaggcccugcc

SEQ ID NO: 55549 - RNA, 22 nt, Human
ucucacagugagccugaggucg

SEQ ID NO: 55550 - RNA, 22 nt, Human
ucucaccaaagccuugaccaua

SEQ ID NO: 55551 - RNA, 22 nt, Human
ucucacccaacgugcaaugagu

SEQ ID NO: 55552 - RNA, 22 nt, Human
ucucacugauuugagaccaagg

SEQ ID NO: 55553 - RNA, 22 nt, Human
ucucagaaauacuauguuguca

SEQ ID NO: 55554 - RNA, 22 nt, Human
ucucagaauaaauuccuaacuu

SEQ ID NO: 55555 - RNA, 22 nt, Human
ucuucuguggcucucaccaccc

SEQ ID NO: 55556 - RNA, 22 nt, Human
ucuucuguuaccacagcgauga

SEQ ID NO: 55557 - RNA, 22 nt, Human
ucuucuguuuuagauugcauac

SEQ ID NO: 55558 - RNA, 22 nt, Human
ucuucuuaaaguauguucucuu

SEQ ID NO: 55559 - RNA, 22 nt, Human
ucuucuuuuugucccacagaau

SEQ ID NO: 55560 - RNA, 22 nt, Human
ucuugaaagcaugagauggaca

SEQ ID NO: 55561 - RNA, 22 nt, Human
ucuugaaaggagauuggaggca

SEQ ID NO: 55562 - RNA, 22 nt, Human
ucuugaaguccuuacauuugau

SEQ ID NO: 55563 - RNA, 22 nt, Human
ucuugagguuauuaagcuguua

SEQ ID NO: 55564 - RNA, 22 nt, Human
ucuugauucauguucccugcau

SEQ ID NO: 55565 - RNA, 22 nt, Human
ucuugauuuauucuacccagaa

SEQ ID NO: 55566 - RNA, 22 nt, Human
ucuugcaccacacaaaaauuug

SEQ ID NO: 55567 - RNA, 22 nt, Human
ucuugcagaaaauaguauagau

SEQ ID NO: 55568 - RNA, 22 nt, Human
ucuugcagacagcuuccagccu

SEQ ID NO: 55569 - RNA, 22 nt, Human
ucuugcagacucacaagguacu

SEQ ID NO: 55570 - RNA, 22 nt, Human
ucuugcagaggcacugugucag

SEQ ID NO: 55571 - RNA, 22 nt, Human
ucuugcugcuguccacacagua

SEQ ID NO: 55572 - RNA, 22 nt, Human
ucuuggaacuuauuauuguaga

SEQ ID NO: 55573 - RNA, 22 nt, Human
ucuuggaaucuccauagaguga

SEQ ID NO: 55574 - RNA, 22 nt, Human
ucuuggagaauggcagagaagc

SEQ ID NO: 55575 - RNA, 22 nt, Human
ucuuggagacucuuguauauuu

SEQ ID NO: 55576 - RNA, 22 nt, Human
ucuuggagauagggucuuaaug

SEQ ID NO: 55577 - RNA, 20 nt, Human
ucuuggcaaaugggaguguc

SEQ ID NO: 55578 - RNA, 18 nt, Human
ucuuggcagcaucuggca

SEQ ID NO: 55579 - RNA, 22 nt, Human
ucuuggccagguguggugccuc

SEQ ID NO: 55580 - RNA, 22 nt, Human
ucuuggccccaacccucuauuu

SEQ ID NO: 55581 - RNA, 21 nt, Human
ucuuggccuaaguucacugaa

SEQ ID NO: 55582 - RNA, 22 nt, Human
ucuuggcuaguaccuuccugcc

SEQ ID NO: 55583 - RNA, 22 nt, Human
ucuuggcugcagagccggcaag

SEQ ID NO: 55584 - RNA, 22 nt, Human
ucuuggcugcugccaauuuacu

SEQ ID NO: 55585 - RNA, 23 nt, Human
ucuuggcuggacaagucacucac

SEQ ID NO: 55586 - RNA, 22 nt, Human
ucuuggcugugcaugcaucuuc

SEQ ID NO: 55587 - RNA, 22 nt, Human
ucuugggaagcccauuuccacc

SEQ ID NO: 55588 - RNA, 22 nt, Human
ucuugggaccauuuacacauac

SEQ ID NO: 55589 - RNA, 22 nt, Human
ucuugggagucccaggacauag

SEQ ID NO: 55590 - RNA, 22 nt, Human
ucuugggcaauuucucuagagg

SEQ ID NO: 55591 - RNA, 22 nt, Human
ucuugguuaggggaaauaggca

SEQ ID NO: 55592 - RNA, 22 nt, Human
ucuuguauuugauuccuuccaa

SEQ ID NO: 55593 - RNA, 22 nt, Human
ucuugucacuacuguuaugcau

SEQ ID NO: 55594 - RNA, 22 nt, Human
ucuuguccuaagagcuggauuc

SEQ ID NO: 55595 - RNA, 21 nt, Human
ucuugugugcugcccugcuac

SEQ ID NO: 55596 - RNA, 22 nt, Human
ucuuguuacaguuuauuacaug

SEQ ID NO: 55597 - RNA, 22 nt, Human
ucuuguuaucaggaaaacagua

SEQ ID NO: 55598 - RNA, 23 nt, Human
ucuuguuuccuuugcgcuaucca

SEQ ID NO: 55599 - RNA, 22 nt, Human
ucuuguuuugaacucaucagga

SEQ ID NO: 55600 - RNA, 22 nt, Human
ucuuuaaaguuggagcuugcaa

SEQ ID NO: 55601 - RNA, 22 nt, Human
ucuuuaauaucugccccagagc

SEQ ID NO: 55602 - RNA, 22 nt, Human
ucuuuaaugugauuguaauuau

SEQ ID NO: 55603 - RNA, 22 nt, Human
ucuuuaauucagcaugaugcgg

SEQ ID NO: 55604 - RNA, 22 nt, Human
ucuuuaauuguggaagagcagc

SEQ ID NO: 55605 - RNA, 22 nt, Human
ucuuuacaguccucugucaauc

SEQ ID NO: 55606 - RNA, 22 nt, Human
ucuuuagagcacgggaaaaaca

SEQ ID NO: 55607 - RNA, 22 nt, Human
ucuuuagauguuuagaggaaga

SEQ ID NO: 55608 - RNA, 22 nt, Human
ucuuuaguauugaguuauggua

SEQ ID NO: 55609 - RNA, 19 nt, Human
ucuuuagucacauuuuuau

SEQ ID NO: 55610 - RNA, 22 nt, Human
ucuuuagugaccaucucauucu

SEQ ID NO: 55611 - RNA, 22 nt, Human
ucuuuauacaaacugggaaaca

SEQ ID NO: 55612 - RNA, 22 nt, Human
ucuuuauguugauuuccucagg

SEQ ID NO: 55613 - RNA, 22 nt, Human
ucuuucaaagcaaaaugaggcu

SEQ ID NO: 55614 - RNA, 22 nt, Human
ucuuucaaagcuguaguagauu

SEQ ID NO: 55615 - RNA, 22 nt, Human
ucuuucagccacuuaccugucu

SEQ ID NO: 55616 - RNA, 22 nt, Human
ucuuucauucuagucugagguu

SEQ ID NO: 55617 - RNA, 19 nt, Human
ucuuucauuucuagcucug

SEQ ID NO: 55618 - RNA, 22 nt, Human
ucuuuccacagcauguccaugc

SEQ ID NO: 55619 - RNA, 22 nt, Human
ucuuuccacauucucuguuuag

SEQ ID NO: 55620 - RNA, 22 nt, Human
ucuuuccauggccacacagucu

SEQ ID NO: 55621 - RNA, 22 nt, Human
ucuuucccgccagagcaugagu

SEQ ID NO: 55622 - RNA, 17 nt, Human
ucuuucccugggagaug

SEQ ID NO: 55623 - RNA, 22 nt, Human
ucuuuccuacuuuauugugaac

SEQ ID NO: 55624 - RNA, 22 nt, Human
ucuuuccuagaggcugaugagu

SEQ ID NO: 55625 - RNA, 17 nt, Human
ucuuuccugccaugcuc

SEQ ID NO: 55626 - RNA, 21 nt, Human
ucuuuccugcccaguugcccu

SEQ ID NO: 55627 - RNA, 22 nt, Human
ucuuucuacaucauuugcuucu

SEQ ID NO: 55628 - RNA, 22 nt, Human
ucuuucuuacaaagaaaacggu

SEQ ID NO: 55629 - RNA, 22 nt, Human
ucuuucuuauuagccauuguuc

SEQ ID NO: 55630 - RNA, 22 nt, Human
ucuuucuuccuggagcccaaca

SEQ ID NO: 55631 - RNA, 22 nt, Human
ucuuucuucuuucauaguguga

SEQ ID NO: 55632 - RNA, 22 nt, Human
ucuuucuugcaaggaugcagga

SEQ ID NO: 55633 - RNA, 22 nt, Human
ucucccacuggccuuguaugau

SEQ ID NO: 55634 - RNA, 22 nt, Human
ucucccauucagcuugcaguca

SEQ ID NO: 55635 - RNA, 22 nt, Human
ucuccccaaaggacucacucuc

SEQ ID NO: 55636 - RNA, 22 nt, Human
ucuccccagacccuggacauaa

SEQ ID NO: 55637 - RNA, 22 nt, Human
ucuccccagggguauggguauu

SEQ ID NO: 55638 - RNA, 21 nt, Human
ucuccccauucuuauucccau

SEQ ID NO: 55639 - RNA, 22 nt, Human
ucucccucuuugucugcuuugg

SEQ ID NO: 55640 - RNA, 16 nt, Human
ucucccuugucaccug

SEQ ID NO: 55641 - RNA, 22 nt, Human
ucuccgaucacagguuuucaau

SEQ ID NO: 55642 - RNA, 22 nt, Human
ucuccucaccaccagcagcaga

SEQ ID NO: 55643 - RNA, 22 nt, Human
ucuccucccaggcucuuccagg

SEQ ID NO: 55644 - RNA, 22 nt, Human
ucuccucuacugggucugcaga

SEQ ID NO: 55645 - RNA, 22 nt, Human
ucuccucugugccacagcuugg

SEQ ID NO: 55646 - RNA, 22 nt, Human
ucuccugcagucagcagucuca

SEQ ID NO: 55647 - RNA, 22 nt, Human
ucuccugcuucaacugauggac

SEQ ID NO: 55648 - RNA, 22 nt, Human
ucuccuggauggaccuucucuu

SEQ ID NO: 55649 - RNA, 22 nt, Human
ucuccuggcauuugguugagua

SEQ ID NO: 55650 - RNA, 22 nt, Human
ucuccuggccuuuagguuaagg

SEQ ID NO: 55651 - RNA, 22 nt, Human
ucuccugggaggacaaggaagg

SEQ ID NO: 55652 - RNA, 22 nt, Human
ucuccugggcuugguugaaguu

SEQ ID NO: 55653 - RNA, 22 nt, Human
ucuccugggugcuuuaucagaa

SEQ ID NO: 55654 - RNA, 22 nt, Human
ucuccugucuucucagcacccc

SEQ ID NO: 55655 - RNA, 18 nt, Human
ucuccuuccaaaucuuca

SEQ ID NO: 55656 - RNA, 22 nt, Human
ucuccuugacaggcaggcagac

SEQ ID NO: 55657 - RNA, 22 nt, Human
ucuccuuugaaaguuaggacug

SEQ ID NO: 55658 - RNA, 22 nt, Human
ucucgugcaggccuugcucgga

SEQ ID NO: 55659 - RNA, 22 nt, Human
ucucuaaaugcucucccauccc

SEQ ID NO: 55660 - RNA, 22 nt, Human
ucucuacacaggauucacauga

SEQ ID NO: 55661 - RNA, 19 nt, Human
ucucuacacuacauuucua

SEQ ID NO: 55662 - RNA, 22 nt, Human
ucucuacauaaccucaauacuc

SEQ ID NO: 55663 - RNA, 22 nt, Human
ucucuagcuuccuuaggaacac

SEQ ID NO: 55664 - RNA, 22 nt, Human
ucuccccuguuggccagguuuu

SEQ ID NO: 55665 - RNA, 22 nt, Human
ucucccuacugacuccaggacc

SEQ ID NO: 55666 - RNA, 22 nt, Human
ucucccuagggccgcuggcuaa

SEQ ID NO: 55667 - RNA, 23 nt, Human
ucucccugagguuguuagcauua

SEQ ID NO: 55668 - RNA, 22 nt, Human
ucuccuaggcuggagugcagug

SEQ ID NO: 55669 - RNA, 22 nt, Human
ucuccucuauuucuguauguau

SEQ ID NO: 55670 - RNA, 22 nt, Human
ucuccugacaugucuggaggaa

SEQ ID NO: 55671 - RNA, 22 nt, Human
ucuccugauaucugcagaccua

SEQ ID NO: 55672 - RNA, 22 nt, Human
ucuccugcucccaacugcugca

SEQ ID NO: 55673 - RNA, 22 nt, Human
ucuccuggaagaauaccacacu

SEQ ID NO: 55674 - RNA, 22 nt, Human
ucuccuggcaugugggucaucu

SEQ ID NO: 55675 - RNA, 23 nt, Human
ucuccuggcugcacuguggccac

SEQ ID NO: 55676 - RNA, 22 nt, Human
ucuccuggguaaaaggguugau

SEQ ID NO: 55677 - RNA, 18 nt, Human
ucuccuggguaggggccu

SEQ ID NO: 55678 - RNA, 22 nt, Human
ucuccuggucaccucagaaguc

SEQ ID NO: 55679 - RNA, 20 nt, Human
ucuccuggucugguccgugc

SEQ ID NO: 55680 - RNA, 23 nt, Human
ucuccuguccuaauuaccacccc

SEQ ID NO: 55681 - RNA, 22 nt, Human
ucuccuugcuacccaguauguc

SEQ ID NO: 55682 - RNA, 21 nt, Human
ucucguuguauggucuugggg

SEQ ID NO: 55683 - RNA, 22 nt, Human
ucucuaaagaagccucccuaaa

SEQ ID NO: 55684 - RNA, 22 nt, Human
ucucuaaagauagcugccucga

SEQ ID NO: 55685 - RNA, 22 nt, Human
ucucuaaagcacuuuaaccaca

SEQ ID NO: 55686 - RNA, 22 nt, Human
ucucuaaaucugguucacuugc

SEQ ID NO: 55687 - RNA, 19 nt, Human
ucucuaaccucaagagguu

SEQ ID NO: 55688 - RNA, 21 nt, Human
ucucuacaaauuauguuaggu

SEQ ID NO: 55689 - RNA, 22 nt, Human
ucucuacagacacuguugacuu

SEQ ID NO: 55690 - RNA, 22 nt, Human
ucucuacagauccuauauagaa

SEQ ID NO: 55691 - RNA, 22 nt, Human
ucucuacagcacccgcaugcua

SEQ ID NO: 55692 - RNA, 18 nt, Human
ucucuaccagaagugacg

SEQ ID NO: 55693 - RNA, 22 nt, Human
ucucuaggcagugucagaauca

SEQ ID NO: 55694 - RNA, 22 nt, Human
ucucuagggaucuguuuuaauu

SEQ ID NO: 55695 - RNA, 22 nt, Human
ucucucagaggccaggguccug

SEQ ID NO: 55696 - RNA, 22 nt, Human
ucucucagauggggcacuagua

SEQ ID NO: 55697 - RNA, 22 nt, Human
ucucucccaaaucugcagauag

SEQ ID NO: 55698 - RNA, 22 nt, Human
ucucucuaggcaucuauuuuca

SEQ ID NO: 55699 - RNA, 22 nt, Human
ucucucugagcccugcuuuuuc

SEQ ID NO: 55700 - RNA, 23 nt, Human
ucucucuggcaaauuucacauau

SEQ ID NO: 55701 - RNA, 22 nt, Human
ucucucuuuuuaaucauguaau

SEQ ID NO: 55702 - RNA, 22 nt, Human
ucucugaagcuguuguagucuc

SEQ ID NO: 55703 - RNA, 18 nt, Human
ucucugaauauuuuaugu

SEQ ID NO: 55704 - RNA, 22 nt, Human
ucucugacagugaaagaguuca

SEQ ID NO: 55705 - RNA, 21 nt, Human
ucucugacccaggaagagggc

SEQ ID NO: 55706 - RNA, 22 nt, Human
ucucugagaauaucccauaaga

SEQ ID NO: 55707 - RNA, 22 nt, Human
ucucugagcccaauguagcaau

SEQ ID NO: 55708 - RNA, 22 nt, Human
ucucugagcuggauuuguucuu

SEQ ID NO: 55709 - RNA, 20 nt, Human
ucucugagcuucucuugggg

SEQ ID NO: 55710 - RNA, 20 nt, Human
ucucugaguuuccuaauuug

SEQ ID NO: 55711 - RNA, 22 nt, Human
ucucugaguuuuaaggaugaug

SEQ ID NO: 55712 - RNA, 22 nt, Human
ucucugcauccccagggcucuc

SEQ ID NO: 55713 - RNA, 22 nt, Human
ucucugcccaugagcaaucugc

SEQ ID NO: 55714 - RNA, 20 nt, Human
ucucugcuguccacauuugc

SEQ ID NO: 55715 - RNA, 19 nt, Human
ucucugcuucucuuggcau

SEQ ID NO: 55716 - RNA, 22 nt, Human
ucucuggagggcuccaggcggg

SEQ ID NO: 55717 - RNA, 20 nt, Human
ucucuggcaagaagcugcag

SEQ ID NO: 55718 - RNA, 22 nt, Human
ucucuggcagggauaucuggcu

SEQ ID NO: 55719 - RNA, 20 nt, Human
ucucuggccagaaacaacag

SEQ ID NO: 55720 - RNA, 22 nt, Human
ucucugggaauucacaagcccu

SEQ ID NO: 55721 - RNA, 22 nt, Human
ucucugggaauuuuuuggacau

SEQ ID NO: 55722 - RNA, 21 nt, Human
ucucugggaggacuugugaga

SEQ ID NO: 55723 - RNA, 22 nt, Human
ucucugggaucagguggcccag

SEQ ID NO: 55724 - RNA, 22 nt, Human
ucucugggaucguuuugggcuc

SEQ ID NO: 55725 - RNA, 22 nt, Human
ucucuggggaugcuuauucuug

SEQ ID NO: 55726 - RNA, 22 nt, Human
ucucuggggauggaccugggag

SEQ ID NO: 55727 - RNA, 22 nt, Human
ucucuggggguagaacucaggc

SEQ ID NO: 55728 - RNA, 22 nt, Human
ucucuggguaugguaacguugg

SEQ ID NO: 55729 - RNA, 22 nt, Human
ucucugggugauggcagggcac

SEQ ID NO: 55730 - RNA, 22 nt, Human
ucucuggucccaccuggccauu

SEQ ID NO: 55731 - RNA, 22 nt, Human
ucucugguuauuaacuaacucc

SEQ ID NO: 55732 - RNA, 22 nt, Human
ucucuguaaaauguggaugaua

SEQ ID NO: 55733 - RNA, 20 nt, Human
ucucuguaaaucuucuuuua

SEQ ID NO: 55734 - RNA, 22 nt, Human
ucucuguaaggaagaauuagau

SEQ ID NO: 55735 - RNA, 22 nt, Human
ucucuguagagacagcacugug

SEQ ID NO: 55736 - RNA, 22 nt, Human
ucucuguaucccagaaccaaaa

SEQ ID NO: 55737 - RNA, 22 nt, Human
ucucuguauucugauauucacu

SEQ ID NO: 55738 - RNA, 22 nt, Human
ucucugucugagccuggcagac

SEQ ID NO: 55739 - RNA, 22 nt, Human
ucucugugacugcagcuuugca

SEQ ID NO: 55740 - RNA, 22 nt, Human
ucucuguggcauccacucaacu

SEQ ID NO: 55741 - RNA, 22 nt, Human
ucucugugucucauguuccuau

SEQ ID NO: 55742 - RNA, 21 nt, Human
ucucuguguucaaggugccag

SEQ ID NO: 55743 - RNA, 22 nt, Human
ucucuguucauggcacuauguc

SEQ ID NO: 55744 - RNA, 22 nt, Human
ucucuuaaaagaguaauagaga

SEQ ID NO: 55745 - RNA, 22 nt, Human
ucucuuaaauacuucacaucuc

SEQ ID NO: 55746 - RNA, 22 nt, Human
ucucuuaauucagaggcaguua

SEQ ID NO: 55747 - RNA, 22 nt, Human
ucucuucagcccauuauaaggg

SEQ ID NO: 55748 - RNA, 22 nt, Human
ucucuuccaguaagagucuuua

SEQ ID NO: 55749 - RNA, 22 nt, Human
ucucuuccaguggcuuugauuu

SEQ ID NO: 55750 - RNA, 21 nt, Human
ucucuucccaucaggacacua

SEQ ID NO: 55751 - RNA, 22 nt, Human
ucucuucccuuuaugguaugug

SEQ ID NO: 55752 - RNA, 22 nt, Human
ucucuucuaauuaggguccaug

SEQ ID NO: 55753 - RNA, 22 nt, Human
ucucuucugaaaccugucuuua

SEQ ID NO: 55754 - RNA, 20 nt, Human
ucucuucuggggagauaaaa

SEQ ID NO: 55755 - RNA, 22 nt, Human
ucucuugaagauugaagacaaa

SEQ ID NO: 55756 - RNA, 22 nt, Human
ucucuugagcucaguucugaug

SEQ ID NO: 55757 - RNA, 22 nt, Human
ucucuuggaaagcuugcccacu

SEQ ID NO: 55758 - RNA, 22 nt, Human
ucucuuguaauuuaaaaaaucu

SEQ ID NO: 55759 - RNA, 23 nt, Human
ucucuuucaagagcuuaaugugc

SEQ ID NO: 55760 - RNA, 22 nt, Human
ucucuuucuauaugugagucuu

SEQ ID NO: 55761 - RNA, 22 nt, Human
ucucuuucuauugcaccaugcu

SEQ ID NO: 55762 - RNA, 21 nt, Human
ucucuuucuggaagcuucccu

SEQ ID NO: 55763 - RNA, 21 nt, Human
ucucuuugggaacauuaauca

SEQ ID NO: 55764 - RNA, 18 nt, Human
ucucuuuuccccucauug

SEQ ID NO: 55765 - RNA, 22 nt, Human
ucugaaagagaguacauacagu

SEQ ID NO: 55766 - RNA, 22 nt, Human
uuagaacaguguuugccucgcu

SEQ ID NO: 55767 - RNA, 22 nt, Human
uuagaacaucugugucuuuaug

SEQ ID NO: 55768 - RNA, 22 nt, Human
uuagaacuuaaacuucagaaag

SEQ ID NO: 55769 - RNA, 22 nt, Human
uuagaacuuaagaauacugucu

SEQ ID NO: 55770 - RNA, 22 nt, Human
uuagaagcaggcugugucccca

SEQ ID NO: 55771 - RNA, 22 nt, Human
uuagaaguaaggucagauuucu

SEQ ID NO: 55772 - RNA, 20 nt, Human
uuagaaguggcuauuuccuc

SEQ ID NO: 55773 - RNA, 22 nt, Human
ucuggaggcaacuaaccuaguu

SEQ ID NO: 55774 - RNA, 22 nt, Human
ucuggaggcucugagggugagu

SEQ ID NO: 55775 - RNA, 18 nt, Human
ucuggagggaagcuuuga

SEQ ID NO: 55776 - RNA, 23 nt, Human
ucuggaggggacacugcagaugc

SEQ ID NO: 55777 - RNA, 22 nt, Human
ucuggagggguuuagagggaca

SEQ ID NO: 55778 - RNA, 22 nt, Human
ucuggaguaacucuguuucugg

SEQ ID NO: 55779 - RNA, 22 nt, Human
ucuggaguaggaccugaaaaua

SEQ ID NO: 55780 - RNA, 22 nt, Human
ucuggaguagggucugggaauu

SEQ ID NO: 55781 - RNA, 21 nt, Human
ucuggagucaucuuuaccaua

SEQ ID NO: 55782 - RNA, 22 nt, Human
ucuggaguccagauccauuugg

SEQ ID NO: 55783 - RNA, 22 nt, Human
ucuggaguguccaguucuacuc

SEQ ID NO: 55784 - RNA, 22 nt, Human
ucuggaguugcauguuuuggcu

SEQ ID NO: 55785 - RNA, 22 nt, Human
ucuggaucaccacuucugccuc

SEQ ID NO: 55786 - RNA, 22 nt, Human
ucuggauccuaugcacuggacu

SEQ ID NO: 55787 - RNA, 22 nt, Human
ucuggaucggguuccucagguc

SEQ ID NO: 55788 - RNA, 22 nt, Human
ucuggaucuccagcacuuauca

SEQ ID NO: 55789 - RNA, 23 nt, Human
ucuggaugccaccacauacuaac

SEQ ID NO: 55790 - RNA, 22 nt, Human
ucuggaugggaugaggcaacaa

SEQ ID NO: 55791 - RNA, 22 nt, Human
ucuggauguugcggaguacaga

SEQ ID NO: 55792 - RNA, 20 nt, Human
ucuggcacacugagaagcuc

SEQ ID NO: 55793 - RNA, 22 nt, Human
ucuggcagaggaaggaggccug

SEQ ID NO: 55794 - RNA, 22 nt, Human
ucuggcagcgaagcguguacuu

SEQ ID NO: 55795 - RNA, 22 nt, Human
ucuggcaggaccaugaagcgua

SEQ ID NO: 55796 - RNA, 21 nt, Human
ucuggcaggcacgggcccagc

SEQ ID NO: 55797 - RNA, 22 nt, Human
ucuggcagggucagggcccagg

SEQ ID NO: 55798 - RNA, 22 nt, Human
ucuggcaggucaaucauucuuu

SEQ ID NO: 55799 - RNA, 20 nt, Human
ucuggcaggugaacgagcug

SEQ ID NO: 55800 - RNA, 22 nt, Human
ucuggcagugagcaacuugaca

SEQ ID NO: 55801 - RNA, 21 nt, Human
ucuggcaguggucuuucaaau

SEQ ID NO: 55802 - RNA, 22 nt, Human
ucuggcauggauuugagugucu

SEQ ID NO: 55803 - RNA, 22 nt, Human
ucuggcauuucaggcaucuaua

SEQ ID NO: 55804 - RNA, 22 nt, Human
ucuggcccaugauccugcuaac

SEQ ID NO: 55805 - RNA, 22 nt, Human
ucuggccccggucuucacagcu

SEQ ID NO: 55806 - RNA, 20 nt, Human
ucuggccccuuccuguccug

SEQ ID NO: 55807 - RNA, 21 nt, Human
ucuggcccuagguugggccuc

SEQ ID NO: 55808 - RNA, 22 nt, Human
ucuggcccuauggcauguaccu

SEQ ID NO: 55809 - RNA, 22 nt, Human
ucuggccuauuucugucagauc

SEQ ID NO: 55810 - RNA, 22 nt, Human
ucuggccuccuccaccagggaa

SEQ ID NO: 55811 - RNA, 22 nt, Human
ucuggccugaaaguccaugcuu

SEQ ID NO: 55812 - RNA, 22 nt, Human
ucuggccuguguugguggcccc

SEQ ID NO: 55813 - RNA, 17 nt, Human
ucuggccuuccugaacu

SEQ ID NO: 55814 - RNA, 22 nt, Human
ucuggcuagauugaugaguccc

SEQ ID NO: 55815 - RNA, 18 nt, Human
ucuggcucaggacugaac

SEQ ID NO: 55816 - RNA, 22 nt, Human
ucuggcucauaggaaggccauu

SEQ ID NO: 55817 - RNA, 22 nt, Human
ucuggcucaucucuccagguaa

SEQ ID NO: 55818 - RNA, 22 nt, Human
ucuggcuccaccuccuuuacua

SEQ ID NO: 55819 - RNA, 22 nt, Human
ucuggcuccacucugugcaugc

SEQ ID NO: 55820 - RNA, 22 nt, Human
ucuggcuccaggaccgggcaca

SEQ ID NO: 55821 - RNA, 19 nt, Human
ucuggcuccgccucuuagu

SEQ ID NO: 55822 - RNA, 22 nt, Human
ucuggcucuccagugcucuuag

SEQ ID NO: 55823 - RNA, 22 nt, Human
ucuggcucuguguccucaccca

SEQ ID NO: 55824 - RNA, 20 nt, Human
ucuggcucuuugcuccuccc

SEQ ID NO: 55825 - RNA, 22 nt, Human
ucuggcugaagcuuuugcagcu

SEQ ID NO: 55826 - RNA, 22 nt, Human
ucuggcugauucccugggacug

SEQ ID NO: 55827 - RNA, 22 nt, Human
ucuggcuggcagugauggugug

SEQ ID NO: 55828 - RNA, 22 nt, Human
ucuggcugggugagagcuucuc

SEQ ID NO: 55829 - RNA, 22 nt, Human
ucuggcugucauuggaggcccc

SEQ ID NO: 55830 - RNA, 22 nt, Human
ucuggcuguuguuagguuccug

SEQ ID NO: 55831 - RNA, 22 nt, Human
ucuggcuguuuuagaugagcuc

SEQ ID NO: 55832 - RNA, 22 nt, Human
ucuggcuucaacuuuacugaaa

SEQ ID NO: 55833 - RNA, 22 nt, Human
ucuggcuucccacucugccggg

SEQ ID NO: 55834 - RNA, 22 nt, Human
ucuggcuucuaugaauguccuu

SEQ ID NO: 55835 - RNA, 22 nt, Human
ucuggcuugagcuucgaccagu

SEQ ID NO: 55836 - RNA, 22 nt, Human
ucuggcuugcuggcuugguccc

SEQ ID NO: 55837 - RNA, 22 nt, Human
ucuggcuuggacacaaucuucc

SEQ ID NO: 55838 - RNA, 22 nt, Human
ucuggcuugucucagggucuga

SEQ ID NO: 55839 - RNA, 22 nt, Human
ucuggcuuucucagcauggcau

SEQ ID NO: 55840 - RNA, 18 nt, Human
ucuggcuuuguuccuugu

SEQ ID NO: 55841 - RNA, 22 nt, Human
ucuggcuuuuauucaguuggca

SEQ ID NO: 55842 - RNA, 22 nt, Human
ucugggaaauggcuacuuguca

SEQ ID NO: 55843 - RNA, 22 nt, Human
ucugggaaccagugcggcuggg

SEQ ID NO: 55844 - RNA, 22 nt, Human
ucugggaaccauugguggggau

SEQ ID NO: 55845 - RNA, 22 nt, Human
ucugggaacuauaucugguggu

SEQ ID NO: 55846 - RNA, 22 nt, Human
ucugggaacugagcuccccuag

SEQ ID NO: 55847 - RNA, 22 nt, Human
ucugggaagccuguaugcagaa

SEQ ID NO: 55848 - RNA, 22 nt, Human
ucugggaagcugguccuguucu

SEQ ID NO: 55849 - RNA, 22 nt, Human
ucugggaaggagccugagaauu

SEQ ID NO: 55850 - RNA, 22 nt, Human
ucugggaaguccucugucaugc

SEQ ID NO: 55851 - RNA, 22 nt, Human
ucugggaauaaaacuagggacu

SEQ ID NO: 55852 - RNA, 22 nt, Human
ucugggaaugaggcuugggcaa

SEQ ID NO: 55853 - RNA, 22 nt, Human
ucugggagagcacguggcugac

SEQ ID NO: 55854 - RNA, 22 nt, Human
ucugggagaguagauaaaggaa

SEQ ID NO: 55855 - RNA, 22 nt, Human
ucugggagcacacgcagugauc

SEQ ID NO: 55856 - RNA, 22 nt, Human
ucugggagccaugccuuggagu

SEQ ID NO: 55857 - RNA, 22 nt, Human
ucugggagccugaaagugaaug

SEQ ID NO: 55858 - RNA, 22 nt, Human
ucugggagggagccucagaauc

SEQ ID NO: 55859 - RNA, 22 nt, Human
ucugggaggggcugccauugcu

SEQ ID NO: 55860 - RNA, 22 nt, Human
ucugggagguaaccaugcugau

SEQ ID NO: 55861 - RNA, 22 nt, Human
ucugggagguggcagggugcau

SEQ ID NO: 55862 - RNA, 22 nt, Human
ucugggaguuagaauacauggg

SEQ ID NO: 55863 - RNA, 22 nt, Human
ucugggauaagaccacagauuu

SEQ ID NO: 55864 - RNA, 22 nt, Human
ucugggauagggccagaacaug

SEQ ID NO: 55865 - RNA, 22 nt, Human
ucugggaugaagccagaaacuu

SEQ ID NO: 55866 - RNA, 22 nt, Human
ucugggcagccucaggccaggg

SEQ ID NO: 55867 - RNA, 22 nt, Human
ucugggccgcugcguuccauga

SEQ ID NO: 55868 - RNA, 22 nt, Human
ucugggccuuggaguggggaga

SEQ ID NO: 55869 - RNA, 22 nt, Human
ucugggcucugggaauuaggga

SEQ ID NO: 55870 - RNA, 22 nt, Human
ucugggcuggcuuuaugcugac

SEQ ID NO: 55871 - RNA, 22 nt, Human
ucugggcugggcuuaggaaccc

SEQ ID NO: 55872 - RNA, 22 nt, Human
ucugggcugugggaauucaaca

SEQ ID NO: 55873 - RNA, 17 nt, Human
ucugggcuucagugguc

SEQ ID NO: 55874 - RNA, 22 nt, Human
ucugggcuuggauuggcucugc

SEQ ID NO: 55875 - RNA, 22 nt, Human
ucugggcuuuaguuuguuaucu

SEQ ID NO: 55876 - RNA, 21 nt, Human
ucugggcuuucuuauaaggca

SEQ ID NO: 55877 - RNA, 21 nt, Human
ucuggggaagacaucuaggau

SEQ ID NO: 55878 - RNA, 22 nt, Human
ucuggggaccauggcaucuaaa

SEQ ID NO: 55879 - RNA, 22 nt, Human
ugagaaggaaacaauggcuuuu

SEQ ID NO: 55880 - RNA, 17 nt, Human
ugagaaguaggcaucau

SEQ ID NO: 55881 - RNA, 22 nt, Human
ugagaauauuugaagauguuag

SEQ ID NO: 55882 - RNA, 22 nt, Human
ucuguguuuugugccuacugcu

SEQ ID NO: 55883 - RNA, 18 nt, Human
ucugaaagcaccggugaa

SEQ ID NO: 55884 - RNA, 18 nt, Human
ucugaaagcccuuuucca

SEQ ID NO: 55885 - RNA, 22 nt, Human
ucugaaagcuagaaaaugcucu

SEQ ID NO: 55886 - RNA, 22 nt, Human
ucugaaagggcuaaauaauuug

SEQ ID NO: 55887 - RNA, 22 nt, Human
ucugaaaugaacucuugaacuu

SEQ ID NO: 55888 - RNA, 22 nt, Human
ucugaaauguucucuuguuuug

SEQ ID NO: 55889 - RNA, 21 nt, Human
ucugaacaacauacgaaucuu

SEQ ID NO: 55890 - RNA, 22 nt, Human
ucugaacaagggcaccuuccag

SEQ ID NO: 55891 - RNA, 19 nt, Human
ucugaacaaugcaguuccc

SEQ ID NO: 55892 - RNA, 22 nt, Human
ucugaacacugagugucaucac

SEQ ID NO: 55893 - RNA, 22 nt, Human
ucugaacauccagcaaugcaca

SEQ ID NO: 55894 - RNA, 22 nt, Human
ucugaacauccuacaacauuuu

SEQ ID NO: 55895 - RNA, 22 nt, Human
ucugaagaacugaguaaacaug

SEQ ID NO: 55896 - RNA, 22 nt, Human
ucugaagacauaugauauggug

SEQ ID NO: 55897 - RNA, 22 nt, Human
ucugaagagcuuuggaaguaug

SEQ ID NO: 55898 - RNA, 22 nt, Human
ucugaagaggcucuugauaaga

SEQ ID NO: 55899 - RNA, 22 nt, Human
ucugaagagucuugcaagaaag

SEQ ID NO: 55900 - RNA, 22 nt, Human
ucugaagauucuuuccacuauu

SEQ ID NO: 55901 - RNA, 22 nt, Human
ucugaagcagaaaauggggaua

SEQ ID NO: 55902 - RNA, 22 nt, Human
ucugaaggugcuagagaaagcu

SEQ ID NO: 55903 - RNA, 22 nt, Human
ucugaagguuacuucugcucag

SEQ ID NO: 55904 - RNA, 22 nt, Human
ucugaauaauguccuuguauca

SEQ ID NO: 55905 - RNA, 22 nt, Human
ucugaaucacagucauucagcu

SEQ ID NO: 55906 - RNA, 22 nt, Human
ucugaauguaucgaauugaggc

SEQ ID NO: 55907 - RNA, 19 nt, Human
ucugaauuauuuauguacc

SEQ ID NO: 55908 - RNA, 22 nt, Human
ucugaauucaguauggucuuuc

SEQ ID NO: 55909 - RNA, 21 nt, Human
ucugacaaucucauuucaaac

SEQ ID NO: 55910 - RNA, 22 nt, Human
ucugacaggucauuuucuauag

SEQ ID NO: 55911 - RNA, 22 nt, Human
ucugacagucacaguggaggau

SEQ ID NO: 55912 - RNA, 22 nt, Human
ucugacagucucuucuuuagcu

SEQ ID NO: 55913 - RNA, 22 nt, Human
ucugaccaggcucagccaaggc

SEQ ID NO: 55914 - RNA, 22 nt, Human
ucugacccacaagcauccugga

SEQ ID NO: 55915 - RNA, 22 nt, Human
ucugacccguggcucugccucc

SEQ ID NO: 55916 - RNA, 22 nt, Human
ucugaccugcaggcacagcaau

SEQ ID NO: 55917 - RNA, 22 nt, Human
ucugacugaaccaauuauuuac

SEQ ID NO: 55918 - RNA, 22 nt, Human
ucugacuuggcgcucuugucuu

SEQ ID NO: 55919 - RNA, 22 nt, Human
ucugagaaaauaggaaacuuga

SEQ ID NO: 55920 - RNA, 17 nt, Human
ucugagaaaggagaauc

SEQ ID NO: 55921 - RNA, 22 nt, Human
ucugagaaauuucuuugugaug

SEQ ID NO: 55922 - RNA, 22 nt, Human
ucugagaagcuagaggacaaag

SEQ ID NO: 55923 - RNA, 22 nt, Human
ucugagaaggaagcucugugua

SEQ ID NO: 55924 - RNA, 23 nt, Human
ucugagaagguuucagccagacu

SEQ ID NO: 55925 - RNA, 22 nt, Human
ucugagacaacuuagcccucga

SEQ ID NO: 55926 - RNA, 20 nt, Human
ucugagaccuuuccacaccc

SEQ ID NO: 55927 - RNA, 22 nt, Human
ucugagacugcagugagccgcu

SEQ ID NO: 55928 - RNA, 22 nt, Human
ucugagagcaggaggagcugcu

SEQ ID NO: 55929 - RNA, 22 nt, Human
ucugagagccacugaacagcaa

SEQ ID NO: 55930 - RNA, 22 nt, Human
ucugagaguagagcugccucuu

SEQ ID NO: 55931 - RNA, 22 nt, Human
ucugagaguccaucuccaagcc

SEQ ID NO: 55932 - RNA, 22 nt, Human
ucugagcacaucacacagcuca

SEQ ID NO: 55933 - RNA, 22 nt, Human
ucugagcagcuuuguuuugugu

SEQ ID NO: 55934 - RNA, 22 nt, Human
ucugagccaaaauaaacagcau

SEQ ID NO: 55935 - RNA, 22 nt, Human
ucugagccguauggcuuggcua

SEQ ID NO: 55936 - RNA, 22 nt, Human
ucugagccuauuucaaauuccu

SEQ ID NO: 55937 - RNA, 23 nt, Human
ucugagcugucuuuucagcagaa

SEQ ID NO: 55938 - RNA, 22 nt, Human
ucugagcuucugccugcugcaa

SEQ ID NO: 55939 - RNA, 22 nt, Human
ucugagcuuuagcugggauuuu

SEQ ID NO: 55940 - RNA, 22 nt, Human
ucugaggaaaaguucuugucac

SEQ ID NO: 55941 - RNA, 22 nt, Human
ucugaggaccuacugaagaguu

SEQ ID NO: 55942 - RNA, 22 nt, Human
ucugaggauagaggcaauagga

SEQ ID NO: 55943 - RNA, 22 nt, Human
ucugaggcauacccaggccccc

SEQ ID NO: 55944 - RNA, 22 nt, Human
ucugaggccccagcccugcaca

SEQ ID NO: 55945 - RNA, 22 nt, Human
ucugaggcccuacccugagccu

SEQ ID NO: 55946 - RNA, 22 nt, Human
ucugaggcccugcaggcagugu

SEQ ID NO: 55947 - RNA, 22 nt, Human
ucugaggccuagagaggggcuu

SEQ ID NO: 55948 - RNA, 22 nt, Human
ucugaggccugaagcagcagag

SEQ ID NO: 55949 - RNA, 22 nt, Human
ucugaggccuuggcagcuaagg

SEQ ID NO: 55950 - RNA, 22 nt, Human
ucugaggcuauguucaggcuaa

SEQ ID NO: 55951 - RNA, 19 nt, Human
ucugaggcuucuccccuug

SEQ ID NO: 55952 - RNA, 22 nt, Human
ucugagggcuguacuaugcacg

SEQ ID NO: 55953 - RNA, 19 nt, Human
ucugaggguccagaugcau

SEQ ID NO: 55954 - RNA, 22 nt, Human
ucugaggguuacuuuauuaggc

SEQ ID NO: 55955 - RNA, 22 nt, Human
ucugaggucacagauuucaaga

SEQ ID NO: 55956 - RNA, 22 nt, Human
ucugagguccugugauuucucu

SEQ ID NO: 55957 - RNA, 22 nt, Human
ucugaggucuaugacuuugcuu

SEQ ID NO: 55958 - RNA, 22 nt, Human
ucugaggucucaugacuugcau

SEQ ID NO: 55959 - RNA, 17 nt, Human
ucugaggugaggaugca

SEQ ID NO: 55960 - RNA, 22 nt, Human
ucugagguggacgauggagccu

SEQ ID NO: 55961 - RNA, 23 nt, Human
ucugagguggcucuugcuuugaa

SEQ ID NO: 55962 - RNA, 22 nt, Human
ucugagguuacugcuuuguaga

SEQ ID NO: 55963 - RNA, 22 nt, Human
ucugagguuauugucugccauu

SEQ ID NO: 55964 - RNA, 22 nt, Human
ucugagguucuguuuucaacug

SEQ ID NO: 55965 - RNA, 22 nt, Human
ucugagucuuggggucccuauu

SEQ ID NO: 55966 - RNA, 22 nt, Human
ucugagugaucagaugcauugc

SEQ ID NO: 55967 - RNA, 22 nt, Human
ucugagugcacuaggaggggca

SEQ ID NO: 55968 - RNA, 22 nt, Human
ucugaguuuaggaccaggcuga

SEQ ID NO: 55969 - RNA, 22 nt, Human
ucugauaacaaccaugucuggc

SEQ ID NO: 55970 - RNA, 22 nt, Human
ucugauaacucuggccccaggc

SEQ ID NO: 55971 - RNA, 22 nt, Human
ucugauaagacagcugauuuga

SEQ ID NO: 55972 - RNA, 22 nt, Human
ucugauaagugguguauacugu

SEQ ID NO: 55973 - RNA, 22 nt, Human
ucugauaaugugcuucgugacc

SEQ ID NO: 55974 - RNA, 22 nt, Human
ucugauauaaaagugacauuca

SEQ ID NO: 55975 - RNA, 22 nt, Human
ucugauaucgcacuaaacucug

SEQ ID NO: 55976 - RNA, 21 nt, Human
ucugaugguagaugagaugug

SEQ ID NO: 55977 - RNA, 22 nt, Human
ucugauguggagacacuguuuu

SEQ ID NO: 55978 - RNA, 22 nt, Human
ucugauguggcagcugcaucua

SEQ ID NO: 55979 - RNA, 21 nt, Human
ucugauguucacacccuguau

SEQ ID NO: 55980 - RNA, 23 nt, Human
ucugauguucucuuaugcuguag

SEQ ID NO: 55981 - RNA, 22 nt, Human
ucugauuacuugaguuauuuag

SEQ ID NO: 55982 - RNA, 22 nt, Human
ucugauucauucaugugcacca

SEQ ID NO: 55983 - RNA, 22 nt, Human
ucugauuucucuuguggaugcu

SEQ ID NO: 55984 - RNA, 22 nt, Human
ucugcaaacuggcucuuacugc

SEQ ID NO: 55985 - RNA, 22 nt, Human
ucugcaaacuuaaguugaaaua

SEQ ID NO: 55986 - RNA, 22 nt, Human
ucugcaacagugcccuguaaau

SEQ ID NO: 55987 - RNA, 22 nt, Human
ucugcaagcuaaggaagcaucu

SEQ ID NO: 55988 - RNA, 22 nt, Human
ucugcaagugacccgggcccag

SEQ ID NO: 55989 - RNA, 22 nt, Human
ucugcacaaaacugucgcagaa

SEQ ID NO: 55990 - RNA, 22 nt, Human
ucugcacacuuuuauugaccuc

SEQ ID NO: 55991 - RNA, 22 nt, Human
uucaacauuugauacaagucag

SEQ ID NO: 55992 - RNA, 22 nt, Human
uucaacauuuuugaguuuaggu

SEQ ID NO: 55993 - RNA, 22 nt, Human
uucaacugggcggaucugagaa

SEQ ID NO: 55994 - RNA, 22 nt, Human
uucaagaaagaguggcuauucc

SEQ ID NO: 55995 - RNA, 22 nt, Human
uucaagaagcccaaagacuagc

SEQ ID NO: 55996 - RNA, 22 nt, Human
ugagcugugaucuaugauaaau

SEQ ID NO: 55997 - RNA, 22 nt, Human
ugagcugugcuacgcccuggga

SEQ ID NO: 55998 - RNA, 22 nt, Human
ugagcuguguccugggggcagu

SEQ ID NO: 55999 - RNA, 22 nt, Human
ugagcuuauucauaaaagugca

SEQ ID NO: 56000 - RNA, 20 nt, Human
ugagcuucagauaucgugca

SEQ ID NO: 56001 - RNA, 22 nt, Human
ugagcuugcagugccagccuug

SEQ ID NO: 56002 - RNA, 22 nt, Human
ugagcuugcuacauagaucaga

SEQ ID NO: 56003 - RNA, 22 nt, Human
ugaggaaauugaggcucacaga

SEQ ID NO: 56004 - RNA, 22 nt, Human
ugaggaacucaccaggcagaga

SEQ ID NO: 56005 - RNA, 22 nt, Human
ugaggaagcaaaggcuugugug

SEQ ID NO: 56006 - RNA, 22 nt, Human
ugaggaagugguuguaugguuu

SEQ ID NO: 56007 - RNA, 22 nt, Human
ugaggaaguugaucucaucagu

SEQ ID NO: 56008 - RNA, 22 nt, Human
ugaggaaguuguuucucuucua

SEQ ID NO: 56009 - RNA, 22 nt, Human
ugaggaaugugacaaaaccaag

SEQ ID NO: 56010 - RNA, 22 nt, Human
ugaggaauguuuugagugccga

SEQ ID NO: 56011 - RNA, 22 nt, Human
ugaggacaugagugggacagag

SEQ ID NO: 56012 - RNA, 22 nt, Human
ugaggacauugagacuggagac

SEQ ID NO: 56013 - RNA, 22 nt, Human
ugaggacauuggucaggacaug

SEQ ID NO: 56014 - RNA, 22 nt, Human
ugaggacauuuaucuuggcgca

SEQ ID NO: 56015 - RNA, 22 nt, Human
ugaggacuuuccauguuaaugu

SEQ ID NO: 56016 - RNA, 22 nt, Human
ugaggagcaggguggcuuacuc

SEQ ID NO: 56017 - RNA, 22 nt, Human
ugaggagcgggcagggaugcag

SEQ ID NO: 56018 - RNA, 22 nt, Human
ugaggaggcccagguuggggcu

SEQ ID NO: 56019 - RNA, 22 nt, Human
ugaggaggucagagucuggcug

SEQ ID NO: 56020 - RNA, 22 nt, Human
ugaggaggugggcacacagagu

SEQ ID NO: 56021 - RNA, 22 nt, Human
ugaggaguguggauggagcuug

SEQ ID NO: 56022 - RNA, 22 nt, Human
ugaggauggcagugugcucagc

SEQ ID NO: 56023 - RNA, 22 nt, Human
ugaggauggucccgaggacacu

SEQ ID NO: 56024 - RNA, 21 nt, Human
ugaggaugugcagcagcagga

SEQ ID NO: 56025 - RNA, 22 nt, Human
ugaggcaaaaguuaugugguag

SEQ ID NO: 56026 - RNA, 22 nt, Human
ugaggcaagcugggcccaugga

SEQ ID NO: 56027 - RNA, 22 nt, Human
ugaggcaaucccuaggguaagg

SEQ ID NO: 56028 - RNA, 22 nt, Human
ugaggcacauccaggccagcuc

SEQ ID NO: 56029 - RNA, 19 nt, Human
ugaggcacuagucuggucc

SEQ ID NO: 56030 - RNA, 22 nt, Human
ugaggcacugggagagcacacu

SEQ ID NO: 56031 - RNA, 22 nt, Human
ugaggcagauauuuauuggguu

SEQ ID NO: 56032 - RNA, 22 nt, Human
ugaggcagcccacuuuccuuag

SEQ ID NO: 56033 - RNA, 22 nt, Human
ugaggcagcuuuuucugugugu

SEQ ID NO: 56034 - RNA, 22 nt, Human
ugaggcaggaauggggaaaagu

SEQ ID NO: 56035 - RNA, 22 nt, Human
ugaggcaggacauggacaacug

SEQ ID NO: 56036 - RNA, 22 nt, Human
ugaggcaggacuugcauaaagu

SEQ ID NO: 56037 - RNA, 22 nt, Human
ugaggcaggagaauggcgggaa

SEQ ID NO: 56038 - RNA, 22 nt, Human
ugaggcaggaggauugcaggau

SEQ ID NO: 56039 - RNA, 22 nt, Human
ugaggcaggaguuaaugugcuc

SEQ ID NO: 56040 - RNA, 22 nt, Human
ugaggcaggaguucaggcugcg

SEQ ID NO: 56041 - RNA, 22 nt, Human
ugaggcagguaagcaaguuuug

SEQ ID NO: 56042 - RNA, 22 nt, Human
ugaggcagguggauuacaaggu

SEQ ID NO: 56043 - RNA, 22 nt, Human
ugaggcagugauguuuaagcac

SEQ ID NO: 56044 - RNA, 22 nt, Human
ugaggcaguugagcuuccugag

SEQ ID NO: 56045 - RNA, 22 nt, Human
ugaggcauuaaagggaggucaa

SEQ ID NO: 56046 - RNA, 22 nt, Human
ugaggccaaaaugacucaaaug

SEQ ID NO: 56047 - RNA, 19 nt, Human
ugaggccaaggucacagau

SEQ ID NO: 56048 - RNA, 22 nt, Human
ugaggccagccacagccacccu

SEQ ID NO: 56049 - RNA, 22 nt, Human
ugaggccaggacccccagcagg

SEQ ID NO: 56050 - RNA, 22 nt, Human
ugaggccaggaucccaggcucu

SEQ ID NO: 56051 - RNA, 22 nt, Human
ugaggccaugcccgugccggcc

SEQ ID NO: 56052 - RNA, 17 nt, Human
ugaggccauggcaccau

SEQ ID NO: 56053 - RNA, 20 nt, Human
ugaggcccagcagagucggg

SEQ ID NO: 56054 - RNA, 22 nt, Human
ugaggccccgaagcugagguuu

SEQ ID NO: 56055 - RNA, 22 nt, Human
ugaggcccggguggaggaaugc

SEQ ID NO: 56056 - RNA, 21 nt, Human
ugaggccucuccugggcuggc

SEQ ID NO: 56057 - RNA, 18 nt, Human
ugaggccucugcugggcc

SEQ ID NO: 56058 - RNA, 22 nt, Human
ugaggccucuugguauggugug

SEQ ID NO: 56059 - RNA, 17 nt, Human
ugaggccugcaucagug

SEQ ID NO: 56060 - RNA, 22 nt, Human
ugaggccuggagggaggaguuu

SEQ ID NO: 56061 - RNA, 22 nt, Human
ugaggcuaaaggugaccagauu

SEQ ID NO: 56062 - RNA, 22 nt, Human
ugaggcucaagaaagauuuguu

SEQ ID NO: 56063 - RNA, 22 nt, Human
ugaggcucagagcaccugcucc

SEQ ID NO: 56064 - RNA, 22 nt, Human
ugaggcucagugagcccugcag

SEQ ID NO: 56065 - RNA, 22 nt, Human
ugaggcucuuccuccccugcuc

SEQ ID NO: 56066 - RNA, 18 nt, Human
ugaggcugaauauggggc

SEQ ID NO: 56067 - RNA, 23 nt, Human
ugaggcugauugauuuuugcuca

SEQ ID NO: 56068 - RNA, 22 nt, Human
ugaggcuguucuaccagggcca

SEQ ID NO: 56069 - RNA, 21 nt, Human
ugaggcuguuguaccagggag

SEQ ID NO: 56070 - RNA, 22 nt, Human
ugaggcuuagagaauuaaguga

SEQ ID NO: 56071 - RNA, 22 nt, Human
ugaggcuuccaacaugugagaa

SEQ ID NO: 56072 - RNA, 23 nt, Human
ugagggacaugguggcuucugag

SEQ ID NO: 56073 - RNA, 19 nt, Human
ugagggacauugggagcag

SEQ ID NO: 56074 - RNA, 22 nt, Human
ugagggacucccggcccugcca

SEQ ID NO: 56075 - RNA, 22 nt, Human
ugagggagcugaccuuucugug

SEQ ID NO: 56076 - RNA, 22 nt, Human
ugagggaggccuccaucugcca

SEQ ID NO: 56077 - RNA, 22 nt, Human
ugagggcugacaggaggacagc

SEQ ID NO: 56078 - RNA, 22 nt, Human
ugaggggagacagaguggacuc

SEQ ID NO: 56079 - RNA, 22 nt, Human
ugaggggagcccgcccuggacg

SEQ ID NO: 56080 - RNA, 22 nt, Human
ugaggggagcuagcaugccuug

SEQ ID NO: 56081 - RNA, 22 nt, Human
ugaggggguuaauuaggagagu

SEQ ID NO: 56082 - RNA, 22 nt, Human
ugagggugcauuuagcauguag

SEQ ID NO: 56083 - RNA, 22 nt, Human
ugaggguggccuuguguggacu

SEQ ID NO: 56084 - RNA, 22 nt, Human
ugagggugugcggcccagacag

SEQ ID NO: 56085 - RNA, 22 nt, Human
ugagguaauaaguguuuguuuu

SEQ ID NO: 56086 - RNA, 22 nt, Human
ugagguagaaaaagcuuguagu

SEQ ID NO: 56087 - RNA, 22 nt, Human
ugagguagcugcuauuuguagu

SEQ ID NO: 56088 - RNA, 22 nt, Human
ugagguagcuguuuagaaagac

SEQ ID NO: 56089 - RNA, 22 nt, Human
ugagguaggaauuuguauuggg

SEQ ID NO: 56090 - RNA, 22 nt, Human
ugagguaggauaagacaaugag

SEQ ID NO: 56091 - RNA, 22 nt, Human
ugagguagguaccauuaucacu

SEQ ID NO: 56092 - RNA, 22 nt, Human
ugagguaggugguaagagauac

SEQ ID NO: 56093 - RNA, 22 nt, Human
ugagguagguggugaaaaauga

SEQ ID NO: 56094 - RNA, 22 nt, Human
ugagguaggugguggcagccau

SEQ ID NO: 56095 - RNA, 22 nt, Human
ugagguagugcuugucauguuu

SEQ ID NO: 56096 - RNA, 22 nt, Human
ugagguaugagguucuaugauc

SEQ ID NO: 56097 - RNA, 22 nt, Human
ugaggucccagggguagugugc

SEQ ID NO: 56098 - RNA, 22 nt, Human
ugagguggaaggauccuuugaa

SEQ ID NO: 56099 - RNA, 22 nt, Human
ugagguggcuagggaggcacuc

SEQ ID NO: 56100 - RNA, 22 nt, Human
ugauguuauuagauacaaacca

SEQ ID NO: 56101 - RNA, 22 nt, Human
ugauuaacguuuuaggcauacu

SEQ ID NO: 56102 - RNA, 22 nt, Human
ugauuaacugucuauuaaucau

SEQ ID NO: 56103 - RNA, 22 nt, Human
ugauuaaguucaaaauauagaa

SEQ ID NO: 56104 - RNA, 22 nt, Human
ugauuaauaucaccaccauugg

SEQ ID NO: 56105 - RNA, 22 nt, Human
ugauuacaaaagauuguuugaa

SEQ ID NO: 56106 - RNA, 22 nt, Human
ugauuacaauugucuuagauuu

SEQ ID NO: 56107 - RNA, 22 nt, Human
ugauuacacagcaguaauuuca

SEQ ID NO: 56108 - RNA, 22 nt, Human
ugauuacauugguaauguuuau

SEQ ID NO: 56109 - RNA, 22 nt, Human
ugauuagacaaaggaaucaugc

SEQ ID NO: 56110 - RNA, 22 nt, Human
ugauuagauaguaagugacuaa

SEQ ID NO: 56111 - RNA, 22 nt, Human
ucuguuaaccuggucuuggcuu

SEQ ID NO: 56112 - RNA, 22 nt, Human
ucuguuaucucaagucacaaga

SEQ ID NO: 56113 - RNA, 22 nt, Human
ucuguuauucugcucaguauag

SEQ ID NO: 56114 - RNA, 20 nt, Human
ucuguuauugcauguacaua

SEQ ID NO: 56115 - RNA, 22 nt, Human
ucuguucaagacugaggugaca

SEQ ID NO: 56116 - RNA, 23 nt, Human
ucuguucaaggcuuucuccuuga

SEQ ID NO: 56117 - RNA, 19 nt, Human
ucuguucacauuguuucgc

SEQ ID NO: 56118 - RNA, 22 nt, Human
ucuguucacugagcaauggcaa

SEQ ID NO: 56119 - RNA, 22 nt, Human
ucuguucagaagaggugaaagu

SEQ ID NO: 56120 - RNA, 22 nt, Human
ucuguucagacacuuuacaugu

SEQ ID NO: 56121 - RNA, 22 nt, Human
ucuguucaguugauuagacaga

SEQ ID NO: 56122 - RNA, 22 nt, Human
ucuguuccaguagaaaggugca

SEQ ID NO: 56123 - RNA, 22 nt, Human
ucuguucuucuccacuguaugu

SEQ ID NO: 56124 - RNA, 22 nt, Human
ucuguucuugcuuuucuccaac

SEQ ID NO: 56125 - RNA, 22 nt, Human
ucuguucuuuccaacaagacag

SEQ ID NO: 56126 - RNA, 22 nt, Human
ucuguuggacauucaucugcag

SEQ ID NO: 56127 - RNA, 22 nt, Human
ucuguuuauucaauuucuauau

SEQ ID NO: 56128 - RNA, 17 nt, Human
ucuguuucuccuuucuu

SEQ ID NO: 56129 - RNA, 22 nt, Human
ucuguuugcuggugcauggguu

SEQ ID NO: 56130 - RNA, 22 nt, Human
ucuuaaaccacaaaauucagag

SEQ ID NO: 56131 - RNA, 22 nt, Human
ucuuaaacuuugcuguaauucu

SEQ ID NO: 56132 - RNA, 22 nt, Human
ucuuaaaugacugauaagagga

SEQ ID NO: 56133 - RNA, 22 nt, Human
ucuuaacagugcuacagagcag

SEQ ID NO: 56134 - RNA, 22 nt, Human
ucuuaacauauuauuuuagcac

SEQ ID NO: 56135 - RNA, 22 nt, Human
ucuuaacugacaguuuaauggg

SEQ ID NO: 56136 - RNA, 22 nt, Human
ucuuaagaaagugacaaauagg

SEQ ID NO: 56137 - RNA, 22 nt, Human
ucuuaagcagagaagaaguuga

SEQ ID NO: 56138 - RNA, 20 nt, Human
ucuuacaaucguuacaucca

SEQ ID NO: 56139 - RNA, 22 nt, Human
ucuuacaccauucaaauauuuu

SEQ ID NO: 56140 - RNA, 22 nt, Human
ucuuacagaaaauagauaacau

SEQ ID NO: 56141 - RNA, 22 nt, Human
ucuuacagccacucugugaagc

SEQ ID NO: 56142 - RNA, 22 nt, Human
ucuuagaaauuccccaguggcu

SEQ ID NO: 56143 - RNA, 22 nt, Human
ucuuagaaugucaacugauguu

SEQ ID NO: 56144 - RNA, 22 nt, Human
ucuuagcaaauacuacuuagaa

SEQ ID NO: 56145 - RNA, 22 nt, Human
ucuuagcagacuuggcuacugu

SEQ ID NO: 56146 - RNA, 22 nt, Human
ucuuagguguaugucauuaggg

SEQ ID NO: 56147 - RNA, 16 nt, Human
ucuuaguuguguggua

SEQ ID NO: 56148 - RNA, 22 nt, Human
ucuuauaaucucuauuuuaaug

SEQ ID NO: 56149 - RNA, 20 nt, Human
ucuuauacagaaaacauuuu

SEQ ID NO: 56150 - RNA, 21 nt, Human
ucuuauacagcaauagaucug

SEQ ID NO: 56151 - RNA, 22 nt, Human
ucuuauagcucaaaggaagagu

SEQ ID NO: 56152 - RNA, 22 nt, Human
ucuuauugucuagauugagaug

SEQ ID NO: 56153 - RNA, 20 nt, Human
ucuuauugucuugaggaguu

SEQ ID NO: 56154 - RNA, 22 nt, Human
ucuuauuuagagaggacuagag

SEQ ID NO: 56155 - RNA, 22 nt, Human
ucuuauuuuguuagaugcugua

SEQ ID NO: 56156 - RNA, 22 nt, Human
ucuucaaaaacugcaccuugcu

SEQ ID NO: 56157 - RNA, 22 nt, Human
ucuucaaaaauacagguuuuca

SEQ ID NO: 56158 - RNA, 22 nt, Human
ucuucaaacccuggcucuuccu

SEQ ID NO: 56159 - RNA, 22 nt, Human
ucuucaauauguguuuaauauu

SEQ ID NO: 56160 - RNA, 22 nt, Human
ucuucacaaagcuguuguuaaa

SEQ ID NO: 56161 - RNA, 22 nt, Human
ucuucacauuuuaagaaguucu

SEQ ID NO: 56162 - RNA, 22 nt, Human
ucuucacugaugucucucaaau

SEQ ID NO: 56163 - RNA, 22 nt, Human
ucuucagaagaucacaucagug

SEQ ID NO: 56164 - RNA, 22 nt, Human
ucuucagacccuuagcugugau

SEQ ID NO: 56165 - RNA, 22 nt, Human
ucuucagaggagcugaauauau

SEQ ID NO: 56166 - RNA, 22 nt, Human
ucuucagagugaaagucuguga

SEQ ID NO: 56167 - RNA, 22 nt, Human
ucuucagcucugaggcucuggc

SEQ ID NO: 56168 - RNA, 22 nt, Human
ucuucaggguaugggaaaggga

SEQ ID NO: 56169 - RNA, 22 nt, Human
ucuucagguuaacuugucuuuu

SEQ ID NO: 56170 - RNA, 22 nt, Human
ucuucauauauaaaguggaaua

SEQ ID NO: 56171 - RNA, 22 nt, Human
ucuucaucucagauuaacagga

SEQ ID NO: 56172 - RNA, 22 nt, Human
ucuucaugaaugaaucuuugac

SEQ ID NO: 56173 - RNA, 22 nt, Human
ucuucaugauacccuaagccac

SEQ ID NO: 56174 - RNA, 22 nt, Human
ucuucauguugcuguagggaga

SEQ ID NO: 56175 - RNA, 22 nt, Human
ucuucauguugcuuauucuggg

SEQ ID NO: 56176 - RNA, 22 nt, Human
ucuuccaaaauuagucucaguu

SEQ ID NO: 56177 - RNA, 18 nt, Human
ucuuccaacacugacacc

SEQ ID NO: 56178 - RNA, 22 nt, Human
ucuuccaaggugcagaucuucu

SEQ ID NO: 56179 - RNA, 22 nt, Human
ucuuccaaugguuucuagauuu

SEQ ID NO: 56180 - RNA, 22 nt, Human
ucuuccagaaucucagagggcu

SEQ ID NO: 56181 - RNA, 22 nt, Human
ucuuccagcaaugugaaaucac

SEQ ID NO: 56182 - RNA, 22 nt, Human
ucuuccagccaauagcguccuu

SEQ ID NO: 56183 - RNA, 22 nt, Human
ucuuccagcuccccacgguguc

SEQ ID NO: 56184 - RNA, 22 nt, Human
ucuuccaggaccuggggcucca

SEQ ID NO: 56185 - RNA, 22 nt, Human
ucuuccaggagggcauuucuuu

SEQ ID NO: 56186 - RNA, 22 nt, Human
ucuuccaggagggugggcaaac

SEQ ID NO: 56187 - RNA, 22 nt, Human
ucuuccaguguagacaucugcc

SEQ ID NO: 56188 - RNA, 22 nt, Human
ucuucccacugcccaugggcag

SEQ ID NO: 56189 - RNA, 22 nt, Human
ucuucccccgugcuccagugca

SEQ ID NO: 56190 - RNA, 21 nt, Human
ucuucccucaggauguccugc

SEQ ID NO: 56191 - RNA, 22 nt, Human
ucuuccucaauguaacaacccc

SEQ ID NO: 56192 - RNA, 22 nt, Human
ucuuccugcuuggugugucugg

SEQ ID NO: 56193 - RNA, 22 nt, Human
ucuuccuggauggggguugaug

SEQ ID NO: 56194 - RNA, 22 nt, Human
ucuuccuggcauugaugcugca

SEQ ID NO: 56195 - RNA, 22 nt, Human
ucuuccuucgcccuugcuguuu

SEQ ID NO: 56196 - RNA, 22 nt, Human
ucuuccuugcuccuugucacuu

SEQ ID NO: 56197 - RNA, 22 nt, Human
ucuuccuuguaagggcuuuaga

SEQ ID NO: 56198 - RNA, 22 nt, Human
ucuuccuuucauucauguguua

SEQ ID NO: 56199 - RNA, 22 nt, Human
ucuucuaugaaucauuggaaca

SEQ ID NO: 56200 - RNA, 22 nt, Human
ucuucucaaaaaauguaggugg

SEQ ID NO: 56201 - RNA, 22 nt, Human
ucuucuccauaaucaacacucu

SEQ ID NO: 56202 - RNA, 22 nt, Human
ucuucucuguggccugguggug

SEQ ID NO: 56203 - RNA, 22 nt, Human
ucuucuguauuguuaacucagg

SEQ ID NO: 56204 - RNA, 22 nt, Human
ucuucugugagaauucaagcaa

SEQ ID NO: 56205 - RNA, 22 nt, Human
ucuucugugaucuauguguuuu

SEQ ID NO: 56206 - RNA, 20 nt, Human
ucuucuguugccuuguucug

SEQ ID NO: 56207 - RNA, 22 nt, Human
ucuucuucccaucccucaaaug

SEQ ID NO: 56208 - RNA, 22 nt, Human
ucuucuuuaugucauaugccag

SEQ ID NO: 56209 - RNA, 22 nt, Human
ugcaauuucaggcauauauugu

SEQ ID NO: 56210 - RNA, 22 nt, Human
ugcaauuuucagaaauuccaaa

SEQ ID NO: 56211 - RNA, 22 nt, Human
ugcaauuuuuaucaauucagca

SEQ ID NO: 56212 - RNA, 22 nt, Human
ugcaauuuuuuagcacaaggag

SEQ ID NO: 56213 - RNA, 22 nt, Human
ugcacaaacacagagaauagau

SEQ ID NO: 56214 - RNA, 21 nt, Human
ugcacaaacuuucuguggcuu

SEQ ID NO: 56215 - RNA, 22 nt, Human
ugcacaagucagaguaacauuu

SEQ ID NO: 56216 - RNA, 22 nt, Human
ugcacacaaaugugaacgugcc

SEQ ID NO: 56217 - RNA, 22 nt, Human
ugcacacaaguuggagaaugaa

SEQ ID NO: 56218 - RNA, 22 nt, Human
ugcacacacgcggcacaucugu

SEQ ID NO: 56219 - RNA, 22 nt, Human
ugcacacagccagugaguggca

SEQ ID NO: 56220 - RNA, 22 nt, Human
ugcacacaguggacaagucuug

SEQ ID NO: 56221 - RNA, 22 nt, Human
ugcacacauuaaggauacacag

SEQ ID NO: 56222 - RNA, 22 nt, Human
ugcacagagcuggacuccgcgg

SEQ ID NO: 56223 - RNA, 22 nt, Human
ugcacagauagugauagauagc

SEQ ID NO: 56224 - RNA, 22 nt, Human
uucaagacuccaagaaauuagu

SEQ ID NO: 56225 - RNA, 22 nt, Human
uucaagaguccaggagagucug

SEQ ID NO: 56226 - RNA, 22 nt, Human
uucaagaugcacaguggcauuc

SEQ ID NO: 56227 - RNA, 22 nt, Human
uucaagauggcaccagugagug

SEQ ID NO: 56228 - RNA, 22 nt, Human
uucaagcaccaaauuaguaggc

SEQ ID NO: 56229 - RNA, 22 nt, Human
uucaagcagagauauuucaaga

SEQ ID NO: 56230 - RNA, 22 nt, Human
uucaaggaaaccagcauuuggu

SEQ ID NO: 56231 - RNA, 22 nt, Human
uucaagguucagggagaaauug

SEQ ID NO: 56232 - RNA, 19 nt, Human
uucaaguaaacuauuauua

SEQ ID NO: 56233 - RNA, 22 nt, Human
uucaaguaaaucacuuuuuguc

SEQ ID NO: 56234 - RNA, 22 nt, Human
uucaaguacauuguguuuuccu

SEQ ID NO: 56235 - RNA, 22 nt, Human
uucaaguacuguagauuucagg

SEQ ID NO: 56236 - RNA, 22 nt, Human
uucaaguagaaaguauugauga

SEQ ID NO: 56237 - RNA, 22 nt, Human
uucaaguaggccagcugcaugg

SEQ ID NO: 56238 - RNA, 22 nt, Human
uucaagucauguuaacugcuuc

SEQ ID NO: 56239 - RNA, 22 nt, Human
uucaaguccuuuggaaggccug

SEQ ID NO: 56240 - RNA, 22 nt, Human
uucaaguuaccuuuaaacagcu

SEQ ID NO: 56241 - RNA, 22 nt, Human
uucaaguucauguguagucagu

SEQ ID NO: 56242 - RNA, 22 nt, Human
uucaaguuuguauuucuguauu

SEQ ID NO: 56243 - RNA, 22 nt, Human
uucaauagaaaugacauucuuu

SEQ ID NO: 56244 - RNA, 22 nt, Human
uucaauagcauacuuuugcucu

SEQ ID NO: 56245 - RNA, 22 nt, Human
uucaaugagcccggggccauag

SEQ ID NO: 56246 - RNA, 22 nt, Human
uucaauucaauucuaaauauau

SEQ ID NO: 56247 - RNA, 22 nt, Human
uucaauucuaaacuaauauucu

SEQ ID NO: 56248 - RNA, 22 nt, Human
uucaauucugcucugaucuuag

SEQ ID NO: 56249 - RNA, 22 nt, Human
uucaauuucauaauaucuagcu

SEQ ID NO: 56250 - RNA, 18 nt, Human
uucacaagggcuugguuu

SEQ ID NO: 56251 - RNA, 22 nt, Human
uucacaagucuggaauaugcua

SEQ ID NO: 56252 - RNA, 22 nt, Human
uucacaauaauguccauccucu

SEQ ID NO: 56253 - RNA, 22 nt, Human
uucacaaucuggcuuagcauug

SEQ ID NO: 56254 - RNA, 22 nt, Human
uucacaaugccagcaaccacuu

SEQ ID NO: 56255 - RNA, 22 nt, Human
uucacaauggcaaaccauuaaa

SEQ ID NO: 56256 - RNA, 22 nt, Human
uucacacucucacucccugacc

SEQ ID NO: 56257 - RNA, 22 nt, Human
uucacacugucccggguggaaa

SEQ ID NO: 56258 - RNA, 22 nt, Human
uucacagaccaggaggcuguga

SEQ ID NO: 56259 - RNA, 20 nt, Human
uucacagaggacucagguca

SEQ ID NO: 56260 - RNA, 22 nt, Human
uucacaggauauaugugcaggg

SEQ ID NO: 56261 - RNA, 22 nt, Human
uucacaguaaguaggauaguug

SEQ ID NO: 56262 - RNA, 22 nt, Human
uucacaguggcuuaggcuaugg

SEQ ID NO: 56263 - RNA, 22 nt, Human
uucacagugugaucuaugggca

SEQ ID NO: 56264 - RNA, 22 nt, Human
uucacauaaaagcuccaaagaa

SEQ ID NO: 56265 - RNA, 17 nt, Human
uucacauccgagaacaa

SEQ ID NO: 56266 - RNA, 22 nt, Human
uucacaucuauaacuuagauaa

SEQ ID NO: 56267 - RNA, 22 nt, Human
uucacauguuggacauagagga

SEQ ID NO: 56268 - RNA, 22 nt, Human
uucacauuacaaggccauauuu

SEQ ID NO: 56269 - RNA, 22 nt, Human
uucacauuccgcggcuauuuuc

SEQ ID NO: 56270 - RNA, 22 nt, Human
uucacauugguucuugauagcu

SEQ ID NO: 56271 - RNA, 20 nt, Human
uucacauuucuguagugauu

SEQ ID NO: 56272 - RNA, 22 nt, Human
uucacauuugaaaggaaagaua

SEQ ID NO: 56273 - RNA, 22 nt, Human
uucaccagagguuagaauauuu

SEQ ID NO: 56274 - RNA, 22 nt, Human
uucaccagauuuuguauaguca

SEQ ID NO: 56275 - RNA, 18 nt, Human
uucaccagugugaugggu

SEQ ID NO: 56276 - RNA, 22 nt, Human
uucaccaugggaugacaacagu

SEQ ID NO: 56277 - RNA, 22 nt, Human
uucacccacuagagaacucagg

SEQ ID NO: 56278 - RNA, 22 nt, Human
uucacccuggaccagaaauugg

SEQ ID NO: 56279 - RNA, 22 nt, Human
uucaccugugacagguagaguu

SEQ ID NO: 56280 - RNA, 22 nt, Human
uucaccuguguuuuguggcuga

SEQ ID NO: 56281 - RNA, 19 nt, Human
uucacuaggucacaagguc

SEQ ID NO: 56282 - RNA, 22 nt, Human
uucacuauaaaguuucaacuuu

SEQ ID NO: 56283 - RNA, 22 nt, Human
uucacucuucggcaucucugua

SEQ ID NO: 56284 - RNA, 22 nt, Human
uucacugaauuaauuuccuucu

SEQ ID NO: 56285 - RNA, 22 nt, Human
uucacugccaacuaacauggaa

SEQ ID NO: 56286 - RNA, 22 nt, Human
uucacugcugggugauuggguu

SEQ ID NO: 56287 - RNA, 22 nt, Human
uucacuguaugagagggcuuga

SEQ ID NO: 56288 - RNA, 22 nt, Human
uucacugugauggugcagaggc

SEQ ID NO: 56289 - RNA, 22 nt, Human
uucacuuauagggauguuauug

SEQ ID NO: 56290 - RNA, 22 nt, Human
uucagaaaaaacuucaauaagu

SEQ ID NO: 56291 - RNA, 22 nt, Human
uucagaaacccauugggucucu

SEQ ID NO: 56292 - RNA, 22 nt, Human
uucagaaaggauaauuggaagg

SEQ ID NO: 56293 - RNA, 22 nt, Human
uucagaaagugaaucuuguuau

SEQ ID NO: 56294 - RNA, 20 nt, Human
uucagaaauaaggaaugagg

SEQ ID NO: 56295 - RNA, 22 nt, Human
uucagaaaucgaguuucauguc

SEQ ID NO: 56296 - RNA, 22 nt, Human
uucagaacaauaugaacagaac

SEQ ID NO: 56297 - RNA, 22 nt, Human
uucagaaguuuucaaaacuaag

SEQ ID NO: 56298 - RNA, 22 nt, Human
uucagaauauuauuuuaaaggc

SEQ ID NO: 56299 - RNA, 22 nt, Human
uucagaaugagaauggaugggu

SEQ ID NO: 56300 - RNA, 22 nt, Human
uucagaaugauuucagcgagca

SEQ ID NO: 56301 - RNA, 22 nt, Human
uucagaaugugaccuuauuugg

SEQ ID NO: 56302 - RNA, 19 nt, Human
uucagaauugggaggugau

SEQ ID NO: 56303 - RNA, 22 nt, Human
uucagacuggcuacauuuucau

SEQ ID NO: 56304 - RNA, 22 nt, Human
uucagacuuaaaagaucccagc

SEQ ID NO: 56305 - RNA, 22 nt, Human
uucagacuuuguggggcccucc

SEQ ID NO: 56306 - RNA, 22 nt, Human
uucagagagaaaccagugggaa

SEQ ID NO: 56307 - RNA, 22 nt, Human
uucagagcagauauugaagggu

SEQ ID NO: 56308 - RNA, 22 nt, Human
uucagagccagcaacacuaggc

SEQ ID NO: 56309 - RNA, 16 nt, Human
uucagagcggcucaua

SEQ ID NO: 56310 - RNA, 22 nt, Human
uucagaggcuguaugacuagau

SEQ ID NO: 56311 - RNA, 22 nt, Human
uucagagggacauucaagggaa

SEQ ID NO: 56312 - RNA, 22 nt, Human
uucagagguagagaggaucuug

SEQ ID NO: 56313 - RNA, 20 nt, Human
uucagaggugaaguuguggu

SEQ ID NO: 56314 - RNA, 22 nt, Human
uucagaggugggcugagaggau

SEQ ID NO: 56315 - RNA, 22 nt, Human
uucagagguuagagcaguggga

SEQ ID NO: 56316 - RNA, 22 nt, Human
uucagcaaacacgaugcuuguu

SEQ ID NO: 56317 - RNA, 22 nt, Human
uucagcaaauggacuguucagg

SEQ ID NO: 56318 - RNA, 22 nt, Human
ucuugcagaagaagcugccaag

SEQ ID NO: 56319 - RNA, 22 nt, Human
ucuugcagagggcccuucugcu

SEQ ID NO: 56320 - RNA, 22 nt, Human
ucuugcaggcaugaaaggacuc

SEQ ID NO: 56321 - RNA, 22 nt, Human
ucuugcaggcggcucagcaacc

SEQ ID NO: 56322 - RNA, 22 nt, Human
ucuugccucuuccccuuuccau

SEQ ID NO: 56323 - RNA, 22 nt, Human
ucuugcuagaaucauuuggaga

SEQ ID NO: 56324 - RNA, 22 nt, Human
ucuugcuaggagcuauggaaga

SEQ ID NO: 56325 - RNA, 22 nt, Human
ucuugcugaaaacaaaucucuu

SEQ ID NO: 56326 - RNA, 22 nt, Human
ucuugcuguguauugcaucucc

SEQ ID NO: 56327 - RNA, 22 nt, Human
ucuugcuguuacagaauuaaca

SEQ ID NO: 56328 - RNA, 20 nt, Human
ucuuggaaaaaguucagaau

SEQ ID NO: 56329 - RNA, 22 nt, Human
ucuuggaacccuaugugauuuc

SEQ ID NO: 56330 - RNA, 22 nt, Human
ucuuggaauaccccgaagguca

SEQ ID NO: 56331 - RNA, 22 nt, Human
ucuuggacucaaaauugccuua

SEQ ID NO: 56332 - RNA, 22 nt, Human
ucuuggaggagaguaaguaccu

SEQ ID NO: 56333 - RNA, 22 nt, Human
ucuuggaguauugggccucagg

SEQ ID NO: 56334 - RNA, 22 nt, Human
ucuuggcaaguggcagauucuu

SEQ ID NO: 56335 - RNA, 22 nt, Human
ucuuggccacuaccaccuggag

SEQ ID NO: 56336 - RNA, 22 nt, Human
ucuuggccccaccugugccagc

SEQ ID NO: 56337 - RNA, 22 nt, Human
ucuuggcuacuuaggaggauuc

SEQ ID NO: 56338 - RNA, 22 nt, Human
ucuuggcucccuuguaggcccu

SEQ ID NO: 56339 - RNA, 21 nt, Human
ucuuggcucugccacuuauua

SEQ ID NO: 56340 - RNA, 22 nt, Human
ucuuggcugcguccuggcugug

SEQ ID NO: 56341 - RNA, 22 nt, Human
ucuuggcuguaccauugacuag

SEQ ID NO: 56342 - RNA, 22 nt, Human
ucuuggcuucuguauuuccugu

SEQ ID NO: 56343 - RNA, 22 nt, Human
ucuugggaaauguuugcgagcu

SEQ ID NO: 56344 - RNA, 22 nt, Human
ucuuggucuuucauccuucaac

SEQ ID NO: 56345 - RNA, 22 nt, Human
ucuuguauguguauuuugcugu

SEQ ID NO: 56346 - RNA, 21 nt, Human
ucuuguccuugcucucccacu

SEQ ID NO: 56347 - RNA, 22 nt, Human
ucuugugugguggaagauaugg

SEQ ID NO: 56348 - RNA, 22 nt, Human
ucuuguuucuguauauaaugac

SEQ ID NO: 56349 - RNA, 22 nt, Human
ucuuuaacaggaauuauuacag

SEQ ID NO: 56350 - RNA, 22 nt, Human
ucuuuaagaguaauuauuuugg

SEQ ID NO: 56351 - RNA, 22 nt, Human
ucuuuaagaguucauuugcaug

SEQ ID NO: 56352 - RNA, 22 nt, Human
ucuuuaaggugauuucugcuac

SEQ ID NO: 56353 - RNA, 18 nt, Human
ucuuuaaguugucagagu

SEQ ID NO: 56354 - RNA, 22 nt, Human
ucuuuaauauaaaggaaugaau

SEQ ID NO: 56355 - RNA, 22 nt, Human
ucuuuaaucauaaccaagaugg

SEQ ID NO: 56356 - RNA, 22 nt, Human
ugcaggcucugguuuauagugc

SEQ ID NO: 56357 - RNA, 22 nt, Human
ugcaggcugcaccccugcccug

SEQ ID NO: 56358 - RNA, 22 nt, Human
ugcaggcugccuucacagagcc

SEQ ID NO: 56359 - RNA, 22 nt, Human
ugcaggcugggaagagggacaa

SEQ ID NO: 56360 - RNA, 22 nt, Human
ugcaggcuguaaucugaggcua

SEQ ID NO: 56361 - RNA, 17 nt, Human
ugcaggcuguuauagcc

SEQ ID NO: 56362 - RNA, 21 nt, Human
ugcaggcuguuuaagaggcaa

SEQ ID NO: 56363 - RNA, 22 nt, Human
ugcaggcuuuagccccauggcu

SEQ ID NO: 56364 - RNA, 22 nt, Human
ugcagggaaaacccaggaugcu

SEQ ID NO: 56365 - RNA, 22 nt, Human
ugcagggaauccagucuagggu

SEQ ID NO: 56366 - RNA, 22 nt, Human
ugcagggaaugcuugcagcaug

SEQ ID NO: 56367 - RNA, 22 nt, Human
ugcagggagcucuggggugcag

SEQ ID NO: 56368 - RNA, 23 nt, Human
ugcagggcaaguuagagacccca

SEQ ID NO: 56369 - RNA, 22 nt, Human
ugcagggcaguggagguugagu

SEQ ID NO: 56370 - RNA, 22 nt, Human
ugcagggcauaggguccaguuu

SEQ ID NO: 56371 - RNA, 22 nt, Human
ugcagggcaucuuugaagugug

SEQ ID NO: 56372 - RNA, 20 nt, Human
ugcagggccuaaaaagggaa

SEQ ID NO: 56373 - RNA, 22 nt, Human
ugcagggccuugggaugugucc

SEQ ID NO: 56374 - RNA, 22 nt, Human
ugcagggccuuguugaugugcu

SEQ ID NO: 56375 - RNA, 22 nt, Human
ugcagggcuacaggacuacaac

SEQ ID NO: 56376 - RNA, 22 nt, Human
ugcagggcuauaacuccauucu

SEQ ID NO: 56377 - RNA, 22 nt, Human
ugcagggugcacaguggggugc

SEQ ID NO: 56378 - RNA, 23 nt, Human
ugcagguagggcccagcagucuu

SEQ ID NO: 56379 - RNA, 22 nt, Human
ugcaggucaaucuucagguucc

SEQ ID NO: 56380 - RNA, 22 nt, Human
ugcaggucucugcaaggccuau

SEQ ID NO: 56381 - RNA, 22 nt, Human
ugcaggugcguuuucaagccuc

SEQ ID NO: 56382 - RNA, 22 nt, Human
ugcagguggauaucucaucaga

SEQ ID NO: 56383 - RNA, 23 nt, Human
ugcaggugugcagagggcucuug

SEQ ID NO: 56384 - RNA, 22 nt, Human
ugcaggugugggcaggggagca

SEQ ID NO: 56385 - RNA, 22 nt, Human
ugcaggugugugcaagggaggg

SEQ ID NO: 56386 - RNA, 22 nt, Human
ugcagucagcauuagcaaaaua

SEQ ID NO: 56387 - RNA, 22 nt, Human
ugcaguccuaaauauauagcug

SEQ ID NO: 56388 - RNA, 22 nt, Human
ugcaguccuggugaggggacau

SEQ ID NO: 56389 - RNA, 22 nt, Human
ugcagugaggcaguuggguugg

SEQ ID NO: 56390 - RNA, 22 nt, Human
ugcagugauuaaaguguuaaau

SEQ ID NO: 56391 - RNA, 22 nt, Human
ugcaguggaacaauuucaacag

SEQ ID NO: 56392 - RNA, 22 nt, Human
ugcaguggaaucuggagagcag

SEQ ID NO: 56393 - RNA, 22 nt, Human
ugcaguggaggccgugagacag

SEQ ID NO: 56394 - RNA, 22 nt, Human
ugcagugggccggaggccaggg

SEQ ID NO: 56395 - RNA, 21 nt, Human
ugcagugucccuaacaguggu

SEQ ID NO: 56396 - RNA, 22 nt, Human
ugcagugugcuagauuuggacu

SEQ ID NO: 56397 - RNA, 22 nt, Human
ugcaguguggccaugucagcua

SEQ ID NO: 56398 - RNA, 22 nt, Human
ugcaguguucagugaucucucc

SEQ ID NO: 56399 - RNA, 22 nt, Human
ugcaguguuccuguagccugcc

SEQ ID NO: 56400 - RNA, 22 nt, Human
ugcaguguuuggaugcugaguc

SEQ ID NO: 56401 - RNA, 22 nt, Human
ugcaguuuucucacccccacaa

SEQ ID NO: 56402 - RNA, 22 nt, Human
ugcauaaaauaugagaaaugua

SEQ ID NO: 56403 - RNA, 22 nt, Human
ugcauaaauauuguugggagua

SEQ ID NO: 56404 - RNA, 22 nt, Human
ugcauaauggaugauuucacaa

SEQ ID NO: 56405 - RNA, 22 nt, Human
ugcauacacaugugcacauacg

SEQ ID NO: 56406 - RNA, 22 nt, Human
ugcauacauaaucgagaccagu

SEQ ID NO: 56407 - RNA, 22 nt, Human
ugcauacuuguauguguuacau

SEQ ID NO: 56408 - RNA, 22 nt, Human
ugcauauacccgcauuuacaua

SEQ ID NO: 56409 - RNA, 19 nt, Human
ugcauauaucuaugaaaga

SEQ ID NO: 56410 - RNA, 22 nt, Human
ugcauauuuucugauucagaag

SEQ ID NO: 56411 - RNA, 22 nt, Human
ugcaucaaaacuggacuccuuc

SEQ ID NO: 56412 - RNA, 22 nt, Human
ugcaucaaccuaauaucagcuc

SEQ ID NO: 56413 - RNA, 19 nt, Human
ugcauccaaagccccacca

SEQ ID NO: 56414 - RNA, 22 nt, Human
ugcauccuccuuuguccucuug

SEQ ID NO: 56415 - RNA, 22 nt, Human
ugcauccuguucuagguuuggg

SEQ ID NO: 56416 - RNA, 22 nt, Human
ugcaucuuacguuuugaaaggg

SEQ ID NO: 56417 - RNA, 21 nt, Human
ugcaucuucaagguuggcagg

SEQ ID NO: 56418 - RNA, 22 nt, Human
ugcaugaaauauuuucuguagg

SEQ ID NO: 56419 - RNA, 22 nt, Human
ugcaugaacacaugugcaugua

SEQ ID NO: 56420 - RNA, 22 nt, Human
ugcaugacaauugccgucaagu

SEQ ID NO: 56421 - RNA, 22 nt, Human
ugcaugaugacuaaggugguga

SEQ ID NO: 56422 - RNA, 22 nt, Human
ugcaugcaacaauucuucuaua

SEQ ID NO: 56423 - RNA, 22 nt, Human
ugcaugcacauguagguauggu

SEQ ID NO: 56424 - RNA, 22 nt, Human
ugcaugcauaaauguacacaca

SEQ ID NO: 56425 - RNA, 23 nt, Human
ugcaugcuaacacagugcacagg

SEQ ID NO: 56426 - RNA, 22 nt, Human
ugcaugcuccacagcccauuca

SEQ ID NO: 56427 - RNA, 22 nt, Human
uucugagagugccagaaguucu

SEQ ID NO: 56428 - RNA, 20 nt, Human
uucugagauuagguuacaaa

SEQ ID NO: 56429 - RNA, 22 nt, Human
uucugagauuguuaggcacuaa

SEQ ID NO: 56430 - RNA, 22 nt, Human
uucugagccagagucaguuaug

SEQ ID NO: 56431 - RNA, 22 nt, Human
uucugaggaggagcaaaaacuc

SEQ ID NO: 56432 - RNA, 22 nt, Human
uucugaggcacuggcucuccca

SEQ ID NO: 56433 - RNA, 22 nt, Human
uucugaggccauuaccaauaaa

SEQ ID NO: 56434 - RNA, 22 nt, Human
uucugagggaaccuuguucuug

SEQ ID NO: 56435 - RNA, 22 nt, Human
uucugauaacaaacaccaauuu

SEQ ID NO: 56436 - RNA, 22 nt, Human
uucugauacuggaaucgaugcc

SEQ ID NO: 56437 - RNA, 22 nt, Human
uucugauuguuggaggaugcuu

SEQ ID NO: 56438 - RNA, 22 nt, Human
uucugcagcccaacaguaguuu

SEQ ID NO: 56439 - RNA, 22 nt, Human
uucugcaggaugcucugguggu

SEQ ID NO: 56440 - RNA, 22 nt, Human
uucugcaggcuguacaagaagc

SEQ ID NO: 56441 - RNA, 22 nt, Human
uucugcauaggcuauauuuguu

SEQ ID NO: 56442 - RNA, 22 nt, Human
uucugcaucccagaagaggaca

SEQ ID NO: 56443 - RNA, 22 nt, Human
uucugcauccuaugaucgcaua

SEQ ID NO: 56444 - RNA, 22 nt, Human
uucugcaugcccucuguguggc

SEQ ID NO: 56445 - RNA, 22 nt, Human
uucugcauggagaaacugaguc

SEQ ID NO: 56446 - RNA, 17 nt, Human
uucugcaugugaagaug

SEQ ID NO: 56447 - RNA, 22 nt, Human
uucugcauuggagucuauucuu

SEQ ID NO: 56448 - RNA, 22 nt, Human
uucugcauuuaaaauauuacua

SEQ ID NO: 56449 - RNA, 22 nt, Human
uucugccaaaggcuuuguuuug

SEQ ID NO: 56450 - RNA, 22 nt, Human
uucugccaucugcagaagggga

SEQ ID NO: 56451 - RNA, 22 nt, Human
uucugccuuggcaggguggucc

SEQ ID NO: 56452 - RNA, 22 nt, Human
uucugcuauacuuaugaauaca

SEQ ID NO: 56453 - RNA, 22 nt, Human
uucugcuaugaaaaaagugcug

SEQ ID NO: 56454 - RNA, 22 nt, Human
uucugcucaguaguaagagugc

SEQ ID NO: 56455 - RNA, 22 nt, Human
uucugcugaagucacugggagc

SEQ ID NO: 56456 - RNA, 22 nt, Human
uucugcugcugcugcacccaau

SEQ ID NO: 56457 - RNA, 22 nt, Human
uucugcuguaguugcaucuguu

SEQ ID NO: 56458 - RNA, 21 nt, Human
uucugcugugccaugccucug

SEQ ID NO: 56459 - RNA, 21 nt, Human
uucugcuguucaccaccaccc

SEQ ID NO: 56460 - RNA, 22 nt, Human
uucugcuuauucuguagccuuu

SEQ ID NO: 56461 - RNA, 22 nt, Human
uucugcuucacuggccuggagg

SEQ ID NO: 56462 - RNA, 22 nt, Human
uucugcuucugugugucccagg

SEQ ID NO: 56463 - RNA, 20 nt, Human
uucugcuugcaaauaucaag

SEQ ID NO: 56464 - RNA, 22 nt, Human
uucuggaaaagaaaguuaagau

SEQ ID NO: 56465 - RNA, 19 nt, Human
uucuggaaacccagguaau

SEQ ID NO: 56466 - RNA, 22 nt, Human
uucuggaaacccucagccagug

SEQ ID NO: 56467 - RNA, 22 nt, Human
uucuggaaaucagcagagggug

SEQ ID NO: 56468 - RNA, 22 nt, Human
uucuggaaaugcacaacuaauu

SEQ ID NO: 56469 - RNA, 23 nt, Human
uucuggaagauuuacuugagaca

SEQ ID NO: 56470 - RNA, 22 nt, Human
uucuggaaguggaauuuuugua

SEQ ID NO: 56471 - RNA, 22 nt, Human
uucuggaaguuggaaauagcag

SEQ ID NO: 56472 - RNA, 22 nt, Human
ucuuuacaagucacauuuucug

SEQ ID NO: 56473 - RNA, 22 nt, Human
ucuuuacaaucuaagcauaguu

SEQ ID NO: 56474 - RNA, 22 nt, Human
ucuuuacacaagacaagaauaa

SEQ ID NO: 56475 - RNA, 21 nt, Human
ucuuuacauuugccucuugca

SEQ ID NO: 56476 - RNA, 22 nt, Human
ucuuuagacauccaguuucucu

SEQ ID NO: 56477 - RNA, 22 nt, Human
ucuuuagcuaacuggaugccaa

SEQ ID NO: 56478 - RNA, 22 nt, Human
ucuuuaucaagucuguucuuug

SEQ ID NO: 56479 - RNA, 22 nt, Human
ucuuuaucaggugaagagggac

SEQ ID NO: 56480 - RNA, 22 nt, Human
ucuuuaucuggcucagagacac

SEQ ID NO: 56481 - RNA, 22 nt, Human
ucuuuaugagaaaaagauugua

SEQ ID NO: 56482 - RNA, 22 nt, Human
ucuuuauguuuacuccagcuga

SEQ ID NO: 56483 - RNA, 22 nt, Human
ucuuuauguuugaaaguacaau

SEQ ID NO: 56484 - RNA, 22 nt, Human
ucuuuauugcuacugguuuguc

SEQ ID NO: 56485 - RNA, 22 nt, Human
ucuuuauuuuaugcuugugcaa

SEQ ID NO: 56486 - RNA, 22 nt, Human
ucuuucaaaguaacaaccacga

SEQ ID NO: 56487 - RNA, 22 nt, Human
ucuuucaagggcccuaguuugg

SEQ ID NO: 56488 - RNA, 22 nt, Human
ucuuucaaugugaaaccaugua

SEQ ID NO: 56489 - RNA, 22 nt, Human
ucuuucagaaacuuugucugcg

SEQ ID NO: 56490 - RNA, 22 nt, Human
ucuuuccaaggacucuguagca

SEQ ID NO: 56491 - RNA, 22 nt, Human
ucuuuccaaguaauacuuccca

SEQ ID NO: 56492 - RNA, 22 nt, Human
ucuuuccagaggaauuuuuaga

SEQ ID NO: 56493 - RNA, 22 nt, Human
ucuuuccccuacauuugguuaa

SEQ ID NO: 56494 - RNA, 23 nt, Human
ucuuuccucagcacacaccaaga

SEQ ID NO: 56495 - RNA, 22 nt, Human
ucuuuccucugagcuccuguag

SEQ ID NO: 56496 - RNA, 22 nt, Human
ucuuucggccauagcgaugauu

SEQ ID NO: 56497 - RNA, 22 nt, Human
ucuuucuacauuuuauaugcuu

SEQ ID NO: 56498 - RNA, 22 nt, Human
ucuuucugcacuuaguggggcu

SEQ ID NO: 56499 - RNA, 22 nt, Human
ucuuucuugguauucugagcua

SEQ ID NO: 56500 - RNA, 22 nt, Human
ucuuucuugugggugcccuuuu

SEQ ID NO: 56501 - RNA, 22 nt, Human
ucuuugaaaagauauuccuccu

SEQ ID NO: 56502 - RNA, 22 nt, Human
ucuuugaaguaucuuaaauggu

SEQ ID NO: 56503 - RNA, 22 nt, Human
ucuuugaauacaggaagcauga

SEQ ID NO: 56504 - RNA, 22 nt, Human
ucuuugaauccuuuacaucuga

SEQ ID NO: 56505 - RNA, 22 nt, Human
ucuuugauacagauguaagcug

SEQ ID NO: 56506 - RNA, 22 nt, Human
ucuuugaucagccuuucacuga

SEQ ID NO: 56507 - RNA, 22 nt, Human
ucuuugauggagagauagauau

SEQ ID NO: 56508 - RNA, 22 nt, Human
ucuuugaugggagaucugagag

SEQ ID NO: 56509 - RNA, 22 nt, Human
ucuuugcaaauguuauuaucuu

SEQ ID NO: 56510 - RNA, 17 nt, Human
ucuuugcaaugagacug

SEQ ID NO: 56511 - RNA, 22 nt, Human
ucuuugcagccccaggaagugg

SEQ ID NO: 56512 - RNA, 22 nt, Human
ucuuugcaucccuuccauaguu

SEQ ID NO: 56513 - RNA, 22 nt, Human
ucuuugcuccacacucuagaga

SEQ ID NO: 56514 - RNA, 22 nt, Human
ucuuuggaagcuuucagagaag

SEQ ID NO: 56515 - RNA, 22 nt, Human
ucuuuggaaggagcaguuuuug

SEQ ID NO: 56516 - RNA, 22 nt, Human
ucuuuggaaugcuagcauucua

SEQ ID NO: 56517 - RNA, 22 nt, Human
ucuuuggacauguugagguugc

SEQ ID NO: 56518 - RNA, 22 nt, Human
ucuuuggacuuuccaauuuguu

SEQ ID NO: 56519 - RNA, 22 nt, Human
ucuuuggaguguuaucaguaau

SEQ ID NO: 56520 - RNA, 22 nt, Human
ucuuuggauaucgcuagaccgu

SEQ ID NO: 56521 - RNA, 22 nt, Human
ucuuuggauauguauggauaga

SEQ ID NO: 56522 - RNA, 22 nt, Human
ucuuuggaucccaacuggcugg

SEQ ID NO: 56523 - RNA, 22 nt, Human
ucuuuggaugcguuacuuuuac

SEQ ID NO: 56524 - RNA, 19 nt, Human
ucuuuggcuaaauugggug

SEQ ID NO: 56525 - RNA, 22 nt, Human
ucuuuggcuuugccacacccaa

SEQ ID NO: 56526 - RNA, 22 nt, Human
ucuuugggagauguuauuuaua

SEQ ID NO: 56527 - RNA, 22 nt, Human
ucuuugguugcacugcaggugu

SEQ ID NO: 56528 - RNA, 22 nt, Human
ucuuuguaacugucuauugaga

SEQ ID NO: 56529 - RNA, 22 nt, Human
ucuuuguaagacauguaagucc

SEQ ID NO: 56530 - RNA, 22 nt, Human
ucuuuguaaguuauauguagua

SEQ ID NO: 56531 - RNA, 22 nt, Human
ucuuuguacaggaaggcacugu

SEQ ID NO: 56532 - RNA, 18 nt, Human
ucuuuguuuccuucuugc

SEQ ID NO: 56533 - RNA, 22 nt, Human
ucuuuuaaaagcccugcugucu

SEQ ID NO: 56534 - RNA, 22 nt, Human
ucuuuuaagccucuggcauagg

SEQ ID NO: 56535 - RNA, 22 nt, Human
ucuuuuagaaaaguugaaugua

SEQ ID NO: 56536 - RNA, 22 nt, Human
ugcccguggccuggggcagcuu

SEQ ID NO: 56537 - RNA, 22 nt, Human
ugcccucucaaguugagucaga

SEQ ID NO: 56538 - RNA, 22 nt, Human
ugcccucugcaggccgccaugg

SEQ ID NO: 56539 - RNA, 22 nt, Human
ugcccugaugauccuccucgca

SEQ ID NO: 56540 - RNA, 22 nt, Human
ugcccugcagacccugcagugu

SEQ ID NO: 56541 - RNA, 19 nt, Human
ugcccugcccgcagccuug

SEQ ID NO: 56542 - RNA, 22 nt, Human
ugcccugcggcuaucuagauga

SEQ ID NO: 56543 - RNA, 22 nt, Human
ugcccugcuaaauauagguagc

SEQ ID NO: 56544 - RNA, 22 nt, Human
ugcccugcuguggcucugccca

SEQ ID NO: 56545 - RNA, 22 nt, Human
ugcccugcuugguuuauuuuca

SEQ ID NO: 56546 - RNA, 22 nt, Human
ugcccuggaggggcuuacaguc

SEQ ID NO: 56547 - RNA, 22 nt, Human
ugcccuggcgcugucucuaugg

SEQ ID NO: 56548 - RNA, 22 nt, Human
ugcccuggcucuccacuaguuu

SEQ ID NO: 56549 - RNA, 22 nt, Human
ugcccuggcuggagugcagugg

SEQ ID NO: 56550 - RNA, 21 nt, Human
ugcccuggggcucuucccuca

SEQ ID NO: 56551 - RNA, 22 nt, Human
ugcccugguagacacagacugu

SEQ ID NO: 56552 - RNA, 22 nt, Human
ugccuaacuccaccaggcaggu

SEQ ID NO: 56553 - RNA, 22 nt, Human
ugccuagccuucuucaugccau

SEQ ID NO: 56554 - RNA, 22 nt, Human
ugccuagggccuaaccagagcc

SEQ ID NO: 56555 - RNA, 23 nt, Human
ugccuauucagcagagugauagc

SEQ ID NO: 56556 - RNA, 22 nt, Human
ugccucagagaccugacaguac

SEQ ID NO: 56557 - RNA, 22 nt, Human
ugccucagcugaggccgcucca

SEQ ID NO: 56558 - RNA, 22 nt, Human
ugccucaguuucuccauaugaa

SEQ ID NO: 56559 - RNA, 22 nt, Human
ugccuccaggaggggcagcucu

SEQ ID NO: 56560 - RNA, 22 nt, Human
ugccucccucucugccacugga

SEQ ID NO: 56561 - RNA, 22 nt, Human
ugccucuggccuuuggugccca

SEQ ID NO: 56562 - RNA, 22 nt, Human
ugccucugggugaccaaggagc

SEQ ID NO: 56563 - RNA, 22 nt, Human
ugccucuguugagccuuggcug

SEQ ID NO: 56564 - RNA, 22 nt, Human
ugccugaggagucagggcaggu

SEQ ID NO: 56565 - RNA, 22 nt, Human
ugccugaugcaggaguaucaga

SEQ ID NO: 56566 - RNA, 22 nt, Human
ugccugcagcgucuccagcagg

SEQ ID NO: 56567 - RNA, 22 nt, Human
ugccugccaaugaugcuugugu

SEQ ID NO: 56568 - RNA, 17 nt, Human
ugccugccagcauugga

SEQ ID NO: 56569 - RNA, 22 nt, Human
ugccugccaugcagaaagcuga

SEQ ID NO: 56570 - RNA, 18 nt, Human
ugccugccccguaagggu

SEQ ID NO: 56571 - RNA, 22 nt, Human
ugccugcccuuuccacacagcc

SEQ ID NO: 56572 - RNA, 22 nt, Human
ugccugccugcauagucccacg

SEQ ID NO: 56573 - RNA, 22 nt, Human
ugccugcuagauauccagguga

SEQ ID NO: 56574 - RNA, 22 nt, Human
ugccugcuaggcccugcugggu

SEQ ID NO: 56575 - RNA, 22 nt, Human
ugccugcugccacugcuguuac

SEQ ID NO: 56576 - RNA, 22 nt, Human
ugccugcugccuuucaucccaa

SEQ ID NO: 56577 - RNA, 22 nt, Human
ugccugcuuucuccucaacuca

SEQ ID NO: 56578 - RNA, 22 nt, Human
ugccuggaugugcuggccucac

SEQ ID NO: 56579 - RNA, 22 nt, Human
ugccuggcaccccagucugcac

SEQ ID NO: 56580 - RNA, 22 nt, Human
ugccuggcagcuugaaagaaau

SEQ ID NO: 56581 - RNA, 22 nt, Human
ugccuggcucuaucaguggugg

SEQ ID NO: 56582 - RNA, 22 nt, Human
ugccuggcugggcugcucaugg

SEQ ID NO: 56583 - RNA, 22 nt, Human
ugccugggacaugcuguggacu

SEQ ID NO: 56584 - RNA, 22 nt, Human
ugccugggacuguacuaaauuu

SEQ ID NO: 56585 - RNA, 22 nt, Human
ugccugggagugaccaagacuc

SEQ ID NO: 56586 - RNA, 22 nt, Human
ugccugggaucugugcccuuug

SEQ ID NO: 56587 - RNA, 22 nt, Human
ugaaaucaucugccaauaaguu

SEQ ID NO: 56588 - RNA, 22 nt, Human
ugaaaugagagcacagaauaaa

SEQ ID NO: 56589 - RNA, 22 nt, Human
ugaaaugagcauuuauucuuua

SEQ ID NO: 56590 - RNA, 22 nt, Human
ugaaaugaucaguuugguuacu

SEQ ID NO: 56591 - RNA, 22 nt, Human
ugaaaugauuauaugguguuug

SEQ ID NO: 56592 - RNA, 19 nt, Human
ugaaauggcaguugcuaaa

SEQ ID NO: 56593 - RNA, 22 nt, Human
ugaaauggcccaaacacccagu

SEQ ID NO: 56594 - RNA, 22 nt, Human
ugaaauguaagcauagagguug

SEQ ID NO: 56595 - RNA, 22 nt, Human
ugaaauguacaagugcuuuuuu

SEQ ID NO: 56596 - RNA, 22 nt, Human
ugaaauguacauaaaaacgcac

SEQ ID NO: 56597 - RNA, 22 nt, Human
ugaaaugucucacuuagacuuu

SEQ ID NO: 56598 - RNA, 22 nt, Human
ugaaauguggagaugguaagua

SEQ ID NO: 56599 - RNA, 22 nt, Human
ugaaauguguccauguuauuuc

SEQ ID NO: 56600 - RNA, 22 nt, Human
ugaaauguugccaugaggucuc

SEQ ID NO: 56601 - RNA, 22 nt, Human
ugaaauuaugcauuguuguacc

SEQ ID NO: 56602 - RNA, 22 nt, Human
ugaaauucauuguuuuaugugu

SEQ ID NO: 56603 - RNA, 22 nt, Human
ugaaauuuaggugcagauaaau

SEQ ID NO: 56604 - RNA, 21 nt, Human
ugaacaaaguucuuaucguga

SEQ ID NO: 56605 - RNA, 22 nt, Human
ugaacaacagauguccauuguu

SEQ ID NO: 56606 - RNA, 22 nt, Human
ugaacacauaaaagcaaagggu

SEQ ID NO: 56607 - RNA, 22 nt, Human
ugaacacgcuucauacagaggg

SEQ ID NO: 56608 - RNA, 22 nt, Human
ugaacacuguauauucuucuug

SEQ ID NO: 56609 - RNA, 22 nt, Human
ugaacagaucaauagaacugac

SEQ ID NO: 56610 - RNA, 18 nt, Human
ugaacagaugaguugaag

SEQ ID NO: 56611 - RNA, 22 nt, Human
ugaacaguuacuuuguagaaga

SEQ ID NO: 56612 - RNA, 22 nt, Human
ugaaccaggcacauuuccuaca

SEQ ID NO: 56613 - RNA, 22 nt, Human
ugaacccaggagguugcaguga

SEQ ID NO: 56614 - RNA, 22 nt, Human
ugaacccugaccucuggaagga

SEQ ID NO: 56615 - RNA, 22 nt, Human
ugaaccuuuguguuggaccugg

SEQ ID NO: 56616 - RNA, 22 nt, Human
ugaaccuuuugaauaaggacca

SEQ ID NO: 56617 - RNA, 22 nt, Human
ugaacugagcaguuuccuggga

SEQ ID NO: 56618 - RNA, 18 nt, Human
ugaacuuuggugucucuc

SEQ ID NO: 56619 - RNA, 18 nt, Human
ugaacuuuuccugcugcu

SEQ ID NO: 56620 - RNA, 22 nt, Human
ugaagaaaggugugggauacuc

SEQ ID NO: 56621 - RNA, 22 nt, Human
ugaagaauaaaugguugagacu

SEQ ID NO: 56622 - RNA, 22 nt, Human
ugaagaaucccagggaauuugg

SEQ ID NO: 56623 - RNA, 22 nt, Human
ugaagacaagugugcugguguu

SEQ ID NO: 56624 - RNA, 22 nt, Human
ugaagagaagaaaauuaucuuu

SEQ ID NO: 56625 - RNA, 22 nt, Human
ugaagagauagaaguacaugcu

SEQ ID NO: 56626 - RNA, 19 nt, Human
ugaagagcugucaaaagug

SEQ ID NO: 56627 - RNA, 20 nt, Human
ugaagaggaagaggacggcc

SEQ ID NO: 56628 - RNA, 22 nt, Human
ugaagagugcuugagauuuuaa

SEQ ID NO: 56629 - RNA, 22 nt, Human
ugaagauaacaguaagguauug

SEQ ID NO: 56630 - RNA, 22 nt, Human
ugaagauauuuuaaaauacuga

SEQ ID NO: 56631 - RNA, 22 nt, Human
ugaagaucugucaaccccauau

SEQ ID NO: 56632 - RNA, 22 nt, Human
ugaagaugucagcagggguggu

SEQ ID NO: 56633 - RNA, 22 nt, Human
ugaagauuuaagcaucucaauu

SEQ ID NO: 56634 - RNA, 22 nt, Human
ugaagauuuccaccaaaucaca

SEQ ID NO: 56635 - RNA, 20 nt, Human
ugaagauuuuguguuuagaa

SEQ ID NO: 56636 - RNA, 22 nt, Human
ugaagcaaauuguuuagccuga

SEQ ID NO: 56637 - RNA, 22 nt, Human
ugaagcaauagagacaagacca

SEQ ID NO: 56638 - RNA, 22 nt, Human
ugaagcagcuucuuucugucaa

SEQ ID NO: 56639 - RNA, 19 nt, Human
ugaagcaggcagagaagau

SEQ ID NO: 56640 - RNA, 22 nt, Human
ugaagcaggguggccagauugu

SEQ ID NO: 56641 - RNA, 22 nt, Human
ugaagcaguucucagaaguggg

SEQ ID NO: 56642 - RNA, 22 nt, Human
ugaagccacacuagcuuguccu

SEQ ID NO: 56643 - RNA, 22 nt, Human
ugaagccaccgaaccagaagag

SEQ ID NO: 56644 - RNA, 22 nt, Human
ugaagccacuuuccagaaucac

SEQ ID NO: 56645 - RNA, 17 nt, Human
ugcuagggggagaguag

SEQ ID NO: 56646 - RNA, 22 nt, Human
ugcuauaagaauuauauuacuc

SEQ ID NO: 56647 - RNA, 22 nt, Human
ugcuauacauguacauauuagu

SEQ ID NO: 56648 - RNA, 22 nt, Human
ugcuaucaccaacucugcuaag

SEQ ID NO: 56649 - RNA, 22 nt, Human
ugcuauuaaugaggcugcauuu

SEQ ID NO: 56650 - RNA, 19 nt, Human
ugcuauuuagaacgccugg

SEQ ID NO: 56651 - RNA, 19 nt, Human
ugcuauuugaagaagugua

SEQ ID NO: 56652 - RNA, 22 nt, Human
ugcuauuugggggcuacaugau

SEQ ID NO: 56653 - RNA, 22 nt, Human
ugcuauuugugagugucuucgu

SEQ ID NO: 56654 - RNA, 22 nt, Human
ugcuauuuuguuuucaguccau

SEQ ID NO: 56655 - RNA, 22 nt, Human
ugcucacaauuaucagaaguau

SEQ ID NO: 56656 - RNA, 19 nt, Human
ugcucacucucagucccuc

SEQ ID NO: 56657 - RNA, 22 nt, Human
ugcucagaauugcgcuggugga

SEQ ID NO: 56658 - RNA, 22 nt, Human
ugcucagagcucuggugcaggu

SEQ ID NO: 56659 - RNA, 22 nt, Human
ugcucagcagaucucaggagau

SEQ ID NO: 56660 - RNA, 22 nt, Human
ugcucagcuggugccagggucc

SEQ ID NO: 56661 - RNA, 22 nt, Human
ugcucaggaggaggcugugagg

SEQ ID NO: 56662 - RNA, 20 nt, Human
ugcucaggauggagaggugu

SEQ ID NO: 56663 - RNA, 22 nt, Human
ugcucagggagcuuccuggugg

SEQ ID NO: 56664 - RNA, 22 nt, Human
ugcucaguagcagugugcugcu

SEQ ID NO: 56665 - RNA, 22 nt, Human
ugcucaguccuaccuuggcucc

SEQ ID NO: 56666 - RNA, 22 nt, Human
ugcucaguccuccugcagugcc

SEQ ID NO: 56667 - RNA, 21 nt, Human
ugcucaugagcccacagcugc

SEQ ID NO: 56668 - RNA, 21 nt, Human
ugcucaugcaaugcaugucca

SEQ ID NO: 56669 - RNA, 19 nt, Human
ugcucauggggacuucucc

SEQ ID NO: 56670 - RNA, 22 nt, Human
ugcucauugcugauuuacaugu

SEQ ID NO: 56671 - RNA, 22 nt, Human
ugcuccacuaagccaucccauu

SEQ ID NO: 56672 - RNA, 22 nt, Human
ugcuccagcaccaagagcucca

SEQ ID NO: 56673 - RNA, 22 nt, Human
ugcuccagcuggagaugggggc

SEQ ID NO: 56674 - RNA, 22 nt, Human
ugcuccaggagcacuuuccauu

SEQ ID NO: 56675 - RNA, 22 nt, Human
ugcuccaggcaagcugagaguu

SEQ ID NO: 56676 - RNA, 18 nt, Human
ugcuccaggcccaugggc

SEQ ID NO: 56677 - RNA, 22 nt, Human
ugcuccaggcugcugaagaucu

SEQ ID NO: 56678 - RNA, 22 nt, Human
ugcuccaggugugccucucaug

SEQ ID NO: 56679 - RNA, 22 nt, Human
ugcuccagugccugccccacag

SEQ ID NO: 56680 - RNA, 22 nt, Human
ugcucccaaaccugacaggcuc

SEQ ID NO: 56681 - RNA, 22 nt, Human
ugcucccacacuacucggaggc

SEQ ID NO: 56682 - RNA, 22 nt, Human
ugcucccagcuccugcagcaac

SEQ ID NO: 56683 - RNA, 22 nt, Human
ugcucccaggcauucucuguug

SEQ ID NO: 56684 - RNA, 22 nt, Human
ugcucccugacccaggucuucu

SEQ ID NO: 56685 - RNA, 20 nt, Human
ugcucccuugcgagucgcug

SEQ ID NO: 56686 - RNA, 22 nt, Human
ugcuccgggaaagagcagccgc

SEQ ID NO: 56687 - RNA, 22 nt, Human
ugcuccguucuucugcuucuug

SEQ ID NO: 56688 - RNA, 22 nt, Human
ugcuccugacaguuuuaggcuc

SEQ ID NO: 56689 - RNA, 22 nt, Human
ugcuccugcugcaugcaucucc

SEQ ID NO: 56690 - RNA, 22 nt, Human
ugcuccuggcaucucugcgucc

SEQ ID NO: 56691 - RNA, 17 nt, Human
ugcuccugggacaagga

SEQ ID NO: 56692 - RNA, 21 nt, Human
ugcuccuuagcugccccugcc

SEQ ID NO: 56693 - RNA, 21 nt, Human
ugcuccuuuaccccacaagac

SEQ ID NO: 56694 - RNA, 22 nt, Human
ugcucuagcucauaggacucau

SEQ ID NO: 56695 - RNA, 22 nt, Human
ugcucuccugcuccucagccca

SEQ ID NO: 56696 - RNA, 19 nt, Human
ugcucucuggugcuucaug

SEQ ID NO: 56697 - RNA, 22 nt, Human
ugcucugcacaucccucacaaa

SEQ ID NO: 56698 - RNA, 22 nt, Human
ugcucuggaccaugacuaugug

SEQ ID NO: 56699 - RNA, 19 nt, Human
ugcucuggagccagcucuc

SEQ ID NO: 56700 - RNA, 22 nt, Human
ugcucuggagggugaagcuuuu

SEQ ID NO: 56701 - RNA, 22 nt, Human
ugcucugggggaagccagcugu

SEQ ID NO: 56702 - RNA, 21 nt, Human
ugcucugguguuuuauuuaac

SEQ ID NO: 56703 - RNA, 22 nt, Human
uucuuuggggaauauucugguu

SEQ ID NO: 56704 - RNA, 22 nt, Human
uucuuuggggucuccagcauag

SEQ ID NO: 56705 - RNA, 22 nt, Human
uucuuuguagcaaaacguguau

SEQ ID NO: 56706 - RNA, 22 nt, Human
uucuuugugcugaagaagcccu

SEQ ID NO: 56707 - RNA, 20 nt, Human
uucuuuguuccuuacauuug

SEQ ID NO: 56708 - RNA, 22 nt, Human
uucuuuuaaugucuggcuuuca

SEQ ID NO: 56709 - RNA, 22 nt, Human
uucuuuuaauugugggggagug

SEQ ID NO: 56710 - RNA, 22 nt, Human
uucuuuuacauuaagauuucag

SEQ ID NO: 56711 - RNA, 22 nt, Human
uucuuuuccuguggcucaucca

SEQ ID NO: 56712 - RNA, 22 nt, Human
uucuuuucggccugugagaagg

SEQ ID NO: 56713 - RNA, 22 nt, Human
uucuuuucuuuaggcauugugu

SEQ ID NO: 56714 - RNA, 22 nt, Human
uucuuuugcaagacuauugauu

SEQ ID NO: 56715 - RNA, 22 nt, Human
uucuuuugggaauuacguaugc

SEQ ID NO: 56716 - RNA, 23 nt, Human
uugaaaaauauagucccauuguc

SEQ ID NO: 56717 - RNA, 22 nt, Human
uugaaaacauuuauauuagaau

SEQ ID NO: 56718 - RNA, 22 nt, Human
uugaaacagacaaguaaauguc

SEQ ID NO: 56719 - RNA, 22 nt, Human
uugaaacaguagcucauagacc

SEQ ID NO: 56720 - RNA, 22 nt, Human
uugaaacuaugaagacaaccau

SEQ ID NO: 56721 - RNA, 22 nt, Human
uugaaagaacaauucugugaug

SEQ ID NO: 56722 - RNA, 22 nt, Human
uugaaagaacucuucagagaua

SEQ ID NO: 56723 - RNA, 22 nt, Human
uugaaagaagaagcugcgaugu

SEQ ID NO: 56724 - RNA, 22 nt, Human
uugaaagaaggugguagagaau

SEQ ID NO: 56725 - RNA, 23 nt, Human
uugaaagguagcuggcagcuaga

SEQ ID NO: 56726 - RNA, 22 nt, Human
uugaaaguaauaacuuuguuca

SEQ ID NO: 56727 - RNA, 22 nt, Human
uugaaauaaggaagcucgaaau

SEQ ID NO: 56728 - RNA, 22 nt, Human
uugaaauccaauuaucauaugu

SEQ ID NO: 56729 - RNA, 22 nt, Human
uugaaaugaaauauuuaagcuc

SEQ ID NO: 56730 - RNA, 22 nt, Human
uugaaaugcagauuccaaucca

SEQ ID NO: 56731 - RNA, 22 nt, Human
uugaaauggcagcagcugaccu

SEQ ID NO: 56732 - RNA, 22 nt, Human
uugaacaaucaaaagaauucau

SEQ ID NO: 56733 - RNA, 22 nt, Human
uugaacacuaaguuuccaggcu

SEQ ID NO: 56734 - RNA, 22 nt, Human
uugaacaguuuugucagguuca

SEQ ID NO: 56735 - RNA, 22 nt, Human
uugaacauuaacuucagucuau

SEQ ID NO: 56736 - RNA, 22 nt, Human
uugaacauuuucuauguuauag

SEQ ID NO: 56737 - RNA, 22 nt, Human
uugaagaaagucauauauaaug

SEQ ID NO: 56738 - RNA, 22 nt, Human
uugaagaacauaauagcuacuu

SEQ ID NO: 56739 - RNA, 22 nt, Human
uugaagaaguaauuuuaagucu

SEQ ID NO: 56740 - RNA, 22 nt, Human
uugaagaccuuuagugcuaugu

SEQ ID NO: 56741 - RNA, 22 nt, Human
uugaagagucuagauugguuau

SEQ ID NO: 56742 - RNA, 22 nt, Human
uugaagagugcauuagcauauu

SEQ ID NO: 56743 - RNA, 22 nt, Human
uugaagcauuguggcuuguauu

SEQ ID NO: 56744 - RNA, 22 nt, Human
uugaagcauuugcuauagcauu

SEQ ID NO: 56745 - RNA, 22 nt, Human
uugaaggacaucuuguuucuag

SEQ ID NO: 56746 - RNA, 22 nt, Human
uugaaggaggcgaaaauugguc

SEQ ID NO: 56747 - RNA, 22 nt, Human
uugaagucaguucauauuuuua

SEQ ID NO: 56748 - RNA, 22 nt, Human
uugaaguucugcauuucuaaua

SEQ ID NO: 56749 - RNA, 22 nt, Human
uugaaguugguguggaaaguag

SEQ ID NO: 56750 - RNA, 22 nt, Human
uugaauaauaugcuucguucuc

SEQ ID NO: 56751 - RNA, 23 nt, Human
uugaauaggguggcaacaaacug

SEQ ID NO: 56752 - RNA, 22 nt, Human
uugaaucauuacaauagauaag

SEQ ID NO: 56753 - RNA, 22 nt, Human
uugaaucucuugaaucucuguu

SEQ ID NO: 56754 - RNA, 22 nt, Human
uugaaucuggguacuuguaaua

SEQ ID NO: 56755 - RNA, 22 nt, Human
uugaaugaagggaugaccgaag

SEQ ID NO: 56756 - RNA, 22 nt, Human
uugaaugaagucccuuuuuacu

SEQ ID NO: 56757 - RNA, 20 nt, Human
uugaaugaaugucuggcuca

SEQ ID NO: 56758 - RNA, 22 nt, Human
uugaaugaauucuacuuccaga

SEQ ID NO: 56759 - RNA, 16 nt, Human
uugaaugacugugugc

SEQ ID NO: 56760 - RNA, 22 nt, Human
uugaaugagaaguuauugccau

SEQ ID NO: 56761 - RNA, 22 nt, Human
uugaaugauccuaucuagcaca

SEQ ID NO: 56762 - RNA, 22 nt, Human
uugaaugauuaaagucaucuga

SEQ ID NO: 56763 - RNA, 22 nt, Human
uugaaugcaucuuugagcuccu

SEQ ID NO: 56764 - RNA, 22 nt, Human
uugaauguaggucuuggugagc

SEQ ID NO: 56765 - RNA, 22 nt, Human
uugaauuauaagugugucuacu

SEQ ID NO: 56766 - RNA, 22 nt, Human
uugaauuauauguauguccuuu

SEQ ID NO: 56767 - RNA, 22 nt, Human
uugaauugaaacauacccuggu

SEQ ID NO: 56768 - RNA, 22 nt, Human
uugacaaaaauaacacagcaua

SEQ ID NO: 56769 - RNA, 22 nt, Human
uugacaaaacaacacagauuuc

SEQ ID NO: 56770 - RNA, 22 nt, Human
uugacaaagauauauucaugcu

SEQ ID NO: 56771 - RNA, 22 nt, Human
uugacaaaggaccuugcuauuu

SEQ ID NO: 56772 - RNA, 22 nt, Human
uugacaauugggagauauaaag

SEQ ID NO: 56773 - RNA, 22 nt, Human
uugacacauuagagcuuguaaa

SEQ ID NO: 56774 - RNA, 22 nt, Human
uugacagagcuaggucaacucu

SEQ ID NO: 56775 - RNA, 22 nt, Human
uugacagcaaagauugugccua

SEQ ID NO: 56776 - RNA, 22 nt, Human
uugacagcuacggagcagcugu

SEQ ID NO: 56777 - RNA, 22 nt, Human
uugacaguugcaauggugaucu

SEQ ID NO: 56778 - RNA, 21 nt, Human
uugaccaagggugcgugcucc

SEQ ID NO: 56779 - RNA, 22 nt, Human
uugacccaaggcccuggaauug

SEQ ID NO: 56780 - RNA, 22 nt, Human
uugacucuaaauuuacuuuucc

SEQ ID NO: 56781 - RNA, 22 nt, Human
uugacugugaugggcucagcug

SEQ ID NO: 56782 - RNA, 22 nt, Human
uugacuguugcugccauucugg

SEQ ID NO: 56783 - RNA, 22 nt, Human
uugacuuuacaguuuucuuagg

SEQ ID NO: 56784 - RNA, 22 nt, Human
uugacuuuucuuggucacauga

SEQ ID NO: 56785 - RNA, 22 nt, Human
uugagaaaaccaucguaagaau

SEQ ID NO: 56786 - RNA, 22 nt, Human
uugagaaaccuggcaguagaga

SEQ ID NO: 56787 - RNA, 19 nt, Human
uugagaaaguugauuuggg

SEQ ID NO: 56788 - RNA, 22 nt, Human
uugagaaauaagcaugucuaga

SEQ ID NO: 56789 - RNA, 19 nt, Human
uugagaaaugggaaaagca

SEQ ID NO: 56790 - RNA, 22 nt, Human
uugagaaauguuuuuuaagcug

SEQ ID NO: 56791 - RNA, 19 nt, Human
uugagaacaccaaguacug

SEQ ID NO: 56792 - RNA, 22 nt, Human
uugagaagaaauaguuugcaau

SEQ ID NO: 56793 - RNA, 22 nt, Human
uugagaauguguuuugcuaagu

SEQ ID NO: 56794 - RNA, 22 nt, Human
uugagacucgagucucucagac

SEQ ID NO: 56795 - RNA, 22 nt, Human
uugagaggauggauuagacaaa

SEQ ID NO: 56796 - RNA, 22 nt, Human
uugagaguagagauggcagggc

SEQ ID NO: 56797 - RNA, 22 nt, Human
uugagagucauuuaagguguug

SEQ ID NO: 56798 - RNA, 22 nt, Human
uugagagugccaagcauccucc

SEQ ID NO: 56799 - RNA, 22 nt, Human
uugagaguuugggggcaauaug

SEQ ID NO: 56800 - RNA, 22 nt, Human
uugagauagaucucaucuuccc

SEQ ID NO: 56801 - RNA, 22 nt, Human
uugagaugacuuaaauuuggga

SEQ ID NO: 56802 - RNA, 22 nt, Human
uugagauggagccucagucuug

SEQ ID NO: 56803 - RNA, 22 nt, Human
uugagaugggcuuuauguucag

SEQ ID NO: 56804 - RNA, 22 nt, Human
uugagcaaaggaguaaaaugca

SEQ ID NO: 56805 - RNA, 22 nt, Human
uugagcaaaucagaaguuuaga

SEQ ID NO: 56806 - RNA, 22 nt, Human
uugagcaaaucagauuguaauu

SEQ ID NO: 56807 - RNA, 21 nt, Human
uugagcagaaauguguaugcc

SEQ ID NO: 56808 - RNA, 22 nt, Human
uugagcaucaauuaagugaguu

SEQ ID NO: 56809 - RNA, 22 nt, Human
uugagcaucuuauagaaagagc

SEQ ID NO: 56810 - RNA, 21 nt, Human
uugagcauguacuuugugcuu

SEQ ID NO: 56811 - RNA, 22 nt, Human
uugagcucuccucaucacccug

SEQ ID NO: 56812 - RNA, 20 nt, Human
uugaggagauauugaauacu

SEQ ID NO: 56813 - RNA, 23 nt, Human
uugaggagcagcgcuuuuuaccg

SEQ ID NO: 56814 - RNA, 22 nt, Human
ugaaugaccuuugaggauggaa

SEQ ID NO: 56815 - RNA, 21 nt, Human
ugaaugaggaggauggcauuu

SEQ ID NO: 56816 - RNA, 22 nt, Human
ugaaugagugaguucagaccuc

SEQ ID NO: 56817 - RNA, 22 nt, Human
ugaaugaguuuggcugcuguuc

SEQ ID NO: 56818 - RNA, 22 nt, Human
ugaaugaucuaguuuuguagac

SEQ ID NO: 56819 - RNA, 21 nt, Human
ugaaugaugccccagaguugu

SEQ ID NO: 56820 - RNA, 22 nt, Human
ugaaugaugguguguucuugcc

SEQ ID NO: 56821 - RNA, 22 nt, Human
ugaaugauuucuuaggcaauug

SEQ ID NO: 56822 - RNA, 22 nt, Human
ugaaugauuugggugcauucag

SEQ ID NO: 56823 - RNA, 22 nt, Human
ugaaugcagagacugugggaaa

SEQ ID NO: 56824 - RNA, 21 nt, Human
ugaaugcuucgucauccuggc

SEQ ID NO: 56825 - RNA, 22 nt, Human
ugaauguuugaugagaaauaga

SEQ ID NO: 56826 - RNA, 22 nt, Human
ugaauuagcaguagacagacug

SEQ ID NO: 56827 - RNA, 22 nt, Human
ugaauucaccugaaagucugga

SEQ ID NO: 56828 - RNA, 22 nt, Human
ugaauucuggcucuucuguuua

SEQ ID NO: 56829 - RNA, 22 nt, Human
ugaauuguacaguaugugaauu

SEQ ID NO: 56830 - RNA, 22 nt, Human
ugaauuguggcuuuuuccaauu

SEQ ID NO: 56831 - RNA, 22 nt, Human
ugaauuuaucaaagauucuuaa

SEQ ID NO: 56832 - RNA, 22 nt, Human
ugacaaacccugcaaauagcuc

SEQ ID NO: 56833 - RNA, 22 nt, Human
ugacaaagaggaacagcagggg

SEQ ID NO: 56834 - RNA, 22 nt, Human
ugacaaagccucauccuucaga

SEQ ID NO: 56835 - RNA, 22 nt, Human
ugacaaagguguugccagaggg

SEQ ID NO: 56836 - RNA, 23 nt, Human
ugacaaagucaucucuccuucuu

SEQ ID NO: 56837 - RNA, 22 nt, Human
ugacaaagugaggucuucagua

SEQ ID NO: 56838 - RNA, 20 nt, Human
ugacaaaugaucugauuuuc

SEQ ID NO: 56839 - RNA, 22 nt, Human
ugacaaauucauauuucagagg

SEQ ID NO: 56840 - RNA, 22 nt, Human
ugacaacauugaguuaugugca

SEQ ID NO: 56841 - RNA, 22 nt, Human
ugacaacuuuacaaaauucuuc

SEQ ID NO: 56842 - RNA, 22 nt, Human
ugacaagaaagcgucuucuuuu

SEQ ID NO: 56843 - RNA, 22 nt, Human
ugacaagaauuugggacuguua

SEQ ID NO: 56844 - RNA, 22 nt, Human
ugacaagcuuuacagaauugaa

SEQ ID NO: 56845 - RNA, 22 nt, Human
ugacaaguuggaaagcagugca

SEQ ID NO: 56846 - RNA, 22 nt, Human
ugacaaguuuccuggugauuuu

SEQ ID NO: 56847 - RNA, 22 nt, Human
ugacaauggauauuaguugugg

SEQ ID NO: 56848 - RNA, 22 nt, Human
ugacaauggggcacauggaaag

SEQ ID NO: 56849 - RNA, 22 nt, Human
ugacaauuguugugaauucuuc

SEQ ID NO: 56850 - RNA, 22 nt, Human
ugacacagauuagagacauacc

SEQ ID NO: 56851 - RNA, 22 nt, Human
ugacacaggcagcucccagcac

SEQ ID NO: 56852 - RNA, 23 nt, Human
ugacacaggucaaaaauaagaug

SEQ ID NO: 56853 - RNA, 22 nt, Human
ugacacugccgaaacuguagag

SEQ ID NO: 56854 - RNA, 22 nt, Human
ugacacuuccaguuaaaaauau

SEQ ID NO: 56855 - RNA, 22 nt, Human
ugacacuucuccaucaagucaa

SEQ ID NO: 56856 - RNA, 22 nt, Human
ugacacuugagagggacacgga

SEQ ID NO: 56857 - RNA, 22 nt, Human
ugacacuuggaagcuuggcaac

SEQ ID NO: 56858 - RNA, 22 nt, Human
ugacacuuugugacucugagaa

SEQ ID NO: 56859 - RNA, 22 nt, Human
ugacagaaagaauaugucaauc

SEQ ID NO: 56860 - RNA, 22 nt, Human
ugacagaaauaguucuuaauuu

SEQ ID NO: 56861 - RNA, 22 nt, Human
ugacagaacagguugggagcaa

SEQ ID NO: 56862 - RNA, 22 nt, Human
ugacagaacuuuuucacaucuc

SEQ ID NO: 56863 - RNA, 22 nt, Human
ugagugagacauccugucuuaa

SEQ ID NO: 56864 - RNA, 22 nt, Human
ugagugagcuggggagccggug

SEQ ID NO: 56865 - RNA, 20 nt, Human
ugagugauggaggcggguca

SEQ ID NO: 56866 - RNA, 21 nt, Human
ugagugccaccugcuggccaa

SEQ ID NO: 56867 - RNA, 22 nt, Human
ugagugcuuuaaauguuauuuu

SEQ ID NO: 56868 - RNA, 18 nt, Human
ugaguggaaugagggggc

SEQ ID NO: 56869 - RNA, 22 nt, Human
ugaguggagacuguguguagag

SEQ ID NO: 56870 - RNA, 20 nt, Human
ugaguggccacugggucgca

SEQ ID NO: 56871 - RNA, 16 nt, Human
ugagugggagaagggg

SEQ ID NO: 56872 - RNA, 19 nt, Human
ugagugggagcccagguau

SEQ ID NO: 56873 - RNA, 22 nt, Human
ugagugggaugaguuagaggug

SEQ ID NO: 56874 - RNA, 22 nt, Human
ugagugggauuaaaugagguga

SEQ ID NO: 56875 - RNA, 22 nt, Human
ugagugugaggugggagcuugg

SEQ ID NO: 56876 - RNA, 22 nt, Human
ugagugugcuaggugucucggu

SEQ ID NO: 56877 - RNA, 22 nt, Human
ugaguguggggaaugucaugag

SEQ ID NO: 56878 - RNA, 22 nt, Human
ugaguguguauuauguaucagg

SEQ ID NO: 56879 - RNA, 21 nt, Human
ugaguuaaaaugucagugcca

SEQ ID NO: 56880 - RNA, 22 nt, Human
ugaguuaagcagguagcaagcu

SEQ ID NO: 56881 - RNA, 21 nt, Human
ugaguuaaggauccaauucug

SEQ ID NO: 56882 - RNA, 22 nt, Human
ugaguuaaucucuacgauagaa

SEQ ID NO: 56883 - RNA, 22 nt, Human
ugaguuacugccuaguaacuug

SEQ ID NO: 56884 - RNA, 22 nt, Human
ugaguuauauauacuggcucug

SEQ ID NO: 56885 - RNA, 22 nt, Human
ugaguuaucuaaaauagucaaa

SEQ ID NO: 56886 - RNA, 22 nt, Human
ugaguuauggagaauaaaguca

SEQ ID NO: 56887 - RNA, 22 nt, Human
ugaguucaaguccaaguugcug

SEQ ID NO: 56888 - RNA, 22 nt, Human
ugaguucagauccuggcucugc

SEQ ID NO: 56889 - RNA, 22 nt, Human
ugaguucuaggcuuaaaacuaa

SEQ ID NO: 56890 - RNA, 22 nt, Human
ugaguucuucacauuaccuacg

SEQ ID NO: 56891 - RNA, 22 nt, Human
ugaguugcccugcccugugcuu

SEQ ID NO: 56892 - RNA, 19 nt, Human
ugaguuuaaugcaaaacug

SEQ ID NO: 56893 - RNA, 22 nt, Human
ugaguuugguaucuaggggguc

SEQ ID NO: 56894 - RNA, 22 nt, Human
ugaguuuuguaauauucaagau

SEQ ID NO: 56895 - RNA, 22 nt, Human
ugauaauguucgagaaugaaga

SEQ ID NO: 56896 - RNA, 22 nt, Human
ugauacagaauugauaucugag

SEQ ID NO: 56897 - RNA, 22 nt, Human
ugauacagagcaagcaucuuuu

SEQ ID NO: 56898 - RNA, 22 nt, Human
ugauacccuuuggcugcgagca

SEQ ID NO: 56899 - RNA, 22 nt, Human
ugauagaaaaugcugucaagcu

SEQ ID NO: 56900 - RNA, 22 nt, Human
ugauagagcacuaaguagugua

SEQ ID NO: 56901 - RNA, 23 nt, Human
ugauagaugucauggucuugagu

SEQ ID NO: 56902 - RNA, 22 nt, Human
ugauauggaaggaagauguaca

SEQ ID NO: 56903 - RNA, 22 nt, Human
ugauauuugcugacugcauugu

SEQ ID NO: 56904 - RNA, 22 nt, Human
ugaucaaaacauuacuccacca

SEQ ID NO: 56905 - RNA, 22 nt, Human
ugaucacaagucugaagaauga

SEQ ID NO: 56906 - RNA, 22 nt, Human
ugaucagcaucuucccagcucg

SEQ ID NO: 56907 - RNA, 22 nt, Human
ugaucagucccaugaucuucca

SEQ ID NO: 56908 - RNA, 22 nt, Human
ugaucaguguugguucuaucua

SEQ ID NO: 56909 - RNA, 22 nt, Human
ugaucauccaguuucuugucca

SEQ ID NO: 56910 - RNA, 21 nt, Human
ugaucauuuguguaaaggaga

SEQ ID NO: 56911 - RNA, 22 nt, Human
ugauccccuucccaguaagccu

SEQ ID NO: 56912 - RNA, 22 nt, Human
ugaucccuggacuugaguaagu

SEQ ID NO: 56913 - RNA, 22 nt, Human
ugauccuuccccuugaggaugg

SEQ ID NO: 56914 - RNA, 21 nt, Human
ugauccuuucccccauguugc

SEQ ID NO: 56915 - RNA, 22 nt, Human
ugaucugaaggacaugggaccc

SEQ ID NO: 56916 - RNA, 22 nt, Human
ugaucugguccuacugugggca

SEQ ID NO: 56917 - RNA, 22 nt, Human
ugaucuuuacugcuguuuauaa

SEQ ID NO: 56918 - RNA, 22 nt, Human
ugaucuuugguaguacgauaau

SEQ ID NO: 56919 - RNA, 22 nt, Human
ugaucuuuuuggucauuugggu

SEQ ID NO: 56920 - RNA, 22 nt, Human
ugaugaaacugagguuccaaga

SEQ ID NO: 56921 - RNA, 22 nt, Human
ugaugaaauguugaggcaguga

SEQ ID NO: 56922 - RNA, 22 nt, Human
ugaugaauaaacuugagaguca

SEQ ID NO: 56923 - RNA, 22 nt, Human
ugaugacaaacuuuccugaugc

SEQ ID NO: 56924 - RNA, 22 nt, Human
ugaugaggagacuguggcuugg

SEQ ID NO: 56925 - RNA, 22 nt, Human
ugaugagggaacugguucauac

SEQ ID NO: 56926 - RNA, 22 nt, Human
ugaugagggagauuugagccca

SEQ ID NO: 56927 - RNA, 22 nt, Human
uugaggaggaaaaggggguacc

SEQ ID NO: 56928 - RNA, 22 nt, Human
uugaggagguaguacagaguau

SEQ ID NO: 56929 - RNA, 22 nt, Human
uugaggagguaugacuagguac

SEQ ID NO: 56930 - RNA, 22 nt, Human
uugaggagugugaggucuccca

SEQ ID NO: 56931 - RNA, 22 nt, Human
uugaggcacagauuuuaguggc

SEQ ID NO: 56932 - RNA, 22 nt, Human
uugaggcagcccuuaauuggga

SEQ ID NO: 56933 - RNA, 22 nt, Human
uugaggcauuacuguaaugaga

SEQ ID NO: 56934 - RNA, 22 nt, Human
uugaggccugcuggaagguguu

SEQ ID NO: 56935 - RNA, 22 nt, Human
uugagggaaauaacugaugcuu

SEQ ID NO: 56936 - RNA, 22 nt, Human
uugagggaacaugagaaucauc

SEQ ID NO: 56937 - RNA, 22 nt, Human
uugagggacuuucucuauuauu

SEQ ID NO: 56938 - RNA, 22 nt, Human
uugagggagauguugacuucag

SEQ ID NO: 56939 - RNA, 18 nt, Human
uugagggaggggcagagu

SEQ ID NO: 56940 - RNA, 22 nt, Human
uugagguaggcauuguucaaaa

SEQ ID NO: 56941 - RNA, 22 nt, Human
uugagguaggcggacuccucca

SEQ ID NO: 56942 - RNA, 22 nt, Human
uugagguaguggccuccaaaug

SEQ ID NO: 56943 - RNA, 22 nt, Human
uugagguauaguugacaauuua

SEQ ID NO: 56944 - RNA, 22 nt, Human
uugagguauugauauuuuauga

SEQ ID NO: 56945 - RNA, 22 nt, Human
uugaggucaucugaaguacuag

SEQ ID NO: 56946 - RNA, 22 nt, Human
uugagguccccaguacccacug

SEQ ID NO: 56947 - RNA, 23 nt, Human
uugaggucggcucucugagccug

SEQ ID NO: 56948 - RNA, 22 nt, Human
uugagucugcccaaauuaagaa

SEQ ID NO: 56949 - RNA, 22 nt, Human
uugagucugugcccuaugcugu

SEQ ID NO: 56950 - RNA, 23 nt, Human
uugagucuuauaggauugaggug

SEQ ID NO: 56951 - RNA, 22 nt, Human
uugaguucuggucuuuuaaaag

SEQ ID NO: 56952 - RNA, 22 nt, Human
uugaguuuccugacagcgaagg

SEQ ID NO: 56953 - RNA, 22 nt, Human
uugauacacaauggaacaaugu

SEQ ID NO: 56954 - RNA, 22 nt, Human
uugauacaggccuucuagauga

SEQ ID NO: 56955 - RNA, 22 nt, Human
uugauacaggcucuauuucauc

SEQ ID NO: 56956 - RNA, 22 nt, Human
uugauaucucugcuguguuagg

SEQ ID NO: 56957 - RNA, 22 nt, Human
uugauauucccgauuuaaggua

SEQ ID NO: 56958 - RNA, 22 nt, Human
uugaucucuuguguaugguaga

SEQ ID NO: 56959 - RNA, 22 nt, Human
uugaucuucaucgaaauauugu

SEQ ID NO: 56960 - RNA, 22 nt, Human
uugaucuuggacuuuccagccu

SEQ ID NO: 56961 - RNA, 22 nt, Human
uugaugagaccauugccgcguc

SEQ ID NO: 56962 - RNA, 22 nt, Human
uugaugaucuuacggcagagga

SEQ ID NO: 56963 - RNA, 22 nt, Human
uugauguaaacuuugauuucau

SEQ ID NO: 56964 - RNA, 22 nt, Human
uugauguaaagauaguuucugu

SEQ ID NO: 56965 - RNA, 22 nt, Human
uugauguagggauuccuguaaa

SEQ ID NO: 56966 - RNA, 22 nt, Human
uugauguagguuuaucuauugu

SEQ ID NO: 56967 - RNA, 22 nt, Human
uugauguugcucuuaacaguau

SEQ ID NO: 56968 - RNA, 22 nt, Human
uugauuaaaaugagacaucauu

SEQ ID NO: 56969 - RNA, 22 nt, Human
uugauucaaaacaggagguagg

SEQ ID NO: 56970 - RNA, 22 nt, Human
uugauucaguaaagcuaaauuu

SEQ ID NO: 56971 - RNA, 18 nt, Human
uugauucauauuaaccau

SEQ ID NO: 56972 - RNA, 22 nt, Human
ugauugauacaacucaauccaa

SEQ ID NO: 56973 - RNA, 22 nt, Human
ugauugauggaggugauuuacc

SEQ ID NO: 56974 - RNA, 22 nt, Human
ugauugcuucuuugcuaucugu

SEQ ID NO: 56975 - RNA, 22 nt, Human
ugauuuaaaagaaacauugucu

SEQ ID NO: 56976 - RNA, 22 nt, Human
ugauuuacaauuguaaaaguuu

SEQ ID NO: 56977 - RNA, 22 nt, Human
ugauuuacaguagugucuaaac

SEQ ID NO: 56978 - RNA, 22 nt, Human
ugauuucaaguagugacaugcu

SEQ ID NO: 56979 - RNA, 22 nt, Human
ugauuucauaguauauacauga

SEQ ID NO: 56980 - RNA, 21 nt, Human
ugauuuccaucuuaaaauaaa

SEQ ID NO: 56981 - RNA, 22 nt, Human
ugauuucccucaucauaacaga

SEQ ID NO: 56982 - RNA, 15 nt, Human
ugauuuccuacuaac

SEQ ID NO: 56983 - RNA, 22 nt, Human
ugauuuccucuacuagcaauua

SEQ ID NO: 56984 - RNA, 22 nt, Human
ugauuuccuggcuuuggaguuc

SEQ ID NO: 56985 - RNA, 22 nt, Human
ugauuucucuccguuauuucag

SEQ ID NO: 56986 - RNA, 22 nt, Human
ugauuuuauuggugaggaaauu

SEQ ID NO: 56987 - RNA, 22 nt, Human
ugauuuuuagcuauucugaaga

SEQ ID NO: 56988 - RNA, 22 nt, Human
ugcaaaaacagccuugaggccu

SEQ ID NO: 56989 - RNA, 22 nt, Human
ugcaaaaacugcaauugcuuuu

SEQ ID NO: 56990 - RNA, 22 nt, Human
ugcaaaauaaugaacgauuuuu

SEQ ID NO: 56991 - RNA, 22 nt, Human
ugcaaacaccacagagacaauu

SEQ ID NO: 56992 - RNA, 22 nt, Human
ugcaaacacuucaacgugcauc

SEQ ID NO: 56993 - RNA, 22 nt, Human
ugcaaacagaaaagcuacuuug

SEQ ID NO: 56994 - RNA, 20 nt, Human
ugcaaacauuacuugggugu

SEQ ID NO: 56995 - RNA, 22 nt, Human
ugcaaagaaggggaggaggauu

SEQ ID NO: 56996 - RNA, 22 nt, Human
ugcaaagauaugagaagcugua

SEQ ID NO: 56997 - RNA, 21 nt, Human
ugcaaagcugcugaaguggua

SEQ ID NO: 56998 - RNA, 22 nt, Human
ugcaaaggcaucugggaagguu

SEQ ID NO: 56999 - RNA, 22 nt, Human
ugcaaaguugcaucaaaaccca

SEQ ID NO: 57000 - RNA, 23 nt, Human
ugcaaauaacaaggaguuuaagg

SEQ ID NO: 57001 - RNA, 22 nt, Human
ugcaaauaagcuauuauggaau

SEQ ID NO: 57002 - RNA, 22 nt, Human
ugcaaauagccuauauuuauag

SEQ ID NO: 57003 - RNA, 22 nt, Human
ugcaaauauugggacagucuag

SEQ ID NO: 57004 - RNA, 22 nt, Human
ugcaaaucauaaacaauagugu

SEQ ID NO: 57005 - RNA, 22 nt, Human
ugcaaaugaguugcagaucagg

SEQ ID NO: 57006 - RNA, 18 nt, Human
ugcaaauggcuguuugau

SEQ ID NO: 57007 - RNA, 19 nt, Human
ugcaaauguaggaagaaua

SEQ ID NO: 57008 - RNA, 23 nt, Human
ugcaaauuaggccgggacucagc

SEQ ID NO: 57009 - RNA, 22 nt, Human
ugcaaauucaaacauuuuccug

SEQ ID NO: 57010 - RNA, 22 nt, Human
ugcaaauucagaagaacugccc

SEQ ID NO: 57011 - RNA, 22 nt, Human
ugcaaauuccauuuaaacacua

SEQ ID NO: 57012 - RNA, 22 nt, Human
ugcaaauucuuuacucugugau

SEQ ID NO: 57013 - RNA, 22 nt, Human
ugcaaauugcaugauguguauc

SEQ ID NO: 57014 - RNA, 22 nt, Human
ugcaaauuuaaugaaacuaugu

SEQ ID NO: 57015 - RNA, 22 nt, Human
ugcaaauuugacuucacacauc

SEQ ID NO: 57016 - RNA, 22 nt, Human
ugcaacagacuuuauuaacucu

SEQ ID NO: 57017 - RNA, 22 nt, Human
ugcaacaguggggcaugcugaa

SEQ ID NO: 57018 - RNA, 22 nt, Human
ugcaaccugacccagccagccc

SEQ ID NO: 57019 - RNA, 22 nt, Human
ugcaacuuguuuggagagaaag

SEQ ID NO: 57020 - RNA, 22 nt, Human
ugcaagacgugaaauugagaca

SEQ ID NO: 57021 - RNA, 22 nt, Human
ugcaagagcccaccacacacuu

SEQ ID NO: 57022 - RNA, 22 nt, Human
ugcaagaggcaucuuuuaaaaa

SEQ ID NO: 57023 - RNA, 22 nt, Human
ugcaagaucacgguguugagag

SEQ ID NO: 57024 - RNA, 22 nt, Human
ugcaagcaaguuuuugaagugg

SEQ ID NO: 57025 - RNA, 22 nt, Human
ugcaagcaauccaggaaggcua

SEQ ID NO: 57026 - RNA, 22 nt, Human
ugcaaggauauuuagucuagug

SEQ ID NO: 57027 - RNA, 20 nt, Human
ugcaaggccagggucaggag

SEQ ID NO: 57028 - RNA, 22 nt, Human
ugcaaggcugccucugaggacc

SEQ ID NO: 57029 - RNA, 22 nt, Human
ugcaaggcuugcaauggugauc

SEQ ID NO: 57030 - RNA, 22 nt, Human
ugcaagguccaguauaacuuaa

SEQ ID NO: 57031 - RNA, 22 nt, Human
ugcaaggugcuuuuugguguca

SEQ ID NO: 57032 - RNA, 22 nt, Human
ugcaaguaauuccagcuacuga

SEQ ID NO: 57033 - RNA, 22 nt, Human
ugcaagugccaugugcacagug

SEQ ID NO: 57034 - RNA, 22 nt, Human
ugcaauaaggaguaauaguaaa

SEQ ID NO: 57035 - RNA, 22 nt, Human
ugcaaucagaaaguucagcggu

SEQ ID NO: 57036 - RNA, 22 nt, Human
ugcaaugaauuacuucccaaac

SEQ ID NO: 57037 - RNA, 22 nt, Human
ugcaaugagaauauauuaacca

SEQ ID NO: 57038 - RNA, 22 nt, Human
ugcaauuuggggaagaaagaga

SEQ ID NO: 57039 - RNA, 22 nt, Human
ugcacaaaggcucccugcugag

SEQ ID NO: 57040 - RNA, 22 nt, Human
ugaccuuucucugggugcuugg

SEQ ID NO: 57041 - RNA, 22 nt, Human
ugacggcugggggcagugguca

SEQ ID NO: 57042 - RNA, 22 nt, Human
ugacuaaaauaggacauuaacu

SEQ ID NO: 57043 - RNA, 22 nt, Human
ugacuauguggccuugaccaag

SEQ ID NO: 57044 - RNA, 22 nt, Human
ugacuauuuuuuauagauucca

SEQ ID NO: 57045 - RNA, 22 nt, Human
ugacucaccaucggaguuugaa

SEQ ID NO: 57046 - RNA, 18 nt, Human
ugacucacccugucagug

SEQ ID NO: 57047 - RNA, 22 nt, Human
ugacucacuuaauuuacaaguc

SEQ ID NO: 57048 - RNA, 22 nt, Human
ugacuccacaauuugacuuaua

SEQ ID NO: 57049 - RNA, 22 nt, Human
ugacucucccaaguuugaggga

SEQ ID NO: 57050 - RNA, 20 nt, Human
ugacucugcaaccgucucuc

SEQ ID NO: 57051 - RNA, 20 nt, Human
ugacucuggucccaguauga

SEQ ID NO: 57052 - RNA, 22 nt, Human
ugacucuuaaauauacuguuga

SEQ ID NO: 57053 - RNA, 22 nt, Human
ugacucuuggugauuacugggu

SEQ ID NO: 57054 - RNA, 22 nt, Human
ugacugccccuuccauuccugc

SEQ ID NO: 57055 - RNA, 17 nt, Human
ugacuuaacagcaaggc

SEQ ID NO: 57056 - RNA, 22 nt, Human
ugacuuccagcaacuuccucca

SEQ ID NO: 57057 - RNA, 22 nt, Human
ugacuuccugcacucaggugau

SEQ ID NO: 57058 - RNA, 22 nt, Human
ugacuucucuggccuggugcag

SEQ ID NO: 57059 - RNA, 22 nt, Human
ugacuucugauugcuucuauuu

SEQ ID NO: 57060 - RNA, 20 nt, Human
ugacuucugggauuuguggu

SEQ ID NO: 57061 - RNA, 22 nt, Human
ugacuucugggugagccagcau

SEQ ID NO: 57062 - RNA, 22 nt, Human
ugacuugucaaagaaaugugug

SEQ ID NO: 57063 - RNA, 22 nt, Human
ugacuuuaaaauaacaaguuua

SEQ ID NO: 57064 - RNA, 21 nt, Human
ugacuuuauauugugucagga

SEQ ID NO: 57065 - RNA, 21 nt, Human
ugacuuuauuugacagcccag

SEQ ID NO: 57066 - RNA, 17 nt, Human
ugacuuuauuugcuugg

SEQ ID NO: 57067 - RNA, 22 nt, Human
ugacuuuggauaagaaaaugag

SEQ ID NO: 57068 - RNA, 22 nt, Human
ugacuuuggcuuaagcagcagu

SEQ ID NO: 57069 - RNA, 22 nt, Human
ugagaaaaguacauggagaagc

SEQ ID NO: 57070 - RNA, 22 nt, Human
ugagaaacacaggcaugaauag

SEQ ID NO: 57071 - RNA, 22 nt, Human
ugagaaacauaugagagauuug

SEQ ID NO: 57072 - RNA, 20 nt, Human
ugagaaaguagagacucagg

SEQ ID NO: 57073 - RNA, 22 nt, Human
ugagaaauauugcacagugagg

SEQ ID NO: 57074 - RNA, 22 nt, Human
ugagaaaugggucugcugaaga

SEQ ID NO: 57075 - RNA, 22 nt, Human
ugagaacauacaaacagagaaa

SEQ ID NO: 57076 - RNA, 22 nt, Human
ugagaacauugggaaagcuaug

SEQ ID NO: 57077 - RNA, 22 nt, Human
ugagaacauuugcagggagagu

SEQ ID NO: 57078 - RNA, 22 nt, Human
ugagaaccaugaaaagcuguca

SEQ ID NO: 57079 - RNA, 22 nt, Human
ugagaaccucgaagauuuugcc

SEQ ID NO: 57080 - RNA, 22 nt, Human
ugagaacugaggauuugaauuc

SEQ ID NO: 57081 - RNA, 22 nt, Human
ugauucaguugguuuuguucag

SEQ ID NO: 57082 - RNA, 22 nt, Human
ugauucaucagaauaggaguuu

SEQ ID NO: 57083 - RNA, 22 nt, Human
ugauuccugugcuuauuccagu

SEQ ID NO: 57084 - RNA, 22 nt, Human
ugauucuauggaaggcauaagg

SEQ ID NO: 57085 - RNA, 22 nt, Human
ugauucucaaagguagacuggg

SEQ ID NO: 57086 - RNA, 22 nt, Human
ugauucucugauggagaaagac

SEQ ID NO: 57087 - RNA, 22 nt, Human
ugauucugaucaucaucauggu

SEQ ID NO: 57088 - RNA, 22 nt, Human
ugauucugccccuuggcucugg

SEQ ID NO: 57089 - RNA, 22 nt, Human
ugauucugcuuugauccuugug

SEQ ID NO: 57090 - RNA, 18 nt, Human
ugauucugugaugugguc

SEQ ID NO: 57091 - RNA, 22 nt, Human
ugauucuguucuccuugagaau

SEQ ID NO: 57092 - RNA, 22 nt, Human
ugauucuuucuccaccaauuca

SEQ ID NO: 57093 - RNA, 22 nt, Human
ugauugaauucaaaugcaaucu

SEQ ID NO: 57094 - RNA, 22 nt, Human
ugauuguuuccuauguacaccu

SEQ ID NO: 57095 - RNA, 22 nt, Human
ugauuuacacaucaaagcagca

SEQ ID NO: 57096 - RNA, 22 nt, Human
ugauuuacccguccaggcccua

SEQ ID NO: 57097 - RNA, 22 nt, Human
ugauuuacucccacuuagagcc

SEQ ID NO: 57098 - RNA, 22 nt, Human
ugauuuaggaaacagcuacagg

SEQ ID NO: 57099 - RNA, 22 nt, Human
ugauuuccaaaaggcuucuaag

SEQ ID NO: 57100 - RNA, 22 nt, Human
ugauuuccaguugcugggugcu

SEQ ID NO: 57101 - RNA, 22 nt, Human
ugauuuccugugcgcccuuagg

SEQ ID NO: 57102 - RNA, 22 nt, Human
ugauuucucuuggcaauauguu

SEQ ID NO: 57103 - RNA, 22 nt, Human
ugauuugauucuucuuggagua

SEQ ID NO: 57104 - RNA, 22 nt, Human
ugauuugcauggagaauaacag

SEQ ID NO: 57105 - RNA, 22 nt, Human
ugauuuuacuuagcaugauguu

SEQ ID NO: 57106 - RNA, 20 nt, Human
ugauuuucugaaacagcaca

SEQ ID NO: 57107 - RNA, 22 nt, Human
ugauuuuuggaucugagcugca

SEQ ID NO: 57108 - RNA, 22 nt, Human
ugcaaaaagagcgaggagcccu

SEQ ID NO: 57109 - RNA, 22 nt, Human
ugcaaaaaggcagacuggugau

SEQ ID NO: 57110 - RNA, 17 nt, Human
ugcaaacaaucacauau

SEQ ID NO: 57111 - RNA, 22 nt, Human
ugcaaacagaaaguuuauugug

SEQ ID NO: 57112 - RNA, 22 nt, Human
ugcaaacuagcaucaacuagua

SEQ ID NO: 57113 - RNA, 22 nt, Human
ugcaaagaagcaacauccuugu

SEQ ID NO: 57114 - RNA, 22 nt, Human
ugcaaagaagccuuugccuucu

SEQ ID NO: 57115 - RNA, 22 nt, Human
ugcaaagauuuaucuuucucca

SEQ ID NO: 57116 - RNA, 22 nt, Human
ugcaaagcaauguaggucagcu

SEQ ID NO: 57117 - RNA, 22 nt, Human
ugcaaagucgcaaaauucuucu

SEQ ID NO: 57118 - RNA, 22 nt, Human
ugcaaagugcuagcccacacca

SEQ ID NO: 57119 - RNA, 22 nt, Human
ugcaaaguugaggaaggcaugg

SEQ ID NO: 57120 - RNA, 22 nt, Human
ugcaaaugaugaaacuaacuuu

SEQ ID NO: 57121 - RNA, 22 nt, Human
ugcaaaugcccauuuauuuucu

SEQ ID NO: 57122 - RNA, 22 nt, Human
ugcaaaugggaaacccagcagu

SEQ ID NO: 57123 - RNA, 22 nt, Human
ugcaaaugucaaggguuagugu

SEQ ID NO: 57124 - RNA, 22 nt, Human
ugcaaauugcgauuuuuauuag

SEQ ID NO: 57125 - RNA, 22 nt, Human
ugcaaccugcacucugucuuua

SEQ ID NO: 57126 - RNA, 22 nt, Human
ugcaacucuggaucuucuggua

SEQ ID NO: 57127 - RNA, 22 nt, Human
ugcaagaaacauauuccacaag

SEQ ID NO: 57128 - RNA, 22 nt, Human
ugcaagaaggcaauaaacucuu

SEQ ID NO: 57129 - RNA, 21 nt, Human
ugcaagaaucaggaagcugcc

SEQ ID NO: 57130 - RNA, 22 nt, Human
ugcaagaaugacccaucuaccc

SEQ ID NO: 57131 - RNA, 22 nt, Human
ugcaagagcccaaacuauauac

SEQ ID NO: 57132 - RNA, 22 nt, Human
ugcaagagcccagggccaggaa

SEQ ID NO: 57133 - RNA, 22 nt, Human
ugcaagagcuguggcaaaagca

SEQ ID NO: 57134 - RNA, 22 nt, Human
ugcaagaggaauucuagaagca

SEQ ID NO: 57135 - RNA, 22 nt, Human
ugcaagaggagacuguacucag

SEQ ID NO: 57136 - RNA, 22 nt, Human
ugcaagaggauuguaucaauaa

SEQ ID NO: 57137 - RNA, 22 nt, Human
ugcaagagguaaaaugaaagga

SEQ ID NO: 57138 - RNA, 22 nt, Human
ugcaagauauuaucuuugcugc

SEQ ID NO: 57139 - RNA, 22 nt, Human
ugcaagaucuugucucugccac

SEQ ID NO: 57140 - RNA, 22 nt, Human
ugcaaggaagggacagcugaga

SEQ ID NO: 57141 - RNA, 22 nt, Human
ugcaaggcuauucacauguauu

SEQ ID NO: 57142 - RNA, 22 nt, Human
ugcaagggguuuaugcagauga

SEQ ID NO: 57143 - RNA, 22 nt, Human
ugcaaggguagaagugauggca

SEQ ID NO: 57144 - RNA, 22 nt, Human
ugcaaguaguccagccuuuggg

SEQ ID NO: 57145 - RNA, 22 nt, Human
ugcaaguaugacagccccaugg

SEQ ID NO: 57146 - RNA, 22 nt, Human
ugcaagugauucuguuuucuca

SEQ ID NO: 57147 - RNA, 22 nt, Human
ugcaauaacccaugagauagaa

SEQ ID NO: 57148 - RNA, 22 nt, Human
ugcaauaacuacuuuaauguug

SEQ ID NO: 57149 - RNA, 22 nt, Human
ugcaauaauguaugucacuccc

SEQ ID NO: 57150 - RNA, 22 nt, Human
ugcaauauuuggcacugagaug

SEQ ID NO: 57151 - RNA, 19 nt, Human
ugcaaucagcuacccaggu

SEQ ID NO: 57152 - RNA, 22 nt, Human
ugcaauccacuauucuaaagcc

SEQ ID NO: 57153 - RNA, 22 nt, Human
ugcaaugauauugucaaagcau

SEQ ID NO: 57154 - RNA, 21 nt, Human
ugcaaugcauugacagcagca

SEQ ID NO: 57155 - RNA, 23 nt, Human
ugcaauggcaugauuucagcuca

SEQ ID NO: 57156 - RNA, 22 nt, Human
ugcaauuacugggagguuuuau

SEQ ID NO: 57157 - RNA, 22 nt, Human
ugcaauuagcauuguauucuua

SEQ ID NO: 57158 - RNA, 22 nt, Human
ugcaauuuaugugcaagugguu

SEQ ID NO: 57159 - RNA, 22 nt, Human
ugcacaaacuugugucccaggg

SEQ ID NO: 57160 - RNA, 22 nt, Human
ugcacaaauuuguguaugcuca

SEQ ID NO: 57161 - RNA, 17 nt, Human
ugcacaagagacaauag

SEQ ID NO: 57162 - RNA, 22 nt, Human
ugcacacacggagauaggcuuu

SEQ ID NO: 57163 - RNA, 22 nt, Human
ugcacacacucguguauaugag

SEQ ID NO: 57164 - RNA, 19 nt, Human
ugcacacagauaaguaucu

SEQ ID NO: 57165 - RNA, 22 nt, Human
ugcacacaguucucaggaaaga

SEQ ID NO: 57166 - RNA, 22 nt, Human
ugcacacauaugagcaugugug

SEQ ID NO: 57167 - RNA, 22 nt, Human
ugcacagagcaggcaccagcgg

SEQ ID NO: 57168 - RNA, 22 nt, Human
ugcacagagggaggcauaaaau

SEQ ID NO: 57169 - RNA, 22 nt, Human
ugcacagaucugguggcaagga

SEQ ID NO: 57170 - RNA, 22 nt, Human
ugcacagcgggugucugucagg

SEQ ID NO: 57171 - RNA, 22 nt, Human
uggaacaaacauggugauggcu

SEQ ID NO: 57172 - RNA, 22 nt, Human
uggaacaaauuuuggggaccuu

SEQ ID NO: 57173 - RNA, 22 nt, Human
uggaacaacucccucggagccu

SEQ ID NO: 57174 - RNA, 22 nt, Human
uggaacaagaagcaggucgcuu

SEQ ID NO: 57175 - RNA, 22 nt, Human
uggaacaagacagcauagagcu

SEQ ID NO: 57176 - RNA, 22 nt, Human
uggaacaaucccgguuuagcuc

SEQ ID NO: 57177 - RNA, 22 nt, Human
uggaacacaagucauugagggg

SEQ ID NO: 57178 - RNA, 22 nt, Human
uggaacacaucuaaggaagcag

SEQ ID NO: 57179 - RNA, 22 nt, Human
uggaaccuggcauuagggacac

SEQ ID NO: 57180 - RNA, 22 nt, Human
uggaaccuggccugagcuacca

SEQ ID NO: 57181 - RNA, 22 nt, Human
uggaacuaagguagaaacuauu

SEQ ID NO: 57182 - RNA, 22 nt, Human
uggaagaaaauucaaucgaguu

SEQ ID NO: 57183 - RNA, 20 nt, Human
uggaagaagaacucaggcuu

SEQ ID NO: 57184 - RNA, 22 nt, Human
uggaagaagcuacaagcgguga

SEQ ID NO: 57185 - RNA, 22 nt, Human
uggaagacaauguacaugcagu

SEQ ID NO: 57186 - RNA, 20 nt, Human
uggaagacacugaagggcca

SEQ ID NO: 57187 - RNA, 22 nt, Human
uggaagacagugacugguugug

SEQ ID NO: 57188 - RNA, 22 nt, Human
uggaagagggagcuggguggcc

SEQ ID NO: 57189 - RNA, 22 nt, Human
uggaagagguggaaguggcuuc

SEQ ID NO: 57190 - RNA, 22 nt, Human
uggagcugagcaccuccagggc

SEQ ID NO: 57191 - RNA, 18 nt, Human
uggagcugagggcaaugc

SEQ ID NO: 57192 - RNA, 22 nt, Human
uggagcugauacagcuggcuuu

SEQ ID NO: 57193 - RNA, 22 nt, Human
uggagcugggaguccugggcug

SEQ ID NO: 57194 - RNA, 22 nt, Human
uggagcugggauuugaacugca

SEQ ID NO: 57195 - RNA, 23 nt, Human
uggagcugggcagcugggaaagu

SEQ ID NO: 57196 - RNA, 22 nt, Human
uggagcuguagccaccacccug

SEQ ID NO: 57197 - RNA, 22 nt, Human
uggaggaaaaaaccaggcagag

SEQ ID NO: 57198 - RNA, 23 nt, Human
uggaggaaacacaucagaagacc

SEQ ID NO: 57199 - RNA, 22 nt, Human
uggaggaaguggcuggccagaa

SEQ ID NO: 57200 - RNA, 22 nt, Human
uggaggaaguugcuggaaguca

SEQ ID NO: 57201 - RNA, 22 nt, Human
uggaggacguguccaccaugaa

SEQ ID NO: 57202 - RNA, 22 nt, Human
uggaggagaauuuauggucgaa

SEQ ID NO: 57203 - RNA, 22 nt, Human
uggaggaugccauccaggauac

SEQ ID NO: 57204 - RNA, 22 nt, Human
uggaggaugccuggggaggccu

SEQ ID NO: 57205 - RNA, 22 nt, Human
uggaggauuaaucuggaaagau

SEQ ID NO: 57206 - RNA, 19 nt, Human
uggaggcaagacauggagg

SEQ ID NO: 57207 - RNA, 22 nt, Human
uggaggcacuaaauggccacaa

SEQ ID NO: 57208 - RNA, 22 nt, Human
uggaggcaggagacagggcaaa

SEQ ID NO: 57209 - RNA, 22 nt, Human
uggaggcauaggccugggcccu

SEQ ID NO: 57210 - RNA, 22 nt, Human
uggaggcaucagagugcuuggc

SEQ ID NO: 57211 - RNA, 22 nt, Human
uggaggcauugugacugcugaa

SEQ ID NO: 57212 - RNA, 22 nt, Human
uggaggccaaggcaggcggauc

SEQ ID NO: 57213 - RNA, 22 nt, Human
uggaggccaggaaggcagcgag

SEQ ID NO: 57214 - RNA, 20 nt, Human
uggaggccaggauacuuugu

SEQ ID NO: 57215 - RNA, 22 nt, Human
uggaggccauaccuccugacau

SEQ ID NO: 57216 - RNA, 22 nt, Human
uggaggcccccaggcaacagca

SEQ ID NO: 57217 - RNA, 22 nt, Human
uggaggccgaauuagagcguug

SEQ ID NO: 57218 - RNA, 22 nt, Human
uggaggcugguuucugcugagg

SEQ ID NO: 57219 - RNA, 22 nt, Human
uggagggaacccaggcugcucu

SEQ ID NO: 57220 - RNA, 22 nt, Human
uggaggggcaauggagcgcgga

SEQ ID NO: 57221 - RNA, 22 nt, Human
uggagggucaccccuugcugag

SEQ ID NO: 57222 - RNA, 22 nt, Human
uggaggucgcuagcgagcgggc

SEQ ID NO: 57223 - RNA, 22 nt, Human
uggaggucuuacccagggcuau

SEQ ID NO: 57224 - RNA, 22 nt, Human
uggagguggcacaagggagguc

SEQ ID NO: 57225 - RNA, 22 nt, Human
uggagguggggcucaggaaucu

SEQ ID NO: 57226 - RNA, 20 nt, Human
uggagguggucugcuguccu

SEQ ID NO: 57227 - RNA, 22 nt, Human
uggagguguauaagguagcuuc

SEQ ID NO: 57228 - RNA, 23 nt, Human
uggagguuuuacugaguugagga

SEQ ID NO: 57229 - RNA, 22 nt, Human
uggagucaguggcuauugggca

SEQ ID NO: 57230 - RNA, 22 nt, Human
uggagucaucuuaaucuaggca

SEQ ID NO: 57231 - RNA, 22 nt, Human
uggagucaugauggcugcugau

SEQ ID NO: 57232 - RNA, 20 nt, Human
uggagucugacagaugggua

SEQ ID NO: 57233 - RNA, 22 nt, Human
uggagugcaguugggaggacac

SEQ ID NO: 57234 - RNA, 20 nt, Human
uggagugcuguguugagaag

SEQ ID NO: 57235 - RNA, 22 nt, Human
uggaguggacuucaugaggcca

SEQ ID NO: 57236 - RNA, 22 nt, Human
uggaguuaaaaacaggaugcac

SEQ ID NO: 57237 - RNA, 22 nt, Human
uggaguuagauaaaccugggua

SEQ ID NO: 57238 - RNA, 22 nt, Human
uggaguuccuuugaaaggcucu

SEQ ID NO: 57239 - RNA, 22 nt, Human
uggaguugugucaucuuuguaa

SEQ ID NO: 57240 - RNA, 23 nt, Human
uggauaaaauacuuacauucaac

SEQ ID NO: 57241 - RNA, 21 nt, Human
uggauaaaggcacuuuucauc

SEQ ID NO: 57242 - RNA, 22 nt, Human
uggauaaauagauacacuugca

SEQ ID NO: 57243 - RNA, 22 nt, Human
uggaucugguucccugagccuu

SEQ ID NO: 57244 - RNA, 22 nt, Human
uggaucuucacaagagagggcg

SEQ ID NO: 57245 - RNA, 22 nt, Human
uggaugagauuaaagugagguu

SEQ ID NO: 57246 - RNA, 22 nt, Human
uggaugagucugagauugggca

SEQ ID NO: 57247 - RNA, 22 nt, Human
uggauggccccacuggauccau

SEQ ID NO: 57248 - RNA, 22 nt, Human
uggaugugagaaggaucaggcu

SEQ ID NO: 57249 - RNA, 22 nt, Human
uggaugugucgcccuggcucuc

SEQ ID NO: 57250 - RNA, 22 nt, Human
uggauuaaagauuaaaaugaca

SEQ ID NO: 57251 - RNA, 22 nt, Human
uggauuagugcugaaaugaugg

SEQ ID NO: 57252 - RNA, 22 nt, Human
uggauuaguuaagaaauguuag

SEQ ID NO: 57253 - RNA, 22 nt, Human
uggauuaguuucaaggcagcaa

SEQ ID NO: 57254 - RNA, 22 nt, Human
uggauuauuguaagacaaagua

SEQ ID NO: 57255 - RNA, 22 nt, Human
uggauuuaccacagggccacag

SEQ ID NO: 57256 - RNA, 22 nt, Human
uggauuuauggagaccgaaagu

SEQ ID NO: 57257 - RNA, 22 nt, Human
uggauuuauuagguuggugaaa

SEQ ID NO: 57258 - RNA, 22 nt, Human
uggauuuccagacagcuuaauu

SEQ ID NO: 57259 - RNA, 22 nt, Human
uggcaaaaguuuuagguuauuu

SEQ ID NO: 57260 - RNA, 22 nt, Human
uggcaaagacgcuagcuaagau

SEQ ID NO: 57261 - RNA, 22 nt, Human
uggcaaagacugcaaggacuuu

SEQ ID NO: 57262 - RNA, 22 nt, Human
uggcaaagaugguucucaccau

SEQ ID NO: 57263 - RNA, 22 nt, Human
uggcaaaguuuaucaggaauau

SEQ ID NO: 57264 - RNA, 22 nt, Human
uggcaaauauuuuguuuuguaa

SEQ ID NO: 57265 - RNA, 22 nt, Human
uggcaaauuccaaaguuaauuc

SEQ ID NO: 57266 - RNA, 22 nt, Human
uggcaaccagguggucuagggu

SEQ ID NO: 57267 - RNA, 17 nt, Human
uggcaagaauggaaaug

SEQ ID NO: 57268 - RNA, 17 nt, Human
uggcaagacagcucagg

SEQ ID NO: 57269 - RNA, 22 nt, Human
uggcaagccugagauccgggag

SEQ ID NO: 57270 - RNA, 22 nt, Human
uggcaagcuggguuggguagcc

SEQ ID NO: 57271 - RNA, 22 nt, Human
uggcaaggccacaggugcaguu

SEQ ID NO: 57272 - RNA, 22 nt, Human
uggcaaguggcauagaauagcc

SEQ ID NO: 57273 - RNA, 22 nt, Human
uggcaauauccacaauuacuuu

SEQ ID NO: 57274 - RNA, 22 nt, Human
uggcacacagagaagacacuug

SEQ ID NO: 57275 - RNA, 20 nt, Human
uggcacagaacccuugccua

SEQ ID NO: 57276 - RNA, 22 nt, Human
uggcacagacagcacagcaaug

SEQ ID NO: 57277 - RNA, 22 nt, Human
uggcacagaccuuaucuucucu

SEQ ID NO: 57278 - RNA, 22 nt, Human
uggcacagagggacccagcagc

SEQ ID NO: 57279 - RNA, 22 nt, Human
uggcacagccaucuucuccugc

SEQ ID NO: 57280 - RNA, 22 nt, Human
uggcacaggcgguaagggugug

SEQ ID NO: 57281 - RNA, 22 nt, Human
uggcacauccacagaaucugga

SEQ ID NO: 57282 - RNA, 22 nt, Human
uggcacaugguaagacucagua

SEQ ID NO: 57283 - RNA, 22 nt, Human
uggcaccaaaagcagacguauu

SEQ ID NO: 57284 - RNA, 22 nt, Human
uggcaccaccagacaccaggag

SEQ ID NO: 57285 - RNA, 23 nt, Human
uggcaccaggcauucuaggggua

SEQ ID NO: 57286 - RNA, 16 nt, Human
uuguggcuuuugcaca

SEQ ID NO: 57287 - RNA, 20 nt, Human
uugugguuuagauuaucuga

SEQ ID NO: 57288 - RNA, 22 nt, Human
uuguguaacuugagcaaacaca

SEQ ID NO: 57289 - RNA, 22 nt, Human
uuguguaagaugcaauauggua

SEQ ID NO: 57290 - RNA, 22 nt, Human
uuguguaaugaaguuaucaugu

SEQ ID NO: 57291 - RNA, 22 nt, Human
uugugucccccuuugagagcca

SEQ ID NO: 57292 - RNA, 22 nt, Human
uugugucccuggagcuucugug

SEQ ID NO: 57293 - RNA, 21 nt, Human
uuguguccuucuaaagggcca

SEQ ID NO: 57294 - RNA, 22 nt, Human
uugugucuggauuucagcuuuc

SEQ ID NO: 57295 - RNA, 22 nt, Human
uugugugacuccuagaguagag

SEQ ID NO: 57296 - RNA, 22 nt, Human
uugugugucuucuucacugccc

SEQ ID NO: 57297 - RNA, 22 nt, Human
uugugugugagccuucaccaca

SEQ ID NO: 57298 - RNA, 22 nt, Human
uuguguguuuguagaaaaucca

SEQ ID NO: 57299 - RNA, 22 nt, Human
ugcaccuuuuagaagucauuuu

SEQ ID NO: 57300 - RNA, 22 nt, Human
ugcacuacugugauacacagcc

SEQ ID NO: 57301 - RNA, 22 nt, Human
ugcacugggaaagaaggaggga

SEQ ID NO: 57302 - RNA, 22 nt, Human
ugcacugguggugagugaggga

SEQ ID NO: 57303 - RNA, 23 nt, Human
ugcacuucuccauagaugcaucu

SEQ ID NO: 57304 - RNA, 22 nt, Human
ugcacuugaggauuuuccacag

SEQ ID NO: 57305 - RNA, 21 nt, Human
ugcacuuugggggacaggcug

SEQ ID NO: 57306 - RNA, 22 nt, Human
ugcagaaagucacauucccuuu

SEQ ID NO: 57307 - RNA, 22 nt, Human
ugcagaaccaguccucagaccc

SEQ ID NO: 57308 - RNA, 22 nt, Human
ugcagaagaaaacagcugugug

SEQ ID NO: 57309 - RNA, 20 nt, Human
ugcagaagaacguucugguu

SEQ ID NO: 57310 - RNA, 19 nt, Human
ugcagaagacacaguggug

SEQ ID NO: 57311 - RNA, 22 nt, Human
ugcagaagcagagaguugccaa

SEQ ID NO: 57312 - RNA, 22 nt, Human
ugcagaagcugcaggucagugg

SEQ ID NO: 57313 - RNA, 22 nt, Human
ugcagaaguauuccaggcccca

SEQ ID NO: 57314 - RNA, 22 nt, Human
ugcagaauauucuggugacaau

SEQ ID NO: 57315 - RNA, 23 nt, Human
ugcagacuucgaggagggggaua

SEQ ID NO: 57316 - RNA, 22 nt, Human
ugcagagaaaacuccuggguac

SEQ ID NO: 57317 - RNA, 22 nt, Human
ugcagagaagaggacaguucua

SEQ ID NO: 57318 - RNA, 22 nt, Human
ugcagagagauccucaggguuu

SEQ ID NO: 57319 - RNA, 22 nt, Human
ugcagagauugaacaagaagga

SEQ ID NO: 57320 - RNA, 20 nt, Human
ugcagagcugacauuaccug

SEQ ID NO: 57321 - RNA, 22 nt, Human
ugcagaggcccagcgguucuuc

SEQ ID NO: 57322 - RNA, 19 nt, Human
ugcagaggguaggaaggcc

SEQ ID NO: 57323 - RNA, 22 nt, Human
ugcagaguaaaagcagaugcua

SEQ ID NO: 57324 - RNA, 22 nt, Human
ugcagaguagcuauaccauuuu

SEQ ID NO: 57325 - RNA, 22 nt, Human
ugcagaguagugaggggacaga

SEQ ID NO: 57326 - RNA, 22 nt, Human
ugcagagucacccagauaauua

SEQ ID NO: 57327 - RNA, 22 nt, Human
ugcagagugaggaagaacugca

SEQ ID NO: 57328 - RNA, 22 nt, Human
ugcagaguggauucuguauacc

SEQ ID NO: 57329 - RNA, 21 nt, Human
ugcagauaauugaaagcugac

SEQ ID NO: 57330 - RNA, 22 nt, Human
ugcagauacaguauguggaagc

SEQ ID NO: 57331 - RNA, 22 nt, Human
ugcagcaaauggggcccguccu

SEQ ID NO: 57332 - RNA, 23 nt, Human
ugcagcaaccuuggaagcauuuc

SEQ ID NO: 57333 - RNA, 22 nt, Human
ugcagcaagaccggauaugucg

SEQ ID NO: 57334 - RNA, 22 nt, Human
ugcagcaaggggcccugauagg

SEQ ID NO: 57335 - RNA, 22 nt, Human
ugcagcaauggucccugcccuc

SEQ ID NO: 57336 - RNA, 22 nt, Human
ugcagcaauuuuuuaggcauuc

SEQ ID NO: 57337 - RNA, 22 nt, Human
ugcagcagaauauggcugcagg

SEQ ID NO: 57338 - RNA, 21 nt, Human
ugcagcagaguaagcagggga

SEQ ID NO: 57339 - RNA, 22 nt, Human
ugcagcagcagggaggaggcuc

SEQ ID NO: 57340 - RNA, 22 nt, Human
ugcagcaggagccaggccuggu

SEQ ID NO: 57341 - RNA, 22 nt, Human
ugcagcagggaccucuauguga

SEQ ID NO: 57342 - RNA, 22 nt, Human
ugcagcagucagucaggccugg

SEQ ID NO: 57343 - RNA, 22 nt, Human
ugcagccaauucauucauucuu

SEQ ID NO: 57344 - RNA, 22 nt, Human
ugcagccacaugaccugggucu

SEQ ID NO: 57345 - RNA, 22 nt, Human
ugcagccaccaccucugcugaa

SEQ ID NO: 57346 - RNA, 22 nt, Human
ugcagccagacuuugugcgaaa

SEQ ID NO: 57347 - RNA, 22 nt, Human
ugcagccagcaagugaauacau

SEQ ID NO: 57348 - RNA, 22 nt, Human
ugcagccaggaaauauuugcug

SEQ ID NO: 57349 - RNA, 22 nt, Human
ugcagccaucgcagagucugua

SEQ ID NO: 57350 - RNA, 22 nt, Human
ugcagccauuuucugccaaugc

SEQ ID NO: 57351 - RNA, 22 nt, Human
ugcagcccagccccagaaccuu

SEQ ID NO: 57352 - RNA, 22 nt, Human
ugcagccugguggucacuggag

SEQ ID NO: 57353 - RNA, 22 nt, Human
ugcagcucaagcuggugaggug

SEQ ID NO: 57354 - RNA, 22 nt, Human
ugcagcucugggguaaggggug

SEQ ID NO: 57355 - RNA, 22 nt, Human
ugcagcucuguaugcugauuau

SEQ ID NO: 57356 - RNA, 22 nt, Human
ugcagcugaaccuagagucugu

SEQ ID NO: 57357 - RNA, 17 nt, Human
ugcagcugauggggaaa

SEQ ID NO: 57358 - RNA, 22 nt, Human
ugcagcugcaaguccaggucag

SEQ ID NO: 57359 - RNA, 22 nt, Human
ugcagcugcaggagggugggag

SEQ ID NO: 57360 - RNA, 17 nt, Human
ugcagcugcucccaggc

SEQ ID NO: 57361 - RNA, 22 nt, Human
ugcagcuggauuuaucuuuucc

SEQ ID NO: 57362 - RNA, 22 nt, Human
ugcagcugggacauuuuugaua

SEQ ID NO: 57363 - RNA, 22 nt, Human
ugcagcugggucugcccuggcu

SEQ ID NO: 57364 - RNA, 22 nt, Human
ugcagcugugccugaaaaguac

SEQ ID NO: 57365 - RNA, 20 nt, Human
ugcagcuucucaucuucaaa

SEQ ID NO: 57366 - RNA, 22 nt, Human
ugcaggaaaaccaacacgccuu

SEQ ID NO: 57367 - RNA, 22 nt, Human
ugcaggaacagaacucacuccc

SEQ ID NO: 57368 - RNA, 22 nt, Human
ugcaggaagacuucccaagcca

SEQ ID NO: 57369 - RNA, 22 nt, Human
ugcaggaagcaaccagguccaa

SEQ ID NO: 57370 - RNA, 21 nt, Human
ugcaggaaguauggugccuau

SEQ ID NO: 57371 - RNA, 22 nt, Human
ugcaggaauagcuacagagcug

SEQ ID NO: 57372 - RNA, 22 nt, Human
ugcaggacauuaguuaugaauu

SEQ ID NO: 57373 - RNA, 23 nt, Human
ugcaggacuacucgagcacugcu

SEQ ID NO: 57374 - RNA, 22 nt, Human
ugcaggacuucaggacucugag

SEQ ID NO: 57375 - RNA, 22 nt, Human
ugcaggagagcuggucuggccc

SEQ ID NO: 57376 - RNA, 22 nt, Human
ugcaggagcccuugggcucugg

SEQ ID NO: 57377 - RNA, 22 nt, Human
ugcaggagggaggguuacaguu

SEQ ID NO: 57378 - RNA, 18 nt, Human
ugcaggagugaccccggc

SEQ ID NO: 57379 - RNA, 22 nt, Human
ugcaggccggcccuaggccuca

SEQ ID NO: 57380 - RNA, 22 nt, Human
ugcaggccuaugguggggcccc

SEQ ID NO: 57381 - RNA, 22 nt, Human
ugcaggccucacaccuggcacc

SEQ ID NO: 57382 - RNA, 22 nt, Human
ugcaggccucagacuuagccau

SEQ ID NO: 57383 - RNA, 22 nt, Human
ugcaggcucaccugccagggcc

SEQ ID NO: 57384 - RNA, 22 nt, Human
ugcaggcucaucucaagaguag

SEQ ID NO: 57385 - RNA, 22 nt, Human
ugcaggcuccacguuguugucc

SEQ ID NO: 57386 - RNA, 22 nt, Human
ugcaggcugcuggcaguagcuu

SEQ ID NO: 57387 - RNA, 22 nt, Human
ugcaggcuggaggagggacuaa

SEQ ID NO: 57388 - RNA, 22 nt, Human
ugcaggcuggcagugcugaaau

SEQ ID NO: 57389 - RNA, 18 nt, Human
ugcaggcugggguuccuc

SEQ ID NO: 57390 - RNA, 21 nt, Human
ugcaggcugugcgcuccugcc

SEQ ID NO: 57391 - RNA, 18 nt, Human
ugcaggcuguugaaacug

SEQ ID NO: 57392 - RNA, 22 nt, Human
ugcagggaaagggcacugggcu

SEQ ID NO: 57393 - RNA, 22 nt, Human
ugcagggaccccgaggcucucu

SEQ ID NO: 57394 - RNA, 22 nt, Human
ugcagggaggccccgcagcccu

SEQ ID NO: 57395 - RNA, 22 nt, Human
ugcagggauccuagcugaagag

SEQ ID NO: 57396 - RNA, 22 nt, Human
ugcagggaugcuagagguaaga

SEQ ID NO: 57397 - RNA, 22 nt, Human
ugcagggauuagaggccgggga

SEQ ID NO: 57398 - RNA, 22 nt, Human
ugcagggauuauguagggguug

SEQ ID NO: 57399 - RNA, 22 nt, Human
ugcauuccuuugucuguuaaag

SEQ ID NO: 57400 - RNA, 22 nt, Human
ugcauucuaugauaucaaaaca

SEQ ID NO: 57401 - RNA, 22 nt, Human
ugcauucugaacguaaauguga

SEQ ID NO: 57402 - RNA, 22 nt, Human
ugcauucugacuuaguuaauau

SEQ ID NO: 57403 - RNA, 22 nt, Human
ugcauucuuggaagaagcucuc

SEQ ID NO: 57404 - RNA, 22 nt, Human
ugcauugcauuugucaugaaga

SEQ ID NO: 57405 - RNA, 22 nt, Human
ugcauuggguugacauacuaaa

SEQ ID NO: 57406 - RNA, 22 nt, Human
ugcauuguaggauguuuagcag

SEQ ID NO: 57407 - RNA, 22 nt, Human
ugcauuguugaugaguugaaua

SEQ ID NO: 57408 - RNA, 22 nt, Human
ugcccugugugugcaagcacug

SEQ ID NO: 57409 - RNA, 22 nt, Human
ugcccuguuaucuuggaagagu

SEQ ID NO: 57410 - RNA, 22 nt, Human
ugcccuguucacuucaugguuc

SEQ ID NO: 57411 - RNA, 22 nt, Human
ugcccuugggauuuagguaagg

SEQ ID NO: 57412 - RNA, 22 nt, Human
ugccgcuccaggucucgcggug

SEQ ID NO: 57413 - RNA, 22 nt, Human
ugccgcugucgccaccauggcu

SEQ ID NO: 57414 - RNA, 22 nt, Human
ugccgugucccauugugcucug

SEQ ID NO: 57415 - RNA, 22 nt, Human
ugccuaagucugcagucacuug

SEQ ID NO: 57416 - RNA, 22 nt, Human
ugccuacccugcccgcagacac

SEQ ID NO: 57417 - RNA, 22 nt, Human
ugccuagaacuuuauucuuuau

SEQ ID NO: 57418 - RNA, 22 nt, Human
ugccuagcauaguauuugucac

SEQ ID NO: 57419 - RNA, 22 nt, Human
ugccuaggaaaccucaugcuuc

SEQ ID NO: 57420 - RNA, 22 nt, Human
ugccuaguaggguuguuguagg

SEQ ID NO: 57421 - RNA, 22 nt, Human
ugccucagaguugucccuacca

SEQ ID NO: 57422 - RNA, 23 nt, Human
ugccucaguggaaugugagggug

SEQ ID NO: 57423 - RNA, 22 nt, Human
ugccucauaacacuccuggagu

SEQ ID NO: 57424 - RNA, 23 nt, Human
ugccuccaccgagggccaggcau

SEQ ID NO: 57425 - RNA, 17 nt, Human
ugccuccagcaggguga

SEQ ID NO: 57426 - RNA, 22 nt, Human
ugccucgugucugagucuguuc

SEQ ID NO: 57427 - RNA, 22 nt, Human
ugccucugcugcauauucaccu

SEQ ID NO: 57428 - RNA, 22 nt, Human
ugccucugugggcagagcugcc

SEQ ID NO: 57429 - RNA, 22 nt, Human
ugccucuuggagccuuuccucu

SEQ ID NO: 57430 - RNA, 22 nt, Human
ugccugaaugaucagucagauu

SEQ ID NO: 57431 - RNA, 22 nt, Human
ugccugaauucaauuccuggcu

SEQ ID NO: 57432 - RNA, 22 nt, Human
ugccugagggaguaagaguccu

SEQ ID NO: 57433 - RNA, 22 nt, Human
ugccugcaucuuggaggcccca

SEQ ID NO: 57434 - RNA, 22 nt, Human
ugccugccaggugcuucuucau

SEQ ID NO: 57435 - RNA, 22 nt, Human
ugccugcccacgacuacagcag

SEQ ID NO: 57436 - RNA, 20 nt, Human
ugccugcccagguccugcac

SEQ ID NO: 57437 - RNA, 22 nt, Human
ugccugccccacaagggguugc

SEQ ID NO: 57438 - RNA, 22 nt, Human
ugccugccucaggccgagugcu

SEQ ID NO: 57439 - RNA, 21 nt, Human
ugccugccuccuuuggcuagg

SEQ ID NO: 57440 - RNA, 22 nt, Human
ugccugcucugugccacaguug

SEQ ID NO: 57441 - RNA, 22 nt, Human
ugccugcucuugagacuuacaa

SEQ ID NO: 57442 - RNA, 22 nt, Human
ugccugcugcuaagcucuuugu

SEQ ID NO: 57443 - RNA, 22 nt, Human
ugccugcuuguguaccugguga

SEQ ID NO: 57444 - RNA, 19 nt, Human
ugccuggacaaaugugggg

SEQ ID NO: 57445 - RNA, 22 nt, Human
ugccuggauacucauuaauuuc

SEQ ID NO: 57446 - RNA, 22 nt, Human
ugccuggauucgguuguuguca

SEQ ID NO: 57447 - RNA, 22 nt, Human
ugccuggccagacccuauagag

SEQ ID NO: 57448 - RNA, 21 nt, Human
ugccuggccuuugcuuuuccu

SEQ ID NO: 57449 - RNA, 20 nt, Human
ugccugggaaggcguggagg

SEQ ID NO: 57450 - RNA, 22 nt, Human
ugccuggguccaggccaagccu

SEQ ID NO: 57451 - RNA, 22 nt, Human
ugccuggguguaaagggccaac

SEQ ID NO: 57452 - RNA, 22 nt, Human
ugccuggguugacucuuagcug

SEQ ID NO: 57453 - RNA, 22 nt, Human
ugccugguauuugaauaaagag

SEQ ID NO: 57454 - RNA, 22 nt, Human
ugccuguaauaaugcuaagcac

SEQ ID NO: 57455 - RNA, 19 nt, Human
ugccugucaguagaucuca

SEQ ID NO: 57456 - RNA, 22 nt, Human
ugccugucuuaauaucuggaaa

SEQ ID NO: 57457 - RNA, 22 nt, Human
ugccugugacccaaggaugcga

SEQ ID NO: 57458 - RNA, 22 nt, Human
ugccugugcccuucuuggcauu

SEQ ID NO: 57459 - RNA, 22 nt, Human
ugccugugguuccaguuuuuuc

SEQ ID NO: 57460 - RNA, 22 nt, Human
ugccuguguaugugcaugcaca

SEQ ID NO: 57461 - RNA, 22 nt, Human
ugccuguguccccuucuuggca

SEQ ID NO: 57462 - RNA, 22 nt, Human
ugccuucacugagcuuauggga

SEQ ID NO: 57463 - RNA, 22 nt, Human
ugccuuccuaauggugggguuu

SEQ ID NO: 57464 - RNA, 22 nt, Human
ugccuucuucucccuggcucag

SEQ ID NO: 57465 - RNA, 22 nt, Human
ugccuugcacauaauauacauu

SEQ ID NO: 57466 - RNA, 22 nt, Human
ugccuugccacugcucuuaaug

SEQ ID NO: 57467 - RNA, 16 nt, Human
ugccuugcugucaguc

SEQ ID NO: 57468 - RNA, 22 nt, Human
ugccuugcuuaacaagauggca

SEQ ID NO: 57469 - RNA, 22 nt, Human
ugccuugcuucaaucaaaccgu

SEQ ID NO: 57470 - RNA, 22 nt, Human
ugccuuguccuucgucagggcu

SEQ ID NO: 57471 - RNA, 22 nt, Human
ugccuuuaacaagaucuccaga

SEQ ID NO: 57472 - RNA, 22 nt, Human
ugccuuuaaggaaucauucuug

SEQ ID NO: 57473 - RNA, 22 nt, Human
ugccuuuacugauuagcugugu

SEQ ID NO: 57474 - RNA, 22 nt, Human
ugccuuuagggaaaagcaagcu

SEQ ID NO: 57475 - RNA, 22 nt, Human
ugccuuugcaauugaggaggau

SEQ ID NO: 57476 - RNA, 22 nt, Human
ugccuuuuaccuuguaauucug

SEQ ID NO: 57477 - RNA, 22 nt, Human
ugccuuuugaagccucacaggu

SEQ ID NO: 57478 - RNA, 22 nt, Human
ugccuuuuguuagggcugccag

SEQ ID NO: 57479 - RNA, 22 nt, Human
ugcgauguaugcaguauuuguu

SEQ ID NO: 57480 - RNA, 22 nt, Human
ugcgcaggagcucugccaggag

SEQ ID NO: 57481 - RNA, 22 nt, Human
ugcgcgcuggcgucacuuagca

SEQ ID NO: 57482 - RNA, 22 nt, Human
ugcggcagccaccgcguggccc

SEQ ID NO: 57483 - RNA, 22 nt, Human
ugcgggucccagggucacaggc

SEQ ID NO: 57484 - RNA, 22 nt, Human
ugcggguugguggcauaugcag

SEQ ID NO: 57485 - RNA, 23 nt, Human
ugcguacggcugccagugugacu

SEQ ID NO: 57486 - RNA, 22 nt, Human
ugcguggcgcagcgugugggau

SEQ ID NO: 57487 - RNA, 22 nt, Human
ugcguuauugugucuggcuaug

SEQ ID NO: 57488 - RNA, 22 nt, Human
ugcguuuaguuucaagacacgu

SEQ ID NO: 57489 - RNA, 21 nt, Human
ugcuaagugucacaugucugc

SEQ ID NO: 57490 - RNA, 22 nt, Human
ugcuaauaucuagaaguuuguu

SEQ ID NO: 57491 - RNA, 22 nt, Human
ugcuaauguccugaccguucug

SEQ ID NO: 57492 - RNA, 22 nt, Human
ugcuaauguuucauuuuuagau

SEQ ID NO: 57493 - RNA, 22 nt, Human
ugcuacaaauucguaaucaauu

SEQ ID NO: 57494 - RNA, 22 nt, Human
ugcuacacuuaaaucagucacc

SEQ ID NO: 57495 - RNA, 22 nt, Human
ugcuacagagccaggaagagug

SEQ ID NO: 57496 - RNA, 23 nt, Human
ugcuacucaaaguguggucccag

SEQ ID NO: 57497 - RNA, 22 nt, Human
ugcuagaauuugcagaagcaua

SEQ ID NO: 57498 - RNA, 22 nt, Human
ugcuaggagaggcagcacagcg

SEQ ID NO: 57499 - RNA, 22 nt, Human
ugcuaggcauugucugggagua

SEQ ID NO: 57500 - RNA, 22 nt, Human
ugcuagguaagaagggggcucc

SEQ ID NO: 57501 - RNA, 22 nt, Human
ugcuagugcaggguuuucaguu

SEQ ID NO: 57502 - RNA, 22 nt, Human
ugcuauaagcuccacgcuguag

SEQ ID NO: 57503 - RNA, 22 nt, Human
ugcuauaaguagacauucaaca

SEQ ID NO: 57504 - RNA, 22 nt, Human
ugcuauacggagcaucuucagg

SEQ ID NO: 57505 - RNA, 22 nt, Human
ugcuauguugccuaguguaaua

SEQ ID NO: 57506 - RNA, 22 nt, Human
ugcuauuagaagccaugcuguu

SEQ ID NO: 57507 - RNA, 22 nt, Human
ugcuauuuggaaaagcauuugg

SEQ ID NO: 57508 - RNA, 22 nt, Human
ugcuauuuuggucuacagcacu

SEQ ID NO: 57509 - RNA, 17 nt, Human
ugcucaaauacuuuuga

SEQ ID NO: 57510 - RNA, 23 nt, Human
ugcucaauagaccauaauaucca

SEQ ID NO: 57511 - RNA, 22 nt, Human
ugcucacagcccagaacauaau

SEQ ID NO: 57512 - RNA, 22 nt, Human
ugcucagauuacagccccacau

SEQ ID NO: 57513 - RNA, 22 nt, Human
ugcucagccgugagcagagccg

SEQ ID NO: 57514 - RNA, 22 nt, Human
uggcaccaggcgggguggcugu

SEQ ID NO: 57515 - RNA, 22 nt, Human
uggcaccagggaacaagcauuu

SEQ ID NO: 57516 - RNA, 22 nt, Human
uggcacccaguggagcugugcu

SEQ ID NO: 57517 - RNA, 22 nt, Human
ugcauuucagaagaaaauucgg

SEQ ID NO: 57518 - RNA, 22 nt, Human
uuuauucacucauucagccagu

SEQ ID NO: 57519 - RNA, 22 nt, Human
uuuauuccaaagcuugcacuuu

SEQ ID NO: 57520 - RNA, 22 nt, Human
uuuauucuaacuugcugcucua

SEQ ID NO: 57521 - RNA, 22 nt, Human
uuuauucuugagagugagaaga

SEQ ID NO: 57522 - RNA, 22 nt, Human
uuuauugcauacacaaauguca

SEQ ID NO: 57523 - RNA, 22 nt, Human
uuuauugggugcagugcccaca

SEQ ID NO: 57524 - RNA, 22 nt, Human
uuuauuguuaucaugggugagu

SEQ ID NO: 57525 - RNA, 19 nt, Human
uuuauuugagacaugccuu

SEQ ID NO: 57526 - RNA, 22 nt, Human
uuuauuuggcaucucugccaag

SEQ ID NO: 57527 - RNA, 22 nt, Human
uuucaaaagcguacguagugaa

SEQ ID NO: 57528 - RNA, 22 nt, Human
uuucaaacuaugugucaggcag

SEQ ID NO: 57529 - RNA, 22 nt, Human
uuucaaacuccagcucaccaau

SEQ ID NO: 57530 - RNA, 22 nt, Human
uuucaaacugggagugagggga

SEQ ID NO: 57531 - RNA, 22 nt, Human
uuucaaacuuaaauaccuuucc

SEQ ID NO: 57532 - RNA, 22 nt, Human
uuucaaacuuuacucuugaauc

SEQ ID NO: 57533 - RNA, 22 nt, Human
uuucaaagaccauuaacuauca

SEQ ID NO: 57534 - RNA, 22 nt, Human
uuucaaagaguuguaaauuacu

SEQ ID NO: 57535 - RNA, 22 nt, Human
uuucaaagguuuugucaugucu

SEQ ID NO: 57536 - RNA, 22 nt, Human
uuucaaaguaaggauuuucauc

SEQ ID NO: 57537 - RNA, 22 nt, Human
uuucaaaguggagaauuagaca

SEQ ID NO: 57538 - RNA, 22 nt, Human
uuucaaauagaaucuuuccaaa

SEQ ID NO: 57539 - RNA, 23 nt, Human
uuucaacaaugcuuagagaaaac

SEQ ID NO: 57540 - RNA, 22 nt, Human
uuucaacagaucugucuucagg

SEQ ID NO: 57541 - RNA, 23 nt, Human
uuucaacaggcagagaagacuua

SEQ ID NO: 57542 - RNA, 17 nt, Human
uuucaacaucacucagc

SEQ ID NO: 57543 - RNA, 22 nt, Human
uuucaacucaugcuaaaggaag

SEQ ID NO: 57544 - RNA, 22 nt, Human
uuucaacuugaagaauugauac

SEQ ID NO: 57545 - RNA, 22 nt, Human
uuucaagaauugaagaggauuu

SEQ ID NO: 57546 - RNA, 22 nt, Human
uuucaagacucauugaguauug

SEQ ID NO: 57547 - RNA, 22 nt, Human
uuucaagagaaaacuaaccuau

SEQ ID NO: 57548 - RNA, 22 nt, Human
uuucaagcaugucaaguuaguc

SEQ ID NO: 57549 - RNA, 22 nt, Human
uuucaaggcuaauccacaguau

SEQ ID NO: 57550 - RNA, 22 nt, Human
uuucaaggugcaggaggguuuu

SEQ ID NO: 57551 - RNA, 22 nt, Human
uuucaagucaguagcuaaucau

SEQ ID NO: 57552 - RNA, 22 nt, Human
uuucaaguggcgagauaaggaa

SEQ ID NO: 57553 - RNA, 22 nt, Human
uuucaaguuguuuauauccaga

SEQ ID NO: 57554 - RNA, 22 nt, Human
uuucaauuccaccaaagcgccc

SEQ ID NO: 57555 - RNA, 22 nt, Human
uuucacaaacugaggagacaau

SEQ ID NO: 57556 - RNA, 19 nt, Human
uuucacaaagagagcguga

SEQ ID NO: 57557 - RNA, 22 nt, Human
uuucacaaagcauagcacuuua

SEQ ID NO: 57558 - RNA, 22 nt, Human
uuucacaacugcuuauuugaga

SEQ ID NO: 57559 - RNA, 22 nt, Human
uuucacacccacuaggacuguu

SEQ ID NO: 57560 - RNA, 22 nt, Human
uuucacacuagucagaauacca

SEQ ID NO: 57561 - RNA, 22 nt, Human
uuucacagaaagaagcuaguuu

SEQ ID NO: 57562 - RNA, 22 nt, Human
uuucacagauauaagauuucac

SEQ ID NO: 57563 - RNA, 18 nt, Human
uuucacagauucaugacu

SEQ ID NO: 57564 - RNA, 22 nt, Human
uuucacagcuagugagcuucua

SEQ ID NO: 57565 - RNA, 22 nt, Human
uuucacagcugggaagagauau

SEQ ID NO: 57566 - RNA, 22 nt, Human
uuucacaggaguccuuucuaua

SEQ ID NO: 57567 - RNA, 22 nt, Human
uuucacaggaugcuguuuuaua

SEQ ID NO: 57568 - RNA, 22 nt, Human
uuucacaggccuuuuguagccc

SEQ ID NO: 57569 - RNA, 22 nt, Human
uuucacaucagagguagauuag

SEQ ID NO: 57570 - RNA, 22 nt, Human
uuucacauguggaaugccaggu

SEQ ID NO: 57571 - RNA, 23 nt, Human
uuucacauuaauguuuagcagga

SEQ ID NO: 57572 - RNA, 22 nt, Human
uuucacauuagauaugucauuu

SEQ ID NO: 57573 - RNA, 22 nt, Human
uuucaccaagguaaccuuugau

SEQ ID NO: 57574 - RNA, 22 nt, Human
uuucaccucagucuuuuuauau

SEQ ID NO: 57575 - RNA, 22 nt, Human
uuucacuguuaggaguaugcua

SEQ ID NO: 57576 - RNA, 22 nt, Human
uuucagaaauggcacugaaauc

SEQ ID NO: 57577 - RNA, 22 nt, Human
uuucagaaggggagaaagguca

SEQ ID NO: 57578 - RNA, 23 nt, Human
uuucagaagugguccuaggaagc

SEQ ID NO: 57579 - RNA, 22 nt, Human
uuucagacaggacuucauaugu

SEQ ID NO: 57580 - RNA, 22 nt, Human
uuucagacaucacauggguuug

SEQ ID NO: 57581 - RNA, 22 nt, Human
uuucagacugcugugugaaacu

SEQ ID NO: 57582 - RNA, 22 nt, Human
uuucagagccuuuaucucucua

SEQ ID NO: 57583 - RNA, 22 nt, Human
uuucagagcucuaggcucucag

SEQ ID NO: 57584 - RNA, 22 nt, Human
uuucagaggaaaucucauugag

SEQ ID NO: 57585 - RNA, 22 nt, Human
uuucagaggaggaaggcaguua

SEQ ID NO: 57586 - RNA, 22 nt, Human
uuucagagggcagaucuggggc

SEQ ID NO: 57587 - RNA, 22 nt, Human
uuucagagucagcuccucucua

SEQ ID NO: 57588 - RNA, 22 nt, Human
uuucagaugcaauuaauuuuca

SEQ ID NO: 57589 - RNA, 22 nt, Human
uuucagaugguauauacaguag

SEQ ID NO: 57590 - RNA, 22 nt, Human
uuucagaugugugucucugaag

SEQ ID NO: 57591 - RNA, 17 nt, Human
uuucagauucacuuucu

SEQ ID NO: 57592 - RNA, 22 nt, Human
uuucagcacuuuaggcagcagg

SEQ ID NO: 57593 - RNA, 22 nt, Human
uuucaggccauagcacagggaa

SEQ ID NO: 57594 - RNA, 22 nt, Human
uuucagggaaguguugaaaagg

SEQ ID NO: 57595 - RNA, 22 nt, Human
uuucaggguacauggagcaaau

SEQ ID NO: 57596 - RNA, 22 nt, Human
uuucagucauggauucacugag

SEQ ID NO: 57597 - RNA, 22 nt, Human
uuucagucuguaaaggugagga

SEQ ID NO: 57598 - RNA, 22 nt, Human
uuucagugaaagcuacuguuag

SEQ ID NO: 57599 - RNA, 22 nt, Human
uuucaguggaccacaguuugau

SEQ ID NO: 57600 - RNA, 22 nt, Human
uuucagugugcuccugagggcu

SEQ ID NO: 57601 - RNA, 20 nt, Human
uuucaguuaucuugaccuuc

SEQ ID NO: 57602 - RNA, 23 nt, Human
uuucaguugagaaugcacggacc

SEQ ID NO: 57603 - RNA, 22 nt, Human
uuucaguugccaagcuaauucu

SEQ ID NO: 57604 - RNA, 22 nt, Human
uuucaguuuaugucuugaauua

SEQ ID NO: 57605 - RNA, 22 nt, Human
uuucaguuuccagcuuugucau

SEQ ID NO: 57606 - RNA, 22 nt, Human
uuucauaaucugucaagugggg

SEQ ID NO: 57607 - RNA, 22 nt, Human
uuucauagccuucuaaugaguu

SEQ ID NO: 57608 - RNA, 22 nt, Human
uuucauagcugaaaauguugaa

SEQ ID NO: 57609 - RNA, 22 nt, Human
uuucauaugggcauuggcaaua

SEQ ID NO: 57610 - RNA, 22 nt, Human
uuucaucuauuugcuuugugaa

SEQ ID NO: 57611 - RNA, 22 nt, Human
uuucaucuuauuugucuacauc

SEQ ID NO: 57612 - RNA, 22 nt, Human
uuucaugcacaaaugagcaagg

SEQ ID NO: 57613 - RNA, 22 nt, Human
uuucaugcucauggaacacagc

SEQ ID NO: 57614 - RNA, 22 nt, Human
uuucauguacuuuuuugauaga

SEQ ID NO: 57615 - RNA, 22 nt, Human
uuucauguggcgaugucucugg

SEQ ID NO: 57616 - RNA, 22 nt, Human
uuucauguuaguugguucuugg

SEQ ID NO: 57617 - RNA, 22 nt, Human
uuucauguuauuaauagugcug

SEQ ID NO: 57618 - RNA, 22 nt, Human
uuucauguuggggaguugagug

SEQ ID NO: 57619 - RNA, 22 nt, Human
uuucauguuuauggaaaaugag

SEQ ID NO: 57620 - RNA, 22 nt, Human
uuucauuacuuguuaaggguag

SEQ ID NO: 57621 - RNA, 22 nt, Human
uuucauuauaaaaaguuggcuu

SEQ ID NO: 57622 - RNA, 22 nt, Human
uuucauuauucaugcuaguuau

SEQ ID NO: 57623 - RNA, 22 nt, Human
uuucauugagacuauagacauc

SEQ ID NO: 57624 - RNA, 22 nt, Human
uuucauugaugggugauagaaa

SEQ ID NO: 57625 - RNA, 22 nt, Human
uuucauugucuacauaugacau

SEQ ID NO: 57626 - RNA, 17 nt, Human
uuucuggaaugggcaaa

SEQ ID NO: 57627 - RNA, 22 nt, Human
uuucuggcagcgggacaggggu

SEQ ID NO: 57628 - RNA, 22 nt, Human
uuucugggacuggggagauucu

SEQ ID NO: 57629 - RNA, 20 nt, Human
uuucuggguacucucccucu

SEQ ID NO: 57630 - RNA, 22 nt, Human
uuucuguaauuaaaagggcagg

SEQ ID NO: 57631 - RNA, 22 nt, Human
uuucuguauuuugucauaaccu

SEQ ID NO: 57632 - RNA, 20 nt, Human
uuucugugaggacuguacug

SEQ ID NO: 57633 - RNA, 22 nt, Human
uggccacccccaaugucaguag

SEQ ID NO: 57634 - RNA, 22 nt, Human
uggccaccuuauggcuauugga

SEQ ID NO: 57635 - RNA, 22 nt, Human
uggccagacagagaggcuuugu

SEQ ID NO: 57636 - RNA, 17 nt, Human
uggccagagcaggcccc

SEQ ID NO: 57637 - RNA, 22 nt, Human
uggccagauucaugcauguauc

SEQ ID NO: 57638 - RNA, 22 nt, Human
uggccagcccuucagccaugcc

SEQ ID NO: 57639 - RNA, 22 nt, Human
uggccaguaauagcuucuggug

SEQ ID NO: 57640 - RNA, 22 nt, Human
uggccauagcucagcuccuuca

SEQ ID NO: 57641 - RNA, 22 nt, Human
uggccaugaaggaggcagcaga

SEQ ID NO: 57642 - RNA, 22 nt, Human
uggcccagagcacugcugggca

SEQ ID NO: 57643 - RNA, 22 nt, Human
uggcccagcucagggugggcgg

SEQ ID NO: 57644 - RNA, 22 nt, Human
uggcccaggccaaagcccugga

SEQ ID NO: 57645 - RNA, 22 nt, Human
uggcccaggcgaggugggcaga

SEQ ID NO: 57646 - RNA, 22 nt, Human
uggcccagggaguucauggugu

SEQ ID NO: 57647 - RNA, 22 nt, Human
uggcccagggcacagcagggag

SEQ ID NO: 57648 - RNA, 22 nt, Human
uggcccagggucuacagccuca

SEQ ID NO: 57649 - RNA, 22 nt, Human
uggcccaggucucucugagccc

SEQ ID NO: 57650 - RNA, 22 nt, Human
uggcccaggugcaagagacaga

SEQ ID NO: 57651 - RNA, 22 nt, Human
uggcccaggugcacccagaggc

SEQ ID NO: 57652 - RNA, 22 nt, Human
uggcccaguagaaaagggaucg

SEQ ID NO: 57653 - RNA, 22 nt, Human
uggcccaguauguauaaucuua

SEQ ID NO: 57654 - RNA, 22 nt, Human
uggcccagucagcaggagaggg

SEQ ID NO: 57655 - RNA, 22 nt, Human
uggcccgaccucugcucaugca

SEQ ID NO: 57656 - RNA, 22 nt, Human
uggcccgggaguuuugaagagu

SEQ ID NO: 57657 - RNA, 22 nt, Human
uggcccucagucuugcuccugc

SEQ ID NO: 57658 - RNA, 22 nt, Human
uggcccugacagguccugggca

SEQ ID NO: 57659 - RNA, 22 nt, Human
uggcccugacugauguggaggg

SEQ ID NO: 57660 - RNA, 22 nt, Human
uggcccugaggacccagugugg

SEQ ID NO: 57661 - RNA, 22 nt, Human
uggcccugccgccacgacgucu

SEQ ID NO: 57662 - RNA, 22 nt, Human
uggcccuggcugaguuagauuu

SEQ ID NO: 57663 - RNA, 22 nt, Human
uggcccuguccucauuucaucu

SEQ ID NO: 57664 - RNA, 22 nt, Human
uggcccugucugcacacaggau

SEQ ID NO: 57665 - RNA, 22 nt, Human
uggcccugugacugaguucuag

SEQ ID NO: 57666 - RNA, 22 nt, Human
uggcccuguggaggucagugag

SEQ ID NO: 57667 - RNA, 22 nt, Human
uggcccuguggcuucagaacag

SEQ ID NO: 57668 - RNA, 22 nt, Human
uggcccuguucuguaccucaua

SEQ ID NO: 57669 - RNA, 22 nt, Human
uggcccuuugggugcaggggca

SEQ ID NO: 57670 - RNA, 22 nt, Human
uggcccuuugguuuaugacuga

SEQ ID NO: 57671 - RNA, 22 nt, Human
uggccggggcugauggacagug

SEQ ID NO: 57672 - RNA, 22 nt, Human
uggccuagagaagccaaaagau

SEQ ID NO: 57673 - RNA, 22 nt, Human
uggccucaccacuagcugggug

SEQ ID NO: 57674 - RNA, 22 nt, Human
uggccucagauuucaggggugg

SEQ ID NO: 57675 - RNA, 21 nt, Human
uggccucccacacuuccaugg

SEQ ID NO: 57676 - RNA, 22 nt, Human
uggccuccucgggcugacccug

SEQ ID NO: 57677 - RNA, 22 nt, Human
uggccucuccuggcagcaucca

SEQ ID NO: 57678 - RNA, 20 nt, Human
uggccucugagaugccacgg

SEQ ID NO: 57679 - RNA, 20 nt, Human
uggccucuguagaggccaag

SEQ ID NO: 57680 - RNA, 22 nt, Human
uggccucugugggagcugagca

SEQ ID NO: 57681 - RNA, 22 nt, Human
uggccugaauuauggcagaucu

SEQ ID NO: 57682 - RNA, 22 nt, Human
uggccugacugucaggcuguau

SEQ ID NO: 57683 - RNA, 22 nt, Human
uggccugcuuucuuagguguuc

SEQ ID NO: 57684 - RNA, 22 nt, Human
uggccuggcccugaggcccugu

SEQ ID NO: 57685 - RNA, 22 nt, Human
uggccugggccugccggugcaa

SEQ ID NO: 57686 - RNA, 22 nt, Human
uggccugggucacaccaggguc

SEQ ID NO: 57687 - RNA, 22 nt, Human
uggccuggugcucaggcaguag

SEQ ID NO: 57688 - RNA, 22 nt, Human
uggccuuccuggugacucauga

SEQ ID NO: 57689 - RNA, 22 nt, Human
uggccuugagaugcagcagcca

SEQ ID NO: 57690 - RNA, 22 nt, Human
uggccuugcccagcgccuaggu

SEQ ID NO: 57691 - RNA, 22 nt, Human
uggccuuggcagugagaagagu

SEQ ID NO: 57692 - RNA, 22 nt, Human
uggcgagcuuuguucuccagga

SEQ ID NO: 57693 - RNA, 22 nt, Human
uggcgcaacucauucauggugu

SEQ ID NO: 57694 - RNA, 21 nt, Human
uggcggggacuuguggcugcc

SEQ ID NO: 57695 - RNA, 22 nt, Human
uggcggggcagcucuggcuucu

SEQ ID NO: 57696 - RNA, 21 nt, Human
uggcuaaacccuaguaaauua

SEQ ID NO: 57697 - RNA, 23 nt, Human
uggcuaaaggcucuaguccugcu

SEQ ID NO: 57698 - RNA, 22 nt, Human
uggcuaacaguuaagauuucau

SEQ ID NO: 57699 - RNA, 22 nt, Human
uggcuacaagguggcuauucua

SEQ ID NO: 57700 - RNA, 22 nt, Human
uggcuacaaguguguuuaguuu

SEQ ID NO: 57701 - RNA, 22 nt, Human
uggcuacagacauuccuaggga

SEQ ID NO: 57702 - RNA, 22 nt, Human
uggcuacagcuuggccacagag

SEQ ID NO: 57703 - RNA, 22 nt, Human
uggcuacauuuauacucucauu

SEQ ID NO: 57704 - RNA, 22 nt, Human
uggcuaccugauuucuuuucag

SEQ ID NO: 57705 - RNA, 20 nt, Human
uggcuagcauuaaaaugacu

SEQ ID NO: 57706 - RNA, 22 nt, Human
uggcuaggacucauccuguuuc

SEQ ID NO: 57707 - RNA, 22 nt, Human
uggcuaggcuccaagagcugga

SEQ ID NO: 57708 - RNA, 22 nt, Human
uggcuaugacuucguacugucu

SEQ ID NO: 57709 - RNA, 22 nt, Human
uggcuaugaggagcgcaggugu

SEQ ID NO: 57710 - RNA, 22 nt, Human
uggcucaaguaacaaaaauaua

SEQ ID NO: 57711 - RNA, 22 nt, Human
uggcucacaaucucccaugaag

SEQ ID NO: 57712 - RNA, 22 nt, Human
uggcucacuguagccuugaccu

SEQ ID NO: 57713 - RNA, 22 nt, Human
uggcucacuuccguggagaggu

SEQ ID NO: 57714 - RNA, 22 nt, Human
uggcucagaaggcugccuucac

SEQ ID NO: 57715 - RNA, 22 nt, Human
uggcucagagcagggacucugg

SEQ ID NO: 57716 - RNA, 22 nt, Human
uggcucagagccuugagagcug

SEQ ID NO: 57717 - RNA, 22 nt, Human
uggcucagaguucaucuuuuag

SEQ ID NO: 57718 - RNA, 22 nt, Human
uggcucagcagguuagaaacua

SEQ ID NO: 57719 - RNA, 22 nt, Human
uggcucagccagcccuaggaac

SEQ ID NO: 57720 - RNA, 22 nt, Human
uggcucagccauucguguugcc

SEQ ID NO: 57721 - RNA, 22 nt, Human
uggcucagccuggcccuuucau

SEQ ID NO: 57722 - RNA, 22 nt, Human
uggcucagcgcggccuggucuu

SEQ ID NO: 57723 - RNA, 22 nt, Human
uggcucagcgguggcagcagac

SEQ ID NO: 57724 - RNA, 22 nt, Human
uggcucagcuuacuuuugaggg

SEQ ID NO: 57725 - RNA, 22 nt, Human
uggcucaggccacuucuuuuau

SEQ ID NO: 57726 - RNA, 22 nt, Human
uggcucagucuggguugacuga

SEQ ID NO: 57727 - RNA, 22 nt, Human
uggcucaugcaucuuuucuaca

SEQ ID NO: 57728 - RNA, 22 nt, Human
uggcuccacuacuggguguguu

SEQ ID NO: 57729 - RNA, 22 nt, Human
uggcuccacucuccaggaguuu

SEQ ID NO: 57730 - RNA, 22 nt, Human
uggcuccagaagggagggcgcc

SEQ ID NO: 57731 - RNA, 22 nt, Human
uggcuccagcguccacguccug

SEQ ID NO: 57732 - RNA, 22 nt, Human
uggcuccaucauccaugcaaga

SEQ ID NO: 57733 - RNA, 22 nt, Human
uggcucccgcuugcaccuaaga

SEQ ID NO: 57734 - RNA, 22 nt, Human
uggcuccuaaugcugcccagac

SEQ ID NO: 57735 - RNA, 18 nt, Human
uggcagagugucuguucu

SEQ ID NO: 57736 - RNA, 21 nt, Human
uggcagaguugaguaguuaug

SEQ ID NO: 57737 - RNA, 22 nt, Human
uggcagaguuggagguggaaga

SEQ ID NO: 57738 - RNA, 20 nt, Human
uggcagaguugucccaccca

SEQ ID NO: 57739 - RNA, 22 nt, Human
uggcagauaaaauaauagggaa

SEQ ID NO: 57740 - RNA, 22 nt, Human
uggcagauaaccugcugugccc

SEQ ID NO: 57741 - RNA, 22 nt, Human
uggcagauuuucucuggaggag

SEQ ID NO: 57742 - RNA, 22 nt, Human
uggcagcaauuagcuagagcug

SEQ ID NO: 57743 - RNA, 21 nt, Human
uggcagcacccacacccucug

SEQ ID NO: 57744 - RNA, 22 nt, Human
uggcagcacuugaacuugagcc

SEQ ID NO: 57745 - RNA, 22 nt, Human
uggcagcagacaucugaggucu

SEQ ID NO: 57746 - RNA, 22 nt, Human
uggcagcagccauggaaggccc

SEQ ID NO: 57747 - RNA, 22 nt, Human
uggcagcaguggagguagaaag

SEQ ID NO: 57748 - RNA, 22 nt, Human
uggcagcaugucccggccucag

SEQ ID NO: 57749 - RNA, 22 nt, Human
uggcagccacaucucguggauu

SEQ ID NO: 57750 - RNA, 18 nt, Human
uggcagccagcugcuccu

SEQ ID NO: 57751 - RNA, 22 nt, Human
uggcagccaucagagcaggggu

SEQ ID NO: 57752 - RNA, 19 nt, Human
uggcagccuccacuuuugc

SEQ ID NO: 57753 - RNA, 22 nt, Human
uggcagccucccagcugcauuc

SEQ ID NO: 57754 - RNA, 22 nt, Human
uggcagcuagcuguuuucaugc

SEQ ID NO: 57755 - RNA, 22 nt, Human
uggcagcuauuacaaggaaguc

SEQ ID NO: 57756 - RNA, 22 nt, Human
uggcagcucauuuggaaaugga

SEQ ID NO: 57757 - RNA, 22 nt, Human
uggcagcugccauguccacgug

SEQ ID NO: 57758 - RNA, 22 nt, Human
uggcagcugcguuguguuucug

SEQ ID NO: 57759 - RNA, 22 nt, Human
uggcagcugguacagugggucu

SEQ ID NO: 57760 - RNA, 22 nt, Human
uggcagcugucuguggggucuc

SEQ ID NO: 57761 - RNA, 22 nt, Human
uggcagcuguguccagguagaa

SEQ ID NO: 57762 - RNA, 15 nt, Human
uggcagcuuguuaag

SEQ ID NO: 57763 - RNA, 22 nt, Human
uggcagcuuuuuguuucaggcu

SEQ ID NO: 57764 - RNA, 22 nt, Human
uggcaggaagacguggggcacc

SEQ ID NO: 57765 - RNA, 22 nt, Human
uuugcaaauacagaggucuugc

SEQ ID NO: 57766 - RNA, 22 nt, Human
uuugcaaauauguguuucuauu

SEQ ID NO: 57767 - RNA, 22 nt, Human
uuugcaaauucuugucuagccu

SEQ ID NO: 57768 - RNA, 22 nt, Human
uuugcaagaagaauggcacaaa

SEQ ID NO: 57769 - RNA, 22 nt, Human
uuugcaauaguccuggccugua

SEQ ID NO: 57770 - RNA, 22 nt, Human
uuugcaaugguaguuguugcuc

SEQ ID NO: 57771 - RNA, 22 nt, Human
uuugcacuagcauuuguccaug

SEQ ID NO: 57772 - RNA, 22 nt, Human
uuugcacuuaacuuauuugaaa

SEQ ID NO: 57773 - RNA, 22 nt, Human
uuugcagaugagaaaacugugg

SEQ ID NO: 57774 - RNA, 22 nt, Human
uuugcagcuucugguggccucu

SEQ ID NO: 57775 - RNA, 22 nt, Human
uuugcagggcugguaggaccac

SEQ ID NO: 57776 - RNA, 22 nt, Human
uuugcagucuggccugcuuugg

SEQ ID NO: 57777 - RNA, 22 nt, Human
uuugcauaagucauguccagug

SEQ ID NO: 57778 - RNA, 22 nt, Human
uuugcauuauauuuauagaaga

SEQ ID NO: 57779 - RNA, 22 nt, Human
uuugcauucuagaaaaauuucu

SEQ ID NO: 57780 - RNA, 22 nt, Human
uuugcauugcagugguuuacag

SEQ ID NO: 57781 - RNA, 22 nt, Human
uuugcauuuauaaguuggugga

SEQ ID NO: 57782 - RNA, 22 nt, Human
uuugcauuucuaaugagcuccg

SEQ ID NO: 57783 - RNA, 22 nt, Human
uuugcauuugcaaauaaugaaa

SEQ ID NO: 57784 - RNA, 22 nt, Human
uuugcauuuguuuagaaccuga

SEQ ID NO: 57785 - RNA, 21 nt, Human
uuugcauuuuacaugugggga

SEQ ID NO: 57786 - RNA, 22 nt, Human
uuugccaggcuugcaugaauuu

SEQ ID NO: 57787 - RNA, 22 nt, Human
uuugccaguauuuuauugauga

SEQ ID NO: 57788 - RNA, 22 nt, Human
uuugcuauaaaagggucacacg

SEQ ID NO: 57789 - RNA, 20 nt, Human
uuugcuaugcauaucugacc

SEQ ID NO: 57790 - RNA, 22 nt, Human
uuugcuauugugaauagugcca

SEQ ID NO: 57791 - RNA, 22 nt, Human
uuugcugaauaaaugugugacu

SEQ ID NO: 57792 - RNA, 22 nt, Human
uuugcugaauagauuguaaacu

SEQ ID NO: 57793 - RNA, 22 nt, Human
uuugcugaccccauucugaguc

SEQ ID NO: 57794 - RNA, 22 nt, Human
uuugcugaguugaaguuugagg

SEQ ID NO: 57795 - RNA, 18 nt, Human
uuugcugaugagcaucau

SEQ ID NO: 57796 - RNA, 22 nt, Human
uuugcugugaauccauuacugu

SEQ ID NO: 57797 - RNA, 22 nt, Human
uuugcuuaaaagcggagcaaga

SEQ ID NO: 57798 - RNA, 22 nt, Human
uuugcuuucccuuguagaaagu

SEQ ID NO: 57799 - RNA, 22 nt, Human
uuuggaaaaagccugaacauag

SEQ ID NO: 57800 - RNA, 22 nt, Human
uuuggaaaauauugaacugguu

SEQ ID NO: 57801 - RNA, 22 nt, Human
uuuggaaacugaugguacauuc

SEQ ID NO: 57802 - RNA, 17 nt, Human
uuuggaaagugaucauu

SEQ ID NO: 57803 - RNA, 22 nt, Human
uuuggaaggugaggcaugaagg

SEQ ID NO: 57804 - RNA, 22 nt, Human
uuuggaauagcauagaagcuca

SEQ ID NO: 57805 - RNA, 22 nt, Human
uuuggaauccucaguaugauca

SEQ ID NO: 57806 - RNA, 22 nt, Human
uuuggaaugacagauaucaaua

SEQ ID NO: 57807 - RNA, 22 nt, Human
uuuggaaugguaccuucaguug

SEQ ID NO: 57808 - RNA, 22 nt, Human
uuuggaauuccauuucugcauu

SEQ ID NO: 57809 - RNA, 22 nt, Human
uuuggacuaucuguguggcuuu

SEQ ID NO: 57810 - RNA, 22 nt, Human
uuuggagagaguuaaauauguu

SEQ ID NO: 57811 - RNA, 22 nt, Human
uuuggagagaugaaguucugug

SEQ ID NO: 57812 - RNA, 22 nt, Human
uuuggaguuuaacaacuugaag

SEQ ID NO: 57813 - RNA, 22 nt, Human
uuuggauuccaugcucuccggg

SEQ ID NO: 57814 - RNA, 22 nt, Human
uuuggcaagaaaaugugauuga

SEQ ID NO: 57815 - RNA, 22 nt, Human
uuuggcaagugggaaauuagua

SEQ ID NO: 57816 - RNA, 22 nt, Human
uuuggcagagucauuucagaaa

SEQ ID NO: 57817 - RNA, 22 nt, Human
uuuggcauagcucuuuguuccu

SEQ ID NO: 57818 - RNA, 22 nt, Human
uuuggccaugcucaaggguaua

SEQ ID NO: 57819 - RNA, 22 nt, Human
uuuggccuuaguccagaagaag

SEQ ID NO: 57820 - RNA, 22 nt, Human
uuuggcucaucucaguccuagg

SEQ ID NO: 57821 - RNA, 22 nt, Human
uuuggcucucacuugcacucag

SEQ ID NO: 57822 - RNA, 22 nt, Human
uuuggcucugcgucuucaccca

SEQ ID NO: 57823 - RNA, 20 nt, Human
uuuggcuucaagugcauugc

SEQ ID NO: 57824 - RNA, 22 nt, Human
uuuggcuuuagugccuucugau

SEQ ID NO: 57825 - RNA, 22 nt, Human
uuugggaagaaguugcaaauuu

SEQ ID NO: 57826 - RNA, 22 nt, Human
uuugggaagugggagcaaggug

SEQ ID NO: 57827 - RNA, 22 nt, Human
uuugggaaucuuugugcaugac

SEQ ID NO: 57828 - RNA, 18 nt, Human
uuugggauccucuuuucu

SEQ ID NO: 57829 - RNA, 21 nt, Human
uuugggcaaaauuaaaugaga

SEQ ID NO: 57830 - RNA, 22 nt, Human
uuugggcaguagauguaucacu

SEQ ID NO: 57831 - RNA, 22 nt, Human
uuugggcaguccuggaauuugu

SEQ ID NO: 57832 - RNA, 22 nt, Human
uuugggcucacuaugcugaaga

SEQ ID NO: 57833 - RNA, 22 nt, Human
uuugguaaaugcagguucuucu

SEQ ID NO: 57834 - RNA, 22 nt, Human
uuugguaaguacccaccugggu

SEQ ID NO: 57835 - RNA, 22 nt, Human
uuugguaauguuucauugcaga

SEQ ID NO: 57836 - RNA, 22 nt, Human
uuuggucacuggauuuggcugu

SEQ ID NO: 57837 - RNA, 22 nt, Human
uuugguccauuauaugcuguca

SEQ ID NO: 57838 - RNA, 22 nt, Human
uuugguccuaagcugcucucua

SEQ ID NO: 57839 - RNA, 22 nt, Human
uuugguccugagcaaaacuaug

SEQ ID NO: 57840 - RNA, 22 nt, Human
uuuggugauagugcagagaaau

SEQ ID NO: 57841 - RNA, 22 nt, Human
uuugguuaauuuaggcuugcau

SEQ ID NO: 57842 - RNA, 22 nt, Human
uuugguuuuuaauacaaaguac

SEQ ID NO: 57843 - RNA, 22 nt, Human
uuugguuuuuaccugcugagag

SEQ ID NO: 57844 - RNA, 22 nt, Human
uggguagaaacaaggcuggacu

SEQ ID NO: 57845 - RNA, 22 nt, Human
uggguagagacacagucugggg

SEQ ID NO: 57846 - RNA, 22 nt, Human
uggguagagcaggcuggggcuu

SEQ ID NO: 57847 - RNA, 22 nt, Human
uggguagagugcugacaaugcc

SEQ ID NO: 57848 - RNA, 22 nt, Human
uggguagggagcuggaauccua

SEQ ID NO: 57849 - RNA, 22 nt, Human
uggguagguguggccugaaugu

SEQ ID NO: 57850 - RNA, 22 nt, Human
ugggucacuauuugcagagacg

SEQ ID NO: 57851 - RNA, 22 nt, Human
ugggucagagcagaccucugga

SEQ ID NO: 57852 - RNA, 22 nt, Human
ugggucagaggaccucguggcc

SEQ ID NO: 57853 - RNA, 22 nt, Human
ugggucccaggaaggaccagca

SEQ ID NO: 57854 - RNA, 22 nt, Human
ugggucccucaugagaggcauu

SEQ ID NO: 57855 - RNA, 22 nt, Human
uggguccuaaaugcagucacau

SEQ ID NO: 57856 - RNA, 22 nt, Human
uggguccucgucuuccaaggca

SEQ ID NO: 57857 - RNA, 22 nt, Human
uggguccugucuccuuguucug

SEQ ID NO: 57858 - RNA, 22 nt, Human
uggguccuugccaucuuggagu

SEQ ID NO: 57859 - RNA, 22 nt, Human
ugggucuuuaugggggccagga

SEQ ID NO: 57860 - RNA, 20 nt, Human
ugggugagaguguuugcucu

SEQ ID NO: 57861 - RNA, 22 nt, Human
ugggugagcggcugcacacccg

SEQ ID NO: 57862 - RNA, 22 nt, Human
ugggugaguggagggcauucua

SEQ ID NO: 57863 - RNA, 21 nt, Human
ugggugcaagcugcggaugcu

SEQ ID NO: 57864 - RNA, 22 nt, Human
uggguggaauaaaucaguucug

SEQ ID NO: 57865 - RNA, 22 nt, Human
uggguggauuaggauaggguau

SEQ ID NO: 57866 - RNA, 22 nt, Human
ugggugguggcaguaaugagaa

SEQ ID NO: 57867 - RNA, 19 nt, Human
ugggugugaccaucucugc

SEQ ID NO: 57868 - RNA, 22 nt, Human
ugggugugagcccgggagccgc

SEQ ID NO: 57869 - RNA, 22 nt, Human
ugggugugcccagauggugucc

SEQ ID NO: 57870 - RNA, 22 nt, Human
ugguaaaugcuauuccuauauu

SEQ ID NO: 57871 - RNA, 22 nt, Human
ugguaagaacccaucagagaag

SEQ ID NO: 57872 - RNA, 22 nt, Human
ugguaaggauuguagaaacgaa

SEQ ID NO: 57873 - RNA, 22 nt, Human
ugguaagggcucucuuucuggc

SEQ ID NO: 57874 - RNA, 21 nt, Human
ugguaauguucaguauccacu

SEQ ID NO: 57875 - RNA, 22 nt, Human
ugguaauuuauuuugagagauu

SEQ ID NO: 57876 - RNA, 22 nt, Human
ugguacaaagccucuuugccuc

SEQ ID NO: 57877 - RNA, 22 nt, Human
ugguacaagaguauuugcgguu

SEQ ID NO: 57878 - RNA, 22 nt, Human
ugguacaagcagacucagcaga

SEQ ID NO: 57879 - RNA, 22 nt, Human
ugguacaaguucuggcauguga

SEQ ID NO: 57880 - RNA, 22 nt, Human
ugcuuuggccacuagaauucag

SEQ ID NO: 57881 - RNA, 22 nt, Human
ugcuuuuauuuaauaucuugca

SEQ ID NO: 57882 - RNA, 22 nt, Human
ugcuuuuuaguacugucuuauu

SEQ ID NO: 57883 - RNA, 22 nt, Human
uggaaaaaaauuggcuagcuuc

SEQ ID NO: 57884 - RNA, 22 nt, Human
uggaaaacauaaagcuuuuccu

SEQ ID NO: 57885 - RNA, 22 nt, Human
uggaaacacucaagcuuauauu

SEQ ID NO: 57886 - RNA, 22 nt, Human
uggaaacuaagacuagagagac

SEQ ID NO: 57887 - RNA, 22 nt, Human
uggaaacuauaaaagcaccuuc

SEQ ID NO: 57888 - RNA, 22 nt, Human
uggaaacucuaccucucuaaga

SEQ ID NO: 57889 - RNA, 22 nt, Human
uggaaacugcaguucccgggga

SEQ ID NO: 57890 - RNA, 22 nt, Human
uggaaacugggaguuaaaugua

SEQ ID NO: 57891 - RNA, 22 nt, Human
uggaaagaauuccuaugguuca

SEQ ID NO: 57892 - RNA, 22 nt, Human
uggaaagagaaacucuugcuaa

SEQ ID NO: 57893 - RNA, 22 nt, Human
uggaaagaugaagauguuuaag

SEQ ID NO: 57894 - RNA, 22 nt, Human
uggaaagcgaggaguuggcauu

SEQ ID NO: 57895 - RNA, 22 nt, Human
uggaaagguguaaagcagaacc

SEQ ID NO: 57896 - RNA, 22 nt, Human
uggaaagucucuuuugacugua

SEQ ID NO: 57897 - RNA, 22 nt, Human
uggaaagugcucuagacuuucu

SEQ ID NO: 57898 - RNA, 22 nt, Human
uggaaauaugcuccauucuuuu

SEQ ID NO: 57899 - RNA, 22 nt, Human
uggaaauuacuaacacuuagag

SEQ ID NO: 57900 - RNA, 22 nt, Human
uggaacaaauuacaauuaacuu

SEQ ID NO: 57901 - RNA, 22 nt, Human
uggaacaagggcguggcggucg

SEQ ID NO: 57902 - RNA, 22 nt, Human
uggaacaaggguucauuuaaau

SEQ ID NO: 57903 - RNA, 22 nt, Human
uggaacacacuucaaggagaaa

SEQ ID NO: 57904 - RNA, 22 nt, Human
uggaacacagugauugauagcg

SEQ ID NO: 57905 - RNA, 22 nt, Human
uggaacacaucucgcugcaggg

SEQ ID NO: 57906 - RNA, 22 nt, Human
uggaacaccuugcuccagaaag

SEQ ID NO: 57907 - RNA, 22 nt, Human
uggaaccuaaaaaugucauugc

SEQ ID NO: 57908 - RNA, 22 nt, Human
uggaagaauaggauagaagaac

SEQ ID NO: 57909 - RNA, 22 nt, Human
uggaagaaugcuccacagggaa

SEQ ID NO: 57910 - RNA, 22 nt, Human
uggaagaccagacuucccgaac

SEQ ID NO: 57911 - RNA, 23 nt, Human
uggaagacuccucucuuggcugc

SEQ ID NO: 57912 - RNA, 22 nt, Human
uggaagaggccagaaaguggga

SEQ ID NO: 57913 - RNA, 22 nt, Human
uggaagaggcccaugacugccu

SEQ ID NO: 57914 - RNA, 22 nt, Human
uggaagauaagagauugggaag

SEQ ID NO: 57915 - RNA, 22 nt, Human
uggaagcacaggaucaguggaa

SEQ ID NO: 57916 - RNA, 22 nt, Human
uggaagcacuuggguuuuguug

SEQ ID NO: 57917 - RNA, 22 nt, Human
uggaagcagugauucuugucug

SEQ ID NO: 57918 - RNA, 22 nt, Human
uggaagccguaggguuugggaa

SEQ ID NO: 57919 - RNA, 22 nt, Human
uggaagccucaguuugccuucu

SEQ ID NO: 57920 - RNA, 22 nt, Human
uggaagcgagacagagaucucc

SEQ ID NO: 57921 - RNA, 22 nt, Human
uggaagcggugcuggcccaugg

SEQ ID NO: 57922 - RNA, 22 nt, Human
uggaagcuucugaccauuuuug

SEQ ID NO: 57923 - RNA, 22 nt, Human
uggaaggcacugggagaagacu

SEQ ID NO: 57924 - RNA, 22 nt, Human
uggaaggcaugggaacuguucu

SEQ ID NO: 57925 - RNA, 17 nt, Human
uggaaggcuucaauauu

SEQ ID NO: 57926 - RNA, 22 nt, Human
uggaagggaacagguggguguu

SEQ ID NO: 57927 - RNA, 21 nt, Human
uggaagggaagucuugguugu

SEQ ID NO: 57928 - RNA, 22 nt, Human
uggaagggguuacgcagcagga

SEQ ID NO: 57929 - RNA, 22 nt, Human
uggaagugagaaguuuccucag

SEQ ID NO: 57930 - RNA, 17 nt, Human
uggaagugaggacacug

SEQ ID NO: 57931 - RNA, 22 nt, Human
uggaagugauuacaauguagua

SEQ ID NO: 57932 - RNA, 22 nt, Human
uggaagugccuugcuggcugug

SEQ ID NO: 57933 - RNA, 22 nt, Human
uggaaguugaaucucagucaug

SEQ ID NO: 57934 - RNA, 22 nt, Human
uggaauaaugaccacagaaaca

SEQ ID NO: 57935 - RNA, 22 nt, Human
uggaauacuguaaagaaaaauc

SEQ ID NO: 57936 - RNA, 22 nt, Human
uggaauagaggugcugauauua

SEQ ID NO: 57937 - RNA, 22 nt, Human
uggaaucccgcaauggaggauu

SEQ ID NO: 57938 - RNA, 22 nt, Human
uggaaucugugcuguuuuagug

SEQ ID NO: 57939 - RNA, 22 nt, Human
uggaaugacaaguuguucagag

SEQ ID NO: 57940 - RNA, 22 nt, Human
uggaaugcauggcucugugacg

SEQ ID NO: 57941 - RNA, 22 nt, Human
uggaauggaaacaaacugagga

SEQ ID NO: 57942 - RNA, 22 nt, Human
uggaauguaaacucugugaggg

SEQ ID NO: 57943 - RNA, 22 nt, Human
uggaauguaaagcgugugauaa

SEQ ID NO: 57944 - RNA, 22 nt, Human
uggaauguaaucagaauaugaa

SEQ ID NO: 57945 - RNA, 22 nt, Human
uggaauguaaucaugugguggu

SEQ ID NO: 57946 - RNA, 22 nt, Human
uggaaugucaaaagucugcuau

SEQ ID NO: 57947 - RNA, 22 nt, Human
uggaauguggauaagggugucu

SEQ ID NO: 57948 - RNA, 22 nt, Human
uggaauguuaaaccucaaugau

SEQ ID NO: 57949 - RNA, 22 nt, Human
uggaauguuaugaugaugguaa

SEQ ID NO: 57950 - RNA, 19 nt, Human
uggaauguuccaaggaggc

SEQ ID NO: 57951 - RNA, 22 nt, Human
uggaauguuuccccagccugca

SEQ ID NO: 57952 - RNA, 22 nt, Human
uggaauguuugacuuauucagu

SEQ ID NO: 57953 - RNA, 22 nt, Human
uuuucagaauuagcauaccauu

SEQ ID NO: 57954 - RNA, 22 nt, Human
uuuucagagagcuuuuaugucc

SEQ ID NO: 57955 - RNA, 22 nt, Human
uuuucaggccagaagauagacc

SEQ ID NO: 57956 - RNA, 22 nt, Human
uuuucaguaaugucuacauaau

SEQ ID NO: 57957 - RNA, 22 nt, Human
uuuucagugggcaaugauguga

SEQ ID NO: 57958 - RNA, 22 nt, Human
uuuucaguuauagaaugguaga

SEQ ID NO: 57959 - RNA, 22 nt, Human
uuuucauaguaauggugcaugu

SEQ ID NO: 57960 - RNA, 22 nt, Human
uuuucaugugaugugacauuuc

SEQ ID NO: 57961 - RNA, 22 nt, Human
uuuucauuagaaugacugagaa

SEQ ID NO: 57962 - RNA, 22 nt, Human
uuuucauuguuacuaugagcua

SEQ ID NO: 57963 - RNA, 23 nt, Human
uuuuccagaaucgacucuguaga

SEQ ID NO: 57964 - RNA, 22 nt, Human
uuuuccagauggauacuagaau

SEQ ID NO: 57965 - RNA, 22 nt, Human
uuuuccagauuggacuuagucc

SEQ ID NO: 57966 - RNA, 22 nt, Human
uuuuccucaggaaugcuaagcu

SEQ ID NO: 57967 - RNA, 22 nt, Human
uuuuccucuguaugcgugagau

SEQ ID NO: 57968 - RNA, 23 nt, Human
uuuuccuguggagacaugacugg

SEQ ID NO: 57969 - RNA, 22 nt, Human
uuuuccuucaccucuugagccu

SEQ ID NO: 57970 - RNA, 19 nt, Human
uuuuccuucuauauguuuc

SEQ ID NO: 57971 - RNA, 22 nt, Human
uuuuccuuucaucaggacaaag

SEQ ID NO: 57972 - RNA, 23 nt, Human
uuuuccuuuggacaggcuguauu

SEQ ID NO: 57973 - RNA, 22 nt, Human
uuuucuaacaucuaguaauuug

SEQ ID NO: 57974 - RNA, 22 nt, Human
uuuucuauuaacucauuuugca

SEQ ID NO: 57975 - RNA, 22 nt, Human
uuuucucaggugcuuaucuaag

SEQ ID NO: 57976 - RNA, 22 nt, Human
uuuucuccccagagaccaucau

SEQ ID NO: 57977 - RNA, 17 nt, Human
uuuucucucuuggauuc

SEQ ID NO: 57978 - RNA, 22 nt, Human
uuuucugagcucagugacuuac

SEQ ID NO: 57979 - RNA, 22 nt, Human
uuuucugccugcguguuuagga

SEQ ID NO: 57980 - RNA, 22 nt, Human
uuuucuguaagaggacuuuaau

SEQ ID NO: 57981 - RNA, 20 nt, Human
uuuucugugccaagaaaacu

SEQ ID NO: 57982 - RNA, 22 nt, Human
uuuucugugcccugcuagcugg

SEQ ID NO: 57983 - RNA, 22 nt, Human
uuuucuguguauccaggcuucc

SEQ ID NO: 57984 - RNA, 22 nt, Human
uuuucugugugucccucgacag

SEQ ID NO: 57985 - RNA, 22 nt, Human
uuuucuuauggugaagcacaaa

SEQ ID NO: 57986 - RNA, 22 nt, Human
uuuucuuccuggauuuuggcau

SEQ ID NO: 57987 - RNA, 22 nt, Human
uuuucuuggaguggcuguccuu

SEQ ID NO: 57988 - RNA, 22 nt, Human
uuuugaaagccagguuuguaug

SEQ ID NO: 57989 - RNA, 22 nt, Human
uuuugaagaagaugggaauuua

SEQ ID NO: 57990 - RNA, 22 nt, Human
uuuugaauaauucagaaacagc

SEQ ID NO: 57991 - RNA, 22 nt, Human
uuuugcugguuuaucucuauua

SEQ ID NO: 57992 - RNA, 22 nt, Human
uuuugcuguguccuugagccgg

SEQ ID NO: 57993 - RNA, 22 nt, Human
uuuugcuuaaucuagauuuugc

SEQ ID NO: 57994 - RNA, 22 nt, Human
uuuuggaugagcccagauuucu

SEQ ID NO: 57995 - RNA, 22 nt, Human
uuuuggcaaaggcauucucuuu

SEQ ID NO: 57996 - RNA, 22 nt, Human
uuuuggcuccagugguuugugc

SEQ ID NO: 57997 - RNA, 18 nt, Human
ugguuccuugaaggggca

SEQ ID NO: 57998 - RNA, 23 nt, Human
ugguucuaggccuauaauuauau

SEQ ID NO: 57999 - RNA, 23 nt, Human
ugguugcagugccaaguaucacg

SEQ ID NO: 58000 - RNA, 22 nt, Human
ugguuguauaaugucacuaagc

SEQ ID NO: 58001 - RNA, 22 nt, Human
ugguugugcacggagcugcagg

SEQ ID NO: 58002 - RNA, 22 nt, Human
ugguugugguccuccacaucgc

SEQ ID NO: 58003 - RNA, 22 nt, Human
ugguuuaccccuguccuauauc

SEQ ID NO: 58004 - RNA, 22 nt, Human
ugguuuacucuguaaaccagga

SEQ ID NO: 58005 - RNA, 22 nt, Human
ugguuucaugagaugagaauuu

SEQ ID NO: 58006 - RNA, 22 nt, Human
ugguuucccauuaucugcagga

SEQ ID NO: 58007 - RNA, 22 nt, Human
ugguuugagagugugagcuuuu

SEQ ID NO: 58008 - RNA, 22 nt, Human
ugguuuuaaaagauguuugaga

SEQ ID NO: 58009 - RNA, 22 nt, Human
ugguuuuagaguauauucaggg

SEQ ID NO: 58010 - RNA, 22 nt, Human
ugguuuuagaugccuuuacugc

SEQ ID NO: 58011 - RNA, 22 nt, Human
ugguuuucuggugguggcagug

SEQ ID NO: 58012 - RNA, 22 nt, Human
ugguuuugcuaaaauagaaaga

SEQ ID NO: 58013 - RNA, 22 nt, Human
ugguuuuugguguucacagagg

SEQ ID NO: 58014 - RNA, 22 nt, Human
uguaaaagacauuucuaagcaa

SEQ ID NO: 58015 - RNA, 22 nt, Human
uguaaaagguuguucuuucguu

SEQ ID NO: 58016 - RNA, 22 nt, Human
uguaaaauaauucuccauguuu

SEQ ID NO: 58017 - RNA, 22 nt, Human
uguaaacaaaugcauucuugcu

SEQ ID NO: 58018 - RNA, 18 nt, Human
uguaaacacuuucauucu

SEQ ID NO: 58019 - RNA, 22 nt, Human
uguaaacaguaggacuaaagag

SEQ ID NO: 58020 - RNA, 22 nt, Human
uguaaacauaccagagccaagu

SEQ ID NO: 58021 - RNA, 22 nt, Human
uguaaacauaucagacuuucuu

SEQ ID NO: 58022 - RNA, 23 nt, Human
uguaaacaucacccccuggaguu

SEQ ID NO: 58023 - RNA, 22 nt, Human
uguaaagagaaggcuuauaaag

SEQ ID NO: 58024 - RNA, 22 nt, Human
uguaaagauccuuagcaacauc

SEQ ID NO: 58025 - RNA, 22 nt, Human
uguaaaguuuuauuguuccuuc

SEQ ID NO: 58026 - RNA, 22 nt, Human
uguaaauaguuagcuugccucu

SEQ ID NO: 58027 - RNA, 22 nt, Human
uguaaauugaaggaaauuugug

SEQ ID NO: 58028 - RNA, 17 nt, Human
uguaacaacuccuauua

SEQ ID NO: 58029 - RNA, 20 nt, Human
uguaacaaucuggauguugc

SEQ ID NO: 58030 - RNA, 20 nt, Human
uguaacacaugagcuuugag

SEQ ID NO: 58031 - RNA, 22 nt, Human
uguaacauauagcauguucuug

SEQ ID NO: 58032 - RNA, 22 nt, Human
uguaacaucacagugauguuug

SEQ ID NO: 58033 - RNA, 22 nt, Human
uguaacaugguucuuacucuca

SEQ ID NO: 58034 - RNA, 23 nt, Human
uguaacuucuuaaauucuucacu

SEQ ID NO: 58035 - RNA, 23 nt, Human
uguaacuugauggaaugagcuau

SEQ ID NO: 58036 - RNA, 23 nt, Human
uguaacuuugggcauguugcuuc

SEQ ID NO: 58037 - RNA, 22 nt, Human
uguaagaagggccagagcucca

SEQ ID NO: 58038 - RNA, 22 nt, Human
uguaagauaugaguacauguaa

SEQ ID NO: 58039 - RNA, 22 nt, Human
uguaagauuugcuauguguugu

SEQ ID NO: 58040 - RNA, 17 nt, Human
uguaagcaggugagaga

SEQ ID NO: 58041 - RNA, 22 nt, Human
uguaagccuucccugagaaagu

SEQ ID NO: 58042 - RNA, 22 nt, Human
uguaagugcucagcugaugguu

SEQ ID NO: 58043 - RNA, 22 nt, Human
uguaauaaugaggcauccagcc

SEQ ID NO: 58044 - RNA, 22 nt, Human
uguaauaccacuguuggacauu

SEQ ID NO: 58045 - RNA, 22 nt, Human
uguaauauuguagugacaguac

SEQ ID NO: 58046 - RNA, 22 nt, Human
uguaaucauuacaguacaugga

SEQ ID NO: 58047 - RNA, 22 nt, Human
uguaaugaaaaggaggaaauag

SEQ ID NO: 58048 - RNA, 22 nt, Human
uguaaugggcuacuaggaagag

SEQ ID NO: 58049 - RNA, 22 nt, Human
uguaauguuagaaacaauugcu

SEQ ID NO: 58050 - RNA, 22 nt, Human
uguaauuaacguucuuguuaga

SEQ ID NO: 58051 - RNA, 22 nt, Human
uguaauuauuucugugcaguca

SEQ ID NO: 58052 - RNA, 22 nt, Human
uguaauuugcauggcugaaugc

SEQ ID NO: 58053 - RNA, 22 nt, Human
uguacaaggccaucuacaugcu

SEQ ID NO: 58054 - RNA, 22 nt, Human
uguacaaugccagggaacacca

SEQ ID NO: 58055 - RNA, 22 nt, Human
uguacaauguguuuguuggcuu

SEQ ID NO: 58056 - RNA, 22 nt, Human
uguacacaacgugcagguuugu

SEQ ID NO: 58057 - RNA, 22 nt, Human
uguacacaaugauaaauuauua

SEQ ID NO: 58058 - RNA, 22 nt, Human
uguacacaaugugcagguuugu

SEQ ID NO: 58059 - RNA, 22 nt, Human
uguacacaauucuuaacauaca

SEQ ID NO: 58060 - RNA, 22 nt, Human
uguacacaugguguacacuccc

SEQ ID NO: 58061 - RNA, 22 nt, Human
uguacacauuaagcucuuuaga

SEQ ID NO: 58062 - RNA, 22 nt, Human
uggcuccuggcagguguuucaa

SEQ ID NO: 58063 - RNA, 22 nt, Human
uggcuccuucauucuccugcca

SEQ ID NO: 58064 - RNA, 22 nt, Human
uggcuccuuuccgggucuccag

SEQ ID NO: 58065 - RNA, 22 nt, Human
uggcucucaauggcuguacuau

SEQ ID NO: 58066 - RNA, 22 nt, Human
uggcucuccagagccuauggua

SEQ ID NO: 58067 - RNA, 22 nt, Human
uggcucuccagcucuaaggccu

SEQ ID NO: 58068 - RNA, 22 nt, Human
uggcucucccaauaccuuucug

SEQ ID NO: 58069 - RNA, 22 nt, Human
uggcucucuacaggucaagacc

SEQ ID NO: 58070 - RNA, 22 nt, Human
uggcucugagucugcccuuggc

SEQ ID NO: 58071 - RNA, 18 nt, Human
uggcucugccacucaccg

SEQ ID NO: 58072 - RNA, 22 nt, Human
uggcucugccccauaccccugc

SEQ ID NO: 58073 - RNA, 22 nt, Human
uggcucugcgucuguucguggg

SEQ ID NO: 58074 - RNA, 22 nt, Human
uggcucuggccaccgggagggc

SEQ ID NO: 58075 - RNA, 22 nt, Human
uggcucugucacugugagcuau

SEQ ID NO: 58076 - RNA, 22 nt, Human
uggcucuguggauguucugacc

SEQ ID NO: 58077 - RNA, 22 nt, Human
uggcucuguugugcugagccag

SEQ ID NO: 58078 - RNA, 22 nt, Human
uggcucuguuuguuaacuagac

SEQ ID NO: 58079 - RNA, 22 nt, Human
uggcucuguuuuaugaguacca

SEQ ID NO: 58080 - RNA, 22 nt, Human
uggcucuuaaggucccugugcu

SEQ ID NO: 58081 - RNA, 22 nt, Human
uggcucuuggugcuaguuucug

SEQ ID NO: 58082 - RNA, 22 nt, Human
uggcucuuucugucugggaucc

SEQ ID NO: 58083 - RNA, 22 nt, Human
uggcucuuuucacguccccucu

SEQ ID NO: 58084 - RNA, 22 nt, Human
uggcugaaggaagauucuucua

SEQ ID NO: 58085 - RNA, 22 nt, Human
uggcugaauaauauucuguugu

SEQ ID NO: 58086 - RNA, 22 nt, Human
uggcugagaccaucagggugua

SEQ ID NO: 58087 - RNA, 22 nt, Human
uggcugagccacuuguucagau

SEQ ID NO: 58088 - RNA, 22 nt, Human
uggcugagccuuuggggcuuuc

SEQ ID NO: 58089 - RNA, 22 nt, Human
uggcugaggagagggcggaagu

SEQ ID NO: 58090 - RNA, 22 nt, Human
uggcugaggagggucuucuggu

SEQ ID NO: 58091 - RNA, 22 nt, Human
uggcugagguaacuaugaauaa

SEQ ID NO: 58092 - RNA, 22 nt, Human
uggcugaguuucaugcaucaug

SEQ ID NO: 58093 - RNA, 21 nt, Human
uggcugcacuguggcuuucau

SEQ ID NO: 58094 - RNA, 22 nt, Human
uggcugcagaucugugggacac

SEQ ID NO: 58095 - RNA, 22 nt, Human
uggcugcagugcuugagauguc

SEQ ID NO: 58096 - RNA, 22 nt, Human
uggcugccuagugucugagcag

SEQ ID NO: 58097 - RNA, 22 nt, Human
uggcugcugagaaggcagcugu

SEQ ID NO: 58098 - RNA, 21 nt, Human
uggcugcuggcccucucucca

SEQ ID NO: 58099 - RNA, 22 nt, Human
uggcuggaagucagaaauggga

SEQ ID NO: 58100 - RNA, 22 nt, Human
uggcuggaauggagcugagccu

SEQ ID NO: 58101 - RNA, 22 nt, Human
uggcuggacagugggcagugga

SEQ ID NO: 58102 - RNA, 22 nt, Human
uggcuggaguauaggaguagga

SEQ ID NO: 58103 - RNA, 22 nt, Human
uggcuggauaauauucuguugu

SEQ ID NO: 58104 - RNA, 22 nt, Human
uggcuggauaucagaggaagug

SEQ ID NO: 58105 - RNA, 22 nt, Human
uggcuggcaaggcuggagucag

SEQ ID NO: 58106 - RNA, 18 nt, Human
uggcuggcagugggcagc

SEQ ID NO: 58107 - RNA, 22 nt, Human
uggcuggcauagccauugcucc

SEQ ID NO: 58108 - RNA, 22 nt, Human
uggcuggcuagugggcaggauu

SEQ ID NO: 58109 - RNA, 22 nt, Human
uggcuggcuggaccacaccugc

SEQ ID NO: 58110 - RNA, 22 nt, Human
uuuuggcucuugguaggucaga

SEQ ID NO: 58111 - RNA, 19 nt, Human
uuuuggcuggagugaucug

SEQ ID NO: 58112 - RNA, 22 nt, Human
uuuuggggagaacgguugcuau

SEQ ID NO: 58113 - RNA, 22 nt, Human
uuuugguacaugcaauagcaau

SEQ ID NO: 58114 - RNA, 21 nt, Human
uuuugguccuggcuuaggagc

SEQ ID NO: 58115 - RNA, 22 nt, Human
uuuuggugaauuuaagugcugu

SEQ ID NO: 58116 - RNA, 17 nt, Human
uuuuggugaccuuggcc

SEQ ID NO: 58117 - RNA, 22 nt, Human
uuuuggugauuuuacugaaggu

SEQ ID NO: 58118 - RNA, 22 nt, Human
uuuugguuuggcuccaaauagg

SEQ ID NO: 58119 - RNA, 22 nt, Human
uuuuguaagaaacugccaagcc

SEQ ID NO: 58120 - RNA, 22 nt, Human
uuuugucagugagaacagaguu

SEQ ID NO: 58121 - RNA, 22 nt, Human
uuuugugagcccauaaaugcca

SEQ ID NO: 58122 - RNA, 22 nt, Human
uuuugugagcuccuuggaggua

SEQ ID NO: 58123 - RNA, 22 nt, Human
uuuugugauggcauuacauuua

SEQ ID NO: 58124 - RNA, 17 nt, Human
uuuuguucaucuucaaa

SEQ ID NO: 58125 - RNA, 22 nt, Human
uuuuguuguaauauaccuaucc

SEQ ID NO: 58126 - RNA, 22 nt, Human
uuuuguuuaaaauccuggaugg

SEQ ID NO: 58127 - RNA, 22 nt, Human
uuuuuaagcuccuuugauguca

SEQ ID NO: 58128 - RNA, 19 nt, Human
uuuuuacaaguagguguga

SEQ ID NO: 58129 - RNA, 22 nt, Human
uuuuuacagucauggucacuca

SEQ ID NO: 58130 - RNA, 22 nt, Human
uuuuuagaguguuaccaguaua

SEQ ID NO: 58131 - RNA, 22 nt, Human
uuuuuagccaagccauaggucu

SEQ ID NO: 58132 - RNA, 22 nt, Human
uuuuuauaccaccucucacuua

SEQ ID NO: 58133 - RNA, 22 nt, Human
uuuuuaucuacagauucucagc

SEQ ID NO: 58134 - RNA, 22 nt, Human
uuuuucccaaaggcaauugccu

SEQ ID NO: 58135 - RNA, 22 nt, Human
uuuuuccuagcgauuugucagc

SEQ ID NO: 58136 - RNA, 20 nt, Human
uuuuuccuucucuacaggca

SEQ ID NO: 58137 - RNA, 22 nt, Human
uuuuucugagaauaugagagga

SEQ ID NO: 58138 - RNA, 22 nt, Human
uuuuucugccauucaaagagga

SEQ ID NO: 58139 - RNA, 22 nt, Human
uuuuugagauggauuuagcucu

SEQ ID NO: 58140 - RNA, 22 nt, Human
uuuuugaucugagcaguuggag

SEQ ID NO: 58141 - RNA, 22 nt, Human
uuuuugcuccacaacuuugaag

SEQ ID NO: 58142 - RNA, 22 nt, Human
uuuuuggcccuuagcucuguau

SEQ ID NO: 58143 - RNA, 22 nt, Human
uuuuuguagucauuagaagagg

SEQ ID NO: 58144 - RNA, 22 nt, Human
uuuuugucuagcgucucuaguu

SEQ ID NO: 58145 - RNA, 22 nt, Human
uuuuugugaaaucuccagacau

SEQ ID NO: 58146 - RNA, 22 nt, Human
uuuuugugauaugacacuguau

SEQ ID NO: 58147 - RNA, 22 nt, Human
uuuuuguucccagagaauuugu

SEQ ID NO: 58148 - RNA, 22 nt, Human
uuuuuguugcagagaggccacu

SEQ ID NO: 58149 - RNA, 22 nt, Human
uuuuuuacagaaucauuaauca

SEQ ID NO: 58150 - RNA, 22 nt, Human
uuuuuuaguuaggucagaaugu

SEQ ID NO: 58151 - RNA, 22 nt, Human
uuuuuucagccugucugugcca

SEQ ID NO: 58152 - RNA, 22 nt, Human
uuuuuuccucugugauggcaaa

SEQ ID NO: 58153 - RNA, 22 nt, Human
uuuuuugcacacucugcuaaau

SEQ ID NO: 58154 - RNA, 22 nt, Human
uuuuuuguuggguagaacggaa

SEQ ID NO: 58155 - RNA, 22 nt, Human
uggaucugacuggcuuuucuuc

SEQ ID NO: 58156 - RNA, 22 nt, Human
uggaugaaaaaugagaauuuuc

SEQ ID NO: 58157 - RNA, 22 nt, Human
uggaugagaaacucuggugacu

SEQ ID NO: 58158 - RNA, 22 nt, Human
uggaugaggcuggguuaggcag

SEQ ID NO: 58159 - RNA, 22 nt, Human
uggaugagggcugagcacuggg

SEQ ID NO: 58160 - RNA, 22 nt, Human
uggaugaguucaaugaggcaga

SEQ ID NO: 58161 - RNA, 22 nt, Human
uggaugccugggccuccuucca

SEQ ID NO: 58162 - RNA, 22 nt, Human
uggauggagacugauaugggua

SEQ ID NO: 58163 - RNA, 22 nt, Human
uggauggcuggggaagagcagg

SEQ ID NO: 58164 - RNA, 22 nt, Human
uggauggguugaaaugugagcc

SEQ ID NO: 58165 - RNA, 20 nt, Human
uggaugucaaauuaggcugg

SEQ ID NO: 58166 - RNA, 22 nt, Human
uggauuaguuuaacaauguggc

SEQ ID NO: 58167 - RNA, 22 nt, Human
uggauucaaauuucagcucugu

SEQ ID NO: 58168 - RNA, 20 nt, Human
uggauucuggagcugcccuc

SEQ ID NO: 58169 - RNA, 18 nt, Human
uggauugaauugagaggu

SEQ ID NO: 58170 - RNA, 21 nt, Human
uggauugaggugacagugugc

SEQ ID NO: 58171 - RNA, 22 nt, Human
uggauugauaaaaugggauguu

SEQ ID NO: 58172 - RNA, 22 nt, Human
uggauugcagcagcuccugugg

SEQ ID NO: 58173 - RNA, 19 nt, Human
uggauuuauauucuuuauc

SEQ ID NO: 58174 - RNA, 22 nt, Human
uggauuugcuaccuucugauau

SEQ ID NO: 58175 - RNA, 22 nt, Human
uggcaaaaugagcaauuacuuu

SEQ ID NO: 58176 - RNA, 22 nt, Human
uggcaaagaccgcaauuacuuu

SEQ ID NO: 58177 - RNA, 22 nt, Human
uggcaaaggaaaugauuuaaga

SEQ ID NO: 58178 - RNA, 22 nt, Human
uggcaaaggaaccuauuuuaaa

SEQ ID NO: 58179 - RNA, 22 nt, Human
uggcaaauuuuggcaagcugaa

SEQ ID NO: 58180 - RNA, 22 nt, Human
uggcaacaagaaaggcagaggg

SEQ ID NO: 58181 - RNA, 22 nt, Human
uggcaacaccuggaagacaugg

SEQ ID NO: 58182 - RNA, 22 nt, Human
uggcaacauggacaggucugcc

SEQ ID NO: 58183 - RNA, 22 nt, Human
uggcaacaugucgaagugcugu

SEQ ID NO: 58184 - RNA, 22 nt, Human
uggcaagaauauuggaccagaa

SEQ ID NO: 58185 - RNA, 22 nt, Human
uggcaagcagagucuggugggg

SEQ ID NO: 58186 - RNA, 18 nt, Human
uggcaaguaaugacaaaa

SEQ ID NO: 58187 - RNA, 22 nt, Human
uggcaauaaagaccaacagguu

SEQ ID NO: 58188 - RNA, 22 nt, Human
uggcaauaauuguaauucaauu

SEQ ID NO: 58189 - RNA, 22 nt, Human
uggcaauauaaucaucugcucu

SEQ ID NO: 58190 - RNA, 22 nt, Human
uggcaaugagcaggugcucugg

SEQ ID NO: 58191 - RNA, 21 nt, Human
uggcaauggccaacagucauc

SEQ ID NO: 58192 - RNA, 22 nt, Human
uggcaauguggaaugguccagg

SEQ ID NO: 58193 - RNA, 22 nt, Human
uggcaauguggcaucaacgaag

SEQ ID NO: 58194 - RNA, 22 nt, Human
uggcaauguuagcaaagcauuu

SEQ ID NO: 58195 - RNA, 22 nt, Human
uggcaauuuucuagcagauggc

SEQ ID NO: 58196 - RNA, 22 nt, Human
uggcacagaaaaaugcuccauu

SEQ ID NO: 58197 - RNA, 16 nt, Human
uggcacagagcagaua

SEQ ID NO: 58198 - RNA, 17 nt, Human
uggcacagaggugcuau

SEQ ID NO: 58199 - RNA, 23 nt, Human
uggcacagcaggugugcuuuguu

SEQ ID NO: 58200 - RNA, 22 nt, Human
uggcacagccacugaaucggga

SEQ ID NO: 58201 - RNA, 22 nt, Human
uggcacagcccagagcucuuga

SEQ ID NO: 58202 - RNA, 22 nt, Human
uggcacaggagcacugcccugg

SEQ ID NO: 58203 - RNA, 22 nt, Human
uggcacuggaaucguagccuug

SEQ ID NO: 58204 - RNA, 22 nt, Human
uggcacugggaugcuacuguua

SEQ ID NO: 58205 - RNA, 22 nt, Human
uggcagaaguucacuaguagcu

SEQ ID NO: 58206 - RNA, 22 nt, Human
uggcagaaugaagacuggggcc

SEQ ID NO: 58207 - RNA, 21 nt, Human
uggcagacaggaggagcucac

SEQ ID NO: 58208 - RNA, 22 nt, Human
uguccucaaggagcuucagucu

SEQ ID NO: 58209 - RNA, 22 nt, Human
uguccucaggaccuggcacagu

SEQ ID NO: 58210 - RNA, 22 nt, Human
uguccucuaauuggccucuugc

SEQ ID NO: 58211 - RNA, 22 nt, Human
uguccucuguuaggggauagcg

SEQ ID NO: 58212 - RNA, 22 nt, Human
uguccugcaagcccuaaugaau

SEQ ID NO: 58213 - RNA, 22 nt, Human
uguccugggaacucacagucca

SEQ ID NO: 58214 - RNA, 22 nt, Human
uguccugggccggcgacugguc

SEQ ID NO: 58215 - RNA, 22 nt, Human
uguccuggggacaagaggcccu

SEQ ID NO: 58216 - RNA, 22 nt, Human
uguccuggugcuccagguggcu

SEQ ID NO: 58217 - RNA, 22 nt, Human
uguccugugaccuggcaccaca

SEQ ID NO: 58218 - RNA, 22 nt, Human
uguccugugauuccagcucuuc

SEQ ID NO: 58219 - RNA, 22 nt, Human
uguccuguucuggcgugagugg

SEQ ID NO: 58220 - RNA, 22 nt, Human
uguccuuagggauauaaaauau

SEQ ID NO: 58221 - RNA, 22 nt, Human
uguccuuaucuccaaacaauca

SEQ ID NO: 58222 - RNA, 22 nt, Human
uguccuuuacugauugcuucug

SEQ ID NO: 58223 - RNA, 22 nt, Human
uguccuuugggagggcacagcu

SEQ ID NO: 58224 - RNA, 22 nt, Human
uguccuuuguucccugucucug

SEQ ID NO: 58225 - RNA, 22 nt, Human
uguccuuuuccccaaauucacu

SEQ ID NO: 58226 - RNA, 22 nt, Human
uguccuuuuggcugucuauggu

SEQ ID NO: 58227 - RNA, 22 nt, Human
ugucgauucagcucuucagaga

SEQ ID NO: 58228 - RNA, 22 nt, Human
ugucggccacgagggagccgcg

SEQ ID NO: 58229 - RNA, 22 nt, Human
ugucgggcaugcauucugagaa

SEQ ID NO: 58230 - RNA, 22 nt, Human
ugucuacaagccuuguucggca

SEQ ID NO: 58231 - RNA, 22 nt, Human
ugucuacuccugugcuagcucc

SEQ ID NO: 58232 - RNA, 22 nt, Human
ugucuagaggccaacaggaaag

SEQ ID NO: 58233 - RNA, 22 nt, Human
ugucuauguauacauguguaua

SEQ ID NO: 58234 - RNA, 22 nt, Human
ugucuauuaauuccacauaaaa

SEQ ID NO: 58235 - RNA, 22 nt, Human
ugucucagaauggcucauaaua

SEQ ID NO: 58236 - RNA, 22 nt, Human
ugucucagaguaucccugaacu

SEQ ID NO: 58237 - RNA, 22 nt, Human
ugucucagcugugcuucauugg

SEQ ID NO: 58238 - RNA, 18 nt, Human
ugucucaggcugaaacag

SEQ ID NO: 58239 - RNA, 22 nt, Human
ugucucaggggcauugaaauaa

SEQ ID NO: 58240 - RNA, 22 nt, Human
ugucucaucucuuaaccccacu

SEQ ID NO: 58241 - RNA, 22 nt, Human
ugucuccaaaacaaucucagau

SEQ ID NO: 58242 - RNA, 22 nt, Human
ugucuccacaggugucagcuca

SEQ ID NO: 58243 - RNA, 22 nt, Human
ugucuccaccaucaucuuacca

SEQ ID NO: 58244 - RNA, 22 nt, Human
ugucuccagaaagcaccaggag

SEQ ID NO: 58245 - RNA, 22 nt, Human
ugucuccauagaguagcuugau

SEQ ID NO: 58246 - RNA, 22 nt, Human
ugucuccaugugauaguggccu

SEQ ID NO: 58247 - RNA, 22 nt, Human
ugucuccuaaugucuguuuccu

SEQ ID NO: 58248 - RNA, 22 nt, Human
ugucuccucaacucaugcucga

SEQ ID NO: 58249 - RNA, 22 nt, Human
ugucuccucauacugucauauu

SEQ ID NO: 58250 - RNA, 22 nt, Human
ugucucuccacacagccagugc

SEQ ID NO: 58251 - RNA, 22 nt, Human
ugucucucugcccccauugcuc

SEQ ID NO: 58252 - RNA, 22 nt, Human
ugucucugaaauauguggcucc

SEQ ID NO: 58253 - RNA, 22 nt, Human
ugucucugaacagcuuacuaaa

SEQ ID NO: 58254 - RNA, 22 nt, Human
ugucucuggcccaugagcagag

SEQ ID NO: 58255 - RNA, 22 nt, Human
ugucucuuacuuugauucuugg

SEQ ID NO: 58256 - RNA, 22 nt, Human
ugucucuucugccuccagcugu

SEQ ID NO: 58257 - RNA, 22 nt, Human
ugucucuuuggccucccauaug

SEQ ID NO: 58258 - RNA, 22 nt, Human
ugucucuuuggguuccucuugg

SEQ ID NO: 58259 - RNA, 22 nt, Human
ugucugaaacuuaugauauacu

SEQ ID NO: 58260 - RNA, 22 nt, Human
ugucugaaacuugguccuaugc

SEQ ID NO: 58261 - RNA, 22 nt, Human
ugucugaaagaggacgagcugg

SEQ ID NO: 58262 - RNA, 22 nt, Human
ugucugaaaggcuuuuucucac

SEQ ID NO: 58263 - RNA, 18 nt, Human
ugucugaagccacuuuuu

SEQ ID NO: 58264 - RNA, 22 nt, Human
uggcugcccccucccguggaca

SEQ ID NO: 58265 - RNA, 20 nt, Human
uggcugcccgaggcacacac

SEQ ID NO: 58266 - RNA, 21 nt, Human
uggcugccuggcucugugguu

SEQ ID NO: 58267 - RNA, 22 nt, Human
uggcugcguuuuccgauguauu

SEQ ID NO: 58268 - RNA, 22 nt, Human
uggcugcuuguuuuagugaggc

SEQ ID NO: 58269 - RNA, 22 nt, Human
uggcuggaaacaggagauucag

SEQ ID NO: 58270 - RNA, 22 nt, Human
uggcuggaccugggcuggaauu

SEQ ID NO: 58271 - RNA, 22 nt, Human
uggcuggagaacuuggggaucu

SEQ ID NO: 58272 - RNA, 22 nt, Human
uggcuggaggaaggaacugagg

SEQ ID NO: 58273 - RNA, 22 nt, Human
uggcuggaggguuagugagaua

SEQ ID NO: 58274 - RNA, 22 nt, Human
uggcuggagugggagaaguuua

SEQ ID NO: 58275 - RNA, 22 nt, Human
uggcuggauuauuggcuaguac

SEQ ID NO: 58276 - RNA, 23 nt, Human
uggcuggcagaaacugaagcaug

SEQ ID NO: 58277 - RNA, 18 nt, Human
uggcuggcucugucaucu

SEQ ID NO: 58278 - RNA, 22 nt, Human
uggcuggcuguccagcugggca

SEQ ID NO: 58279 - RNA, 22 nt, Human
uggcugggcccccaccugccuc

SEQ ID NO: 58280 - RNA, 19 nt, Human
uggcugggcgugccuccgu

SEQ ID NO: 58281 - RNA, 22 nt, Human
uggcuggggccacaguuuuccu

SEQ ID NO: 58282 - RNA, 19 nt, Human
uggcugggugccaauggcc

SEQ ID NO: 58283 - RNA, 20 nt, Human
uggcugugggcaucuguuuc

SEQ ID NO: 58284 - RNA, 22 nt, Human
uggcuguggguggaaggaaacc

SEQ ID NO: 58285 - RNA, 22 nt, Human
uggcuucaaaaucuaguggucu

SEQ ID NO: 58286 - RNA, 23 nt, Human
uggcuucaacucugucggcagcc

SEQ ID NO: 58287 - RNA, 22 nt, Human
uggcuucaaggugauaauuuac

SEQ ID NO: 58288 - RNA, 22 nt, Human
uggcuucaagucuagguucuac

SEQ ID NO: 58289 - RNA, 22 nt, Human
uggcuucagacuucugcuacgu

SEQ ID NO: 58290 - RNA, 22 nt, Human
uggcuucagagacagaaucuau

SEQ ID NO: 58291 - RNA, 17 nt, Human
uggcuucagauguacau

SEQ ID NO: 58292 - RNA, 22 nt, Human
uggcuucagucucaucuuggaa

SEQ ID NO: 58293 - RNA, 22 nt, Human
uggcuucauguaguuugaguug

SEQ ID NO: 58294 - RNA, 22 nt, Human
uggcuuccaaaggaaugggccu

SEQ ID NO: 58295 - RNA, 22 nt, Human
uggcuuccaaauuaucccuaga

SEQ ID NO: 58296 - RNA, 22 nt, Human
uggcuuccaguaaucaggauuu

SEQ ID NO: 58297 - RNA, 22 nt, Human
uggcuucccauagcuugcuagu

SEQ ID NO: 58298 - RNA, 22 nt, Human
uggcuuccuggacagaugcggu

SEQ ID NO: 58299 - RNA, 22 nt, Human
uggcuucuagagcccauccuuc

SEQ ID NO: 58300 - RNA, 22 nt, Human
uuaaugcagcucuaccacacag

SEQ ID NO: 58301 - RNA, 22 nt, Human
uuaauggaugcggcugcgugac

SEQ ID NO: 58302 - RNA, 22 nt, Human
uuaauggcagggcagaauauua

SEQ ID NO: 58303 - RNA, 22 nt, Human
uuaauguuuuaaguuauagaga

SEQ ID NO: 58304 - RNA, 22 nt, Human
uuaauuacaaaacacauagguu

SEQ ID NO: 58305 - RNA, 22 nt, Human
uuaauuagagcugauguucaua

SEQ ID NO: 58306 - RNA, 22 nt, Human
uuaauuaugagaaagggaaaag

SEQ ID NO: 58307 - RNA, 22 nt, Human
uuaauucagucaaagaaaccau

SEQ ID NO: 58308 - RNA, 22 nt, Human
uuaauucuuccggacugugaaa

SEQ ID NO: 58309 - RNA, 22 nt, Human
uuaauugagccagaaaguaucu

SEQ ID NO: 58310 - RNA, 22 nt, Human
uuaauuggccucuuagagguua

SEQ ID NO: 58311 - RNA, 22 nt, Human
uuaauugggugcaacagcugaa

SEQ ID NO: 58312 - RNA, 22 nt, Human
uuaauuuauguccaaaccagau

SEQ ID NO: 58313 - RNA, 22 nt, Human
uuaauuuuuauguauagugugu

SEQ ID NO: 58314 - RNA, 22 nt, Human
uuacaaagaaaauuaggcauuu

SEQ ID NO: 58315 - RNA, 22 nt, Human
uuacaaagagugccagagugug

SEQ ID NO: 58316 - RNA, 22 nt, Human
uuacaaagauuauauucaguua

SEQ ID NO: 58317 - RNA, 21 nt, Human
uuacaaagcuacagauguugc

SEQ ID NO: 58318 - RNA, 22 nt, Human
uuacaaaguuuaagguggcacu

SEQ ID NO: 58319 - RNA, 17 nt, Human
uuacaacaauucaugag

SEQ ID NO: 58320 - RNA, 22 nt, Human
uuacaacaccaggcaguauccu

SEQ ID NO: 58321 - RNA, 22 nt, Human
uuacaacagcgauuuaccuguc

SEQ ID NO: 58322 - RNA, 23 nt, Human
uuacaacaguguccauauuugua

SEQ ID NO: 58323 - RNA, 22 nt, Human
uuacaacauauuuagcuugauu

SEQ ID NO: 58324 - RNA, 21 nt, Human
uuacaacauuuguguucuaug

SEQ ID NO: 58325 - RNA, 17 nt, Human
uuacaacgucaucucug

SEQ ID NO: 58326 - RNA, 22 nt, Human
uuacaacugaagcuaaugugcu

SEQ ID NO: 58327 - RNA, 22 nt, Human
uuacaacuggugaauuuuaugg

SEQ ID NO: 58328 - RNA, 22 nt, Human
uuacaagauaugugagaacuag

SEQ ID NO: 58329 - RNA, 22 nt, Human
uuacaagaucuuugaaggcaag

SEQ ID NO: 58330 - RNA, 22 nt, Human
uuacaagaugggaaagggaagu

SEQ ID NO: 58331 - RNA, 22 nt, Human
uuacaagauuaauuauuggagu

SEQ ID NO: 58332 - RNA, 22 nt, Human
uuacaagcagcuacauaucaca

SEQ ID NO: 58333 - RNA, 20 nt, Human
uuacaagccuuguuaaaucu

SEQ ID NO: 58334 - RNA, 22 nt, Human
uuacaagcuaauuguuucagcu

SEQ ID NO: 58335 - RNA, 22 nt, Human
uuacaaguacugaauaugauuu

SEQ ID NO: 58336 - RNA, 22 nt, Human
uuacaaugacagguguaucauu

SEQ ID NO: 58337 - RNA, 22 nt, Human
uuacaaugagacguucuuaucu

SEQ ID NO: 58338 - RNA, 22 nt, Human
uuacaaugaugaauaaauggca

SEQ ID NO: 58339 - RNA, 22 nt, Human
uuacaaugaugggauucagcca

SEQ ID NO: 58340 - RNA, 22 nt, Human
uuacaauugagucuauuguaug

SEQ ID NO: 58341 - RNA, 22 nt, Human
uuacacaaaguuagcucuugca

SEQ ID NO: 58342 - RNA, 22 nt, Human
uuacacaacagugcaucagcag

SEQ ID NO: 58343 - RNA, 22 nt, Human
uuacacaacaucuguauuauua

SEQ ID NO: 58344 - RNA, 22 nt, Human
uuacacacucugcccugcuguu

SEQ ID NO: 58345 - RNA, 22 nt, Human
uuacacaugcucacuuauuugu

SEQ ID NO: 58346 - RNA, 22 nt, Human
uuacacauuaacaggcagcuaa

SEQ ID NO: 58347 - RNA, 19 nt, Human
uuacacuucugcuuuguga

SEQ ID NO: 58348 - RNA, 22 nt, Human
uuacacuuguaauuauauaacg

SEQ ID NO: 58349 - RNA, 22 nt, Human
uuacacuuuggcaagcuauuaa

SEQ ID NO: 58350 - RNA, 22 nt, Human
uuacagaacugcccuaguuggc

SEQ ID NO: 58351 - RNA, 22 nt, Human
uuacagaacugucuugaaauuu

SEQ ID NO: 58352 - RNA, 22 nt, Human
uuacagaaugugccauuugguc

SEQ ID NO: 58353 - RNA, 22 nt, Human
uuacagaauguucuuccaacag

SEQ ID NO: 58354 - RNA, 22 nt, Human
uuacagagauaaacuguaagug

SEQ ID NO: 58355 - RNA, 22 nt, Human
uuacagagggcuucucugaacu

SEQ ID NO: 58356 - RNA, 22 nt, Human
uuacagauacauuucuuuuguu

SEQ ID NO: 58357 - RNA, 22 nt, Human
uuacagauggcaguuucuugag

SEQ ID NO: 58358 - RNA, 22 nt, Human
uuacagcaaagugcgcagaccu

SEQ ID NO: 58359 - RNA, 22 nt, Human
uuacagcagugggaaggaguca

SEQ ID NO: 58360 - RNA, 22 nt, Human
uuacagcauuuaaugagaucug

SEQ ID NO: 58361 - RNA, 22 nt, Human
uuacagggguguggaggcaauc

SEQ ID NO: 58362 - RNA, 22 nt, Human
uuacaggguugcagcauugacg

SEQ ID NO: 58363 - RNA, 22 nt, Human
uuacagguauuuuauugagcag

SEQ ID NO: 58364 - RNA, 22 nt, Human
uuacagguggagaaguaaggcu

SEQ ID NO: 58365 - RNA, 22 nt, Human
uuacagguuaagugacacuuaa

SEQ ID NO: 58366 - RNA, 22 nt, Human
uuacagucuggauuaggaaaca

SEQ ID NO: 58367 - RNA, 22 nt, Human
uuacagugacaguugcuaugau

SEQ ID NO: 58368 - RNA, 22 nt, Human
uuacagugacucacauuaacaa

SEQ ID NO: 58369 - RNA, 22 nt, Human
uuacaguggucauuugggaaaa

SEQ ID NO: 58370 - RNA, 22 nt, Human
uuacagugugcaaucccagaau

SEQ ID NO: 58371 - RNA, 22 nt, Human
uuacaguugcuacaaaggauaa

SEQ ID NO: 58372 - RNA, 22 nt, Human
uuacaguuguucuaucagcaug

SEQ ID NO: 58373 - RNA, 22 nt, Human
uuacaguuuaguccaagccaga

SEQ ID NO: 58374 - RNA, 22 nt, Human
uuacauacaaaggcuggguuau

SEQ ID NO: 58375 - RNA, 22 nt, Human
uuacauagauucauuuaguuaa

SEQ ID NO: 58376 - RNA, 22 nt, Human
uuacaucaugcuuaucccuuuc

SEQ ID NO: 58377 - RNA, 22 nt, Human
uuacaucugcacuccaggacag

SEQ ID NO: 58378 - RNA, 22 nt, Human
uuacaugaauacauaaccauuc

SEQ ID NO: 58379 - RNA, 19 nt, Human
uuacaugacacuccagccu

SEQ ID NO: 58380 - RNA, 22 nt, Human
uuacaugaugauuucauaaaca

SEQ ID NO: 58381 - RNA, 22 nt, Human
uggucagcuucagaguguucca

SEQ ID NO: 58382 - RNA, 22 nt, Human
uggucaggcugcucugcggcgu

SEQ ID NO: 58383 - RNA, 22 nt, Human
uggucagugugacauuuuuuaa

SEQ ID NO: 58384 - RNA, 22 nt, Human
uggucauaacaugauuaguagg

SEQ ID NO: 58385 - RNA, 22 nt, Human
ugguccagaagauauucaacca

SEQ ID NO: 58386 - RNA, 22 nt, Human
ugguccaguagcagggauacca

SEQ ID NO: 58387 - RNA, 22 nt, Human
ugguccaguuuagcauugagug

SEQ ID NO: 58388 - RNA, 22 nt, Human
ugguccauguucccagaagaca

SEQ ID NO: 58389 - RNA, 19 nt, Human
uggucccauacugcuggcc

SEQ ID NO: 58390 - RNA, 22 nt, Human
uggucccuaaagaugucuacau

SEQ ID NO: 58391 - RNA, 22 nt, Human
uggucccugaagagagaccuug

SEQ ID NO: 58392 - RNA, 22 nt, Human
ugguccgcuccuauucgccgca

SEQ ID NO: 58393 - RNA, 20 nt, Human
ugguccucacaugccaucuu

SEQ ID NO: 58394 - RNA, 22 nt, Human
ugguccucacccuacccagcug

SEQ ID NO: 58395 - RNA, 22 nt, Human
ugguccugagaauccuguccuc

SEQ ID NO: 58396 - RNA, 22 nt, Human
ugguccugaggcuuguuuccac

SEQ ID NO: 58397 - RNA, 22 nt, Human
ugguccugcccacgcccaucug

SEQ ID NO: 58398 - RNA, 22 nt, Human
ugguccuggaagguccugaggg

SEQ ID NO: 58399 - RNA, 22 nt, Human
ugguccugguagcggugugcuu

SEQ ID NO: 58400 - RNA, 22 nt, Human
ugguccuguagcucucuaaguu

SEQ ID NO: 58401 - RNA, 22 nt, Human
ugguccugucucaaggagccuu

SEQ ID NO: 58402 - RNA, 21 nt, Human
ugguccuucuuuacugccucc

SEQ ID NO: 58403 - RNA, 22 nt, Human
ugguccuugcuauagagugaua

SEQ ID NO: 58404 - RNA, 22 nt, Human
uggucgaccaguuggaaaguaa

SEQ ID NO: 58405 - RNA, 23 nt, Human
uggucucacuugguaagaugaag

SEQ ID NO: 58406 - RNA, 22 nt, Human
uggucucugcaggccaggcuca

SEQ ID NO: 58407 - RNA, 22 nt, Human
uggucucugcugcagcuucuca

SEQ ID NO: 58408 - RNA, 19 nt, Human
uggucucugucucuuugca

SEQ ID NO: 58409 - RNA, 22 nt, Human
ugucacauucugaugugaggug

SEQ ID NO: 58410 - RNA, 22 nt, Human
ugucaccaaguugaugaaugca

SEQ ID NO: 58411 - RNA, 22 nt, Human
ugucaccacauuugucaauauc

SEQ ID NO: 58412 - RNA, 22 nt, Human
ugucacuucaggaaugcaggga

SEQ ID NO: 58413 - RNA, 22 nt, Human
ugucacuuggagaagcugaucc

SEQ ID NO: 58414 - RNA, 21 nt, Human
ugucacuuuaagcuagcucua

SEQ ID NO: 58415 - RNA, 22 nt, Human
ugucacuuuggccaagccauug

SEQ ID NO: 58416 - RNA, 22 nt, Human
ugucacuuuggggagaguuuug

SEQ ID NO: 58417 - RNA, 22 nt, Human
ugucacuuuuuauagguguuga

SEQ ID NO: 58418 - RNA, 21 nt, Human
ugucagaaauaagcaugugau

SEQ ID NO: 58419 - RNA, 22 nt, Human
ugucagaacucuauugaugucc

SEQ ID NO: 58420 - RNA, 22 nt, Human
ugucagacacagccagagacug

SEQ ID NO: 58421 - RNA, 22 nt, Human
ugucagagagcaggcaguagaa

SEQ ID NO: 58422 - RNA, 22 nt, Human
ugucagagcaaggccaggccag

SEQ ID NO: 58423 - RNA, 22 nt, Human
ugucagaugcgauaaacuagug

SEQ ID NO: 58424 - RNA, 21 nt, Human
ugucagcaacaauacuuucuc

SEQ ID NO: 58425 - RNA, 22 nt, Human
ugucagcaacccaucacuccca

SEQ ID NO: 58426 - RNA, 22 nt, Human
ugucagcaagacaucagaguga

SEQ ID NO: 58427 - RNA, 21 nt, Human
ugucagcacgcaugaggccag

SEQ ID NO: 58428 - RNA, 22 nt, Human
ugucagcagaaguggugcacuc

SEQ ID NO: 58429 - RNA, 22 nt, Human
ugucagcaugaacccugaauua

SEQ ID NO: 58430 - RNA, 22 nt, Human
ugucagcucauugaaggcacaa

SEQ ID NO: 58431 - RNA, 22 nt, Human
ugucagugauuuguagggaauu

SEQ ID NO: 58432 - RNA, 22 nt, Human
ugucagugcuauagugggaaua

SEQ ID NO: 58433 - RNA, 22 nt, Human
ugucaguuaccuagcacaagaa

SEQ ID NO: 58434 - RNA, 22 nt, Human
ugucaguucagugauuacaaaa

SEQ ID NO: 58435 - RNA, 22 nt, Human
ugucaguucaucaguuggcuaa

SEQ ID NO: 58436 - RNA, 22 nt, Human
ugucaguuuccugugcccugcu

SEQ ID NO: 58437 - RNA, 22 nt, Human
ugucaguuuggcucuaaaguuu

SEQ ID NO: 58438 - RNA, 22 nt, Human
ugucauaacuuagugacaaauc

SEQ ID NO: 58439 - RNA, 18 nt, Human
ugucauaauauaucaccu

SEQ ID NO: 58440 - RNA, 22 nt, Human
ugucauacaacaauaaguaccg

SEQ ID NO: 58441 - RNA, 22 nt, Human
ugucauauagaauguucuauga

SEQ ID NO: 58442 - RNA, 22 nt, Human
ugucauaucuauuaaaugucua

SEQ ID NO: 58443 - RNA, 22 nt, Human
ugucauauguaauauguucauu

SEQ ID NO: 58444 - RNA, 22 nt, Human
ugucaucagcauauaagacagu

SEQ ID NO: 58445 - RNA, 22 nt, Human
ugucaucuggccugauuggugu

SEQ ID NO: 58446 - RNA, 22 nt, Human
ugucaucuguguuuugcuggag

SEQ ID NO: 58447 - RNA, 20 nt, Human
ugucaugcauuagaugaaga

SEQ ID NO: 58448 - RNA, 22 nt, Human
ugucaugccaggaaauaguccc

SEQ ID NO: 58449 - RNA, 22 nt, Human
ugucauggggaaaauaacagac

SEQ ID NO: 58450 - RNA, 22 nt, Human
ugucaugguagcugaaggaugu

SEQ ID NO: 58451 - RNA, 22 nt, Human
ugucauguuucauguuuguagg

SEQ ID NO: 58452 - RNA, 22 nt, Human
ugucauguuuuccuacaaggua

SEQ ID NO: 58453 - RNA, 21 nt, Human
ugucauuaaucgcuauagaag

SEQ ID NO: 58454 - RNA, 22 nt, Human
ugucauugaggaaaacuaggug

SEQ ID NO: 58455 - RNA, 22 nt, Human
ugucauuggugaucugaugccu

SEQ ID NO: 58456 - RNA, 22 nt, Human
ugucauuuaucuuauaguaauc

SEQ ID NO: 58457 - RNA, 22 nt, Human
ugucauuuaugcuucuucagug

SEQ ID NO: 58458 - RNA, 22 nt, Human
ugucauuuggacuuugguauua

SEQ ID NO: 58459 - RNA, 22 nt, Human
ugucauuuucagcuuaugcuuc

SEQ ID NO: 58460 - RNA, 21 nt, Human
uguccaagguaugcacugggg

SEQ ID NO: 58461 - RNA, 22 nt, Human
uguccagcucgagacacuaucu

SEQ ID NO: 58462 - RNA, 22 nt, Human
uguccagcugacauucccuucc

SEQ ID NO: 58463 - RNA, 22 nt, Human
uguccaggugugucuaaagaga

SEQ ID NO: 58464 - RNA, 22 nt, Human
uguccaguccuuggggugcugu

SEQ ID NO: 58465 - RNA, 22 nt, Human
uguccauacaauguaacaucuu

SEQ ID NO: 58466 - RNA, 22 nt, Human
uguccaugcguauccagggagc

SEQ ID NO: 58467 - RNA, 22 nt, Human
uguccauggagaagcucagggc

SEQ ID NO: 58468 - RNA, 22 nt, Human
uguccaugggcgucaggcagga

SEQ ID NO: 58469 - RNA, 22 nt, Human
ugucccaacccugagaagauuc

SEQ ID NO: 58470 - RNA, 22 nt, Human
ugucccagacacaguaugcgcu

SEQ ID NO: 58471 - RNA, 22 nt, Human
ugucccagcugucucuguuuuu

SEQ ID NO: 58472 - RNA, 22 nt, Human
ugucccagggaaggcccagcac

SEQ ID NO: 58473 - RNA, 22 nt, Human
ugucccagucaaggcugucauc

SEQ ID NO: 58474 - RNA, 22 nt, Human
ugucccauggcuuuucuggugg

SEQ ID NO: 58475 - RNA, 20 nt, Human
uguccccaccaaaauuucau

SEQ ID NO: 58476 - RNA, 22 nt, Human
uguccccuuucuuuccuucgua

SEQ ID NO: 58477 - RNA, 22 nt, Human
ugucccucugaggcuucccugg

SEQ ID NO: 58478 - RNA, 22 nt, Human
ugucccugguggaggcuggcag

SEQ ID NO: 58479 - RNA, 22 nt, Human
ugucccuuuguguucugaaacu

SEQ ID NO: 58480 - RNA, 22 nt, Human
uguccuauuucucugugcauga

SEQ ID NO: 58481 - RNA, 22 nt, Human
uguccucacaggaaugaacuuu

SEQ ID NO: 58482 - RNA, 22 nt, Human
uguccugcaacugaaggagaag

SEQ ID NO: 58483 - RNA, 22 nt, Human
uguccuggacaacagccccuag

SEQ ID NO: 58484 - RNA, 22 nt, Human
uguccugggaaaucccuuaggc

SEQ ID NO: 58485 - RNA, 22 nt, Human
uguccugggaggcgggguccag

SEQ ID NO: 58486 - RNA, 22 nt, Human
uguccugggucaaccaggucga

SEQ ID NO: 58487 - RNA, 21 nt, Human
uguccuggucacugcucuccc

SEQ ID NO: 58488 - RNA, 22 nt, Human
uguccuguccuuccuggaaguc

SEQ ID NO: 58489 - RNA, 22 nt, Human
uguccugugccaccuuccugag

SEQ ID NO: 58490 - RNA, 22 nt, Human
uguccugugucuaggggucuuc

SEQ ID NO: 58491 - RNA, 21 nt, Human
uguccuuaaugcaauguccuu

SEQ ID NO: 58492 - RNA, 22 nt, Human
uguccuuacaaggucccuuucg

SEQ ID NO: 58493 - RNA, 22 nt, Human
uguccuugugacauucuggcuu

SEQ ID NO: 58494 - RNA, 22 nt, Human
uguccuuguuccuaauguaaaa

SEQ ID NO: 58495 - RNA, 23 nt, Human
uguccuuuuugaggccuccuccu

SEQ ID NO: 58496 - RNA, 22 nt, Human
ugucgcagcugaaaaucucaau

SEQ ID NO: 58497 - RNA, 22 nt, Human
ugucuaaaugaaaagagaugcc

SEQ ID NO: 58498 - RNA, 22 nt, Human
ugucuacagaauguuaauauuu

SEQ ID NO: 58499 - RNA, 17 nt, Human
ugucuacucugacuaaa

SEQ ID NO: 58500 - RNA, 22 nt, Human
ugucuacugagaagcuaugcaa

SEQ ID NO: 58501 - RNA, 22 nt, Human
ugucuacuugggcucuacagca

SEQ ID NO: 58502 - RNA, 22 nt, Human
uuaggaagaauauauuuagagc

SEQ ID NO: 58503 - RNA, 22 nt, Human
uuaggaagagcuuucaaucacu

SEQ ID NO: 58504 - RNA, 22 nt, Human
uuaggaagcaggccuaaaauuu

SEQ ID NO: 58505 - RNA, 22 nt, Human
uuaggaaggccuugaaugccag

SEQ ID NO: 58506 - RNA, 22 nt, Human
uuaggaauauguauuuuaaagu

SEQ ID NO: 58507 - RNA, 22 nt, Human
uuaggauaugaaacaguauaag

SEQ ID NO: 58508 - RNA, 22 nt, Human
uuaggauuugaaaaggggcaga

SEQ ID NO: 58509 - RNA, 22 nt, Human
uuaggcaaauaaaauguuucca

SEQ ID NO: 58510 - RNA, 22 nt, Human
uuaggcaauaucauuggaguug

SEQ ID NO: 58511 - RNA, 22 nt, Human
uuaggcaaugcucucaaauuug

SEQ ID NO: 58512 - RNA, 22 nt, Human
uuaggcaauuugauuuuucaag

SEQ ID NO: 58513 - RNA, 22 nt, Human
uuaggcaauuuugucauugugu

SEQ ID NO: 58514 - RNA, 22 nt, Human
uuaggcauauggcacaugauag

SEQ ID NO: 58515 - RNA, 20 nt, Human
uuaggcauuuggauuggcuu

SEQ ID NO: 58516 - RNA, 22 nt, Human
uuaggcugggcuacaacaacug

SEQ ID NO: 58517 - RNA, 22 nt, Human
uuaggcuguucuuguguuguua

SEQ ID NO: 58518 - RNA, 17 nt, Human
uuccaaggagcauuuga

SEQ ID NO: 58519 - RNA, 22 nt, Human
uuccaaggcugcuauuuguuuc

SEQ ID NO: 58520 - RNA, 20 nt, Human
uuccaaggucuaugcuucuu

SEQ ID NO: 58521 - RNA, 22 nt, Human
uuccaagucuaaguuauaaauc

SEQ ID NO: 58522 - RNA, 22 nt, Human
uuccaagugaaaguagcuuugu

SEQ ID NO: 58523 - RNA, 22 nt, Human
uuccaaguguugagauuagagg

SEQ ID NO: 58524 - RNA, 22 nt, Human
uuccaaguugagcgauuuuccu

SEQ ID NO: 58525 - RNA, 22 nt, Human
uuccaauccaaacuucaccuuu

SEQ ID NO: 58526 - RNA, 22 nt, Human
uuccaauuuguggugaguuaau

SEQ ID NO: 58527 - RNA, 22 nt, Human
uuccacaaacacauccugagca

SEQ ID NO: 58528 - RNA, 22 nt, Human
uuccacaaaucaauucugcuga

SEQ ID NO: 58529 - RNA, 22 nt, Human
uuccacaagugauaucuagcug

SEQ ID NO: 58530 - RNA, 22 nt, Human
uuccacaauguaugaauaagau

SEQ ID NO: 58531 - RNA, 22 nt, Human
uuccacagucauccugggaauu

SEQ ID NO: 58532 - RNA, 20 nt, Human
uuccacaucuuugcacaugc

SEQ ID NO: 58533 - RNA, 19 nt, Human
uuccaccaucacucuguuu

SEQ ID NO: 58534 - RNA, 22 nt, Human
uuccaccauucaugcuaauauu

SEQ ID NO: 58535 - RNA, 22 nt, Human
uuccacuccuccugguggggug

SEQ ID NO: 58536 - RNA, 22 nt, Human
uuccacucuacacacugcuggc

SEQ ID NO: 58537 - RNA, 22 nt, Human
uuccacucuccagucaauuuca

SEQ ID NO: 58538 - RNA, 22 nt, Human
uuccacucuguccccuguggga

SEQ ID NO: 58539 - RNA, 22 nt, Human
uuccacucuucucuggacuuau

SEQ ID NO: 58540 - RNA, 22 nt, Human
uuccacuuaguggaagggcaug

SEQ ID NO: 58541 - RNA, 22 nt, Human
uuccagaaaacucugccuggua

SEQ ID NO: 58542 - RNA, 22 nt, Human
uuccagaaccuuccugcuggaa

SEQ ID NO: 58543 - RNA, 22 nt, Human
uuccagaacuuuuguuaauuuc

SEQ ID NO: 58544 - RNA, 22 nt, Human
uuccagaauuuuguucugcuug

SEQ ID NO: 58545 - RNA, 22 nt, Human
uuccagagaguuauuccccugg

SEQ ID NO: 58546 - RNA, 21 nt, Human
uuccagagauuguuucaccug

SEQ ID NO: 58547 - RNA, 22 nt, Human
uuccagagcuuugcgcuuggaa

SEQ ID NO: 58548 - RNA, 22 nt, Human
uuccagaggagugauucagagg

SEQ ID NO: 58549 - RNA, 22 nt, Human
uuccagaggccugggcacacuc

SEQ ID NO: 58550 - RNA, 22 nt, Human
uuccagaguauugguagcuaua

SEQ ID NO: 58551 - RNA, 22 nt, Human
uuccagagucagccacugggag

SEQ ID NO: 58552 - RNA, 23 nt, Human
uuccagaguccacaucugccacc

SEQ ID NO: 58553 - RNA, 22 nt, Human
uuccagaguccauguuggcuca

SEQ ID NO: 58554 - RNA, 22 nt, Human
uuccagagucugguuccauggu

SEQ ID NO: 58555 - RNA, 22 nt, Human
uuccagauguuuaaguucugcu

SEQ ID NO: 58556 - RNA, 22 nt, Human
uuccagcacagaaguauacauu

SEQ ID NO: 58557 - RNA, 22 nt, Human
uuccagcagcgugggagaagua

SEQ ID NO: 58558 - RNA, 22 nt, Human
uuccagcaggguacuuguaauu

SEQ ID NO: 58559 - RNA, 17 nt, Human
uuccagcauguuacuaa

SEQ ID NO: 58560 - RNA, 22 nt, Human
uuccagccacuuuauacugcua

SEQ ID NO: 58561 - RNA, 22 nt, Human
uuccagcccgcgacuuguucag

SEQ ID NO: 58562 - RNA, 22 nt, Human
uuccaggaacagaugaagguug

SEQ ID NO: 58563 - RNA, 22 nt, Human
uguccuuuaugaaaugguguuu

SEQ ID NO: 58564 - RNA, 22 nt, Human
ugucuaaacuuguuuuaucuca

SEQ ID NO: 58565 - RNA, 22 nt, Human
ugucuaauggcaauuucaugug

SEQ ID NO: 58566 - RNA, 22 nt, Human
ugucuagaaaugcugagucuca

SEQ ID NO: 58567 - RNA, 22 nt, Human
ugucuagacaagaaguauugcc

SEQ ID NO: 58568 - RNA, 19 nt, Human
ugucuagcugcacagcuga

SEQ ID NO: 58569 - RNA, 22 nt, Human
ugucuagugguuuauaaaauca

SEQ ID NO: 58570 - RNA, 22 nt, Human
ugucuauagaaucaugcaguuu

SEQ ID NO: 58571 - RNA, 22 nt, Human
ugucuauuaacacaagaaagga

SEQ ID NO: 58572 - RNA, 22 nt, Human
ugucuauuugaauuauccuaau

SEQ ID NO: 58573 - RNA, 23 nt, Human
ugucucagacugagggguuuccc

SEQ ID NO: 58574 - RNA, 22 nt, Human
ugucucagaguguuguauuaga

SEQ ID NO: 58575 - RNA, 22 nt, Human
ugucucaguacacuccgauguu

SEQ ID NO: 58576 - RNA, 22 nt, Human
ugucuccauagaagagacugca

SEQ ID NO: 58577 - RNA, 22 nt, Human
ugucucccaggugugcccagug

SEQ ID NO: 58578 - RNA, 22 nt, Human
ugucuccuauuuccugcuaagg

SEQ ID NO: 58579 - RNA, 22 nt, Human
ugucuccucuguccugucagga

SEQ ID NO: 58580 - RNA, 22 nt, Human
ugucuccugggucccuuccacc

SEQ ID NO: 58581 - RNA, 18 nt, Human
ugucucuccuuucugugu

SEQ ID NO: 58582 - RNA, 22 nt, Human
ugucucugaagcccccuccuuu

SEQ ID NO: 58583 - RNA, 18 nt, Human
ugucucugaauuccagug

SEQ ID NO: 58584 - RNA, 22 nt, Human
ugucucugagaugacucccacc

SEQ ID NO: 58585 - RNA, 22 nt, Human
ugucucugauaaguaguucagu

SEQ ID NO: 58586 - RNA, 22 nt, Human
ugucucugcugcaccuucuggg

SEQ ID NO: 58587 - RNA, 22 nt, Human
ugucucuggcugcagccuguuc

SEQ ID NO: 58588 - RNA, 22 nt, Human
ugucucugucucccagguugug

SEQ ID NO: 58589 - RNA, 22 nt, Human
ugucucugugcauuugugcuuc

SEQ ID NO: 58590 - RNA, 22 nt, Human
ugucucuugagcugccugaugc

SEQ ID NO: 58591 - RNA, 22 nt, Human
ugucucuugaguuuguuuuaau

SEQ ID NO: 58592 - RNA, 22 nt, Human
ugucucuuggagggucuaguga

SEQ ID NO: 58593 - RNA, 22 nt, Human
ugucucuuggauugcuugcucu

SEQ ID NO: 58594 - RNA, 22 nt, Human
ugucucuuguuaaugauuacua

SEQ ID NO: 58595 - RNA, 22 nt, Human
ugucugaacaaacucugccucc

SEQ ID NO: 58596 - RNA, 22 nt, Human
ugucugaacccuggcccugccu

SEQ ID NO: 58597 - RNA, 22 nt, Human
ugucugaacugcacugaaagac

SEQ ID NO: 58598 - RNA, 22 nt, Human
ugucugaacugcauuugcuccu

SEQ ID NO: 58599 - RNA, 22 nt, Human
ugucugaagcacugggcguugc

SEQ ID NO: 58600 - RNA, 22 nt, Human
ugucugaaucgcuuccuagagg

SEQ ID NO: 58601 - RNA, 22 nt, Human
ugucugaauuccacaucguucu

SEQ ID NO: 58602 - RNA, 21 nt, Human
ugucugagugacugggucugc

SEQ ID NO: 58603 - RNA, 22 nt, Human
ugucugagugcauaugugcugg

SEQ ID NO: 58604 - RNA, 21 nt, Human
ugucugauguauuuuuugccu

SEQ ID NO: 58605 - RNA, 22 nt, Human
ugucugcccauucaugggcaca

SEQ ID NO: 58606 - RNA, 22 nt, Human
ugucugcuaaauuacuauuaca

SEQ ID NO: 58607 - RNA, 20 nt, Human
ugucugcucauaauaaaccc

SEQ ID NO: 58608 - RNA, 22 nt, Human
ugucuggaggucagguccuggg

SEQ ID NO: 58609 - RNA, 22 nt, Human
ugucuggauagagccuaggccc

SEQ ID NO: 58610 - RNA, 23 nt, Human
ugucuggauucgacugugguugg

SEQ ID NO: 58611 - RNA, 22 nt, Human
ugucugggagggacagggcuac

SEQ ID NO: 58612 - RNA, 23 nt, Human
ugucuggggcgccagaagagaga

SEQ ID NO: 58613 - RNA, 22 nt, Human
ugucuguaauagucacuaugug

SEQ ID NO: 58614 - RNA, 22 nt, Human
ugucuguacaaauuuucugugu

SEQ ID NO: 58615 - RNA, 22 nt, Human
ugucuguauuagucagcauucu

SEQ ID NO: 58616 - RNA, 22 nt, Human
ugucugucagcagugggucagg

SEQ ID NO: 58617 - RNA, 22 nt, Human
ugucugucugcaagccagaaag

SEQ ID NO: 58618 - RNA, 22 nt, Human
ugucugucuguccuucucauua

SEQ ID NO: 58619 - RNA, 22 nt, Human
ugucugugauuuaggccagggc

SEQ ID NO: 58620 - RNA, 22 nt, Human
ugucuuaaacuugugggacuuc

SEQ ID NO: 58621 - RNA, 22 nt, Human
ugucuuaagaaauugcauuugu

SEQ ID NO: 58622 - RNA, 22 nt, Human
ugucuuacaugagucaccccaa

SEQ ID NO: 58623 - RNA, 22 nt, Human
ugucuuaugcugcauagacuau

SEQ ID NO: 58624 - RNA, 22 nt, Human
ugucuuauggucuugggcuucc

SEQ ID NO: 58625 - RNA, 22 nt, Human
ugucuuauguagauacugagaa

SEQ ID NO: 58626 - RNA, 22 nt, Human
ugucuuauuccuucuguucagc

SEQ ID NO: 58627 - RNA, 22 nt, Human
uuaacugugacaguuucucaga

SEQ ID NO: 58628 - RNA, 22 nt, Human
uuaacuuuuauuucugcucgcc

SEQ ID NO: 58629 - RNA, 22 nt, Human
uuaagaagccacacaccucuuu

SEQ ID NO: 58630 - RNA, 21 nt, Human
uuaagacacacagauuaagga

SEQ ID NO: 58631 - RNA, 22 nt, Human
uuaagacauucagauauuucua

SEQ ID NO: 58632 - RNA, 22 nt, Human
uuaagacuuuucaaaggcaaac

SEQ ID NO: 58633 - RNA, 22 nt, Human
uuaagaggugaggccuuuaaga

SEQ ID NO: 58634 - RNA, 22 nt, Human
uuaagagguggucgugucugug

SEQ ID NO: 58635 - RNA, 19 nt, Human
uuaagaguaggcauugugc

SEQ ID NO: 58636 - RNA, 22 nt, Human
uuaagauagaacccaguagucu

SEQ ID NO: 58637 - RNA, 23 nt, Human
uuaagcacuguuaguagaaaagg

SEQ ID NO: 58638 - RNA, 22 nt, Human
uuaagcauaauuaaagugaaau

SEQ ID NO: 58639 - RNA, 22 nt, Human
uuaagcauggaagugaaauaau

SEQ ID NO: 58640 - RNA, 22 nt, Human
uuaaggaauuacgaaaauauuu

SEQ ID NO: 58641 - RNA, 22 nt, Human
uuaaggagcacaguguauuaau

SEQ ID NO: 58642 - RNA, 22 nt, Human
uuaaggcauagcuuguguugac

SEQ ID NO: 58643 - RNA, 22 nt, Human
uuaaggcauucuccuacuaaua

SEQ ID NO: 58644 - RNA, 22 nt, Human
uuaaggcugguccccucugcgu

SEQ ID NO: 58645 - RNA, 22 nt, Human
uuaagugccucuaaaacaagcc

SEQ ID NO: 58646 - RNA, 22 nt, Human
uuaagugcuucaagggaagcuc

SEQ ID NO: 58647 - RNA, 23 nt, Human
uuaaguggucaguuuuagacaac

SEQ ID NO: 58648 - RNA, 22 nt, Human
uuaauacagaagcaagacacug

SEQ ID NO: 58649 - RNA, 22 nt, Human
uuaauacauuucagacuguuau

SEQ ID NO: 58650 - RNA, 22 nt, Human
uuaauacuauaauuugaaguac

SEQ ID NO: 58651 - RNA, 22 nt, Human
uuaauaggcuucuaacauagcu

SEQ ID NO: 58652 - RNA, 22 nt, Human
uuaauauacaauuuuacgggcu

SEQ ID NO: 58653 - RNA, 22 nt, Human
uuaauccauggcaguuauuaaa

SEQ ID NO: 58654 - RNA, 22 nt, Human
uuaaucucuuagcaaauuaaug

SEQ ID NO: 58655 - RNA, 22 nt, Human
uuaaucuucagggacucuugcu

SEQ ID NO: 58656 - RNA, 22 nt, Human
uuaaugacaggauaggcucuga

SEQ ID NO: 58657 - RNA, 22 nt, Human
uuaaugaccuagagcaguaauu

SEQ ID NO: 58658 - RNA, 22 nt, Human
uuaaugccaacaaagugauuuu

SEQ ID NO: 58659 - RNA, 22 nt, Human
uuaaugcuugucuagaucuucu

SEQ ID NO: 58660 - RNA, 22 nt, Human
uuaauggauuggagguuucaau

SEQ ID NO: 58661 - RNA, 22 nt, Human
uuaauuaaauucaugagcauug

SEQ ID NO: 58662 - RNA, 22 nt, Human
uuaauuaagagauacugcagua

SEQ ID NO: 58663 - RNA, 22 nt, Human
uuaauuaauuaguuaagcaugu

SEQ ID NO: 58664 - RNA, 22 nt, Human
uuaauuacuggcauggugguug

SEQ ID NO: 58665 - RNA, 22 nt, Human
uuaauuguuggaaauagauuau

SEQ ID NO: 58666 - RNA, 22 nt, Human
uuaauuuaagaaacggcaggcc

SEQ ID NO: 58667 - RNA, 22 nt, Human
uuaauuuauacauaaucacagg

SEQ ID NO: 58668 - RNA, 22 nt, Human
uuacaaagcguugagacaagua

SEQ ID NO: 58669 - RNA, 22 nt, Human
uuacaacaaaggcacgugcaug

SEQ ID NO: 58670 - RNA, 23 nt, Human
uuacaacuauuugccauguuguu

SEQ ID NO: 58671 - RNA, 22 nt, Human
uuacaacugggcuugucagcuu

SEQ ID NO: 58672 - RNA, 22 nt, Human
uuacaacuuuccugugucaaau

SEQ ID NO: 58673 - RNA, 22 nt, Human
uuacaagacacagugcugaagg

SEQ ID NO: 58674 - RNA, 22 nt, Human
uuacaagacagugugguaaaua

SEQ ID NO: 58675 - RNA, 20 nt, Human
uuacaagguagaggagggaa

SEQ ID NO: 58676 - RNA, 20 nt, Human
uuacaaguuucuaauaacca

SEQ ID NO: 58677 - RNA, 22 nt, Human
uuacaauaccacaucaccucau

SEQ ID NO: 58678 - RNA, 22 nt, Human
uuacaauggguauacuuccauu

SEQ ID NO: 58679 - RNA, 19 nt, Human
uuacaauggugauuagguu

SEQ ID NO: 58680 - RNA, 22 nt, Human
ugugagcacugugaugcuguuc

SEQ ID NO: 58681 - RNA, 22 nt, Human
ugugagcagcucuguggacuca

SEQ ID NO: 58682 - RNA, 21 nt, Human
ugugagcuuugugaaagcagg

SEQ ID NO: 58683 - RNA, 22 nt, Human
ugugaggaacaggacuagagca

SEQ ID NO: 58684 - RNA, 22 nt, Human
ugugaggaacccggaauguggg

SEQ ID NO: 58685 - RNA, 22 nt, Human
ugugaggacauuggaggacuca

SEQ ID NO: 58686 - RNA, 21 nt, Human
ugugauaaacuccaaguggga

SEQ ID NO: 58687 - RNA, 19 nt, Human
ugugauaagcagaauucca

SEQ ID NO: 58688 - RNA, 19 nt, Human
ugugauaguugaaccugcc

SEQ ID NO: 58689 - RNA, 22 nt, Human
ugugaugcauaguuuuuauugc

SEQ ID NO: 58690 - RNA, 22 nt, Human
ugugaugguucacugggcauga

SEQ ID NO: 58691 - RNA, 22 nt, Human
ugugauuauauuguaguacauu

SEQ ID NO: 58692 - RNA, 22 nt, Human
ugugcaacaugagacagaacag

SEQ ID NO: 58693 - RNA, 22 nt, Human
ugugcaauagaaaguggcaugg

SEQ ID NO: 58694 - RNA, 22 nt, Human
ugugcaaucauauuuuaaaaug

SEQ ID NO: 58695 - RNA, 22 nt, Human
ugugcacaggaagcuauucucu

SEQ ID NO: 58696 - RNA, 22 nt, Human
ugugcacauaaaacaguacuag

SEQ ID NO: 58697 - RNA, 22 nt, Human
ugugcagagcggggaagagcac

SEQ ID NO: 58698 - RNA, 22 nt, Human
ugugcagaguaaggcagcuguu

SEQ ID NO: 58699 - RNA, 22 nt, Human
ugugcagauagugauuucagaa

SEQ ID NO: 58700 - RNA, 22 nt, Human
ugugcagcuaguccuggacuug

SEQ ID NO: 58701 - RNA, 22 nt, Human
ugugcagcucuagagccaagcc

SEQ ID NO: 58702 - RNA, 20 nt, Human
ugugcaggagagugaggcug

SEQ ID NO: 58703 - RNA, 22 nt, Human
ugugcagggaagggcaugcuau

SEQ ID NO: 58704 - RNA, 22 nt, Human
ugugcaguuuuaaguggucuaa

SEQ ID NO: 58705 - RNA, 17 nt, Human
ugugcauagaauaauga

SEQ ID NO: 58706 - RNA, 22 nt, Human
ugugcauagacuuucaccaccu

SEQ ID NO: 58707 - RNA, 22 nt, Human
ugugcaugacagcauacaaacg

SEQ ID NO: 58708 - RNA, 22 nt, Human
ugugcaugugucuuuauaguag

SEQ ID NO: 58709 - RNA, 16 nt, Human
ugugcauguucugugu

SEQ ID NO: 58710 - RNA, 22 nt, Human
ugugccaaucugcugacugucu

SEQ ID NO: 58711 - RNA, 22 nt, Human
ugugccagccucuggcuguguc

SEQ ID NO: 58712 - RNA, 22 nt, Human
ugugccaugaggcucugauaug

SEQ ID NO: 58713 - RNA, 23 nt, Human
ugugccauugaggcugaggcuca

SEQ ID NO: 58714 - RNA, 22 nt, Human
ugugcccaacgugcagguuugu

SEQ ID NO: 58715 - RNA, 22 nt, Human
ugugcccauuacacagaggcau

SEQ ID NO: 58716 - RNA, 22 nt, Human
ugugcccucagaagaguacauc

SEQ ID NO: 58717 - RNA, 20 nt, Human
ugugcccugcagacuucuuu

SEQ ID NO: 58718 - RNA, 22 nt, Human
ugugcccugccuacaucaccuu

SEQ ID NO: 58719 - RNA, 22 nt, Human
ugugcccuguuaaaugcacagu

SEQ ID NO: 58720 - RNA, 19 nt, Human
ugugccuccucgucuccua

SEQ ID NO: 58721 - RNA, 19 nt, Human
ugugccucuauagcaugug

SEQ ID NO: 58722 - RNA, 22 nt, Human
ugugccugacuaggugaaucaa

SEQ ID NO: 58723 - RNA, 22 nt, Human
ugugccugaguuggcugaguac

SEQ ID NO: 58724 - RNA, 22 nt, Human
ugugccuggagucccugaggag

SEQ ID NO: 58725 - RNA, 22 nt, Human
ugugccuggucccugagucgag

SEQ ID NO: 58726 - RNA, 22 nt, Human
ugugccugucacccucagagag

SEQ ID NO: 58727 - RNA, 22 nt, Human
ugugccuuuaaggggagcugag

SEQ ID NO: 58728 - RNA, 17 nt, Human
ugugcgcuugugugagg

SEQ ID NO: 58729 - RNA, 22 nt, Human
ugugcuauuacacauuuauuua

SEQ ID NO: 58730 - RNA, 22 nt, Human
ugugcuauuugacuguuugcua

SEQ ID NO: 58731 - RNA, 22 nt, Human
ugugcucagccaggggcaggcc

SEQ ID NO: 58732 - RNA, 22 nt, Human
ugugcucugaagagugcauguc

SEQ ID NO: 58733 - RNA, 22 nt, Human
ugugcucuucuguuacuuguag

SEQ ID NO: 58734 - RNA, 22 nt, Human
ugugcugggaaauggcaggaua

SEQ ID NO: 58735 - RNA, 22 nt, Human
ugugcuuacuuugaauuauaua

SEQ ID NO: 58736 - RNA, 22 nt, Human
uucugagcacguucauuuaaau

SEQ ID NO: 58737 - RNA, 21 nt, Human
uucugagcacucaucacuguc

SEQ ID NO: 58738 - RNA, 17 nt, Human
uucugagccacuuccuu

SEQ ID NO: 58739 - RNA, 22 nt, Human
uucugagccucauucaugaggc

SEQ ID NO: 58740 - RNA, 22 nt, Human
uucugauacagucccaacacaa

SEQ ID NO: 58741 - RNA, 22 nt, Human
uucugauaccuugcaggauccu

SEQ ID NO: 58742 - RNA, 22 nt, Human
uucugauauaacacucuagcua

SEQ ID NO: 58743 - RNA, 22 nt, Human
uucugaugaggaggucucuaag

SEQ ID NO: 58744 - RNA, 22 nt, Human
uucugaugcaugggucucuguu

SEQ ID NO: 58745 - RNA, 22 nt, Human
uucugaugguggaaugcuucag

SEQ ID NO: 58746 - RNA, 22 nt, Human
uucugauucaugauccaguucu

SEQ ID NO: 58747 - RNA, 22 nt, Human
uucugcaaucgcucugaccauu

SEQ ID NO: 58748 - RNA, 22 nt, Human
uucugcagcaugaggcuggagc

SEQ ID NO: 58749 - RNA, 22 nt, Human
uucugcaguguuaacaauguca

SEQ ID NO: 58750 - RNA, 22 nt, Human
uucugcaugaaaagaacugaac

SEQ ID NO: 58751 - RNA, 22 nt, Human
uucugcaugauauuaaauguaa

SEQ ID NO: 58752 - RNA, 22 nt, Human
uucugcauuauacacaaccuaa

SEQ ID NO: 58753 - RNA, 22 nt, Human
uucugcauucaaauuaugugag

SEQ ID NO: 58754 - RNA, 22 nt, Human
uucugcauugacuuuuauuucc

SEQ ID NO: 58755 - RNA, 22 nt, Human
uucugcauuucuaauaaguucc

SEQ ID NO: 58756 - RNA, 22 nt, Human
uucugccugauguagucauacc

SEQ ID NO: 58757 - RNA, 22 nt, Human
uucugccuggcaggaggacugu

SEQ ID NO: 58758 - RNA, 21 nt, Human
uucugcuaagaaaacauuauu

SEQ ID NO: 58759 - RNA, 22 nt, Human
uucugcucugacuugcaaggaa

SEQ ID NO: 58760 - RNA, 22 nt, Human
uucugcugaagccagggagcaa

SEQ ID NO: 58761 - RNA, 22 nt, Human
uucugcugguguuuugugaggc

SEQ ID NO: 58762 - RNA, 19 nt, Human
uucugcuguuccuaggcug

SEQ ID NO: 58763 - RNA, 22 nt, Human
uucugcuguuuguaguaaugua

SEQ ID NO: 58764 - RNA, 22 nt, Human
uucugcuugguucuugguauga

SEQ ID NO: 58765 - RNA, 22 nt, Human
uucugcuuugguuccauggaug

SEQ ID NO: 58766 - RNA, 22 nt, Human
uucugcuuuuagcuaaacuaua

SEQ ID NO: 58767 - RNA, 22 nt, Human
uucuggaaagcauuugaggccc

SEQ ID NO: 58768 - RNA, 22 nt, Human
uucuggaaauggguauagagca

SEQ ID NO: 58769 - RNA, 22 nt, Human
uucuggaaccagccugccuggg

SEQ ID NO: 58770 - RNA, 22 nt, Human
uucuggaagcugcagguggccg

SEQ ID NO: 58771 - RNA, 22 nt, Human
uucuggaagcugggcagcaccc

SEQ ID NO: 58772 - RNA, 22 nt, Human
uucuggaaguguuagaaucugg

SEQ ID NO: 58773 - RNA, 22 nt, Human
uucuggagaaucaccaccaggc

SEQ ID NO: 58774 - RNA, 22 nt, Human
uucuggagaugacuuuuagaaa

SEQ ID NO: 58775 - RNA, 22 nt, Human
uucuggagauugagaaggcauu

SEQ ID NO: 58776 - RNA, 22 nt, Human
uucuggagccccaagaucugua

SEQ ID NO: 58777 - RNA, 22 nt, Human
uucuggagcuaaaguccacucu

SEQ ID NO: 58778 - RNA, 22 nt, Human
uucuggaggccccuuccuucuc

SEQ ID NO: 58779 - RNA, 19 nt, Human
uucuggagguuacccugag

SEQ ID NO: 58780 - RNA, 22 nt, Human
uucuggaguucaggucccuaaa

SEQ ID NO: 58781 - RNA, 22 nt, Human
uucuggaucagcaucaugagau

SEQ ID NO: 58782 - RNA, 22 nt, Human
uucuggcaaggcaagccuggcu

SEQ ID NO: 58783 - RNA, 22 nt, Human
uucuggcaugagagaugggggu

SEQ ID NO: 58784 - RNA, 22 nt, Human
uucuggcuacccuccuaauguu

SEQ ID NO: 58785 - RNA, 18 nt, Human
uucuggcucacucaugcu

SEQ ID NO: 58786 - RNA, 22 nt, Human
uucuggcuguaugauauuuaau

SEQ ID NO: 58787 - RNA, 22 nt, Human
uucuggcuugaccccuacuucc

SEQ ID NO: 58788 - RNA, 22 nt, Human
uucugggacaucuggacaguuu

SEQ ID NO: 58789 - RNA, 22 nt, Human
uucugggagagaaagggccuug

SEQ ID NO: 58790 - RNA, 22 nt, Human
uucugggagauucauaugaaaa

SEQ ID NO: 58791 - RNA, 19 nt, Human
uucugggaggggcugacug

SEQ ID NO: 58792 - RNA, 22 nt, Human
uucugggaguuugggucggcug

SEQ ID NO: 58793 - RNA, 22 nt, Human
uucugggcauguuacauucugu

SEQ ID NO: 58794 - RNA, 22 nt, Human
uucugggcccaacccuagagug

SEQ ID NO: 58795 - RNA, 22 nt, Human
uucugggcucccacauauuuca

SEQ ID NO: 58796 - RNA, 22 nt, Human
uucugggcuuggcuguuuccau

SEQ ID NO: 58797 - RNA, 22 nt, Human
uucuggggacauaacaguaagc

SEQ ID NO: 58798 - RNA, 22 nt, Human
uucuggggccaauugccacugc

SEQ ID NO: 58799 - RNA, 19 nt, Human
uucuggggccuggccuugg

SEQ ID NO: 58800 - RNA, 22 nt, Human
uucugggggaauacagcuauga

SEQ ID NO: 58801 - RNA, 22 nt, Human
uuagaaacuuuggaggauagau

SEQ ID NO: 58802 - RNA, 22 nt, Human
uuagaaagaauagccuggcugc

SEQ ID NO: 58803 - RNA, 22 nt, Human
uuagaaaucugcugccaugcaa

SEQ ID NO: 58804 - RNA, 22 nt, Human
uuagaacaccauucuauauuac

SEQ ID NO: 58805 - RNA, 22 nt, Human
uuagaacaguagaagaaagggu

SEQ ID NO: 58806 - RNA, 21 nt, Human
uuagaacaucaacagcaccua

SEQ ID NO: 58807 - RNA, 19 nt, Human
uuagaacauccucuaggga

SEQ ID NO: 58808 - RNA, 22 nt, Human
uuagaacauuccaucacugggu

SEQ ID NO: 58809 - RNA, 22 nt, Human
uuagaacauuuuuagaccaaua

SEQ ID NO: 58810 - RNA, 22 nt, Human
uuagaaccaccuggagagcuuu

SEQ ID NO: 58811 - RNA, 22 nt, Human
uuagaaccacugaagacucaca

SEQ ID NO: 58812 - RNA, 22 nt, Human
uuagaagcacuaauuacucaca

SEQ ID NO: 58813 - RNA, 22 nt, Human
uuagaaguacauuuagaacaua

SEQ ID NO: 58814 - RNA, 22 nt, Human
uuagaaguucaggucuguaauc

SEQ ID NO: 58815 - RNA, 22 nt, Human
uuagaaucuuuagagucucacu

SEQ ID NO: 58816 - RNA, 22 nt, Human
uuagacagagcuccuugagggc

SEQ ID NO: 58817 - RNA, 22 nt, Human
uuagacaucaagaagccaaugu

SEQ ID NO: 58818 - RNA, 22 nt, Human
uuagacauguuugcuaaaauga

SEQ ID NO: 58819 - RNA, 22 nt, Human
uuagagaaaggguuugauuccg

SEQ ID NO: 58820 - RNA, 22 nt, Human
uuagagaaguuuuacuuaagaa

SEQ ID NO: 58821 - RNA, 22 nt, Human
uuagagacaggcuucccaagga

SEQ ID NO: 58822 - RNA, 22 nt, Human
uuagagagaaccaucaggaucu

SEQ ID NO: 58823 - RNA, 22 nt, Human
uuagagccccagaaaacagugg

SEQ ID NO: 58824 - RNA, 22 nt, Human
uuagagcuagaugaggucauga

SEQ ID NO: 58825 - RNA, 22 nt, Human
uuagagcugggauggauuuucc

SEQ ID NO: 58826 - RNA, 22 nt, Human
uuagaggacaagaggccuggcu

SEQ ID NO: 58827 - RNA, 22 nt, Human
uuagagguucuaugugucugga

SEQ ID NO: 58828 - RNA, 22 nt, Human
uuagagucaagcugcauguucu

SEQ ID NO: 58829 - RNA, 22 nt, Human
uuagaguuuuuguaaguacaau

SEQ ID NO: 58830 - RNA, 22 nt, Human
uuagauaaaaguguucaauaaa

SEQ ID NO: 58831 - RNA, 22 nt, Human
uuagauaauguagagauaugag

SEQ ID NO: 58832 - RNA, 22 nt, Human
uuagauaccuuuguguuguaga

SEQ ID NO: 58833 - RNA, 22 nt, Human
uuagauacgcaggcaguuuuaa

SEQ ID NO: 58834 - RNA, 22 nt, Human
uuagauauguuuuugcuaaugc

SEQ ID NO: 58835 - RNA, 22 nt, Human
uuagaucauuuuagcuaaaugg

SEQ ID NO: 58836 - RNA, 22 nt, Human
uuagaucuuaggcaaauguguu

SEQ ID NO: 58837 - RNA, 22 nt, Human
uuagcaaacccuugcuggugag

SEQ ID NO: 58838 - RNA, 21 nt, Human
uuagcaagucuacccauuucu

SEQ ID NO: 58839 - RNA, 22 nt, Human
uuagcaauguaugauuaaaaua

SEQ ID NO: 58840 - RNA, 22 nt, Human
uuagcacaggcaacuccacaua

SEQ ID NO: 58841 - RNA, 22 nt, Human
uuagcacuggauuaaucaaagu

SEQ ID NO: 58842 - RNA, 22 nt, Human
uuagcacugucugguuaucuug

SEQ ID NO: 58843 - RNA, 22 nt, Human
uuagcagcaauggcaucaacua

SEQ ID NO: 58844 - RNA, 22 nt, Human
uuagcagcggucaguuuugaag

SEQ ID NO: 58845 - RNA, 22 nt, Human
uucuuacaucuauaaaguuggg

SEQ ID NO: 58846 - RNA, 22 nt, Human
uucuuagaugauuaaugauggg

SEQ ID NO: 58847 - RNA, 20 nt, Human
uucuuaguagagcauguauu

SEQ ID NO: 58848 - RNA, 19 nt, Human
uucuuagucucaugcauga

SEQ ID NO: 58849 - RNA, 22 nt, Human
uucuuagugguagucaucuuug

SEQ ID NO: 58850 - RNA, 22 nt, Human
uucuuauaaguuaauauuucca

SEQ ID NO: 58851 - RNA, 22 nt, Human
uucuuauagaagcaaccauugu

SEQ ID NO: 58852 - RNA, 22 nt, Human
uucuuauuaugugcucugugaa

SEQ ID NO: 58853 - RNA, 22 nt, Human
uucuuauugggagaccuuuucu

SEQ ID NO: 58854 - RNA, 22 nt, Human
uucuucaaaacaacacuggccu

SEQ ID NO: 58855 - RNA, 22 nt, Human
uucuucaaaauccagcaugauu

SEQ ID NO: 58856 - RNA, 22 nt, Human
uucuucaaacaaaaguggcaug

SEQ ID NO: 58857 - RNA, 22 nt, Human
uucuucaaaguaauagagacua

SEQ ID NO: 58858 - RNA, 22 nt, Human
uucuucaacaaggacacuguua

SEQ ID NO: 58859 - RNA, 22 nt, Human
uucuucagacuacugaugauug

SEQ ID NO: 58860 - RNA, 22 nt, Human
uucuucagacucccucuuuaag

SEQ ID NO: 58861 - RNA, 23 nt, Human
uucuucagccuuauagcccuggg

SEQ ID NO: 58862 - RNA, 22 nt, Human
uucuucagcuucuaccugcguc

SEQ ID NO: 58863 - RNA, 22 nt, Human
uucuucaggauacgucauccag

SEQ ID NO: 58864 - RNA, 22 nt, Human
uucuucagggaagcuuguuaau

SEQ ID NO: 58865 - RNA, 22 nt, Human
uucuucagucuaggccuuucuu

SEQ ID NO: 58866 - RNA, 22 nt, Human
uucuucagugccccucuaguag

SEQ ID NO: 58867 - RNA, 22 nt, Human
uucuucaguguagcaacuguau

SEQ ID NO: 58868 - RNA, 22 nt, Human
uucuucaucuguaagauaagca

SEQ ID NO: 58869 - RNA, 23 nt, Human
uucuucauuuucagaguugagca

SEQ ID NO: 58870 - RNA, 22 nt, Human
uucuucccuucauuccaccacc

SEQ ID NO: 58871 - RNA, 22 nt, Human
uucuuccucuguaaaaggugac

SEQ ID NO: 58872 - RNA, 22 nt, Human
uucuucuacagugauuaauagu

SEQ ID NO: 58873 - RNA, 22 nt, Human
uucuucugccucccaccugaua

SEQ ID NO: 58874 - RNA, 22 nt, Human
uucuucugugaggugugugccu

SEQ ID NO: 58875 - RNA, 22 nt, Human
uucuucuuuaucucaguauccu

SEQ ID NO: 58876 - RNA, 22 nt, Human
uucuucuuuccaauuacauggu

SEQ ID NO: 58877 - RNA, 22 nt, Human
uucuucuuuccuauaauuaauu

SEQ ID NO: 58878 - RNA, 22 nt, Human
uucuugaaucacuuuagagaua

SEQ ID NO: 58879 - RNA, 20 nt, Human
uucuugagccaaaaggcaua

SEQ ID NO: 58880 - RNA, 22 nt, Human
uucuugaguaucugcacagugc

SEQ ID NO: 58881 - RNA, 22 nt, Human
uucuugauguaccaacuuggga

SEQ ID NO: 58882 - RNA, 22 nt, Human
uucuugauuucaugcaguuaag

SEQ ID NO: 58883 - RNA, 22 nt, Human
uucuuggagauaaauucuuaca

SEQ ID NO: 58884 - RNA, 22 nt, Human
uucuuggaugcccucaugccuu

SEQ ID NO: 58885 - RNA, 22 nt, Human
uucuuggcaucaugaaaaauua

SEQ ID NO: 58886 - RNA, 22 nt, Human
uucuuggcauuuucccauuugg

SEQ ID NO: 58887 - RNA, 21 nt, Human
uucuugguuacgcuguagugc

SEQ ID NO: 58888 - RNA, 22 nt, Human
uucuuguauguaugcaaaauca

SEQ ID NO: 58889 - RNA, 22 nt, Human
uucuuuaaaauagugagaaaga

SEQ ID NO: 58890 - RNA, 18 nt, Human
uucuuuaauucaguuuga

SEQ ID NO: 58891 - RNA, 22 nt, Human
uucuuuaccagugaaauguuau

SEQ ID NO: 58892 - RNA, 22 nt, Human
uucuuuauagcuauuggaugag

SEQ ID NO: 58893 - RNA, 22 nt, Human
uucuuuauaucugcuagugggu

SEQ ID NO: 58894 - RNA, 23 nt, Human
uucuuucaagaaguucacagugc

SEQ ID NO: 58895 - RNA, 22 nt, Human
uucuuucaauagcuggcauaug

SEQ ID NO: 58896 - RNA, 22 nt, Human
uucuuucacucaagaaggaucu

SEQ ID NO: 58897 - RNA, 22 nt, Human
uucuuuccacagaggggaugau

SEQ ID NO: 58898 - RNA, 22 nt, Human
uucuuucucagugggcagauac

SEQ ID NO: 58899 - RNA, 22 nt, Human
uucuuucucuacuagcagagcu

SEQ ID NO: 58900 - RNA, 22 nt, Human
uucuuucucuccacaaggcuug

SEQ ID NO: 58901 - RNA, 21 nt, Human
uucuuucugaaucugaaguau

SEQ ID NO: 58902 - RNA, 22 nt, Human
uucuuucuuagcaaucuauggu

SEQ ID NO: 58903 - RNA, 22 nt, Human
uucuuucuucucaggcugggua

SEQ ID NO: 58904 - RNA, 22 nt, Human
uucuuucuuuguaguccugaac

SEQ ID NO: 58905 - RNA, 22 nt, Human
uucuuugcccauguuuccuaag

SEQ ID NO: 58906 - RNA, 22 nt, Human
uucuuugcccuuaaugaaauaa

SEQ ID NO: 58907 - RNA, 22 nt, Human
uucuuuggcuuacgucuggccu

SEQ ID NO: 58908 - RNA, 23 nt, Human
uucuuuguggauaaucuccagug

SEQ ID NO: 58909 - RNA, 22 nt, Human
uucuuuguggcagugagcuggg

SEQ ID NO: 58910 - RNA, 22 nt, Human
uucuuuuaauuucugucugcag

SEQ ID NO: 58911 - RNA, 22 nt, Human
uucuuuucccaauauuuugcug

SEQ ID NO: 58912 - RNA, 22 nt, Human
uucuuuucugcagcugguauuu

SEQ ID NO: 58913 - RNA, 22 nt, Human
uucuuuucuuggcaggaguaga

SEQ ID NO: 58914 - RNA, 22 nt, Human
uucuuuuggacucaaagagaac

SEQ ID NO: 58915 - RNA, 22 nt, Human
uucuuuuuggauagcugaugaa

SEQ ID NO: 58916 - RNA, 22 nt, Human
uugaaaacagcguagauucaca

SEQ ID NO: 58917 - RNA, 22 nt, Human
uugaaaacuuucuagaccaaga

SEQ ID NO: 58918 - RNA, 22 nt, Human
uuaguugaucauucaacauggg

SEQ ID NO: 58919 - RNA, 22 nt, Human
uuaguugaugcuaagggauccc

SEQ ID NO: 58920 - RNA, 22 nt, Human
uuaguugcucacuacaagguua

SEQ ID NO: 58921 - RNA, 22 nt, Human
uuaguuuucucaucuaucucac

SEQ ID NO: 58922 - RNA, 22 nt, Human
uuauaaagauccuuccagaguu

SEQ ID NO: 58923 - RNA, 23 nt, Human
uuauaaauauuuucagguguguu

SEQ ID NO: 58924 - RNA, 22 nt, Human
uuauaacaacaguuuacuuuaa

SEQ ID NO: 58925 - RNA, 22 nt, Human
uuauaacaucaaucagaguuaa

SEQ ID NO: 58926 - RNA, 23 nt, Human
uuauaagaagcaucacaggaaga

SEQ ID NO: 58927 - RNA, 22 nt, Human
uuauaauucuggcauaggcugu

SEQ ID NO: 58928 - RNA, 22 nt, Human
uuauaauugcuuauuagaccca

SEQ ID NO: 58929 - RNA, 22 nt, Human
uuauacacaauucuuuuacuac

SEQ ID NO: 58930 - RNA, 22 nt, Human
uuauacacguuuauggagcuac

SEQ ID NO: 58931 - RNA, 22 nt, Human
uuauacaggagauuccuuacuu

SEQ ID NO: 58932 - RNA, 22 nt, Human
uuauagaucuaaaugugaaggg

SEQ ID NO: 58933 - RNA, 22 nt, Human
uuauagcagcaugauuuauaau

SEQ ID NO: 58934 - RNA, 22 nt, Human
uuauagcagcaugauuuauagu

SEQ ID NO: 58935 - RNA, 22 nt, Human
uuauaggaaucugcauguguga

SEQ ID NO: 58936 - RNA, 21 nt, Human
uuauaggcugggguuugcuuu

SEQ ID NO: 58937 - RNA, 22 nt, Human
uuauagugggcccaacauggcg

SEQ ID NO: 58938 - RNA, 22 nt, Human
uuauaguuaguaggucauuaaa

SEQ ID NO: 58939 - RNA, 22 nt, Human
uuauauaacucaggugggcuca

SEQ ID NO: 58940 - RNA, 22 nt, Human
uuauauacugugguaguacugu

SEQ ID NO: 58941 - RNA, 22 nt, Human
uuauauauauguagaggucacg

SEQ ID NO: 58942 - RNA, 22 nt, Human
uuauauccaaaggcaaggagga

SEQ ID NO: 58943 - RNA, 22 nt, Human
uuauaugauugagcaucuuggu

SEQ ID NO: 58944 - RNA, 22 nt, Human
uuauauguaugcuuauaaacca

SEQ ID NO: 58945 - RNA, 22 nt, Human
uuauauuaguuagacuugcugu

SEQ ID NO: 58946 - RNA, 22 nt, Human
uuaucaguuguguguauacacg

SEQ ID NO: 58947 - RNA, 22 nt, Human
uuaucauaaguaauugaaauaa

SEQ ID NO: 58948 - RNA, 22 nt, Human
uuaucaucuccugcugugguua

SEQ ID NO: 58949 - RNA, 22 nt, Human
uuaucaugggaccugaauuuua

SEQ ID NO: 58950 - RNA, 22 nt, Human
uuauccugcauccuggaacuca

SEQ ID NO: 58951 - RNA, 17 nt, Human
uuaucuacugcuacugu

SEQ ID NO: 58952 - RNA, 22 nt, Human
uuaucuagauguguuaucagac

SEQ ID NO: 58953 - RNA, 22 nt, Human
uuaucugaaaaccucaaaauau

SEQ ID NO: 58954 - RNA, 22 nt, Human
uucauuuggccucugcuuaaaa

SEQ ID NO: 58955 - RNA, 22 nt, Human
uucauuugggaugagucagaag

SEQ ID NO: 58956 - RNA, 19 nt, Human
uucauuuguaucugcucac

SEQ ID NO: 58957 - RNA, 22 nt, Human
uucauuuguccaaauacuaugu

SEQ ID NO: 58958 - RNA, 22 nt, Human
uucauuuguggugaaugaagug

SEQ ID NO: 58959 - RNA, 22 nt, Human
uucauuugugguuauuuacaau

SEQ ID NO: 58960 - RNA, 22 nt, Human
uucauuugugugccugaugcaa

SEQ ID NO: 58961 - RNA, 21 nt, Human
uucauuuguuauagacaaagu

SEQ ID NO: 58962 - RNA, 20 nt, Human
uucauuuguugagcaccuuc

SEQ ID NO: 58963 - RNA, 22 nt, Human
uucauuuuauaaacccugcuga

SEQ ID NO: 58964 - RNA, 22 nt, Human
uucauuuucuuucacgcugcug

SEQ ID NO: 58965 - RNA, 22 nt, Human
uuccaaaaugccuugauaugau

SEQ ID NO: 58966 - RNA, 22 nt, Human
uuccaaacucauaguauggugu

SEQ ID NO: 58967 - RNA, 22 nt, Human
uuccaaagaaguucacauuuac

SEQ ID NO: 58968 - RNA, 22 nt, Human
uuccaaaggaauggggagcuau

SEQ ID NO: 58969 - RNA, 22 nt, Human
uuccaaagucauguugcugaua

SEQ ID NO: 58970 - RNA, 22 nt, Human
uuccaaauuccaauccccugaa

SEQ ID NO: 58971 - RNA, 22 nt, Human
uuccaagaagucaacagguagu

SEQ ID NO: 58972 - RNA, 22 nt, Human
uuccaagacaccuuuagucacu

SEQ ID NO: 58973 - RNA, 22 nt, Human
uuccaagagccuuucuucuaga

SEQ ID NO: 58974 - RNA, 22 nt, Human
uuccaagagcuuuaauuguuga

SEQ ID NO: 58975 - RNA, 22 nt, Human
uuccaaggcccagcagagagga

SEQ ID NO: 58976 - RNA, 22 nt, Human
uuccaaggcuagguuguaaagg

SEQ ID NO: 58977 - RNA, 22 nt, Human
uuccaagucacccuuaggguca

SEQ ID NO: 58978 - RNA, 22 nt, Human
uuccaaguccagccaggccaaa

SEQ ID NO: 58979 - RNA, 22 nt, Human
uuccaagugcccauauuucauc

SEQ ID NO: 58980 - RNA, 22 nt, Human
uuccaagugcugaggacaguag

SEQ ID NO: 58981 - RNA, 22 nt, Human
uuccaaguuaggcgagcuggug

SEQ ID NO: 58982 - RNA, 22 nt, Human
uuccaaucaggauaauaauuag

SEQ ID NO: 58983 - RNA, 22 nt, Human
uuccaaugacuaguggcauccu

SEQ ID NO: 58984 - RNA, 22 nt, Human
uuccacaagauguuucuuagaa

SEQ ID NO: 58985 - RNA, 17 nt, Human
uuccacaauaguuuguc

SEQ ID NO: 58986 - RNA, 23 nt, Human
uuccacaaugaaaauaaagcagg

SEQ ID NO: 58987 - RNA, 22 nt, Human
uuccacagauguaugaaguggu

SEQ ID NO: 58988 - RNA, 22 nt, Human
uuccacagccaucacuguugcu

SEQ ID NO: 58989 - RNA, 21 nt, Human
uuccacaguccugaggauuca

SEQ ID NO: 58990 - RNA, 21 nt, Human
uuccacagugagaacugcaag

SEQ ID NO: 58991 - RNA, 22 nt, Human
uuccacaguggcuguaguucug

SEQ ID NO: 58992 - RNA, 22 nt, Human
uuccaccaauucuccuccaagg

SEQ ID NO: 58993 - RNA, 22 nt, Human
uuccaccaggagauauuucaaa

SEQ ID NO: 58994 - RNA, 22 nt, Human
uuccacuggcuuucagugaucu

SEQ ID NO: 58995 - RNA, 22 nt, Human
uuccagaaaaaaauguauaucu

SEQ ID NO: 58996 - RNA, 22 nt, Human
uuccagaaaacgcuuuauuuag

SEQ ID NO: 58997 - RNA, 22 nt, Human
uuccagaaaguucuggaacugg

SEQ ID NO: 58998 - RNA, 22 nt, Human
uuccagaaaucuuucagcucaa

SEQ ID NO: 58999 - RNA, 22 nt, Human
uuccagaagauggcagcaaagg

SEQ ID NO: 59000 - RNA, 22 nt, Human
uuccagaaggaagccggggagc

SEQ ID NO: 59001 - RNA, 22 nt, Human
uuccagaauagauggagcucua

SEQ ID NO: 59002 - RNA, 20 nt, Human
uuccagagaucugcauuuua

SEQ ID NO: 59003 - RNA, 22 nt, Human
uuccagagcaguuuucagauca

SEQ ID NO: 59004 - RNA, 23 nt, Human
uuccagagucuucgacgguaggc

SEQ ID NO: 59005 - RNA, 22 nt, Human
uuccagccagauuugcuggguu

SEQ ID NO: 59006 - RNA, 22 nt, Human
uuccagcuaacucacaucccuu

SEQ ID NO: 59007 - RNA, 22 nt, Human
uuccagcucuugaaggugggau

SEQ ID NO: 59008 - RNA, 22 nt, Human
uuccaggaagauucaacaaaag

SEQ ID NO: 59009 - RNA, 22 nt, Human
uuccaggaccaggaagagggga

SEQ ID NO: 59010 - RNA, 22 nt, Human
uuccaggacuggguguuugaag

SEQ ID NO: 59011 - RNA, 22 nt, Human
uuccaggacuucauggcucuga

SEQ ID NO: 59012 - RNA, 22 nt, Human
uuccaggagccacacaggggcg

SEQ ID NO: 59013 - RNA, 22 nt, Human
uuccaggaggcauucuuaguuu

SEQ ID NO: 59014 - RNA, 22 nt, Human
uuccaggauggagacacuagua

SEQ ID NO: 59015 - RNA, 22 nt, Human
uuccaggcucccuuggaggugu

SEQ ID NO: 59016 - RNA, 22 nt, Human
uuccaggcugaugggccacagg

SEQ ID NO: 59017 - RNA, 22 nt, Human
uuccaguuaaggaagcuauucu

SEQ ID NO: 59018 - RNA, 22 nt, Human
uuccaguuggcacugcaauuua

SEQ ID NO: 59019 - RNA, 22 nt, Human
uuccaguugucauaaagcuagg

SEQ ID NO: 59020 - RNA, 17 nt, Human
uuccaguuuaguauugu

SEQ ID NO: 59021 - RNA, 22 nt, Human
uuccauaauaggcuuaagugaa

SEQ ID NO: 59022 - RNA, 22 nt, Human
uuccauaaugagauucccagcc

SEQ ID NO: 59023 - RNA, 22 nt, Human
uuccauaauuaaguggagagaa

SEQ ID NO: 59024 - RNA, 22 nt, Human
uuccauauuagacuaugugggg

SEQ ID NO: 59025 - RNA, 22 nt, Human
uuccauauucccaauuuugcca

SEQ ID NO: 59026 - RNA, 22 nt, Human
uuccaugacugaagcaggggcg

SEQ ID NO: 59027 - RNA, 22 nt, Human
uuccaugagcucugaguucaca

SEQ ID NO: 59028 - RNA, 18 nt, Human
uuccaugauuccuuucac

SEQ ID NO: 59029 - RNA, 22 nt, Human
uuccaugggucugggggcucca

SEQ ID NO: 59030 - RNA, 22 nt, Human
uuccauuguuucugucuucacu

SEQ ID NO: 59031 - RNA, 22 nt, Human
uuccauuuggcacuucacugag

SEQ ID NO: 59032 - RNA, 22 nt, Human
uucccacaaucugcguguguau

SEQ ID NO: 59033 - RNA, 22 nt, Human
uucccacacaauuaagucauuu

SEQ ID NO: 59034 - RNA, 22 nt, Human
uucccacagugacuccagagaa

SEQ ID NO: 59035 - RNA, 22 nt, Human
uucccacaguguugaauccucu

SEQ ID NO: 59036 - RNA, 22 nt, Human
uucccagauuggagggcagggg

SEQ ID NO: 59037 - RNA, 21 nt, Human
uucccagcaccuagcacaggu

SEQ ID NO: 59038 - RNA, 19 nt, Human
uucccaggaaaggggugca

SEQ ID NO: 59039 - RNA, 22 nt, Human
uucccagguaauucugaggcag

SEQ ID NO: 59040 - RNA, 22 nt, Human
uucccagugauugaacaucccu

SEQ ID NO: 59041 - RNA, 22 nt, Human
uuccccagggaagcuccugcgc

SEQ ID NO: 59042 - RNA, 19 nt, Human
uuccccuccccagggauag

SEQ ID NO: 59043 - RNA, 22 nt, Human
uuccccuuauaagucuggcuuc

SEQ ID NO: 59044 - RNA, 22 nt, Human
uucccucucacuuaaagcuugg

SEQ ID NO: 59045 - RNA, 22 nt, Human
uucccucucuagcuuuccccaa

SEQ ID NO: 59046 - RNA, 22 nt, Human
uucccugagucucccugagucu

SEQ ID NO: 59047 - RNA, 22 nt, Human
uucccugcaaccuuucccuggg

SEQ ID NO: 59048 - RNA, 22 nt, Human
uucccuggcucuucuacaucgu

SEQ ID NO: 59049 - RNA, 22 nt, Human
uucccuggugggugagaaccug

SEQ ID NO: 59050 - RNA, 22 nt, Human
uucccuucuaguuuugagagac

SEQ ID NO: 59051 - RNA, 22 nt, Human
uuccgagggcucggcggccgcc

SEQ ID NO: 59052 - RNA, 22 nt, Human
uuccgcuguuuaguugaaguuu

SEQ ID NO: 59053 - RNA, 22 nt, Human
uuccuacaauuagagccucuuu

SEQ ID NO: 59054 - RNA, 22 nt, Human
uuccuacagcccugaaucucua

SEQ ID NO: 59055 - RNA, 22 nt, Human
uuccuacauuuguacaauaaga

SEQ ID NO: 59056 - RNA, 22 nt, Human
uuccuagcuauaaagcucuucc

SEQ ID NO: 59057 - RNA, 22 nt, Human
uuccuauccuuuuauguuuaug

SEQ ID NO: 59058 - RNA, 22 nt, Human
uuccucaacaacuucccuacag

SEQ ID NO: 59059 - RNA, 22 nt, Human
uuccucagaaaauacuguccaa

SEQ ID NO: 59060 - RNA, 22 nt, Human
uuccucagagagacagaaacua

SEQ ID NO: 59061 - RNA, 22 nt, Human
uuccucagagggcgcuggggaa

SEQ ID NO: 59062 - RNA, 22 nt, Human
uuccucagcacaaagccaagau

SEQ ID NO: 59063 - RNA, 22 nt, Human
uucuaggggagaggaagaagug

SEQ ID NO: 59064 - RNA, 22 nt, Human
uucuaguuaauguagcaucuug

SEQ ID NO: 59065 - RNA, 22 nt, Human
uucuaguucugaaagccugaca

SEQ ID NO: 59066 - RNA, 22 nt, Human
uucuaguuuccauuuuaagaca

SEQ ID NO: 59067 - RNA, 22 nt, Human
uucuaguuuugccuuaucaaca

SEQ ID NO: 59068 - RNA, 22 nt, Human
uucuauaaugcaagccacugca

SEQ ID NO: 59069 - RNA, 22 nt, Human
uucuaucauacuugaauacauu

SEQ ID NO: 59070 - RNA, 22 nt, Human
uucuaugaagguaagauguacg

SEQ ID NO: 59071 - RNA, 22 nt, Human
uucuaugucagugugcucugug

SEQ ID NO: 59072 - RNA, 22 nt, Human
uucuaugugcuggagaauauuu

SEQ ID NO: 59073 - RNA, 22 nt, Human
uucuauguuaguaugggucucc

SEQ ID NO: 59074 - RNA, 22 nt, Human
uucucaaaacucaggguaucug

SEQ ID NO: 59075 - RNA, 22 nt, Human
uucucaaagggugguuugcaaa

SEQ ID NO: 59076 - RNA, 22 nt, Human
uucucaaagugugcucccugga

SEQ ID NO: 59077 - RNA, 22 nt, Human
uucucaacucucaagagaagcu

SEQ ID NO: 59078 - RNA, 22 nt, Human
uucucaagaacauauguagggu

SEQ ID NO: 59079 - RNA, 22 nt, Human
uucucaaggacaaaaugacaug

SEQ ID NO: 59080 - RNA, 22 nt, Human
uucucagaauugacugggagca

SEQ ID NO: 59081 - RNA, 22 nt, Human
uucucagcuuuccuugcaguua

SEQ ID NO: 59082 - RNA, 22 nt, Human
uucucaggacuccugccugcuu

SEQ ID NO: 59083 - RNA, 22 nt, Human
uucucaggcuguggagccgucu

SEQ ID NO: 59084 - RNA, 22 nt, Human
uucucagggcaucucaugaccc

SEQ ID NO: 59085 - RNA, 22 nt, Human
uucucaggguuugugcaggcuu

SEQ ID NO: 59086 - RNA, 22 nt, Human
uucucaggugaggcugaggcug

SEQ ID NO: 59087 - RNA, 22 nt, Human
uucucaguaguuagcauuugug

SEQ ID NO: 59088 - RNA, 22 nt, Human
uucucagugaaguuuagaacau

SEQ ID NO: 59089 - RNA, 19 nt, Human
uucucaguucaggagaaga

SEQ ID NO: 59090 - RNA, 22 nt, Human
uucucaguuucacugauaacag

SEQ ID NO: 59091 - RNA, 22 nt, Human
uucucauaggagcgcaaacccu

SEQ ID NO: 59092 - RNA, 22 nt, Human
uucucaugaaacucgcuuccuc

SEQ ID NO: 59093 - RNA, 22 nt, Human
uucucaugaugcaauucauccc

SEQ ID NO: 59094 - RNA, 20 nt, Human
uucuccaaaggagacacuag

SEQ ID NO: 59095 - RNA, 22 nt, Human
uucuccaaguagaagcuaaguu

SEQ ID NO: 59096 - RNA, 22 nt, Human
uucuccagaccuugugacuaug

SEQ ID NO: 59097 - RNA, 22 nt, Human
uucuccagcacauuuucuuuga

SEQ ID NO: 59098 - RNA, 22 nt, Human
uucuccagccuauuggccuauc

SEQ ID NO: 59099 - RNA, 22 nt, Human
uucuccagcucaucagggaggg

SEQ ID NO: 59100 - RNA, 22 nt, Human
uucuccaggccgcgcagggggc

SEQ ID NO: 59101 - RNA, 22 nt, Human
uucucccaucucagucuuacau

SEQ ID NO: 59102 - RNA, 22 nt, Human
uucucccugccaaagcugccuc

SEQ ID NO: 59103 - RNA, 22 nt, Human
uucucccugguauuuacuuagu

SEQ ID NO: 59104 - RNA, 22 nt, Human
uucuccucuguuggccuucccu

SEQ ID NO: 59105 - RNA, 22 nt, Human
uucuccuuccugguuuucaggc

SEQ ID NO: 59106 - RNA, 22 nt, Human
uucuccuuguucccuucaauug

SEQ ID NO: 59107 - RNA, 22 nt, Human
uucucuaagaguuauaugaauu

SEQ ID NO: 59108 - RNA, 22 nt, Human
uucucuagcaaaaccagcuagu

SEQ ID NO: 59109 - RNA, 22 nt, Human
uucucuccuacccaguauccau

SEQ ID NO: 59110 - RNA, 22 nt, Human
uucucucuuccaguucccacuu

SEQ ID NO: 59111 - RNA, 22 nt, Human
uucucucuuuuggguaggaggu

SEQ ID NO: 59112 - RNA, 22 nt, Human
uucucugacccccuuaaauauu

SEQ ID NO: 59113 - RNA, 22 nt, Human
uucucugagauagacuaagugg

SEQ ID NO: 59114 - RNA, 22 nt, Human
uucucugaguacguuucagugu

SEQ ID NO: 59115 - RNA, 22 nt, Human
uucucugaucuugcuagacuga

SEQ ID NO: 59116 - RNA, 22 nt, Human
uucucugcagcuuaggcccagu

SEQ ID NO: 59117 - RNA, 21 nt, Human
uucucuggauaggccaguccu

SEQ ID NO: 59118 - RNA, 22 nt, Human
uucucugggaacauaaaugaag

SEQ ID NO: 59119 - RNA, 22 nt, Human
uucucugggaucuggcaaaagg

SEQ ID NO: 59120 - RNA, 22 nt, Human
uucucugggguucaguaucucu

SEQ ID NO: 59121 - RNA, 22 nt, Human
uucucugguaaacacaugcgua

SEQ ID NO: 59122 - RNA, 21 nt, Human
uucucuggucaagcacacaua

SEQ ID NO: 59123 - RNA, 16 nt, Human
uucucuguuccuugug

SEQ ID NO: 59124 - RNA, 17 nt, Human
uucucuuccuggauagu

SEQ ID NO: 59125 - RNA, 22 nt, Human
uucucuuuauguauuuaguggg

SEQ ID NO: 59126 - RNA, 22 nt, Human
uucucuuucuacagugugauug

SEQ ID NO: 59127 - RNA, 22 nt, Human
uucugaaaacacacuuugcagc

SEQ ID NO: 59128 - RNA, 22 nt, Human
uucugaaaauugggucauacuu

SEQ ID NO: 59129 - RNA, 20 nt, Human
uucugaaagcagcagaggga

SEQ ID NO: 59130 - RNA, 22 nt, Human
uucugaaagccaauucauugaa

SEQ ID NO: 59131 - RNA, 22 nt, Human
uucugaaauaggagauagcugu

SEQ ID NO: 59132 - RNA, 22 nt, Human
uucugaaauucgacuauccaau

SEQ ID NO: 59133 - RNA, 22 nt, Human
uucugaaauuucuguagaucuu

SEQ ID NO: 59134 - RNA, 22 nt, Human
uucugaaggcuccucaggaaag

SEQ ID NO: 59135 - RNA, 22 nt, Human
uucugaaggucagcagcuuggu

SEQ ID NO: 59136 - RNA, 22 nt, Human
uucugaauccucgaaacauagc

SEQ ID NO: 59137 - RNA, 22 nt, Human
uucugaaugauagucuugaacu

SEQ ID NO: 59138 - RNA, 22 nt, Human
uucugacauauccagucucagu

SEQ ID NO: 59139 - RNA, 22 nt, Human
uucugacaugugagauuuuguu

SEQ ID NO: 59140 - RNA, 22 nt, Human
uucugacauuugucaaaaugau

SEQ ID NO: 59141 - RNA, 22 nt, Human
uucugagaggcagagcuuguga

SEQ ID NO: 59142 - RNA, 22 nt, Human
uucugagaguaaacauagccug

SEQ ID NO: 59143 - RNA, 22 nt, Human
uucugagaguuguaguguaucc

SEQ ID NO: 59144 - RNA, 22 nt, Human
uucugagaugaggaggaaaaag

SEQ ID NO: 59145 - RNA, 22 nt, Human
uucugagaugcguuagaaauuu

SEQ ID NO: 59146 - RNA, 22 nt, Human
uucugagccuuucuaagaaaca

SEQ ID NO: 59147 - RNA, 22 nt, Human
uucugagcugcaacacuaacau

SEQ ID NO: 59148 - RNA, 22 nt, Human
uucugaggcuuucccguccccu

SEQ ID NO: 59149 - RNA, 22 nt, Human
uucugagggcuaauguacugua

SEQ ID NO: 59150 - RNA, 22 nt, Human
uucugagguccaugcaguacug

SEQ ID NO: 59151 - RNA, 22 nt, Human
uucugauugcugaugaggccca

SEQ ID NO: 59152 - RNA, 22 nt, Human
uucugcacuaaauaucaaauau

SEQ ID NO: 59153 - RNA, 22 nt, Human
uucugcagaucaacuugacugc

SEQ ID NO: 59154 - RNA, 22 nt, Human
uucugcagugaaugacucaaua

SEQ ID NO: 59155 - RNA, 22 nt, Human
uucugcagugugcagggccugu

SEQ ID NO: 59156 - RNA, 22 nt, Human
uucugcaucucacagccagugc

SEQ ID NO: 59157 - RNA, 22 nt, Human
uucugcaucugaauuuaaguac

SEQ ID NO: 59158 - RNA, 22 nt, Human
uucugcaugaacaguuuauucc

SEQ ID NO: 59159 - RNA, 22 nt, Human
uucugcaugguuggggagaagc

SEQ ID NO: 59160 - RNA, 21 nt, Human
uucugcauuaagguggagaua

SEQ ID NO: 59161 - RNA, 22 nt, Human
uucugccaaagaaguaaaugga

SEQ ID NO: 59162 - RNA, 22 nt, Human
uucugccacgagcaguuucuuc

SEQ ID NO: 59163 - RNA, 22 nt, Human
uucugcccaccacacuuuaucu

SEQ ID NO: 59164 - RNA, 19 nt, Human
uucugcccucucuucuagc

SEQ ID NO: 59165 - RNA, 20 nt, Human
uucugccuaggguuagccug

SEQ ID NO: 59166 - RNA, 22 nt, Human
uucagcaaccagaaaggcuggg

SEQ ID NO: 59167 - RNA, 22 nt, Human
uucagcaagaauuuacugagcu

SEQ ID NO: 59168 - RNA, 22 nt, Human
uucagcaagaccaccauguacc

SEQ ID NO: 59169 - RNA, 21 nt, Human
uucagcaagcacucuggacac

SEQ ID NO: 59170 - RNA, 22 nt, Human
uucagcaagugucucuacuguc

SEQ ID NO: 59171 - RNA, 22 nt, Human
uucagcacccucugaggcaucc

SEQ ID NO: 59172 - RNA, 22 nt, Human
uucugcuccaccacuuccagca

SEQ ID NO: 59173 - RNA, 21 nt, Human
uucugcuccagcuccucuggg

SEQ ID NO: 59174 - RNA, 22 nt, Human
uucugcugaaaacagccaugua

SEQ ID NO: 59175 - RNA, 22 nt, Human
uucugcugccuacuccugggga

SEQ ID NO: 59176 - RNA, 17 nt, Human
uucugcugucguccucu

SEQ ID NO: 59177 - RNA, 17 nt, Human
uucugcuguuuccccuu

SEQ ID NO: 59178 - RNA, 22 nt, Human
uucugcuuagagggcauuugca

SEQ ID NO: 59179 - RNA, 22 nt, Human
uucugcuuauucaaaugaucuu

SEQ ID NO: 59180 - RNA, 22 nt, Human
uucugcuuucaguucuucuggg

SEQ ID NO: 59181 - RNA, 22 nt, Human
uucugcuuuuauugccagaguu

SEQ ID NO: 59182 - RNA, 22 nt, Human
uucuggaaagauuugcguguaa

SEQ ID NO: 59183 - RNA, 22 nt, Human
uucuggaaauguugcugaggcc

SEQ ID NO: 59184 - RNA, 22 nt, Human
uucuggaacauagcaagaaguu

SEQ ID NO: 59185 - RNA, 22 nt, Human
uucuggaagaauaaugggcaaa

SEQ ID NO: 59186 - RNA, 22 nt, Human
uucuggaagauaccucuccuaa

SEQ ID NO: 59187 - RNA, 22 nt, Human
uucuggaagcuggaaaaggcaa

SEQ ID NO: 59188 - RNA, 22 nt, Human
uucuggaaggcagggagaaccc

SEQ ID NO: 59189 - RNA, 22 nt, Human
uucuggaaggguggaguagcuu

SEQ ID NO: 59190 - RNA, 22 nt, Human
uucuggaauauuugacacaauu

SEQ ID NO: 59191 - RNA, 22 nt, Human
uucuggaauccucaaaacauga

SEQ ID NO: 59192 - RNA, 19 nt, Human
uucuggacagcagaaacca

SEQ ID NO: 59193 - RNA, 22 nt, Human
uucuggacuugccuugcugaug

SEQ ID NO: 59194 - RNA, 22 nt, Human
uucuggagacccagcaacaggg

SEQ ID NO: 59195 - RNA, 22 nt, Human
uucuggagccgggccugggcag

SEQ ID NO: 59196 - RNA, 22 nt, Human
uucuggaggagaaagggugggc

SEQ ID NO: 59197 - RNA, 22 nt, Human
uucuggagggcaugcugcugcc

SEQ ID NO: 59198 - RNA, 22 nt, Human
uucuggagucauuggggcugau

SEQ ID NO: 59199 - RNA, 22 nt, Human
uucuggaguugugaccucaggg

SEQ ID NO: 59200 - RNA, 22 nt, Human
uucuggauaugggagagggagc

SEQ ID NO: 59201 - RNA, 22 nt, Human
uucuggaucugagggggaagau

SEQ ID NO: 59202 - RNA, 23 nt, Human
uucuggauguucuagucugagag

SEQ ID NO: 59203 - RNA, 22 nt, Human
uucuggcagauugcguaauaaa

SEQ ID NO: 59204 - RNA, 22 nt, Human
uucuggcaucugggggaggccu

SEQ ID NO: 59205 - RNA, 22 nt, Human
uucuggccaaggcugccagauu

SEQ ID NO: 59206 - RNA, 22 nt, Human
uucuggcuuaguuguuguauau

SEQ ID NO: 59207 - RNA, 22 nt, Human
uucuggcuuuacuucccaucca

SEQ ID NO: 59208 - RNA, 22 nt, Human
uucuggcuuuaggcuuuucaag

SEQ ID NO: 59209 - RNA, 20 nt, Human
uucugggaauuggguagcug

SEQ ID NO: 59210 - RNA, 22 nt, Human
uucugggacauugcagguauuc

SEQ ID NO: 59211 - RNA, 22 nt, Human
uucugggcacacaggcccuggu

SEQ ID NO: 59212 - RNA, 19 nt, Human
uucugggcagcacaugaau

SEQ ID NO: 59213 - RNA, 21 nt, Human
uucugggccaugcugcuucuc

SEQ ID NO: 59214 - RNA, 22 nt, Human
uucugggcuaccuucccggcag

SEQ ID NO: 59215 - RNA, 23 nt, Human
uucugggcuguggaagccucggg

SEQ ID NO: 59216 - RNA, 22 nt, Human
uucugggcuugaaaguuuaaua

SEQ ID NO: 59217 - RNA, 22 nt, Human
uucuggggcuaauacagagguc

SEQ ID NO: 59218 - RNA, 22 nt, Human
uucuggguaacaaggcaagaau

SEQ ID NO: 59219 - RNA, 17 nt, Human
uucugggucccagggcc

SEQ ID NO: 59220 - RNA, 22 nt, Human
uucuggguggccaguauuuaga

SEQ ID NO: 59221 - RNA, 21 nt, Human
uucuggguuguuaaucugaac

SEQ ID NO: 59222 - RNA, 22 nt, Human
uucugguaccgugucagaaacc

SEQ ID NO: 59223 - RNA, 22 nt, Human
uucugguggccagaagucugaa

SEQ ID NO: 59224 - RNA, 22 nt, Human
uucugguguguucucucuaggc

SEQ ID NO: 59225 - RNA, 22 nt, Human
uucuguaagcuaccaaguuugu

SEQ ID NO: 59226 - RNA, 19 nt, Human
uucuguaaggacauuaauc

SEQ ID NO: 59227 - RNA, 22 nt, Human
uucuguaagggauuuauucuga

SEQ ID NO: 59228 - RNA, 22 nt, Human
uucuguacaaguuguggcugcu

SEQ ID NO: 59229 - RNA, 22 nt, Human
uucuguaguauucuuuugguca

SEQ ID NO: 59230 - RNA, 22 nt, Human
uucuguaucuuucuucaagauu

SEQ ID NO: 59231 - RNA, 22 nt, Human
uucuguauuuaguuugaggaca

SEQ ID NO: 59232 - RNA, 22 nt, Human
uucugucaaacucacaggccga

SEQ ID NO: 59233 - RNA, 22 nt, Human
uucugucaaagacuuuuucagg

SEQ ID NO: 59234 - RNA, 16 nt, Human
uucugucacguacggc

SEQ ID NO: 59235 - RNA, 22 nt, Human
uucugucacuugcaaucaagag

SEQ ID NO: 59236 - RNA, 22 nt, Human
uucuguccaggcgcccagcuau

SEQ ID NO: 59237 - RNA, 22 nt, Human
uucuguccuguuggaugaauca

SEQ ID NO: 59238 - RNA, 22 nt, Human
uucugucuguaaacuucucaau

SEQ ID NO: 59239 - RNA, 22 nt, Human
uucugucuucucgguuguuuac

SEQ ID NO: 59240 - RNA, 23 nt, Human
uucugucuugcugucagcuuucu

SEQ ID NO: 59241 - RNA, 22 nt, Human
uucugugaaucuuuuuucccac

SEQ ID NO: 59242 - RNA, 22 nt, Human
uucugugaauggccaugacaag

SEQ ID NO: 59243 - RNA, 22 nt, Human
uucugugauugacauguggcuu

SEQ ID NO: 59244 - RNA, 18 nt, Human
uucugugcaucuuucuau

SEQ ID NO: 59245 - RNA, 22 nt, Human
uucugugcucaaaacuuuccaa

SEQ ID NO: 59246 - RNA, 22 nt, Human
uucuguggguaauaccucauac

SEQ ID NO: 59247 - RNA, 22 nt, Human
uucugugguugaaaggagagau

SEQ ID NO: 59248 - RNA, 22 nt, Human
uucugugugccagaguugugcu

SEQ ID NO: 59249 - RNA, 22 nt, Human
uucugugugcugucuuggcuuu

SEQ ID NO: 59250 - RNA, 22 nt, Human
uucuguguggguagcuccuguu

SEQ ID NO: 59251 - RNA, 22 nt, Human
uucuguuacuugcaaccacagg

SEQ ID NO: 59252 - RNA, 22 nt, Human
uucuguuucuggggucucugac

SEQ ID NO: 59253 - RNA, 22 nt, Human
uucuguuuugcacagacuugaa

SEQ ID NO: 59254 - RNA, 22 nt, Human
uucuuaaaacuuauggacaggu

SEQ ID NO: 59255 - RNA, 22 nt, Human
uucuuaaagaggcaaaacacag

SEQ ID NO: 59256 - RNA, 22 nt, Human
uucuuaagacugcaaaucaacc

SEQ ID NO: 59257 - RNA, 22 nt, Human
uucuuaagaggaacauuuuugu

SEQ ID NO: 59258 - RNA, 22 nt, Human
uucuuaaguuuagcaacuugug

SEQ ID NO: 59259 - RNA, 22 nt, Human
uucuuaauaccuauuuucuacc

SEQ ID NO: 59260 - RNA, 22 nt, Human
uucuuaaucuguguggguucga

SEQ ID NO: 59261 - RNA, 22 nt, Human
uucuuacagauuuggugaauga

SEQ ID NO: 59262 - RNA, 22 nt, Human
uucuuacagcccuauuacuaaa

SEQ ID NO: 59263 - RNA, 22 nt, Human
uucuuacaucaguuuauuuugu

SEQ ID NO: 59264 - RNA, 22 nt, Human
uucuuacauuacuuuacaugug

SEQ ID NO: 59265 - RNA, 22 nt, Human
uucuuacuacauuugcaggcua

SEQ ID NO: 59266 - RNA, 22 nt, Human
uucuuacuaugauuugagccuc

SEQ ID NO: 59267 - RNA, 22 nt, Human
uucuuagaagaaacaucuaaaa

SEQ ID NO: 59268 - RNA, 22 nt, Human
uucuuaggagcauuaguaauuu

SEQ ID NO: 59269 - RNA, 22 nt, Human
uucuuauucuugaaauguggga

SEQ ID NO: 59270 - RNA, 22 nt, Human
uucuuauuucccccuucaucau

SEQ ID NO: 59271 - RNA, 21 nt, Human
uucuucaaagaagaaggcaca

SEQ ID NO: 59272 - RNA, 22 nt, Human
uucuucaaauagcagggaguca

SEQ ID NO: 59273 - RNA, 22 nt, Human
uucuucaauuuuccauauacug

SEQ ID NO: 59274 - RNA, 22 nt, Human
uucuucaguuugguaaauguaa

SEQ ID NO: 59275 - RNA, 22 nt, Human
uucuucauucccuuacuuccga

SEQ ID NO: 59276 - RNA, 23 nt, Human
uucuuccaaggugcuuugugguu

SEQ ID NO: 59277 - RNA, 22 nt, Human
uucuucuccgaggagggcuggu

SEQ ID NO: 59278 - RNA, 22 nt, Human
uucuucugaaacagugacagac

SEQ ID NO: 59279 - RNA, 22 nt, Human
uucuucugagagaaaaagcuca

SEQ ID NO: 59280 - RNA, 22 nt, Human
uucuucugauugccuucugcaa

SEQ ID NO: 59281 - RNA, 22 nt, Human
uucuaaugaaaucuguacagua

SEQ ID NO: 59282 - RNA, 22 nt, Human
uucuaauugcaaguuuuaguau

SEQ ID NO: 59283 - RNA, 22 nt, Human
uucuacaaauauuuacuguucc

SEQ ID NO: 59284 - RNA, 22 nt, Human
uucuacacugaguuuuuucccu

SEQ ID NO: 59285 - RNA, 22 nt, Human
uucuacagaauaaauguuuaca

SEQ ID NO: 59286 - RNA, 23 nt, Human
uucuacagcuucuucaguuaagg

SEQ ID NO: 59287 - RNA, 22 nt, Human
uucuacaucacuuaacaugcua

SEQ ID NO: 59288 - RNA, 22 nt, Human
uuuacaguccccaggugaggau

SEQ ID NO: 59289 - RNA, 20 nt, Human
uuuacauccccaccagcaau

SEQ ID NO: 59290 - RNA, 22 nt, Human
uuuacauguaauguuauacaaa

SEQ ID NO: 59291 - RNA, 17 nt, Human
uuuacauugcucgcagu

SEQ ID NO: 59292 - RNA, 22 nt, Human
uuuacauuucccucugucaguu

SEQ ID NO: 59293 - RNA, 20 nt, Human
uuuaccaaaggaguuaugau

SEQ ID NO: 59294 - RNA, 22 nt, Human
uuuaccaaauagauuaugucag

SEQ ID NO: 59295 - RNA, 20 nt, Human
uuuaccaacucaccaguauc

SEQ ID NO: 59296 - RNA, 22 nt, Human
uuuaccaaggcauaguaaucuc

SEQ ID NO: 59297 - RNA, 23 nt, Human
uuuaccagaauagcaggggagag

SEQ ID NO: 59298 - RNA, 22 nt, Human
uuuaccaucugccacagauaug

SEQ ID NO: 59299 - RNA, 22 nt, Human
uuuacccaguaacugcuuggcu

SEQ ID NO: 59300 - RNA, 22 nt, Human
uuuaccuucuuuuaacuacagu

SEQ ID NO: 59301 - RNA, 22 nt, Human
uuuacgaaaagugacuaauagg

SEQ ID NO: 59302 - RNA, 22 nt, Human
uuuacuaaguacuuguaucccu

SEQ ID NO: 59303 - RNA, 22 nt, Human
uuuacuacuugugauaacugaa

SEQ ID NO: 59304 - RNA, 22 nt, Human
uuuacucuugcuacacaacugu

SEQ ID NO: 59305 - RNA, 22 nt, Human
uuuacugaccuccaaucccacu

SEQ ID NO: 59306 - RNA, 22 nt, Human
uuuacugagugaccuagaauaa

SEQ ID NO: 59307 - RNA, 22 nt, Human
uuuacuguuuacagcuaaugca

SEQ ID NO: 59308 - RNA, 22 nt, Human
uuuacuucugcauuuccccuag

SEQ ID NO: 59309 - RNA, 22 nt, Human
uuuacuuguucugcugaauucu

SEQ ID NO: 59310 - RNA, 22 nt, Human
uuuacuuuugguaaggucauuu

SEQ ID NO: 59311 - RNA, 22 nt, Human
uuuagaaauugcagagugggug

SEQ ID NO: 59312 - RNA, 22 nt, Human
uuuagaauguuagcguuaaagg

SEQ ID NO: 59313 - RNA, 22 nt, Human
uuuagaauuggcuagugggaau

SEQ ID NO: 59314 - RNA, 22 nt, Human
uuuagacaucuauaauugcuaa

SEQ ID NO: 59315 - RNA, 19 nt, Human
uuuagacauugucugguau

SEQ ID NO: 59316 - RNA, 21 nt, Human
uuuagagaauacucacuauuu

SEQ ID NO: 59317 - RNA, 22 nt, Human
uuuagagacccucugcuauuuu

SEQ ID NO: 59318 - RNA, 22 nt, Human
uuuagagagaaauaaaugagau

SEQ ID NO: 59319 - RNA, 22 nt, Human
uuuagagcaggguguggcacau

SEQ ID NO: 59320 - RNA, 22 nt, Human
uuuagaggcugccuaucacaac

SEQ ID NO: 59321 - RNA, 22 nt, Human
uuuagaggggaaaguggcuggu

SEQ ID NO: 59322 - RNA, 22 nt, Human
uuuagagguuagaggcugauag

SEQ ID NO: 59323 - RNA, 22 nt, Human
uuuagaguccaaguucuucacu

SEQ ID NO: 59324 - RNA, 22 nt, Human
uuuagcaaauuagcaccucuaa

SEQ ID NO: 59325 - RNA, 22 nt, Human
uuuagcaacgaagcacucgaca

SEQ ID NO: 59326 - RNA, 22 nt, Human
uuuagcaaguauuuacugacua

SEQ ID NO: 59327 - RNA, 22 nt, Human
uuuagcaaguucucugagagaa

SEQ ID NO: 59328 - RNA, 22 nt, Human
uuuagcaauuucuaaaaguguu

SEQ ID NO: 59329 - RNA, 21 nt, Human
uuuagcauuuacauauuucca

SEQ ID NO: 59330 - RNA, 19 nt, Human
uuuagcuuacguuucauug

SEQ ID NO: 59331 - RNA, 22 nt, Human
uuuagcuucauuuggcgugauu

SEQ ID NO: 59332 - RNA, 22 nt, Human
uuuagcuugaaaguuuuggagg

SEQ ID NO: 59333 - RNA, 22 nt, Human
uuuagcuuugaaggauaugguu

SEQ ID NO: 59334 - RNA, 22 nt, Human
uuuagcuuuugugucagauaag

SEQ ID NO: 59335 - RNA, 22 nt, Human
uuuaggaacuuagguuuaugga

SEQ ID NO: 59336 - RNA, 22 nt, Human
uuuaggcaagaacucacugaga

SEQ ID NO: 59337 - RNA, 22 nt, Human
uuuaggcagaacauggacuuug

SEQ ID NO: 59338 - RNA, 22 nt, Human
uuuagggaaauugaggguuaag

SEQ ID NO: 59339 - RNA, 22 nt, Human
uuuaguaccaucauuugccucu

SEQ ID NO: 59340 - RNA, 22 nt, Human
uuuaguagaauaguauaucaaa

SEQ ID NO: 59341 - RNA, 22 nt, Human
uuuaguagaaugauacagggca

SEQ ID NO: 59342 - RNA, 22 nt, Human
uuuaguagcuacaguuagaagg

SEQ ID NO: 59343 - RNA, 22 nt, Human
uuuaguauccuaucucauuuaa

SEQ ID NO: 59344 - RNA, 23 nt, Human
uuuagucaguugacagccauaua

SEQ ID NO: 59345 - RNA, 22 nt, Human
uuuagucauagauacccaaggu

SEQ ID NO: 59346 - RNA, 22 nt, Human
uuuagucauuuggauuugaucu

SEQ ID NO: 59347 - RNA, 22 nt, Human
uuuagucuaauaaaaguggagu

SEQ ID NO: 59348 - RNA, 22 nt, Human
uuuagucugacuauuaccucca

SEQ ID NO: 59349 - RNA, 22 nt, Human
uuuagugagugugaaucaaaug

SEQ ID NO: 59350 - RNA, 22 nt, Human
uuuaguguaagcauaaagaaca

SEQ ID NO: 59351 - RNA, 22 nt, Human
uuuaguguagcauucagaguca

SEQ ID NO: 59352 - RNA, 22 nt, Human
uuuaguguagccuaagcagaau

SEQ ID NO: 59353 - RNA, 22 nt, Human
uuuagugugacaguccccagua

SEQ ID NO: 59354 - RNA, 22 nt, Human
uuuaguucacaccaggguagca

SEQ ID NO: 59355 - RNA, 22 nt, Human
uuuaguucauaaaaccagggug

SEQ ID NO: 59356 - RNA, 22 nt, Human
uuuaguuuuaacugaaagcuau

SEQ ID NO: 59357 - RNA, 22 nt, Human
uuuauacauggagaauuuuugc

SEQ ID NO: 59358 - RNA, 23 nt, Human
uuuauagcagcaugauuuauaau

SEQ ID NO: 59359 - RNA, 23 nt, Human
uuuauagcagcaugauuuauagu

SEQ ID NO: 59360 - RNA, 22 nt, Human
uuuauagucgucucaguaauaa

SEQ ID NO: 59361 - RNA, 22 nt, Human
uuuauauaacagagacugcuau

SEQ ID NO: 59362 - RNA, 18 nt, Human
uuuauauggauagagacc

SEQ ID NO: 59363 - RNA, 22 nt, Human
uuuauauguauugacuuugaug

SEQ ID NO: 59364 - RNA, 23 nt, Human
uuuauauuccuaaugucuugagc

SEQ ID NO: 59365 - RNA, 22 nt, Human
uuuaucaguagcaaaguuuuaa

SEQ ID NO: 59366 - RNA, 22 nt, Human
uuuaucaucuuguuuuuaaagc

SEQ ID NO: 59367 - RNA, 22 nt, Human
uuuauccaagcacaauuucuaa

SEQ ID NO: 59368 - RNA, 22 nt, Human
uuuauccaaggguuuuaacugu

SEQ ID NO: 59369 - RNA, 22 nt, Human
uuuauccaccagggacuaggac

SEQ ID NO: 59370 - RNA, 22 nt, Human
uuuauccaguguuggaauuuuu

SEQ ID NO: 59371 - RNA, 22 nt, Human
uuuauccauucaccaguugaac

SEQ ID NO: 59372 - RNA, 22 nt, Human
uuuaucugagcugauagauagu

SEQ ID NO: 59373 - RNA, 22 nt, Human
uuuaucugcuaucugcugugcu

SEQ ID NO: 59374 - RNA, 22 nt, Human
uuuaucuggacugugauauaaa

SEQ ID NO: 59375 - RNA, 22 nt, Human
uuuaucuguuguacauuuaugc

SEQ ID NO: 59376 - RNA, 22 nt, Human
uuuaucuuuaggacuuugcaga

SEQ ID NO: 59377 - RNA, 22 nt, Human
uuuaugagcaccuuggcccaga

SEQ ID NO: 59378 - RNA, 22 nt, Human
uuuaugauuauuuuaaagcagc

SEQ ID NO: 59379 - RNA, 23 nt, Human
uuuaugcugugauucacccagcc

SEQ ID NO: 59380 - RNA, 22 nt, Human
uuuauggcacacaaauaucaaa

SEQ ID NO: 59381 - RNA, 21 nt, Human
uuuauguacuucauagaguag

SEQ ID NO: 59382 - RNA, 22 nt, Human
uuuauguaguuacggacuauca

SEQ ID NO: 59383 - RNA, 22 nt, Human
uuuaugucacuuugaaagagag

SEQ ID NO: 59384 - RNA, 22 nt, Human
uuuaugucccuucaaauguuua

SEQ ID NO: 59385 - RNA, 22 nt, Human
uuuauguuugacaaugaucugg

SEQ ID NO: 59386 - RNA, 22 nt, Human
uuuauguuugcauuuucaaaga

SEQ ID NO: 59387 - RNA, 22 nt, Human
uuuauuaagaugcgaaugcuga

SEQ ID NO: 59388 - RNA, 22 nt, Human
uuuauuaauguagcauccaugg

SEQ ID NO: 59389 - RNA, 22 nt, Human
uuuauuauccaguguugucaug

SEQ ID NO: 59390 - RNA, 16 nt, Human
uucucugggguugugc

SEQ ID NO: 59391 - RNA, 22 nt, Human
uucucuguaguugccuggugga

SEQ ID NO: 59392 - RNA, 22 nt, Human
uucucugugagggugcuggauu

SEQ ID NO: 59393 - RNA, 22 nt, Human
uucucuuacauuuucucagccu

SEQ ID NO: 59394 - RNA, 22 nt, Human
uucucuuaucuggcauuauugg

SEQ ID NO: 59395 - RNA, 22 nt, Human
uucucuuauucuggauaugcag

SEQ ID NO: 59396 - RNA, 22 nt, Human
uucucuucaucucaguaaaugu

SEQ ID NO: 59397 - RNA, 22 nt, Human
uucucuuccagccgggcuugca

SEQ ID NO: 59398 - RNA, 22 nt, Human
uucucuugagcuggucauguuu

SEQ ID NO: 59399 - RNA, 22 nt, Human
uucucuuugacauuauucaggu

SEQ ID NO: 59400 - RNA, 20 nt, Human
uucucuuuggguccagagaa

SEQ ID NO: 59401 - RNA, 22 nt, Human
uucucuuuuagaggcuccauga

SEQ ID NO: 59402 - RNA, 22 nt, Human
uucucuuuuugcaucucaaccu

SEQ ID NO: 59403 - RNA, 23 nt, Human
uucugaaaauagauaguggcucc

SEQ ID NO: 59404 - RNA, 22 nt, Human
uucugaaaggcagguuguuugc

SEQ ID NO: 59405 - RNA, 22 nt, Human
uugcaaggugauaaaagaauga

SEQ ID NO: 59406 - RNA, 20 nt, Human
uugcaauaaaugaaagacca

SEQ ID NO: 59407 - RNA, 22 nt, Human
uugcaauagccuuauuuccaaa

SEQ ID NO: 59408 - RNA, 21 nt, Human
uugcaaugggcauuuuggagg

SEQ ID NO: 59409 - RNA, 21 nt, Human
uugcacagaaaaccauagaga

SEQ ID NO: 59410 - RNA, 22 nt, Human
uugcacaucuaauaaugcuaga

SEQ ID NO: 59411 - RNA, 22 nt, Human
uugcacaugauagaugauuucu

SEQ ID NO: 59412 - RNA, 22 nt, Human
uugcacauuuccuagaauuuca

SEQ ID NO: 59413 - RNA, 22 nt, Human
uugcacgcuugcgguuccugcc

SEQ ID NO: 59414 - RNA, 22 nt, Human
uugcacuaggaaaaggcagcca

SEQ ID NO: 59415 - RNA, 22 nt, Human
uugcacuagucucagaggcaaa

SEQ ID NO: 59416 - RNA, 22 nt, Human
uugcacuauaggaaaauguguc

SEQ ID NO: 59417 - RNA, 23 nt, Human
uugcacugaucaauuugauaagc

SEQ ID NO: 59418 - RNA, 22 nt, Human
uugcacuguaagcaucuguguc

SEQ ID NO: 59419 - RNA, 17 nt, Human
uugcagacuuuuuauua

SEQ ID NO: 59420 - RNA, 22 nt, Human
uugcagauauuuccgaugcuau

SEQ ID NO: 59421 - RNA, 22 nt, Human
uugcagauuaaaacacugagcu

SEQ ID NO: 59422 - RNA, 20 nt, Human
uugcagcagugaggugaagg

SEQ ID NO: 59423 - RNA, 22 nt, Human
uugcagcauauugaucuccugu

SEQ ID NO: 59424 - RNA, 22 nt, Human
uugcagcaugcauagacacugc

SEQ ID NO: 59425 - RNA, 22 nt, Human
uugcagcugaggaaauugaagc

SEQ ID NO: 59426 - RNA, 22 nt, Human
uugcagcuucaagcagguugac

SEQ ID NO: 59427 - RNA, 22 nt, Human
uugcagggaaauagaaauaaac

SEQ ID NO: 59428 - RNA, 22 nt, Human
uugcagggaaaucagugaggau

SEQ ID NO: 59429 - RNA, 22 nt, Human
uugcagggcaucgcguacuucu

SEQ ID NO: 59430 - RNA, 22 nt, Human
uugcagggccuuggcuucuucc

SEQ ID NO: 59431 - RNA, 22 nt, Human
uugcagggucccagaggccugg

SEQ ID NO: 59432 - RNA, 22 nt, Human
uugcaggguuaaaguaagguag

SEQ ID NO: 59433 - RNA, 22 nt, Human
uugcaggguugacacugccugc

SEQ ID NO: 59434 - RNA, 19 nt, Human
uugcaguuggguggggagu

SEQ ID NO: 59435 - RNA, 22 nt, Human
uugcaguuuguggcaacuuuga

SEQ ID NO: 59436 - RNA, 22 nt, Human
uugcaguuuugacagaccaaau

SEQ ID NO: 59437 - RNA, 22 nt, Human
uugcauaauagcuacccacuca

SEQ ID NO: 59438 - RNA, 22 nt, Human
uugcauauauuucuaaggaggu

SEQ ID NO: 59439 - RNA, 22 nt, Human
uugcaucagguagacaacuaua

SEQ ID NO: 59440 - RNA, 22 nt, Human
uugcaugcaccuaacaaauuau

SEQ ID NO: 59441 - RNA, 22 nt, Human
uugcauguagaauacucaacuu

SEQ ID NO: 59442 - RNA, 22 nt, Human
uugcaugugugcauauauuugc

SEQ ID NO: 59443 - RNA, 22 nt, Human
uugcauguuauuuaaucuguau

SEQ ID NO: 59444 - RNA, 22 nt, Human
uugcauguuguuuaauuucgag

SEQ ID NO: 59445 - RNA, 23 nt, Human
uugcauuaauguggaggcacagg

SEQ ID NO: 59446 - RNA, 22 nt, Human
uugcauuccaguccccacugug

SEQ ID NO: 59447 - RNA, 22 nt, Human
uugcauuuacugcaccgugagu

SEQ ID NO: 59448 - RNA, 22 nt, Human
uugcauuuccuguacuguuuga

SEQ ID NO: 59449 - RNA, 22 nt, Human
uugcauuugacaaauuauuuaa

SEQ ID NO: 59450 - RNA, 22 nt, Human
uugccaggagcucaucugaggg

SEQ ID NO: 59451 - RNA, 22 nt, Human
uugccagggaacagggagaggc

SEQ ID NO: 59452 - RNA, 22 nt, Human
uugccagggccagugggggugu

SEQ ID NO: 59453 - RNA, 22 nt, Human
uugccagggcuuugguggcauc

SEQ ID NO: 59454 - RNA, 22 nt, Human
uugccagugccagcccaggcag

SEQ ID NO: 59455 - RNA, 22 nt, Human
uugccaugcagccaggaaggag

SEQ ID NO: 59456 - RNA, 22 nt, Human
uugccauguugccaaggcuggu

SEQ ID NO: 59457 - RNA, 22 nt, Human
uugccauuccaggguauuaggg

SEQ ID NO: 59458 - RNA, 22 nt, Human
uugcccaccuuagucuucagac

SEQ ID NO: 59459 - RNA, 22 nt, Human
uugcccacucuguuucccaaga

SEQ ID NO: 59460 - RNA, 16 nt, Human
uugcccacuuguucau

SEQ ID NO: 59461 - RNA, 18 nt, Human
uugccccugggugaggau

SEQ ID NO: 59462 - RNA, 17 nt, Human
uugcccugauuuuuaac

SEQ ID NO: 59463 - RNA, 22 nt, Human
uugcccuuguggaguuuacaug

SEQ ID NO: 59464 - RNA, 16 nt, Human
uugccgcacaggucgc

SEQ ID NO: 59465 - RNA, 22 nt, Human
uugccguccuuacuccagcgga

SEQ ID NO: 59466 - RNA, 22 nt, Human
uugccucccagcaugggcagcu

SEQ ID NO: 59467 - RNA, 22 nt, Human
uugccugcuacggucuucacug

SEQ ID NO: 59468 - RNA, 22 nt, Human
uugccuggagggacauggagac

SEQ ID NO: 59469 - RNA, 22 nt, Human
uugccuggauucuaccacagaa

SEQ ID NO: 59470 - RNA, 22 nt, Human
uugccuggcuuguagauggggg

SEQ ID NO: 59471 - RNA, 22 nt, Human
uugccugggcuaguaagccaga

SEQ ID NO: 59472 - RNA, 22 nt, Human
uugccugugaacgcugaguccu

SEQ ID NO: 59473 - RNA, 22 nt, Human
uugccuuacugcauucaguaaa

SEQ ID NO: 59474 - RNA, 22 nt, Human
uugccuugauucuucucaugug

SEQ ID NO: 59475 - RNA, 22 nt, Human
uugccuuuaaguauaacugcug

SEQ ID NO: 59476 - RNA, 22 nt, Human
uugcuaaauuuauuuucgaaca

SEQ ID NO: 59477 - RNA, 22 nt, Human
uugcuaaugcccuagaaguauu

SEQ ID NO: 59478 - RNA, 20 nt, Human
uugcuagcuuuugugucacu

SEQ ID NO: 59479 - RNA, 22 nt, Human
uugcuauuuccugaaauaagca

SEQ ID NO: 59480 - RNA, 22 nt, Human
uugcucaguggcagggcuggua

SEQ ID NO: 59481 - RNA, 22 nt, Human
uugcucuaguggccccugaaug

SEQ ID NO: 59482 - RNA, 22 nt, Human
uugcucuguaauaaucuggggu

SEQ ID NO: 59483 - RNA, 22 nt, Human
uugcucugucagggccucaguc

SEQ ID NO: 59484 - RNA, 22 nt, Human
uugcugaaaacaguggguauug

SEQ ID NO: 59485 - RNA, 22 nt, Human
uugcugaagaaaaaauauguua

SEQ ID NO: 59486 - RNA, 22 nt, Human
uugcugaaguugcucagcucca

SEQ ID NO: 59487 - RNA, 23 nt, Human
uugcugagauaaagaaugcaggg

SEQ ID NO: 59488 - RNA, 22 nt, Human
uugcugagcuuuggcaaggaag

SEQ ID NO: 59489 - RNA, 22 nt, Human
uugcugaucugaaacguuacug

SEQ ID NO: 59490 - RNA, 22 nt, Human
uugcugccuuccgaauccucuc

SEQ ID NO: 59491 - RNA, 22 nt, Human
uugcugccuuuguacucugaug

SEQ ID NO: 59492 - RNA, 22 nt, Human
uugcugcucccaagaggcagcu

SEQ ID NO: 59493 - RNA, 22 nt, Human
uugcugcuuucauuuauacagu

SEQ ID NO: 59494 - RNA, 22 nt, Human
uugcuggaguagaaaacuuaac

SEQ ID NO: 59495 - RNA, 22 nt, Human
uugcugggcaugucuuaauucu

SEQ ID NO: 59496 - RNA, 22 nt, Human
uugcuguaguguucugauguca

SEQ ID NO: 59497 - RNA, 22 nt, Human
uugcuguuucucugugucuggu

SEQ ID NO: 59498 - RNA, 22 nt, Human
uugcuguuuuacaucugguggg

SEQ ID NO: 59499 - RNA, 22 nt, Human
uuuaggcauugaauuagaauag

SEQ ID NO: 59500 - RNA, 22 nt, Human
uuuaggccagauuuauuugaca

SEQ ID NO: 59501 - RNA, 22 nt, Human
uuuaggcucaaaagaguuggug

SEQ ID NO: 59502 - RNA, 22 nt, Human
uuuagggaauagaagaucugaa

SEQ ID NO: 59503 - RNA, 22 nt, Human
uuuagucuagucuccucagaaa

SEQ ID NO: 59504 - RNA, 22 nt, Human
uuuagugauaagaauuaugaaa

SEQ ID NO: 59505 - RNA, 22 nt, Human
uuuagugccugggccaguucca

SEQ ID NO: 59506 - RNA, 22 nt, Human
uuuauaaacaguaccacggugc

SEQ ID NO: 59507 - RNA, 22 nt, Human
uuuauaaguacuuugucugcuu

SEQ ID NO: 59508 - RNA, 22 nt, Human
uuuauaauuaucucuacucuua

SEQ ID NO: 59509 - RNA, 17 nt, Human
uuuauaauuggccucuu

SEQ ID NO: 59510 - RNA, 22 nt, Human
uuuauacuccacucugcaagcg

SEQ ID NO: 59511 - RNA, 22 nt, Human
uuuauagggacaguucuuggag

SEQ ID NO: 59512 - RNA, 22 nt, Human
uuuauaguagcaugauuuauag

SEQ ID NO: 59513 - RNA, 22 nt, Human
uuuauaguuauauacagauguu

SEQ ID NO: 59514 - RNA, 22 nt, Human
uuuauauccaucuuugaaguaa

SEQ ID NO: 59515 - RNA, 22 nt, Human
uuuauaugugaagguuugcaga

SEQ ID NO: 59516 - RNA, 22 nt, Human
uuuauauguuuguacaauuaag

SEQ ID NO: 59517 - RNA, 22 nt, Human
uuuauauuguaaaaaugguucu

SEQ ID NO: 59518 - RNA, 22 nt, Human
uuuaucacagaauaagaaguca

SEQ ID NO: 59519 - RNA, 22 nt, Human
uuuaucagaaguuagagaaaga

SEQ ID NO: 59520 - RNA, 22 nt, Human
uuuaucagaggcuauguuucau

SEQ ID NO: 59521 - RNA, 21 nt, Human
uuuaucaucacgagcuugagc

SEQ ID NO: 59522 - RNA, 22 nt, Human
uuuauccaccuuacccuguucc

SEQ ID NO: 59523 - RNA, 22 nt, Human
uuuauccagcagcuauucaaaa

SEQ ID NO: 59524 - RNA, 22 nt, Human
uuuauccauugguuagaaaauc

SEQ ID NO: 59525 - RNA, 22 nt, Human
uuuaugacauuacaauaucaag

SEQ ID NO: 59526 - RNA, 22 nt, Human
uuuaugagcaaugcugagggga

SEQ ID NO: 59527 - RNA, 22 nt, Human
uuuaugagccucaaaucugagu

SEQ ID NO: 59528 - RNA, 22 nt, Human
uuuaugauuaauccaauucugu

SEQ ID NO: 59529 - RNA, 22 nt, Human
uuuaugcagauuuguacaguga

SEQ ID NO: 59530 - RNA, 22 nt, Human
uuuaugcagcacuuuacauuug

SEQ ID NO: 59531 - RNA, 22 nt, Human
uuuaugcagcguuucaccaccc

SEQ ID NO: 59532 - RNA, 22 nt, Human
uuuaugcaucucuaggaagggc

SEQ ID NO: 59533 - RNA, 22 nt, Human
uuuaugcuacucaauagucagu

SEQ ID NO: 59534 - RNA, 22 nt, Human
uuuaugcucauccaaggaaggu

SEQ ID NO: 59535 - RNA, 22 nt, Human
uuuaugucaaaacuacaguugg

SEQ ID NO: 59536 - RNA, 22 nt, Human
uuuauuagugcuuguaucacug

SEQ ID NO: 59537 - RNA, 20 nt, Human
uuuauucacagagaagaguu

SEQ ID NO: 59538 - RNA, 22 nt, Human
uuggaaaugcauuuguuauuau

SEQ ID NO: 59539 - RNA, 22 nt, Human
uuggaaauguagaaaagcagau

SEQ ID NO: 59540 - RNA, 22 nt, Human
uuggaaauugcaagugauuugc

SEQ ID NO: 59541 - RNA, 22 nt, Human
uuggaacaaucacauccuugcu

SEQ ID NO: 59542 - RNA, 22 nt, Human
uuggaacaggauucaauuaaag

SEQ ID NO: 59543 - RNA, 22 nt, Human
uuggaacauccaggacagauau

SEQ ID NO: 59544 - RNA, 22 nt, Human
uuggaacuggauuucauguagc

SEQ ID NO: 59545 - RNA, 22 nt, Human
uuggaagacagccgucuuuauu

SEQ ID NO: 59546 - RNA, 22 nt, Human
uuggaagacagugaaacagcac

SEQ ID NO: 59547 - RNA, 22 nt, Human
uuggaagagagccacaguuaau

SEQ ID NO: 59548 - RNA, 22 nt, Human
uuggaagaguagaguugaauaa

SEQ ID NO: 59549 - RNA, 22 nt, Human
uuggaagauuacuuaguuuucu

SEQ ID NO: 59550 - RNA, 22 nt, Human
uuggaagauucugugucuggug

SEQ ID NO: 59551 - RNA, 22 nt, Human
uuggaagcaguguacacuguac

SEQ ID NO: 59552 - RNA, 22 nt, Human
uuggaagcauucugaaugucca

SEQ ID NO: 59553 - RNA, 22 nt, Human
uuggaagcccugugauaggcca

SEQ ID NO: 59554 - RNA, 19 nt, Human
uuggaaggagccagagugg

SEQ ID NO: 59555 - RNA, 22 nt, Human
uuggaaggagucaaccagcuga

SEQ ID NO: 59556 - RNA, 22 nt, Human
uuggaaggcagcauuuguccau

SEQ ID NO: 59557 - RNA, 22 nt, Human
uuggaaguaaugaagagguggg

SEQ ID NO: 59558 - RNA, 22 nt, Human
uuggaaguucuuagccuuuuca

SEQ ID NO: 59559 - RNA, 22 nt, Human
uuggaauaucaugcagaauaaa

SEQ ID NO: 59560 - RNA, 22 nt, Human
uuggaauuccuguuguuucguc

SEQ ID NO: 59561 - RNA, 22 nt, Human
uuggaauugcuauugauaacaa

SEQ ID NO: 59562 - RNA, 22 nt, Human
uuggacagaauuuugugugugu

SEQ ID NO: 59563 - RNA, 22 nt, Human
uuggaccaguggauuauggugg

SEQ ID NO: 59564 - RNA, 22 nt, Human
uuggaccucaguuauucuauca

SEQ ID NO: 59565 - RNA, 22 nt, Human
uuggacuuaacaaagggugaug

SEQ ID NO: 59566 - RNA, 21 nt, Human
uuggacuuuugcgugauugag

SEQ ID NO: 59567 - RNA, 22 nt, Human
uuggagaggcagucuugcucug

SEQ ID NO: 59568 - RNA, 22 nt, Human
uuggagaguuaauugacaguua

SEQ ID NO: 59569 - RNA, 22 nt, Human
uuggagauaugugaaaaaaaca

SEQ ID NO: 59570 - RNA, 22 nt, Human
uuggaggaugcaaugagggagu

SEQ ID NO: 59571 - RNA, 22 nt, Human
uuggaggaugucggcauauuua

SEQ ID NO: 59572 - RNA, 22 nt, Human
uuggagggacugagcuucaguc

SEQ ID NO: 59573 - RNA, 20 nt, Human
uuggaggugcagugcaugca

SEQ ID NO: 59574 - RNA, 22 nt, Human
uuggagguuucccaacuguggg

SEQ ID NO: 59575 - RNA, 22 nt, Human
uuggagguuugaaaauaugugu

SEQ ID NO: 59576 - RNA, 22 nt, Human
uuggagucacaggagaagaaug

SEQ ID NO: 59577 - RNA, 22 nt, Human
uuggaucaaauuucaugcuguc

SEQ ID NO: 59578 - RNA, 22 nt, Human
uuggauguuugaaaucacguac

SEQ ID NO: 59579 - RNA, 22 nt, Human
uuggauucacuguugguagagu

SEQ ID NO: 59580 - RNA, 22 nt, Human
uuggauucuguuaggcaccuuc

SEQ ID NO: 59581 - RNA, 22 nt, Human
uuggcaaaauuuaaagaaguga

SEQ ID NO: 59582 - RNA, 22 nt, Human
uuggcaaaggacucaaagcagg

SEQ ID NO: 59583 - RNA, 22 nt, Human
uuggcaacacauggaaaaauuu

SEQ ID NO: 59584 - RNA, 22 nt, Human
uuggcaauauuuacugaaguug

SEQ ID NO: 59585 - RNA, 22 nt, Human
uuggcaaugaucucaaucuucu

SEQ ID NO: 59586 - RNA, 22 nt, Human
uuggcaauggaccagccacugg

SEQ ID NO: 59587 - RNA, 22 nt, Human
uuggcaaugucuaaacacauuu

SEQ ID NO: 59588 - RNA, 22 nt, Human
uuggcaauuaguuauaucugca

SEQ ID NO: 59589 - RNA, 22 nt, Human
uuggcacacaguaagcccuaag

SEQ ID NO: 59590 - RNA, 22 nt, Human
uuggcacagagcugcagccugg

SEQ ID NO: 59591 - RNA, 22 nt, Human
uuggcacugaccaaagaagucc

SEQ ID NO: 59592 - RNA, 22 nt, Human
uuggcagaaugggcagcuugag

SEQ ID NO: 59593 - RNA, 22 nt, Human
uuggcagaggccgaggugaaga

SEQ ID NO: 59594 - RNA, 22 nt, Human
uuggcagaugaacacaacugga

SEQ ID NO: 59595 - RNA, 22 nt, Human
uuggcagauuugucaguaagcu

SEQ ID NO: 59596 - RNA, 22 nt, Human
uuggcagcagggaguuggccgc

SEQ ID NO: 59597 - RNA, 23 nt, Human
uuggcagcgggucaggcuguggg

SEQ ID NO: 59598 - RNA, 22 nt, Human
uuggcagcuacuuccccagugc

SEQ ID NO: 59599 - RNA, 19 nt, Human
uuggcagcugagauccugc

SEQ ID NO: 59600 - RNA, 22 nt, Human
uuggcaggaauauugcagaggu

SEQ ID NO: 59601 - RNA, 22 nt, Human
uuggcagggcaucagacacgug

SEQ ID NO: 59602 - RNA, 22 nt, Human
uuggcaguccaggauuaauaua

SEQ ID NO: 59603 - RNA, 22 nt, Human
uuggcagucucagucagauggc

SEQ ID NO: 59604 - RNA, 22 nt, Human
uuggcagugucugcaaaaugga

SEQ ID NO: 59605 - RNA, 22 nt, Human
uuggcauaaaacucuucaaaau

SEQ ID NO: 59606 - RNA, 22 nt, Human
uuggcaucaguguaggaccugu

SEQ ID NO: 59607 - RNA, 22 nt, Human
uuggccaaacagaguucaacag

SEQ ID NO: 59608 - RNA, 22 nt, Human
uuguacacaauucuuaacauac

SEQ ID NO: 59609 - RNA, 22 nt, Human
uuguacagggaaguaauacaag

SEQ ID NO: 59610 - RNA, 22 nt, Human
uuguacaguuuaagugggugaa

SEQ ID NO: 59611 - RNA, 22 nt, Human
uuguacauucuauggguuugga

SEQ ID NO: 59612 - RNA, 22 nt, Human
uuguaccagcucauuucagaac

SEQ ID NO: 59613 - RNA, 22 nt, Human
uuguacuuacauuuuaaagcua

SEQ ID NO: 59614 - RNA, 22 nt, Human
uuguacuuuggggaaauguuga

SEQ ID NO: 59615 - RNA, 22 nt, Human
uuguagaaaauuagaugcaugg

SEQ ID NO: 59616 - RNA, 22 nt, Human
uuguagaaucauuauuucuagu

SEQ ID NO: 59617 - RNA, 22 nt, Human
uuguagcugaaaguaaagaagu

SEQ ID NO: 59618 - RNA, 22 nt, Human
uuguagcuuaucaaggcuguuu

SEQ ID NO: 59619 - RNA, 22 nt, Human
uuguagcuuuuuaaugugcugc

SEQ ID NO: 59620 - RNA, 22 nt, Human
uuguauauaaagcccccacugu

SEQ ID NO: 59621 - RNA, 22 nt, Human
uuguaugaggauagcaagaagc

SEQ ID NO: 59622 - RNA, 22 nt, Human
uuguaugaucccauuuagugaa

SEQ ID NO: 59623 - RNA, 22 nt, Human
uuguauggauuugugggugagu

SEQ ID NO: 59624 - RNA, 22 nt, Human
uuguauuaggcccuagggaguu

SEQ ID NO: 59625 - RNA, 22 nt, Human
uuguauuaguaagucagcugcu

SEQ ID NO: 59626 - RNA, 22 nt, Human
uuguauucauugcuuacccaau

SEQ ID NO: 59627 - RNA, 22 nt, Human
uuguauucuuuaugacuucccu

SEQ ID NO: 59628 - RNA, 22 nt, Human
uuguauuucuuccggucucauu

SEQ ID NO: 59629 - RNA, 22 nt, Human
uuguauuugauugucauaucgu

SEQ ID NO: 59630 - RNA, 22 nt, Human
uugucaaguaaggcugacauuu

SEQ ID NO: 59631 - RNA, 22 nt, Human
uugucagccagcucgcacucuu

SEQ ID NO: 59632 - RNA, 22 nt, Human
uugucaucaagaugcauugguc

SEQ ID NO: 59633 - RNA, 22 nt, Human
uugucaucauccucuuuggggu

SEQ ID NO: 59634 - RNA, 22 nt, Human
uugucaugauccuucuguuagg

SEQ ID NO: 59635 - RNA, 22 nt, Human
uuguccaaaguaacacaucuag

SEQ ID NO: 59636 - RNA, 19 nt, Human
uuguccagaaaggcauugc

SEQ ID NO: 59637 - RNA, 23 nt, Human
uuguccagcugguuugggccaca

SEQ ID NO: 59638 - RNA, 22 nt, Human
uuguccauugugacaagugugg

SEQ ID NO: 59639 - RNA, 22 nt, Human
uuguccauuuuauuggauggug

SEQ ID NO: 59640 - RNA, 22 nt, Human
uugucccugccccugcuugcuu

SEQ ID NO: 59641 - RNA, 23 nt, Human
uuguccugccgaucucugagaau

SEQ ID NO: 59642 - RNA, 22 nt, Human
uuguccuggcccaaaugucaac

SEQ ID NO: 59643 - RNA, 22 nt, Human
uuguccuuaccucaaucuggaa

SEQ ID NO: 59644 - RNA, 22 nt, Human
uuguccuuggcucuagagguga

SEQ ID NO: 59645 - RNA, 22 nt, Human
uugucuauuuguucagguaagg

SEQ ID NO: 59646 - RNA, 22 nt, Human
uugucucuacagagaguaguag

SEQ ID NO: 59647 - RNA, 22 nt, Human
uugucucuguguggcuucccua

SEQ ID NO: 59648 - RNA, 22 nt, Human
uugucugagagauggcagaggu

SEQ ID NO: 59649 - RNA, 22 nt, Human
uugucugaggguuugagagaau

SEQ ID NO: 59650 - RNA, 22 nt, Human
uugucugcaugauucuaggcag

SEQ ID NO: 59651 - RNA, 22 nt, Human
uugucugcuugaugccaagcau

SEQ ID NO: 59652 - RNA, 22 nt, Human
uugucugcuuguucagauggaa

SEQ ID NO: 59653 - RNA, 22 nt, Human
uuuauucacuucagugccaaag

SEQ ID NO: 59654 - RNA, 22 nt, Human
uuuauucagcagcagcaguggu

SEQ ID NO: 59655 - RNA, 20 nt, Human
uuuauucagccuacccucuu

SEQ ID NO: 59656 - RNA, 22 nt, Human
uuuauucauuguuucgucgcag

SEQ ID NO: 59657 - RNA, 22 nt, Human
uuuauucuagcucagaauaguu

SEQ ID NO: 59658 - RNA, 22 nt, Human
uuuauucugugcuacaugaaga

SEQ ID NO: 59659 - RNA, 22 nt, Human
uuuauugaacacuugcacuggc

SEQ ID NO: 59660 - RNA, 22 nt, Human
uuuauugagcacccguugugcg

SEQ ID NO: 59661 - RNA, 22 nt, Human
uuuauugaguaucuacuaugug

SEQ ID NO: 59662 - RNA, 22 nt, Human
uuuauugcccuguaguacagga

SEQ ID NO: 59663 - RNA, 22 nt, Human
uuuauugcuagcccuuggucca

SEQ ID NO: 59664 - RNA, 22 nt, Human
uuuauugcugagaaggauucca

SEQ ID NO: 59665 - RNA, 22 nt, Human
uuuauuggaacacagccaugac

SEQ ID NO: 59666 - RNA, 22 nt, Human
uuuauuggauauuuacaagaua

SEQ ID NO: 59667 - RNA, 22 nt, Human
uuuauugucuucguggugccua

SEQ ID NO: 59668 - RNA, 22 nt, Human
uuuauuuaccuuauguccucca

SEQ ID NO: 59669 - RNA, 16 nt, Human
uuuauuuacuaguguu

SEQ ID NO: 59670 - RNA, 22 nt, Human
uuuauuuauaagccacuugcug

SEQ ID NO: 59671 - RNA, 23 nt, Human
uuuauuuauuuaggcugagggau

SEQ ID NO: 59672 - RNA, 22 nt, Human
uuuauuugaaucaggggagaau

SEQ ID NO: 59673 - RNA, 22 nt, Human
uuucaaaccuacuuguauguuu

SEQ ID NO: 59674 - RNA, 20 nt, Human
uuucaaacugcaccuuugcu

SEQ ID NO: 59675 - RNA, 22 nt, Human
uuucaaacugcccagcacaccu

SEQ ID NO: 59676 - RNA, 22 nt, Human
uuucaaacuguacuuuccccua

SEQ ID NO: 59677 - RNA, 17 nt, Human
uuucaaagcagucagga

SEQ ID NO: 59678 - RNA, 22 nt, Human
uuucaaagggaaguuaugaagu

SEQ ID NO: 59679 - RNA, 19 nt, Human
uuucaaagggcauaagccu

SEQ ID NO: 59680 - RNA, 22 nt, Human
uuucaaagguggaagagugaau

SEQ ID NO: 59681 - RNA, 22 nt, Human
uuucaaauggaucccucagccu

SEQ ID NO: 59682 - RNA, 22 nt, Human
uuucaacagaauaugaucagag

SEQ ID NO: 59683 - RNA, 22 nt, Human
uuucaacagcucucaaaugauc

SEQ ID NO: 59684 - RNA, 22 nt, Human
uuucaacaggaugauaauaggc

SEQ ID NO: 59685 - RNA, 22 nt, Human
uuucaacauauaccauaaugcc

SEQ ID NO: 59686 - RNA, 21 nt, Human
uuucaagggacccuggggauc

SEQ ID NO: 59687 - RNA, 22 nt, Human
uuucaaguagagggaucgcuag

SEQ ID NO: 59688 - RNA, 20 nt, Human
uuucaagucagcaauucuca

SEQ ID NO: 59689 - RNA, 22 nt, Human
uuucaaguggggacauuugaga

SEQ ID NO: 59690 - RNA, 22 nt, Human
uuucaaguuaaauggggucuuu

SEQ ID NO: 59691 - RNA, 22 nt, Human
uuucaaguucccaguuuugugg

SEQ ID NO: 59692 - RNA, 22 nt, Human
uuucaaugacacaaaagagaaa

SEQ ID NO: 59693 - RNA, 22 nt, Human
uuucaauguaugucuuucugag

SEQ ID NO: 59694 - RNA, 22 nt, Human
uuucaauuaggauguuuccaug

SEQ ID NO: 59695 - RNA, 22 nt, Human
uuucaauugacuuuggaagaaa

SEQ ID NO: 59696 - RNA, 22 nt, Human
uuucaauuuccaggcuagaauu

SEQ ID NO: 59697 - RNA, 22 nt, Human
uuucacaaacucagggugugug

SEQ ID NO: 59698 - RNA, 22 nt, Human
uuucacaacacaaucucguuaa

SEQ ID NO: 59699 - RNA, 18 nt, Human
uuucacaaccuccagagg

SEQ ID NO: 59700 - RNA, 22 nt, Human
uuucacaaguuucaggauucug

SEQ ID NO: 59701 - RNA, 20 nt, Human
uuucacaaugaacaugucuc

SEQ ID NO: 59702 - RNA, 22 nt, Human
uuucacaaugcaauccuacuuc

SEQ ID NO: 59703 - RNA, 22 nt, Human
uuucacaauuuuaaggagcaaa

SEQ ID NO: 59704 - RNA, 22 nt, Human
uuucacacugcagcaucagaga

SEQ ID NO: 59705 - RNA, 22 nt, Human
uuucacagagaauauugccuug

SEQ ID NO: 59706 - RNA, 22 nt, Human
uuucacagcagaauuucugagg

SEQ ID NO: 59707 - RNA, 22 nt, Human
uuucacagcagugugcugcuuu

SEQ ID NO: 59708 - RNA, 22 nt, Human
uuucacagcugucuuccgucuc

SEQ ID NO: 59709 - RNA, 22 nt, Human
uuucacagcuuccacuuaagga

SEQ ID NO: 59710 - RNA, 22 nt, Human
uuucacaggaauacccggcuuu

SEQ ID NO: 59711 - RNA, 22 nt, Human
uuucacagguaagcaauacagg

SEQ ID NO: 59712 - RNA, 22 nt, Human
uuucacaguagaaaucauuaug

SEQ ID NO: 59713 - RNA, 20 nt, Human
uuucacagucccuguuuccu

SEQ ID NO: 59714 - RNA, 22 nt, Human
uuucacagugcucuguaaguau

SEQ ID NO: 59715 - RNA, 22 nt, Human
uuucacaguuagcaugaggacu

SEQ ID NO: 59716 - RNA, 22 nt, Human
uuucacauaaauggaguaaaga

SEQ ID NO: 59717 - RNA, 22 nt, Human
uuuagcuauggauaacaaccac

SEQ ID NO: 59718 - RNA, 22 nt, Human
uuuagcuuaaauggagaaagag

SEQ ID NO: 59719 - RNA, 22 nt, Human
uuuagcuugaaucuuguuuaaa

SEQ ID NO: 59720 - RNA, 22 nt, Human
uuuaggaagaguugaguaaauu

SEQ ID NO: 59721 - RNA, 22 nt, Human
uuuaggaaguuucagauaggaa

SEQ ID NO: 59722 - RNA, 18 nt, Human
uuuaggaauuccaagaga

SEQ ID NO: 59723 - RNA, 22 nt, Human
uuuaggauaacuccaguuuucc

SEQ ID NO: 59724 - RNA, 22 nt, Human
uuuaggaugcucuauucugacu

SEQ ID NO: 59725 - RNA, 22 nt, Human
uuuaggcaagggcaagauuauc

SEQ ID NO: 59726 - RNA, 22 nt, Human
uuuaggcacagaguugagggac

SEQ ID NO: 59727 - RNA, 22 nt, Human
uuuaggcagcagugaggaugaa

SEQ ID NO: 59728 - RNA, 22 nt, Human
uuuaggcagcuacauacuaacu

SEQ ID NO: 59729 - RNA, 22 nt, Human
uuuaggcagucauugaacaagu

SEQ ID NO: 59730 - RNA, 22 nt, Human
uuuaggcauugggugcucaagu

SEQ ID NO: 59731 - RNA, 22 nt, Human
uuuagggacaagggucuggggu

SEQ ID NO: 59732 - RNA, 21 nt, Human
uuuagggaccaggucauaggc

SEQ ID NO: 59733 - RNA, 22 nt, Human
uuuaggucuucuuaagagucaa

SEQ ID NO: 59734 - RNA, 22 nt, Human
uuuagguuaaucaacaaacauu

SEQ ID NO: 59735 - RNA, 22 nt, Human
uuuagguucuuggaaucagucu

SEQ ID NO: 59736 - RNA, 22 nt, Human
uuuagguuuuuucacguggcua

SEQ ID NO: 59737 - RNA, 22 nt, Human
uuuaguaaguucacugcaaagc

SEQ ID NO: 59738 - RNA, 22 nt, Human
uuuaguacucaggggagaaguu

SEQ ID NO: 59739 - RNA, 22 nt, Human
uuuaguagaugcagcauuauuu

SEQ ID NO: 59740 - RNA, 19 nt, Human
uuuaguaugagcuccaggg

SEQ ID NO: 59741 - RNA, 22 nt, Human
uuuaguauguauuuaauggacu

SEQ ID NO: 59742 - RNA, 22 nt, Human
uuuagugcuuugcuauucaugg

SEQ ID NO: 59743 - RNA, 22 nt, Human
uuuaguguuugcguguacuccu

SEQ ID NO: 59744 - RNA, 22 nt, Human
uuuaguuauugcacagaauuag

SEQ ID NO: 59745 - RNA, 21 nt, Human
uuuaguucaaguacagaacca

SEQ ID NO: 59746 - RNA, 22 nt, Human
uuuauaaaauagacugggucua

SEQ ID NO: 59747 - RNA, 22 nt, Human
uuuauaagaagcaaugucugag

SEQ ID NO: 59748 - RNA, 23 nt, Human
uuuauacaagaaaccgcuggccu

SEQ ID NO: 59749 - RNA, 22 nt, Human
uuuauacuucauaaugucuauu

SEQ ID NO: 59750 - RNA, 22 nt, Human
uuuauagaugucuguauuauaa

SEQ ID NO: 59751 - RNA, 22 nt, Human
uuuauaggguagcuaggauuga

SEQ ID NO: 59752 - RNA, 22 nt, Human
uuuauaguagcaugauuuauaa

SEQ ID NO: 59753 - RNA, 22 nt, Human
uuuauauagagauuugugcaug

SEQ ID NO: 59754 - RNA, 22 nt, Human
uuuauaugaaagugaccagugg

SEQ ID NO: 59755 - RNA, 22 nt, Human
uuuauaugguugacuaugaguu

SEQ ID NO: 59756 - RNA, 22 nt, Human
uuuauauugggagucguuuuga

SEQ ID NO: 59757 - RNA, 20 nt, Human
uuuaucaggcacuuacuauu

SEQ ID NO: 59758 - RNA, 23 nt, Human
uuuauccaacucuguaaucucuc

SEQ ID NO: 59759 - RNA, 22 nt, Human
uuuauccacaguauccaaaauc

SEQ ID NO: 59760 - RNA, 22 nt, Human
uuuauccacucauccaugccuc

SEQ ID NO: 59761 - RNA, 22 nt, Human
uuuauccauaucauuaaaaucu

SEQ ID NO: 59762 - RNA, 22 nt, Human
uuuauccaucaucugcugaagg

SEQ ID NO: 59763 - RNA, 22 nt, Human
uuuaucuauuguauuguugaug

SEQ ID NO: 59764 - RNA, 22 nt, Human
uuuaucugaccucacuucuuaa

SEQ ID NO: 59765 - RNA, 22 nt, Human
uuuaucugauauucagcgauuu

SEQ ID NO: 59766 - RNA, 22 nt, Human
uuuaucuguagagcuucaccua

SEQ ID NO: 59767 - RNA, 22 nt, Human
uuuaucuguauaucucaagugu

SEQ ID NO: 59768 - RNA, 22 nt, Human
uuuaucugugggaguuguuugg

SEQ ID NO: 59769 - RNA, 22 nt, Human
uuuaucuguuguaccugcauug

SEQ ID NO: 59770 - RNA, 22 nt, Human
uuuaugaaccacucuacaccuu

SEQ ID NO: 59771 - RNA, 22 nt, Human
uuucuccucuccagagugcagu

SEQ ID NO: 59772 - RNA, 22 nt, Human
uuucuccugcuagaacaaggag

SEQ ID NO: 59773 - RNA, 22 nt, Human
uuucuccuguguaagccgccca

SEQ ID NO: 59774 - RNA, 22 nt, Human
uuucucuaaauagggaggcuua

SEQ ID NO: 59775 - RNA, 22 nt, Human
uuucucuagcuauucauuaaau

SEQ ID NO: 59776 - RNA, 22 nt, Human
uuucucucagccuguagaaacu

SEQ ID NO: 59777 - RNA, 22 nt, Human
uuucucuccuccaaaccaaaga

SEQ ID NO: 59778 - RNA, 22 nt, Human
uuucucucugacugggagcuga

SEQ ID NO: 59779 - RNA, 16 nt, Human
uuucucucugcuauuu

SEQ ID NO: 59780 - RNA, 22 nt, Human
uuucucugaggcuggccucccu

SEQ ID NO: 59781 - RNA, 22 nt, Human
uuucucugcagagccccaagga

SEQ ID NO: 59782 - RNA, 22 nt, Human
uuucucugcuguguuggcagcu

SEQ ID NO: 59783 - RNA, 22 nt, Human
uuucucugggcuguuggcagcc

SEQ ID NO: 59784 - RNA, 18 nt, Human
uuucucugucgucuucug

SEQ ID NO: 59785 - RNA, 19 nt, Human
uuucucugugcaccuuuuc

SEQ ID NO: 59786 - RNA, 22 nt, Human
uuucucuugcgauaugcuacac

SEQ ID NO: 59787 - RNA, 22 nt, Human
uuucucuuuggaggggcugaau

SEQ ID NO: 59788 - RNA, 22 nt, Human
uuucugaaaacugaaguagugc

SEQ ID NO: 59789 - RNA, 22 nt, Human
uuucugaaacauggucuuugua

SEQ ID NO: 59790 - RNA, 22 nt, Human
uuucugaagggcagcagacucu

SEQ ID NO: 59791 - RNA, 22 nt, Human
uuucugaauuuacucaagguca

SEQ ID NO: 59792 - RNA, 22 nt, Human
uuucugacacaucaguuguaaa

SEQ ID NO: 59793 - RNA, 22 nt, Human
uuucugacagagugcucagagu

SEQ ID NO: 59794 - RNA, 22 nt, Human
uuucugaccugcaacaguuuac

SEQ ID NO: 59795 - RNA, 22 nt, Human
uuucugacuccagagaggaaua

SEQ ID NO: 59796 - RNA, 22 nt, Human
uuucugacugguguauaauagg

SEQ ID NO: 59797 - RNA, 22 nt, Human
uuucugaggaauuaauacagaa

SEQ ID NO: 59798 - RNA, 22 nt, Human
uuucugauauacuguagaaucc

SEQ ID NO: 59799 - RNA, 22 nt, Human
uuucugauauucauuuagaaga

SEQ ID NO: 59800 - RNA, 22 nt, Human
uuucugcaaaaucuaaguuaga

SEQ ID NO: 59801 - RNA, 22 nt, Human
uuucugcaaacuuccacgucuc

SEQ ID NO: 59802 - RNA, 22 nt, Human
uuucugcacauuucuaaaguug

SEQ ID NO: 59803 - RNA, 20 nt, Human
uuucugcagauguuuacaug

SEQ ID NO: 59804 - RNA, 22 nt, Human
uuucugcaugcauuuaauuaaa

SEQ ID NO: 59805 - RNA, 22 nt, Human
uuucugccagguuucuggauga

SEQ ID NO: 59806 - RNA, 22 nt, Human
uuucugcucauccuaguggagc

SEQ ID NO: 59807 - RNA, 22 nt, Human
uuucugcuucucagacccugaa

SEQ ID NO: 59808 - RNA, 22 nt, Human
uuucugcuugagagaauugcug

SEQ ID NO: 59809 - RNA, 22 nt, Human
uuucugcuuucagagugagaca

SEQ ID NO: 59810 - RNA, 22 nt, Human
uuucuggaaacggguucaagcu

SEQ ID NO: 59811 - RNA, 22 nt, Human
uuucuggacagcaagaucaguu

SEQ ID NO: 59812 - RNA, 20 nt, Human
uuucuguaaggcauuaaucu

SEQ ID NO: 59813 - RNA, 22 nt, Human
uuucuguaaguucaggcuuucc

SEQ ID NO: 59814 - RNA, 20 nt, Human
uuucuguagcucaguauuca

SEQ ID NO: 59815 - RNA, 22 nt, Human
uuucuguagggauuucacaguu

SEQ ID NO: 59816 - RNA, 22 nt, Human
uuucuguauuuaaaagaucugg

SEQ ID NO: 59817 - RNA, 22 nt, Human
uuucuguauuuaggacaggugg

SEQ ID NO: 59818 - RNA, 20 nt, Human
uuucugugcccaggucuguu

SEQ ID NO: 59819 - RNA, 22 nt, Human
uuucuguuuagcauaaaguggc

SEQ ID NO: 59820 - RNA, 22 nt, Human
uuucuuaauuugaguuccacua

SEQ ID NO: 59821 - RNA, 21 nt, Human
uuucuuaucuguaaaguggga

SEQ ID NO: 59822 - RNA, 22 nt, Human
uuucuucaauugcuaacaagga

SEQ ID NO: 59823 - RNA, 22 nt, Human
uuucuuccaaaggcacguucuc

SEQ ID NO: 59824 - RNA, 22 nt, Human
uuucuuccuaaauaugauuucc

SEQ ID NO: 59825 - RNA, 22 nt, Human
uuugaugaaccuauauaauuug

SEQ ID NO: 59826 - RNA, 22 nt, Human
uuugaugaguuuaauaacagcc

SEQ ID NO: 59827 - RNA, 22 nt, Human
uuugaugaugaugauaaaguuu

SEQ ID NO: 59828 - RNA, 22 nt, Human
uuugauucaaaaaccacuccac

SEQ ID NO: 59829 - RNA, 22 nt, Human
uuugauucaauguuuauauaaa

SEQ ID NO: 59830 - RNA, 22 nt, Human
uuugauucuggccucugagaag

SEQ ID NO: 59831 - RNA, 22 nt, Human
uuugauuuacuggauauucuca

SEQ ID NO: 59832 - RNA, 22 nt, Human
uuugcaaacggcccugaguccc

SEQ ID NO: 59833 - RNA, 22 nt, Human
uuugcaaagucccugggaugga

SEQ ID NO: 59834 - RNA, 22 nt, Human
uuugcaaagugacuauuauaug

SEQ ID NO: 59835 - RNA, 22 nt, Human
uuugcaaaguuauuuagacuca

SEQ ID NO: 59836 - RNA, 22 nt, Human
uuugcaaaugaagcucugagga

SEQ ID NO: 59837 - RNA, 22 nt, Human
uuugcaaauuucgucuccucag

SEQ ID NO: 59838 - RNA, 23 nt, Human
uuugcaaauuuuccugacuacuc

SEQ ID NO: 59839 - RNA, 22 nt, Human
uuugcaaggcagcaggugcagu

SEQ ID NO: 59840 - RNA, 22 nt, Human
uuugcaauuugugcugcaaaug

SEQ ID NO: 59841 - RNA, 22 nt, Human
uuugcacacauucuuagaaaug

SEQ ID NO: 59842 - RNA, 22 nt, Human
uuugcagaagaaaacaugaaca

SEQ ID NO: 59843 - RNA, 22 nt, Human
uuugcagcaauucguuauacag

SEQ ID NO: 59844 - RNA, 22 nt, Human
uuugcagccucccuggcagaag

SEQ ID NO: 59845 - RNA, 22 nt, Human
uuugcauaaaggagcauuucuc

SEQ ID NO: 59846 - RNA, 18 nt, Human
uuugcaugguaacauuga

SEQ ID NO: 59847 - RNA, 22 nt, Human
uuugcauugcauacaaggaacu

SEQ ID NO: 59848 - RNA, 22 nt, Human
uuugcauugcauuaaguauucu

SEQ ID NO: 59849 - RNA, 22 nt, Human
uuugcauuuccagaguagcaga

SEQ ID NO: 59850 - RNA, 22 nt, Human
uuugcauuuguucaaguauuga

SEQ ID NO: 59851 - RNA, 22 nt, Human
uuugccucucagagucuacaca

SEQ ID NO: 59852 - RNA, 22 nt, Human
uuugccugauucuaagagcuca

SEQ ID NO: 59853 - RNA, 22 nt, Human
uuugccugggaauucuagugua

SEQ ID NO: 59854 - RNA, 21 nt, Human
uuugccuucacgaagcauccu

SEQ ID NO: 59855 - RNA, 22 nt, Human
uuugccuucucugaaccuauuu

SEQ ID NO: 59856 - RNA, 20 nt, Human
uuugcgaggccaaggcgggc

SEQ ID NO: 59857 - RNA, 22 nt, Human
uuugcuaaaaggccauugauuu

SEQ ID NO: 59858 - RNA, 22 nt, Human
uuugcuaaaauguauugggauu

SEQ ID NO: 59859 - RNA, 22 nt, Human
uuugcuaaauaagugauuaagu

SEQ ID NO: 59860 - RNA, 22 nt, Human
uuugcucacuuguguauuuuca

SEQ ID NO: 59861 - RNA, 22 nt, Human
uuugcucugcuguugccaggug

SEQ ID NO: 59862 - RNA, 22 nt, Human
uuugcugacuggaugcaguugg

SEQ ID NO: 59863 - RNA, 22 nt, Human
uuugcugaguuuucuccuaaga

SEQ ID NO: 59864 - RNA, 22 nt, Human
uuugcugauauuuugcugauac

SEQ ID NO: 59865 - RNA, 22 nt, Human
uuugcugcuguauauggagccc

SEQ ID NO: 59866 - RNA, 22 nt, Human
uuugcuggagaugagcgugggu

SEQ ID NO: 59867 - RNA, 19 nt, Human
uuugcugguucaggaaaga

SEQ ID NO: 59868 - RNA, 22 nt, Human
uuugcugugggauauccaugug

SEQ ID NO: 59869 - RNA, 20 nt, Human
uuugcuguggguguaagaau

SEQ ID NO: 59870 - RNA, 22 nt, Human
uuugcuuaacugguagaaugcg

SEQ ID NO: 59871 - RNA, 22 nt, Human
uuugcuucacaaguaugguucu

SEQ ID NO: 59872 - RNA, 22 nt, Human
uuugcuugauuaggauauggaa

SEQ ID NO: 59873 - RNA, 22 nt, Human
uuugcuuguucaagauuucugu

SEQ ID NO: 59874 - RNA, 18 nt, Human
uuugcuuuccuucuucag

SEQ ID NO: 59875 - RNA, 22 nt, Human
uuugcuuucuugauucagauua

SEQ ID NO: 59876 - RNA, 22 nt, Human
uuugcuuugacugucagcaagu

SEQ ID NO: 59877 - RNA, 22 nt, Human
uuugcuuuugugcucuaguggu

SEQ ID NO: 59878 - RNA, 22 nt, Human
uuuggaaacaucucagaaaaua

SEQ ID NO: 59879 - RNA, 22 nt, Human
uuuggaaagacacacaguuuua

SEQ ID NO: 59880 - RNA, 22 nt, Human
uuuggaaaguguacaaauuuga

SEQ ID NO: 59881 - RNA, 22 nt, Human
uuuggaaauaauuccaucucau

SEQ ID NO: 59882 - RNA, 22 nt, Human
uuuggaaauacgcguaggcaga

SEQ ID NO: 59883 - RNA, 22 nt, Human
uuuggaaaugaccccgucuaag

SEQ ID NO: 59884 - RNA, 22 nt, Human
uuuggaaauuucaucaauagcc

SEQ ID NO: 59885 - RNA, 22 nt, Human
uuuggaaauuuucauccagaca

SEQ ID NO: 59886 - RNA, 19 nt, Human
uuuggaacuuuuugaugcc

SEQ ID NO: 59887 - RNA, 22 nt, Human
uuuggaagauaguucggcaguu

SEQ ID NO: 59888 - RNA, 22 nt, Human
uuuggaagggaaagaaaguacu

SEQ ID NO: 59889 - RNA, 22 nt, Human
uuuggaaguaaaugaguguuuu

SEQ ID NO: 59890 - RNA, 22 nt, Human
uuuggaaucauagauauauuca

SEQ ID NO: 59891 - RNA, 22 nt, Human
uuuggaaugaaacagcagagcc

SEQ ID NO: 59892 - RNA, 22 nt, Human
uuuggaaugcccauggacuggu

SEQ ID NO: 59893 - RNA, 22 nt, Human
uuuggaauguuaggugucucau

SEQ ID NO: 59894 - RNA, 22 nt, Human
uuuggaauucagauggcuuagg

SEQ ID NO: 59895 - RNA, 22 nt, Human
uuuggacaaacagaauagagcu

SEQ ID NO: 59896 - RNA, 19 nt, Human
uuuggacagaguguccagg

SEQ ID NO: 59897 - RNA, 22 nt, Human
uuuggacuuagccugcagaauu

SEQ ID NO: 59898 - RNA, 22 nt, Human
uuuggagaaguugcuaaagugu

SEQ ID NO: 59899 - RNA, 20 nt, Human
uuuggagagaaagaaguagu

SEQ ID NO: 59900 - RNA, 22 nt, Human
uuuucccaucuacaaagcaggg

SEQ ID NO: 59901 - RNA, 22 nt, Human
uuuuccuacugauaaacaguua

SEQ ID NO: 59902 - RNA, 22 nt, Human
uuuuccuaguaggccuauuaga

SEQ ID NO: 59903 - RNA, 20 nt, Human
uuuuccucguguuuguucua

SEQ ID NO: 59904 - RNA, 22 nt, Human
uuuuccucugagcuuugaauaa

SEQ ID NO: 59905 - RNA, 22 nt, Human
uuuuccucugcaauaaaagcag

SEQ ID NO: 59906 - RNA, 22 nt, Human
uuuuccuggagauggaguuguu

SEQ ID NO: 59907 - RNA, 22 nt, Human
uuuuccugggcuuucuguguaa

SEQ ID NO: 59908 - RNA, 22 nt, Human
uuuuccuguuaaaucugggcac

SEQ ID NO: 59909 - RNA, 22 nt, Human
uuuuccuuaacagagggagaaa

SEQ ID NO: 59910 - RNA, 22 nt, Human
uuuuccuucuagagcagauuuc

SEQ ID NO: 59911 - RNA, 22 nt, Human
uuuuccuuugauucccagaugu

SEQ ID NO: 59912 - RNA, 22 nt, Human
uuuucguuggucauuccccagc

SEQ ID NO: 59913 - RNA, 22 nt, Human
uuuucguuuauuugacauguaa

SEQ ID NO: 59914 - RNA, 22 nt, Human
uuuucuaaaagaagucacugau

SEQ ID NO: 59915 - RNA, 22 nt, Human
uuuucuaagggaaacguccucc

SEQ ID NO: 59916 - RNA, 22 nt, Human
uuuucuaauuuaguuacccucc

SEQ ID NO: 59917 - RNA, 22 nt, Human
uuuucuagggugcuaaaugaac

SEQ ID NO: 59918 - RNA, 22 nt, Human
uuuucuaucuccuagaacugcc

SEQ ID NO: 59919 - RNA, 22 nt, Human
uuuucucaagauccaaugcacu

SEQ ID NO: 59920 - RNA, 22 nt, Human
uuuucucagcugcacuguauua

SEQ ID NO: 59921 - RNA, 22 nt, Human
uuuucuccaacucaaaggaaag

SEQ ID NO: 59922 - RNA, 22 nt, Human
uuuucuccagggaacaagguga

SEQ ID NO: 59923 - RNA, 22 nt, Human
uuuucucccgcuggcugcucuu

SEQ ID NO: 59924 - RNA, 22 nt, Human
uuuucuccuaagacccuucacc

SEQ ID NO: 59925 - RNA, 17 nt, Human
uuuucuccugcccauuc

SEQ ID NO: 59926 - RNA, 19 nt, Human
uuuucucgugcuugucugc

SEQ ID NO: 59927 - RNA, 22 nt, Human
uuuucucuacaaaauaaccagc

SEQ ID NO: 59928 - RNA, 22 nt, Human
uuuucucuccagguggggugau

SEQ ID NO: 59929 - RNA, 22 nt, Human
uuuucugaaguuuaagacauuu

SEQ ID NO: 59930 - RNA, 22 nt, Human
uuuucugaccuaucuacauuua

SEQ ID NO: 59931 - RNA, 22 nt, Human
uuuucuguuacaaaguacagcg

SEQ ID NO: 59932 - RNA, 22 nt, Human
uuuucuguuugcuucaagacau

SEQ ID NO: 59933 - RNA, 22 nt, Human
uuuucuuaugugcagcuauaug

SEQ ID NO: 59934 - RNA, 22 nt, Human
uuuugacaaugcuaaucucaau

SEQ ID NO: 59935 - RNA, 22 nt, Human
uuuugagauggagucuugcucu

SEQ ID NO: 59936 - RNA, 22 nt, Human
uuuugagauggugucucgcucc

SEQ ID NO: 59937 - RNA, 22 nt, Human
uuuugauaucaugaugaacaga

SEQ ID NO: 59938 - RNA, 23 nt, Human
uuuugcaauaagucacuggaaua

SEQ ID NO: 59939 - RNA, 22 nt, Human
uuuugccugagauccgagucug

SEQ ID NO: 59940 - RNA, 22 nt, Human
uuuugcugcauugaagucagau

SEQ ID NO: 59941 - RNA, 22 nt, Human
uuuuggaaucugggaaaacagu

SEQ ID NO: 59942 - RNA, 22 nt, Human
uuuuggaaugaggaacauccag

SEQ ID NO: 59943 - RNA, 22 nt, Human
uuuuggcacugcgucuacaugg

SEQ ID NO: 59944 - RNA, 22 nt, Human
uuuuggcagauuacuuaauaug

SEQ ID NO: 59945 - RNA, 22 nt, Human
uuuuggcuguagcuggaaaucu

SEQ ID NO: 59946 - RNA, 22 nt, Human
uuuuggcuuaaagagaauguau

SEQ ID NO: 59947 - RNA, 22 nt, Human
uuuugguaauuaaguagauauu

SEQ ID NO: 59948 - RNA, 22 nt, Human
uuuuggucaacaguacaugcgg

SEQ ID NO: 59949 - RNA, 22 nt, Human
uuuugguucugggauacagaga

SEQ ID NO: 59950 - RNA, 22 nt, Human
uuuugguuucccuucuuauggu

SEQ ID NO: 59951 - RNA, 22 nt, Human
uuuuguaauuuccugacgacua

SEQ ID NO: 59952 - RNA, 22 nt, Human
uuuuguauccucccuuucacug

SEQ ID NO: 59953 - RNA, 22 nt, Human
uuuugucuaagaacuuugcaaa

SEQ ID NO: 59954 - RNA, 22 nt, Human
uuuugugacacuucuugagaca

SEQ ID NO: 59955 - RNA, 22 nt, Human
uuuugugagcugagaaauguau

SEQ ID NO: 59956 - RNA, 23 nt, Human
uuuugugugacuuaauaucucuu

SEQ ID NO: 59957 - RNA, 22 nt, Human
uuuuguuuguguccacugcagu

SEQ ID NO: 59958 - RNA, 22 nt, Human
uuuuguuuucuuagaaaccugg

SEQ ID NO: 59959 - RNA, 22 nt, Human
uuuuuaagagauucuccagucu

SEQ ID NO: 59960 - RNA, 22 nt, Human
uuuuuaaugcagucugagacau

SEQ ID NO: 59961 - RNA, 19 nt, Human
uuuuuaaugggcuggagca

SEQ ID NO: 59962 - RNA, 22 nt, Human
uuuuuagaauuggcugagaauu

SEQ ID NO: 59963 - RNA, 22 nt, Human
uuuuuagauuacucagccacca

SEQ ID NO: 59964 - RNA, 22 nt, Human
uuuuuauaggucagggcaaguc

SEQ ID NO: 59965 - RNA, 22 nt, Human
uuuuuauaugaaggauagugcg

SEQ ID NO: 59966 - RNA, 22 nt, Human
uuuuuaucuuguaugugucucu

SEQ ID NO: 59967 - RNA, 22 nt, Human
uuuuucacacauguggcuugau

SEQ ID NO: 59968 - RNA, 22 nt, Human
uuuuucauauuccccucucugg

SEQ ID NO: 59969 - RNA, 22 nt, Human
uuuuuccacauacccuaggcca

SEQ ID NO: 59970 - RNA, 22 nt, Human
uuuuuccaggguuagauguuua

SEQ ID NO: 59971 - RNA, 22 nt, Human
uuuuucuagcucaaagauucua

SEQ ID NO: 59972 - RNA, 22 nt, Human
uuuuucucuaaguagucccaaa

SEQ ID NO: 59973 - RNA, 18 nt, Human
uuuuucugauaaaacaag

SEQ ID NO: 59974 - RNA, 22 nt, Human
uuuuucugucucuuacauugca

SEQ ID NO: 59975 - RNA, 22 nt, Human
uuuuucuuaaauguggguuggc

SEQ ID NO: 59976 - RNA, 22 nt, Human
uuuuucuugugcuggaucuaau

SEQ ID NO: 59977 - RNA, 22 nt, Human
uuuuugauacucaagaggggua

SEQ ID NO: 59978 - RNA, 22 nt, Human
uuuuuggaaggagauccacacu

SEQ ID NO: 59979 - RNA, 22 nt, Human
uuuuuguggugugaguggacau

SEQ ID NO: 59980 - RNA, 22 nt, Human
uuuuugugugagcaggguguua

SEQ ID NO: 59981 - RNA, 22 nt, Human
aaaaacagaaugugucuaacuc

SEQ ID NO: 59982 - RNA, 20 nt, Human
aaaaacaguaaugcugaaga

SEQ ID NO: 59983 - RNA, 22 nt, Human
aaaaaccuuucccauacuaaga

SEQ ID NO: 59984 - RNA, 19 nt, Human
aaaaacuuaguccagaaag

SEQ ID NO: 59985 - RNA, 20 nt, Human
aaaaagacaaaacgaguugg

SEQ ID NO: 59986 - RNA, 22 nt, Human
aaaaagacuuccaacucaggag

SEQ ID NO: 59987 - RNA, 22 nt, Human
aaaaagauguccugaaguuuag

SEQ ID NO: 59988 - RNA, 22 nt, Human
aaaaagguugauccagauuagg

SEQ ID NO: 59989 - RNA, 22 nt, Human
aaaaagucauauucuuguuccu

SEQ ID NO: 59990 - RNA, 22 nt, Human
aaaaaucuaugacugcuucucc

SEQ ID NO: 59991 - RNA, 22 nt, Human
aaaaaugaauucuucaguggca

SEQ ID NO: 59992 - RNA, 22 nt, Human
aaaaaugucauuauggaacuga

SEQ ID NO: 59993 - RNA, 22 nt, Human
aaaacacugccugcuugacuga

SEQ ID NO: 59994 - RNA, 22 nt, Human
aaaacaguuuaggcaucacagu

SEQ ID NO: 59995 - RNA, 22 nt, Human
aaaacauguccauacagaaacu

SEQ ID NO: 59996 - RNA, 22 nt, Human
aaaacauucugugaacucucaa

SEQ ID NO: 59997 - RNA, 22 nt, Human
aaaacauuuuacugccaucuca

SEQ ID NO: 59998 - RNA, 22 nt, Human
aaaaccacaaugacuuuugcag

SEQ ID NO: 59999 - RNA, 22 nt, Human
aaaaccagguagcaaaggagac

SEQ ID NO: 60000 - RNA, 22 nt, Human
aaaaccuucuagacuuuauauu

SEQ ID NO: 60001 - RNA, 22 nt, Human
aaaacucaaacauuuuggcaua

SEQ ID NO: 60002 - RNA, 22 nt, Human
aaaacuccugaaauuguuuccc

SEQ ID NO: 60003 - RNA, 22 nt, Human
aaaacugaaauacgauccaaug

SEQ ID NO: 60004 - RNA, 22 nt, Human
aaaagaaccuagcuccucaguc

SEQ ID NO: 60005 - RNA, 22 nt, Human
aaaagacaggugucugcggccc

SEQ ID NO: 60006 - RNA, 22 nt, Human
aaaagaggaacucuuauauacu

SEQ ID NO: 60007 - RNA, 20 nt, Human
aaaagagugcuucaacugcu

SEQ ID NO: 60008 - RNA, 22 nt, Human
aaaagaguguuucaacuuuggc

SEQ ID NO: 60009 - RNA, 22 nt, Human
aaaagcaaggcagucugucuga

SEQ ID NO: 60010 - RNA, 22 nt, Human
aaaagcagaccacgcuuugugg

SEQ ID NO: 60011 - RNA, 22 nt, Human
aaaagcagaucuccaaagucua

SEQ ID NO: 60012 - RNA, 22 nt, Human
aaaagcagguacucagcuuggg

SEQ ID NO: 60013 - RNA, 22 nt, Human
aaaaggacaagcuuuggaguua

SEQ ID NO: 60014 - RNA, 19 nt, Human
aaaaggagagaucagaguu

SEQ ID NO: 60015 - RNA, 22 nt, Human
aaaaggauguuuucaugaaaca

SEQ ID NO: 60016 - RNA, 22 nt, Human
aaaaggcuaauccagagcaacu

SEQ ID NO: 60017 - RNA, 22 nt, Human
aaaaggcucuucaaaauggaag

SEQ ID NO: 60018 - RNA, 22 nt, Human
aaaagggcaaaaccaucaugga

SEQ ID NO: 60019 - RNA, 22 nt, Human
aaaagguagauucuccuucuau

SEQ ID NO: 60020 - RNA, 22 nt, Human
aaaaguaauugcaauuuuguag

SEQ ID NO: 60021 - RNA, 22 nt, Human
aaaaguaauugcaguuuucgcc

SEQ ID NO: 60022 - RNA, 22 nt, Human
aaaaguaauugcaguuuugcca

SEQ ID NO: 60023 - RNA, 22 nt, Human
aaaaguaauugugguuuuggcc

SEQ ID NO: 60024 - RNA, 22 nt, Human
aaaaguacuauuuuaacaaagu

SEQ ID NO: 60025 - RNA, 22 nt, Human
aaaagucugcucucauuucaga

SEQ ID NO: 60026 - RNA, 22 nt, Human
aaaagugaugggauggcacuuc

SEQ ID NO: 60027 - RNA, 22 nt, Human
aaaaguuagcuauuaguaggug

SEQ ID NO: 60028 - RNA, 22 nt, Human
aaaaguuuaagacucauucuag

SEQ ID NO: 60029 - RNA, 22 nt, Human
aaaauaacuucuacuauuugca

SEQ ID NO: 60030 - RNA, 22 nt, Human
aaaauacacauacuaggggaaa

SEQ ID NO: 60031 - RNA, 22 nt, Human
aaaauagcuauggaaugucacu

SEQ ID NO: 60032 - RNA, 22 nt, Human
aaaauagguacggauuagaaug

SEQ ID NO: 60033 - RNA, 22 nt, Human
aaaauauggggugagcccagag

SEQ ID NO: 60034 - RNA, 22 nt, Human
aaaauauguauaacucuucugc

SEQ ID NO: 60035 - RNA, 22 nt, Human
aaaaucacaagcuugggucacu

SEQ ID NO: 60036 - RNA, 22 nt, Human
aaaaucacacaaguagaugggg

SEQ ID NO: 60037 - RNA, 23 nt, Human
aaaaucauuaauuuacccugaaa

SEQ ID NO: 60038 - RNA, 22 nt, Human
aaaauccacaacgcucauuuca

SEQ ID NO: 60039 - RNA, 22 nt, Human
aaaauccucuaauucuagaaua

SEQ ID NO: 60040 - RNA, 22 nt, Human
aaaaucuugugacuuaggaagg

SEQ ID NO: 60041 - RNA, 22 nt, Human
aaaaugagacacaugugacucc

SEQ ID NO: 60042 - RNA, 22 nt, Human
aaaaugaggucaauauccuuuu

SEQ ID NO: 60043 - RNA, 22 nt, Human
aaagcagccgguucccuggucu

SEQ ID NO: 60044 - RNA, 22 nt, Human
aaagcagccugcucauccugga

SEQ ID NO: 60045 - RNA, 22 nt, Human
aaagcagcggugucuuuacugc

SEQ ID NO: 60046 - RNA, 22 nt, Human
aaagcagcugaucucagagccu

SEQ ID NO: 60047 - RNA, 22 nt, Human
aaagcagcuguuugacuuucca

SEQ ID NO: 60048 - RNA, 22 nt, Human
aaagcagggcgauguccuccuc

SEQ ID NO: 60049 - RNA, 22 nt, Human
aaagcagguuaugaccauggcc

SEQ ID NO: 60050 - RNA, 22 nt, Human
aaagcagucacuccagugugau

SEQ ID NO: 60051 - RNA, 22 nt, Human
aaagcagucuguuuuaaccuga

SEQ ID NO: 60052 - RNA, 19 nt, Human
aaagcagugcauccucuuu

SEQ ID NO: 60053 - RNA, 22 nt, Human
aaagcagugcugugagaacacu

SEQ ID NO: 60054 - RNA, 22 nt, Human
aaagcauguucugggaauagua

SEQ ID NO: 60055 - RNA, 22 nt, Human
aaagcauuguuucaagauuaac

SEQ ID NO: 60056 - RNA, 20 nt, Human
aaagcauuuacuugugauug

SEQ ID NO: 60057 - RNA, 20 nt, Human
aaagccacuggcaagagacu

SEQ ID NO: 60058 - RNA, 22 nt, Human
aaagccagaauucguccagccu

SEQ ID NO: 60059 - RNA, 22 nt, Human
aaagccagcaaggugaguuuca

SEQ ID NO: 60060 - RNA, 22 nt, Human
aaagccagggacagugugcaug

SEQ ID NO: 60061 - RNA, 22 nt, Human
aaagccauaagccuaauacuaa

SEQ ID NO: 60062 - RNA, 22 nt, Human
aaagccaucaguaaaaugauuu

SEQ ID NO: 60063 - RNA, 22 nt, Human
aaagccauuacaaaauuucaua

SEQ ID NO: 60064 - RNA, 22 nt, Human
aaagccauugcagagcaggauu

SEQ ID NO: 60065 - RNA, 22 nt, Human
aaagccuugagauccuauaguu

SEQ ID NO: 60066 - RNA, 22 nt, Human
aaagccuuggucaucugguucc

SEQ ID NO: 60067 - RNA, 22 nt, Human
aaagcuaagguagcauuggaga

SEQ ID NO: 60068 - RNA, 22 nt, Human
aaagcuaccuuuguguucauag

SEQ ID NO: 60069 - RNA, 22 nt, Human
aaagcuauagggucaagcauuu

SEQ ID NO: 60070 - RNA, 22 nt, Human
aaagcuaugaggcaugcauuuc

SEQ ID NO: 60071 - RNA, 22 nt, Human
aaagcucucccacuguaugaag

SEQ ID NO: 60072 - RNA, 22 nt, Human
aaagcucuuuuccaaguauuga

SEQ ID NO: 60073 - RNA, 22 nt, Human
aaagcugccaaggagaauacua

SEQ ID NO: 60074 - RNA, 22 nt, Human
aaagcugggcuggccaacccag

SEQ ID NO: 60075 - RNA, 22 nt, Human
aaagcugguuauucugaggcag

SEQ ID NO: 60076 - RNA, 22 nt, Human
aaagcuguaaugcaugcuuucu

SEQ ID NO: 60077 - RNA, 22 nt, Human
aaagcuguagaaucaucuuaau

SEQ ID NO: 60078 - RNA, 18 nt, Human
aaagcuguuauuccagaa

SEQ ID NO: 60079 - RNA, 22 nt, Human
aaagcuucuaggccuauugcuu

SEQ ID NO: 60080 - RNA, 22 nt, Human
aaagcuugugcuguaguauuua

SEQ ID NO: 60081 - RNA, 22 nt, Human
aaagcuuuuguuuucguaacug

SEQ ID NO: 60082 - RNA, 22 nt, Human
aaaggaaaauaaguaguuccau

SEQ ID NO: 60083 - RNA, 22 nt, Human
aaaggaagaugccaggacucug

SEQ ID NO: 60084 - RNA, 22 nt, Human
aaaggaauauucaaaacaguca

SEQ ID NO: 60085 - RNA, 22 nt, Human
aaaggacuagucuuucuaccau

SEQ ID NO: 60086 - RNA, 22 nt, Human
aaaggagacuucagaucuccuu

SEQ ID NO: 60087 - RNA, 22 nt, Human
aaaggagagugagucagaugcc

SEQ ID NO: 60088 - RNA, 22 nt, Human
aaaggauaagguuaucaauuuu

SEQ ID NO: 60089 - RNA, 22 nt, Human
aaaggauucucuugauuucagu

SEQ ID NO: 60090 - RNA, 23 nt, Human
aaaggcacagcauugucuagcag

SEQ ID NO: 60091 - RNA, 22 nt, Human
aaaggcagagugcucagcuggc

SEQ ID NO: 60092 - RNA, 22 nt, Human
aaaggcagugugauacuguggu

SEQ ID NO: 60093 - RNA, 22 nt, Human
aaaggcaugccuccauuucuau

SEQ ID NO: 60094 - RNA, 22 nt, Human
aaaggcaugcugcugaaugaug

SEQ ID NO: 60095 - RNA, 22 nt, Human
aaaggccaauaaagacaagcug

SEQ ID NO: 60096 - RNA, 22 nt, Human
aaaggccacacagagcagggag

SEQ ID NO: 60097 - RNA, 22 nt, Human
aaaggccacacugcucuuucuc

SEQ ID NO: 60098 - RNA, 22 nt, Human
aaaggccacugcaagggaaggu

SEQ ID NO: 60099 - RNA, 22 nt, Human
aaaggccacuugaaggauuuuu

SEQ ID NO: 60100 - RNA, 22 nt, Human
aaaggccucuguccuagugccu

SEQ ID NO: 60101 - RNA, 16 nt, Human
aaagaaacaggugucc

SEQ ID NO: 60102 - RNA, 22 nt, Human
aaagaacaucggagugggcggg

SEQ ID NO: 60103 - RNA, 22 nt, Human
aaagaacuauuaacgaggaagc

SEQ ID NO: 60104 - RNA, 22 nt, Human
aaagaagagcuggaaggagucu

SEQ ID NO: 60105 - RNA, 22 nt, Human
aaagaagauggagaccugacua

SEQ ID NO: 60106 - RNA, 22 nt, Human
aaagaagggacagacugccucu

SEQ ID NO: 60107 - RNA, 22 nt, Human
aaagaauagccuuuguccaaau

SEQ ID NO: 60108 - RNA, 22 nt, Human
aaagaauaguuaaguuuagggc

SEQ ID NO: 60109 - RNA, 22 nt, Human
aaagaaucuauauaucaccacc

SEQ ID NO: 60110 - RNA, 22 nt, Human
aaagaaugcagugccuuccagc

SEQ ID NO: 60111 - RNA, 22 nt, Human
aaagaaugucugaacagcuggc

SEQ ID NO: 60112 - RNA, 22 nt, Human
aaagacacacagccagcaagug

SEQ ID NO: 60113 - RNA, 22 nt, Human
aaagacagacggaaaccugagg

SEQ ID NO: 60114 - RNA, 22 nt, Human
aaagacaugacacauuggagag

SEQ ID NO: 60115 - RNA, 22 nt, Human
aaagacauggaacuagagaugg

SEQ ID NO: 60116 - RNA, 22 nt, Human
aaagaccugugguagcucuaaa

SEQ ID NO: 60117 - RNA, 22 nt, Human
aaagacuaaacaaccaauaucu

SEQ ID NO: 60118 - RNA, 22 nt, Human
aaagacucuuaacucccuagcg

SEQ ID NO: 60119 - RNA, 22 nt, Human
aaagacugggacugcagcaggc

SEQ ID NO: 60120 - RNA, 22 nt, Human
aaagacugguguguuacauaua

SEQ ID NO: 60121 - RNA, 22 nt, Human
aaagagaaaaugaucuguacau

SEQ ID NO: 60122 - RNA, 22 nt, Human
aaagagaacuuuuacccaagaa

SEQ ID NO: 60123 - RNA, 20 nt, Human
aaagagaagccucaccuugu

SEQ ID NO: 60124 - RNA, 22 nt, Human
aaagagacugguggcauuuugc

SEQ ID NO: 60125 - RNA, 22 nt, Human
aaagagcaagggcuuugaggcu

SEQ ID NO: 60126 - RNA, 22 nt, Human
aaagagcacccucaaugucuga

SEQ ID NO: 60127 - RNA, 22 nt, Human
aaagagcuugcuugcuuuauau

SEQ ID NO: 60128 - RNA, 21 nt, Human
aaagagcuuuugugcuaguua

SEQ ID NO: 60129 - RNA, 21 nt, Human
aaagagguuaauauuguaagu

SEQ ID NO: 60130 - RNA, 22 nt, Human
aaagagucuggcacuguaccag

SEQ ID NO: 60131 - RNA, 22 nt, Human
aaagaguugaaaacuaacagug

SEQ ID NO: 60132 - RNA, 22 nt, Human
aaagaguugaggcaguuaucca

SEQ ID NO: 60133 - RNA, 22 nt, Human
aaagaguuuccauugacauuuc

SEQ ID NO: 60134 - RNA, 22 nt, Human
aaagaguuuggagacaagauca

SEQ ID NO: 60135 - RNA, 22 nt, Human
aaagauaugucuccaaagagau

SEQ ID NO: 60136 - RNA, 23 nt, Human
aaagaucaaaguggcaggccugu

SEQ ID NO: 60137 - RNA, 22 nt, Human
aaagaucacacuguggggcagu

SEQ ID NO: 60138 - RNA, 22 nt, Human
aaagaucacgucccaggacucg

SEQ ID NO: 60139 - RNA, 22 nt, Human
aaagaucuccccuucaaagagu

SEQ ID NO: 60140 - RNA, 22 nt, Human
aaagaucugacuuagacacaga

SEQ ID NO: 60141 - RNA, 22 nt, Human
aaagaugccuaacucagaagau

SEQ ID NO: 60142 - RNA, 22 nt, Human
aaagaugucacaagaugugaug

SEQ ID NO: 60143 - RNA, 21 nt, Human
aaagauguuucaucugagaaa

SEQ ID NO: 60144 - RNA, 22 nt, Human
aaagauuaaaucaaauugguca

SEQ ID NO: 60145 - RNA, 22 nt, Human
aaagauuauggcauugaaauac

SEQ ID NO: 60146 - RNA, 22 nt, Human
aaagcaagacaggaguuucaga

SEQ ID NO: 60147 - RNA, 23 nt, Human
aaagcaaggaauuggcaacagag

SEQ ID NO: 60148 - RNA, 22 nt, Human
aaagcaauagaggguaagacug

SEQ ID NO: 60149 - RNA, 22 nt, Human
aaagcaaucuaguuccaauucu

SEQ ID NO: 60150 - RNA, 22 nt, Human
aaagcaaugcuuguggaaugua

SEQ ID NO: 60151 - RNA, 22 nt, Human
aaagcaauuacaaaagggauaa

SEQ ID NO: 60152 - RNA, 22 nt, Human
aaaugaugcucacagauuagug

SEQ ID NO: 60153 - RNA, 22 nt, Human
aaaugcacaauaaaguaaaggc

SEQ ID NO: 60154 - RNA, 22 nt, Human
aaaugcacagagccuuagagau

SEQ ID NO: 60155 - RNA, 22 nt, Human
aaaugcagaaucucagacccca

SEQ ID NO: 60156 - RNA, 22 nt, Human
aaaugcagaaugauuucaucua

SEQ ID NO: 60157 - RNA, 22 nt, Human
aaaugcagccuagcucaguuuu

SEQ ID NO: 60158 - RNA, 22 nt, Human
aaaugcaggauuaacagcuuug

SEQ ID NO: 60159 - RNA, 21 nt, Human
aaaugcaggcucuuuguuuuc

SEQ ID NO: 60160 - RNA, 22 nt, Human
aaaugcauuaagucagaacaau

SEQ ID NO: 60161 - RNA, 22 nt, Human
aaaugccaaggagagacuguua

SEQ ID NO: 60162 - RNA, 22 nt, Human
aaaugccaggauuauuagaggc

SEQ ID NO: 60163 - RNA, 22 nt, Human
aaaugccucccaaacagcacaa

SEQ ID NO: 60164 - RNA, 22 nt, Human
aaaugccucccauucuacugac

SEQ ID NO: 60165 - RNA, 22 nt, Human
aaaugccucugcuguacacaau

SEQ ID NO: 60166 - RNA, 22 nt, Human
aaaugccucuggguuauucuag

SEQ ID NO: 60167 - RNA, 22 nt, Human
aaaugcuaacaaggaaugcugc

SEQ ID NO: 60168 - RNA, 18 nt, Human
aaaugcuaggcuacauga

SEQ ID NO: 60169 - RNA, 22 nt, Human
aaaugcuauuugggaacaacau

SEQ ID NO: 60170 - RNA, 22 nt, Human
aaaugcucaccacagggaugug

SEQ ID NO: 60171 - RNA, 22 nt, Human
aaaugcucucuaauguaauaca

SEQ ID NO: 60172 - RNA, 22 nt, Human
aaaugcugcagcuaguguguuu

SEQ ID NO: 60173 - RNA, 20 nt, Human
aaaugcuguaauguuuggga

SEQ ID NO: 60174 - RNA, 20 nt, Human
aaaugcugugcuguugccau

SEQ ID NO: 60175 - RNA, 22 nt, Human
aaaugcuguucuuuuagguaga

SEQ ID NO: 60176 - RNA, 22 nt, Human
aaaugcuuagagguguucaaau

SEQ ID NO: 60177 - RNA, 21 nt, Human
aaaugcuuuguauauaucugu

SEQ ID NO: 60178 - RNA, 22 nt, Human
aaauggacauugggugagcucu

SEQ ID NO: 60179 - RNA, 22 nt, Human
aaauggaggcaaaauugguuuc

SEQ ID NO: 60180 - RNA, 22 nt, Human
aaauggaggcacgcagugguua

SEQ ID NO: 60181 - RNA, 22 nt, Human
aaauggaucuuuuuauaaugca

SEQ ID NO: 60182 - RNA, 22 nt, Human
aaauggauggaauugacauuua

SEQ ID NO: 60183 - RNA, 22 nt, Human
aaauggcacuuugacagccugc

SEQ ID NO: 60184 - RNA, 22 nt, Human
aaauggcaggcucuuugcuagu

SEQ ID NO: 60185 - RNA, 23 nt, Human
aaauggccaaaaccaggugguua

SEQ ID NO: 60186 - RNA, 23 nt, Human
aaauggccaagguuaaaaauaca

SEQ ID NO: 60187 - RNA, 22 nt, Human
aaauggcuccaguugacuuuuu

SEQ ID NO: 60188 - RNA, 19 nt, Human
aaauggcuuucuacuuaau

SEQ ID NO: 60189 - RNA, 23 nt, Human
aaauggguuucuguuuuguggac

SEQ ID NO: 60190 - RNA, 22 nt, Human
aaaugguagguuuucuuaagaa

SEQ ID NO: 60191 - RNA, 22 nt, Human
aaaugguauaaugucauguauu

SEQ ID NO: 60192 - RNA, 22 nt, Human
aaauggugaaguguaauuuagc

SEQ ID NO: 60193 - RNA, 20 nt, Human
aaauguauaggacccuucua

SEQ ID NO: 60194 - RNA, 22 nt, Human
aaaugucagaagcuuuacuucu

SEQ ID NO: 60195 - RNA, 22 nt, Human
aaaugucauauuuaaguaggaa

SEQ ID NO: 60196 - RNA, 22 nt, Human
aaauguccuuagagaaaaguca

SEQ ID NO: 60197 - RNA, 22 nt, Human
aaaugucuaucuggcauauucc

SEQ ID NO: 60198 - RNA, 22 nt, Human
aaaugucugucucaugaggaaa

SEQ ID NO: 60199 - RNA, 22 nt, Human
aaaugucuuucaauagagaaau

SEQ ID NO: 60200 - RNA, 22 nt, Human
aaaugugcuaaaguauuaacau

SEQ ID NO: 60201 - RNA, 22 nt, Human
aaauguggguaaugggacugga

SEQ ID NO: 60202 - RNA, 22 nt, Human
aaauguguuugauaggaauauu

SEQ ID NO: 60203 - RNA, 22 nt, Human
aaauguuccuuuggauuaaacu

SEQ ID NO: 60204 - RNA, 22 nt, Human
aaauguuuaaguguaggagcaa

SEQ ID NO: 60205 - RNA, 22 nt, Human
aaauuaagaguaacucuguaga

SEQ ID NO: 60206 - RNA, 22 nt, Human
aaauuaagggugagaagaguug

SEQ ID NO: 60207 - RNA, 20 nt, Human
aaauuacugccacacauuuc

SEQ ID NO: 60208 - RNA, 22 nt, Human
aaauuagaagugcucaggaaua

SEQ ID NO: 60209 - RNA, 22 nt, Human
aaauuauaggugccaccuugga

SEQ ID NO: 60210 - RNA, 22 nt, Human
aaauuaucaugauuauugugua

SEQ ID NO: 60211 - RNA, 22 nt, Human
aaauuauuacaagcuaguuggc

SEQ ID NO: 60212 - RNA, 22 nt, Human
aaauucaauuaacuuucaugcu

SEQ ID NO: 60213 - RNA, 22 nt, Human
aaauucagcauccugcacugga

SEQ ID NO: 60214 - RNA, 22 nt, Human
aaauaauuauagcgagucuauc

SEQ ID NO: 60215 - RNA, 22 nt, Human
aaauacagaguuauggaccuca

SEQ ID NO: 60216 - RNA, 22 nt, Human
aaauacaguggcagcagauaau

SEQ ID NO: 60217 - RNA, 22 nt, Human
aaauagaauuggaagcagaguu

SEQ ID NO: 60218 - RNA, 22 nt, Human
aaauagagcuggguuaaacuuu

SEQ ID NO: 60219 - RNA, 22 nt, Human
aaauagcacagcagcugaggcu

SEQ ID NO: 60220 - RNA, 22 nt, Human
aaauagcagcuuugacagcaca

SEQ ID NO: 60221 - RNA, 22 nt, Human
aaauagcauaaaauaggaagcu

SEQ ID NO: 60222 - RNA, 22 nt, Human
aaauaggaaugugguccuggga

SEQ ID NO: 60223 - RNA, 22 nt, Human
aaauaguuacuucugcugucuu

SEQ ID NO: 60224 - RNA, 22 nt, Human
aaauauagcaauuaugccuacu

SEQ ID NO: 60225 - RNA, 22 nt, Human
aaauauuagggagaacagggac

SEQ ID NO: 60226 - RNA, 22 nt, Human
aaaucaaaagacauguguuuua

SEQ ID NO: 60227 - RNA, 22 nt, Human
aaaucacagggucucuaaguau

SEQ ID NO: 60228 - RNA, 21 nt, Human
aaaucacuguccaaucuuggu

SEQ ID NO: 60229 - RNA, 22 nt, Human
aaaucacuuaaauggcuuauuu

SEQ ID NO: 60230 - RNA, 22 nt, Human
aaaucaguuggaacacaagcag

SEQ ID NO: 60231 - RNA, 22 nt, Human
aaaucaugguggaagaaacaga

SEQ ID NO: 60232 - RNA, 22 nt, Human
aaauccauucuguuuuaaaagu

SEQ ID NO: 60233 - RNA, 22 nt, Human
aaaucccugauaauguaggucu

SEQ ID NO: 60234 - RNA, 22 nt, Human
aaauccuuuggaggacaugaug

SEQ ID NO: 60235 - RNA, 22 nt, Human
aaaucgcuugaacccaggaagu

SEQ ID NO: 60236 - RNA, 22 nt, Human
aaaucguuauaauguuaagccu

SEQ ID NO: 60237 - RNA, 22 nt, Human
aaaucguuucguuccugguuuu

SEQ ID NO: 60238 - RNA, 22 nt, Human
aaaucuagaaguuuaaaaggau

SEQ ID NO: 60239 - RNA, 22 nt, Human
aaaucucagcccuuauuuuaga

SEQ ID NO: 60240 - RNA, 22 nt, Human
aaaucucaggccucuauuuacu

SEQ ID NO: 60241 - RNA, 22 nt, Human
aaaucugaaauagugugaagua

SEQ ID NO: 60242 - RNA, 22 nt, Human
aaaucugagaaauauuguccag

SEQ ID NO: 60243 - RNA, 22 nt, Human
aaaucugguucaguaaguccuc

SEQ ID NO: 60244 - RNA, 22 nt, Human
aaaucuguuucucauaggguag

SEQ ID NO: 60245 - RNA, 22 nt, Human
aaaugacagagcugggacuagu

SEQ ID NO: 60246 - RNA, 22 nt, Human
aaaugacaguucucucugagua

SEQ ID NO: 60247 - RNA, 22 nt, Human
aaaugacauuaggauccugcau

SEQ ID NO: 60248 - RNA, 22 nt, Human
aaaugaggccagaucaugcaga

SEQ ID NO: 60249 - RNA, 22 nt, Human
aaaugagguuaauacagugcuu

SEQ ID NO: 60250 - RNA, 22 nt, Human
aaaugaguagcgaugcacauua

SEQ ID NO: 60251 - RNA, 20 nt, Human
aaaugaugggaauaaucuau

SEQ ID NO: 60252 - RNA, 22 nt, Human
aaaugauguggagugaaauugu

SEQ ID NO: 60253 - RNA, 22 nt, Human
aaaugauugucaaaguucuguu

SEQ ID NO: 60254 - RNA, 22 nt, Human
aaaugcaaguucauauuuuguu

SEQ ID NO: 60255 - RNA, 22 nt, Human
aaaugcaauucaggaagacaag

SEQ ID NO: 60256 - RNA, 22 nt, Human
aaaugcacacaccaggaaacua

SEQ ID NO: 60257 - RNA, 22 nt, Human
aaaugcacagaaaggaugugga

SEQ ID NO: 60258 - RNA, 22 nt, Human
aaaugcagauucuuaggcccca

SEQ ID NO: 60259 - RNA, 22 nt, Human
aaaugcagcagcuaauugaaaa

SEQ ID NO: 60260 - RNA, 22 nt, Human
aaaugcaggaaauuaugcuuuu

SEQ ID NO: 60261 - RNA, 22 nt, Human
aaaguaaagauugggaaugugu

SEQ ID NO: 60262 - RNA, 22 nt, Human
aaaguaaccuaguaauaguguc

SEQ ID NO: 60263 - RNA, 22 nt, Human
aaaguaauugugguucuugcca

SEQ ID NO: 60264 - RNA, 22 nt, Human
aaaguacaaggaaaggaucuga

SEQ ID NO: 60265 - RNA, 22 nt, Human
aaaguacacacagagccaagaa

SEQ ID NO: 60266 - RNA, 22 nt, Human
aaaguacagccacauccaagua

SEQ ID NO: 60267 - RNA, 22 nt, Human
aaaguacauagcauauuccaac

SEQ ID NO: 60268 - RNA, 22 nt, Human
aaaguacaugagauucaagggg

SEQ ID NO: 60269 - RNA, 23 nt, Human
aaaguacuuaaucugcaaaccac

SEQ ID NO: 60270 - RNA, 23 nt, Human
aaaguacuuccacagcuaugauc

SEQ ID NO: 60271 - RNA, 22 nt, Human
aaaguacuugaugcuacagagu

SEQ ID NO: 60272 - RNA, 22 nt, Human
aaaguagaguuguggaauuacu

SEQ ID NO: 60273 - RNA, 22 nt, Human
aaaguagcuuuguagguacagu

SEQ ID NO: 60274 - RNA, 22 nt, Human
aaaguagucucuuucaucuuuu

SEQ ID NO: 60275 - RNA, 22 nt, Human
aaaguaucugaccgauuauaaa

SEQ ID NO: 60276 - RNA, 22 nt, Human
aaaguauuugugauuuuuacca

SEQ ID NO: 60277 - RNA, 22 nt, Human
aaagucaaugauuucuccugga

SEQ ID NO: 60278 - RNA, 22 nt, Human
aaagucacaauauuggaaggug

SEQ ID NO: 60279 - RNA, 22 nt, Human
aaagucacaguuuaggggauau

SEQ ID NO: 60280 - RNA, 22 nt, Human
aaagucacauauaacaagggca

SEQ ID NO: 60281 - RNA, 22 nt, Human
aaagucacgcugaugggaaaug

SEQ ID NO: 60282 - RNA, 22 nt, Human
aaagucaguuggccagaucacu

SEQ ID NO: 60283 - RNA, 22 nt, Human
aaagucaucagaaccuuccaga

SEQ ID NO: 60284 - RNA, 22 nt, Human
aaagucaugaugaaccaccgua

SEQ ID NO: 60285 - RNA, 22 nt, Human
aaagucauguaaugauaugauu

SEQ ID NO: 60286 - RNA, 22 nt, Human
aaagucauuggaauauuaauga

SEQ ID NO: 60287 - RNA, 22 nt, Human
aaagucauuguaauauaugcua

SEQ ID NO: 60288 - RNA, 22 nt, Human
aaagucauuuuccagaccagua

SEQ ID NO: 60289 - RNA, 22 nt, Human
aaaguccagagggcacacugaa

SEQ ID NO: 60290 - RNA, 22 nt, Human
aaaguccaggggcuggaggcgg

SEQ ID NO: 60291 - RNA, 22 nt, Human
aaaguccuguuaacuguuaaca

SEQ ID NO: 60292 - RNA, 22 nt, Human
aaaguccuguuugaaggaccug

SEQ ID NO: 60293 - RNA, 22 nt, Human
aaagucugaaagaugcuaacau

SEQ ID NO: 60294 - RNA, 22 nt, Human
aaagucuuguuacguuccauug

SEQ ID NO: 60295 - RNA, 22 nt, Human
aaagugacaaccagcaggacuu

SEQ ID NO: 60296 - RNA, 23 nt, Human
aaagugacuuuuauaccacuaac

SEQ ID NO: 60297 - RNA, 22 nt, Human
aaagugaggacuugaguacugu

SEQ ID NO: 60298 - RNA, 15 nt, Human
aaagugcacccaaua

SEQ ID NO: 60299 - RNA, 22 nt, Human
aaagugcagcugaaaacauccu

SEQ ID NO: 60300 - RNA, 22 nt, Human
aaagugcagcuugugaucccua

SEQ ID NO: 60301 - RNA, 23 nt, Human
aaagugcaguugaggaaucauag

SEQ ID NO: 60302 - RNA, 22 nt, Human
aaagugcauagaguagugccua

SEQ ID NO: 60303 - RNA, 22 nt, Human
aaagugcaucaaaugacuuccc

SEQ ID NO: 60304 - RNA, 22 nt, Human
aaagugccugacucauaguuag

SEQ ID NO: 60305 - RNA, 22 nt, Human
aaagugcuaggauuacaagcgu

SEQ ID NO: 60306 - RNA, 22 nt, Human
aaagugcugggauuacaagugu

SEQ ID NO: 60307 - RNA, 22 nt, Human
aaagugcugggauuaccggcau

SEQ ID NO: 60308 - RNA, 22 nt, Human
aaagugcugugauuacaggcau

SEQ ID NO: 60309 - RNA, 22 nt, Human
aaagugcuuuaggauauuugga

SEQ ID NO: 60310 - RNA, 22 nt, Human
aaagugggaacaauggagagug

SEQ ID NO: 60311 - RNA, 22 nt, Human
aaaguggugggcgaacucauca

SEQ ID NO: 60312 - RNA, 22 nt, Human
aaagugguugcugucagccucu

SEQ ID NO: 60313 - RNA, 22 nt, Human
aaagugguuucccaguucagua

SEQ ID NO: 60314 - RNA, 22 nt, Human
aaagugguuuuucagacuuuga

SEQ ID NO: 60315 - RNA, 22 nt, Human
aaaguguacuaugucaugaaca

SEQ ID NO: 60316 - RNA, 22 nt, Human
aaaguguagagacuuuggaacc

SEQ ID NO: 60317 - RNA, 22 nt, Human
aaaguguagagugccucaaaau

SEQ ID NO: 60318 - RNA, 23 nt, Human
aaaguguagccagguuaagaacc

SEQ ID NO: 60319 - RNA, 22 nt, Human
aaaguguggagauugaacuaaa

SEQ ID NO: 60320 - RNA, 22 nt, Human
aaaguguuaacacuggcuacuu

SEQ ID NO: 60321 - RNA, 22 nt, Human
aaaguguugauaugugacaucc

SEQ ID NO: 60322 - RNA, 22 nt, Human
aaaguguugggauuacaggugu

SEQ ID NO: 60323 - RNA, 22 nt, Human
aaaguguugggauuauaggcgu

SEQ ID NO: 60324 - RNA, 22 nt, Human
aaaguguuuuccaugcaaugaa

SEQ ID NO: 60325 - RNA, 19 nt, Human
aaaguguuuucuuuucugu

SEQ ID NO: 60326 - RNA, 22 nt, Human
aaaguguuuugauuuaguggua

SEQ ID NO: 60327 - RNA, 22 nt, Human
aaaguuacacgacuauuuaugu

SEQ ID NO: 60328 - RNA, 22 nt, Human
aaaguuacaguaauucagugua

SEQ ID NO: 60329 - RNA, 22 nt, Human
aaaguuacccaaucucuaugaa

SEQ ID NO: 60330 - RNA, 22 nt, Human
aaaguuagaaugauaucaacga

SEQ ID NO: 60331 - RNA, 22 nt, Human
aaauucagauggcuuucuuuuc

SEQ ID NO: 60332 - RNA, 22 nt, Human
aaauucaguuccucagccacau

SEQ ID NO: 60333 - RNA, 22 nt, Human
aaauucauuuuucuuagugugc

SEQ ID NO: 60334 - RNA, 22 nt, Human
aaauuccaguucuuuuaccugc

SEQ ID NO: 60335 - RNA, 22 nt, Human
aaauuccauuaugauaauuucg

SEQ ID NO: 60336 - RNA, 22 nt, Human
aaauucuaugucaauguuuauu

SEQ ID NO: 60337 - RNA, 22 nt, Human
aaauucucuaaagaaaacauga

SEQ ID NO: 60338 - RNA, 22 nt, Human
aaauucuucagguaauuuugau

SEQ ID NO: 60339 - RNA, 22 nt, Human
aaauucuuucauggcuaauaag

SEQ ID NO: 60340 - RNA, 22 nt, Human
aaauucuuuggccuacuuugaa

SEQ ID NO: 60341 - RNA, 22 nt, Human
aaauugcacaauauagacauga

SEQ ID NO: 60342 - RNA, 22 nt, Human
aaauugcuaaggaucucaugug

SEQ ID NO: 60343 - RNA, 22 nt, Human
aaauugcuaguugcuuuuuuca

SEQ ID NO: 60344 - RNA, 22 nt, Human
aaauugcuguugggugacucuu

SEQ ID NO: 60345 - RNA, 22 nt, Human
aaauugcuuauaaagaugaaug

SEQ ID NO: 60346 - RNA, 22 nt, Human
aaauuguagagaucgcuuugug

SEQ ID NO: 60347 - RNA, 22 nt, Human
aaauuguaggaucacaugaccu

SEQ ID NO: 60348 - RNA, 22 nt, Human
aaauugucagaauucagaaagu

SEQ ID NO: 60349 - RNA, 23 nt, Human
aaauugucguaagguggagaugu

SEQ ID NO: 60350 - RNA, 22 nt, Human
aaauuuaagaagugugugcgug

SEQ ID NO: 60351 - RNA, 22 nt, Human
aaauuucaagcaaaguagcuau

SEQ ID NO: 60352 - RNA, 21 nt, Human
aaauuucugcaagccucaacu

SEQ ID NO: 60353 - RNA, 22 nt, Human
aaauuuuagaccaggcaaaacu

SEQ ID NO: 60354 - RNA, 22 nt, Human
aaauuuuaguaaggaaguugag

SEQ ID NO: 60355 - RNA, 22 nt, Human
aaauuuucagagcacuagagaa

SEQ ID NO: 60356 - RNA, 22 nt, Human
aacaaaagccgaaguagguguc

SEQ ID NO: 60357 - RNA, 22 nt, Human
aacaaaccuggguggagaaagg

SEQ ID NO: 60358 - RNA, 22 nt, Human
aacaaaccuucccuauacgucu

SEQ ID NO: 60359 - RNA, 22 nt, Human
aacaaacucaaauggaagagug

SEQ ID NO: 60360 - RNA, 22 nt, Human
aacaaaggccguuaauaaccac

SEQ ID NO: 60361 - RNA, 21 nt, Human
aacaaagggaugcucaucuuu

SEQ ID NO: 60362 - RNA, 22 nt, Human
aacaaagucguugccuagaaga

SEQ ID NO: 60363 - RNA, 22 nt, Human
aacaaaguuucaggaagauaga

SEQ ID NO: 60364 - RNA, 22 nt, Human
aacaaaucuuaaaguaauucaa

SEQ ID NO: 60365 - RNA, 22 nt, Human
aacaaaugaccugauuucuucc

SEQ ID NO: 60366 - RNA, 22 nt, Human
aacaaauggaacacaaaucuuu

SEQ ID NO: 60367 - RNA, 22 nt, Human
aacaaauguguggcaguguggg

SEQ ID NO: 60368 - RNA, 22 nt, Human
aacaacagugagugcugggagg

SEQ ID NO: 60369 - RNA, 22 nt, Human
aacaagaacaccuacaguucua

SEQ ID NO: 60370 - RNA, 22 nt, Human
aaauccuuuucuauacagcaua

SEQ ID NO: 60371 - RNA, 22 nt, Human
aaaucuaggccgggugcggugg

SEQ ID NO: 60372 - RNA, 22 nt, Human
aaaucucacuggcaggcaggca

SEQ ID NO: 60373 - RNA, 22 nt, Human
aaaucucacuguagucaaagug

SEQ ID NO: 60374 - RNA, 22 nt, Human
aaaucucauuauuuauaccaua

SEQ ID NO: 60375 - RNA, 22 nt, Human
aaaucucugaacuuaauaaugc

SEQ ID NO: 60376 - RNA, 22 nt, Human
aaaucuggccccuugccuauuu

SEQ ID NO: 60377 - RNA, 22 nt, Human
aaaucuguuguaauguuuuuua

SEQ ID NO: 60378 - RNA, 22 nt, Human
aaaucuuccugaaauuuguuca

SEQ ID NO: 60379 - RNA, 22 nt, Human
aaaugaacucaaugaucuccca

SEQ ID NO: 60380 - RNA, 21 nt, Human
aaaugaaugugguagugcaag

SEQ ID NO: 60381 - RNA, 22 nt, Human
aaaugacacucauucaguguca

SEQ ID NO: 60382 - RNA, 23 nt, Human
aaaugacauaugguuucugaagg

SEQ ID NO: 60383 - RNA, 22 nt, Human
aaaugacuaaugauccugggca

SEQ ID NO: 60384 - RNA, 22 nt, Human
aaaugcaaggcacauuccuuuu

SEQ ID NO: 60385 - RNA, 22 nt, Human
aaaugcaaggccaugugaagga

SEQ ID NO: 60386 - RNA, 22 nt, Human
aaaugcacaaagauuuugcacu

SEQ ID NO: 60387 - RNA, 22 nt, Human
aaaugcacaaaguaaguguaau

SEQ ID NO: 60388 - RNA, 22 nt, Human
aaaugcacagguuuuaaauccu

SEQ ID NO: 60389 - RNA, 22 nt, Human
aaaugcacgcuacccagcuaga

SEQ ID NO: 60390 - RNA, 22 nt, Human
aaaugcacucugcuucugugac

SEQ ID NO: 60391 - RNA, 22 nt, Human
aaaugcacugaauauuccaaau

SEQ ID NO: 60392 - RNA, 22 nt, Human
aaaugcagacagcuucacacac

SEQ ID NO: 60393 - RNA, 22 nt, Human
aaaugcagaucccugaaucuca

SEQ ID NO: 60394 - RNA, 22 nt, Human
aaaugcagauuuugaugcagca

SEQ ID NO: 60395 - RNA, 20 nt, Human
aaaugcagggcugcugcgga

SEQ ID NO: 60396 - RNA, 23 nt, Human
aaaugcagggucgcagguuacag

SEQ ID NO: 60397 - RNA, 22 nt, Human
aaaugcagguaguauuuauuuu

SEQ ID NO: 60398 - RNA, 22 nt, Human
aaaugcagugguucuacuucuc

SEQ ID NO: 60399 - RNA, 22 nt, Human
aaaugcaguugguggggauaug

SEQ ID NO: 60400 - RNA, 22 nt, Human
aaaugcaguuuccugagaccca

SEQ ID NO: 60401 - RNA, 22 nt, Human
aaaugcaucagcucauaagaga

SEQ ID NO: 60402 - RNA, 22 nt, Human
aaaugcaugagaaaguauucug

SEQ ID NO: 60403 - RNA, 22 nt, Human
aaaugcaugguaaaugauugcc

SEQ ID NO: 60404 - RNA, 22 nt, Human
aaaugcaugugcuauagaugug

SEQ ID NO: 60405 - RNA, 22 nt, Human
aaaugcauuucacuaauguuuc

SEQ ID NO: 60406 - RNA, 22 nt, Human
aaaugcauuuuuaauuagaccc

SEQ ID NO: 60407 - RNA, 23 nt, Human
aaaugccagggagacaggaacca

SEQ ID NO: 60408 - RNA, 22 nt, Human
aaaugccuagaaaucacgcaga

SEQ ID NO: 60409 - RNA, 22 nt, Human
aaaugccuauuuguuccuucag

SEQ ID NO: 60410 - RNA, 22 nt, Human
aaaugccucauuuucucucacu

SEQ ID NO: 60411 - RNA, 22 nt, Human
aaaugcuagggagaaacucucc

SEQ ID NO: 60412 - RNA, 22 nt, Human
aaaugcucgccuuggccgagac

SEQ ID NO: 60413 - RNA, 22 nt, Human
aaaugcucuccaaaaugaaagu

SEQ ID NO: 60414 - RNA, 23 nt, Human
aaaugcugaaucuuuacuguuua

SEQ ID NO: 60415 - RNA, 20 nt, Human
aaaugcugagaaguccuuaa

SEQ ID NO: 60416 - RNA, 22 nt, Human
aaaugcugaguguuuagagauc

SEQ ID NO: 60417 - RNA, 22 nt, Human
aaaugcugucaguguuauugga

SEQ ID NO: 60418 - RNA, 22 nt, Human
aaaugcuuguaaauuuuccaug

SEQ ID NO: 60419 - RNA, 22 nt, Human
aaaugcuuuggugcugguacag

SEQ ID NO: 60420 - RNA, 20 nt, Human
aaaugcuuuugacacauauu

SEQ ID NO: 60421 - RNA, 22 nt, Human
aaauggaagaagugcaauacug

SEQ ID NO: 60422 - RNA, 22 nt, Human
aaauggaaguguauuuaguguu

SEQ ID NO: 60423 - RNA, 19 nt, Human
aaauggagcuaaucuuguc

SEQ ID NO: 60424 - RNA, 22 nt, Human
aaauggauggaaagcaauuuuu

SEQ ID NO: 60425 - RNA, 22 nt, Human
aaauggauguugaguuaaaugu

SEQ ID NO: 60426 - RNA, 22 nt, Human
aaauggcaacagaagggaguuc

SEQ ID NO: 60427 - RNA, 22 nt, Human
aaauggcauagaggugaaggua

SEQ ID NO: 60428 - RNA, 22 nt, Human
aaauggcugacuuuucauggga

SEQ ID NO: 60429 - RNA, 23 nt, Human
aaauggcuuuagacgugccuuau

SEQ ID NO: 60430 - RNA, 22 nt, Human
aaauggcuuugaggguaggaca

SEQ ID NO: 60431 - RNA, 22 nt, Human
aaaugguaaauuaguaguagcu

SEQ ID NO: 60432 - RNA, 22 nt, Human
aaaugguaagacaacacauuau

SEQ ID NO: 60433 - RNA, 17 nt, Human
aaaugguccuagggauu

SEQ ID NO: 60434 - RNA, 22 nt, Human
aaaugguggcucuuuuaaauug

SEQ ID NO: 60435 - RNA, 22 nt, Human
aaauguacaacauccauauaua

SEQ ID NO: 60436 - RNA, 22 nt, Human
aaauguacacuuugcaucuuga

SEQ ID NO: 60437 - RNA, 22 nt, Human
aaauguacgggaguagaauuag

SEQ ID NO: 60438 - RNA, 22 nt, Human
aaauguacugauacuuauuuua

SEQ ID NO: 60439 - RNA, 18 nt, Human
aaauguacuguccauggc

SEQ ID NO: 60440 - RNA, 22 nt, Human
aaauguaguugaaaaguuaagg

SEQ ID NO: 60441 - RNA, 22 nt, Human
aaaugucagaaaacauggagug

SEQ ID NO: 60442 - RNA, 22 nt, Human
aaaugucagagcuggaaggggc

SEQ ID NO: 60443 - RNA, 22 nt, Human
aaaugucagaggaacauauuga

SEQ ID NO: 60444 - RNA, 22 nt, Human
aaauguccauugaauggaugag

SEQ ID NO: 60445 - RNA, 22 nt, Human
aaaugucuacuccuguguuuau

SEQ ID NO: 60446 - RNA, 22 nt, Human
aacuacuaccaguaguaguagu

SEQ ID NO: 60447 - RNA, 22 nt, Human
aacuacucaacucugccauugu

SEQ ID NO: 60448 - RNA, 22 nt, Human
aacuagaaaaagacuuucugag

SEQ ID NO: 60449 - RNA, 22 nt, Human
aacuagaaaacaagaugcugau

SEQ ID NO: 60450 - RNA, 22 nt, Human
aacuagaaagaacauauuucca

SEQ ID NO: 60451 - RNA, 22 nt, Human
aacuagaaaucacuacagguau

SEQ ID NO: 60452 - RNA, 22 nt, Human
aacuagaacgagaaagcugaac

SEQ ID NO: 60453 - RNA, 22 nt, Human
aacuagaacgucuaguugcugg

SEQ ID NO: 60454 - RNA, 22 nt, Human
aacuagcuggauuaguguuuuc

SEQ ID NO: 60455 - RNA, 22 nt, Human
aacuagucagugauucucagaa

SEQ ID NO: 60456 - RNA, 22 nt, Human
aacucaaagaugcaugacgcuu

SEQ ID NO: 60457 - RNA, 22 nt, Human
aacucauucuaaguauaccaaa

SEQ ID NO: 60458 - RNA, 22 nt, Human
aacuccagggcauugucuccug

SEQ ID NO: 60459 - RNA, 22 nt, Human
aacuccagggucaccauucaca

SEQ ID NO: 60460 - RNA, 21 nt, Human
aacucccagugccuucccagc

SEQ ID NO: 60461 - RNA, 20 nt, Human
aacuccuagccucaagugau

SEQ ID NO: 60462 - RNA, 22 nt, Human
aacucucauuuuagguguaagg

SEQ ID NO: 60463 - RNA, 22 nt, Human
aacucucucuggcucccagcaa

SEQ ID NO: 60464 - RNA, 22 nt, Human
aacucucuuuagagagggacaa

SEQ ID NO: 60465 - RNA, 22 nt, Human
aacucuggagcacgcccuggcc

SEQ ID NO: 60466 - RNA, 22 nt, Human
aacucuuaauuuucaugaaaug

SEQ ID NO: 60467 - RNA, 22 nt, Human
aacucuugaauucccuugaaga

SEQ ID NO: 60468 - RNA, 22 nt, Human
aacugaaaucaaucagugauuc

SEQ ID NO: 60469 - RNA, 22 nt, Human
aacugaacagcaggcuucuacc

SEQ ID NO: 60470 - RNA, 22 nt, Human
aacugaacugauaacauacacg

SEQ ID NO: 60471 - RNA, 22 nt, Human
aacugaauuuuaaauacaggcc

SEQ ID NO: 60472 - RNA, 21 nt, Human
aacugagaccagcuaaagugg

SEQ ID NO: 60473 - RNA, 22 nt, Human
aacugaggucuccagugcagaa

SEQ ID NO: 60474 - RNA, 22 nt, Human
aacugauuguuggaugauagug

SEQ ID NO: 60475 - RNA, 22 nt, Human
aacugcaaagccaaucucagga

SEQ ID NO: 60476 - RNA, 21 nt, Human
aacugcaaaucuuagacugca

SEQ ID NO: 60477 - RNA, 22 nt, Human
aacugcaacuuguuugauucuu

SEQ ID NO: 60478 - RNA, 22 nt, Human
aacugcaagcucuuuacugcua

SEQ ID NO: 60479 - RNA, 22 nt, Human
aacaucugaaaaggcuucacuc

SEQ ID NO: 60480 - RNA, 22 nt, Human
aacaucugaucgaacagugcca

SEQ ID NO: 60481 - RNA, 22 nt, Human
aacaucugugaacuccgaaaau

SEQ ID NO: 60482 - RNA, 22 nt, Human
aacaucuguguuugaaucucaa

SEQ ID NO: 60483 - RNA, 22 nt, Human
aacaucuuugccaaauugcuau

SEQ ID NO: 60484 - RNA, 19 nt, Human
aacaugacagccacucugg

SEQ ID NO: 60485 - RNA, 22 nt, Human
aacaugaugacauuguaagcuu

SEQ ID NO: 60486 - RNA, 22 nt, Human
aacaugauguauuuucuugucu

SEQ ID NO: 60487 - RNA, 22 nt, Human
aacaugaugugaagcaugaacu

SEQ ID NO: 60488 - RNA, 22 nt, Human
aacaugauuucaugcauuuaga

SEQ ID NO: 60489 - RNA, 22 nt, Human
aacaugcagguuuuaggguugc

SEQ ID NO: 60490 - RNA, 22 nt, Human
aacaugcauauagguaaaugga

SEQ ID NO: 60491 - RNA, 22 nt, Human
aacaugcauguuauuuaucagu

SEQ ID NO: 60492 - RNA, 22 nt, Human
aacaugcucuggauugcuguga

SEQ ID NO: 60493 - RNA, 22 nt, Human
aacauggaggcagacagacgug

SEQ ID NO: 60494 - RNA, 22 nt, Human
aacaugucuuacuuugcuuucu

SEQ ID NO: 60495 - RNA, 22 nt, Human
aacaugugagcagguuuuuuau

SEQ ID NO: 60496 - RNA, 22 nt, Human
aacauguuuccaguguaaggcc

SEQ ID NO: 60497 - RNA, 22 nt, Human
aacauuaagauggcggaacagu

SEQ ID NO: 60498 - RNA, 22 nt, Human
aacauuagauuuguuuuucuag

SEQ ID NO: 60499 - RNA, 22 nt, Human
aacauucaauugaggaaguuaa

SEQ ID NO: 60500 - RNA, 22 nt, Human
aacauucaccucuaccuccuuc

SEQ ID NO: 60501 - RNA, 22 nt, Human
aacauucagcugaugggucaua

SEQ ID NO: 60502 - RNA, 22 nt, Human
aacauucuaugugcauucagaa

SEQ ID NO: 60503 - RNA, 20 nt, Human
aacauugaaagucuagaaga

SEQ ID NO: 60504 - RNA, 22 nt, Human
aacauugaacuuggcacaccca

SEQ ID NO: 60505 - RNA, 22 nt, Human
aacauugagaaacauugggaua

SEQ ID NO: 60506 - RNA, 21 nt, Human
aacauugauucauuuggcuau

SEQ ID NO: 60507 - RNA, 22 nt, Human
aacauugauugcaucuguucac

SEQ ID NO: 60508 - RNA, 20 nt, Human
aacauugcuucaauguaacc

SEQ ID NO: 60509 - RNA, 21 nt, Human
aacauugguucaaauaaaacu

SEQ ID NO: 60510 - RNA, 22 nt, Human
aacauuuacaaauccuucugca

SEQ ID NO: 60511 - RNA, 22 nt, Human
aacauuuaggaaggaccuccuc

SEQ ID NO: 60512 - RNA, 22 nt, Human
aacauuuaugauugagguaaau

SEQ ID NO: 60513 - RNA, 22 nt, Human
aacauuuaugguagucauugca

SEQ ID NO: 60514 - RNA, 22 nt, Human
aacauuuauugagcaccuacug

SEQ ID NO: 60515 - RNA, 22 nt, Human
aacauuucugagaauaucaguu

SEQ ID NO: 60516 - RNA, 22 nt, Human
aacauuugaaaaucaagaaucu

SEQ ID NO: 60517 - RNA, 20 nt, Human
aacauuuguagucaggcaca

SEQ ID NO: 60518 - RNA, 22 nt, Human
aacauuuguguuugcuaaaaau

SEQ ID NO: 60519 - RNA, 22 nt, Human
aacauuuuuaagaccaagugcu

SEQ ID NO: 60520 - RNA, 22 nt, Human
aaccaaagaaaacuguggugag

SEQ ID NO: 60521 - RNA, 22 nt, Human
aaccaaauggaugguaagaggg

SEQ ID NO: 60522 - RNA, 22 nt, Human
aaccaagaggguuuuccuugaa

SEQ ID NO: 60523 - RNA, 22 nt, Human
aaccaagcucaauggucugagu

SEQ ID NO: 60524 - RNA, 22 nt, Human
aaccaauuuaaauauaaagacu

SEQ ID NO: 60525 - RNA, 21 nt, Human
aaccacauggauuagucagag

SEQ ID NO: 60526 - RNA, 22 nt, Human
aaccacauggcucaguggacau

SEQ ID NO: 60527 - RNA, 22 nt, Human
aaccaccaccguaauuuaccca

SEQ ID NO: 60528 - RNA, 21 nt, Human
aaccagagccaggcucucagc

SEQ ID NO: 60529 - RNA, 22 nt, Human
aaccagaggcagcaguaccuga

SEQ ID NO: 60530 - RNA, 22 nt, Human
aaccagagugacacucuacaga

SEQ ID NO: 60531 - RNA, 22 nt, Human
aaccagcuaacauguggaauga

SEQ ID NO: 60532 - RNA, 17 nt, Human
aaccagcuguccccucc

SEQ ID NO: 60533 - RNA, 22 nt, Human
aaccagugaaacaccaggcaag

SEQ ID NO: 60534 - RNA, 22 nt, Human
aaccaguuucaaagaaaauugc

SEQ ID NO: 60535 - RNA, 22 nt, Human
aaccaugaauggguucuggugu

SEQ ID NO: 60536 - RNA, 22 nt, Human
aaccaugucuuguuuuccuagu

SEQ ID NO: 60537 - RNA, 22 nt, Human
aaccauuugcaguuacugagac

SEQ ID NO: 60538 - RNA, 22 nt, Human
aacccacaaaggauuucagcuc

SEQ ID NO: 60539 - RNA, 16 nt, Human
aacccacagcucccga

SEQ ID NO: 60540 - RNA, 22 nt, Human
aacccagaaacgcaggcgguca

SEQ ID NO: 60541 - RNA, 22 nt, Human
aacccaggucuuuggcuuccag

SEQ ID NO: 60542 - RNA, 22 nt, Human
aacccuggcccuggaauaggca

SEQ ID NO: 60543 - RNA, 22 nt, Human
aacccugggucggcaccauuuu

SEQ ID NO: 60544 - RNA, 22 nt, Human
aaccuagaaguuagaguaucau

SEQ ID NO: 60545 - RNA, 22 nt, Human
aaccuagacagggccucuguua

SEQ ID NO: 60546 - RNA, 22 nt, Human
aaccuagaguugccuuuuuuaa

SEQ ID NO: 60547 - RNA, 22 nt, Human
aaccucgaaugccuuccugagg

SEQ ID NO: 60548 - RNA, 16 nt, Human
aaccucucuacugugg

SEQ ID NO: 60549 - RNA, 22 nt, Human
aaccugaauuacuuuugcacca

SEQ ID NO: 60550 - RNA, 21 nt, Human
aaccugagacccacgggacua

SEQ ID NO: 60551 - RNA, 22 nt, Human
aaccuggaccuuuuggguauug

SEQ ID NO: 60552 - RNA, 22 nt, Human
aaccuggagugcugguuucacu

SEQ ID NO: 60553 - RNA, 22 nt, Human
aaccuggccccagauuccccau

SEQ ID NO: 60554 - RNA, 22 nt, Human
aaccuguuuugauuaacaagua

SEQ ID NO: 60555 - RNA, 19 nt, Human
aaccuuagcuucucaggcc

SEQ ID NO: 60556 - RNA, 22 nt, Human
aaccuucuugugcagaacugua

SEQ ID NO: 60557 - RNA, 22 nt, Human
aacguccucaccuguaacuugg

SEQ ID NO: 60558 - RNA, 22 nt, Human
aacgucuucucuccaaguaaau

SEQ ID NO: 60559 - RNA, 22 nt, Human
aacuacaauauguauguaugua

SEQ ID NO: 60560 - RNA, 22 nt, Human
aacuacagaaaagguaagcucu

SEQ ID NO: 60561 - RNA, 22 nt, Human
aacuacagaaucauagaaaaua

SEQ ID NO: 60562 - RNA, 22 nt, Human
aacuacagcaucuauacaaaua

SEQ ID NO: 60563 - RNA, 19 nt, Human
aacuacagcgcacuguccu

SEQ ID NO: 60564 - RNA, 22 nt, Human
aacuacauagaaauuaguauuu

SEQ ID NO: 60565 - RNA, 22 nt, Human
aacuacuaccacagucaagaca

SEQ ID NO: 60566 - RNA, 22 nt, Human
aacuagaaccugcauuuuaaca

SEQ ID NO: 60567 - RNA, 22 nt, Human
aacucagcauccugcacagaga

SEQ ID NO: 60568 - RNA, 22 nt, Human
aacucauuugcauuuuuccugu

SEQ ID NO: 60569 - RNA, 22 nt, Human
aacuccagacuacuaauuuagu

SEQ ID NO: 60570 - RNA, 22 nt, Human
aacuccagcaggaaggugagaa

SEQ ID NO: 60571 - RNA, 22 nt, Human
aacuccaggcagggaggccacu

SEQ ID NO: 60572 - RNA, 22 nt, Human
aacuccagggggucaauauuua

SEQ ID NO: 60573 - RNA, 22 nt, Human
aacuccagguccuuugaaucug

SEQ ID NO: 60574 - RNA, 22 nt, Human
aacuccaugguucucagauucu

SEQ ID NO: 60575 - RNA, 22 nt, Human
aacuccucucuggugguucguc

SEQ ID NO: 60576 - RNA, 22 nt, Human
aacuccugaggaaauggucuca

SEQ ID NO: 60577 - RNA, 22 nt, Human
aacucuacuugggacuccucug

SEQ ID NO: 60578 - RNA, 22 nt, Human
aacucuauuuacccuacuaaac

SEQ ID NO: 60579 - RNA, 22 nt, Human
aacucucuugggaguaccugga

SEQ ID NO: 60580 - RNA, 22 nt, Human
aacucugauuagcucaaguuaa

SEQ ID NO: 60581 - RNA, 22 nt, Human
aacucugguucagugauuucag

SEQ ID NO: 60582 - RNA, 22 nt, Human
aacucuguguaggaaccagguc

SEQ ID NO: 60583 - RNA, 22 nt, Human
aacucuuaaaauuuuggcuugc

SEQ ID NO: 60584 - RNA, 22 nt, Human
aacugaaaccaaacacuuuagg

SEQ ID NO: 60585 - RNA, 22 nt, Human
aacugaaacggugaucuuuuaa

SEQ ID NO: 60586 - RNA, 22 nt, Human
aacugacagcaggaaccauucc

SEQ ID NO: 60587 - RNA, 22 nt, Human
aacugagggcccugcugaagca

SEQ ID NO: 60588 - RNA, 20 nt, Human
aacuuuagacauaaucucuu

SEQ ID NO: 60589 - RNA, 22 nt, Human
aacuuucagaauccuaugcauu

SEQ ID NO: 60590 - RNA, 22 nt, Human
aacuuucuaauuuuggcugagc

SEQ ID NO: 60591 - RNA, 22 nt, Human
aacuuucuggcuuuggggagag

SEQ ID NO: 60592 - RNA, 23 nt, Human
aacuuugccaggagacagcacag

SEQ ID NO: 60593 - RNA, 22 nt, Human
aacuuugcuugggucaaacuca

SEQ ID NO: 60594 - RNA, 22 nt, Human
aacuuuggccacaaguacccug

SEQ ID NO: 60595 - RNA, 22 nt, Human
aacuuuuaaaauacacagacaa

SEQ ID NO: 60596 - RNA, 22 nt, Human
aacuuuucacaggcuagcucuu

SEQ ID NO: 60597 - RNA, 22 nt, Human
aagaaaacguuuugaggaguuu

SEQ ID NO: 60598 - RNA, 22 nt, Human
aagaaaagaaaccugaggcuuu

SEQ ID NO: 60599 - RNA, 22 nt, Human
aagaaacaaccacugcucuccu

SEQ ID NO: 60600 - RNA, 22 nt, Human
aagaaacucacuuugggaggca

SEQ ID NO: 60601 - RNA, 22 nt, Human
aagaaacuggaauauagagagc

SEQ ID NO: 60602 - RNA, 22 nt, Human
aagaaagauaagguuugcuugg

SEQ ID NO: 60603 - RNA, 22 nt, Human
aagaaagcauuagacaggcauu

SEQ ID NO: 60604 - RNA, 22 nt, Human
aagaaagcugaauauucugugu

SEQ ID NO: 60605 - RNA, 22 nt, Human
aagaaaggauauaugggaggua

SEQ ID NO: 60606 - RNA, 22 nt, Human
aagaaagugcuuuguaaauuau

SEQ ID NO: 60607 - RNA, 22 nt, Human
aagaaauaagacuucucugucc

SEQ ID NO: 60608 - RNA, 22 nt, Human
aagaaaucagaaaagcauucgu

SEQ ID NO: 60609 - RNA, 22 nt, Human
aagaaauguagagccuaguaaa

SEQ ID NO: 60610 - RNA, 22 nt, Human
aagaaaugugaauauugaauag

SEQ ID NO: 60611 - RNA, 22 nt, Human
aagaacagguucuagaaccauu

SEQ ID NO: 60612 - RNA, 22 nt, Human
aagaacauaaacagaaggacag

SEQ ID NO: 60613 - RNA, 22 nt, Human
aagaacaugaacacaauguuua

SEQ ID NO: 60614 - RNA, 22 nt, Human
aagaacaugguaggauaacaaa

SEQ ID NO: 60615 - RNA, 22 nt, Human
aagaacauuuaugauggcauuu

SEQ ID NO: 60616 - RNA, 22 nt, Human
aagaacuaucucuggcuguagg

SEQ ID NO: 60617 - RNA, 19 nt, Human
aagaacuaugugauuacag

SEQ ID NO: 60618 - RNA, 22 nt, Human
aagaacugguuauguuaucuug

SEQ ID NO: 60619 - RNA, 22 nt, Human
aagaacuguuuacaauuuucac

SEQ ID NO: 60620 - RNA, 22 nt, Human
aagaacuuuuggcaaguguuau

SEQ ID NO: 60621 - RNA, 22 nt, Human
aagaagaaguguuauuuuuaga

SEQ ID NO: 60622 - RNA, 22 nt, Human
aagaagagaacuggcauccuaa

SEQ ID NO: 60623 - RNA, 22 nt, Human
aagaagaugguuaacuuucagu

SEQ ID NO: 60624 - RNA, 22 nt, Human
aagaagcacuuuccuacauguu

SEQ ID NO: 60625 - RNA, 22 nt, Human
aagaagcaugagaagauuuuau

SEQ ID NO: 60626 - RNA, 22 nt, Human
aagaagcauggcuguagauucc

SEQ ID NO: 60627 - RNA, 22 nt, Human
aagaaggcuucagagcccagga

SEQ ID NO: 60628 - RNA, 22 nt, Human
aagaagucuggagcaaugcaau

SEQ ID NO: 60629 - RNA, 22 nt, Human
aagaagugguccuuuucuuucu

SEQ ID NO: 60630 - RNA, 22 nt, Human
aagaagugguuggaagaagcau

SEQ ID NO: 60631 - RNA, 23 nt, Human
aagaaguuaccuaaaguuguacu

SEQ ID NO: 60632 - RNA, 22 nt, Human
aagaaguuagguguaacaauau

SEQ ID NO: 60633 - RNA, 23 nt, Human
aagaauaaaugacauuaaaggug

SEQ ID NO: 60634 - RNA, 22 nt, Human
aagaauaaauuaagauacuuag

SEQ ID NO: 60635 - RNA, 22 nt, Human
aagaauaagaggauuuagaaca

SEQ ID NO: 60636 - RNA, 22 nt, Human
aagaaucauagagccacugaua

SEQ ID NO: 60637 - RNA, 22 nt, Human
aagaaucauccugcaagagucu

SEQ ID NO: 60638 - RNA, 22 nt, Human
aagaaucauuguaaaguucugu

SEQ ID NO: 60639 - RNA, 22 nt, Human
aagaaucuaugguacauccaag

SEQ ID NO: 60640 - RNA, 15 nt, Human
aagaaucugaagcuu

SEQ ID NO: 60641 - RNA, 22 nt, Human
aagaaucuuaauccagaaaccu

SEQ ID NO: 60642 - RNA, 22 nt, Human
aagaaugaaggauuuagcuguu

SEQ ID NO: 60643 - RNA, 23 nt, Human
aagaaugcuucugaagagcugcc

SEQ ID NO: 60644 - RNA, 22 nt, Human
aagaaugucaagcagaaggucu

SEQ ID NO: 60645 - RNA, 22 nt, Human
aagaauguucaacgcuuuuuug

SEQ ID NO: 60646 - RNA, 22 nt, Human
aagaauugaugugaauugcagc

SEQ ID NO: 60647 - RNA, 22 nt, Human
aagaauugguuuccucugucau

SEQ ID NO: 60648 - RNA, 22 nt, Human
aagaauuuuccagcaugucagu

SEQ ID NO: 60649 - RNA, 22 nt, Human
aagacaagccuuguuuuucugc

SEQ ID NO: 60650 - RNA, 22 nt, Human
aagacaauauugcugugaacgu

SEQ ID NO: 60651 - RNA, 22 nt, Human
aagacaaugaguccugauggga

SEQ ID NO: 60652 - RNA, 22 nt, Human
aagacaauguuucugauagaua

SEQ ID NO: 60653 - RNA, 22 nt, Human
aagacaauuuauguuaggguca

SEQ ID NO: 60654 - RNA, 22 nt, Human
aagacaauuuugaguaugcaca

SEQ ID NO: 60655 - RNA, 22 nt, Human
aagacagaccacgugacagggc

SEQ ID NO: 60656 - RNA, 22 nt, Human
aagacagcacuggcauuuucaa

SEQ ID NO: 60657 - RNA, 22 nt, Human
aagacagcagcaccucucguuu

SEQ ID NO: 60658 - RNA, 22 nt, Human
aagacagccuuucccuggugcc

SEQ ID NO: 60659 - RNA, 22 nt, Human
aagacagcucaggacagauuca

SEQ ID NO: 60660 - RNA, 22 nt, Human
aagacagugacagucacaauug

SEQ ID NO: 60661 - RNA, 22 nt, Human
aagacaugcaguuuguuccauu

SEQ ID NO: 60662 - RNA, 22 nt, Human
aagacauguuuuaagaauauuu

SEQ ID NO: 60663 - RNA, 22 nt, Human
aagacauucacaaauguucacu

SEQ ID NO: 60664 - RNA, 22 nt, Human
aagacauuccaaaguggcuaau

SEQ ID NO: 60665 - RNA, 22 nt, Human
aagaccauuuaauggagaaaga

SEQ ID NO: 60666 - RNA, 17 nt, Human
aagacccuagucuaccc

SEQ ID NO: 60667 - RNA, 22 nt, Human
aagacgcacccuuugagggcac

SEQ ID NO: 60668 - RNA, 22 nt, Human
aagacuaaauguguucuaaagu

SEQ ID NO: 60669 - RNA, 22 nt, Human
aagacucuguaucaugagggag

SEQ ID NO: 60670 - RNA, 22 nt, Human
aagacuuucucccaaauccuca

SEQ ID NO: 60671 - RNA, 22 nt, Human
aagacuuucugggguguaaagg

SEQ ID NO: 60672 - RNA, 22 nt, Human
aagagaaagcagacuuugucau

SEQ ID NO: 60673 - RNA, 22 nt, Human
aagagaagaaagugucuacaca

SEQ ID NO: 60674 - RNA, 22 nt, Human
aagagaauacaagcaggcagga

SEQ ID NO: 60675 - RNA, 22 nt, Human
aagagacuucuagauuuguuga

SEQ ID NO: 60676 - RNA, 22 nt, Human
aagagagaccaugggggacagg

SEQ ID NO: 60677 - RNA, 22 nt, Human
aagagagggacuuauuaaaguc

SEQ ID NO: 60678 - RNA, 22 nt, Human
aagagaugauggcagccagagg

SEQ ID NO: 60679 - RNA, 22 nt, Human
aagagauguggaaucauuuaca

SEQ ID NO: 60680 - RNA, 22 nt, Human
aagagauuaaaguaacuugccu

SEQ ID NO: 60681 - RNA, 22 nt, Human
aagagcaacuuggaaacacuca

SEQ ID NO: 60682 - RNA, 22 nt, Human
aagagcacuaacagagcugaua

SEQ ID NO: 60683 - RNA, 22 nt, Human
aagagcagccuccaggggugga

SEQ ID NO: 60684 - RNA, 22 nt, Human
aagagcaggcugucaauggggc

SEQ ID NO: 60685 - RNA, 22 nt, Human
aagagcauauuaauaguggaga

SEQ ID NO: 60686 - RNA, 22 nt, Human
aagagcaucuauuucacagugg

SEQ ID NO: 60687 - RNA, 22 nt, Human
aagagcauggaauggagaucca

SEQ ID NO: 60688 - RNA, 22 nt, Human
aagagccaagcagucaucaaua

SEQ ID NO: 60689 - RNA, 22 nt, Human
aagagcccuuguucauaauuau

SEQ ID NO: 60690 - RNA, 22 nt, Human
aagagccucuguguuucagccu

SEQ ID NO: 60691 - RNA, 23 nt, Human
aagagcuauacauucaccuggua

SEQ ID NO: 60692 - RNA, 22 nt, Human
aagagcuggaguuugcagcccu

SEQ ID NO: 60693 - RNA, 22 nt, Human
aagaggacaguauucaauauga

SEQ ID NO: 60694 - RNA, 23 nt, Human
aagaggaggcccugcucccgucc

SEQ ID NO: 60695 - RNA, 19 nt, Human
aagaggcaacccucgagcc

SEQ ID NO: 60696 - RNA, 21 nt, Human
aagaggcaucacuauuugugu

SEQ ID NO: 60697 - RNA, 22 nt, Human
aagcuuugcaccgguggcugga

SEQ ID NO: 60698 - RNA, 22 nt, Human
aagcuuugggcagaagaggauu

SEQ ID NO: 60699 - RNA, 22 nt, Human
aagcuuuguccaaggccaugca

SEQ ID NO: 60700 - RNA, 22 nt, Human
aagcuuuuauuaaaaucuugcc

SEQ ID NO: 60701 - RNA, 22 nt, Human
aagcuuuucucaguguccuugg

SEQ ID NO: 60702 - RNA, 22 nt, Human
aagcuuuuuggauuugcuucag

SEQ ID NO: 60703 - RNA, 22 nt, Human
aaggaaauagaugcagauggua

SEQ ID NO: 60704 - RNA, 22 nt, Human
aaggaaaugagguugauggaug

SEQ ID NO: 60705 - RNA, 19 nt, Human
aaggaacccuggguugcuc

SEQ ID NO: 60706 - RNA, 22 nt, Human
aaggaacucacagucuguuggg

SEQ ID NO: 60707 - RNA, 22 nt, Human
aaggaacugaugcucaaagaau

SEQ ID NO: 60708 - RNA, 22 nt, Human
aaggaacuuggugcccgugccc

SEQ ID NO: 60709 - RNA, 22 nt, Human
aaggaacuuugcagaggugauu

SEQ ID NO: 60710 - RNA, 22 nt, Human
aaggaagacacagaugaaguga

SEQ ID NO: 60711 - RNA, 22 nt, Human
aaggaagagaauccuucucaga

SEQ ID NO: 60712 - RNA, 22 nt, Human
aaggaagagucuagaacaggca

SEQ ID NO: 60713 - RNA, 22 nt, Human
aaggaagcagcaaugcaugauu

SEQ ID NO: 60714 - RNA, 22 nt, Human
aaggaagggaaauagugauguc

SEQ ID NO: 60715 - RNA, 22 nt, Human
aaggaagguacucagugauucu

SEQ ID NO: 60716 - RNA, 22 nt, Human
aaggaagugauuuucaugucaa

SEQ ID NO: 60717 - RNA, 22 nt, Human
aaggaaguuaagucuuagaaug

SEQ ID NO: 60718 - RNA, 20 nt, Human
aaggaauauuuguaucuggg

SEQ ID NO: 60719 - RNA, 17 nt, Human
aaggaaugucagaaguu

SEQ ID NO: 60720 - RNA, 22 nt, Human
aaggaauucaaauuuucucugg

SEQ ID NO: 60721 - RNA, 22 nt, Human
aaggacaaguaguauuugcauc

SEQ ID NO: 60722 - RNA, 19 nt, Human
aaggacacaacagagauag

SEQ ID NO: 60723 - RNA, 22 nt, Human
aaggacagaaacagauugcugg

SEQ ID NO: 60724 - RNA, 22 nt, Human
aaggacaggcacagugguggag

SEQ ID NO: 60725 - RNA, 22 nt, Human
aaggacaggcuaaccugacauu

SEQ ID NO: 60726 - RNA, 22 nt, Human
aaggaccuauauugucagagga

SEQ ID NO: 60727 - RNA, 22 nt, Human
aaggaccugauuuugagcaucu

SEQ ID NO: 60728 - RNA, 21 nt, Human
aaggacgagguuuugauuaca

SEQ ID NO: 60729 - RNA, 22 nt, Human
aaggacucuccagcuagcaaau

SEQ ID NO: 60730 - RNA, 22 nt, Human
aaggacugacaaaugucuuccu

SEQ ID NO: 60731 - RNA, 22 nt, Human
aaggacuggcauuaucuuaugu

SEQ ID NO: 60732 - RNA, 22 nt, Human
aaggacugucuaaggccuccaa

SEQ ID NO: 60733 - RNA, 22 nt, Human
aaggagaaaugguagaugugca

SEQ ID NO: 60734 - RNA, 22 nt, Human
aaggagaaggguaaucaacaca

SEQ ID NO: 60735 - RNA, 22 nt, Human
aaggagaauuuggcuugugaug

SEQ ID NO: 60736 - RNA, 22 nt, Human
aaggagcuuguucgccuuccuc

SEQ ID NO: 60737 - RNA, 22 nt, Human
aaggaggagugggguccuggaa

SEQ ID NO: 60738 - RNA, 22 nt, Human
aaggaggcagaacucacaugga

SEQ ID NO: 60739 - RNA, 22 nt, Human
aaggaggcccucuccuucugga

SEQ ID NO: 60740 - RNA, 22 nt, Human
aaggaggccuggcagaugaaga

SEQ ID NO: 60741 - RNA, 16 nt, Human
aaggagggaagagaau

SEQ ID NO: 60742 - RNA, 22 nt, Human
aaggaggguucccagguccugg

SEQ ID NO: 60743 - RNA, 22 nt, Human
aaggagugauauaugggugcua

SEQ ID NO: 60744 - RNA, 22 nt, Human
aaggagugcaugacucagagua

SEQ ID NO: 60745 - RNA, 22 nt, Human
aaggaguuuggguagucauaca

SEQ ID NO: 60746 - RNA, 22 nt, Human
aaggaucaaguggauuuucuua

SEQ ID NO: 60747 - RNA, 22 nt, Human
aaggaucuuucuuuuuaccauu

SEQ ID NO: 60748 - RNA, 22 nt, Human
aaggaugaacauuaauacauca

SEQ ID NO: 60749 - RNA, 22 nt, Human
aaggauugucuggcuauuuaug

SEQ ID NO: 60750 - RNA, 22 nt, Human
aaggcaaugaauacuguuuuug

SEQ ID NO: 60751 - RNA, 22 nt, Human
aaggcaaugggauggaucaugu

SEQ ID NO: 60752 - RNA, 22 nt, Human
aaggcaauugauuauuuuuccu

SEQ ID NO: 60753 - RNA, 22 nt, Human
aaggcaauuucagggcucucua

SEQ ID NO: 60754 - RNA, 22 nt, Human
aaggcacagaggcagggcacuu

SEQ ID NO: 60755 - RNA, 17 nt, Human
aaggcacagggcacugg

SEQ ID NO: 60756 - RNA, 22 nt, Human
aaggcacaugaccuaggccugg

SEQ ID NO: 60757 - RNA, 22 nt, Human
aaggcaccauugucaacgguaa

SEQ ID NO: 60758 - RNA, 22 nt, Human
aaggcacuacgcugcuggggcg

SEQ ID NO: 60759 - RNA, 22 nt, Human
aaggcacuagcaagcugccugg

SEQ ID NO: 60760 - RNA, 22 nt, Human
aaggcacuuaacgugggaggau

SEQ ID NO: 60761 - RNA, 22 nt, Human
aaggcacuugcccagagcugca

SEQ ID NO: 60762 - RNA, 22 nt, Human
aaggcacuuuuccugagaugau

SEQ ID NO: 60763 - RNA, 22 nt, Human
aaggcacuuuucuaaagaccuu

SEQ ID NO: 60764 - RNA, 22 nt, Human
aaggcagaaauucaacuacugg

SEQ ID NO: 60765 - RNA, 22 nt, Human
aaggcagagggcuggaucagag

SEQ ID NO: 60766 - RNA, 22 nt, Human
aaggcagagucuaucuuggaag

SEQ ID NO: 60767 - RNA, 20 nt, Human
aaggcagaguggguuggagc

SEQ ID NO: 60768 - RNA, 22 nt, Human
aaggcagcaggauuuggugacu

SEQ ID NO: 60769 - RNA, 19 nt, Human
aaggcagcaguagcaucca

SEQ ID NO: 60770 - RNA, 22 nt, Human
aaggcagcagugcacgacugau

SEQ ID NO: 60771 - RNA, 22 nt, Human
aaggcagcuuuaaaaaagaugc

SEQ ID NO: 60772 - RNA, 22 nt, Human
aaggcaguaaaaucuaccuugc

SEQ ID NO: 60773 - RNA, 22 nt, Human
aaggcaguagguguuucaaacu

SEQ ID NO: 60774 - RNA, 22 nt, Human
aaggcagucugguuucaaagca

SEQ ID NO: 60775 - RNA, 22 nt, Human
aaggcaguggcuggaaaaccug

SEQ ID NO: 60776 - RNA, 22 nt, Human
aaggcagugguugugauacugu

SEQ ID NO: 60777 - RNA, 22 nt, Human
aaggcauacauauuguuauagg

SEQ ID NO: 60778 - RNA, 22 nt, Human
aaggcauaccugaauguuugug

SEQ ID NO: 60779 - RNA, 22 nt, Human
aaggcauauauucuaaacagga

SEQ ID NO: 60780 - RNA, 22 nt, Human
aaggcauaugcauagaagacag

SEQ ID NO: 60781 - RNA, 22 nt, Human
aaggcauaugcuguguacaguu

SEQ ID NO: 60782 - RNA, 22 nt, Human
aaggcaucuggauggaggagga

SEQ ID NO: 60783 - RNA, 22 nt, Human
aaggcaugaaagcgaaaugaga

SEQ ID NO: 60784 - RNA, 22 nt, Human
aaggcauguguccucagagaga

SEQ ID NO: 60785 - RNA, 22 nt, Human
aaggcauucaagauggaaguug

SEQ ID NO: 60786 - RNA, 23 nt, Human
aaggcauuggcuucucucauuuc

SEQ ID NO: 60787 - RNA, 22 nt, Human
aaggccaaagacaccuacacag

SEQ ID NO: 60788 - RNA, 22 nt, Human
aaggccacuuuaccuuaaaucc

SEQ ID NO: 60789 - RNA, 23 nt, Human
aaggccagaauuucaauggugcc

SEQ ID NO: 60790 - RNA, 23 nt, Human
aaggccagagagaggcuaguguc

SEQ ID NO: 60791 - RNA, 22 nt, Human
aaggccagaguacuagaggcug

SEQ ID NO: 60792 - RNA, 22 nt, Human
aaggccagcgcagaccauuguc

SEQ ID NO: 60793 - RNA, 22 nt, Human
aaggccaggagacuuggaguca

SEQ ID NO: 60794 - RNA, 22 nt, Human
aaggccaggucccugcagugca

SEQ ID NO: 60795 - RNA, 22 nt, Human
aaggccauuauucugauauauu

SEQ ID NO: 60796 - RNA, 17 nt, Human
aaggccauuuccaccca

SEQ ID NO: 60797 - RNA, 22 nt, Human
aaggcccacagaacugucucca

SEQ ID NO: 60798 - RNA, 22 nt, Human
aaggcccagcgugaccucagug

SEQ ID NO: 60799 - RNA, 22 nt, Human
aaggcccaggcugcccugggca

SEQ ID NO: 60800 - RNA, 22 nt, Human
aaggcccuagaaucuauauugc

SEQ ID NO: 60801 - RNA, 22 nt, Human
aaggcccuucggcuuccucagc

SEQ ID NO: 60802 - RNA, 22 nt, Human
aaggcccuuggaaaaugcagua

SEQ ID NO: 60803 - RNA, 22 nt, Human
aaggccucaggugaggcugccc

SEQ ID NO: 60804 - RNA, 22 nt, Human
aaggccuccgccaauggcagag

SEQ ID NO: 60805 - RNA, 22 nt, Human
aaggccugcucagcugucugug

SEQ ID NO: 60806 - RNA, 22 nt, Human
auaauucaugggccuuucaccu

SEQ ID NO: 60807 - RNA, 22 nt, Human
auaauucuccaauuuuuguugu

SEQ ID NO: 60808 - RNA, 23 nt, Human
auacaaaccuugcaggacauguu

SEQ ID NO: 60809 - RNA, 22 nt, Human
auacaaagcuuucugucuggua

SEQ ID NO: 60810 - RNA, 22 nt, Human
auacaaaggaacacaggcaugu

SEQ ID NO: 60811 - RNA, 22 nt, Human
auacaaauuauaggccccaucc

SEQ ID NO: 60812 - RNA, 22 nt, Human
auacaaauuuauagaugcauuu

SEQ ID NO: 60813 - RNA, 22 nt, Human
auacaacagaaaaugauuauuc

SEQ ID NO: 60814 - RNA, 22 nt, Human
auacaacugccuuagaaggaaa

SEQ ID NO: 60815 - RNA, 21 nt, Human
auacaagaagauggcagucug

SEQ ID NO: 60816 - RNA, 22 nt, Human
auacaagacaguaggaaacuga

SEQ ID NO: 60817 - RNA, 19 nt, Human
auacaagacuagcauuuac

SEQ ID NO: 60818 - RNA, 19 nt, Human
auacaagagagcaguugag

SEQ ID NO: 60819 - RNA, 22 nt, Human
auacaagaucacuccagaaaau

SEQ ID NO: 60820 - RNA, 18 nt, Human
auacaagcagcagagauu

SEQ ID NO: 60821 - RNA, 22 nt, Human
auacaaggucaugaagguuuac

SEQ ID NO: 60822 - RNA, 22 nt, Human
auacaagugauauaauuguuuc

SEQ ID NO: 60823 - RNA, 22 nt, Human
auacaaguuaaugagaaugaca

SEQ ID NO: 60824 - RNA, 22 nt, Human
auacaaucaucauuauauuccc

SEQ ID NO: 60825 - RNA, 22 nt, Human
auacaaugagugagugaauggg

SEQ ID NO: 60826 - RNA, 22 nt, Human
auacaaugauaauaguacuuua

SEQ ID NO: 60827 - RNA, 22 nt, Human
auacacacauaugugaguuuug

SEQ ID NO: 60828 - RNA, 22 nt, Human
auacacacgugcacgugggaaa

SEQ ID NO: 60829 - RNA, 22 nt, Human
auacacagccauuaugaauuag

SEQ ID NO: 60830 - RNA, 22 nt, Human
auacacaggcaugcuucugauu

SEQ ID NO: 60831 - RNA, 22 nt, Human
auacacaggugcuaggucaaua

SEQ ID NO: 60832 - RNA, 21 nt, Human
auacacauacacauaaaugug

SEQ ID NO: 60833 - RNA, 22 nt, Human
auacacauauauacacguuuaa

SEQ ID NO: 60834 - RNA, 22 nt, Human
auacacauaucagguguauaca

SEQ ID NO: 60835 - RNA, 20 nt, Human
auacacauauucuugcaacu

SEQ ID NO: 60836 - RNA, 22 nt, Human
auacacaucuauuuaagagaca

SEQ ID NO: 60837 - RNA, 22 nt, Human
auacacaugcacacaugugugu

SEQ ID NO: 60838 - RNA, 20 nt, Human
auacacaugcagacagaugc

SEQ ID NO: 60839 - RNA, 22 nt, Human
auacacauuacuuucugucuga

SEQ ID NO: 60840 - RNA, 22 nt, Human
auacacauuugcuagagauggg

SEQ ID NO: 60841 - RNA, 19 nt, Human
auacacguguauacauaca

SEQ ID NO: 60842 - RNA, 22 nt, Human
auacacuacuaagcacagauug

SEQ ID NO: 60843 - RNA, 22 nt, Human
auacacuuguacauuuuuuaau

SEQ ID NO: 60844 - RNA, 22 nt, Human
auacacuuuagaaaaacgcugc

SEQ ID NO: 60845 - RNA, 22 nt, Human
auacagaaaaugaugcagaguu

SEQ ID NO: 60846 - RNA, 22 nt, Human
auacagaacucucaguuguaua

SEQ ID NO: 60847 - RNA, 22 nt, Human
auacagaagaccccuccgucau

SEQ ID NO: 60848 - RNA, 22 nt, Human
auacagaagccuguauuucugg

SEQ ID NO: 60849 - RNA, 22 nt, Human
auacagaauacuaauuccugag

SEQ ID NO: 60850 - RNA, 22 nt, Human
auacagagacacuugagacugg

SEQ ID NO: 60851 - RNA, 20 nt, Human
auacagaugguuccagcugg

SEQ ID NO: 60852 - RNA, 22 nt, Human
auacagauguuaaagcaauuuc

SEQ ID NO: 60853 - RNA, 22 nt, Human
auacagcagcccuugcuuugca

SEQ ID NO: 60854 - RNA, 22 nt, Human
auacagcuuacaguucuaaugc

SEQ ID NO: 60855 - RNA, 22 nt, Human
auacagguaauuugaauaauag

SEQ ID NO: 60856 - RNA, 22 nt, Human
auacagguggaacuaaauaaau

SEQ ID NO: 60857 - RNA, 22 nt, Human
auacagguucucuagggaacag

SEQ ID NO: 60858 - RNA, 22 nt, Human
auacaguaauuuguaacucauc

SEQ ID NO: 60859 - RNA, 22 nt, Human
auacaguagggaccaugucuga

SEQ ID NO: 60860 - RNA, 22 nt, Human
auacaguauguaggcuuuucag

SEQ ID NO: 60861 - RNA, 21 nt, Human
auacagugguaugaauguagg

SEQ ID NO: 60862 - RNA, 22 nt, Human
auacaguuagaaaaaaagccuu

SEQ ID NO: 60863 - RNA, 22 nt, Human
auacauaugaaugauuuggcuc

SEQ ID NO: 60864 - RNA, 22 nt, Human
auacaucaccuauauauucaca

SEQ ID NO: 60865 - RNA, 22 nt, Human
auacaucaugcuccauauauuu

SEQ ID NO: 60866 - RNA, 22 nt, Human
auacaugacacugggcuacagg

SEQ ID NO: 60867 - RNA, 22 nt, Human
auacaugaggcucauuuauguc

SEQ ID NO: 60868 - RNA, 22 nt, Human
auacaugcgccauguuggugug

SEQ ID NO: 60869 - RNA, 22 nt, Human
auacaugucaucauauguuugu

SEQ ID NO: 60870 - RNA, 22 nt, Human
auacaugugccgcguuggugug

SEQ ID NO: 60871 - RNA, 22 nt, Human
auacaugugcuauguuggugua

SEQ ID NO: 60872 - RNA, 22 nt, Human
auacaugugucccugauuuauu

SEQ ID NO: 60873 - RNA, 22 nt, Human
auacauguucguguacauguuc

SEQ ID NO: 60874 - RNA, 22 nt, Human
auacauguugagaaaauaucug

SEQ ID NO: 60875 - RNA, 22 nt, Human
auacauguuguaccauauguuu

SEQ ID NO: 60876 - RNA, 22 nt, Human
auacauguuugcuggauaaaca

SEQ ID NO: 60877 - RNA, 22 nt, Human
auacauucaucacuuuuggucc

SEQ ID NO: 60878 - RNA, 17 nt, Human
auacauuguuaaaguau

SEQ ID NO: 60879 - RNA, 22 nt, Human
auaccaauuagaguuuguugca

SEQ ID NO: 60880 - RNA, 22 nt, Human
auaccaccaucuaugaaaggua

SEQ ID NO: 60881 - RNA, 21 nt, Human
auaccauuugccaaaaggauc

SEQ ID NO: 60882 - RNA, 22 nt, Human
auacccagccccagcugcagga

SEQ ID NO: 60883 - RNA, 22 nt, Human
auacccaggcuuauguugguca

SEQ ID NO: 60884 - RNA, 22 nt, Human
auaccuaugugacaguauuauu

SEQ ID NO: 60885 - RNA, 22 nt, Human
auaccugaucaaggcaaaaaug

SEQ ID NO: 60886 - RNA, 22 nt, Human
auaccugcaguauuuuauuguu

SEQ ID NO: 60887 - RNA, 22 nt, Human
auaccuuuaggcauuuugcauc

SEQ ID NO: 60888 - RNA, 22 nt, Human
auacggguuguuaaaaaaucau

SEQ ID NO: 60889 - RNA, 22 nt, Human
auacuacacauugacuauauuu

SEQ ID NO: 60890 - RNA, 22 nt, Human
auacuacaucacagccaagaag

SEQ ID NO: 60891 - RNA, 22 nt, Human
auacuauauuaccuucucaacu

SEQ ID NO: 60892 - RNA, 22 nt, Human
auacucaagguuaaugauugaa

SEQ ID NO: 60893 - RNA, 22 nt, Human
auacugaaaaaugauuugcugu

SEQ ID NO: 60894 - RNA, 21 nt, Human
auacugaaccucauaagccca

SEQ ID NO: 60895 - RNA, 22 nt, Human
auacugaaggcauucagauaac

SEQ ID NO: 60896 - RNA, 22 nt, Human
auacugauacggaagaaaaaag

SEQ ID NO: 60897 - RNA, 22 nt, Human
auacugaugaugugaagaaaca

SEQ ID NO: 60898 - RNA, 22 nt, Human
auacugugugugcucaaggaau

SEQ ID NO: 60899 - RNA, 22 nt, Human
auacuguuggcagcagaccaga

SEQ ID NO: 60900 - RNA, 22 nt, Human
auacuguuuugugacuuaucuu

SEQ ID NO: 60901 - RNA, 22 nt, Human
auacuucccuguuuuuuccuga

SEQ ID NO: 60902 - RNA, 22 nt, Human
auacuuucugaccaauuaauug

SEQ ID NO: 60903 - RNA, 22 nt, Human
auacuuugcuaguaucagugug

SEQ ID NO: 60904 - RNA, 22 nt, Human
auacuuuuaauuccuucugagu

SEQ ID NO: 60905 - RNA, 22 nt, Human
auagaaacagaugcacuucucu

SEQ ID NO: 60906 - RNA, 19 nt, Human
auagaaaggguuaaagaca

SEQ ID NO: 60907 - RNA, 22 nt, Human
auagaacagggcacugucauga

SEQ ID NO: 60908 - RNA, 22 nt, Human
auagaagaggaaacugagguug

SEQ ID NO: 60909 - RNA, 20 nt, Human
auagaaguauuauguaaugu

SEQ ID NO: 60910 - RNA, 20 nt, Human
auagaaucacaaguccugaa

SEQ ID NO: 60911 - RNA, 22 nt, Human
auagaauguauuauaguacaga

SEQ ID NO: 60912 - RNA, 22 nt, Human
auagaauuacaguguguuugga

SEQ ID NO: 60913 - RNA, 22 nt, Human
auagacaaucccccauccuacc

SEQ ID NO: 60914 - RNA, 22 nt, Human
auagacaaugguuugccaagaa

SEQ ID NO: 60915 - RNA, 22 nt, Human
auauguuuugugcuucauuggu

SEQ ID NO: 60916 - RNA, 22 nt, Human
auauguuuuucacagguuuaag

SEQ ID NO: 60917 - RNA, 22 nt, Human
auauuaaaacuaugguuuucag

SEQ ID NO: 60918 - RNA, 22 nt, Human
auauuaaauggauuuugggagc

SEQ ID NO: 60919 - RNA, 22 nt, Human
auauuaaugggauuuagucagg

SEQ ID NO: 60920 - RNA, 22 nt, Human
auauuacucugauuuaguaaau

SEQ ID NO: 60921 - RNA, 22 nt, Human
auauuacuuccugguauaaaau

SEQ ID NO: 60922 - RNA, 22 nt, Human
auauuaggcaaggagauuauuu

SEQ ID NO: 60923 - RNA, 21 nt, Human
aggacaggaacuggcugaaua

SEQ ID NO: 60924 - RNA, 22 nt, Human
aggacaggauugagcugaacug

SEQ ID NO: 60925 - RNA, 22 nt, Human
aggacagggauucaaacuccca

SEQ ID NO: 60926 - RNA, 22 nt, Human
aggacaguggcaaggcaggaca

SEQ ID NO: 60927 - RNA, 22 nt, Human
aggacaguuaguuaggaaguuu

SEQ ID NO: 60928 - RNA, 22 nt, Human
aggaccaggucuaaugaagaca

SEQ ID NO: 60929 - RNA, 19 nt, Human
aggacccuuauccuggcuu

SEQ ID NO: 60930 - RNA, 22 nt, Human
aggaccuggaucacagagaucu

SEQ ID NO: 60931 - RNA, 22 nt, Human
aggaccuguaccucagcaucua

SEQ ID NO: 60932 - RNA, 22 nt, Human
aggacgcucucgcugaacuucu

SEQ ID NO: 60933 - RNA, 22 nt, Human
aggacuaaggaacagcugauuc

SEQ ID NO: 60934 - RNA, 22 nt, Human
aggacuaauuucaggggauaua

SEQ ID NO: 60935 - RNA, 22 nt, Human
aggacugaaaaugaguucuucu

SEQ ID NO: 60936 - RNA, 22 nt, Human
aggacuggcagugugagggguc

SEQ ID NO: 60937 - RNA, 22 nt, Human
aggacuggcccugaggggaggc

SEQ ID NO: 60938 - RNA, 22 nt, Human
aggacuuagaacauuauguacu

SEQ ID NO: 60939 - RNA, 22 nt, Human
aggacuuccaaaccucccaaau

SEQ ID NO: 60940 - RNA, 22 nt, Human
aggacuucugaggucaagucgc

SEQ ID NO: 60941 - RNA, 18 nt, Human
aggacuugccucaguugc

SEQ ID NO: 60942 - RNA, 22 nt, Human
aggacuuguuuaaaguuugugc

SEQ ID NO: 60943 - RNA, 21 nt, Human
aggagaaacacaggucagccc

SEQ ID NO: 60944 - RNA, 22 nt, Human
aggagaaagacuggacagccaa

SEQ ID NO: 60945 - RNA, 22 nt, Human
aggagaaggaggccccucacac

SEQ ID NO: 60946 - RNA, 22 nt, Human
aggagacagaauuuaaauuugg

SEQ ID NO: 60947 - RNA, 22 nt, Human
aggagacagccaggggccugag

SEQ ID NO: 60948 - RNA, 22 nt, Human
aggagacauacuauaggaauau

SEQ ID NO: 60949 - RNA, 22 nt, Human
aggagacccaaugccagaaaga

SEQ ID NO: 60950 - RNA, 22 nt, Human
aggagacccagaauguugcugu

SEQ ID NO: 60951 - RNA, 22 nt, Human
aggagaccuucaccacuuccac

SEQ ID NO: 60952 - RNA, 22 nt, Human
aggagaccuuuugagugugaga

SEQ ID NO: 60953 - RNA, 22 nt, Human
aggagacugugaauugacuguc

SEQ ID NO: 60954 - RNA, 22 nt, Human
aggagagaauuacuggguguca

SEQ ID NO: 60955 - RNA, 22 nt, Human
aggagagagaacacuugggucc

SEQ ID NO: 60956 - RNA, 22 nt, Human
aggagagcuggugucuggaauc

SEQ ID NO: 60957 - RNA, 22 nt, Human
aggagaggguggcauuaaguuu

SEQ ID NO: 60958 - RNA, 22 nt, Human
aggagaggucucccuuccccag

SEQ ID NO: 60959 - RNA, 22 nt, Human
aggagagucuugagucacuggu

SEQ ID NO: 60960 - RNA, 22 nt, Human
aggagaguucacacuggucaga

SEQ ID NO: 60961 - RNA, 22 nt, Human
aggagcaaaugaugagacagca

SEQ ID NO: 60962 - RNA, 22 nt, Human
aggagcacuaauuccugcagag

SEQ ID NO: 60963 - RNA, 22 nt, Human
aggagcagcccacuccuguccu

SEQ ID NO: 60964 - RNA, 22 nt, Human
aggagcagcuucugaaccaugu

SEQ ID NO: 60965 - RNA, 22 nt, Human
aggagccaagcagaacuaagga

SEQ ID NO: 60966 - RNA, 22 nt, Human
aggagccaaggaaaacaguauu

SEQ ID NO: 60967 - RNA, 22 nt, Human
aggagccaccuaggagcuguuu

SEQ ID NO: 60968 - RNA, 22 nt, Human
aggagccagcguuccucaggau

SEQ ID NO: 60969 - RNA, 22 nt, Human
aggagccaggaaaccugcucug

SEQ ID NO: 60970 - RNA, 21 nt, Human
aggagccauguggucugaugg

SEQ ID NO: 60971 - RNA, 20 nt, Human
aggagccauugacugcagca

SEQ ID NO: 60972 - RNA, 22 nt, Human
aggagccauugcaggauggcag

SEQ ID NO: 60973 - RNA, 22 nt, Human
aggagccauuuuccaagggcga

SEQ ID NO: 60974 - RNA, 23 nt, Human
aggagccccuaauucugggcagc

SEQ ID NO: 60975 - RNA, 22 nt, Human
aggagccccucuucaguccugg

SEQ ID NO: 60976 - RNA, 22 nt, Human
aggagcccuccguugcuucauc

SEQ ID NO: 60977 - RNA, 22 nt, Human
aggagccuggcuggcccacagg

SEQ ID NO: 60978 - RNA, 22 nt, Human
aggagccugugccuggcacucc

SEQ ID NO: 60979 - RNA, 19 nt, Human
aggagccuugagcagugag

SEQ ID NO: 60980 - RNA, 22 nt, Human
aggagcuagccaggcauaugca

SEQ ID NO: 60981 - RNA, 22 nt, Human
aggagcucagccugcagggagc

SEQ ID NO: 60982 - RNA, 22 nt, Human
aggagcucagcuaaguuggaga

SEQ ID NO: 60983 - RNA, 22 nt, Human
aggagcuccagcccagggaagu

SEQ ID NO: 60984 - RNA, 21 nt, Human
aggagcucuccaaggacaaag

SEQ ID NO: 60985 - RNA, 22 nt, Human
aggagcucucccaugcugcaga

SEQ ID NO: 60986 - RNA, 22 nt, Human
aggagcucuugaugcuugaggg

SEQ ID NO: 60987 - RNA, 22 nt, Human
aggagcugaagucucugcacuc

SEQ ID NO: 60988 - RNA, 22 nt, Human
aggagcugagucagcccgacag

SEQ ID NO: 60989 - RNA, 22 nt, Human
aggagcugauaaaaggggguca

SEQ ID NO: 60990 - RNA, 22 nt, Human
aggagcugcuuuggugcgguuu

SEQ ID NO: 60991 - RNA, 21 nt, Human
aggagcuggagaaaacuuucc

SEQ ID NO: 60992 - RNA, 22 nt, Human
aggagcuggccuagaaaggaga

SEQ ID NO: 60993 - RNA, 22 nt, Human
aggagcuggguuccuuuggugg

SEQ ID NO: 60994 - RNA, 22 nt, Human
aggagcugucagagugccagag

SEQ ID NO: 60995 - RNA, 22 nt, Human
aggagcuguuuuguucagcaaa

SEQ ID NO: 60996 - RNA, 22 nt, Human
aggagcuucagagagaaccugg

SEQ ID NO: 60997 - RNA, 22 nt, Human
aggaggaaaaaggccacagcaa

SEQ ID NO: 60998 - RNA, 20 nt, Human
aggaggaagaaagcacacug

SEQ ID NO: 60999 - RNA, 21 nt, Human
aggaggagagcuuggccuacc

SEQ ID NO: 61000 - RNA, 22 nt, Human
aggaggagcagcuuuuugucuc

SEQ ID NO: 61001 - RNA, 17 nt, Human
aggaggaucagagagua

SEQ ID NO: 61002 - RNA, 22 nt, Human
aggaggcacucacucucagggu

SEQ ID NO: 61003 - RNA, 22 nt, Human
aggaggcagaugcuuggcugua

SEQ ID NO: 61004 - RNA, 22 nt, Human
aggaggcaggaagucuauggga

SEQ ID NO: 61005 - RNA, 20 nt, Human
aggaggcauagucuggaaag

SEQ ID NO: 61006 - RNA, 22 nt, Human
aggaggccccuccuggguugcu

SEQ ID NO: 61007 - RNA, 22 nt, Human
aggaggcccuagagcucuagag

SEQ ID NO: 61008 - RNA, 22 nt, Human
aggaggccgauuucagaggucg

SEQ ID NO: 61009 - RNA, 22 nt, Human
aggaggccuacgcacaugucua

SEQ ID NO: 61010 - RNA, 23 nt, Human
aggaggccugaaacugaggcuga

SEQ ID NO: 61011 - RNA, 20 nt, Human
aggaggccugcagauaguuc

SEQ ID NO: 61012 - RNA, 22 nt, Human
aggaggccugcagcugccauuc

SEQ ID NO: 61013 - RNA, 22 nt, Human
aggaggccuguguuugucugua

SEQ ID NO: 61014 - RNA, 22 nt, Human
aggaggcugaacuagggucugg

SEQ ID NO: 61015 - RNA, 22 nt, Human
aggaggcugguucaggccauau

SEQ ID NO: 61016 - RNA, 17 nt, Human
aggagggaaauagcuug

SEQ ID NO: 61017 - RNA, 20 nt, Human
aggagggaccuggauuggcg

SEQ ID NO: 61018 - RNA, 22 nt, Human
aggagggcaggcuggcugccua

SEQ ID NO: 61019 - RNA, 22 nt, Human
aggaggguggggucugccuguc

SEQ ID NO: 61020 - RNA, 22 nt, Human
aggaggguucucuggacagagg

SEQ ID NO: 61021 - RNA, 22 nt, Human
aggaggucagagccccaugcug

SEQ ID NO: 61022 - RNA, 22 nt, Human
aggaggugacagccugcaucug

SEQ ID NO: 61023 - RNA, 22 nt, Human
aggagguggcugaacuugaggg

SEQ ID NO: 61024 - RNA, 22 nt, Human
auguauaaguacacagucggaa

SEQ ID NO: 61025 - RNA, 22 nt, Human
auguauacgugcaggucacagg

SEQ ID NO: 61026 - RNA, 17 nt, Human
auguauauuaacucuga

SEQ ID NO: 61027 - RNA, 22 nt, Human
auguaucaacugcaggcaaguu

SEQ ID NO: 61028 - RNA, 22 nt, Human
auguaugagagauucuuuuauu

SEQ ID NO: 61029 - RNA, 22 nt, Human
auguaugaugcuaggcucucag

SEQ ID NO: 61030 - RNA, 22 nt, Human
auguaugcauguauguaucgcu

SEQ ID NO: 61031 - RNA, 22 nt, Human
auguauguaugcugugcuugca

SEQ ID NO: 61032 - RNA, 22 nt, Human
auguauguuagacaagccuaca

SEQ ID NO: 61033 - RNA, 23 nt, Human
auguauguuucugcaucuucaac

SEQ ID NO: 61034 - RNA, 22 nt, Human
auguauuaugguuuuccuuaag

SEQ ID NO: 61035 - RNA, 23 nt, Human
auguauuuaaauuucagugauga

SEQ ID NO: 61036 - RNA, 22 nt, Human
auguauuugaaauuugagacau

SEQ ID NO: 61037 - RNA, 22 nt, Human
auguauuugcuuguuauggauu

SEQ ID NO: 61038 - RNA, 22 nt, Human
augucaaaucaguuuuaucaga

SEQ ID NO: 61039 - RNA, 22 nt, Human
augucacaugguucuggggccu

SEQ ID NO: 61040 - RNA, 22 nt, Human
augucaccuucgguggcacggu

SEQ ID NO: 61041 - RNA, 19 nt, Human
augucacucauguucccug

SEQ ID NO: 61042 - RNA, 22 nt, Human
augucacuccagggacacaggu

SEQ ID NO: 61043 - RNA, 22 nt, Human
augucacuguuguuauuguuau

SEQ ID NO: 61044 - RNA, 22 nt, Human
augucagaagcuggaugacagc

SEQ ID NO: 61045 - RNA, 22 nt, Human
augucaguugcugcuugaggua

SEQ ID NO: 61046 - RNA, 22 nt, Human
augucaguuucauuuuaaguca

SEQ ID NO: 61047 - RNA, 22 nt, Human
augucauuuaaauguuuguaua

SEQ ID NO: 61048 - RNA, 22 nt, Human
auguccaauuucagagucucau

SEQ ID NO: 61049 - RNA, 22 nt, Human
auguccagagccggccugcuga

SEQ ID NO: 61050 - RNA, 22 nt, Human
auguccagggcuuuagcggggc

SEQ ID NO: 61051 - RNA, 22 nt, Human
auguccaguacuucuaaauggu

SEQ ID NO: 61052 - RNA, 20 nt, Human
auguccagugacuggaccau

SEQ ID NO: 61053 - RNA, 22 nt, Human
auguccaugcuuugcuccagaa

SEQ ID NO: 61054 - RNA, 19 nt, Human
augucccaccgccccugag

SEQ ID NO: 61055 - RNA, 22 nt, Human
augucccugagggucucucuga

SEQ ID NO: 61056 - RNA, 22 nt, Human
auguccucggcucugugcugcu

SEQ ID NO: 61057 - RNA, 22 nt, Human
auguccucuucugccucaggcc

SEQ ID NO: 61058 - RNA, 22 nt, Human
auguccuggggucuucucuuca

SEQ ID NO: 61059 - RNA, 22 nt, Human
auguccuuaaucugaauguuag

SEQ ID NO: 61060 - RNA, 22 nt, Human
augucuaaaagauaaaguuuaa

SEQ ID NO: 61061 - RNA, 22 nt, Human
augucuagagcaagagaugcug

SEQ ID NO: 61062 - RNA, 21 nt, Human
augucuaugacauauuuccuu

SEQ ID NO: 61063 - RNA, 22 nt, Human
augucucucucugagugccaga

SEQ ID NO: 61064 - RNA, 22 nt, Human
augucugagucugcuccaguug

SEQ ID NO: 61065 - RNA, 22 nt, Human
augucugcggcccaggccaggg

SEQ ID NO: 61066 - RNA, 22 nt, Human
augucugcuauucauagggaaa

SEQ ID NO: 61067 - RNA, 19 nt, Human
augucuggguaacagcugc

SEQ ID NO: 61068 - RNA, 22 nt, Human
augucuguacgaguuacaaugg

SEQ ID NO: 61069 - RNA, 22 nt, Human
augucuguggcaauuguugaug

SEQ ID NO: 61070 - RNA, 22 nt, Human
augucugugugaucuuggauaa

SEQ ID NO: 61071 - RNA, 22 nt, Human
augucuguguuaucuguagaau

SEQ ID NO: 61072 - RNA, 22 nt, Human
augucuguuuucauaucagaua

SEQ ID NO: 61073 - RNA, 22 nt, Human
augucuuggguuucaguuuacu

SEQ ID NO: 61074 - RNA, 22 nt, Human
augucuuguuaaucugaagcaa

SEQ ID NO: 61075 - RNA, 22 nt, Human
agggcgggcucaucacaugcuc

SEQ ID NO: 61076 - RNA, 22 nt, Human
agggcgugguggugcuggagca

SEQ ID NO: 61077 - RNA, 21 nt, Human
agggcucaaaugugcuugcug

SEQ ID NO: 61078 - RNA, 22 nt, Human
agggcucacuacaacccuggga

SEQ ID NO: 61079 - RNA, 22 nt, Human
agggcucagaaagcagguuuuc

SEQ ID NO: 61080 - RNA, 22 nt, Human
agggcucagggucaccaucugu

SEQ ID NO: 61081 - RNA, 22 nt, Human
agggcucaguugccuggagccc

SEQ ID NO: 61082 - RNA, 22 nt, Human
agggcuccaggggaccaucagu

SEQ ID NO: 61083 - RNA, 22 nt, Human
agggcucccgugaggugacugc

SEQ ID NO: 61084 - RNA, 23 nt, Human
agggcuccuuguugauuagcauu

SEQ ID NO: 61085 - RNA, 22 nt, Human
agggcucugagugggaaagagg

SEQ ID NO: 61086 - RNA, 22 nt, Human
agggcucuuccuuugccucuca

SEQ ID NO: 61087 - RNA, 22 nt, Human
agggcugaccuaagcuccacuu

SEQ ID NO: 61088 - RNA, 22 nt, Human
agggcugaggcgagggagaugc

SEQ ID NO: 61089 - RNA, 22 nt, Human
agggcugcaguccuaaggugcu

SEQ ID NO: 61090 - RNA, 22 nt, Human
agggcugcaucugccuggugaa

SEQ ID NO: 61091 - RNA, 22 nt, Human
agggcugccauuucuggcccaa

SEQ ID NO: 61092 - RNA, 22 nt, Human
agggcugccccaguccagccgg

SEQ ID NO: 61093 - RNA, 22 nt, Human
agggcugccugacuccagagcc

SEQ ID NO: 61094 - RNA, 19 nt, Human
agggcugcucuggccuggg

SEQ ID NO: 61095 - RNA, 22 nt, Human
agggcugcugcuccgggcccag

SEQ ID NO: 61096 - RNA, 22 nt, Human
agggcuggccacaugauuuggu

SEQ ID NO: 61097 - RNA, 22 nt, Human
agggcugggcugcuuguuguca

SEQ ID NO: 61098 - RNA, 22 nt, Human
agggcugugucccuaggggagc

SEQ ID NO: 61099 - RNA, 22 nt, Human
agggcuguguuugcacccucug

SEQ ID NO: 61100 - RNA, 22 nt, Human
agggcuugccauugccuguuag

SEQ ID NO: 61101 - RNA, 22 nt, Human
agggcuugcugauuuaaagagc

SEQ ID NO: 61102 - RNA, 22 nt, Human
agggcuuucggcacucugaggg

SEQ ID NO: 61103 - RNA, 22 nt, Human
agggcuuugagaauaguggaac

SEQ ID NO: 61104 - RNA, 22 nt, Human
agggcuuugauggcauucucau

SEQ ID NO: 61105 - RNA, 22 nt, Human
agggcuuugauguccaugagga

SEQ ID NO: 61106 - RNA, 22 nt, Human
agggcuuugcaaugcacagugg

SEQ ID NO: 61107 - RNA, 22 nt, Human
agggcuuuguggcagucacuau

SEQ ID NO: 61108 - RNA, 22 nt, Human
aggggacacggcuucuccaggg

SEQ ID NO: 61109 - RNA, 22 nt, Human
aggggagaaaaaugccuucugu

SEQ ID NO: 61110 - RNA, 22 nt, Human
aggggagagaacauaaggaagu

SEQ ID NO: 61111 - RNA, 22 nt, Human
aggggagaggugagcaacuucu

SEQ ID NO: 61112 - RNA, 17 nt, Human
aggggagagugggaaga

SEQ ID NO: 61113 - RNA, 22 nt, Human
aggggaggagcuuuucuugccu

SEQ ID NO: 61114 - RNA, 22 nt, Human
aggggagguguccccaaaucuc

SEQ ID NO: 61115 - RNA, 22 nt, Human
aggggaugauccucccgcagcg

SEQ ID NO: 61116 - RNA, 22 nt, Human
aggggccauuguucugcccgcu

SEQ ID NO: 61117 - RNA, 22 nt, Human
aggggccucagccuccugguca

SEQ ID NO: 61118 - RNA, 22 nt, Human
aggggccucgcaggaccgcucc

SEQ ID NO: 61119 - RNA, 22 nt, Human
aggggccuggacauggacgcgc

SEQ ID NO: 61120 - RNA, 22 nt, Human
aggggcucaaagugugcaggga

SEQ ID NO: 61121 - RNA, 22 nt, Human
aggggcuccaaggaaguuuggg

SEQ ID NO: 61122 - RNA, 22 nt, Human
aggggcugcuggguccgccccu

SEQ ID NO: 61123 - RNA, 22 nt, Human
aggggcuggcuuaucugagagu

SEQ ID NO: 61124 - RNA, 22 nt, Human
aggggcugggacagagccaagc

SEQ ID NO: 61125 - RNA, 22 nt, Human
agggggcauuaugaggcuuuuc

SEQ ID NO: 61126 - RNA, 22 nt, Human
agggggucuccuaucauggaag

SEQ ID NO: 61127 - RNA, 22 nt, Human
agggguagagauugcuggugua

SEQ ID NO: 61128 - RNA, 22 nt, Human
aggggucuuuaggaacgucggg

SEQ ID NO: 61129 - RNA, 22 nt, Human
aggggugaaggcccgauaggag

SEQ ID NO: 61130 - RNA, 22 nt, Human
aggggugacacauaucagugca

SEQ ID NO: 61131 - RNA, 22 nt, Human
agggguggagaguguugccagu

SEQ ID NO: 61132 - RNA, 22 nt, Human
agggguggccugccuuacuccc

SEQ ID NO: 61133 - RNA, 22 nt, Human
auguguccaaggccacaauagc

SEQ ID NO: 61134 - RNA, 22 nt, Human
augugucucuaccaaugcaauu

SEQ ID NO: 61135 - RNA, 22 nt, Human
augugucuuauuugauuccaca

SEQ ID NO: 61136 - RNA, 22 nt, Human
augugucuugagggggauggag

SEQ ID NO: 61137 - RNA, 22 nt, Human
augugugcaucaaugauagauc

SEQ ID NO: 61138 - RNA, 22 nt, Human
augugugccccuuuuacucuuu

SEQ ID NO: 61139 - RNA, 22 nt, Human
augugugcgggaaggaaaguga

SEQ ID NO: 61140 - RNA, 21 nt, Human
augugugcuagaggacuacug

SEQ ID NO: 61141 - RNA, 22 nt, Human
augugugcucuugagccuucac

SEQ ID NO: 61142 - RNA, 22 nt, Human
augugugguacagucccguuua

SEQ ID NO: 61143 - RNA, 22 nt, Human
augugugguuuguaaaugauuu

SEQ ID NO: 61144 - RNA, 22 nt, Human
auguguguaaacaaguauaauu

SEQ ID NO: 61145 - RNA, 22 nt, Human
auguguuaaugucaaccagaaa

SEQ ID NO: 61146 - RNA, 22 nt, Human
auguguuuaccaggggaacaug

SEQ ID NO: 61147 - RNA, 22 nt, Human
auguguuuauaauuacucaauc

SEQ ID NO: 61148 - RNA, 22 nt, Human
auguguuuguccugcagaaaua

SEQ ID NO: 61149 - RNA, 22 nt, Human
auguguuuugguaauuucugcu

SEQ ID NO: 61150 - RNA, 22 nt, Human
auguuaaauaaucccuuaaagc

SEQ ID NO: 61151 - RNA, 20 nt, Human
auguuaaauagcauuuagag

SEQ ID NO: 61152 - RNA, 22 nt, Human
auguuacaauccaacaaaauua

SEQ ID NO: 61153 - RNA, 22 nt, Human
auguuacaauucaaaaugcugc

SEQ ID NO: 61154 - RNA, 22 nt, Human
auguuacacuguuucacguucc

SEQ ID NO: 61155 - RNA, 22 nt, Human
auguuacagggagagaaggcca

SEQ ID NO: 61156 - RNA, 22 nt, Human
auguuacaguugaguaaauuaa

SEQ ID NO: 61157 - RNA, 22 nt, Human
auguuacauaguccuuauuugu

SEQ ID NO: 61158 - RNA, 22 nt, Human
auguuacuuagaauaauucugg

SEQ ID NO: 61159 - RNA, 22 nt, Human
auguuagaaggaauguuaaaag

SEQ ID NO: 61160 - RNA, 22 nt, Human
auguuagaaucucugaaugugg

SEQ ID NO: 61161 - RNA, 22 nt, Human
auguuaugucugggaaggggua

SEQ ID NO: 61162 - RNA, 22 nt, Human
auguucaaguaccuuugugucu

SEQ ID NO: 61163 - RNA, 22 nt, Human
auguucauccaugucguagcag

SEQ ID NO: 61164 - RNA, 22 nt, Human
auguucaugauugguuuuggcg

SEQ ID NO: 61165 - RNA, 22 nt, Human
auguucauuugacaaguaguga

SEQ ID NO: 61166 - RNA, 19 nt, Human
auguucuauccuccaaguu

SEQ ID NO: 61167 - RNA, 19 nt, Human
auguucugaauuacuguaa

SEQ ID NO: 61168 - RNA, 22 nt, Human
auguucuuaucauucuuucgga

SEQ ID NO: 61169 - RNA, 22 nt, Human
auguucuuccaaaucuguaaca

SEQ ID NO: 61170 - RNA, 22 nt, Human
auguucuuccuucaauuuggaa

SEQ ID NO: 61171 - RNA, 22 nt, Human
auguugaacuaggaucucuuga

SEQ ID NO: 61172 - RNA, 22 nt, Human
auguuguuuuuucauaaaguau

SEQ ID NO: 61173 - RNA, 22 nt, Human
auguuuaaauuuauagacagug

SEQ ID NO: 61174 - RNA, 20 nt, Human
auguuuaauguuguccaccc

SEQ ID NO: 61175 - RNA, 21 nt, Human
auguuuacacugacuacugug

SEQ ID NO: 61176 - RNA, 22 nt, Human
auguuuacugguuuauagaaua

SEQ ID NO: 61177 - RNA, 22 nt, Human
auguuuauguugggcuauauuu

SEQ ID NO: 61178 - RNA, 22 nt, Human
auguuuauuuugcagaguaggg

SEQ ID NO: 61179 - RNA, 22 nt, Human
auguuucaagagaaaaagagac

SEQ ID NO: 61180 - RNA, 22 nt, Human
auguuucaccaguuuuauaaga

SEQ ID NO: 61181 - RNA, 22 nt, Human
auguuucaggaaaucagcuaga

SEQ ID NO: 61182 - RNA, 22 nt, Human
auguuucaguucuaaaguuaga

SEQ ID NO: 61183 - RNA, 22 nt, Human
auguuuccauagaagucacagu

SEQ ID NO: 61184 - RNA, 22 nt, Human
auguuuccauguucaauuuacu

SEQ ID NO: 61185 - RNA, 22 nt, Human
auguuuccgugagcauccuuga

SEQ ID NO: 61186 - RNA, 20 nt, Human
auguuucucugucgugauuu

SEQ ID NO: 61187 - RNA, 18 nt, Human
auguuucucuuggcucug

SEQ ID NO: 61188 - RNA, 22 nt, Human
auguuugaaauuguaaguauau

SEQ ID NO: 61189 - RNA, 22 nt, Human
auguuugacugaguuuggcaga

SEQ ID NO: 61190 - RNA, 22 nt, Human
auguuugcuauuguucuagugg

SEQ ID NO: 61191 - RNA, 22 nt, Human
auguuugcuuaauuggagaaau

SEQ ID NO: 61192 - RNA, 23 nt, Human
agggcugaugccauugcagcucu

SEQ ID NO: 61193 - RNA, 22 nt, Human
agggcugcuccuccuucaggcc

SEQ ID NO: 61194 - RNA, 22 nt, Human
agggcuggaggguacuaguuua

SEQ ID NO: 61195 - RNA, 22 nt, Human
agggcuggcuaggugcguuccc

SEQ ID NO: 61196 - RNA, 22 nt, Human
agggcuggcuccguuaccuuga

SEQ ID NO: 61197 - RNA, 22 nt, Human
agggcugguauguccaugaaag

SEQ ID NO: 61198 - RNA, 22 nt, Human
agggcugucagacugaggaggc

SEQ ID NO: 61199 - RNA, 22 nt, Human
agggcuuguuaacauagagauu

SEQ ID NO: 61200 - RNA, 22 nt, Human
agggcuuuguuuaggugaccac

SEQ ID NO: 61201 - RNA, 22 nt, Human
agggcuuuugcaauccaagucu

SEQ ID NO: 61202 - RNA, 22 nt, Human
aggggaagagcccuuuacaugg

SEQ ID NO: 61203 - RNA, 22 nt, Human
aggggagaguuaaugugaaugu

SEQ ID NO: 61204 - RNA, 22 nt, Human
aggggagcaacauagucacucu

SEQ ID NO: 61205 - RNA, 22 nt, Human
aggggagcaucugugaugguua

SEQ ID NO: 61206 - RNA, 22 nt, Human
aggggagccccugguccuggug

SEQ ID NO: 61207 - RNA, 22 nt, Human
aggggagccgaggggcaucugu

SEQ ID NO: 61208 - RNA, 22 nt, Human
aggggcaaaugugagccuggaa

SEQ ID NO: 61209 - RNA, 22 nt, Human
aggggcacuagaaugggagacu

SEQ ID NO: 61210 - RNA, 19 nt, Human
aggggcacugucucuagag

SEQ ID NO: 61211 - RNA, 22 nt, Human
aggggcagccucacaauccucu

SEQ ID NO: 61212 - RNA, 18 nt, Human
aggggcagcuugugugga

SEQ ID NO: 61213 - RNA, 22 nt, Human
aggggcaucaguugcacauuuu

SEQ ID NO: 61214 - RNA, 22 nt, Human
aggggccaccaccaaggaaggu

SEQ ID NO: 61215 - RNA, 22 nt, Human
aggggccauguaaguguaucac

SEQ ID NO: 61216 - RNA, 22 nt, Human
aggggccuccucauuggagugu

SEQ ID NO: 61217 - RNA, 20 nt, Human
aggggccuggaacaggccuu

SEQ ID NO: 61218 - RNA, 22 nt, Human
aggggcucaagcaguguggucu

SEQ ID NO: 61219 - RNA, 22 nt, Human
aggggcuguggaaaccaacucu

SEQ ID NO: 61220 - RNA, 22 nt, Human
agggggaguuucaguuagaaag

SEQ ID NO: 61221 - RNA, 22 nt, Human
agggggcaucagguccuggcuc

SEQ ID NO: 61222 - RNA, 22 nt, Human
agggggcccuugcaggugagcg

SEQ ID NO: 61223 - RNA, 22 nt, Human
agggggcuccuuggugugcaga

SEQ ID NO: 61224 - RNA, 22 nt, Human
agggggcugccaaggaauguaa

SEQ ID NO: 61225 - RNA, 22 nt, Human
agggggguggaucaccugaggu

SEQ ID NO: 61226 - RNA, 22 nt, Human
agggggugcauuugugaaugaa

SEQ ID NO: 61227 - RNA, 22 nt, Human
agggggugcuacuuccagaguu

SEQ ID NO: 61228 - RNA, 22 nt, Human
agggggugucucugauuggguu

SEQ ID NO: 61229 - RNA, 22 nt, Human
agggguaguaggauaacaaauu

SEQ ID NO: 61230 - RNA, 22 nt, Human
aggggucagugaccauugagga

SEQ ID NO: 61231 - RNA, 22 nt, Human
aggggucuugaggacuccagca

SEQ ID NO: 61232 - RNA, 20 nt, Human
aggggugaucgggugacacu

SEQ ID NO: 61233 - RNA, 22 nt, Human
aggguagcuacccaacuccaga

SEQ ID NO: 61234 - RNA, 22 nt, Human
aggguagguguaagauagcccu

SEQ ID NO: 61235 - RNA, 22 nt, Human
agggucaacacuuuaaacauau

SEQ ID NO: 61236 - RNA, 22 nt, Human
agggucagcuggcugucagggg

SEQ ID NO: 61237 - RNA, 19 nt, Human
agggucaggacaaggacuu

SEQ ID NO: 61238 - RNA, 22 nt, Human
agggucaggagacacuggcaac

SEQ ID NO: 61239 - RNA, 20 nt, Human
agggucaguagcacagagcu

SEQ ID NO: 61240 - RNA, 18 nt, Human
agggucagugucacuggc

SEQ ID NO: 61241 - RNA, 19 nt, Human
aggguccagggagcggcuc

SEQ ID NO: 61242 - RNA, 19 nt, Human
aguuaaugagcuuuugauc

SEQ ID NO: 61243 - RNA, 22 nt, Human
aguuacaaguacaggcuuugga

SEQ ID NO: 61244 - RNA, 22 nt, Human
aguuacagaauguacagagguu

SEQ ID NO: 61245 - RNA, 22 nt, Human
aguuacagcacucaaaguuuuc

SEQ ID NO: 61246 - RNA, 22 nt, Human
aguuacagugaccauuuauuua

SEQ ID NO: 61247 - RNA, 22 nt, Human
aguuacaucuguuauguguguu

SEQ ID NO: 61248 - RNA, 21 nt, Human
aguuacauguauagauaaagu

SEQ ID NO: 61249 - RNA, 22 nt, Human
aguuaccuuucugaaacuucgu

SEQ ID NO: 61250 - RNA, 22 nt, Human
aguuacuugagacguuuaugaa

SEQ ID NO: 61251 - RNA, 22 nt, Human
aguuagaaaguaaaucauuuga

SEQ ID NO: 61252 - RNA, 22 nt, Human
aguuagagcgcauauuuuauua

SEQ ID NO: 61253 - RNA, 22 nt, Human
aguuagcaucuccuccagucua

SEQ ID NO: 61254 - RNA, 22 nt, Human
aguuaguagacuuuuccauuua

SEQ ID NO: 61255 - RNA, 22 nt, Human
aguuaguauacaaaguaacagc

SEQ ID NO: 61256 - RNA, 22 nt, Human
aguuagugaagcucaucacagc

SEQ ID NO: 61257 - RNA, 22 nt, Human
aguuagugagcucuugggaccu

SEQ ID NO: 61258 - RNA, 20 nt, Human
aguuagugaguaauugagcu

SEQ ID NO: 61259 - RNA, 17 nt, Human
aguuaguguagcagugc

SEQ ID NO: 61260 - RNA, 22 nt, Human
aguuauaccuuauacacauaug

SEQ ID NO: 61261 - RNA, 22 nt, Human
aguuauagccauauucuaagau

SEQ ID NO: 61262 - RNA, 22 nt, Human
aguuauaugugaaaacacguau

SEQ ID NO: 61263 - RNA, 22 nt, Human
aguuauauuccauagauucaga

SEQ ID NO: 61264 - RNA, 22 nt, Human
aguuaucaucccuuacacuuug

SEQ ID NO: 61265 - RNA, 22 nt, Human
aguuauccgaaggcacugagau

SEQ ID NO: 61266 - RNA, 22 nt, Human
aguuauuuaaaaugauuguccu

SEQ ID NO: 61267 - RNA, 23 nt, Human
aguucaaaaucaaccaggacacu

SEQ ID NO: 61268 - RNA, 22 nt, Human
aguucaagcaaugcuggaagaa

SEQ ID NO: 61269 - RNA, 22 nt, Human
aguucaauuguuuuguaaaagu

SEQ ID NO: 61270 - RNA, 22 nt, Human
aguucacaagcguaggugcuga

SEQ ID NO: 61271 - RNA, 22 nt, Human
aguucacaauagaagagguggc

SEQ ID NO: 61272 - RNA, 22 nt, Human
aguucacagaauggccagaacu

SEQ ID NO: 61273 - RNA, 22 nt, Human
aguucacagccauguucaugug

SEQ ID NO: 61274 - RNA, 21 nt, Human
aguucacaggaacaagcaggg

SEQ ID NO: 61275 - RNA, 23 nt, Human
aguucacugagguugaccacugg

SEQ ID NO: 61276 - RNA, 22 nt, Human
aguucacuuucuguaguggaag

SEQ ID NO: 61277 - RNA, 22 nt, Human
aguucagcuucaagcuaugagg

SEQ ID NO: 61278 - RNA, 23 nt, Human
aguucauaauuucuuauuugugu

SEQ ID NO: 61279 - RNA, 21 nt, Human
aguucauacugaguaacaaaa

SEQ ID NO: 61280 - RNA, 22 nt, Human
aguuccagugugagagaacaug

SEQ ID NO: 61281 - RNA, 22 nt, Human
aguucgagaucugcugaugaga

SEQ ID NO: 61282 - RNA, 22 nt, Human
aguucuaaacacuugaggaacc

SEQ ID NO: 61283 - RNA, 22 nt, Human
aguucuaagaugcuccacagag

SEQ ID NO: 61284 - RNA, 22 nt, Human
aguucuaaggugaguagagagg

SEQ ID NO: 61285 - RNA, 22 nt, Human
aguucuaauugcguuuucuugc

SEQ ID NO: 61286 - RNA, 23 nt, Human
aguucucaaaaccagcuugacaa

SEQ ID NO: 61287 - RNA, 22 nt, Human
aguucucaagacaauuaccugu

SEQ ID NO: 61288 - RNA, 22 nt, Human
aguucucaucaugaagcauaag

SEQ ID NO: 61289 - RNA, 22 nt, Human
aguucucauugcaugagacaga

SEQ ID NO: 61290 - RNA, 22 nt, Human
aguucucuggcuccuuuccaga

SEQ ID NO: 61291 - RNA, 22 nt, Human
aguucucuuccacagccuccuc

SEQ ID NO: 61292 - RNA, 22 nt, Human
aguucugacucugaaucuggga

SEQ ID NO: 61293 - RNA, 22 nt, Human
aguucugcugcugccuagggug

SEQ ID NO: 61294 - RNA, 22 nt, Human
aguucugugacaauaucauuac

SEQ ID NO: 61295 - RNA, 22 nt, Human
aguucuuauuuuggaacugagg

SEQ ID NO: 61296 - RNA, 22 nt, Human
aguucuuuguaaaaggucucua

SEQ ID NO: 61297 - RNA, 22 nt, Human
aguucuuugucaucucuggagu

SEQ ID NO: 61298 - RNA, 22 nt, Human
aguucuuuuaccaaggcaaaug

SEQ ID NO: 61299 - RNA, 22 nt, Human
aguugaaaauuaagugaauuuc

SEQ ID NO: 61300 - RNA, 22 nt, Human
aguugaauauacuugcuguugc

SEQ ID NO: 61301 - RNA, 22 nt, Human
aguugacaauaaauuuaauugg

SEQ ID NO: 61302 - RNA, 22 nt, Human
aguugcugauucugucugugau

SEQ ID NO: 61303 - RNA, 22 nt, Human
aguugcuggcaccugugaguau

SEQ ID NO: 61304 - RNA, 22 nt, Human
aguugcugguaaauguuaucaa

SEQ ID NO: 61305 - RNA, 22 nt, Human
aguuggcagucugcaaccugga

SEQ ID NO: 61306 - RNA, 22 nt, Human
aguuggcgggacauguggaaag

SEQ ID NO: 61307 - RNA, 22 nt, Human
aguuggcuucaaaggcagagag

SEQ ID NO: 61308 - RNA, 22 nt, Human
aguuguaauaacaauaccaaaa

SEQ ID NO: 61309 - RNA, 22 nt, Human
aguugugaauagaucugauugg

SEQ ID NO: 61310 - RNA, 22 nt, Human
aguuuacaacaguagcuaugga

SEQ ID NO: 61311 - RNA, 22 nt, Human
aguuuacacuaugaaaagacua

SEQ ID NO: 61312 - RNA, 22 nt, Human
aguuuacaguucucaucgcaac

SEQ ID NO: 61313 - RNA, 22 nt, Human
aguuuagaaaaucuguuucuuc

SEQ ID NO: 61314 - RNA, 22 nt, Human
aguuuagaagaggaacuuguua

SEQ ID NO: 61315 - RNA, 19 nt, Human
aguuuagagagacucuaaa

SEQ ID NO: 61316 - RNA, 20 nt, Human
aguuuagaggccaacaagcc

SEQ ID NO: 61317 - RNA, 22 nt, Human
aguuuauagcccagauucaugg

SEQ ID NO: 61318 - RNA, 22 nt, Human
aguuuaugucuuuacuucagcu

SEQ ID NO: 61319 - RNA, 22 nt, Human
aguuuauguguaagacagcugu

SEQ ID NO: 61320 - RNA, 20 nt, Human
aguuuauuccaggagaacug

SEQ ID NO: 61321 - RNA, 17 nt, Human
aguuuauuuagccuucu

SEQ ID NO: 61322 - RNA, 22 nt, Human
aguuucacacaacauuugcaug

SEQ ID NO: 61323 - RNA, 22 nt, Human
aguuucacagaauaugaagguu

SEQ ID NO: 61324 - RNA, 21 nt, Human
aguuucacagaggggccgucc

SEQ ID NO: 61325 - RNA, 22 nt, Human
aguuucacaugcauggaugugu

SEQ ID NO: 61326 - RNA, 22 nt, Human
aguuucaugagacagauuuuca

SEQ ID NO: 61327 - RNA, 22 nt, Human
aguuuccaaagcauguucacac

SEQ ID NO: 61328 - RNA, 22 nt, Human
aguuuccaaauauuguuuuagc

SEQ ID NO: 61329 - RNA, 22 nt, Human
aguuuccagcacagggcaagcu

SEQ ID NO: 61330 - RNA, 19 nt, Human
aguuucccuggagacauca

SEQ ID NO: 61331 - RNA, 21 nt, Human
aguuuccucaucugcauagga

SEQ ID NO: 61332 - RNA, 22 nt, Human
aguuuccucauguuaauaugga

SEQ ID NO: 61333 - RNA, 22 nt, Human
aguuuccugggagauucuuaca

SEQ ID NO: 61334 - RNA, 22 nt, Human
aguuucuaacauauagcauugg

SEQ ID NO: 61335 - RNA, 22 nt, Human
aguuucuagcaaggauuguuga

SEQ ID NO: 61336 - RNA, 22 nt, Human
aguuucuagccucacuguuuag

SEQ ID NO: 61337 - RNA, 22 nt, Human
aguuucuugaagacugauguuu

SEQ ID NO: 61338 - RNA, 22 nt, Human
aguuucuuuagauagaaaguuc

SEQ ID NO: 61339 - RNA, 22 nt, Human
aguuugaaaguauugacagaag

SEQ ID NO: 61340 - RNA, 22 nt, Human
aguuugaagaaggugagaugca

SEQ ID NO: 61341 - RNA, 22 nt, Human
aguuugacaaaguaaaaugaca

SEQ ID NO: 61342 - RNA, 21 nt, Human
aguuugaugcaauuucugaga

SEQ ID NO: 61343 - RNA, 22 nt, Human
aguuugauggcuuaauaguaga

SEQ ID NO: 61344 - RNA, 22 nt, Human
aguuugauuugucuaucuucau

SEQ ID NO: 61345 - RNA, 22 nt, Human
aguggaaggcugggaaaugcgg

SEQ ID NO: 61346 - RNA, 22 nt, Human
aguggaauguagaaaaaagaug

SEQ ID NO: 61347 - RNA, 22 nt, Human
aguggaauugcugauugaaaua

SEQ ID NO: 61348 - RNA, 22 nt, Human
aguggagaauaugcagaaagcc

SEQ ID NO: 61349 - RNA, 22 nt, Human
aguggaggcacuaauuggauuu

SEQ ID NO: 61350 - RNA, 22 nt, Human
aguggaugguauugggaccagg

SEQ ID NO: 61351 - RNA, 22 nt, Human
aguguguuuaggcugcggguug

SEQ ID NO: 61352 - RNA, 22 nt, Human
aguguuaacaugaaugguuucc

SEQ ID NO: 61353 - RNA, 18 nt, Human
aguguuaaguaaguagca

SEQ ID NO: 61354 - RNA, 22 nt, Human
aguguuaaugguguauauuagg

SEQ ID NO: 61355 - RNA, 22 nt, Human
aguguuagugaaagguguuuau

SEQ ID NO: 61356 - RNA, 22 nt, Human
aguguuauuuuucaaaggcccu

SEQ ID NO: 61357 - RNA, 22 nt, Human
aguguucauuuauucauucacu

SEQ ID NO: 61358 - RNA, 17 nt, Human
aguguucuggguugccc

SEQ ID NO: 61359 - RNA, 22 nt, Human
aguguucuucugggguaugcuc

SEQ ID NO: 61360 - RNA, 22 nt, Human
aguguucuucuucaaagcucug

SEQ ID NO: 61361 - RNA, 23 nt, Human
aguguugagcagaugcaaagguu

SEQ ID NO: 61362 - RNA, 22 nt, Human
aguguuggaccgagguggagcc

SEQ ID NO: 61363 - RNA, 22 nt, Human
aguguugggucuuuagaauuua

SEQ ID NO: 61364 - RNA, 23 nt, Human
aguguugguugggaagccaagca

SEQ ID NO: 61365 - RNA, 22 nt, Human
aguguuuaaugccuuuuccagc

SEQ ID NO: 61366 - RNA, 22 nt, Human
aguguuuacauauaaggcccuu

SEQ ID NO: 61367 - RNA, 22 nt, Human
aguguuuacauugaagcuugua

SEQ ID NO: 61368 - RNA, 22 nt, Human
aguguuuacucaaaggguucca

SEQ ID NO: 61369 - RNA, 20 nt, Human
aguguuuagaauacuauuau

SEQ ID NO: 61370 - RNA, 22 nt, Human
aguguuuagucaaguaagacgc

SEQ ID NO: 61371 - RNA, 22 nt, Human
aguguuuauuagauuucccuuu

SEQ ID NO: 61372 - RNA, 22 nt, Human
aguguuuauugugugccacaca

SEQ ID NO: 61373 - RNA, 22 nt, Human
aguguuuauuuacagaugguuu

SEQ ID NO: 61374 - RNA, 22 nt, Human
aguguuucaagaagcaggaagu

SEQ ID NO: 61375 - RNA, 22 nt, Human
aguguuucaauccuagggguug

SEQ ID NO: 61376 - RNA, 22 nt, Human
aguguuucuggcaaaugaaagu

SEQ ID NO: 61377 - RNA, 22 nt, Human
aguguuucugugccccaguguu

SEQ ID NO: 61378 - RNA, 22 nt, Human
aguguuugaguuugcggcauug

SEQ ID NO: 61379 - RNA, 22 nt, Human
aguguuugcaucucauugauuu

SEQ ID NO: 61380 - RNA, 22 nt, Human
aguguuugucccguuagaaaug

SEQ ID NO: 61381 - RNA, 21 nt, Human
aguuaaaccuuuagagaacua

SEQ ID NO: 61382 - RNA, 22 nt, Human
aguuaaacuuugccagauggga

SEQ ID NO: 61383 - RNA, 22 nt, Human
aguuaaagaaagauaauucgcc

SEQ ID NO: 61384 - RNA, 22 nt, Human
aguuaacacaaguaagauucca

SEQ ID NO: 61385 - RNA, 22 nt, Human
aguuaacuaaauuaagagacaa

SEQ ID NO: 61386 - RNA, 22 nt, Human
aguuaacucugaaaagacauuu

SEQ ID NO: 61387 - RNA, 22 nt, Human
aguuaagagugugaaaauguua

SEQ ID NO: 61388 - RNA, 22 nt, Human
aguuaaugagcauuuuggaaug

SEQ ID NO: 61389 - RNA, 22 nt, Human
aguuacaagcuauuuuacuuaa

SEQ ID NO: 61390 - RNA, 21 nt, Human
aguuacaaguuuauucagagg

SEQ ID NO: 61391 - RNA, 22 nt, Human
aguuacaugugaauagaaagua

SEQ ID NO: 61392 - RNA, 22 nt, Human
aguuacauucugagcugaguag

SEQ ID NO: 61393 - RNA, 22 nt, Human
aguuacuuucugaucagugugu

SEQ ID NO: 61394 - RNA, 22 nt, Human
aguuagaauagucagauuguag

SEQ ID NO: 61395 - RNA, 22 nt, Human
aguuagaauauaauuauguuaa

SEQ ID NO: 61396 - RNA, 21 nt, Human
aguuagcagauuucugucucc

SEQ ID NO: 61397 - RNA, 22 nt, Human
aguuagcagcuuauuagaaaca

SEQ ID NO: 61398 - RNA, 22 nt, Human
aguuaguggcaaagugguuuga

SEQ ID NO: 61399 - RNA, 22 nt, Human
aguuauaaucugcuacugauau

SEQ ID NO: 61400 - RNA, 20 nt, Human
aguuauaguaucuagccaug

SEQ ID NO: 61401 - RNA, 22 nt, Human
aguuauauaacuaucuagaugc

SEQ ID NO: 61402 - RNA, 22 nt, Human
aguuaucagguguuuucaugga

SEQ ID NO: 61403 - RNA, 22 nt, Human
aguuaucccaaaugcaaaaugg

SEQ ID NO: 61404 - RNA, 22 nt, Human
aguucaaacucuauaagaacuu

SEQ ID NO: 61405 - RNA, 22 nt, Human
aguucaauagaaaaauauauua

SEQ ID NO: 61406 - RNA, 22 nt, Human
aguucacaagugcauuucagga

SEQ ID NO: 61407 - RNA, 20 nt, Human
aguucacaggccaaauuucu

SEQ ID NO: 61408 - RNA, 22 nt, Human
aguucacagggaagguuauugu

SEQ ID NO: 61409 - RNA, 22 nt, Human
aguucacauuccgagguacugg

SEQ ID NO: 61410 - RNA, 22 nt, Human
aguucacuauagaagacagugu

SEQ ID NO: 61411 - RNA, 22 nt, Human
aguucagaaaugucuuugcaaa

SEQ ID NO: 61412 - RNA, 22 nt, Human
aguucagccauuuguuaacuau

SEQ ID NO: 61413 - RNA, 22 nt, Human
aguucaucuuacuuagaguaca

SEQ ID NO: 61414 - RNA, 19 nt, Human
aguuccacacuuuaucugg

SEQ ID NO: 61415 - RNA, 22 nt, Human
aguuccagaacuggaaaaggac

SEQ ID NO: 61416 - RNA, 22 nt, Human
aguuccaugucuggguuuguga

SEQ ID NO: 61417 - RNA, 22 nt, Human
aguucccuccacaacuucucac

SEQ ID NO: 61418 - RNA, 22 nt, Human
aguuccuauacugggucagucc

SEQ ID NO: 61419 - RNA, 22 nt, Human
aguucuaaguaaauauuuuaua

SEQ ID NO: 61420 - RNA, 21 nt, Human
aguucuauagucuucacagcc

SEQ ID NO: 61421 - RNA, 22 nt, Human
aguucuauuucuaacauguuau

SEQ ID NO: 61422 - RNA, 22 nt, Human
aguucucagcuuaguaugcugu

SEQ ID NO: 61423 - RNA, 22 nt, Human
aguucucaggucagcugagucu

SEQ ID NO: 61424 - RNA, 23 nt, Human
aguucucauucaucacggccuau

SEQ ID NO: 61425 - RNA, 22 nt, Human
aguucucgagcgucccuguuuc

SEQ ID NO: 61426 - RNA, 22 nt, Human
aguucugauaaaggaggaagau

SEQ ID NO: 61427 - RNA, 22 nt, Human
aguucugccuauauagaaacuc

SEQ ID NO: 61428 - RNA, 22 nt, Human
aguucuggcgcccaugagcaga

SEQ ID NO: 61429 - RNA, 22 nt, Human
aguucuggcggcugucggcacu

SEQ ID NO: 61430 - RNA, 22 nt, Human
aguucugggaggugcacgucca

SEQ ID NO: 61431 - RNA, 22 nt, Human
aguucuguggcugugcccugua

SEQ ID NO: 61432 - RNA, 22 nt, Human
aguucuuauugaauagaaauca

SEQ ID NO: 61433 - RNA, 22 nt, Human
aguucuucauaaccuuacugug

SEQ ID NO: 61434 - RNA, 22 nt, Human
aguucuuucuagacacguagac

SEQ ID NO: 61435 - RNA, 22 nt, Human
aguucuuugugaguaauacaga

SEQ ID NO: 61436 - RNA, 22 nt, Human
aguugaaauuagaguccuggcu

SEQ ID NO: 61437 - RNA, 22 nt, Human
aguugaagguuggcugauccau

SEQ ID NO: 61438 - RNA, 22 nt, Human
aguugauuuuucuggcucagcc

SEQ ID NO: 61439 - RNA, 22 nt, Human
aguugcacuuucuagauacugu

SEQ ID NO: 61440 - RNA, 22 nt, Human
aguugcauguccaaggggguag

SEQ ID NO: 61441 - RNA, 22 nt, Human
aguugcugcuucucucuagaga

SEQ ID NO: 61442 - RNA, 22 nt, Human
aguugcugggaaagauuucagu

SEQ ID NO: 61443 - RNA, 22 nt, Human
aguugcuucccuauucuuagca

SEQ ID NO: 61444 - RNA, 22 nt, Human
aguuggaagacacccugaaauc

SEQ ID NO: 61445 - RNA, 22 nt, Human
aguuggagugaacaugagauug

SEQ ID NO: 61446 - RNA, 22 nt, Human
aguuggcaaggucuggccagcg

SEQ ID NO: 61447 - RNA, 17 nt, Human
aguuggcagccguugcu

SEQ ID NO: 61448 - RNA, 22 nt, Human
aguuggcauuuuauuuaaguau

SEQ ID NO: 61449 - RNA, 22 nt, Human
aguuggguuugugucaguugca

SEQ ID NO: 61450 - RNA, 22 nt, Human
aguuggugggugugagcuggac

SEQ ID NO: 61451 - RNA, 22 nt, Human
aguugguucacuccuucaugcc

SEQ ID NO: 61452 - RNA, 22 nt, Human
aguuguaacagauucuaacaua

SEQ ID NO: 61453 - RNA, 22 nt, Human
aguuguacauugugaacauuca

SEQ ID NO: 61454 - RNA, 22 nt, Human
aguuguauacacuuaggcagau

SEQ ID NO: 61455 - RNA, 22 nt, Human
aguuguaucugaaugcauguag

SEQ ID NO: 61456 - RNA, 22 nt, Human
aguugugagaaacagaaugagc

SEQ ID NO: 61457 - RNA, 22 nt, Human
aguuuaauccuccagcccaacu

SEQ ID NO: 61458 - RNA, 21 nt, Human
aguuuacaacuguccagcccc

SEQ ID NO: 61459 - RNA, 22 nt, Human
aguuuacagauguaguaggggu

SEQ ID NO: 61460 - RNA, 22 nt, Human
augcacaggcugugggcugguu

SEQ ID NO: 61461 - RNA, 19 nt, Human
augcacagucauuuguaag

SEQ ID NO: 61462 - RNA, 22 nt, Human
augcacaucacucugaagaaaa

SEQ ID NO: 61463 - RNA, 17 nt, Human
augcacauguaagagga

SEQ ID NO: 61464 - RNA, 22 nt, Human
augcacauguaugucaauauuu

SEQ ID NO: 61465 - RNA, 20 nt, Human
augcacccucagggucccug

SEQ ID NO: 61466 - RNA, 22 nt, Human
augcacugccccucugcaccuc

SEQ ID NO: 61467 - RNA, 22 nt, Human
augcacugggugaggaaggaga

SEQ ID NO: 61468 - RNA, 22 nt, Human
augcagaacguuugugaaacuu

SEQ ID NO: 61469 - RNA, 22 nt, Human
augcagaaugaguucacgaucu

SEQ ID NO: 61470 - RNA, 22 nt, Human
augcagacaugggagaguugag

SEQ ID NO: 61471 - RNA, 21 nt, Human
augcagagaacuccagggaag

SEQ ID NO: 61472 - RNA, 18 nt, Human
augcagcaaucagaaaua

SEQ ID NO: 61473 - RNA, 20 nt, Human
augcagcauuguuguggcaa

SEQ ID NO: 61474 - RNA, 22 nt, Human
augcagcuauuugagcauguca

SEQ ID NO: 61475 - RNA, 22 nt, Human
augcagcucauuuguuuaaaag

SEQ ID NO: 61476 - RNA, 22 nt, Human
augcagcuucaggauuaugaug

SEQ ID NO: 61477 - RNA, 22 nt, Human
augcaggaagucggggagcggg

SEQ ID NO: 61478 - RNA, 22 nt, Human
augcaggaugcagaggggcccg

SEQ ID NO: 61479 - RNA, 22 nt, Human
augcaggauuagaaaguugccu

SEQ ID NO: 61480 - RNA, 22 nt, Human
augcagggaaaagagauauuau

SEQ ID NO: 61481 - RNA, 22 nt, Human
augcaggggccgccuggccagg

SEQ ID NO: 61482 - RNA, 22 nt, Human
augcaggggcuguguuuugggu

SEQ ID NO: 61483 - RNA, 22 nt, Human
augcaggguuauuucaaaaaua

SEQ ID NO: 61484 - RNA, 17 nt, Human
augcaggugugaggggc

SEQ ID NO: 61485 - RNA, 22 nt, Human
augcagguugggcaaguguggg

SEQ ID NO: 61486 - RNA, 22 nt, Human
augcaguaaauguucuaguuug

SEQ ID NO: 61487 - RNA, 22 nt, Human
augcagucauggaaugcucuca

SEQ ID NO: 61488 - RNA, 22 nt, Human
augcagucuaagcauguaaggg

SEQ ID NO: 61489 - RNA, 20 nt, Human
augcagucuuguggcaacua

SEQ ID NO: 61490 - RNA, 22 nt, Human
augcaguggcagcuccuggugu

SEQ ID NO: 61491 - RNA, 22 nt, Human
augcaguuugcuucgcagcagu

SEQ ID NO: 61492 - RNA, 22 nt, Human
augcauaagugcagcagauuug

SEQ ID NO: 61493 - RNA, 22 nt, Human
augcauauaauggccagaacaa

SEQ ID NO: 61494 - RNA, 22 nt, Human
augcauauagaacauuugacau

SEQ ID NO: 61495 - RNA, 22 nt, Human
augcauauauacauacacaguc

SEQ ID NO: 61496 - RNA, 22 nt, Human
augcauaucagugauuguuugc

SEQ ID NO: 61497 - RNA, 22 nt, Human
augcauaugcauggacacucag

SEQ ID NO: 61498 - RNA, 22 nt, Human
augcauauggcuugagggaaua

SEQ ID NO: 61499 - RNA, 22 nt, Human
augcauauugucauuuaguccu

SEQ ID NO: 61500 - RNA, 22 nt, Human
aucauuauaaugguauaguugu

SEQ ID NO: 61501 - RNA, 22 nt, Human
aucauucagucucugggacagu

SEQ ID NO: 61502 - RNA, 22 nt, Human
aucauucaucuuauugccaguc

SEQ ID NO: 61503 - RNA, 22 nt, Human
aucauuccacauguaccacuag

SEQ ID NO: 61504 - RNA, 22 nt, Human
aucauucucugcuugagcacuc

SEQ ID NO: 61505 - RNA, 22 nt, Human
aucauugaaauguaguuucauc

SEQ ID NO: 61506 - RNA, 22 nt, Human
aucauugaauugcuuuguucuu

SEQ ID NO: 61507 - RNA, 22 nt, Human
aucauuuaaaacaagucucuau

SEQ ID NO: 61508 - RNA, 22 nt, Human
aucauuuacaaacucagcauug

SEQ ID NO: 61509 - RNA, 22 nt, Human
aucauuucccuuuagaucacaa

SEQ ID NO: 61510 - RNA, 22 nt, Human
aucauuugaacagaauuuguuu

SEQ ID NO: 61511 - RNA, 22 nt, Human
aucauuugccucaagugaaagu

SEQ ID NO: 61512 - RNA, 22 nt, Human
aucauuugugcauaguaacaga

SEQ ID NO: 61513 - RNA, 22 nt, Human
aucauuuuauggcugagaggac

SEQ ID NO: 61514 - RNA, 22 nt, Human
auccaaaaccagugcauuuucc

SEQ ID NO: 61515 - RNA, 22 nt, Human
auccaaacuaugacuaguguuc

SEQ ID NO: 61516 - RNA, 22 nt, Human
auccaagagacauuugugaaug

SEQ ID NO: 61517 - RNA, 22 nt, Human
auccaauggggagugaguucuu

SEQ ID NO: 61518 - RNA, 22 nt, Human
auccacagagaggaagaauagu

SEQ ID NO: 61519 - RNA, 22 nt, Human
auccacagucagaacgggccua

SEQ ID NO: 61520 - RNA, 22 nt, Human
auccacagucuuagccaucaaa

SEQ ID NO: 61521 - RNA, 22 nt, Human
auccagaacaccuguaucacca

SEQ ID NO: 61522 - RNA, 22 nt, Human
auccagaagcauguguaauuug

SEQ ID NO: 61523 - RNA, 23 nt, Human
auccagccuggggguuuaaccac

SEQ ID NO: 61524 - RNA, 20 nt, Human
auccaggauguugauuugaa

SEQ ID NO: 61525 - RNA, 22 nt, Human
auccaggcauucugacuucaag

SEQ ID NO: 61526 - RNA, 22 nt, Human
auccaggccugagucugguccu

SEQ ID NO: 61527 - RNA, 22 nt, Human
auccaggcugcgggucucaagu

SEQ ID NO: 61528 - RNA, 22 nt, Human
auccaggcuggguguggcuacu

SEQ ID NO: 61529 - RNA, 22 nt, Human
auccaggcugucuaaugggaga

SEQ ID NO: 61530 - RNA, 22 nt, Human
auccaggcuuaaugggagccac

SEQ ID NO: 61531 - RNA, 19 nt, Human
auccaggucauguaguucu

SEQ ID NO: 61532 - RNA, 22 nt, Human
auccaguagugacuuuuacauu

SEQ ID NO: 61533 - RNA, 22 nt, Human
auccaguaugagguagggcuug

SEQ ID NO: 61534 - RNA, 22 nt, Human
auccaguuccaaagaucauuua

SEQ ID NO: 61535 - RNA, 22 nt, Human
auccaguucucagugcuuacag

SEQ ID NO: 61536 - RNA, 22 nt, Human
auccaguuuaugucauauucuu

SEQ ID NO: 61537 - RNA, 22 nt, Human
auccauauaggcagauggcaca

SEQ ID NO: 61538 - RNA, 20 nt, Human
auccaucagagaaaauaaag

SEQ ID NO: 61539 - RNA, 20 nt, Human
auccaugagagucuggauuc

SEQ ID NO: 61540 - RNA, 22 nt, Human
auccaugauuaguaggauaaag

SEQ ID NO: 61541 - RNA, 21 nt, Human
auccauucuccgguuaaugag

SEQ ID NO: 61542 - RNA, 18 nt, Human
auccauuuaaugccugga

SEQ ID NO: 61543 - RNA, 22 nt, Human
auccauuucaguguuccacuug

SEQ ID NO: 61544 - RNA, 22 nt, Human
auccauuucuaucuugcugagg

SEQ ID NO: 61545 - RNA, 22 nt, Human
auccauuugaaagaacagucca

SEQ ID NO: 61546 - RNA, 22 nt, Human
auccauuuguaaauguuagagu

SEQ ID NO: 61547 - RNA, 22 nt, Human
auccauuuguuuacugauggac

SEQ ID NO: 61548 - RNA, 22 nt, Human
auccauuuuccuuggcagcagg

SEQ ID NO: 61549 - RNA, 22 nt, Human
aucccaugagaccacguuggcu

SEQ ID NO: 61550 - RNA, 22 nt, Human
aucccauuuccuaguacaucau

SEQ ID NO: 61551 - RNA, 22 nt, Human
aucccauuuccuguuuugucaa

SEQ ID NO: 61552 - RNA, 22 nt, Human
auccccacgauauagccaaagc

SEQ ID NO: 61553 - RNA, 22 nt, Human
auccccagacuuuagauuucuc

SEQ ID NO: 61554 - RNA, 17 nt, Human
auccccagcaucuagaa

SEQ ID NO: 61555 - RNA, 22 nt, Human
aucccccucuuggauggcggca

SEQ ID NO: 61556 - RNA, 22 nt, Human
auccccuucacacccucugcau

SEQ ID NO: 61557 - RNA, 22 nt, Human
aucccugaaugcuccugacugg

SEQ ID NO: 61558 - RNA, 22 nt, Human
aucccugagguuccuccugagc

SEQ ID NO: 61559 - RNA, 22 nt, Human
aucccuggacggcgccucccca

SEQ ID NO: 61560 - RNA, 20 nt, Human
aucccuggccuuaaggagug

SEQ ID NO: 61561 - RNA, 23 nt, Human
aucccuucuccaguguggugagg

SEQ ID NO: 61562 - RNA, 21 nt, Human
auccguuuaauaauacugaau

SEQ ID NO: 61563 - RNA, 22 nt, Human
auccuaaaauuguucaauuucu

SEQ ID NO: 61564 - RNA, 22 nt, Human
auccucagagaacgaacacaau

SEQ ID NO: 61565 - RNA, 22 nt, Human
auccucaguguuucugacaucu

SEQ ID NO: 61566 - RNA, 23 nt, Human
auccucucuccaucccacugugc

SEQ ID NO: 61567 - RNA, 22 nt, Human
auccucugaccgcugcagggag

SEQ ID NO: 61568 - RNA, 22 nt, Human
auccucuguggauuacaccuag

SEQ ID NO: 61569 - RNA, 22 nt, Human
aagcagaaaaacugagcuccaa

SEQ ID NO: 61570 - RNA, 22 nt, Human
aagcagaauuuaauagaaaggu

SEQ ID NO: 61571 - RNA, 22 nt, Human
aagcagagaaaagcuuagguuc

SEQ ID NO: 61572 - RNA, 22 nt, Human
aagcagagaaucugggagcgag

SEQ ID NO: 61573 - RNA, 22 nt, Human
aagcagagccaccagcuuugga

SEQ ID NO: 61574 - RNA, 22 nt, Human
aagcagagguagggugugcagu

SEQ ID NO: 61575 - RNA, 22 nt, Human
aagcagaguuagcuugucaccu

SEQ ID NO: 61576 - RNA, 22 nt, Human
aagcagaucugauagggcccug

SEQ ID NO: 61577 - RNA, 22 nt, Human
aagcagcaugauuguaauacua

SEQ ID NO: 61578 - RNA, 22 nt, Human
aagcaggaaggagcccagggca

SEQ ID NO: 61579 - RNA, 22 nt, Human
aagcaaagagauaaccuuuugg

SEQ ID NO: 61580 - RNA, 22 nt, Human
aagcaaaggcaggagcuuguga

SEQ ID NO: 61581 - RNA, 22 nt, Human
aagcaaauauuucuagagacug

SEQ ID NO: 61582 - RNA, 22 nt, Human
aagcaaaugugggugcagaauu

SEQ ID NO: 61583 - RNA, 22 nt, Human
aagcaacagaaacauucuaaua

SEQ ID NO: 61584 - RNA, 22 nt, Human
aagcaacuaaggcaaggaaaug

SEQ ID NO: 61585 - RNA, 22 nt, Human
aagcaacuguugaauuggacua

SEQ ID NO: 61586 - RNA, 22 nt, Human
aagcaauagcaacaacuuuaca

SEQ ID NO: 61587 - RNA, 22 nt, Human
aagcaauguguuugaaaggcca

SEQ ID NO: 61588 - RNA, 22 nt, Human
aagcaauguuagaggccuuagg

SEQ ID NO: 61589 - RNA, 19 nt, Human
aagcaauguugugaaucua

SEQ ID NO: 61590 - RNA, 22 nt, Human
aagcacaauuucaccuucuugu

SEQ ID NO: 61591 - RNA, 22 nt, Human
aagcacagcagagccuugcuug

SEQ ID NO: 61592 - RNA, 22 nt, Human
aagcacaggagacgcacagcca

SEQ ID NO: 61593 - RNA, 22 nt, Human
aagcacagggacuuuaggaaua

SEQ ID NO: 61594 - RNA, 18 nt, Human
aagcacagguguuucagg

SEQ ID NO: 61595 - RNA, 22 nt, Human
aagcacauugccuggcacauag

SEQ ID NO: 61596 - RNA, 22 nt, Human
aagcaccuggguuauaucuuag

SEQ ID NO: 61597 - RNA, 22 nt, Human
aagcacuaauauuuuggcaccu

SEQ ID NO: 61598 - RNA, 22 nt, Human
aagcacuggagaugccagagug

SEQ ID NO: 61599 - RNA, 22 nt, Human
aagcacugugccucauaucuga

SEQ ID NO: 61600 - RNA, 22 nt, Human
aagcacuuagaagagugccugc

SEQ ID NO: 61601 - RNA, 22 nt, Human
aagcagaaggggaauaauauuu

SEQ ID NO: 61602 - RNA, 22 nt, Human
aagcagaaguugaucuaccaua

SEQ ID NO: 61603 - RNA, 22 nt, Human
aagcagagaccggcuaauggag

SEQ ID NO: 61604 - RNA, 22 nt, Human
aagcagagcaagcguauuuauu

SEQ ID NO: 61605 - RNA, 22 nt, Human
aagcagaggaccgacggaggga

SEQ ID NO: 61606 - RNA, 22 nt, Human
aagcagaugccaagauuuacca

SEQ ID NO: 61607 - RNA, 22 nt, Human
aagcagaugcguuggagcaguu

SEQ ID NO: 61608 - RNA, 22 nt, Human
aagcagaugggacuccaaggca

SEQ ID NO: 61609 - RNA, 22 nt, Human
aagcagauuggggauuuccaug

SEQ ID NO: 61610 - RNA, 22 nt, Human
aagcagcaacaaacuggauaaa

SEQ ID NO: 61611 - RNA, 22 nt, Human
aagcagcacgcuuugccaacaa

SEQ ID NO: 61612 - RNA, 22 nt, Human
aagcagcagccaucccccaagg

SEQ ID NO: 61613 - RNA, 22 nt, Human
aagcagcagccugaaguacguc

SEQ ID NO: 61614 - RNA, 22 nt, Human
aagcagcauaauugcuauuuua

SEQ ID NO: 61615 - RNA, 22 nt, Human
aagcagcauguggguuaucggg

SEQ ID NO: 61616 - RNA, 22 nt, Human
aagcagcauuguaaccaaugcc

SEQ ID NO: 61617 - RNA, 22 nt, Human
aagcagccacuggccaguuaua

SEQ ID NO: 61618 - RNA, 22 nt, Human
aagcagccagccaucaugcccg

SEQ ID NO: 61619 - RNA, 22 nt, Human
aagcagccuggacuugggcugg

SEQ ID NO: 61620 - RNA, 22 nt, Human
aagcagcugaaggauucagggu

SEQ ID NO: 61621 - RNA, 22 nt, Human
aagcagcugauuucacagcuca

SEQ ID NO: 61622 - RNA, 22 nt, Human
aagcagcugcagguucaaagga

SEQ ID NO: 61623 - RNA, 22 nt, Human
aagcagcuggaagaguaagaug

SEQ ID NO: 61624 - RNA, 22 nt, Human
aagcagcugugugacauaaucu

SEQ ID NO: 61625 - RNA, 22 nt, Human
aagcagcuuaaauuagagccug

SEQ ID NO: 61626 - RNA, 22 nt, Human
aagcagcuuucuuuccugugaa

SEQ ID NO: 61627 - RNA, 22 nt, Human
aagcaggacguauuucuauccu

SEQ ID NO: 61628 - RNA, 22 nt, Human
aagcaggagagccugggcgagc

SEQ ID NO: 61629 - RNA, 22 nt, Human
aagcaggagaugcaggaaugua

SEQ ID NO: 61630 - RNA, 22 nt, Human
aagcaggauggaucuaguguuc

SEQ ID NO: 61631 - RNA, 22 nt, Human
aagcaggcauuccagagacaau

SEQ ID NO: 61632 - RNA, 22 nt, Human
aagcaggcgagggccuggagca

SEQ ID NO: 61633 - RNA, 21 nt, Human
aagcaggcuguaaucaugugg

SEQ ID NO: 61634 - RNA, 22 nt, Human
aagcaggcuugguguggccgcu

SEQ ID NO: 61635 - RNA, 21 nt, Human
aagcagggacugcccaggucc

SEQ ID NO: 61636 - RNA, 22 nt, Human
aagcagggagaaauuuuucuuc

SEQ ID NO: 61637 - RNA, 22 nt, Human
aagcagggcuagaccaagaaga

SEQ ID NO: 61638 - RNA, 22 nt, Human
aagcagggcuuuaagcgguuuu

SEQ ID NO: 61639 - RNA, 22 nt, Human
aagcagggugucuugacccaug

SEQ ID NO: 61640 - RNA, 22 nt, Human
aagcaggugugagccagugggc

SEQ ID NO: 61641 - RNA, 22 nt, Human
aagcagugcgcucaucuaaggg

SEQ ID NO: 61642 - RNA, 22 nt, Human
aagcaguuaauguuuugucaau

SEQ ID NO: 61643 - RNA, 22 nt, Human
aagcauauuuuaauuagccaca

SEQ ID NO: 61644 - RNA, 20 nt, Human
aagcaucuggauguagcaau

SEQ ID NO: 61645 - RNA, 22 nt, Human
aagcaucuuaaaaaguaucaga

SEQ ID NO: 61646 - RNA, 22 nt, Human
aagcaucuuagaccugaguucc

SEQ ID NO: 61647 - RNA, 22 nt, Human
aagcaucuucuaucaguuagac

SEQ ID NO: 61648 - RNA, 22 nt, Human
aagcaugcaaucugugauaagg

SEQ ID NO: 61649 - RNA, 22 nt, Human
aagcauggccucuccgcucccc

SEQ ID NO: 61650 - RNA, 20 nt, Human
aagcauggucaaaacuuaug

SEQ ID NO: 61651 - RNA, 23 nt, Human
aagcaugguucacaguuaguacu

SEQ ID NO: 61652 - RNA, 22 nt, Human
aagcauguacucaagcaaaugu

SEQ ID NO: 61653 - RNA, 22 nt, Human
aagcauguguauaagcugggca

SEQ ID NO: 61654 - RNA, 19 nt, Human
aagcauuagccaaagcauu

SEQ ID NO: 61655 - RNA, 17 nt, Human
aagcauuuaauuugcua

SEQ ID NO: 61656 - RNA, 22 nt, Human
aagcauuucuguuuaucuaucg

SEQ ID NO: 61657 - RNA, 22 nt, Human
aagcauuuuaguaaugaacuug

SEQ ID NO: 61658 - RNA, 22 nt, Human
aagcauuuugccacuugaaguu

SEQ ID NO: 61659 - RNA, 22 nt, Human
aagcauuuuugaaaugguagga

SEQ ID NO: 61660 - RNA, 22 nt, Human
aagccaagguuuuggucacagc

SEQ ID NO: 61661 - RNA, 22 nt, Human
aagccaaugauacgggugaucu

SEQ ID NO: 61662 - RNA, 22 nt, Human
aagccaauguugccuggguuuc

SEQ ID NO: 61663 - RNA, 22 nt, Human
aagccacagaucguucugucac

SEQ ID NO: 61664 - RNA, 22 nt, Human
aagccacugcagcaggagcugc

SEQ ID NO: 61665 - RNA, 22 nt, Human
aagccacuuggggaaagaugga

SEQ ID NO: 61666 - RNA, 22 nt, Human
aagccagauagaagaacucauu

SEQ ID NO: 61667 - RNA, 22 nt, Human
aagccagccagugccagucuua

SEQ ID NO: 61668 - RNA, 22 nt, Human
aagccaggagcgaggccucggc

SEQ ID NO: 61669 - RNA, 22 nt, Human
aagccagggucaggggccuccu

SEQ ID NO: 61670 - RNA, 22 nt, Human
aagccaggguuuguggaucuau

SEQ ID NO: 61671 - RNA, 22 nt, Human
aagccaggugugcccaggaucc

SEQ ID NO: 61672 - RNA, 22 nt, Human
aagccaguauucaauggggcua

SEQ ID NO: 61673 - RNA, 22 nt, Human
aagccaguccucuacugggcac

SEQ ID NO: 61674 - RNA, 22 nt, Human
aagccaguuagcacaucauugc

SEQ ID NO: 61675 - RNA, 22 nt, Human
aagccaugcaagccacaaggug

SEQ ID NO: 61676 - RNA, 19 nt, Human
aagcccaguguaugcucuu

SEQ ID NO: 61677 - RNA, 22 nt, Human
aagcccaguuucacacugagac

SEQ ID NO: 61678 - RNA, 22 nt, Human
aaggcuguuguuucacaacaaa

SEQ ID NO: 61679 - RNA, 22 nt, Human
aaggcuguuuauuagaaaaagu

SEQ ID NO: 61680 - RNA, 22 nt, Human
aaggcuuggaguaagcuuggcu

SEQ ID NO: 61681 - RNA, 22 nt, Human
aaggcuuguagauuugggcuuu

SEQ ID NO: 61682 - RNA, 22 nt, Human
aaggcuuuugggaauuuucaac

SEQ ID NO: 61683 - RNA, 22 nt, Human
aagggaaauggccaggcagaga

SEQ ID NO: 61684 - RNA, 22 nt, Human
aagggacauagacuguacaucu

SEQ ID NO: 61685 - RNA, 22 nt, Human
aagggagaaaacuuguggcuua

SEQ ID NO: 61686 - RNA, 20 nt, Human
aagggagaauaaugauugua

SEQ ID NO: 61687 - RNA, 22 nt, Human
aagggagacccaccguccugga

SEQ ID NO: 61688 - RNA, 22 nt, Human
aagggagaggagggucuuguug

SEQ ID NO: 61689 - RNA, 22 nt, Human
aagggaugcaggaaagaagguu

SEQ ID NO: 61690 - RNA, 22 nt, Human
aagggcacagggaaagagugca

SEQ ID NO: 61691 - RNA, 20 nt, Human
aagggcagagggaacagacu

SEQ ID NO: 61692 - RNA, 22 nt, Human
aagggcagagggaaucccacau

SEQ ID NO: 61693 - RNA, 22 nt, Human
aagggcaggcagagaucauaua

SEQ ID NO: 61694 - RNA, 22 nt, Human
aagggcaugggaugaaaaguag

SEQ ID NO: 61695 - RNA, 22 nt, Human
aagggcccauucucucagaaaa

SEQ ID NO: 61696 - RNA, 22 nt, Human
aagcuaaguggaagucuuauca

SEQ ID NO: 61697 - RNA, 22 nt, Human
aagcuagauaacuuuuauauuu

SEQ ID NO: 61698 - RNA, 22 nt, Human
aagcucagagguagauaauguu

SEQ ID NO: 61699 - RNA, 22 nt, Human
aagcucagcagccaggcccugu

SEQ ID NO: 61700 - RNA, 22 nt, Human
aagcucagcaugucuccuagaa

SEQ ID NO: 61701 - RNA, 22 nt, Human
aagcuccccgaaacccaccucu

SEQ ID NO: 61702 - RNA, 22 nt, Human
aagcucuucuguggauuugagu

SEQ ID NO: 61703 - RNA, 22 nt, Human
aagcucuugaguaaacuaguuu

SEQ ID NO: 61704 - RNA, 22 nt, Human
aagcucuuugaccugggccugg

SEQ ID NO: 61705 - RNA, 22 nt, Human
aagcucuuuucauaagagcaaa

SEQ ID NO: 61706 - RNA, 22 nt, Human
aagcugaaauuccuccugaaau

SEQ ID NO: 61707 - RNA, 22 nt, Human
aagcugaaucugaaauagaauu

SEQ ID NO: 61708 - RNA, 22 nt, Human
aagcugaauuuucuaaaagaau

SEQ ID NO: 61709 - RNA, 22 nt, Human
aagcugaggauacaugaagccu

SEQ ID NO: 61710 - RNA, 19 nt, Human
aagcugagggcuguccacc

SEQ ID NO: 61711 - RNA, 22 nt, Human
aagcugaggucaaguagcuagu

SEQ ID NO: 61712 - RNA, 22 nt, Human
aagcugcagcacagagaggugg

SEQ ID NO: 61713 - RNA, 22 nt, Human
aagcugccacacggugaguacu

SEQ ID NO: 61714 - RNA, 22 nt, Human
aagcugccaccagcccagggca

SEQ ID NO: 61715 - RNA, 23 nt, Human
aagcugccagucugaagccuggg

SEQ ID NO: 61716 - RNA, 18 nt, Human
aagcugcccucaggcagg

SEQ ID NO: 61717 - RNA, 22 nt, Human
aagcugccugggaggaagggcu

SEQ ID NO: 61718 - RNA, 22 nt, Human
aagcuggaacaucuugaggaag

SEQ ID NO: 61719 - RNA, 22 nt, Human
aagcuggagaguuaggugaaua

SEQ ID NO: 61720 - RNA, 22 nt, Human
aagcuggcuaaauaaaaggucc

SEQ ID NO: 61721 - RNA, 22 nt, Human
aagcuggcucugaugucagaau

SEQ ID NO: 61722 - RNA, 22 nt, Human
aagcugggacuuagcgcagaua

SEQ ID NO: 61723 - RNA, 22 nt, Human
aagcuguaugaccuaaaucuug

SEQ ID NO: 61724 - RNA, 22 nt, Human
aagcugucaauguaucuagucu

SEQ ID NO: 61725 - RNA, 22 nt, Human
aagcugugaaauagauuacaca

SEQ ID NO: 61726 - RNA, 22 nt, Human
aagcugugaagagcaagugagg

SEQ ID NO: 61727 - RNA, 22 nt, Human
aagcugugguaaaggguagagg

SEQ ID NO: 61728 - RNA, 22 nt, Human
aagcuguguccuagagguguaa

SEQ ID NO: 61729 - RNA, 22 nt, Human
aagcuguucuccagugacucag

SEQ ID NO: 61730 - RNA, 22 nt, Human
aagcuguugaaguaauucagcc

SEQ ID NO: 61731 - RNA, 22 nt, Human
aagcuguugcccugcucuuucu

SEQ ID NO: 61732 - RNA, 22 nt, Human
aagcuguuggcagauagcucug

SEQ ID NO: 61733 - RNA, 22 nt, Human
aagcuguuuuggccuuaguuga

SEQ ID NO: 61734 - RNA, 22 nt, Human
aagcuguuuuuagguggaggua

SEQ ID NO: 61735 - RNA, 22 nt, Human
aagcuuaaucagucugguugca

SEQ ID NO: 61736 - RNA, 22 nt, Human
aagcuuacaguuccacguagca

SEQ ID NO: 61737 - RNA, 22 nt, Human
aagcuuagguacagaaguuaag

SEQ ID NO: 61738 - RNA, 22 nt, Human
aagcuuauaucagaacaaugcu

SEQ ID NO: 61739 - RNA, 20 nt, Human
aagcuucacuucauuugauc

SEQ ID NO: 61740 - RNA, 22 nt, Human
aagcuucaguucuggggcaaug

SEQ ID NO: 61741 - RNA, 22 nt, Human
aagcuucaucugaugccgaacu

SEQ ID NO: 61742 - RNA, 22 nt, Human
aagcuucauuucaacucagggg

SEQ ID NO: 61743 - RNA, 20 nt, Human
aagcuuccaggaucuggugu

SEQ ID NO: 61744 - RNA, 22 nt, Human
aagcuuccugaaugcucauuua

SEQ ID NO: 61745 - RNA, 20 nt, Human
aagcuuccuugggcgcccgg

SEQ ID NO: 61746 - RNA, 22 nt, Human
aagcuucuuagaaugcaugugc

SEQ ID NO: 61747 - RNA, 22 nt, Human
aagcuucuuuacaggagagauu

SEQ ID NO: 61748 - RNA, 22 nt, Human
aagcuugggaaccacgguaauc

SEQ ID NO: 61749 - RNA, 23 nt, Human
aagcuugucaccauuucuuucag

SEQ ID NO: 61750 - RNA, 22 nt, Human
aagcuuuagagaugaguuccuu

SEQ ID NO: 61751 - RNA, 22 nt, Human
aagcuuuaugaucucucagcua

SEQ ID NO: 61752 - RNA, 22 nt, Human
aagcuuugauaauuggauuacu

SEQ ID NO: 61753 - RNA, 22 nt, Human
aagcuuuggaagggcaggguug

SEQ ID NO: 61754 - RNA, 22 nt, Human
aagcuuuggagaggcgggcagg

SEQ ID NO: 61755 - RNA, 21 nt, Human
aagcuuuuccugagaguuguc

SEQ ID NO: 61756 - RNA, 22 nt, Human
aagcuuuucucuguauuaccug

SEQ ID NO: 61757 - RNA, 22 nt, Human
aaggaaagacaggacggaauuc

SEQ ID NO: 61758 - RNA, 22 nt, Human
aaggaaaucuuuguaacaucuu

SEQ ID NO: 61759 - RNA, 22 nt, Human
aaggaacacuacaaggcuggga

SEQ ID NO: 61760 - RNA, 22 nt, Human
aaggaaccauuugugugcaugg

SEQ ID NO: 61761 - RNA, 22 nt, Human
aaggaaccugagggaccccaaa

SEQ ID NO: 61762 - RNA, 22 nt, Human
aaggaagaaaugaauaggugga

SEQ ID NO: 61763 - RNA, 22 nt, Human
aaggaagaagggaaguuacuua

SEQ ID NO: 61764 - RNA, 22 nt, Human
aaggaagaugaggugcugcuua

SEQ ID NO: 61765 - RNA, 22 nt, Human
aaggaagcagccagagacccuc

SEQ ID NO: 61766 - RNA, 22 nt, Human
aaggaagcuguuagacaugcau

SEQ ID NO: 61767 - RNA, 22 nt, Human
aaggaaggaauugaucaugcgc

SEQ ID NO: 61768 - RNA, 22 nt, Human
aaggaagguucauagucaaaga

SEQ ID NO: 61769 - RNA, 22 nt, Human
aaggaaguuuucuugguuccua

SEQ ID NO: 61770 - RNA, 22 nt, Human
aaggaaucacuucuuuaaauga

SEQ ID NO: 61771 - RNA, 19 nt, Human
aaggaauggcuuuaaguag

SEQ ID NO: 61772 - RNA, 22 nt, Human
aaggacaaagcagagcuggaug

SEQ ID NO: 61773 - RNA, 22 nt, Human
aaggacaccugcagagggacca

SEQ ID NO: 61774 - RNA, 22 nt, Human
aaggacauuucugacuaaugca

SEQ ID NO: 61775 - RNA, 22 nt, Human
aaggacuccaauucuuucaucu

SEQ ID NO: 61776 - RNA, 22 nt, Human
aaggacugaauaauucucuuuc

SEQ ID NO: 61777 - RNA, 22 nt, Human
aaggacugcuaggaagccgugu

SEQ ID NO: 61778 - RNA, 20 nt, Human
aaggagaaugacacggcugc

SEQ ID NO: 61779 - RNA, 22 nt, Human
aaggagagagcuuugcuggaac

SEQ ID NO: 61780 - RNA, 22 nt, Human
aaggagaguacaggaguuggua

SEQ ID NO: 61781 - RNA, 21 nt, Human
aaggagccuaggaggcucagg

SEQ ID NO: 61782 - RNA, 22 nt, Human
aaggaggaauaaagagguggug

SEQ ID NO: 61783 - RNA, 22 nt, Human
aaggaggaauguagccagcucc

SEQ ID NO: 61784 - RNA, 22 nt, Human
aaggaggaauuucagggugaau

SEQ ID NO: 61785 - RNA, 22 nt, Human
aaggaggagcggaggcuuguug

SEQ ID NO: 61786 - RNA, 22 nt, Human
aaggagucucagcugggccuga

SEQ ID NO: 61787 - RNA, 22 nt, Human
aauaacuucaucuucaggauag

SEQ ID NO: 61788 - RNA, 22 nt, Human
aauaacuucauguaacauuuaa

SEQ ID NO: 61789 - RNA, 22 nt, Human
aauaacuuuuaaaagacccugg

SEQ ID NO: 61790 - RNA, 22 nt, Human
aauaagaacaacuaagguuuau

SEQ ID NO: 61791 - RNA, 22 nt, Human
aauaagaauugccagauuugaa

SEQ ID NO: 61792 - RNA, 22 nt, Human
aauaagaauuuacuugucaaga

SEQ ID NO: 61793 - RNA, 22 nt, Human
aauaagauuacugguugucuga

SEQ ID NO: 61794 - RNA, 22 nt, Human
aauaaggugugggugcuaauau

SEQ ID NO: 61795 - RNA, 22 nt, Human
aauaaguugcuucagcuuggug

SEQ ID NO: 61796 - RNA, 22 nt, Human
aauaauacugcauguaaggugc

SEQ ID NO: 61797 - RNA, 22 nt, Human
aauaauagcagaguuuacaauc

SEQ ID NO: 61798 - RNA, 22 nt, Human
aauaauaguugcaaaguguuua

SEQ ID NO: 61799 - RNA, 22 nt, Human
aauaauauuccucugugugcgu

SEQ ID NO: 61800 - RNA, 22 nt, Human
aauaauauuugaagcuucaaag

SEQ ID NO: 61801 - RNA, 22 nt, Human
aauaauccugcccgucucuccg

SEQ ID NO: 61802 - RNA, 22 nt, Human
aauaaucuugacuacugaauca

SEQ ID NO: 61803 - RNA, 22 nt, Human
aauaaugagcuugucuaauugu

SEQ ID NO: 61804 - RNA, 22 nt, Human
aauaaugauaaugguuauagcu

SEQ ID NO: 61805 - RNA, 22 nt, Human
aauaaugucuaugguuccaaaa

SEQ ID NO: 61806 - RNA, 22 nt, Human
aauaauguuuauuuguauucuc

SEQ ID NO: 61807 - RNA, 22 nt, Human
aauaauuacccaucuuuuugua

SEQ ID NO: 61808 - RNA, 22 nt, Human
aauacagagaauguuauuugga

SEQ ID NO: 61809 - RNA, 22 nt, Human
aauacagauauucagugguacu

SEQ ID NO: 61810 - RNA, 22 nt, Human
aauacagcagauggagacaaau

SEQ ID NO: 61811 - RNA, 22 nt, Human
aauacaguagguaauaguucau

SEQ ID NO: 61812 - RNA, 22 nt, Human
aauacagugaaagugagcaagg

SEQ ID NO: 61813 - RNA, 22 nt, Human
aauaccagagacaguguuuacc

SEQ ID NO: 61814 - RNA, 22 nt, Human
aauaccuuccacagugaccuug

SEQ ID NO: 61815 - RNA, 22 nt, Human
aauaccuugcucauagggcuga

SEQ ID NO: 61816 - RNA, 20 nt, Human
aauacuaaacacaaagcagu

SEQ ID NO: 61817 - RNA, 22 nt, Human
aauacuaguuauuaaagcuuuu

SEQ ID NO: 61818 - RNA, 22 nt, Human
aauacuauguagccaaaauaau

SEQ ID NO: 61819 - RNA, 22 nt, Human
aauacugaaaguauuuucaaau

SEQ ID NO: 61820 - RNA, 22 nt, Human
aauacugcccccacucugccca

SEQ ID NO: 61821 - RNA, 22 nt, Human
aauacugcugccugcaaauuau

SEQ ID NO: 61822 - RNA, 22 nt, Human
aauacuggcugucaaagaugga

SEQ ID NO: 61823 - RNA, 22 nt, Human
aauacuguaugagcuaugguag

SEQ ID NO: 61824 - RNA, 22 nt, Human
aauacuugugaauucaaagucu

SEQ ID NO: 61825 - RNA, 22 nt, Human
aauagacuuuguauaauuuccc

SEQ ID NO: 61826 - RNA, 22 nt, Human
aauagauggguuaaacagcaaa

SEQ ID NO: 61827 - RNA, 22 nt, Human
aauagcaauuacccuucaacuc

SEQ ID NO: 61828 - RNA, 22 nt, Human
aauagcacuuccugaacacauu

SEQ ID NO: 61829 - RNA, 22 nt, Human
aauagcagaagacuaguagaca

SEQ ID NO: 61830 - RNA, 22 nt, Human
aauccuuauauaaugccuucca

SEQ ID NO: 61831 - RNA, 22 nt, Human
aaucuaaggacuuagcauugcu

SEQ ID NO: 61832 - RNA, 22 nt, Human
aaucuacaugcaauauuuuuag

SEQ ID NO: 61833 - RNA, 22 nt, Human
aaucucacucaaagaauucucu

SEQ ID NO: 61834 - RNA, 17 nt, Human
aaucucaguggcuuaag

SEQ ID NO: 61835 - RNA, 22 nt, Human
aaucuccauuuacccugcaucu

SEQ ID NO: 61836 - RNA, 22 nt, Human
aaucugcacaauucaguuucag

SEQ ID NO: 61837 - RNA, 22 nt, Human
aaucuggacacaguucucaugc

SEQ ID NO: 61838 - RNA, 23 nt, Human
aaucuggcugauguuuuuucucu

SEQ ID NO: 61839 - RNA, 22 nt, Human
aaucuggucuaagugaggauag

SEQ ID NO: 61840 - RNA, 22 nt, Human
aaucuguaacauucaauaaaga

SEQ ID NO: 61841 - RNA, 22 nt, Human
aaucuguauugcucauacuuga

SEQ ID NO: 61842 - RNA, 22 nt, Human
aaucugucuucuuuugugguuu

SEQ ID NO: 61843 - RNA, 17 nt, Human
aaucuguuuacagucag

SEQ ID NO: 61844 - RNA, 22 nt, Human
aaucuguuuaguucugcguaug

SEQ ID NO: 61845 - RNA, 22 nt, Human
aaucuguuuccaauacuugcua

SEQ ID NO: 61846 - RNA, 22 nt, Human
aaucuguuuccauguuuuauug

SEQ ID NO: 61847 - RNA, 22 nt, Human
aaucuguuugaugcuugugaua

SEQ ID NO: 61848 - RNA, 22 nt, Human
aaucuuaaagaauauucuacca

SEQ ID NO: 61849 - RNA, 22 nt, Human
aaucuuacuuaugauuuuucgg

SEQ ID NO: 61850 - RNA, 22 nt, Human
aaucuuagaguguuuuugaagc

SEQ ID NO: 61851 - RNA, 22 nt, Human
aaucuucaaaaacaauugaggg

SEQ ID NO: 61852 - RNA, 22 nt, Human
aaucuucaacagaaugguagga

SEQ ID NO: 61853 - RNA, 22 nt, Human
aaucuucacagaaaaaugucug

SEQ ID NO: 61854 - RNA, 22 nt, Human
aaucuucacucauucagaguug

SEQ ID NO: 61855 - RNA, 22 nt, Human
aaucuucaggguccuggggcuc

SEQ ID NO: 61856 - RNA, 22 nt, Human
aaucuugaguguuacucucauu

SEQ ID NO: 61857 - RNA, 22 nt, Human
aaucuugguugcaguauauccg

SEQ ID NO: 61858 - RNA, 22 nt, Human
aaucuuucauucauucauacau

SEQ ID NO: 61859 - RNA, 22 nt, Human
aaucuuuuaggggauccugagg

SEQ ID NO: 61860 - RNA, 22 nt, Human
aaugaaacuauauuuagagagg

SEQ ID NO: 61861 - RNA, 22 nt, Human
aaugaaauaguuggcuguagag

SEQ ID NO: 61862 - RNA, 22 nt, Human
aaugaaauguagcuuauccaua

SEQ ID NO: 61863 - RNA, 22 nt, Human
aaugaacacagcccucuacuuu

SEQ ID NO: 61864 - RNA, 22 nt, Human
aaugaacaucaaaugccuacca

SEQ ID NO: 61865 - RNA, 22 nt, Human
aaugaagauuauggugauuaag

SEQ ID NO: 61866 - RNA, 22 nt, Human
aaugaagcaguuuucaucaagu

SEQ ID NO: 61867 - RNA, 22 nt, Human
aaugaagccacugaagacaauc

SEQ ID NO: 61868 - RNA, 22 nt, Human
aaugaagccagguagaagagaa

SEQ ID NO: 61869 - RNA, 22 nt, Human
aaugaaguguuauuuaguuuca

SEQ ID NO: 61870 - RNA, 20 nt, Human
aaugaaugaacgaauggaug

SEQ ID NO: 61871 - RNA, 17 nt, Human
aaugaaugaauucuuug

SEQ ID NO: 61872 - RNA, 22 nt, Human
aaugaauguuuguugagugaag

SEQ ID NO: 61873 - RNA, 22 nt, Human
aaugaauucgagugaaggaaag

SEQ ID NO: 61874 - RNA, 22 nt, Human
aaugaauucugaagucuuccaa

SEQ ID NO: 61875 - RNA, 22 nt, Human
aaugacaauggcagagguagaa

SEQ ID NO: 61876 - RNA, 23 nt, Human
aaugacaccucauagguaacuuc

SEQ ID NO: 61877 - RNA, 22 nt, Human
aaugacagagauagaagggaug

SEQ ID NO: 61878 - RNA, 22 nt, Human
aaugacagagcacugaacuugg

SEQ ID NO: 61879 - RNA, 22 nt, Human
aaugacagcccucuagucuggg

SEQ ID NO: 61880 - RNA, 23 nt, Human
aaugacaggcaauguaauugugu

SEQ ID NO: 61881 - RNA, 22 nt, Human
aaugacaguggcacagucacuu

SEQ ID NO: 61882 - RNA, 22 nt, Human
aaugacaugcuuuuuaauuaua

SEQ ID NO: 61883 - RNA, 22 nt, Human
aaugaccagcgccugcagaggg

SEQ ID NO: 61884 - RNA, 22 nt, Human
aaugaccucagagcacccagaa

SEQ ID NO: 61885 - RNA, 22 nt, Human
aaugaccugggugucauuucau

SEQ ID NO: 61886 - RNA, 22 nt, Human
aaugacuaaaucugaagauagg

SEQ ID NO: 61887 - RNA, 22 nt, Human
aaugagaacugggaguuggugg

SEQ ID NO: 61888 - RNA, 22 nt, Human
aaugagauggcaaugacuuaaa

SEQ ID NO: 61889 - RNA, 20 nt, Human
aaugagauuccuuaugauag

SEQ ID NO: 61890 - RNA, 22 nt, Human
aaugagcuucuauaaucuuguc

SEQ ID NO: 61891 - RNA, 22 nt, Human
aaugaggccaguagaaggaagu

SEQ ID NO: 61892 - RNA, 22 nt, Human
aaugaggucauuaaugguggga

SEQ ID NO: 61893 - RNA, 22 nt, Human
aaugagguuuuuuaaagccaga

SEQ ID NO: 61894 - RNA, 22 nt, Human
aaugagucaaaacagcauauag

SEQ ID NO: 61895 - RNA, 22 nt, Human
aaugagucaugaagauuagcaa

SEQ ID NO: 61896 - RNA, 22 nt, Human
aaucuucuuucuuaacaguaca

SEQ ID NO: 61897 - RNA, 22 nt, Human
aaucuugagggacucaugaggu

SEQ ID NO: 61898 - RNA, 22 nt, Human
aaucuuuaaggacucagucucu

SEQ ID NO: 61899 - RNA, 22 nt, Human
aaugaaacaauuagcuguaaua

SEQ ID NO: 61900 - RNA, 22 nt, Human
aaugaaaucugcuggguaaaga

SEQ ID NO: 61901 - RNA, 22 nt, Human
aaugaacaaaauaugcuuugca

SEQ ID NO: 61902 - RNA, 22 nt, Human
aaugaacaaauggugcugcuug

SEQ ID NO: 61903 - RNA, 22 nt, Human
aaugaacaugggaguacuaaua

SEQ ID NO: 61904 - RNA, 22 nt, Human
aaugaacuccgaacauuuacau

SEQ ID NO: 61905 - RNA, 22 nt, Human
aaugaacuggagaacaaugacc

SEQ ID NO: 61906 - RNA, 22 nt, Human
aaugaacuucagugauuucugg

SEQ ID NO: 61907 - RNA, 22 nt, Human
aaugaagcaguccaucugcucu

SEQ ID NO: 61908 - RNA, 22 nt, Human
aaugaaguucuauucauuuucu

SEQ ID NO: 61909 - RNA, 22 nt, Human
aaugaauggguuuaauauuuua

SEQ ID NO: 61910 - RNA, 22 nt, Human
aaugaaugugauuaacuucaag

SEQ ID NO: 61911 - RNA, 22 nt, Human
aaugacaaauauggaagccuga

SEQ ID NO: 61912 - RNA, 22 nt, Human
aaugacaaccacaauggugcug

SEQ ID NO: 61913 - RNA, 22 nt, Human
aaugacaagacauagucucuga

SEQ ID NO: 61914 - RNA, 22 nt, Human
aaugacaauauuaauuuggagg

SEQ ID NO: 61915 - RNA, 23 nt, Human
aaugacagugugugauugaagaa

SEQ ID NO: 61916 - RNA, 22 nt, Human
aaugacuguagucauauuaagg

SEQ ID NO: 61917 - RNA, 22 nt, Human
aaugacuuugaaauauuugagu

SEQ ID NO: 61918 - RNA, 22 nt, Human
aaugagaaaacacagaggaggu

SEQ ID NO: 61919 - RNA, 22 nt, Human
aaugagaauguaagugaagaga

SEQ ID NO: 61920 - RNA, 22 nt, Human
aaugagauggaauucccgccua

SEQ ID NO: 61921 - RNA, 20 nt, Human
aaugaggucccacugaggag

SEQ ID NO: 61922 - RNA, 22 nt, Human
aaugagguuggcauaauuaaau

SEQ ID NO: 61923 - RNA, 20 nt, Human
aaugaguccugcuggaucac

SEQ ID NO: 61924 - RNA, 22 nt, Human
aaugaguuagaugagaaaauaa

SEQ ID NO: 61925 - RNA, 22 nt, Human
aaugaguucugacacuucacga

SEQ ID NO: 61926 - RNA, 22 nt, Human
aaugaucccauuuagaaacaga

SEQ ID NO: 61927 - RNA, 22 nt, Human
aaugaucuacucucauuaucuc

SEQ ID NO: 61928 - RNA, 22 nt, Human
aaugauggucauggcaacuuuu

SEQ ID NO: 61929 - RNA, 22 nt, Human
aaugauguauguauaaggcagg

SEQ ID NO: 61930 - RNA, 22 nt, Human
aaugauuacugaucgcauagga

SEQ ID NO: 61931 - RNA, 22 nt, Human
aaugauuuggcaaaggaaucca

SEQ ID NO: 61932 - RNA, 22 nt, Human
aaugcaaacagcccagaaucca

SEQ ID NO: 61933 - RNA, 22 nt, Human
aaugcaaacuccacuggagcag

SEQ ID NO: 61934 - RNA, 22 nt, Human
aaugcaaagaguugcuuaucaa

SEQ ID NO: 61935 - RNA, 22 nt, Human
aaugcaaauguaagggugggau

SEQ ID NO: 61936 - RNA, 22 nt, Human
aaugcaaauucuagggcccuau

SEQ ID NO: 61937 - RNA, 22 nt, Human
aaugcaagucaaugcuauaccc

SEQ ID NO: 61938 - RNA, 22 nt, Human
aaugcaauaccuuuuuaugcug

SEQ ID NO: 61939 - RNA, 18 nt, Human
aaugcaauguauuugcag

SEQ ID NO: 61940 - RNA, 22 nt, Human
aaugcacaaaggugucuauugc

SEQ ID NO: 61941 - RNA, 22 nt, Human
aaugcacagcguuccaugcuug

SEQ ID NO: 61942 - RNA, 22 nt, Human
aaugcacauaaauauggucuua

SEQ ID NO: 61943 - RNA, 22 nt, Human
aaugcacaugccacauguggua

SEQ ID NO: 61944 - RNA, 22 nt, Human
aaugcagauucuuauucuguag

SEQ ID NO: 61945 - RNA, 22 nt, Human
aaugcaguugaauuuggguaug

SEQ ID NO: 61946 - RNA, 22 nt, Human
aaugcauauguaggcaagcagu

SEQ ID NO: 61947 - RNA, 19 nt, Human
aauggcagaugccauaucu

SEQ ID NO: 61948 - RNA, 22 nt, Human
aauggcaugacuugcccaaggc

SEQ ID NO: 61949 - RNA, 22 nt, Human
aauggccuggagggaauacaga

SEQ ID NO: 61950 - RNA, 22 nt, Human
aauggccuguauggaaagugaa

SEQ ID NO: 61951 - RNA, 22 nt, Human
aauggcuauacaacaugaguau

SEQ ID NO: 61952 - RNA, 22 nt, Human
aauggcucugauguuguuguga

SEQ ID NO: 61953 - RNA, 22 nt, Human
aauggcugggaguguauuuugg

SEQ ID NO: 61954 - RNA, 22 nt, Human
aauggcuuaaugauaccuuauc

SEQ ID NO: 61955 - RNA, 22 nt, Human
aauggcuuacccuggauugugu

SEQ ID NO: 61956 - RNA, 22 nt, Human
aauggcuuagcagaguuagaag

SEQ ID NO: 61957 - RNA, 22 nt, Human
aauggcuuauguaaugcuguuu

SEQ ID NO: 61958 - RNA, 22 nt, Human
aauggcuuugacauuuucaaau

SEQ ID NO: 61959 - RNA, 22 nt, Human
aauggcuuuggcaggaauuuca

SEQ ID NO: 61960 - RNA, 22 nt, Human
aaugggcucacaagaccugaau

SEQ ID NO: 61961 - RNA, 20 nt, Human
aaugggcuuugaugagugug

SEQ ID NO: 61962 - RNA, 22 nt, Human
aauggguugcuuuccacagccu

SEQ ID NO: 61963 - RNA, 22 nt, Human
aauggguuguagggaaagucaa

SEQ ID NO: 61964 - RNA, 22 nt, Human
aaugguaauauuggcacagaaa

SEQ ID NO: 61965 - RNA, 22 nt, Human
aaugguacccuggugacuuaga

SEQ ID NO: 61966 - RNA, 22 nt, Human
aaugguauuugucaagcauagu

SEQ ID NO: 61967 - RNA, 22 nt, Human
aaugguuuaguuaagacugagu

SEQ ID NO: 61968 - RNA, 22 nt, Human
aaugguuucaaacacacuaagu

SEQ ID NO: 61969 - RNA, 22 nt, Human
aaugguuuggacuauucaauag

SEQ ID NO: 61970 - RNA, 22 nt, Human
aaugguuuuugcauauucaggu

SEQ ID NO: 61971 - RNA, 22 nt, Human
aauguaaaguugggcacaaaug

SEQ ID NO: 61972 - RNA, 22 nt, Human
aauguacaauaagacaaagagg

SEQ ID NO: 61973 - RNA, 22 nt, Human
aauguacaccguggguuuuuua

SEQ ID NO: 61974 - RNA, 22 nt, Human
aauguacagcugcugcugaagg

SEQ ID NO: 61975 - RNA, 22 nt, Human
aauguagaaugauccuuaggau

SEQ ID NO: 61976 - RNA, 22 nt, Human
aauguaguucacaauugguacu

SEQ ID NO: 61977 - RNA, 20 nt, Human
aauguauaugugaccccaaa

SEQ ID NO: 61978 - RNA, 22 nt, Human
aauguaugagcgugaaagcacu

SEQ ID NO: 61979 - RNA, 22 nt, Human
aauguaugggugagaaaguuga

SEQ ID NO: 61980 - RNA, 22 nt, Human
aauguauuauacauaauuugug

SEQ ID NO: 61981 - RNA, 20 nt, Human
aauguauuguuuuguuucag

SEQ ID NO: 61982 - RNA, 22 nt, Human
aaugucaaaauaauugauuugu

SEQ ID NO: 61983 - RNA, 22 nt, Human
aaugucaaaauggaaugagacu

SEQ ID NO: 61984 - RNA, 22 nt, Human
aaugucaaaggcuauacauuca

SEQ ID NO: 61985 - RNA, 22 nt, Human
aaugucaaagugcuuugcaaac

SEQ ID NO: 61986 - RNA, 22 nt, Human
aaugucaaaugagaggggagaa

SEQ ID NO: 61987 - RNA, 22 nt, Human
aaugucacauacaauggcaagu

SEQ ID NO: 61988 - RNA, 22 nt, Human
aaugucagccugaaagcuauuc

SEQ ID NO: 61989 - RNA, 22 nt, Human
aaugucauagcaaagagaguga

SEQ ID NO: 61990 - RNA, 22 nt, Human
aaugucaugagccugcucuugu

SEQ ID NO: 61991 - RNA, 22 nt, Human
aaugucauugguaaagauuagg

SEQ ID NO: 61992 - RNA, 22 nt, Human
aaugucauuuaaagacaaagaa

SEQ ID NO: 61993 - RNA, 22 nt, Human
aaugucauuuuuaaaugugaga

SEQ ID NO: 61994 - RNA, 18 nt, Human
aauguccaguguucauau

SEQ ID NO: 61995 - RNA, 22 nt, Human
aaugucuacaccguauguuguu

SEQ ID NO: 61996 - RNA, 22 nt, Human
aaugucuaugaaaugaaaggga

SEQ ID NO: 61997 - RNA, 22 nt, Human
aaugucucuauaucucauaaga

SEQ ID NO: 61998 - RNA, 22 nt, Human
aaugucugccagaacugaucau

SEQ ID NO: 61999 - RNA, 22 nt, Human
aaugucuuacauuuacugagca

SEQ ID NO: 62000 - RNA, 22 nt, Human
aaugucuucccuggcaggccaa

SEQ ID NO: 62001 - RNA, 22 nt, Human
aaugucuucuucagcugaauaa

SEQ ID NO: 62002 - RNA, 22 nt, Human
aaugucuuucuugguucugguu

SEQ ID NO: 62003 - RNA, 21 nt, Human
aaugucuuuguccaugcucug

SEQ ID NO: 62004 - RNA, 22 nt, Human
aaugucuuuugcaguucaagau

SEQ ID NO: 62005 - RNA, 22 nt, Human
aauugucaaaaauugcaauugu

SEQ ID NO: 62006 - RNA, 22 nt, Human
aauugucuucuccuuccuggca

SEQ ID NO: 62007 - RNA, 22 nt, Human
aauugucuuggugcaaucauga

SEQ ID NO: 62008 - RNA, 22 nt, Human
aauugugcuaugauuaugaaag

SEQ ID NO: 62009 - RNA, 22 nt, Human
aauuguuguacagaauaaauga

SEQ ID NO: 62010 - RNA, 22 nt, Human
aauuuacacuucauuuggaggg

SEQ ID NO: 62011 - RNA, 22 nt, Human
aauuuacaguugcugaugguac

SEQ ID NO: 62012 - RNA, 22 nt, Human
aauuuauggccuucgucuugau

SEQ ID NO: 62013 - RNA, 22 nt, Human
aauuucaauuacuuuugcacca

SEQ ID NO: 62014 - RNA, 21 nt, Human
aauuucagacccauuuugccu

SEQ ID NO: 62015 - RNA, 22 nt, Human
aauuucaguugcuaauaaguuc

SEQ ID NO: 62016 - RNA, 22 nt, Human
aauuuccaaauuucugucacac

SEQ ID NO: 62017 - RNA, 22 nt, Human
aauuuccugggauaaaaagcca

SEQ ID NO: 62018 - RNA, 22 nt, Human
aauuucuccaagaaugcuuaga

SEQ ID NO: 62019 - RNA, 22 nt, Human
aauuucuucagcucuaaaaugg

SEQ ID NO: 62020 - RNA, 22 nt, Human
aauuucuugggagcucagagaa

SEQ ID NO: 62021 - RNA, 18 nt, Human
aauuucuuugacaacuua

SEQ ID NO: 62022 - RNA, 22 nt, Human
aauuugaaacauagucaccacu

SEQ ID NO: 62023 - RNA, 22 nt, Human
aauuugauucccugcaccuguu

SEQ ID NO: 62024 - RNA, 22 nt, Human
aauuugauuuucuuaaaccaua

SEQ ID NO: 62025 - RNA, 22 nt, Human
aauuugcaugaugagaacaaua

SEQ ID NO: 62026 - RNA, 22 nt, Human
aauuuggcagugucuugaagua

SEQ ID NO: 62027 - RNA, 23 nt, Human
aauuugguugaugaaagcauugu

SEQ ID NO: 62028 - RNA, 22 nt, Human
aauuuguuacacagcaauauaa

SEQ ID NO: 62029 - RNA, 22 nt, Human
aauuuuacaaaauaccuccgau

SEQ ID NO: 62030 - RNA, 20 nt, Human
aauuuuaucuccauccuuug

SEQ ID NO: 62031 - RNA, 22 nt, Human
aauuuucacagugcugugagau

SEQ ID NO: 62032 - RNA, 22 nt, Human
aauuuucugguguguaaugaag

SEQ ID NO: 62033 - RNA, 22 nt, Human
aauuuuguucuuggaaaucagg

SEQ ID NO: 62034 - RNA, 22 nt, Human
acaaaacaguguuccugccccu

SEQ ID NO: 62035 - RNA, 22 nt, Human
acaaaaguaguugcgguuuuug

SEQ ID NO: 62036 - RNA, 22 nt, Human
acaaaagugagugugucucaga

SEQ ID NO: 62037 - RNA, 20 nt, Human
acaaaauagguacuggguag

SEQ ID NO: 62038 - RNA, 22 nt, Human
acaaaauuaugaagaggccuug

SEQ ID NO: 62039 - RNA, 22 nt, Human
acaaacaucuugaccucagauu

SEQ ID NO: 62040 - RNA, 19 nt, Human
acaaacugaguacacuugu

SEQ ID NO: 62041 - RNA, 22 nt, Human
acaaacugggauaggauccugu

SEQ ID NO: 62042 - RNA, 22 nt, Human
acaaacuuauguuucauaugua

SEQ ID NO: 62043 - RNA, 22 nt, Human
acaaagagaccaugagccaaac

SEQ ID NO: 62044 - RNA, 22 nt, Human
acaaagauucauuugcauuauu

SEQ ID NO: 62045 - RNA, 22 nt, Human
acaaagcacgagugccauggac

SEQ ID NO: 62046 - RNA, 22 nt, Human
acaaagcuagagaagagaauug

SEQ ID NO: 62047 - RNA, 19 nt, Human
acaaagcugugagcagcuu

SEQ ID NO: 62048 - RNA, 22 nt, Human
acaaagcuuagaccuaagagau

SEQ ID NO: 62049 - RNA, 22 nt, Human
acaaaggacugaaacuggcugu

SEQ ID NO: 62050 - RNA, 22 nt, Human
acaaaggcauagugaauguuuu

SEQ ID NO: 62051 - RNA, 22 nt, Human
acaaaggugcgucccuucagcu

SEQ ID NO: 62052 - RNA, 20 nt, Human
acaaaguauugaggacaagu

SEQ ID NO: 62053 - RNA, 22 nt, Human
acaaaguauuuuuagguuugua

SEQ ID NO: 62054 - RNA, 22 nt, Human
acaaaguccugguguauggcca

SEQ ID NO: 62055 - RNA, 22 nt, Human
acaaagugcacaagaugagaac

SEQ ID NO: 62056 - RNA, 22 nt, Human
acaaaguuucuucuaacaucug

SEQ ID NO: 62057 - RNA, 22 nt, Human
acaaauagagauucaaauaaag

SEQ ID NO: 62058 - RNA, 22 nt, Human
acaaauagguagauuugcaaca

SEQ ID NO: 62059 - RNA, 22 nt, Human
acaaauaugguacucggagaaa

SEQ ID NO: 62060 - RNA, 22 nt, Human
acaaauauuuacugaauccacu

SEQ ID NO: 62061 - RNA, 22 nt, Human
acaaauccagugaacuccagug

SEQ ID NO: 62062 - RNA, 22 nt, Human
acaaaugaacauauaagcuuga

SEQ ID NO: 62063 - RNA, 22 nt, Human
acaaaugcaaguuuuaugucaa

SEQ ID NO: 62064 - RNA, 22 nt, Human
aauaaauguuaagauugucuca

SEQ ID NO: 62065 - RNA, 22 nt, Human
aauaaauguuuguuggauguuu

SEQ ID NO: 62066 - RNA, 22 nt, Human
aauaacagauuuucaagcugug

SEQ ID NO: 62067 - RNA, 22 nt, Human
aauaaccuuuauuucaaagugu

SEQ ID NO: 62068 - RNA, 22 nt, Human
aauaacugcacuuguugaaugc

SEQ ID NO: 62069 - RNA, 22 nt, Human
aauaacuuguaugguuauucca

SEQ ID NO: 62070 - RNA, 22 nt, Human
aauaagaacuugucucuggcag

SEQ ID NO: 62071 - RNA, 22 nt, Human
aauaagaucuuaaagguuauau

SEQ ID NO: 62072 - RNA, 22 nt, Human
aauaagcaagccugugugcaag

SEQ ID NO: 62073 - RNA, 22 nt, Human
aauaagccagcccaugugaccc

SEQ ID NO: 62074 - RNA, 22 nt, Human
aauaagcugcuaggaacuuagu

SEQ ID NO: 62075 - RNA, 22 nt, Human
aauaaguacuuggggauaacuu

SEQ ID NO: 62076 - RNA, 22 nt, Human
aauaaguugccuguugaaucau

SEQ ID NO: 62077 - RNA, 22 nt, Human
aauaauacaugagauuaauguu

SEQ ID NO: 62078 - RNA, 22 nt, Human
aauaauacuucguaaaguuguu

SEQ ID NO: 62079 - RNA, 22 nt, Human
aauaauguaggaugauaaauga

SEQ ID NO: 62080 - RNA, 22 nt, Human
aauaaugugugcugcagucuua

SEQ ID NO: 62081 - RNA, 22 nt, Human
aauaauuagugggacagagaac

SEQ ID NO: 62082 - RNA, 22 nt, Human
aauaauuuuagcucagaguugu

SEQ ID NO: 62083 - RNA, 22 nt, Human
aauaauuuugagagccuggaaa

SEQ ID NO: 62084 - RNA, 22 nt, Human
aauacagaggaaacauuuaaua

SEQ ID NO: 62085 - RNA, 22 nt, Human
aauacagaugagcuucugccuc

SEQ ID NO: 62086 - RNA, 19 nt, Human
aauacaguguuauagaauu

SEQ ID NO: 62087 - RNA, 22 nt, Human
aauaccaugcagaaauaacaua

SEQ ID NO: 62088 - RNA, 22 nt, Human
aauaccuuccaacaucaagaca

SEQ ID NO: 62089 - RNA, 22 nt, Human
aauaccuugcuguagccacgca

SEQ ID NO: 62090 - RNA, 22 nt, Human
aauacgucccaucaucuuuuuc

SEQ ID NO: 62091 - RNA, 22 nt, Human
aauacgucugaaugcauucuca

SEQ ID NO: 62092 - RNA, 22 nt, Human
aauacugccugugagguaacuc

SEQ ID NO: 62093 - RNA, 17 nt, Human
aauacugcuuauccagg

SEQ ID NO: 62094 - RNA, 22 nt, Human
aauacuguaaauggagcagcca

SEQ ID NO: 62095 - RNA, 22 nt, Human
aauacuugaauuucaugucagg

SEQ ID NO: 62096 - RNA, 22 nt, Human
aauacuugggcugagauuuuug

SEQ ID NO: 62097 - RNA, 22 nt, Human
aauagaaaggaggggcucuugu

SEQ ID NO: 62098 - RNA, 22 nt, Human
aauagaauuuguacuguguuuu

SEQ ID NO: 62099 - RNA, 22 nt, Human
aauagacauuauuucucuauga

SEQ ID NO: 62100 - RNA, 22 nt, Human
aauagagagcagcuuugcgguu

SEQ ID NO: 62101 - RNA, 22 nt, Human
aauagaggaagaaaccugauug

SEQ ID NO: 62102 - RNA, 22 nt, Human
aauagaggagcuuuggacuccc

SEQ ID NO: 62103 - RNA, 22 nt, Human
aauagaucugugugcacauuug

SEQ ID NO: 62104 - RNA, 22 nt, Human
aauagcaaacagacaugcacaa

SEQ ID NO: 62105 - RNA, 22 nt, Human
aauagcaaaguuaucaaauuaa

SEQ ID NO: 62106 - RNA, 22 nt, Human
aauagcaaaugcucauuugaaa

SEQ ID NO: 62107 - RNA, 22 nt, Human
aauagcaauuacauuugcacca

SEQ ID NO: 62108 - RNA, 22 nt, Human
aauagcaucuucugagacaaag

SEQ ID NO: 62109 - RNA, 22 nt, Human
aauagcauguuaauaaccagag

SEQ ID NO: 62110 - RNA, 22 nt, Human
aauagcucacugauuucucuuu

SEQ ID NO: 62111 - RNA, 22 nt, Human
aauagcugauuagccuacaaua

SEQ ID NO: 62112 - RNA, 23 nt, Human
aauagcugguaaugauagcacaa

SEQ ID NO: 62113 - RNA, 22 nt, Human
aauagcuugccuaauccucaug

SEQ ID NO: 62114 - RNA, 22 nt, Human
acaaggccaagcauucuagcaa

SEQ ID NO: 62115 - RNA, 22 nt, Human
acaaggcucuaauuucauugaa

SEQ ID NO: 62116 - RNA, 22 nt, Human
acaaggcucuggagaagcagaa

SEQ ID NO: 62117 - RNA, 19 nt, Human
acaaggcugggagagcgcc

SEQ ID NO: 62118 - RNA, 22 nt, Human
acaaggcuguggggagaacuga

SEQ ID NO: 62119 - RNA, 22 nt, Human
acaaggcuucacacaguaugaa

SEQ ID NO: 62120 - RNA, 22 nt, Human
acaagguucuuguggaggaauu

SEQ ID NO: 62121 - RNA, 22 nt, Human
acaaguauuggugaggauguag

SEQ ID NO: 62122 - RNA, 19 nt, Human
acaagucacuuacuuagua

SEQ ID NO: 62123 - RNA, 22 nt, Human
acaagucuguuaugcaccugga

SEQ ID NO: 62124 - RNA, 22 nt, Human
acaagugcauggaaucagcugu

SEQ ID NO: 62125 - RNA, 22 nt, Human
acaaguuccacuacagaguugu

SEQ ID NO: 62126 - RNA, 22 nt, Human
acaaguuuuugauagacuagaa

SEQ ID NO: 62127 - RNA, 19 nt, Human
acaauaacucauugauugc

SEQ ID NO: 62128 - RNA, 22 nt, Human
acaauaaguauugggcuuuuga

SEQ ID NO: 62129 - RNA, 22 nt, Human
acaauacaggcuucuggacuua

SEQ ID NO: 62130 - RNA, 22 nt, Human
acaauacucaugcucuuuuucu

SEQ ID NO: 62131 - RNA, 21 nt, Human
acaauagacauaagcagagca

SEQ ID NO: 62132 - RNA, 22 nt, Human
acaauagacccaugacacauac

SEQ ID NO: 62133 - RNA, 22 nt, Human
acaauagguguccaauuaacaa

SEQ ID NO: 62134 - RNA, 22 nt, Human
acaauaguaagguauauuguca

SEQ ID NO: 62135 - RNA, 22 nt, Human
acaauaugggauauacauuuua

SEQ ID NO: 62136 - RNA, 20 nt, Human
acaauauguagaugaauagc

SEQ ID NO: 62137 - RNA, 22 nt, Human
acaaucccacaagaaacacugg

SEQ ID NO: 62138 - RNA, 22 nt, Human
acaaugaaagcaagaagacggc

SEQ ID NO: 62139 - RNA, 22 nt, Human
acaaugaauaucaugaaguacu

SEQ ID NO: 62140 - RNA, 22 nt, Human
acaaugcagccuauggauccag

SEQ ID NO: 62141 - RNA, 22 nt, Human
acaauggcaugcuagcaaaugg

SEQ ID NO: 62142 - RNA, 22 nt, Human
acaauguagaggcugaaagcaa

SEQ ID NO: 62143 - RNA, 22 nt, Human
acaauguagaguaaaauauguu

SEQ ID NO: 62144 - RNA, 22 nt, Human
acaaugucucauauucguguuc

SEQ ID NO: 62145 - RNA, 23 nt, Human
acaaugucuguucauaaaauacc

SEQ ID NO: 62146 - RNA, 22 nt, Human
acaaugugauaauuuaaagaua

SEQ ID NO: 62147 - RNA, 22 nt, Human
acaauguucucugaguugugug

SEQ ID NO: 62148 - RNA, 19 nt, Human
acaauguuguuggacacuc

SEQ ID NO: 62149 - RNA, 22 nt, Human
acaauuacccuggcuugauaaa

SEQ ID NO: 62150 - RNA, 22 nt, Human
acaauuagcugugugucuaucu

SEQ ID NO: 62151 - RNA, 22 nt, Human
acaauucaagcaagagagacaa

SEQ ID NO: 62152 - RNA, 22 nt, Human
acaauucacuccagugacccca

SEQ ID NO: 62153 - RNA, 22 nt, Human
acaauucucucauaucuuauua

SEQ ID NO: 62154 - RNA, 22 nt, Human
acaauuuauccauuguauaguu

SEQ ID NO: 62155 - RNA, 22 nt, Human
acaauuucugaucagugaauuu

SEQ ID NO: 62156 - RNA, 22 nt, Human
acaauuugaggcuacucaauug

SEQ ID NO: 62157 - RNA, 22 nt, Human
acaauuugugucuuuugcuuau

SEQ ID NO: 62158 - RNA, 22 nt, Human
acaauuuuucaaagaagcuuau

SEQ ID NO: 62159 - RNA, 21 nt, Human
acacaaaccuccucagccugg

SEQ ID NO: 62160 - RNA, 20 nt, Human
acacaaagcaauggaguaca

SEQ ID NO: 62161 - RNA, 21 nt, Human
acacaacaggcagucauuuuc

SEQ ID NO: 62162 - RNA, 22 nt, Human
acacaauacagggcucaaaaua

SEQ ID NO: 62163 - RNA, 22 nt, Human
acacaauuuccuguccauaugu

SEQ ID NO: 62164 - RNA, 22 nt, Human
acacacguauauauacguaugu

SEQ ID NO: 62165 - RNA, 22 nt, Human
acacacugaauuuuguggaaac

SEQ ID NO: 62166 - RNA, 22 nt, Human
acacacugagugccauaggacc

SEQ ID NO: 62167 - RNA, 22 nt, Human
acacacuggcaggagcuauaaa

SEQ ID NO: 62168 - RNA, 22 nt, Human
acacacuggcccccaguacuga

SEQ ID NO: 62169 - RNA, 22 nt, Human
acacacugggcaugguuuaugc

SEQ ID NO: 62170 - RNA, 22 nt, Human
acacacuguugcucauccaggc

SEQ ID NO: 62171 - RNA, 23 nt, Human
acacagaagaagacccaaggaag

SEQ ID NO: 62172 - RNA, 22 nt, Human
acacagaggcaugacaguggcu

SEQ ID NO: 62173 - RNA, 22 nt, Human
acacagagugguuuguagaaua

SEQ ID NO: 62174 - RNA, 22 nt, Human
acacagaugcuauuuagucucu

SEQ ID NO: 62175 - RNA, 22 nt, Human
acacagauggguagaaaacaga

SEQ ID NO: 62176 - RNA, 22 nt, Human
acacagauuuuacauguuaugc

SEQ ID NO: 62177 - RNA, 22 nt, Human
acacagcagaaggcccgugucu

SEQ ID NO: 62178 - RNA, 17 nt, Human
acacagccagguucucc

SEQ ID NO: 62179 - RNA, 22 nt, Human
acacagcucacaacgugugcau

SEQ ID NO: 62180 - RNA, 22 nt, Human
acacagcuuuguguugcuccac

SEQ ID NO: 62181 - RNA, 22 nt, Human
acacaggaagagagauaauaau

SEQ ID NO: 62182 - RNA, 22 nt, Human
acacaggaagcaauuucagagc

SEQ ID NO: 62183 - RNA, 22 nt, Human
acacaggagaaaagaucuccca

SEQ ID NO: 62184 - RNA, 22 nt, Human
acacaggcaagagugcaggucu

SEQ ID NO: 62185 - RNA, 21 nt, Human
acacaggcagugucccgaggu

SEQ ID NO: 62186 - RNA, 19 nt, Human
acacagggaucagaggguu

SEQ ID NO: 62187 - RNA, 22 nt, Human
acacagggcggaaagcaugaga

SEQ ID NO: 62188 - RNA, 22 nt, Human
acacaggggaaaguggagcuga

SEQ ID NO: 62189 - RNA, 22 nt, Human
acacaguaggccaccaugucau

SEQ ID NO: 62190 - RNA, 22 nt, Human
acacaguaguguggaaaaacau

SEQ ID NO: 62191 - RNA, 22 nt, Human
acacaguauugugacuauaacu

SEQ ID NO: 62192 - RNA, 20 nt, Human
acacagugacaggaaagaga

SEQ ID NO: 62193 - RNA, 22 nt, Human
acacagugccaaauugcaguua

SEQ ID NO: 62194 - RNA, 22 nt, Human
acacagugucagggcaggggcc

SEQ ID NO: 62195 - RNA, 22 nt, Human
acacagugugugcagucggacg

SEQ ID NO: 62196 - RNA, 22 nt, Human
acacaguucaggaucaaauagc

SEQ ID NO: 62197 - RNA, 22 nt, Human
acacaguucguuguuuucuacu

SEQ ID NO: 62198 - RNA, 22 nt, Human
acacaguugauugucacucagg

SEQ ID NO: 62199 - RNA, 22 nt, Human
acacaguuuaaacgauuaguac

SEQ ID NO: 62200 - RNA, 16 nt, Human
acacaguuuuaaggca

SEQ ID NO: 62201 - RNA, 22 nt, Human
acacauagaaaauaaauaguua

SEQ ID NO: 62202 - RNA, 22 nt, Human
acacauauaugugcguguauau

SEQ ID NO: 62203 - RNA, 22 nt, Human
acacauauauuauuuguggcuc

SEQ ID NO: 62204 - RNA, 23 nt, Human
acacauauauucagauacagaug

SEQ ID NO: 62205 - RNA, 22 nt, Human
acacauauauuugcauauacac

SEQ ID NO: 62206 - RNA, 22 nt, Human
acacauaugguugcugcaguga

SEQ ID NO: 62207 - RNA, 22 nt, Human
acacauccugaccaaguucagg

SEQ ID NO: 62208 - RNA, 22 nt, Human
acacaucuauauugcaucugca

SEQ ID NO: 62209 - RNA, 22 nt, Human
acacaucuccagaagugggcug

SEQ ID NO: 62210 - RNA, 22 nt, Human
acacaucucucuuugaggagug

SEQ ID NO: 62211 - RNA, 22 nt, Human
acacaucugcaagagccagacc

SEQ ID NO: 62212 - RNA, 22 nt, Human
acacaugaaauaauauuaugca

SEQ ID NO: 62213 - RNA, 22 nt, Human
acacaugaccuccgcagcagca

SEQ ID NO: 62214 - RNA, 22 nt, Human
acacaugagaaacaucaguugu

SEQ ID NO: 62215 - RNA, 22 nt, Human
acacaugaggaugaggggauca

SEQ ID NO: 62216 - RNA, 22 nt, Human
acacaugcagguauacauguuc

SEQ ID NO: 62217 - RNA, 22 nt, Human
acacaugcucauaaauaaauag

SEQ ID NO: 62218 - RNA, 19 nt, Human
acacaugcuccuggagccu

SEQ ID NO: 62219 - RNA, 22 nt, Human
acacaugcugauaagaauauaa

SEQ ID NO: 62220 - RNA, 22 nt, Human
acacauggguggggagcuaagu

SEQ ID NO: 62221 - RNA, 22 nt, Human
acacauggucuacuucuucuca

SEQ ID NO: 62222 - RNA, 22 nt, Human
acacauguacagauuaguauuu

SEQ ID NO: 62223 - RNA, 22 nt, Human
acagaguggaguucaguaaaua

SEQ ID NO: 62224 - RNA, 22 nt, Human
acagaguucccacuccagaagc

SEQ ID NO: 62225 - RNA, 22 nt, Human
acagaguuguguuuguacaacg

SEQ ID NO: 62226 - RNA, 22 nt, Human
acagauaauaggauguacccug

SEQ ID NO: 62227 - RNA, 22 nt, Human
acagauacuauaauguaaagug

SEQ ID NO: 62228 - RNA, 22 nt, Human
acagauauccucagucuccaac

SEQ ID NO: 62229 - RNA, 20 nt, Human
acagauauuugauuuucagu

SEQ ID NO: 62230 - RNA, 22 nt, Human
acagaucacuugacuaaaauga

SEQ ID NO: 62231 - RNA, 22 nt, Human
acagaucuacauugucugaccc

SEQ ID NO: 62232 - RNA, 22 nt, Human
acagaugaaaaagcuuguggau

SEQ ID NO: 62233 - RNA, 23 nt, Human
acagaugaaaguguggcucagag

SEQ ID NO: 62234 - RNA, 22 nt, Human
acagaugaauuuuaauuguguu

SEQ ID NO: 62235 - RNA, 22 nt, Human
acagaugacuugucugcuguaa

SEQ ID NO: 62236 - RNA, 22 nt, Human
acagaugagaaggcugaccagu

SEQ ID NO: 62237 - RNA, 22 nt, Human
acagaugagagacaaugugcua

SEQ ID NO: 62238 - RNA, 22 nt, Human
acagaugagauucauugaccac

SEQ ID NO: 62239 - RNA, 22 nt, Human
acagaugaggaagagucagcca

SEQ ID NO: 62240 - RNA, 20 nt, Human
acagaugaggaugcggaggc

SEQ ID NO: 62241 - RNA, 22 nt, Human
acagaugcucugaugucugggu

SEQ ID NO: 62242 - RNA, 22 nt, Human
acagauggccauauuacuauau

SEQ ID NO: 62243 - RNA, 21 nt, Human
acagaugggaugagcacacug

SEQ ID NO: 62244 - RNA, 22 nt, Human
acagaugguagcauuauguugg

SEQ ID NO: 62245 - RNA, 22 nt, Human
acagauguuacaguaugaucuc

SEQ ID NO: 62246 - RNA, 22 nt, Human
acagauugggaacugucuccuu

SEQ ID NO: 62247 - RNA, 22 nt, Human
acagauuuggaggccucacccc

SEQ ID NO: 62248 - RNA, 22 nt, Human
acagauuuuaaaugacacuccc

SEQ ID NO: 62249 - RNA, 21 nt, Human
acagauuuuauaucucugcug

SEQ ID NO: 62250 - RNA, 22 nt, Human
acagauuuuauuauucagguau

SEQ ID NO: 62251 - RNA, 22 nt, Human
acagauuuuugguaaauaauuu

SEQ ID NO: 62252 - RNA, 22 nt, Human
acagcaaaagacaagaacuuaa

SEQ ID NO: 62253 - RNA, 23 nt, Human
acagcaagaggaccagaugugag

SEQ ID NO: 62254 - RNA, 21 nt, Human
acagcaagccuuccuuucagg

SEQ ID NO: 62255 - RNA, 22 nt, Human
acagcaaugaguaacuccuugg

SEQ ID NO: 62256 - RNA, 22 nt, Human
acagcacagagugguauggcug

SEQ ID NO: 62257 - RNA, 23 nt, Human
acagcacccaugucaucuggcuc

SEQ ID NO: 62258 - RNA, 22 nt, Human
acagcagaucuggcuacagguu

SEQ ID NO: 62259 - RNA, 21 nt, Human
acagcagcaaucugucuuucc

SEQ ID NO: 62260 - RNA, 22 nt, Human
acagcagcagaccagcauaugu

SEQ ID NO: 62261 - RNA, 22 nt, Human
acagcagcauccuauuucacuc

SEQ ID NO: 62262 - RNA, 22 nt, Human
acagcagcuaaccccugggcca

SEQ ID NO: 62263 - RNA, 22 nt, Human
acagcagcugccuucaggcucu

SEQ ID NO: 62264 - RNA, 22 nt, Human
acagcagcuuccugacuguacu

SEQ ID NO: 62265 - RNA, 22 nt, Human
acagcaggcaugaaugacacug

SEQ ID NO: 62266 - RNA, 19 nt, Human
acagcagggauuuuuggag

SEQ ID NO: 62267 - RNA, 22 nt, Human
acagcagguagcuuugugccuc

SEQ ID NO: 62268 - RNA, 22 nt, Human
acagcaguuaacgaucagacuc

SEQ ID NO: 62269 - RNA, 22 nt, Human
acagcaguuacugaaauaaagu

SEQ ID NO: 62270 - RNA, 22 nt, Human
acagcaucuaguacagucuagu

SEQ ID NO: 62271 - RNA, 22 nt, Human
acagcaugucuaguuaaauacu

SEQ ID NO: 62272 - RNA, 22 nt, Human
acagcauucccuuuggcugcuu

SEQ ID NO: 62273 - RNA, 22 nt, Human
acagccaggacuuggcccucuu

SEQ ID NO: 62274 - RNA, 22 nt, Human
acagccagggcauugucgccga

SEQ ID NO: 62275 - RNA, 22 nt, Human
acagccaguaaggaaagaccca

SEQ ID NO: 62276 - RNA, 22 nt, Human
acagccaguaaucuaccccugu

SEQ ID NO: 62277 - RNA, 22 nt, Human
acagccagugcuccgugaggac

SEQ ID NO: 62278 - RNA, 22 nt, Human
acagcccaagucaccugcagga

SEQ ID NO: 62279 - RNA, 22 nt, Human
acagcccagaaagccuaagggg

SEQ ID NO: 62280 - RNA, 22 nt, Human
acagccccagcgcggcgggguc

SEQ ID NO: 62281 - RNA, 19 nt, Human
acagccuguugguggggcu

SEQ ID NO: 62282 - RNA, 22 nt, Human
acagccuuuaaccauuucuucc

SEQ ID NO: 62283 - RNA, 22 nt, Human
acagcuacucugcagauaaauc

SEQ ID NO: 62284 - RNA, 22 nt, Human
acagcuaugacagauggauaau

SEQ ID NO: 62285 - RNA, 22 nt, Human
acagcuccuaacaaaggcucuc

SEQ ID NO: 62286 - RNA, 22 nt, Human
acagcuccuggggcuuuaaugg

SEQ ID NO: 62287 - RNA, 22 nt, Human
acagcucucccucagagaaaug

SEQ ID NO: 62288 - RNA, 22 nt, Human
acagcucuuaggcagaaccaac

SEQ ID NO: 62289 - RNA, 22 nt, Human
acagcucuucuucaagccuggc

SEQ ID NO: 62290 - RNA, 22 nt, Human
acagcugaacaagauaguguca

SEQ ID NO: 62291 - RNA, 22 nt, Human
acagcugauuggaucaaggaca

SEQ ID NO: 62292 - RNA, 22 nt, Human
acagcugcuguggagguuuuca

SEQ ID NO: 62293 - RNA, 22 nt, Human
acagcuggaggccccauugucc

SEQ ID NO: 62294 - RNA, 22 nt, Human
acagcuggaggggcugcagagg

SEQ ID NO: 62295 - RNA, 22 nt, Human
acagcuggcaggggggcaugaa

SEQ ID NO: 62296 - RNA, 22 nt, Human
acagcugggugcugcucagagc

SEQ ID NO: 62297 - RNA, 22 nt, Human
acagcugggugucccacuucug

SEQ ID NO: 62298 - RNA, 22 nt, Human
acagcugugacuuagagaaguu

SEQ ID NO: 62299 - RNA, 22 nt, Human
acagcuguguuuuauaaucagc

SEQ ID NO: 62300 - RNA, 22 nt, Human
acagcuucacccauuaucccug

SEQ ID NO: 62301 - RNA, 22 nt, Human
acagcuucucugaaauucaugu

SEQ ID NO: 62302 - RNA, 22 nt, Human
acagcuugaaucuuaagcucuu

SEQ ID NO: 62303 - RNA, 22 nt, Human
acagcuugcaauggcuuucaac

SEQ ID NO: 62304 - RNA, 22 nt, Human
acagcuuuguguuaaugggaag

SEQ ID NO: 62305 - RNA, 22 nt, Human
acagcuuuucugauagauccug

SEQ ID NO: 62306 - RNA, 22 nt, Human
acaggaaagagcuaggcauagg

SEQ ID NO: 62307 - RNA, 22 nt, Human
acaggaaaugaaaugguaucua

SEQ ID NO: 62308 - RNA, 22 nt, Human
acaggaacagcuugauggcauc

SEQ ID NO: 62309 - RNA, 22 nt, Human
acaggaacgaauguacauuguu

SEQ ID NO: 62310 - RNA, 22 nt, Human
acaggaagugcuggcacuuaca

SEQ ID NO: 62311 - RNA, 22 nt, Human
acaggacaacucagcagccagc

SEQ ID NO: 62312 - RNA, 22 nt, Human
acaggacucucugaaaauguac

SEQ ID NO: 62313 - RNA, 22 nt, Human
acaggagacccugcugguucug

SEQ ID NO: 62314 - RNA, 22 nt, Human
acaggagcucuagggacagcac

SEQ ID NO: 62315 - RNA, 22 nt, Human
acagggcagguggcuacugguc

SEQ ID NO: 62316 - RNA, 23 nt, Human
acagggcauugcuggccucgagg

SEQ ID NO: 62317 - RNA, 22 nt, Human
acagggccaggugagaggugcu

SEQ ID NO: 62318 - RNA, 22 nt, Human
acagggcccugugggccccacu

SEQ ID NO: 62319 - RNA, 22 nt, Human
acagggccucagcugauucugg

SEQ ID NO: 62320 - RNA, 22 nt, Human
acagggccuggcuccaaaagau

SEQ ID NO: 62321 - RNA, 23 nt, Human
acagggcuagcugacagugguau

SEQ ID NO: 62322 - RNA, 22 nt, Human
acagggcuccuagguggugugc

SEQ ID NO: 62323 - RNA, 22 nt, Human
acagggcuggggaaagaggcua

SEQ ID NO: 62324 - RNA, 22 nt, Human
acagggcuggggcacuuggcug

SEQ ID NO: 62325 - RNA, 23 nt, Human
acagggcuuaucugucacucauc

SEQ ID NO: 62326 - RNA, 22 nt, Human
acagggucauuuuaugaucugu

SEQ ID NO: 62327 - RNA, 22 nt, Human
acagggugaaugugacauuauc

SEQ ID NO: 62328 - RNA, 22 nt, Human
acagguacuuuguaaugaagga

SEQ ID NO: 62329 - RNA, 22 nt, Human
acagguagauacauacuucuaa

SEQ ID NO: 62330 - RNA, 22 nt, Human
acaggucaacgagagcaggcaa

SEQ ID NO: 62331 - RNA, 22 nt, Human
acaggucagauaaaggcuggug

SEQ ID NO: 62332 - RNA, 22 nt, Human
acacagaguuauuaugugaacu

SEQ ID NO: 62333 - RNA, 22 nt, Human
acacagaguuugacacauggga

SEQ ID NO: 62334 - RNA, 22 nt, Human
acacagaugauguuccaggaac

SEQ ID NO: 62335 - RNA, 22 nt, Human
acacagccaggguaguaaggcu

SEQ ID NO: 62336 - RNA, 22 nt, Human
acacagccccacggugagcaaa

SEQ ID NO: 62337 - RNA, 22 nt, Human
acacagcucagugccuccaaga

SEQ ID NO: 62338 - RNA, 22 nt, Human
acacagcuucaaagucuaauuc

SEQ ID NO: 62339 - RNA, 22 nt, Human
acacaggaagucagcacugaug

SEQ ID NO: 62340 - RNA, 22 nt, Human
acacaggaggaggauggugguc

SEQ ID NO: 62341 - RNA, 21 nt, Human
acacaggaguuucuucuuucu

SEQ ID NO: 62342 - RNA, 22 nt, Human
acacaggcaaugugagugggag

SEQ ID NO: 62343 - RNA, 22 nt, Human
acacaggcauagccauacaugu

SEQ ID NO: 62344 - RNA, 22 nt, Human
acacagggaggaggugcugugc

SEQ ID NO: 62345 - RNA, 22 nt, Human
acacagggcagagagcuggcuc

SEQ ID NO: 62346 - RNA, 22 nt, Human
acacaggggcucggcugggugc

SEQ ID NO: 62347 - RNA, 22 nt, Human
acacagggggcauucuaggagu

SEQ ID NO: 62348 - RNA, 22 nt, Human
acacagguaaugguuuuggaag

SEQ ID NO: 62349 - RNA, 18 nt, Human
acacagguuauucucucc

SEQ ID NO: 62350 - RNA, 22 nt, Human
acacaguaaauauguauugaau

SEQ ID NO: 62351 - RNA, 22 nt, Human
acacaguaccccaaggcugggc

SEQ ID NO: 62352 - RNA, 20 nt, Human
acacaguagcaauuagugca

SEQ ID NO: 62353 - RNA, 22 nt, Human
acacaguaggauaguuugagga

SEQ ID NO: 62354 - RNA, 22 nt, Human
acacaguaguuugucauugcua

SEQ ID NO: 62355 - RNA, 22 nt, Human
acacaguaugaaaagucuaguu

SEQ ID NO: 62356 - RNA, 18 nt, Human
acacaguggaugccuggu

SEQ ID NO: 62357 - RNA, 22 nt, Human
acacaguguccuucuacuugcc

SEQ ID NO: 62358 - RNA, 22 nt, Human
acacaguucgugcuuuucuauu

SEQ ID NO: 62359 - RNA, 22 nt, Human
acacaguugguggcucagucug

SEQ ID NO: 62360 - RNA, 22 nt, Human
acacaguuuuucagacagagau

SEQ ID NO: 62361 - RNA, 22 nt, Human
acacauauaccacuguaaauga

SEQ ID NO: 62362 - RNA, 22 nt, Human
acacauauucauauguacuuac

SEQ ID NO: 62363 - RNA, 17 nt, Human
acacaucuuggcuuugc

SEQ ID NO: 62364 - RNA, 22 nt, Human
acacaugaaagacauuaaggug

SEQ ID NO: 62365 - RNA, 22 nt, Human
acacaugaggaaggccucaccc

SEQ ID NO: 62366 - RNA, 22 nt, Human
acacaugauaagaaaguuuaaa

SEQ ID NO: 62367 - RNA, 22 nt, Human
acacaugcuccagucuccagga

SEQ ID NO: 62368 - RNA, 19 nt, Human
acacauguaacaguuuuuc

SEQ ID NO: 62369 - RNA, 22 nt, Human
acacauguauggcacuuacauu

SEQ ID NO: 62370 - RNA, 20 nt, Human
acacaugucaagcuaaaggc

SEQ ID NO: 62371 - RNA, 23 nt, Human
acacauguuuaugcuugggggca

SEQ ID NO: 62372 - RNA, 22 nt, Human
acacauuagugcucugucucau

SEQ ID NO: 62373 - RNA, 22 nt, Human
acacauuauagagaguauaaua

SEQ ID NO: 62374 - RNA, 22 nt, Human
acacauuaucucauuaaauacu

SEQ ID NO: 62375 - RNA, 22 nt, Human
acaccaccgucccagccuccug

SEQ ID NO: 62376 - RNA, 22 nt, Human
acaccagccucgcccguguguu

SEQ ID NO: 62377 - RNA, 22 nt, Human
acacccaggaauaaggacuggg

SEQ ID NO: 62378 - RNA, 22 nt, Human
acacccaggcuggcgugcagug

SEQ ID NO: 62379 - RNA, 22 nt, Human
acaccuuucagguccagacagu

SEQ ID NO: 62380 - RNA, 22 nt, Human
acacgcauaaauacacagucua

SEQ ID NO: 62381 - RNA, 21 nt, Human
acacguguguguaaacacaca

SEQ ID NO: 62382 - RNA, 22 nt, Human
acacuacaaucucagaacuaua

SEQ ID NO: 62383 - RNA, 22 nt, Human
acacuacagggccgggauggaa

SEQ ID NO: 62384 - RNA, 22 nt, Human
acacuacuuuucauaaaaguaa

SEQ ID NO: 62385 - RNA, 22 nt, Human
acacuagagagcaggcauuccc

SEQ ID NO: 62386 - RNA, 22 nt, Human
acacuagaugccaauagcaccc

SEQ ID NO: 62387 - RNA, 22 nt, Human
acacuagcuaaaugcugauuaa

SEQ ID NO: 62388 - RNA, 22 nt, Human
acacuauaagacagauacagca

SEQ ID NO: 62389 - RNA, 22 nt, Human
acacucaugcucagcuggugcu

SEQ ID NO: 62390 - RNA, 22 nt, Human
acacucuguaaugucacacucc

SEQ ID NO: 62391 - RNA, 23 nt, Human
acacucuucccagaagguucuga

SEQ ID NO: 62392 - RNA, 22 nt, Human
acacugaaagaagccagcuugu

SEQ ID NO: 62393 - RNA, 22 nt, Human
acacugaauauacaaugaauau

SEQ ID NO: 62394 - RNA, 22 nt, Human
acacugaauguuuaagaacuug

SEQ ID NO: 62395 - RNA, 22 nt, Human
acacugagcuuccaagaugggg

SEQ ID NO: 62396 - RNA, 21 nt, Human
acacugagugaauuagcacau

SEQ ID NO: 62397 - RNA, 22 nt, Human
acacugcagaugaaagcauaag

SEQ ID NO: 62398 - RNA, 22 nt, Human
acacugcagcaucagcuacgga

SEQ ID NO: 62399 - RNA, 21 nt, Human
acacugcaggugaagugcacu

SEQ ID NO: 62400 - RNA, 22 nt, Human
acacugcucacuucuucccuug

SEQ ID NO: 62401 - RNA, 19 nt, Human
acacugggagaagacugcu

SEQ ID NO: 62402 - RNA, 22 nt, Human
acacuggguaacauaucuguua

SEQ ID NO: 62403 - RNA, 22 nt, Human
acacugguguaguuuucugcag

SEQ ID NO: 62404 - RNA, 19 nt, Human
acacugguuguucaagggc

SEQ ID NO: 62405 - RNA, 22 nt, Human
acacuguagacuguugaaguac

SEQ ID NO: 62406 - RNA, 22 nt, Human
acacuguagauauagaguuagu

SEQ ID NO: 62407 - RNA, 22 nt, Human
acacuguaugaaaacaggaaau

SEQ ID NO: 62408 - RNA, 22 nt, Human
acacugugaucuugagaaaggu

SEQ ID NO: 62409 - RNA, 22 nt, Human
acacugugauuucuggguucca

SEQ ID NO: 62410 - RNA, 22 nt, Human
acacugugcagauucccuguga

SEQ ID NO: 62411 - RNA, 22 nt, Human
acacugugcaugcauauacaca

SEQ ID NO: 62412 - RNA, 20 nt, Human
acacugugcuaaggauuuuc

SEQ ID NO: 62413 - RNA, 22 nt, Human
acacugugugacuucugagacu

SEQ ID NO: 62414 - RNA, 22 nt, Human
acacuguguuuacauagagaau

SEQ ID NO: 62415 - RNA, 22 nt, Human
acacuguugcuggcacagacag

SEQ ID NO: 62416 - RNA, 22 nt, Human
acacuguuuuagggaagaaaau

SEQ ID NO: 62417 - RNA, 22 nt, Human
acacuuaagcaugaaguauaaa

SEQ ID NO: 62418 - RNA, 22 nt, Human
acacuuaaucuuacugaggauc

SEQ ID NO: 62419 - RNA, 22 nt, Human
acacuucaccccugcucccagu

SEQ ID NO: 62420 - RNA, 22 nt, Human
acacuucagcuccacaaacauu

SEQ ID NO: 62421 - RNA, 21 nt, Human
acacuucaguuuuuaaaggga

SEQ ID NO: 62422 - RNA, 22 nt, Human
acacuucaugcauucuucacuc

SEQ ID NO: 62423 - RNA, 20 nt, Human
acacuugacaccagaaaugg

SEQ ID NO: 62424 - RNA, 22 nt, Human
acacuuuagauauucccuucug

SEQ ID NO: 62425 - RNA, 22 nt, Human
acacuuugaagauggaaacuug

SEQ ID NO: 62426 - RNA, 22 nt, Human
acagaaagauaggcacaagguc

SEQ ID NO: 62427 - RNA, 20 nt, Human
acagaaagcugccuuguccc

SEQ ID NO: 62428 - RNA, 22 nt, Human
acagaaauaacuuuuuauguuu

SEQ ID NO: 62429 - RNA, 22 nt, Human
acagaaauuagcagugaguuua

SEQ ID NO: 62430 - RNA, 22 nt, Human
acagaacaacaagguggaccag

SEQ ID NO: 62431 - RNA, 22 nt, Human
acagaacaagaccugcuuauug

SEQ ID NO: 62432 - RNA, 22 nt, Human
acagaacaggcugagaaaaaca

SEQ ID NO: 62433 - RNA, 18 nt, Human
acagaacucaggggcacc

SEQ ID NO: 62434 - RNA, 22 nt, Human
acagaacuucaguaguauuccc

SEQ ID NO: 62435 - RNA, 22 nt, Human
acagaacuuggaacuuuucaca

SEQ ID NO: 62436 - RNA, 22 nt, Human
acagaacuuucugauccugagc

SEQ ID NO: 62437 - RNA, 22 nt, Human
acagucuuaauggauaggagcu

SEQ ID NO: 62438 - RNA, 22 nt, Human
acagucuucaugcuagaauggc

SEQ ID NO: 62439 - RNA, 22 nt, Human
acagucuugagcaucagccaga

SEQ ID NO: 62440 - RNA, 22 nt, Human
acagucuugcacuucuaucagc

SEQ ID NO: 62441 - RNA, 22 nt, Human
caggaaguuguguguucgaggc

SEQ ID NO: 62442 - RNA, 22 nt, Human
caggaaugauauucgaggagau

SEQ ID NO: 62443 - RNA, 22 nt, Human
caggaaugcauucuagaauggc

SEQ ID NO: 62444 - RNA, 18 nt, Human
caggaauggaugggauuu

SEQ ID NO: 62445 - RNA, 22 nt, Human
caggaauguuugugcuccuuua

SEQ ID NO: 62446 - RNA, 22 nt, Human
caggaauucauagcauuguucu

SEQ ID NO: 62447 - RNA, 22 nt, Human
caggacaaucucgucggguccu

SEQ ID NO: 62448 - RNA, 22 nt, Human
caggacacuaaaaagccaagcu

SEQ ID NO: 62449 - RNA, 22 nt, Human
caggacacuacagaugggaggg

SEQ ID NO: 62450 - RNA, 22 nt, Human
caggacagaaauaaggaauaua

SEQ ID NO: 62451 - RNA, 22 nt, Human
caggacagaccaagaucgugcu

SEQ ID NO: 62452 - RNA, 22 nt, Human
caggacagugcagguccauccu

SEQ ID NO: 62453 - RNA, 22 nt, Human
caggacauugauccauuggcac

SEQ ID NO: 62454 - RNA, 22 nt, Human
caggaccaggcguucugggcug

SEQ ID NO: 62455 - RNA, 22 nt, Human
caggacucuugucaucaucagu

SEQ ID NO: 62456 - RNA, 22 nt, Human
caggacugauguuccuccagcc

SEQ ID NO: 62457 - RNA, 22 nt, Human
caggacuggaagucucaagaga

SEQ ID NO: 62458 - RNA, 22 nt, Human
caggagaagguuuggagugcag

SEQ ID NO: 62459 - RNA, 22 nt, Human
caggagacaguguuauuuuauu

SEQ ID NO: 62460 - RNA, 19 nt, Human
caggagagcaugcacuuug

SEQ ID NO: 62461 - RNA, 22 nt, Human
caggagauaaaagagaugcuuu

SEQ ID NO: 62462 - RNA, 22 nt, Human
caggagaugacagggaagaacc

SEQ ID NO: 62463 - RNA, 23 nt, Human
caggagauggcugcugugucagc

SEQ ID NO: 62464 - RNA, 22 nt, Human
caggagauguaagacuucuguu

SEQ ID NO: 62465 - RNA, 22 nt, Human
caggagcaaggagcagugggau

SEQ ID NO: 62466 - RNA, 22 nt, Human
caggagcagaggguggucagca

SEQ ID NO: 62467 - RNA, 22 nt, Human
caggagccagaggcggauggag

SEQ ID NO: 62468 - RNA, 22 nt, Human
caggagccgccaggcacguugg

SEQ ID NO: 62469 - RNA, 22 nt, Human
caggagcucucaucgucagggc

SEQ ID NO: 62470 - RNA, 22 nt, Human
caggagcuggaucuccuugcgg

SEQ ID NO: 62471 - RNA, 22 nt, Human
caggagcugggucuggaagcag

SEQ ID NO: 62472 - RNA, 22 nt, Human
caggaggaaaugugacccugcu

SEQ ID NO: 62473 - RNA, 22 nt, Human
caggaggacauacuggcucaca

SEQ ID NO: 62474 - RNA, 22 nt, Human
caggaggcagagguugcagcga

SEQ ID NO: 62475 - RNA, 22 nt, Human
caggaggcaguuucagaaguca

SEQ ID NO: 62476 - RNA, 22 nt, Human
caggaggcauauuuaaauccaa

SEQ ID NO: 62477 - RNA, 22 nt, Human
caggaggcuccuagggcucugu

SEQ ID NO: 62478 - RNA, 22 nt, Human
caggaggggguggaguuucgcc

SEQ ID NO: 62479 - RNA, 22 nt, Human
caggaggugacuuccagggguu

SEQ ID NO: 62480 - RNA, 22 nt, Human
caggagucuguuccucauuugu

SEQ ID NO: 62481 - RNA, 22 nt, Human
caggagugaaaugaggcccagg

SEQ ID NO: 62482 - RNA, 22 nt, Human
caggagugaguuggggucuaca

SEQ ID NO: 62483 - RNA, 22 nt, Human
caggagugucgggucacuaggu

SEQ ID NO: 62484 - RNA, 22 nt, Human
caggaguugguaauauugugga

SEQ ID NO: 62485 - RNA, 22 nt, Human
caggaguuucuauuguuccaaa

SEQ ID NO: 62486 - RNA, 22 nt, Human
caggauaacagaaaauagcuga

SEQ ID NO: 62487 - RNA, 22 nt, Human
caggauagaaaggccauggagu

SEQ ID NO: 62488 - RNA, 22 nt, Human
caggaucugccaauauucaacc

SEQ ID NO: 62489 - RNA, 22 nt, Human
caggaucugcccaggccuuugg

SEQ ID NO: 62490 - RNA, 22 nt, Human
caggaugcacuaggaaccaggg

SEQ ID NO: 62491 - RNA, 22 nt, Human
caggaugccaucugcugcugcu

SEQ ID NO: 62492 - RNA, 22 nt, Human
caggauggagagugagggguca

SEQ ID NO: 62493 - RNA, 22 nt, Human
caggaugggauguagugggccc

SEQ ID NO: 62494 - RNA, 22 nt, Human
caggauggucagaugcauuguc

SEQ ID NO: 62495 - RNA, 22 nt, Human
caggauggugugagugugagga

SEQ ID NO: 62496 - RNA, 22 nt, Human
caggauguaugucuuauucuuc

SEQ ID NO: 62497 - RNA, 22 nt, Human
caggaugugaggaggccauuug

SEQ ID NO: 62498 - RNA, 22 nt, Human
caggauguugcucccauguccc

SEQ ID NO: 62499 - RNA, 22 nt, Human
caggauugagcaaauggauuau

SEQ ID NO: 62500 - RNA, 19 nt, Human
caggauuguuuaaagcuuu

SEQ ID NO: 62501 - RNA, 22 nt, Human
caggcaagauuagagaugagca

SEQ ID NO: 62502 - RNA, 22 nt, Human
caggcaaggagcuggcucaagu

SEQ ID NO: 62503 - RNA, 22 nt, Human
caggcacaaaaggaccccagca

SEQ ID NO: 62504 - RNA, 22 nt, Human
caggcacaagaucggcuagaua

SEQ ID NO: 62505 - RNA, 22 nt, Human
caggcacaauuauuucccuuuc

SEQ ID NO: 62506 - RNA, 20 nt, Human
caggcacacucauuccugcu

SEQ ID NO: 62507 - RNA, 22 nt, Human
caggcacagcugggcaauugcg

SEQ ID NO: 62508 - RNA, 22 nt, Human
caggcaccccaggugagcacug

SEQ ID NO: 62509 - RNA, 22 nt, Human
caggcaccugugugucucaggg

SEQ ID NO: 62510 - RNA, 22 nt, Human
caggcacucagucuggaucccu

SEQ ID NO: 62511 - RNA, 22 nt, Human
caggcacugugcaagggucucg

SEQ ID NO: 62512 - RNA, 22 nt, Human
caggcacugugcugagcucugc

SEQ ID NO: 62513 - RNA, 22 nt, Human
caggcacuuugcugggggcgca

SEQ ID NO: 62514 - RNA, 22 nt, Human
caggcagaaaguauucugugua

SEQ ID NO: 62515 - RNA, 22 nt, Human
caggcagaaauuuuguuucauu

SEQ ID NO: 62516 - RNA, 22 nt, Human
caggcagacuuugagaaugaug

SEQ ID NO: 62517 - RNA, 22 nt, Human
caggcagagcaacugguccaga

SEQ ID NO: 62518 - RNA, 22 nt, Human
caggcagaggaagucugggucu

SEQ ID NO: 62519 - RNA, 22 nt, Human
caggcagagucagauuagacuu

SEQ ID NO: 62520 - RNA, 22 nt, Human
caggcagaguuagagcaacugg

SEQ ID NO: 62521 - RNA, 22 nt, Human
caggcagcaggagcccugcucg

SEQ ID NO: 62522 - RNA, 22 nt, Human
caggcagcguccugcuuccugu

SEQ ID NO: 62523 - RNA, 22 nt, Human
caggcagcugggucaccguccc

SEQ ID NO: 62524 - RNA, 22 nt, Human
auggcuccagcugguagagauu

SEQ ID NO: 62525 - RNA, 18 nt, Human
auggcuccagugucuucc

SEQ ID NO: 62526 - RNA, 22 nt, Human
auggcucuagaauaccccucag

SEQ ID NO: 62527 - RNA, 22 nt, Human
auggcucuugaauugauacucu

SEQ ID NO: 62528 - RNA, 22 nt, Human
auggcugagaugggcuccaggc

SEQ ID NO: 62529 - RNA, 22 nt, Human
auggcugcaucauccugguuga

SEQ ID NO: 62530 - RNA, 19 nt, Human
auggcugcugauuggggau

SEQ ID NO: 62531 - RNA, 22 nt, Human
auggcugggaggagaguaugau

SEQ ID NO: 62532 - RNA, 22 nt, Human
auggcuguaaauucagagaugg

SEQ ID NO: 62533 - RNA, 22 nt, Human
auggcugugcagagauugggaa

SEQ ID NO: 62534 - RNA, 22 nt, Human
auggcugugguaucagacgcag

SEQ ID NO: 62535 - RNA, 22 nt, Human
auggcugugugacugaguucua

SEQ ID NO: 62536 - RNA, 22 nt, Human
auggcugugugcuucuccccau

SEQ ID NO: 62537 - RNA, 22 nt, Human
auggcuguguuagaugcuaagu

SEQ ID NO: 62538 - RNA, 22 nt, Human
auggcuguugugaggaucaaau

SEQ ID NO: 62539 - RNA, 22 nt, Human
auggcuguuuagcuucucugcu

SEQ ID NO: 62540 - RNA, 22 nt, Human
auggcuuccucuggauuggauu

SEQ ID NO: 62541 - RNA, 21 nt, Human
auggcuucucaggugcacuga

SEQ ID NO: 62542 - RNA, 22 nt, Human
auggcuucugucuuggaaauuu

SEQ ID NO: 62543 - RNA, 22 nt, Human
auggcuugcuuuuagagagauc

SEQ ID NO: 62544 - RNA, 22 nt, Human
auggcuugguugguuaaagcac

SEQ ID NO: 62545 - RNA, 22 nt, Human
auggcuugucuaugagugcucu

SEQ ID NO: 62546 - RNA, 22 nt, Human
auggcuuucagauggugaaaga

SEQ ID NO: 62547 - RNA, 22 nt, Human
auggcuuuccggacuuuggcca

SEQ ID NO: 62548 - RNA, 22 nt, Human
auggcuuuccugggacaugggc

SEQ ID NO: 62549 - RNA, 22 nt, Human
auggcuuugaaguaauguaauu

SEQ ID NO: 62550 - RNA, 22 nt, Human
caggccagugggaaauagggau

SEQ ID NO: 62551 - RNA, 22 nt, Human
caggcccaaaugcaaccuucuu

SEQ ID NO: 62552 - RNA, 22 nt, Human
caggcccaagacugaugagucu

SEQ ID NO: 62553 - RNA, 22 nt, Human
caggcccaggugucgauguucc

SEQ ID NO: 62554 - RNA, 22 nt, Human
caggcccagugaucagggcucu

SEQ ID NO: 62555 - RNA, 22 nt, Human
caggcccaucugcucccaggcu

SEQ ID NO: 62556 - RNA, 22 nt, Human
caggccccauuccucuugggac

SEQ ID NO: 62557 - RNA, 22 nt, Human
caggcccuccugugaucugccu

SEQ ID NO: 62558 - RNA, 22 nt, Human
caggcccugcacuaggcccugg

SEQ ID NO: 62559 - RNA, 19 nt, Human
caggcccuggacccaucug

SEQ ID NO: 62560 - RNA, 22 nt, Human
caggcccuggcagggcugaguc

SEQ ID NO: 62561 - RNA, 18 nt, Human
caggcccugucuggccuc

SEQ ID NO: 62562 - RNA, 22 nt, Human
caggcccugugcugggugaugu

SEQ ID NO: 62563 - RNA, 22 nt, Human
caggcccuuuccugggcauagg

SEQ ID NO: 62564 - RNA, 22 nt, Human
caggccucagagaguggcgggg

SEQ ID NO: 62565 - RNA, 22 nt, Human
caggccucgaggagacagcuac

SEQ ID NO: 62566 - RNA, 19 nt, Human
caggccucuggucugcugu

SEQ ID NO: 62567 - RNA, 18 nt, Human
caggccucuugaucuucc

SEQ ID NO: 62568 - RNA, 22 nt, Human
caggccugauacacugaacucu

SEQ ID NO: 62569 - RNA, 22 nt, Human
caggccuggagugcaauggcac

SEQ ID NO: 62570 - RNA, 22 nt, Human
caggccuuaaggacucggagaa

SEQ ID NO: 62571 - RNA, 22 nt, Human
caggccuuaguaggugcucccu

SEQ ID NO: 62572 - RNA, 22 nt, Human
caggccuuaucuccacccugca

SEQ ID NO: 62573 - RNA, 22 nt, Human
caggccuucucccucccucaac

SEQ ID NO: 62574 - RNA, 22 nt, Human
caggccuugaaggccugcggga

SEQ ID NO: 62575 - RNA, 22 nt, Human
caggccuuucuggggaagugag

SEQ ID NO: 62576 - RNA, 22 nt, Human
caggcgggcaggugcggccccu

SEQ ID NO: 62577 - RNA, 22 nt, Human
caggcuacuggggcuuggaugg

SEQ ID NO: 62578 - RNA, 22 nt, Human
caggcucaauggccacuugggc

SEQ ID NO: 62579 - RNA, 22 nt, Human
caggcucagcaggagccugacc

SEQ ID NO: 62580 - RNA, 22 nt, Human
caggcucagucagaaaauguau

SEQ ID NO: 62581 - RNA, 22 nt, Human
caggcuccacaggggaauccgg

SEQ ID NO: 62582 - RNA, 22 nt, Human
caggcuccauuaaucauccugc

SEQ ID NO: 62583 - RNA, 22 nt, Human
caggcucccacaagcucccagc

SEQ ID NO: 62584 - RNA, 22 nt, Human
caggcucccacccuccugcagc

SEQ ID NO: 62585 - RNA, 22 nt, Human
caggcucccugggcaguggcag

SEQ ID NO: 62586 - RNA, 22 nt, Human
caggcucuagguuaguaggaga

SEQ ID NO: 62587 - RNA, 22 nt, Human
caggcucugcugcuacagcugu

SEQ ID NO: 62588 - RNA, 21 nt, Human
caggcucugcugggugcuggg

SEQ ID NO: 62589 - RNA, 22 nt, Human
caggcugauuaggccucgucca

SEQ ID NO: 62590 - RNA, 22 nt, Human
caggcugccgaggcugcagaau

SEQ ID NO: 62591 - RNA, 22 nt, Human
caggcugcggucggcucugguc

SEQ ID NO: 62592 - RNA, 22 nt, Human
caggcugcguuugugaaaggua

SEQ ID NO: 62593 - RNA, 22 nt, Human
caggcuggagugcaauggcaca

SEQ ID NO: 62594 - RNA, 22 nt, Human
caggcuggagugcaauggugcu

SEQ ID NO: 62595 - RNA, 22 nt, Human
caggcuggcaaugcgucaagca

SEQ ID NO: 62596 - RNA, 22 nt, Human
caggcugggcuccggagauaaa

SEQ ID NO: 62597 - RNA, 22 nt, Human
caggcuguggaucaggagccuu

SEQ ID NO: 62598 - RNA, 21 nt, Human
caggcuugaggaaugugccug

SEQ ID NO: 62599 - RNA, 22 nt, Human
caggcuugcuagaggagccaaa

SEQ ID NO: 62600 - RNA, 22 nt, Human
caggcuugcugcuagagcacuu

SEQ ID NO: 62601 - RNA, 22 nt, Human
caggcuuuacuuucucucugaa

SEQ ID NO: 62602 - RNA, 22 nt, Human
cagggacaaggaauaagauuag

SEQ ID NO: 62603 - RNA, 22 nt, Human
cagggacaauggcagagccuga

SEQ ID NO: 62604 - RNA, 22 nt, Human
cagggacagcacuaaacucuug

SEQ ID NO: 62605 - RNA, 22 nt, Human
cagggacaggggagaaaagaug

SEQ ID NO: 62606 - RNA, 22 nt, Human
cagggacauaagaggaacaugg

SEQ ID NO: 62607 - RNA, 22 nt, Human
cagggacccuacuagcucacac

SEQ ID NO: 62608 - RNA, 22 nt, Human
cagggacucccaggguagcucc

SEQ ID NO: 62609 - RNA, 22 nt, Human
cagggagaucuuggcuccuggu

SEQ ID NO: 62610 - RNA, 22 nt, Human
cagggagcaggcucuguccauc

SEQ ID NO: 62611 - RNA, 22 nt, Human
cagggagcuggcuggcgugagu

SEQ ID NO: 62612 - RNA, 22 nt, Human
cagggagcuggugccagccgac

SEQ ID NO: 62613 - RNA, 22 nt, Human
cagggaggaugggcuguuuugc

SEQ ID NO: 62614 - RNA, 22 nt, Human
cagggagggaggaaaauuugcu

SEQ ID NO: 62615 - RNA, 22 nt, Human
cagggaguguacaccaugugua

SEQ ID NO: 62616 - RNA, 22 nt, Human
cagggaugagagauggcacaga

SEQ ID NO: 62617 - RNA, 22 nt, Human
cagggaugagcagauggagcaa

SEQ ID NO: 62618 - RNA, 22 nt, Human
cagggaugcugcuuaggcaguu

SEQ ID NO: 62619 - RNA, 22 nt, Human
cagggauggagagacuacuggc

SEQ ID NO: 62620 - RNA, 22 nt, Human
cagggauggccuggcgggccac

SEQ ID NO: 62621 - RNA, 22 nt, Human
cagggaugucucuggaagggag

SEQ ID NO: 62622 - RNA, 22 nt, Human
cagggaugugaugagcugagcc

SEQ ID NO: 62623 - RNA, 22 nt, Human
cagggauucagcugaaggaggc

SEQ ID NO: 62624 - RNA, 21 nt, Human
cagggcaaccaaguccagaga

SEQ ID NO: 62625 - RNA, 21 nt, Human
cagggcacacagaggauggua

SEQ ID NO: 62626 - RNA, 22 nt, Human
cagggcacuuaaauugccucgu

SEQ ID NO: 62627 - RNA, 22 nt, Human
cagggcagagggaaacuccuuu

SEQ ID NO: 62628 - RNA, 22 nt, Human
cagggcagccaggccccguggg

SEQ ID NO: 62629 - RNA, 22 nt, Human
cagggcaggacagauacauuac

SEQ ID NO: 62630 - RNA, 22 nt, Human
cagggcaguuuuacuucucucu

SEQ ID NO: 62631 - RNA, 22 nt, Human
cagggcauuacuucagguccuu

SEQ ID NO: 62632 - RNA, 22 nt, Human
cagggccaagcugcagcaucug

SEQ ID NO: 62633 - RNA, 21 nt, Human
cagggccaauccugaccucua

SEQ ID NO: 62634 - RNA, 20 nt, Human
cagggccacgcuccaaggca

SEQ ID NO: 62635 - RNA, 22 nt, Human
cagggccagcccacuagcgagg

SEQ ID NO: 62636 - RNA, 22 nt, Human
cagggccagccgcagcauccac

SEQ ID NO: 62637 - RNA, 22 nt, Human
cagggccaggcugauggccugg

SEQ ID NO: 62638 - RNA, 22 nt, Human
cagggccagggcuauggugaag

SEQ ID NO: 62639 - RNA, 22 nt, Human
cagggccaguucucgcagcagu

SEQ ID NO: 62640 - RNA, 22 nt, Human
cagggccaugaggcacaggguc

SEQ ID NO: 62641 - RNA, 22 nt, Human
auguuuccagguucuuccuaug

SEQ ID NO: 62642 - RNA, 22 nt, Human
auguuuccauuuucuuguauca

SEQ ID NO: 62643 - RNA, 22 nt, Human
auguuucccagagcaaaucugg

SEQ ID NO: 62644 - RNA, 22 nt, Human
auguuucccauaagauuuucug

SEQ ID NO: 62645 - RNA, 22 nt, Human
auguuucccuucugauuuggga

SEQ ID NO: 62646 - RNA, 22 nt, Human
auguuuccuguuggauuggccc

SEQ ID NO: 62647 - RNA, 22 nt, Human
auguuugaggacucagaagacg

SEQ ID NO: 62648 - RNA, 23 nt, Human
auguuugcaguaacccauccugg

SEQ ID NO: 62649 - RNA, 22 nt, Human
auguuugucaggauuguaauua

SEQ ID NO: 62650 - RNA, 22 nt, Human
auguuugugggauaaacaaaug

SEQ ID NO: 62651 - RNA, 22 nt, Human
auguuuucaaaguaaacuugua

SEQ ID NO: 62652 - RNA, 22 nt, Human
auguuuuccugggagagcacuc

SEQ ID NO: 62653 - RNA, 22 nt, Human
auguuuucuagaguuuaaaauc

SEQ ID NO: 62654 - RNA, 22 nt, Human
auguuuuuaaauagacuuacag

SEQ ID NO: 62655 - RNA, 22 nt, Human
auguuuuuggaaaugggaacau

SEQ ID NO: 62656 - RNA, 22 nt, Human
auuaaaagcuucccaagaguua

SEQ ID NO: 62657 - RNA, 22 nt, Human
auuaaagcuauccagucaugaa

SEQ ID NO: 62658 - RNA, 22 nt, Human
auuaaagugaaguucucagaug

SEQ ID NO: 62659 - RNA, 22 nt, Human
auuuguacaaauuuauguuagu

SEQ ID NO: 62660 - RNA, 22 nt, Human
auuuguagugaagugaaaauaa

SEQ ID NO: 62661 - RNA, 22 nt, Human
auuuguaucaaucucaauauau

SEQ ID NO: 62662 - RNA, 22 nt, Human
auuugucaauaagaugaacaua

SEQ ID NO: 62663 - RNA, 22 nt, Human
auuugucauguauguaaaguug

SEQ ID NO: 62664 - RNA, 22 nt, Human
auuugugggacuauaaugcagg

SEQ ID NO: 62665 - RNA, 22 nt, Human
auuuguuaauuaugaggcauac

SEQ ID NO: 62666 - RNA, 22 nt, Human
auuuguucagcauugaauuugg

SEQ ID NO: 62667 - RNA, 22 nt, Human
auuuguuccaugaguaaggcua

SEQ ID NO: 62668 - RNA, 23 nt, Human
auuuuaaccuugacuaacaugca

SEQ ID NO: 62669 - RNA, 23 nt, Human
auuuuacaggucaguuccuugaa

SEQ ID NO: 62670 - RNA, 22 nt, Human
auuuuaccuuaaagucuauauu

SEQ ID NO: 62671 - RNA, 22 nt, Human
auuuuacuaaguggauaucugu

SEQ ID NO: 62672 - RNA, 22 nt, Human
auuuuacuacuccaauuaauga

SEQ ID NO: 62673 - RNA, 22 nt, Human
auuuuacuuugugaauauugac

SEQ ID NO: 62674 - RNA, 22 nt, Human
auuuuagagcuccaaguacagc

SEQ ID NO: 62675 - RNA, 22 nt, Human
auuuuagauuuaagaauaaggu

SEQ ID NO: 62676 - RNA, 22 nt, Human
auuuuagcuguccaguggauug

SEQ ID NO: 62677 - RNA, 22 nt, Human
auuuuaugacacgauucuucca

SEQ ID NO: 62678 - RNA, 22 nt, Human
auuuucagguuuugccauugua

SEQ ID NO: 62679 - RNA, 22 nt, Human
auuuucaugacuaccuuaaaua

SEQ ID NO: 62680 - RNA, 22 nt, Human
auuuucauggcuucugcucagu

SEQ ID NO: 62681 - RNA, 21 nt, Human
auuucauggugcuuuuaagaa

SEQ ID NO: 62682 - RNA, 19 nt, Human
auuuccaagaauuggagag

SEQ ID NO: 62683 - RNA, 22 nt, Human
auuuccaccggcucaggaaguu

SEQ ID NO: 62684 - RNA, 22 nt, Human
auuuccagcagcauauuugucu

SEQ ID NO: 62685 - RNA, 22 nt, Human
auuuccaggagaaaggauuuua

SEQ ID NO: 62686 - RNA, 22 nt, Human
auuuccaguacuauuuucugcu

SEQ ID NO: 62687 - RNA, 22 nt, Human
auuuccaugaaggcagauuuua

SEQ ID NO: 62688 - RNA, 22 nt, Human
auuuccaugccuuagcuuaagg

SEQ ID NO: 62689 - RNA, 22 nt, Human
auuuccaugucgguauuuuaua

SEQ ID NO: 62690 - RNA, 22 nt, Human
auuuccauuuucagccauuacu

SEQ ID NO: 62691 - RNA, 22 nt, Human
auuucccaauacgcuaagugga

SEQ ID NO: 62692 - RNA, 22 nt, Human
auuucccagauaaacagcugga

SEQ ID NO: 62693 - RNA, 22 nt, Human
auuucccaggacuagaaauaua

SEQ ID NO: 62694 - RNA, 22 nt, Human
auuuccuaauuuagggauagac

SEQ ID NO: 62695 - RNA, 22 nt, Human
auuuccuaauuuaugcaggagu

SEQ ID NO: 62696 - RNA, 22 nt, Human
auuuccuaggguagaugucaca

SEQ ID NO: 62697 - RNA, 22 nt, Human
auuuccuauggauacaggcaga

SEQ ID NO: 62698 - RNA, 22 nt, Human
auuuccugaucuguaaaauagc

SEQ ID NO: 62699 - RNA, 22 nt, Human
auuuccuggaaugacuaguggg

SEQ ID NO: 62700 - RNA, 22 nt, Human
auuuccugggucucacuccaga

SEQ ID NO: 62701 - RNA, 22 nt, Human
auuuccuguugcuuuugccacu

SEQ ID NO: 62702 - RNA, 22 nt, Human
auuuccuucaucagccuauccu

SEQ ID NO: 62703 - RNA, 22 nt, Human
auuuccuucggacaguuugggu

SEQ ID NO: 62704 - RNA, 22 nt, Human
auuucgauagaccuaacaauug

SEQ ID NO: 62705 - RNA, 22 nt, Human
auuucuagguagagaagcuuag

SEQ ID NO: 62706 - RNA, 22 nt, Human
auuucuagguucacauguguuu

SEQ ID NO: 62707 - RNA, 22 nt, Human
auuucucaaaggaauagaguga

SEQ ID NO: 62708 - RNA, 22 nt, Human
auuucucacucacaguccaugu

SEQ ID NO: 62709 - RNA, 22 nt, Human
auuucucaggguccagguccca

SEQ ID NO: 62710 - RNA, 22 nt, Human
auuucucaguaaucucagcaau

SEQ ID NO: 62711 - RNA, 22 nt, Human
auuucucaguaggugcacagug

SEQ ID NO: 62712 - RNA, 22 nt, Human
auuucucaguuccuacuguuua

SEQ ID NO: 62713 - RNA, 22 nt, Human
auuucucauuuugcuucaaagg

SEQ ID NO: 62714 - RNA, 22 nt, Human
auuucucuaagcauccguuugc

SEQ ID NO: 62715 - RNA, 22 nt, Human
auuucugauaguaaaggucuuu

SEQ ID NO: 62716 - RNA, 22 nt, Human
auuucuggacugaaaaggaagu

SEQ ID NO: 62717 - RNA, 22 nt, Human
auuucuuccucugucaguaacu

SEQ ID NO: 62718 - RNA, 22 nt, Human
auuucuugauuccaccagugaa

SEQ ID NO: 62719 - RNA, 22 nt, Human
auuugaaaaccugagccucccg

SEQ ID NO: 62720 - RNA, 23 nt, Human
auuugaaacuuucuuguuuccag

SEQ ID NO: 62721 - RNA, 22 nt, Human
auuugaaaucccuucuacugua

SEQ ID NO: 62722 - RNA, 22 nt, Human
auuugaaguaaguaaugaguau

SEQ ID NO: 62723 - RNA, 22 nt, Human
auuugacagugaguuguggaug

SEQ ID NO: 62724 - RNA, 22 nt, Human
auuugagaugguaaauaacuuu

SEQ ID NO: 62725 - RNA, 22 nt, Human
auuugauaguaugacagggcag

SEQ ID NO: 62726 - RNA, 22 nt, Human
auuugauuagcuguguaauuuu

SEQ ID NO: 62727 - RNA, 22 nt, Human
auuugauuuguagauaguguag

SEQ ID NO: 62728 - RNA, 22 nt, Human
auuugcacacagucuccugugg

SEQ ID NO: 62729 - RNA, 22 nt, Human
auuugcaggugucgauuagucu

SEQ ID NO: 62730 - RNA, 22 nt, Human
auuugcauaaggaugcuacugu

SEQ ID NO: 62731 - RNA, 22 nt, Human
auuugcauaauagugauuugua

SEQ ID NO: 62732 - RNA, 20 nt, Human
auuugcaucugaauaacuua

SEQ ID NO: 62733 - RNA, 22 nt, Human
auuugccuguaagacaaggccu

SEQ ID NO: 62734 - RNA, 22 nt, Human
auuugccuugugauuuguaagu

SEQ ID NO: 62735 - RNA, 22 nt, Human
auuugcugaaucaaugaauuuu

SEQ ID NO: 62736 - RNA, 22 nt, Human
auuugcugagcucaaagaaaag

SEQ ID NO: 62737 - RNA, 22 nt, Human
auuugcugauggcauuugagcu

SEQ ID NO: 62738 - RNA, 22 nt, Human
auuugcuggugaaauagugaca

SEQ ID NO: 62739 - RNA, 22 nt, Human
auuugcuggugaauguauagcu

SEQ ID NO: 62740 - RNA, 22 nt, Human
auuugcuucauagaucugugga

SEQ ID NO: 62741 - RNA, 22 nt, Human
auuugcuucuugcuuccagcac

SEQ ID NO: 62742 - RNA, 22 nt, Human
auuugcuuguccuggugacugu

SEQ ID NO: 62743 - RNA, 22 nt, Human
auuugcuugugcuaugaaaguu

SEQ ID NO: 62744 - RNA, 22 nt, Human
auuugcuuguucaccaguacuu

SEQ ID NO: 62745 - RNA, 22 nt, Human
auuugcuuugggacagcuuaaa

SEQ ID NO: 62746 - RNA, 19 nt, Human
auuuggaaauaaggucuuc

SEQ ID NO: 62747 - RNA, 22 nt, Human
auuuggaaauguaagaaugcaa

SEQ ID NO: 62748 - RNA, 22 nt, Human
auuuggaacugggcaugcaaac

SEQ ID NO: 62749 - RNA, 22 nt, Human
auuuggaagaaaucugucacag

SEQ ID NO: 62750 - RNA, 22 nt, Human
auuuggaaggagcugcacagca

SEQ ID NO: 62751 - RNA, 22 nt, Human
auuuggaauucgaguaauucca

SEQ ID NO: 62752 - RNA, 22 nt, Human
auuuggaggccucuccugcuug

SEQ ID NO: 62753 - RNA, 22 nt, Human
auuuggauaucacugaauacau

SEQ ID NO: 62754 - RNA, 20 nt, Human
auuugggacgauuggccacc

SEQ ID NO: 62755 - RNA, 22 nt, Human
auuugguaguccugauaagauu

SEQ ID NO: 62756 - RNA, 22 nt, Human
auuugguagugauugaaauuau

SEQ ID NO: 62757 - RNA, 22 nt, Human
auuuggucagaacucucuuuag

SEQ ID NO: 62758 - RNA, 22 nt, Human
auuuggucuacauuuuccaaau

SEQ ID NO: 62759 - RNA, 22 nt, Human
auuuggucuguaauuacaugga

SEQ ID NO: 62760 - RNA, 23 nt, Human
auuugguguugguucugccaccc

SEQ ID NO: 62761 - RNA, 22 nt, Human
auuuguaaagugcuuaaaagua

SEQ ID NO: 62762 - RNA, 22 nt, Human
auuuguauauuuaagaggguag

SEQ ID NO: 62763 - RNA, 22 nt, Human
auuuguaucuucuaauauuauc

SEQ ID NO: 62764 - RNA, 22 nt, Human
auuugucuaaugaguguguacu

SEQ ID NO: 62765 - RNA, 22 nt, Human
auuugucuucaguagguucuuc

SEQ ID NO: 62766 - RNA, 22 nt, Human
auuuguuguugcuccccuaaga

SEQ ID NO: 62767 - RNA, 22 nt, Human
auuuuaacccucuuauauauac

SEQ ID NO: 62768 - RNA, 20 nt, Human
ccagaagguuugccacuuuc

SEQ ID NO: 62769 - RNA, 22 nt, Human
ccagaagugucuaucaagaugu

SEQ ID NO: 62770 - RNA, 22 nt, Human
ccagaaguuccuaagcaucauu

SEQ ID NO: 62771 - RNA, 23 nt, Human
ccagaaucuacucauuggaauga

SEQ ID NO: 62772 - RNA, 22 nt, Human
ccagaauuugaacucaggcaau

SEQ ID NO: 62773 - RNA, 22 nt, Human
ccagacaguuccuugagguuca

SEQ ID NO: 62774 - RNA, 22 nt, Human
ccagacucaucugccauugcug

SEQ ID NO: 62775 - RNA, 22 nt, Human
ccagagaaagcucacaggcagu

SEQ ID NO: 62776 - RNA, 22 nt, Human
ccagagaaccuugagcugugag

SEQ ID NO: 62777 - RNA, 22 nt, Human
ccagagacaaggagcuggaguc

SEQ ID NO: 62778 - RNA, 22 nt, Human
ccagagaccagaacauggggau

SEQ ID NO: 62779 - RNA, 22 nt, Human
ccagagacuggcugagagaucu

SEQ ID NO: 62780 - RNA, 22 nt, Human
ccagagagagaggucaauggca

SEQ ID NO: 62781 - RNA, 22 nt, Human
ccagagaggccaaggucguggu

SEQ ID NO: 62782 - RNA, 22 nt, Human
ccagagagggcgccaccuggag

SEQ ID NO: 62783 - RNA, 22 nt, Human
ccagagagguagcuuacccucu

SEQ ID NO: 62784 - RNA, 22 nt, Human
ccagagagucgaugggggacac

SEQ ID NO: 62785 - RNA, 22 nt, Human
ccagagcagauguggccuuggu

SEQ ID NO: 62786 - RNA, 20 nt, Human
ccagagcagccacugaaguu

SEQ ID NO: 62787 - RNA, 22 nt, Human
ccagagcaugaagggcaaugac

SEQ ID NO: 62788 - RNA, 22 nt, Human
ccagagcccagggucaugcagg

SEQ ID NO: 62789 - RNA, 22 nt, Human
ccagagccggauugugaagugc

SEQ ID NO: 62790 - RNA, 21 nt, Human
ccagagccugagaggauuaug

SEQ ID NO: 62791 - RNA, 22 nt, Human
ccagagcugaugggcccagggu

SEQ ID NO: 62792 - RNA, 22 nt, Human
ccagagcuucggggcggcugua

SEQ ID NO: 62793 - RNA, 22 nt, Human
ccagaggaaaaauaucucccua

SEQ ID NO: 62794 - RNA, 19 nt, Human
ccagaggacuguuaaugaa

SEQ ID NO: 62795 - RNA, 22 nt, Human
ccagaggacuugggggcugaau

SEQ ID NO: 62796 - RNA, 18 nt, Human
ccagaggcccgggcaggc

SEQ ID NO: 62797 - RNA, 22 nt, Human
ccagaggcuggggaaggauaca

SEQ ID NO: 62798 - RNA, 22 nt, Human
ccagaggcuggguucaccucag

SEQ ID NO: 62799 - RNA, 22 nt, Human
ccagagggaacugggccucauu

SEQ ID NO: 62800 - RNA, 22 nt, Human
caaaucauggcucuagcuuaca

SEQ ID NO: 62801 - RNA, 22 nt, Human
caaaucuauauguugauauucu

SEQ ID NO: 62802 - RNA, 22 nt, Human
caaaucuuuaauugaggaauca

SEQ ID NO: 62803 - RNA, 20 nt, Human
caaaugaagcuguuggccuc

SEQ ID NO: 62804 - RNA, 22 nt, Human
caaaugaaguccaaagggcuua

SEQ ID NO: 62805 - RNA, 22 nt, Human
caaaugcaggucauaaccugag

SEQ ID NO: 62806 - RNA, 22 nt, Human
caaaugcaugagaaauaagagg

SEQ ID NO: 62807 - RNA, 22 nt, Human
caaauguaauugcgguuuuugc

SEQ ID NO: 62808 - RNA, 22 nt, Human
caaauguaucagcccagggauu

SEQ ID NO: 62809 - RNA, 22 nt, Human
caaaugugacuuuugggcuucu

SEQ ID NO: 62810 - RNA, 22 nt, Human
caaauguuaagacaggaucaag

SEQ ID NO: 62811 - RNA, 22 nt, Human
caaauguuagugcccaucccuc

SEQ ID NO: 62812 - RNA, 22 nt, Human
caaauguuucuuaucuauuguu

SEQ ID NO: 62813 - RNA, 22 nt, Human
caaauucacaugauugcuucug

SEQ ID NO: 62814 - RNA, 18 nt, Human
caaauucucauugauuuc

SEQ ID NO: 62815 - RNA, 22 nt, Human
caaauucucuuacuguuugaca

SEQ ID NO: 62816 - RNA, 22 nt, Human
caaauuguguuugcuuuucucu

SEQ ID NO: 62817 - RNA, 22 nt, Human
caaauuuaagugaggucuuugu

SEQ ID NO: 62818 - RNA, 22 nt, Human
caaauuuagguaacagucugua

SEQ ID NO: 62819 - RNA, 22 nt, Human
caacaauuucccaguuucccau

SEQ ID NO: 62820 - RNA, 22 nt, Human
caacacagccauuccccuagaa

SEQ ID NO: 62821 - RNA, 22 nt, Human
caacacagggguuaugccaugg

SEQ ID NO: 62822 - RNA, 22 nt, Human
caacacugacaauggacugauu

SEQ ID NO: 62823 - RNA, 22 nt, Human
caacacuucuuauacuuacuga

SEQ ID NO: 62824 - RNA, 22 nt, Human
caacagagggaauggaucucau

SEQ ID NO: 62825 - RNA, 22 nt, Human
caacagcugaucuuugaugaag

SEQ ID NO: 62826 - RNA, 22 nt, Human
caacaguauugugggccaggua

SEQ ID NO: 62827 - RNA, 22 nt, Human
caacagucugguuuauauaaua

SEQ ID NO: 62828 - RNA, 19 nt, Human
caacaguugcaacacuguc

SEQ ID NO: 62829 - RNA, 22 nt, Human
caacauauugugggaugagaga

SEQ ID NO: 62830 - RNA, 22 nt, Human
caacaucaguccucaugagaca

SEQ ID NO: 62831 - RNA, 22 nt, Human
caacaugccagacauuaguuug

SEQ ID NO: 62832 - RNA, 22 nt, Human
caaccucuaucggucaggaagc

SEQ ID NO: 62833 - RNA, 22 nt, Human
caaccucuggaaaguauggaca

SEQ ID NO: 62834 - RNA, 22 nt, Human
caaccugacaagacuaugagua

SEQ ID NO: 62835 - RNA, 22 nt, Human
caacuauagggagagugguuaa

SEQ ID NO: 62836 - RNA, 22 nt, Human
caacuauuaccauguuauuguc

SEQ ID NO: 62837 - RNA, 22 nt, Human
caacuccuggcuguuaggcaca

SEQ ID NO: 62838 - RNA, 22 nt, Human
caacugaggucucagccaauua

SEQ ID NO: 62839 - RNA, 22 nt, Human
caacugccauacagcuccaugg

SEQ ID NO: 62840 - RNA, 19 nt, Human
caacugcccccucaaacau

SEQ ID NO: 62841 - RNA, 22 nt, Human
caacugguaaucuccacgguca

SEQ ID NO: 62842 - RNA, 22 nt, Human
caacuguuauaaaucaacagag

SEQ ID NO: 62843 - RNA, 22 nt, Human
caacuuuagcaauguuaguaua

SEQ ID NO: 62844 - RNA, 22 nt, Human
caacuuuaugauugguuuguca

SEQ ID NO: 62845 - RNA, 22 nt, Human
caacuuugugugaccuagauag

SEQ ID NO: 62846 - RNA, 22 nt, Human
caacuuuucugugaauuuaagu

SEQ ID NO: 62847 - RNA, 22 nt, Human
caagaaacaccaaugacugcug

SEQ ID NO: 62848 - RNA, 22 nt, Human
caagaaauguuuacugagcauc

SEQ ID NO: 62849 - RNA, 22 nt, Human
caagaagaggugauugguaagu

SEQ ID NO: 62850 - RNA, 22 nt, Human
caagaagcaaggucagggccca

SEQ ID NO: 62851 - RNA, 22 nt, Human
caagaagcuuucccugcuugca

SEQ ID NO: 62852 - RNA, 22 nt, Human
caagaagugucagcuuuuuaaa

SEQ ID NO: 62853 - RNA, 22 nt, Human
caagaauccuguucuugaagau

SEQ ID NO: 62854 - RNA, 22 nt, Human
caagaauuaagaauuuugaugu

SEQ ID NO: 62855 - RNA, 21 nt, Human
caagacauaugaguacucugg

SEQ ID NO: 62856 - RNA, 22 nt, Human
caagacaugcaauugccacuuu

SEQ ID NO: 62857 - RNA, 22 nt, Human
caagacuucaccgcucugugcu

SEQ ID NO: 62858 - RNA, 22 nt, Human
caagacuuuggaggaauuugga

SEQ ID NO: 62859 - RNA, 17 nt, Human
caagagagaugacugga

SEQ ID NO: 62860 - RNA, 22 nt, Human
caagagagaugcagcucacuca

SEQ ID NO: 62861 - RNA, 22 nt, Human
caagagccuuugggcagaagga

SEQ ID NO: 62862 - RNA, 22 nt, Human
caagagcucccagaccugggca

SEQ ID NO: 62863 - RNA, 22 nt, Human
caagagcugaggcuggagaggu

SEQ ID NO: 62864 - RNA, 18 nt, Human
caagagcugcuccuggcc

SEQ ID NO: 62865 - RNA, 22 nt, Human
caagagcuuuagaaaugcucau

SEQ ID NO: 62866 - RNA, 22 nt, Human
caagauaaagccaccagaagcu

SEQ ID NO: 62867 - RNA, 22 nt, Human
caagauauauguaugauuccau

SEQ ID NO: 62868 - RNA, 22 nt, Human
caagauauguccuguuacuaag

SEQ ID NO: 62869 - RNA, 22 nt, Human
caagaugaaauugugauauuuu

SEQ ID NO: 62870 - RNA, 22 nt, Human
caagaugaucccugaaggcagc

SEQ ID NO: 62871 - RNA, 22 nt, Human
caagauggaguccgggaaugug

SEQ ID NO: 62872 - RNA, 22 nt, Human
caagauucagagucuucuaacc

SEQ ID NO: 62873 - RNA, 22 nt, Human
caagauucuaguugagguucaa

SEQ ID NO: 62874 - RNA, 22 nt, Human
caagauuuagccugcugccugu

SEQ ID NO: 62875 - RNA, 22 nt, Human
caagauuuauauuuucacacaa

SEQ ID NO: 62876 - RNA, 22 nt, Human
caagauuuggcauucugaggag

SEQ ID NO: 62877 - RNA, 22 nt, Human
cccagagucucugcucuugccu

SEQ ID NO: 62878 - RNA, 22 nt, Human
cccagcacucagcaggcucaua

SEQ ID NO: 62879 - RNA, 22 nt, Human
cccagcagaaucugaugagggc

SEQ ID NO: 62880 - RNA, 22 nt, Human
cccagcagccagaaugaggagc

SEQ ID NO: 62881 - RNA, 22 nt, Human
cccagcagccuggauguucuuu

SEQ ID NO: 62882 - RNA, 22 nt, Human
cccagcaguaaccaguggaaau

SEQ ID NO: 62883 - RNA, 22 nt, Human
cccagcagugacccagugauac

SEQ ID NO: 62884 - RNA, 22 nt, Human
cccagcagugguucucaaacuu

SEQ ID NO: 62885 - RNA, 22 nt, Human
cccagcaguuguuggugcacau

SEQ ID NO: 62886 - RNA, 22 nt, Human
cccagccaagugaucugaccgc

SEQ ID NO: 62887 - RNA, 19 nt, Human
cccagccaggucuugcauc

SEQ ID NO: 62888 - RNA, 22 nt, Human
cccagccugaucucggccagcu

SEQ ID NO: 62889 - RNA, 23 nt, Human
cccagcgcugagcccugcaggca

SEQ ID NO: 62890 - RNA, 22 nt, Human
cccagcuaccucugcuaggaga

SEQ ID NO: 62891 - RNA, 22 nt, Human
cccagcuccaagggacagcgaa

SEQ ID NO: 62892 - RNA, 22 nt, Human
cccagcucccaaguugcuaugg

SEQ ID NO: 62893 - RNA, 22 nt, Human
cccagcucgccgccgaugugcg

SEQ ID NO: 62894 - RNA, 22 nt, Human
cccagcucuaggagugguggca

SEQ ID NO: 62895 - RNA, 23 nt, Human
cccagcugagacuuccugaacuc

SEQ ID NO: 62896 - RNA, 22 nt, Human
cccagcuguaacgggucugcac

SEQ ID NO: 62897 - RNA, 22 nt, Human
cccagcuugcaaauggguugcu

SEQ ID NO: 62898 - RNA, 22 nt, Human
cccaggaaagaaaguauauggu

SEQ ID NO: 62899 - RNA, 22 nt, Human
cccaggaaagugaaucuaauug

SEQ ID NO: 62900 - RNA, 22 nt, Human
cccaggaaaucaggcuuucuag

SEQ ID NO: 62901 - RNA, 22 nt, Human
cccaggaaaugaacuucugauu

SEQ ID NO: 62902 - RNA, 23 nt, Human
cccaggaagccaaagaaauauag

SEQ ID NO: 62903 - RNA, 22 nt, Human
cccaggaagcccagaauucugg

SEQ ID NO: 62904 - RNA, 19 nt, Human
cccaggaagcggagguugc

SEQ ID NO: 62905 - RNA, 22 nt, Human
cccaggaaugagcaggcagggg

SEQ ID NO: 62906 - RNA, 22 nt, Human
cccaggaaugggaaggaggaau

SEQ ID NO: 62907 - RNA, 22 nt, Human
cccaggaauucagggcucaagg

SEQ ID NO: 62908 - RNA, 22 nt, Human
cccaggacccuucaauggcucc

SEQ ID NO: 62909 - RNA, 22 nt, Human
cccaggacuaaugagcucuacg

SEQ ID NO: 62910 - RNA, 22 nt, Human
cccaggacucugacacccccaa

SEQ ID NO: 62911 - RNA, 22 nt, Human
cccaggacucuucacugcagcc

SEQ ID NO: 62912 - RNA, 22 nt, Human
cccaggagacauauagaaggac

SEQ ID NO: 62913 - RNA, 22 nt, Human
cccaggaggacauuccauaccc

SEQ ID NO: 62914 - RNA, 21 nt, Human
cccaggaggagcuccggcucc

SEQ ID NO: 62915 - RNA, 22 nt, Human
cccaggaggcagaaguugcagu

SEQ ID NO: 62916 - RNA, 22 nt, Human
cccaggaggccaagguugcagu

SEQ ID NO: 62917 - RNA, 22 nt, Human
cccaggaggcggagguuguggu

SEQ ID NO: 62918 - RNA, 21 nt, Human
cccaggaggcugagaagagca

SEQ ID NO: 62919 - RNA, 22 nt, Human
cccaggagguggagguugcagu

SEQ ID NO: 62920 - RNA, 22 nt, Human
cccaggagguggagguugcggu

SEQ ID NO: 62921 - RNA, 22 nt, Human
cccaggaggugugcccaacucg

SEQ ID NO: 62922 - RNA, 20 nt, Human
cccaggagugagcagcuuua

SEQ ID NO: 62923 - RNA, 22 nt, Human
cccaggaguuggaggcuacggu

SEQ ID NO: 62924 - RNA, 22 nt, Human
cccaggaugaucgagaguggga

SEQ ID NO: 62925 - RNA, 22 nt, Human
cccaggauggggcugcaguuau

SEQ ID NO: 62926 - RNA, 22 nt, Human
cccaggcacucuuggucauuuu

SEQ ID NO: 62927 - RNA, 20 nt, Human
cccaggcagagcuagcggca

SEQ ID NO: 62928 - RNA, 22 nt, Human
cccaggcagccugcagggaagg

SEQ ID NO: 62929 - RNA, 22 nt, Human
cccaggcagcggggucuccuug

SEQ ID NO: 62930 - RNA, 22 nt, Human
cccaggcauuuucaacuuuagu

SEQ ID NO: 62931 - RNA, 22 nt, Human
cccaggcucagacuggcuuguu

SEQ ID NO: 62932 - RNA, 22 nt, Human
cccaggcuccugcuguguugac

SEQ ID NO: 62933 - RNA, 22 nt, Human
cccaggcuggagggcaguguca

SEQ ID NO: 62934 - RNA, 22 nt, Human
cccaggcuggauuucgguggca

SEQ ID NO: 62935 - RNA, 22 nt, Human
cccaggcuggccuccgcagugc

SEQ ID NO: 62936 - RNA, 22 nt, Human
cccaggcugggaacgauucuag

SEQ ID NO: 62937 - RNA, 22 nt, Human
cccaggcuggggcuccuccagc

SEQ ID NO: 62938 - RNA, 18 nt, Human
cccaggcuuugugggucu

SEQ ID NO: 62939 - RNA, 22 nt, Human
cccagggaaggcagauggagga

SEQ ID NO: 62940 - RNA, 22 nt, Human
cccagggagcuuggagaacggg

SEQ ID NO: 62941 - RNA, 22 nt, Human
cccagggauguggcagauguua

SEQ ID NO: 62942 - RNA, 22 nt, Human
cccagggauuauaaaggugaaa

SEQ ID NO: 62943 - RNA, 22 nt, Human
cccagggcccuggacagcuaca

SEQ ID NO: 62944 - RNA, 22 nt, Human
cccagggcuguagaauguccaa

SEQ ID NO: 62945 - RNA, 19 nt, Human
cccaggggacccagcccua

SEQ ID NO: 62946 - RNA, 22 nt, Human
cccagggguauccauggagaag

SEQ ID NO: 62947 - RNA, 22 nt, Human
cccagggguucugagcagcagc

SEQ ID NO: 62948 - RNA, 22 nt, Human
cccaggguagcugagcuggcag

SEQ ID NO: 62949 - RNA, 22 nt, Human
cccagggugcggcccuggcugg

SEQ ID NO: 62950 - RNA, 22 nt, Human
cccagggugcuaauuaaauaug

SEQ ID NO: 62951 - RNA, 20 nt, Human
cacugcaaguauuuaaccca

SEQ ID NO: 62952 - RNA, 22 nt, Human
cacugcacaauguagcaaagaa

SEQ ID NO: 62953 - RNA, 22 nt, Human
cacugcagcaccaugcagggcu

SEQ ID NO: 62954 - RNA, 22 nt, Human
cacugccauguugauagaugug

SEQ ID NO: 62955 - RNA, 22 nt, Human
cacugcccacuccuucguccaa

SEQ ID NO: 62956 - RNA, 22 nt, Human
cacugcccucacugugguucuc

SEQ ID NO: 62957 - RNA, 20 nt, Human
cacugcccuccagccugagc

SEQ ID NO: 62958 - RNA, 22 nt, Human
cacugcccuuacaugcccugca

SEQ ID NO: 62959 - RNA, 22 nt, Human
cacugccugcuggcugucacuu

SEQ ID NO: 62960 - RNA, 22 nt, Human
cacugccugugagcugugugcc

SEQ ID NO: 62961 - RNA, 23 nt, Human
cacugccuucaguugcuucaccu

SEQ ID NO: 62962 - RNA, 22 nt, Human
cacugcuauuauuagacaaugu

SEQ ID NO: 62963 - RNA, 22 nt, Human
cacugcucgcugcagcauggcc

SEQ ID NO: 62964 - RNA, 22 nt, Human
cacugcuugguugcaacauugc

SEQ ID NO: 62965 - RNA, 22 nt, Human
cacugcuuuuuuggcuauguac

SEQ ID NO: 62966 - RNA, 22 nt, Human
cacuggaaccauccacauagug

SEQ ID NO: 62967 - RNA, 22 nt, Human
cacuggaagagcaucugagcca

SEQ ID NO: 62968 - RNA, 22 nt, Human
cacuggaccaaggaaacucuuc

SEQ ID NO: 62969 - RNA, 18 nt, Human
cacuggaccucaugagag

SEQ ID NO: 62970 - RNA, 22 nt, Human
cacuggauaaaaauuuggaagu

SEQ ID NO: 62971 - RNA, 22 nt, Human
cacuggcccauaaaggccuggg

SEQ ID NO: 62972 - RNA, 22 nt, Human
cacuggcugggccagcacuccu

SEQ ID NO: 62973 - RNA, 22 nt, Human
cacugggaaucugggaaagaga

SEQ ID NO: 62974 - RNA, 22 nt, Human
cacugggaguacaaagaauggg

SEQ ID NO: 62975 - RNA, 23 nt, Human
cacugggcccaggguguggaggc

SEQ ID NO: 62976 - RNA, 22 nt, Human
cacugggcguguccugggugag

SEQ ID NO: 62977 - RNA, 22 nt, Human
cacuggguaaauuugaggcuga

SEQ ID NO: 62978 - RNA, 22 nt, Human
cacugggucaggauagagccca

SEQ ID NO: 62979 - RNA, 22 nt, Human
cacugguagagagaagacaagg

SEQ ID NO: 62980 - RNA, 22 nt, Human
cacugguauuugaaaauagaug

SEQ ID NO: 62981 - RNA, 22 nt, Human
cacuggucagucggucagucuc

SEQ ID NO: 62982 - RNA, 22 nt, Human
cacuggugaguccagaagucau

SEQ ID NO: 62983 - RNA, 22 nt, Human
cacugguugccucuuucuguuc

SEQ ID NO: 62984 - RNA, 22 nt, Human
cacugguuuugcugauaaggca

SEQ ID NO: 62985 - RNA, 22 nt, Human
cacuguacagcauuaacaaggc

SEQ ID NO: 62986 - RNA, 22 nt, Human
cagaaguggccucagagggagu

SEQ ID NO: 62987 - RNA, 22 nt, Human
cagaaguuugaccuuggugggu

SEQ ID NO: 62988 - RNA, 22 nt, Human
cagaaguuugcaauuguuuauu

SEQ ID NO: 62989 - RNA, 22 nt, Human
cagaaucagugacacauguaua

SEQ ID NO: 62990 - RNA, 22 nt, Human
cagaauccacaacagaaguuga

SEQ ID NO: 62991 - RNA, 21 nt, Human
cagaauccagucucuuauuac

SEQ ID NO: 62992 - RNA, 22 nt, Human
cagaaucucgacuucuggcccc

SEQ ID NO: 62993 - RNA, 22 nt, Human
cagaaugagauaacccagauug

SEQ ID NO: 62994 - RNA, 22 nt, Human
cagaaugcaaauuuuauaauau

SEQ ID NO: 62995 - RNA, 22 nt, Human
cagaaugggaaggacugcaguu

SEQ ID NO: 62996 - RNA, 22 nt, Human
cagaauguuaccaguuagucug

SEQ ID NO: 62997 - RNA, 22 nt, Human
cagaauugagagaggcuguucu

SEQ ID NO: 62998 - RNA, 22 nt, Human
cagaauuuagaaaacaacauaa

SEQ ID NO: 62999 - RNA, 22 nt, Human
cagaauuuagcacaauguaugg

SEQ ID NO: 63000 - RNA, 22 nt, Human
cagaauuuuucgaauguacugu

SEQ ID NO: 63001 - RNA, 22 nt, Human
cagacaaagcggaaacuguuua

SEQ ID NO: 63002 - RNA, 22 nt, Human
cagacaaccaggucuuucaguu

SEQ ID NO: 63003 - RNA, 22 nt, Human
cagacacuauuguguauaaauc

SEQ ID NO: 63004 - RNA, 16 nt, Human
cagacagagaacaggg

SEQ ID NO: 63005 - RNA, 22 nt, Human
cagacagagcucacaagucuuu

SEQ ID NO: 63006 - RNA, 17 nt, Human
cagacagauauccuggg

SEQ ID NO: 63007 - RNA, 22 nt, Human
cagacagcaaaucugcuugcau

SEQ ID NO: 63008 - RNA, 22 nt, Human
cagacaggaaguucagaagaaa

SEQ ID NO: 63009 - RNA, 22 nt, Human
cagacaggaauucuggcguggu

SEQ ID NO: 63010 - RNA, 22 nt, Human
cagacaggcaggugcugcuuug

SEQ ID NO: 63011 - RNA, 22 nt, Human
cagacagggaccucgcuccaga

SEQ ID NO: 63012 - RNA, 22 nt, Human
cagacaggguggguuucugggc

SEQ ID NO: 63013 - RNA, 22 nt, Human
cagacagguagggacagaacau

SEQ ID NO: 63014 - RNA, 22 nt, Human
cagacagguugcaaaacuucaa

SEQ ID NO: 63015 - RNA, 22 nt, Human
cagacaguggacuugauaaagg

SEQ ID NO: 63016 - RNA, 22 nt, Human
cagacauauguuuuaacagauu

SEQ ID NO: 63017 - RNA, 22 nt, Human
cagacaugagauacagcugcua

SEQ ID NO: 63018 - RNA, 22 nt, Human
cagaccaguagggcucauccca

SEQ ID NO: 63019 - RNA, 22 nt, Human
cagaccaucuugaagcaaacug

SEQ ID NO: 63020 - RNA, 22 nt, Human
cagaccccgaguuugcagaguu

SEQ ID NO: 63021 - RNA, 22 nt, Human
cagacccucuucuauugguggg

SEQ ID NO: 63022 - RNA, 23 nt, Human
cagaccuggcagucauccucaac

SEQ ID NO: 63023 - RNA, 19 nt, Human
cagaccuguccagccugug

SEQ ID NO: 63024 - RNA, 22 nt, Human
cagacggguggucugcgaggcc

SEQ ID NO: 63025 - RNA, 22 nt, Human
cagacucuugagcugauuguau

SEQ ID NO: 63026 - RNA, 22 nt, Human
cagacugaguggauuaaacaau

SEQ ID NO: 63027 - RNA, 22 nt, Human
cagacuggcugaaggccgagug

SEQ ID NO: 63028 - RNA, 22 nt, Human
cagacugugagcuccuugaggg

SEQ ID NO: 63029 - RNA, 22 nt, Human
cagacuugaaagagacucaguu

SEQ ID NO: 63030 - RNA, 22 nt, Human
cagacuuucugacucccuugcc

SEQ ID NO: 63031 - RNA, 22 nt, Human
cagacuuucuggaagcuaaaaa

SEQ ID NO: 63032 - RNA, 22 nt, Human
cagacuuuugggaggucugugg

SEQ ID NO: 63033 - RNA, 22 nt, Human
cagagaaaaaauccugcucuca

SEQ ID NO: 63034 - RNA, 22 nt, Human
cagagaaagacuugcccuuagu

SEQ ID NO: 63035 - RNA, 22 nt, Human
cagagaaagggugaauuccuuc

SEQ ID NO: 63036 - RNA, 22 nt, Human
cagagacaccccagaaaauaag

SEQ ID NO: 63037 - RNA, 22 nt, Human
cagagacaggaucucgaagacu

SEQ ID NO: 63038 - RNA, 22 nt, Human
cagagacaguuucacagggucu

SEQ ID NO: 63039 - RNA, 22 nt, Human
cagagacauccauguuaguugg

SEQ ID NO: 63040 - RNA, 22 nt, Human
cagagaccccgcugcccuucug

SEQ ID NO: 63041 - RNA, 22 nt, Human
cagagacccuucucaguggcca

SEQ ID NO: 63042 - RNA, 20 nt, Human
cagagaccugucuucacaga

SEQ ID NO: 63043 - RNA, 19 nt, Human
cagagagaccaaggcgcca

SEQ ID NO: 63044 - RNA, 22 nt, Human
cagagagagcaggaaaccuccg

SEQ ID NO: 63045 - RNA, 22 nt, Human
cagagagagucaaaucuuugcu

SEQ ID NO: 63046 - RNA, 22 nt, Human
cagagagagucugucccugaag

SEQ ID NO: 63047 - RNA, 16 nt, Human
cagagaggacagaggc

SEQ ID NO: 63048 - RNA, 22 nt, Human
cagagauaccauugcuaaaauu

SEQ ID NO: 63049 - RNA, 22 nt, Human
cagagcaccugcucauugccag

SEQ ID NO: 63050 - RNA, 22 nt, Human
cagagcagaagcgguccucaca

SEQ ID NO: 63051 - RNA, 22 nt, Human
cagagcaguagaaaacagccuu

SEQ ID NO: 63052 - RNA, 22 nt, Human
cagagcagugaggaguugugua

SEQ ID NO: 63053 - RNA, 20 nt, Human
cagagcagugcccaggcggc

SEQ ID NO: 63054 - RNA, 22 nt, Human
cagagcaugucaacuagcuuua

SEQ ID NO: 63055 - RNA, 22 nt, Human
cagagcauugagggucugccaa

SEQ ID NO: 63056 - RNA, 22 nt, Human
cagagccacagccuccagauuu

SEQ ID NO: 63057 - RNA, 22 nt, Human
cagagccacugucugccaggca

SEQ ID NO: 63058 - RNA, 22 nt, Human
cagagccagggcuaggaacugg

SEQ ID NO: 63059 - RNA, 22 nt, Human
cagagccaggucuaggagucuc

SEQ ID NO: 63060 - RNA, 22 nt, Human
cagagccaugguaugggcuugu

SEQ ID NO: 63061 - RNA, 22 nt, Human
cagagcccauggcacaugugga

SEQ ID NO: 63062 - RNA, 22 nt, Human
cagagccucaucauccacucca

SEQ ID NO: 63063 - RNA, 22 nt, Human
cagagccugcugccuucugaag

SEQ ID NO: 63064 - RNA, 22 nt, Human
cagagccuuuguguccacauuu

SEQ ID NO: 63065 - RNA, 22 nt, Human
cagagcucagagcugccaggca

SEQ ID NO: 63066 - RNA, 18 nt, Human
cagagcuccuggaugcag

SEQ ID NO: 63067 - RNA, 22 nt, Human
cagagcucugacagcuacagcc

SEQ ID NO: 63068 - RNA, 22 nt, Human
cagagacacuuaacaggaaugg

SEQ ID NO: 63069 - RNA, 22 nt, Human
cagagacaggaaucagcugcag

SEQ ID NO: 63070 - RNA, 22 nt, Human
cagagacaggagugcucccagu

SEQ ID NO: 63071 - RNA, 22 nt, Human
cagagacagggcagggagugug

SEQ ID NO: 63072 - RNA, 20 nt, Human
cagagaccaggccagguguc

SEQ ID NO: 63073 - RNA, 22 nt, Human
cagagacccuaggcaggugaca

SEQ ID NO: 63074 - RNA, 22 nt, Human
cagagagcuuagugugcugcau

SEQ ID NO: 63075 - RNA, 22 nt, Human
cagagagggagcaguagucucu

SEQ ID NO: 63076 - RNA, 22 nt, Human
cagagauggggccagcugcucc

SEQ ID NO: 63077 - RNA, 22 nt, Human
cagagaugggucgcagagaugg

SEQ ID NO: 63078 - RNA, 22 nt, Human
cagagcagcagagcuuccaugg

SEQ ID NO: 63079 - RNA, 22 nt, Human
cagagcaggcccacugcccucc

SEQ ID NO: 63080 - RNA, 22 nt, Human
cagagcagggugcaccuugggc

SEQ ID NO: 63081 - RNA, 22 nt, Human
cagagcagucuggagauccagc

SEQ ID NO: 63082 - RNA, 19 nt, Human
cagagcagugguuccugaa

SEQ ID NO: 63083 - RNA, 22 nt, Human
cagagcaugaauaaaaguuaca

SEQ ID NO: 63084 - RNA, 22 nt, Human
cagagccaaaaccguaacagcc

SEQ ID NO: 63085 - RNA, 20 nt, Human
cagagccaagagcagcaucu

SEQ ID NO: 63086 - RNA, 22 nt, Human
cagagccacugcauuuuacagc

SEQ ID NO: 63087 - RNA, 22 nt, Human
cagagccagagaccugcugugc

SEQ ID NO: 63088 - RNA, 19 nt, Human
cagagccaggccuuuggcc

SEQ ID NO: 63089 - RNA, 22 nt, Human
cagagccaggguugcaccccug

SEQ ID NO: 63090 - RNA, 22 nt, Human
cagagccaggucuugaacucag

SEQ ID NO: 63091 - RNA, 22 nt, Human
cagagccaggugguguuggggc

SEQ ID NO: 63092 - RNA, 22 nt, Human
cagagccaucccagccuguggu

SEQ ID NO: 63093 - RNA, 22 nt, Human
cagagccauuauggagacuugc

SEQ ID NO: 63094 - RNA, 20 nt, Human
cagagcccacuuucuuauca

SEQ ID NO: 63095 - RNA, 22 nt, Human
cagcuguuccugguugguggga

SEQ ID NO: 63096 - RNA, 22 nt, Human
cagcuguuucaguagcguuacu

SEQ ID NO: 63097 - RNA, 22 nt, Human
cagcuuagauggauacaaaggu

SEQ ID NO: 63098 - RNA, 22 nt, Human
cagcuucaacugcacagucaac

SEQ ID NO: 63099 - RNA, 22 nt, Human
cagcuucagacccugggcugca

SEQ ID NO: 63100 - RNA, 22 nt, Human
cagcuucaugacaaacaguuuu

SEQ ID NO: 63101 - RNA, 22 nt, Human
cagcuucccagcucacucauaa

SEQ ID NO: 63102 - RNA, 22 nt, Human
cagcuucuauuuaucuuugugu

SEQ ID NO: 63103 - RNA, 22 nt, Human
cagcuucuggcguggagccuga

SEQ ID NO: 63104 - RNA, 22 nt, Human
cagcuucuguuuauugugugcc

SEQ ID NO: 63105 - RNA, 22 nt, Human
cagcuucuuagucuuuccuugu

SEQ ID NO: 63106 - RNA, 22 nt, Human
cggggccuagcugcacacccuc

SEQ ID NO: 63107 - RNA, 22 nt, Human
cggggcuuggaccagccacccc

SEQ ID NO: 63108 - RNA, 22 nt, Human
cgggggcacccacaaaugagga

SEQ ID NO: 63109 - RNA, 21 nt, Human
cgggugaguugagcaggacac

SEQ ID NO: 63110 - RNA, 22 nt, Human
cgggugguuuucaucaagaugg

SEQ ID NO: 63111 - RNA, 22 nt, Human
cgguccaggauggcuggcaagc

SEQ ID NO: 63112 - RNA, 22 nt, Human
cggucguaguucuucagcaggu

SEQ ID NO: 63113 - RNA, 19 nt, Human
cgguggcuugcagggaggu

SEQ ID NO: 63114 - RNA, 22 nt, Human
cguaggauacucagugcucauu

SEQ ID NO: 63115 - RNA, 22 nt, Human
cguagguggcucagcaccuggg

SEQ ID NO: 63116 - RNA, 22 nt, Human
cguauuucaucuccuuucugcu

SEQ ID NO: 63117 - RNA, 22 nt, Human
cgucaggguugagcagguagau

SEQ ID NO: 63118 - RNA, 22 nt, Human
cgucauuuguaaaugaucaaga

SEQ ID NO: 63119 - RNA, 22 nt, Human
cguccagggcgggcuccccuca

SEQ ID NO: 63120 - RNA, 22 nt, Human
cguccauauucaugagcugagu

SEQ ID NO: 63121 - RNA, 22 nt, Human
cgucccagcagauaaaugagga

SEQ ID NO: 63122 - RNA, 20 nt, Human
cguccccuugagcagguccc

SEQ ID NO: 63123 - RNA, 22 nt, Human
cguccucagaggccauccgaaa

SEQ ID NO: 63124 - RNA, 22 nt, Human
cguccuuacagagggucacagc

SEQ ID NO: 63125 - RNA, 22 nt, Human
cguccuuugaauugaggucuuu

SEQ ID NO: 63126 - RNA, 22 nt, Human
cgucuaggccgugcccugaggu

SEQ ID NO: 63127 - RNA, 22 nt, Human
cgucuucacauccuucccaugg

SEQ ID NO: 63128 - RNA, 22 nt, Human
cgugagcaaaauggacacuccc

SEQ ID NO: 63129 - RNA, 17 nt, Human
cgugagcagcaggugcc

SEQ ID NO: 63130 - RNA, 22 nt, Human
cgugauuggcuucugcauugga

SEQ ID NO: 63131 - RNA, 22 nt, Human
cgugcaaauauaugugugauga

SEQ ID NO: 63132 - RNA, 22 nt, Human
cgugcaugauauaugaguuguu

SEQ ID NO: 63133 - RNA, 22 nt, Human
cgugcccugcgcaagugcugcu

SEQ ID NO: 63134 - RNA, 22 nt, Human
cgugcggccucggggcccggcu

SEQ ID NO: 63135 - RNA, 22 nt, Human
cgugcgguuagacagguaccgg

SEQ ID NO: 63136 - RNA, 23 nt, Human
cgugcuuccaggcccagcugagc

SEQ ID NO: 63137 - RNA, 22 nt, Human
cguggcucugggcuccuuugcc

SEQ ID NO: 63138 - RNA, 22 nt, Human
cguggcuggggcgacuccacgg

SEQ ID NO: 63139 - RNA, 22 nt, Human
cgugggaguggugggugcucag

SEQ ID NO: 63140 - RNA, 22 nt, Human
cgugggcugcgcccaguucuuc

SEQ ID NO: 63141 - RNA, 22 nt, Human
cguggggcggguggacacuugc

SEQ ID NO: 63142 - RNA, 22 nt, Human
cgugggucgggacuccgccucg

SEQ ID NO: 63143 - RNA, 22 nt, Human
cguggucucccacagaaagaag

SEQ ID NO: 63144 - RNA, 22 nt, Human
cguguacacgcacacguguccu

SEQ ID NO: 63145 - RNA, 20 nt, Human
cguguccuuggcgggagagc

SEQ ID NO: 63146 - RNA, 22 nt, Human
cgugugcgcacaccuguuucca

SEQ ID NO: 63147 - RNA, 17 nt, Human
cgugugcuugugugcac

SEQ ID NO: 63148 - RNA, 22 nt, Human
cguguguguaccugcgcauuua

SEQ ID NO: 63149 - RNA, 22 nt, Human
cguucuuuucauauuuacaugg

SEQ ID NO: 63150 - RNA, 22 nt, Human
cguuguuugagauuuucagaau

SEQ ID NO: 63151 - RNA, 22 nt, Human
cguuugaaagccuuuguacacu

SEQ ID NO: 63152 - RNA, 22 nt, Human
cguuuucuucacuuugcaaguu

SEQ ID NO: 63153 - RNA, 22 nt, Human
cuaaaauguuuggggcagaacc

SEQ ID NO: 63154 - RNA, 22 nt, Human
cuaaacacuauguaagcaagaa

SEQ ID NO: 63155 - RNA, 22 nt, Human
cuaaacaucuugcaaugcacag

SEQ ID NO: 63156 - RNA, 22 nt, Human
cuaaacauggcuuagaacacuc

SEQ ID NO: 63157 - RNA, 22 nt, Human
cuaaaccuuugugcuugcaauu

SEQ ID NO: 63158 - RNA, 18 nt, Human
cuaaacugcaccuaauga

SEQ ID NO: 63159 - RNA, 22 nt, Human
cuaaagagaguucaagacuccu

SEQ ID NO: 63160 - RNA, 22 nt, Human
cuaaagauaaggaaaguauccu

SEQ ID NO: 63161 - RNA, 22 nt, Human
cuaaagcucaacaggcacuauu

SEQ ID NO: 63162 - RNA, 22 nt, Human
cuaaauaaucccucuggucuua

SEQ ID NO: 63163 - RNA, 22 nt, Human
cuaaaucaggccuuacagcuuc

SEQ ID NO: 63164 - RNA, 22 nt, Human
cuaaaugcccuacaaugacugg

SEQ ID NO: 63165 - RNA, 22 nt, Human
cuaaaugucucagagggagaca

SEQ ID NO: 63166 - RNA, 22 nt, Human
cuaacauuuauugagcacuuag

SEQ ID NO: 63167 - RNA, 22 nt, Human
cuaaccuguugaaggaauugcu

SEQ ID NO: 63168 - RNA, 22 nt, Human
cuaacgaaauaccucagacuuu

SEQ ID NO: 63169 - RNA, 22 nt, Human
cuaacugucaugcacauguguu

SEQ ID NO: 63170 - RNA, 22 nt, Human
cuaacuuuauuugcuaaguaga

SEQ ID NO: 63171 - RNA, 22 nt, Human
cuaacuuuuacagucauguugc

SEQ ID NO: 63172 - RNA, 22 nt, Human
cuaagaaaauagaagcaugcua

SEQ ID NO: 63173 - RNA, 22 nt, Human
cuaagaagucaggggacagagg

SEQ ID NO: 63174 - RNA, 22 nt, Human
cuaagacucugcaaaucagcuu

SEQ ID NO: 63175 - RNA, 20 nt, Human
cuaagagguccuuccacauc

SEQ ID NO: 63176 - RNA, 22 nt, Human
cuaagcacaaugcuuugaguau

SEQ ID NO: 63177 - RNA, 22 nt, Human
cuaaggaaaaggauauauaugu

SEQ ID NO: 63178 - RNA, 22 nt, Human
cuaaggaagugacagugggauu

SEQ ID NO: 63179 - RNA, 22 nt, Human
cuaaggaauuggagcauguguu

SEQ ID NO: 63180 - RNA, 17 nt, Human
cuaagggcccacucuuc

SEQ ID NO: 63181 - RNA, 22 nt, Human
cuaagguuggcaguggaauugg

SEQ ID NO: 63182 - RNA, 22 nt, Human
cuaagucauggaaagugugugu

SEQ ID NO: 63183 - RNA, 22 nt, Human
cuaauagagcuucggaacucug

SEQ ID NO: 63184 - RNA, 22 nt, Human
cuaaucugugaaauagguauga

SEQ ID NO: 63185 - RNA, 22 nt, Human
cuaauguggacucuaucaaagu

SEQ ID NO: 63186 - RNA, 20 nt, Human
cuaauuacagauuuuggaca

SEQ ID NO: 63187 - RNA, 22 nt, Human
cuaauuguaagcuccuugaggg

SEQ ID NO: 63188 - RNA, 22 nt, Human
cuaauuuaaugaaugagucuua

SEQ ID NO: 63189 - RNA, 22 nt, Human
cuaauuuucccaaggccuucua

SEQ ID NO: 63190 - RNA, 22 nt, Human
cuacaaauauaaaacacagaua

SEQ ID NO: 63191 - RNA, 22 nt, Human
cuacaaauauguuaagguguuu

SEQ ID NO: 63192 - RNA, 22 nt, Human
cuacaacaccaggcacggagug

SEQ ID NO: 63193 - RNA, 22 nt, Human
cuacaccuugaucuaacauuuu

SEQ ID NO: 63194 - RNA, 22 nt, Human
cuacacuugcaugagucuugaa

SEQ ID NO: 63195 - RNA, 20 nt, Human
cuacacuuggcaccuggcau

SEQ ID NO: 63196 - RNA, 22 nt, Human
cuacacuuguucgacugcagga

SEQ ID NO: 63197 - RNA, 22 nt, Human
cuacacuuugguugacuuugug

SEQ ID NO: 63198 - RNA, 22 nt, Human
cuacagaaaccuuuuucauaca

SEQ ID NO: 63199 - RNA, 21 nt, Human
cuacagaagcucuccuaucca

SEQ ID NO: 63200 - RNA, 22 nt, Human
cuacaggaguaaaauaauuuca

SEQ ID NO: 63201 - RNA, 22 nt, Human
cuacaguacuggaugcucagcc

SEQ ID NO: 63202 - RNA, 22 nt, Human
cuacaguagagaggauguagaa

SEQ ID NO: 63203 - RNA, 22 nt, Human
cuacaguagaguaggccucuga

SEQ ID NO: 63204 - RNA, 22 nt, Human
cuauggcuguguucaugcuaca

SEQ ID NO: 63205 - RNA, 22 nt, Human
cuauuacaaucugcuacuauga

SEQ ID NO: 63206 - RNA, 22 nt, Human
cuauuacaauucugcaaggagu

SEQ ID NO: 63207 - RNA, 22 nt, Human
cuauuagacacaauuagugauu

SEQ ID NO: 63208 - RNA, 22 nt, Human
cuauuagguaugugguugcuau

SEQ ID NO: 63209 - RNA, 22 nt, Human
cuauuauuaauguggggcuuug

SEQ ID NO: 63210 - RNA, 22 nt, Human
cuauuauuauguuaacuggacu

SEQ ID NO: 63211 - RNA, 22 nt, Human
cuauucaacuugacuguuucac

SEQ ID NO: 63212 - RNA, 22 nt, Human
cuauucuagauuacaguauaaa

SEQ ID NO: 63213 - RNA, 22 nt, Human
cuauucuagucugucaugucca

SEQ ID NO: 63214 - RNA, 22 nt, Human
cuauugaggacauaaggacucu

SEQ ID NO: 63215 - RNA, 22 nt, Human
cuauugcuuuugugugcuccca

SEQ ID NO: 63216 - RNA, 22 nt, Human
cuauuguaguaagggaaagcca

SEQ ID NO: 63217 - RNA, 22 nt, Human
cuauuucagcagaagccggaga

SEQ ID NO: 63218 - RNA, 22 nt, Human
cuauuucauugugcugagucug

SEQ ID NO: 63219 - RNA, 22 nt, Human
cuauuugaaaccaagaaugccg

SEQ ID NO: 63220 - RNA, 22 nt, Human
cuauuuguaaagugccuggugu

SEQ ID NO: 63221 - RNA, 22 nt, Human
cuauuuguaagagccccacacc

SEQ ID NO: 63222 - RNA, 22 nt, Human
cuauuuuccgcagcaggaagua

SEQ ID NO: 63223 - RNA, 22 nt, Human
caggcggccaugaucuggcagg

SEQ ID NO: 63224 - RNA, 22 nt, Human
caggcgggacgugggaggauca

SEQ ID NO: 63225 - RNA, 22 nt, Human
caggcucaagcccugcuuauau

SEQ ID NO: 63226 - RNA, 22 nt, Human
caggcucacuguaaggucagcu

SEQ ID NO: 63227 - RNA, 22 nt, Human
caggcucacuuucucagucaca

SEQ ID NO: 63228 - RNA, 22 nt, Human
caggcucagccacaggggaagg

SEQ ID NO: 63229 - RNA, 22 nt, Human
caggcucagcucuggccagugc

SEQ ID NO: 63230 - RNA, 22 nt, Human
caggcuccaagcccucugaugu

SEQ ID NO: 63231 - RNA, 22 nt, Human
caggcuccacuguaggcagcuc

SEQ ID NO: 63232 - RNA, 22 nt, Human
caggcucccgaaaucacccaug

SEQ ID NO: 63233 - RNA, 23 nt, Human
caggcucccggaccaggauccgc

SEQ ID NO: 63234 - RNA, 22 nt, Human
caggcucccuaagucagcagcc

SEQ ID NO: 63235 - RNA, 20 nt, Human
caggcuccgcaggacuaggg

SEQ ID NO: 63236 - RNA, 17 nt, Human
caggcuccuuccagauu

SEQ ID NO: 63237 - RNA, 22 nt, Human
caggcuccuucccagggauggu

SEQ ID NO: 63238 - RNA, 22 nt, Human
caggcucggaagugcuggcuuu

SEQ ID NO: 63239 - RNA, 22 nt, Human
caggcucgguccaguggcaccc

SEQ ID NO: 63240 - RNA, 22 nt, Human
caggcugacaacugagcauuuu

SEQ ID NO: 63241 - RNA, 22 nt, Human
caggcugauaggguccaaaguu

SEQ ID NO: 63242 - RNA, 22 nt, Human
caggcugaucagggcugggaug

SEQ ID NO: 63243 - RNA, 22 nt, Human
caggcugcagaggccuuucaug

SEQ ID NO: 63244 - RNA, 22 nt, Human
caggcugcauggagggguacag

SEQ ID NO: 63245 - RNA, 22 nt, Human
caggcugccaaggcuggggagg

SEQ ID NO: 63246 - RNA, 22 nt, Human
caggcugccgugggguccaggc

SEQ ID NO: 63247 - RNA, 22 nt, Human
caggcugccuggaagaggacug

SEQ ID NO: 63248 - RNA, 22 nt, Human
caggcugcugacaggcuuggag

SEQ ID NO: 63249 - RNA, 22 nt, Human
caggcugcugccuagaaugaca

SEQ ID NO: 63250 - RNA, 22 nt, Human
caggcuggagugaguguagugg

SEQ ID NO: 63251 - RNA, 22 nt, Human
caggcuggagugcaguugugca

SEQ ID NO: 63252 - RNA, 22 nt, Human
caggcugggaacgccacccgcu

SEQ ID NO: 63253 - RNA, 22 nt, Human
caggcugggcagccuccccggc

SEQ ID NO: 63254 - RNA, 22 nt, Human
caggcuggucccagagcauugc

SEQ ID NO: 63255 - RNA, 22 nt, Human
caggcuguguuccuggaacccc

SEQ ID NO: 63256 - RNA, 22 nt, Human
caggcuuaggagucagccugcu

SEQ ID NO: 63257 - RNA, 22 nt, Human
caggcuucgcucugugggcagg

SEQ ID NO: 63258 - RNA, 22 nt, Human
caggcuugauuauucagacaau

SEQ ID NO: 63259 - RNA, 22 nt, Human
caggcuuggagggcaguggcau

SEQ ID NO: 63260 - RNA, 22 nt, Human
caggcuugguuggggcgaggga

SEQ ID NO: 63261 - RNA, 22 nt, Human
caggcuuucaggacagcgagcc

SEQ ID NO: 63262 - RNA, 22 nt, Human
cagggaacaagaugagaaugga

SEQ ID NO: 63263 - RNA, 22 nt, Human
cagggaauccauggucauaagg

SEQ ID NO: 63264 - RNA, 22 nt, Human
cagggacagacagauauauuug

SEQ ID NO: 63265 - RNA, 22 nt, Human
cagggacagagacugcaccuug

SEQ ID NO: 63266 - RNA, 22 nt, Human
cagggacagcgggacucugaca

SEQ ID NO: 63267 - RNA, 22 nt, Human
cagggacauugguggccagguu

SEQ ID NO: 63268 - RNA, 22 nt, Human
cagggacauuuccaagagaauu

SEQ ID NO: 63269 - RNA, 22 nt, Human
cagggacugagauccagacugu

SEQ ID NO: 63270 - RNA, 22 nt, Human
cagggagaaaucuccaggaggu

SEQ ID NO: 63271 - RNA, 22 nt, Human
cagggagaggccucuguugccc

SEQ ID NO: 63272 - RNA, 22 nt, Human
cagggagaggcugguggaguaa

SEQ ID NO: 63273 - RNA, 22 nt, Human
cagggagcagcgcuggggccuc

SEQ ID NO: 63274 - RNA, 22 nt, Human
cagggagccccaauuccaugcc

SEQ ID NO: 63275 - RNA, 22 nt, Human
cagggagccugaauguuccagg

SEQ ID NO: 63276 - RNA, 22 nt, Human
cagggagcuggaguuggaguac

SEQ ID NO: 63277 - RNA, 22 nt, Human
cagggagcuggcuggcugugcc

SEQ ID NO: 63278 - RNA, 23 nt, Human
cagggaggagauacuguguaucu

SEQ ID NO: 63279 - RNA, 22 nt, Human
cagggaggcugucuuaugccug

SEQ ID NO: 63280 - RNA, 22 nt, Human
cagggaugaccagagggaugug

SEQ ID NO: 63281 - RNA, 22 nt, Human
cagggcaaguuugagauuauuu

SEQ ID NO: 63282 - RNA, 22 nt, Human
cagggcacaguuauggaggugg

SEQ ID NO: 63283 - RNA, 22 nt, Human
cagggcacggagaagucacccc

SEQ ID NO: 63284 - RNA, 22 nt, Human
cagggcagagccaggauuucaa

SEQ ID NO: 63285 - RNA, 22 nt, Human
cagggcagcuuccuuuguuagg

SEQ ID NO: 63286 - RNA, 22 nt, Human
cagggcagggccacacccccug

SEQ ID NO: 63287 - RNA, 22 nt, Human
cagggcaguaccgcccucuggc

SEQ ID NO: 63288 - RNA, 22 nt, Human
cagggcaguuugugccuaugag

SEQ ID NO: 63289 - RNA, 22 nt, Human
cagggccacccucugcugggug

SEQ ID NO: 63290 - RNA, 22 nt, Human
cagggccaccguguuugcugcu

SEQ ID NO: 63291 - RNA, 22 nt, Human
cagggccagcgucucgggcuau

SEQ ID NO: 63292 - RNA, 23 nt, Human
cagggccaggcagcagcugucac

SEQ ID NO: 63293 - RNA, 22 nt, Human
cagggccauuggaacaaagagg

SEQ ID NO: 63294 - RNA, 22 nt, Human
cagggccauuggcguggcuguc

SEQ ID NO: 63295 - RNA, 22 nt, Human
cagggcccaagacacaaugagg

SEQ ID NO: 63296 - RNA, 22 nt, Human
cagggcccauggcucagguagg

SEQ ID NO: 63297 - RNA, 22 nt, Human
cagggcccugcucaauuucucc

SEQ ID NO: 63298 - RNA, 22 nt, Human
cagggccucgaagccucugggc

SEQ ID NO: 63299 - RNA, 22 nt, Human
cagggccucugugggcucucuc

SEQ ID NO: 63300 - RNA, 22 nt, Human
cagggccugagggcugcucugc

SEQ ID NO: 63301 - RNA, 22 nt, Human
cagggccuguacaagucccacc

SEQ ID NO: 63302 - RNA, 22 nt, Human
cagggccuucguaaguguccgg

SEQ ID NO: 63303 - RNA, 22 nt, Human
cagggcucaggcucugggauuc

SEQ ID NO: 63304 - RNA, 22 nt, Human
cagggcuccaugcagggacucc

SEQ ID NO: 63305 - RNA, 22 nt, Human
cagggcucccaaauaucucuuc

SEQ ID NO: 63306 - RNA, 22 nt, Human
cagggcuccccgcaccgcagcc

SEQ ID NO: 63307 - RNA, 22 nt, Human
cagggcucccucuggcucccag

SEQ ID NO: 63308 - RNA, 22 nt, Human
cagggcucccuugcaaggaggg

SEQ ID NO: 63309 - RNA, 22 nt, Human
cagggcucuucaucacacagua

SEQ ID NO: 63310 - RNA, 22 nt, Human
cagggcucuuccggagcaggga

SEQ ID NO: 63311 - RNA, 22 nt, Human
cagggcugagucauauagccuu

SEQ ID NO: 63312 - RNA, 22 nt, Human
cagggcuggauccuccagacuc

SEQ ID NO: 63313 - RNA, 22 nt, Human
accagagagccuaggcugggca

SEQ ID NO: 63314 - RNA, 22 nt, Human
acagaugaaacccagcuaguug

SEQ ID NO: 63315 - RNA, 22 nt, Human
acagaugaaucugugauugcug

SEQ ID NO: 63316 - RNA, 20 nt, Human
acagaugaggaaaaugaagu

SEQ ID NO: 63317 - RNA, 22 nt, Human
acagaugaggcuggcgagggca

SEQ ID NO: 63318 - RNA, 22 nt, Human
acagaugaguuaaagcagagug

SEQ ID NO: 63319 - RNA, 22 nt, Human
acagaugaguuagaauaggcag

SEQ ID NO: 63320 - RNA, 22 nt, Human
acagauggaauguguuauggga

SEQ ID NO: 63321 - RNA, 19 nt, Human
acagauggaggaaucuggg

SEQ ID NO: 63322 - RNA, 22 nt, Human
acagauggagguuauuaugaac

SEQ ID NO: 63323 - RNA, 22 nt, Human
acagauggcaccuuuuugcugu

SEQ ID NO: 63324 - RNA, 22 nt, Human
acagauggcacuuuuuaggacu

SEQ ID NO: 63325 - RNA, 20 nt, Human
acagauggcaguuauuacau

SEQ ID NO: 63326 - RNA, 22 nt, Human
acagaugguacuaaacccauau

SEQ ID NO: 63327 - RNA, 22 nt, Human
acagaugguuauugucauuucu

SEQ ID NO: 63328 - RNA, 22 nt, Human
acagauguugcuugucauucuc

SEQ ID NO: 63329 - RNA, 22 nt, Human
acagauugaucuugagaauuau

SEQ ID NO: 63330 - RNA, 22 nt, Human
acagauuuaggacuguagcgau

SEQ ID NO: 63331 - RNA, 22 nt, Human
acagcaaaggacgaacacucug

SEQ ID NO: 63332 - RNA, 22 nt, Human
acagcaaaugguuuucugucug

SEQ ID NO: 63333 - RNA, 22 nt, Human
acagcaacuccugcuucugagu

SEQ ID NO: 63334 - RNA, 21 nt, Human
acagcaagccuucacaugagu

SEQ ID NO: 63335 - RNA, 22 nt, Human
acagcaauaggaaauacuugca

SEQ ID NO: 63336 - RNA, 19 nt, Human
acagcacagaaauauuuca

SEQ ID NO: 63337 - RNA, 22 nt, Human
acagcacuggucccgcaagccu

SEQ ID NO: 63338 - RNA, 22 nt, Human
acagcacuuuacuucucaguga

SEQ ID NO: 63339 - RNA, 22 nt, Human
acagcagacacaggcacgcugu

SEQ ID NO: 63340 - RNA, 22 nt, Human
acagcagagcaccagggccacu

SEQ ID NO: 63341 - RNA, 22 nt, Human
acagcagagccaguggcucuag

SEQ ID NO: 63342 - RNA, 22 nt, Human
acagcagaguugaguaguugca

SEQ ID NO: 63343 - RNA, 20 nt, Human
acagcagauaccacaacuau

SEQ ID NO: 63344 - RNA, 22 nt, Human
acagcagaucuguggagcuuau

SEQ ID NO: 63345 - RNA, 22 nt, Human
acagcagauuucccugggcucc

SEQ ID NO: 63346 - RNA, 22 nt, Human
acagcagcacuauugacauuuu

SEQ ID NO: 63347 - RNA, 22 nt, Human
acagcagcauaaacugacuaag

SEQ ID NO: 63348 - RNA, 22 nt, Human
acagcagcuaaaggugucuccu

SEQ ID NO: 63349 - RNA, 22 nt, Human
acagcagcuggguucccaccau

SEQ ID NO: 63350 - RNA, 22 nt, Human
acagcaggaagcuggagggaaa

SEQ ID NO: 63351 - RNA, 22 nt, Human
acagcaggaauuaacauauaag

SEQ ID NO: 63352 - RNA, 22 nt, Human
acagcagggucacauucccucu

SEQ ID NO: 63353 - RNA, 22 nt, Human
acagcagguuacaguggcacag

SEQ ID NO: 63354 - RNA, 22 nt, Human
acagcagguuuuaacuuugaag

SEQ ID NO: 63355 - RNA, 22 nt, Human
acagcagucagugaauauuuaa

SEQ ID NO: 63356 - RNA, 22 nt, Human
acagcagucuuaacacauugca

SEQ ID NO: 63357 - RNA, 22 nt, Human
acagcagugucugguacugagu

SEQ ID NO: 63358 - RNA, 22 nt, Human
acagcaguucaggccgcagagg

SEQ ID NO: 63359 - RNA, 21 nt, Human
acagcauguuuguguguuugc

SEQ ID NO: 63360 - RNA, 22 nt, Human
acagccaacgucuuucuuacuu

SEQ ID NO: 63361 - RNA, 20 nt, Human
acagccagaggaggcagaca

SEQ ID NO: 63362 - RNA, 22 nt, Human
acagccagcagagcuguuuccu

SEQ ID NO: 63363 - RNA, 22 nt, Human
acagccaggaauucuggagaag

SEQ ID NO: 63364 - RNA, 22 nt, Human
acagccaggagccaugggcagg

SEQ ID NO: 63365 - RNA, 22 nt, Human
acagccagggacauacaauggu

SEQ ID NO: 63366 - RNA, 23 nt, Human
acagccaguucaccucuccuugg

SEQ ID NO: 63367 - RNA, 23 nt, Human
acagccccaugcagguguguuug

SEQ ID NO: 63368 - RNA, 22 nt, Human
acagcccguucucuggcacaca

SEQ ID NO: 63369 - RNA, 22 nt, Human
acagccugagaguggagcuggc

SEQ ID NO: 63370 - RNA, 22 nt, Human
acagccuggccugaguuaaggc

SEQ ID NO: 63371 - RNA, 22 nt, Human
acagccuuauucuuuaguuuac

SEQ ID NO: 63372 - RNA, 22 nt, Human
acagccuugcuuauuugucucu

SEQ ID NO: 63373 - RNA, 21 nt, Human
acagccuugugauggagacag

SEQ ID NO: 63374 - RNA, 22 nt, Human
acagcuaacuuaaacuaaccua

SEQ ID NO: 63375 - RNA, 22 nt, Human
acagcuaagggcacaggucacc

SEQ ID NO: 63376 - RNA, 22 nt, Human
acagcuaggaaauggaagaacu

SEQ ID NO: 63377 - RNA, 22 nt, Human
acagcuaggucuucagcacuuu

SEQ ID NO: 63378 - RNA, 22 nt, Human
acagcuccuacugaagccaugu

SEQ ID NO: 63379 - RNA, 22 nt, Human
acagcucugagauauuacuauu

SEQ ID NO: 63380 - RNA, 22 nt, Human
acagcugcacuugaagcagguu

SEQ ID NO: 63381 - RNA, 22 nt, Human
acagcugcauucuuaacaggaa

SEQ ID NO: 63382 - RNA, 22 nt, Human
acagcugcucuauaucucagcc

SEQ ID NO: 63383 - RNA, 22 nt, Human
acagcugcuguuuuugaaggac

SEQ ID NO: 63384 - RNA, 22 nt, Human
acagcugcuuucucuuacuaug

SEQ ID NO: 63385 - RNA, 22 nt, Human
acagcuggaggucugugagcac

SEQ ID NO: 63386 - RNA, 22 nt, Human
acagcuggaguguuggugaggu

SEQ ID NO: 63387 - RNA, 22 nt, Human
acagcuggccgaggcucaggga

SEQ ID NO: 63388 - RNA, 22 nt, Human
acagcugggaacucacacagca

SEQ ID NO: 63389 - RNA, 22 nt, Human
acagcugggaaucagcugggga

SEQ ID NO: 63390 - RNA, 22 nt, Human
acagcuguggccacuugcaucc

SEQ ID NO: 63391 - RNA, 22 nt, Human
acagcuguggggacucuugccc

SEQ ID NO: 63392 - RNA, 22 nt, Human
acagcuguggucuccuuagugu

SEQ ID NO: 63393 - RNA, 23 nt, Human
acagcuuccuggcauggagaacc

SEQ ID NO: 63394 - RNA, 23 nt, Human
acagcuugccaauuagccuuccg

SEQ ID NO: 63395 - RNA, 22 nt, Human
acagcuuguaucccaauggagc

SEQ ID NO: 63396 - RNA, 22 nt, Human
acagcuuuuaugggaccagcca

SEQ ID NO: 63397 - RNA, 22 nt, Human
acagcuuuugaaaaauuacugg

SEQ ID NO: 63398 - RNA, 22 nt, Human
acagcuuuuuacuaauagauug

SEQ ID NO: 63399 - RNA, 22 nt, Human
acaggaaauuggcauaucaguu

SEQ ID NO: 63400 - RNA, 22 nt, Human
acaggaaccaggcaggucgauu

SEQ ID NO: 63401 - RNA, 22 nt, Human
acaggaacccagaaacauuucu

SEQ ID NO: 63402 - RNA, 22 nt, Human
acaggaauuuccuaauauucga

SEQ ID NO: 63403 - RNA, 22 nt, Human
acaggacaaggggaagaagaua

SEQ ID NO: 63404 - RNA, 22 nt, Human
acaggacaggcugggcuagacu

SEQ ID NO: 63405 - RNA, 22 nt, Human
acaggacagggaauucgaaauu

SEQ ID NO: 63406 - RNA, 22 nt, Human
acaggacagucuaguaacagua

SEQ ID NO: 63407 - RNA, 22 nt, Human
acaggaguagggcugguggaga

SEQ ID NO: 63408 - RNA, 22 nt, Human
acaggagugaaucuggcacuua

SEQ ID NO: 63409 - RNA, 22 nt, Human
acaggaguggcucuaccagacc

SEQ ID NO: 63410 - RNA, 22 nt, Human
acaggaguuaaggcugaguuga

SEQ ID NO: 63411 - RNA, 22 nt, Human
acaggauggagauaauagaaaa

SEQ ID NO: 63412 - RNA, 22 nt, Human
acaggauuaguggauuugucuu

SEQ ID NO: 63413 - RNA, 22 nt, Human
acaggcaaagggucaguagcag

SEQ ID NO: 63414 - RNA, 22 nt, Human
acaggcaacuucaaaucucacu

SEQ ID NO: 63415 - RNA, 22 nt, Human
acaggcacaacugaguagacuc

SEQ ID NO: 63416 - RNA, 22 nt, Human
acaggcacucucauuaaaauag

SEQ ID NO: 63417 - RNA, 22 nt, Human
acaggcagauuaaggguaggca

SEQ ID NO: 63418 - RNA, 22 nt, Human
acaggcagcacuaaucucuggu

SEQ ID NO: 63419 - RNA, 22 nt, Human
acaggcagggaccuuggcuaag

SEQ ID NO: 63420 - RNA, 22 nt, Human
acaggcagguugagaaacauuu

SEQ ID NO: 63421 - RNA, 22 nt, Human
acaggcauccaggacuaggccu

SEQ ID NO: 63422 - RNA, 17 nt, Human
acagcaggcccggaggg

SEQ ID NO: 63423 - RNA, 22 nt, Human
acagcagggaauaugggaauug

SEQ ID NO: 63424 - RNA, 21 nt, Human
acagcagggcuggcaugacag

SEQ ID NO: 63425 - RNA, 22 nt, Human
acagcagguuauuguuauggca

SEQ ID NO: 63426 - RNA, 18 nt, Human
acagcagguuucauucuu

SEQ ID NO: 63427 - RNA, 22 nt, Human
acagcaguggauuagaggaugg

SEQ ID NO: 63428 - RNA, 22 nt, Human
acagcaguggguugccaguggg

SEQ ID NO: 63429 - RNA, 22 nt, Human
acagcaguuuagaggacagcca

SEQ ID NO: 63430 - RNA, 22 nt, Human
acagcaucauauaguggaagaa

SEQ ID NO: 63431 - RNA, 22 nt, Human
acagcauccuucuaaaguagcu

SEQ ID NO: 63432 - RNA, 22 nt, Human
acagcaugagaguagcaaaagg

SEQ ID NO: 63433 - RNA, 22 nt, Human
acagcauggauaacaaggcacu

SEQ ID NO: 63434 - RNA, 22 nt, Human
acagcauucaauaaauaauaac

SEQ ID NO: 63435 - RNA, 22 nt, Human
acagcauugagagcuaaauuua

SEQ ID NO: 63436 - RNA, 22 nt, Human
acagccaaggaauuaggaaggg

SEQ ID NO: 63437 - RNA, 22 nt, Human
acagccacucaaagggccgaag

SEQ ID NO: 63438 - RNA, 22 nt, Human
acagccagaagucaggguggga

SEQ ID NO: 63439 - RNA, 22 nt, Human
acagccagaggagccaggcugg

SEQ ID NO: 63440 - RNA, 23 nt, Human
acagccaggaugggagcagaagc

SEQ ID NO: 63441 - RNA, 22 nt, Human
acagccagggucucaggaggcg

SEQ ID NO: 63442 - RNA, 22 nt, Human
acagccagucaucucagcaggg

SEQ ID NO: 63443 - RNA, 22 nt, Human
acagccagugacugcagacccu

SEQ ID NO: 63444 - RNA, 22 nt, Human
acagccauagaugcuuauguaa

SEQ ID NO: 63445 - RNA, 22 nt, Human
acagcccaggacuccagugggc

SEQ ID NO: 63446 - RNA, 22 nt, Human
acagcccgugucaucagcugcu

SEQ ID NO: 63447 - RNA, 22 nt, Human
acagccugcagccccaggucgc

SEQ ID NO: 63448 - RNA, 22 nt, Human
acagccugcugccugcuucuug

SEQ ID NO: 63449 - RNA, 22 nt, Human
acagccuguguaccagcuggga

SEQ ID NO: 63450 - RNA, 22 nt, Human
acagccuuauugcgagcaaggc

SEQ ID NO: 63451 - RNA, 22 nt, Human
acagcuauagacgauguauaga

SEQ ID NO: 63452 - RNA, 22 nt, Human
acagcucacucacagggcuagu

SEQ ID NO: 63453 - RNA, 22 nt, Human
acagcucagacaucacugcucu

SEQ ID NO: 63454 - RNA, 22 nt, Human
acagcucugcauggcaguuauu

SEQ ID NO: 63455 - RNA, 22 nt, Human
acagcucugguccuuuagagag

SEQ ID NO: 63456 - RNA, 22 nt, Human
acagcucuguugccagaucugc

SEQ ID NO: 63457 - RNA, 22 nt, Human
acagcugaucauuuugaagaau

SEQ ID NO: 63458 - RNA, 22 nt, Human
acagcugcaaauuguuagagga

SEQ ID NO: 63459 - RNA, 22 nt, Human
acagcugcacacugaacuuggu

SEQ ID NO: 63460 - RNA, 23 nt, Human
acagcugcaccuggccgccuggc

SEQ ID NO: 63461 - RNA, 22 nt, Human
acagcugcaugaugguccagau

SEQ ID NO: 63462 - RNA, 22 nt, Human
acagcugcugcuucucacuggg

SEQ ID NO: 63463 - RNA, 22 nt, Human
acagcuggagcccuauggcugg

SEQ ID NO: 63464 - RNA, 21 nt, Human
acagcuggccgcgcgggucgg

SEQ ID NO: 63465 - RNA, 22 nt, Human
acagcuggugaauguucucugu

SEQ ID NO: 63466 - RNA, 21 nt, Human
acagcuggugcagggcgggga

SEQ ID NO: 63467 - RNA, 22 nt, Human
acagcugugaaaauccacagga

SEQ ID NO: 63468 - RNA, 22 nt, Human
acagcugugagggucacuugua

SEQ ID NO: 63469 - RNA, 22 nt, Human
acagcugugauuucuaucauga

SEQ ID NO: 63470 - RNA, 22 nt, Human
acagcugugggcucugcauaua

SEQ ID NO: 63471 - RNA, 22 nt, Human
acagcuuagccagucaagcucu

SEQ ID NO: 63472 - RNA, 23 nt, Human
acagcuuccuacuuugcugcugc

SEQ ID NO: 63473 - RNA, 22 nt, Human
acagcuucuauuucucuguacu

SEQ ID NO: 63474 - RNA, 22 nt, Human
acagcuucuccucgaugucaug

SEQ ID NO: 63475 - RNA, 22 nt, Human
acagcuugcaugcagaggcacu

SEQ ID NO: 63476 - RNA, 22 nt, Human
acagcuugggaugcuuuauuuc

SEQ ID NO: 63477 - RNA, 22 nt, Human
acagcuuuaucucagggaucag

SEQ ID NO: 63478 - RNA, 22 nt, Human
acagcuuugggcaaugcuauga

SEQ ID NO: 63479 - RNA, 22 nt, Human
acaggaagaaagugcaguagau

SEQ ID NO: 63480 - RNA, 22 nt, Human
acaggaagcuggagacccuuga

SEQ ID NO: 63481 - RNA, 22 nt, Human
acaggacaaaaaucuggauggc

SEQ ID NO: 63482 - RNA, 22 nt, Human
acaggacaauuuauaaugggca

SEQ ID NO: 63483 - RNA, 22 nt, Human
acaggacagguaggauucgcag

SEQ ID NO: 63484 - RNA, 22 nt, Human
acaggacauggcuucugugacg

SEQ ID NO: 63485 - RNA, 22 nt, Human
acaggacauguaccaggugguc

SEQ ID NO: 63486 - RNA, 22 nt, Human
acaggacuagaugauaaaaugu

SEQ ID NO: 63487 - RNA, 22 nt, Human
acaggacuguggaaggaucucu

SEQ ID NO: 63488 - RNA, 22 nt, Human
acaggagaaaucuggucaaaag

SEQ ID NO: 63489 - RNA, 22 nt, Human
acaggagaauuaucuggaacaa

SEQ ID NO: 63490 - RNA, 21 nt, Human
acaggagaccgccuggcaguc

SEQ ID NO: 63491 - RNA, 20 nt, Human
acaggagaucugaggaaagg

SEQ ID NO: 63492 - RNA, 22 nt, Human
acaggaggagcagcugugugcc

SEQ ID NO: 63493 - RNA, 23 nt, Human
acaggaggggacagguggccgug

SEQ ID NO: 63494 - RNA, 22 nt, Human
acaggaggggcaugaaagacgg

SEQ ID NO: 63495 - RNA, 22 nt, Human
acaggaguuuaagaaauauuuc

SEQ ID NO: 63496 - RNA, 21 nt, Human
acaggauaggacaguguuccu

SEQ ID NO: 63497 - RNA, 20 nt, Human
acaggaugccugccauuuca

SEQ ID NO: 63498 - RNA, 22 nt, Human
acaggcaaacacagaaaguagg

SEQ ID NO: 63499 - RNA, 22 nt, Human
acaggcaaguacacaggcucau

SEQ ID NO: 63500 - RNA, 22 nt, Human
acaggcagagaguggcggacuc

SEQ ID NO: 63501 - RNA, 22 nt, Human
acaggcagagucagguuggguu

SEQ ID NO: 63502 - RNA, 22 nt, Human
acaggcagauguuuuaguugua

SEQ ID NO: 63503 - RNA, 22 nt, Human
acaggcagcaaaaucagccuca

SEQ ID NO: 63504 - RNA, 22 nt, Human
acaggcaggcuucggccagagc

SEQ ID NO: 63505 - RNA, 22 nt, Human
acaggcauauuucuagauuaca

SEQ ID NO: 63506 - RNA, 22 nt, Human
acaggccacaguggagucucug

SEQ ID NO: 63507 - RNA, 22 nt, Human
acaggccagagguggggcagcc

SEQ ID NO: 63508 - RNA, 22 nt, Human
acaggccauaaaggcaggcccu

SEQ ID NO: 63509 - RNA, 22 nt, Human
acaggccuauguuccauugcag

SEQ ID NO: 63510 - RNA, 22 nt, Human
acaggccucaaauagggugccu

SEQ ID NO: 63511 - RNA, 22 nt, Human
acaggccucaagacacccaggu

SEQ ID NO: 63512 - RNA, 22 nt, Human
acaggccugaugccuuggcugg

SEQ ID NO: 63513 - RNA, 22 nt, Human
acaggccuggaaaggaaggagu

SEQ ID NO: 63514 - RNA, 22 nt, Human
acaggccugggguacaaguucu

SEQ ID NO: 63515 - RNA, 22 nt, Human
acaggccuggugcugcugacag

SEQ ID NO: 63516 - RNA, 22 nt, Human
acaggcgcuggcagagagaaaa

SEQ ID NO: 63517 - RNA, 22 nt, Human
acaggcucaguucacuggauuu

SEQ ID NO: 63518 - RNA, 22 nt, Human
acaggcugagcguccaucuuca

SEQ ID NO: 63519 - RNA, 22 nt, Human
acaggcugaggaugauugcauc

SEQ ID NO: 63520 - RNA, 22 nt, Human
acaggcugauagaccauaaaua

SEQ ID NO: 63521 - RNA, 22 nt, Human
acaggcugccuaccaaguauca

SEQ ID NO: 63522 - RNA, 22 nt, Human
acaggcugggcgcuuccugcgg

SEQ ID NO: 63523 - RNA, 22 nt, Human
acaggcuguacuucuaaucauc

SEQ ID NO: 63524 - RNA, 22 nt, Human
acaggcuucuuuugaaaucaga

SEQ ID NO: 63525 - RNA, 20 nt, Human
acaggcuuucugaggcuggc

SEQ ID NO: 63526 - RNA, 22 nt, Human
acaggcuuuuuuagaaugacau

SEQ ID NO: 63527 - RNA, 22 nt, Human
acagggaaagggacagcagcag

SEQ ID NO: 63528 - RNA, 22 nt, Human
acagggaaggagcauagaaaaa

SEQ ID NO: 63529 - RNA, 22 nt, Human
acagggauuaugacugacagcc

SEQ ID NO: 63530 - RNA, 22 nt, Human
acagggauuuuccaggcuaccc

SEQ ID NO: 63531 - RNA, 22 nt, Human
acuguagaggccuggauugagg

SEQ ID NO: 63532 - RNA, 22 nt, Human
acuguauaguauuuauucuuag

SEQ ID NO: 63533 - RNA, 22 nt, Human
acuguauauacagcucaaggaa

SEQ ID NO: 63534 - RNA, 22 nt, Human
acuguauuggaaauauagcaaa

SEQ ID NO: 63535 - RNA, 22 nt, Human
acuguauuuuggguguauuuuc

SEQ ID NO: 63536 - RNA, 22 nt, Human
acugucacuaacuaagucuagu

SEQ ID NO: 63537 - RNA, 22 nt, Human
acugucacuacuauguguuugu

SEQ ID NO: 63538 - RNA, 22 nt, Human
acugucacugacagaaucaaca

SEQ ID NO: 63539 - RNA, 22 nt, Human
acugucaggauggcagcuuguu

SEQ ID NO: 63540 - RNA, 22 nt, Human
acugucaugacguuugucaccc

SEQ ID NO: 63541 - RNA, 22 nt, Human
acugucaugaucgaagauguca

SEQ ID NO: 63542 - RNA, 22 nt, Human
acugucaugugcuaacugucca

SEQ ID NO: 63543 - RNA, 21 nt, Human
acugucauuugcuuagggagg

SEQ ID NO: 63544 - RNA, 22 nt, Human
acuguccaagcaugccuggcuu

SEQ ID NO: 63545 - RNA, 22 nt, Human
acuguccuagaaccugcagcuc

SEQ ID NO: 63546 - RNA, 22 nt, Human
acuguccugaauacugcaugac

SEQ ID NO: 63547 - RNA, 22 nt, Human
acugucucucuagcaguucagg

SEQ ID NO: 63548 - RNA, 22 nt, Human
acugucuguccugcucuccgug

SEQ ID NO: 63549 - RNA, 22 nt, Human
acugucuucauaucugugucuc

SEQ ID NO: 63550 - RNA, 22 nt, Human
acugugaaagcuaacaucuuag

SEQ ID NO: 63551 - RNA, 22 nt, Human
acugugaacggacugaagccca

SEQ ID NO: 63552 - RNA, 20 nt, Human
acugugaaugcugaauuagc

SEQ ID NO: 63553 - RNA, 22 nt, Human
acugugacugugucuucugggc

SEQ ID NO: 63554 - RNA, 22 nt, Human
acugugagcagcgaccugagga

SEQ ID NO: 63555 - RNA, 22 nt, Human
acugugagugauuuccuucugg

SEQ ID NO: 63556 - RNA, 21 nt, Human
acugugcagccugaggaugug

SEQ ID NO: 63557 - RNA, 22 nt, Human
acugugcagcugagugcuaauu

SEQ ID NO: 63558 - RNA, 22 nt, Human
acugugcaguguuguaacccga

SEQ ID NO: 63559 - RNA, 22 nt, Human
acugugcauuccccaaccugug

SEQ ID NO: 63560 - RNA, 22 nt, Human
acugugcauuucaugucuuuuc

SEQ ID NO: 63561 - RNA, 22 nt, Human
acugugcauuugaagggaucau

SEQ ID NO: 63562 - RNA, 22 nt, Human
acugugccuucuuauugggucc

SEQ ID NO: 63563 - RNA, 22 nt, Human
acugugccuuucacuugcacuu

SEQ ID NO: 63564 - RNA, 19 nt, Human
acugugcucgggaaccacu

SEQ ID NO: 63565 - RNA, 22 nt, Human
acugugcuugccaaaccauuga

SEQ ID NO: 63566 - RNA, 22 nt, Human
acucugaaccagagaucauacc

SEQ ID NO: 63567 - RNA, 22 nt, Human
acucugaaugugcauguaaauc

SEQ ID NO: 63568 - RNA, 22 nt, Human
acucugagaaucccuggacuuu

SEQ ID NO: 63569 - RNA, 19 nt, Human
acucugagcuugcucuauc

SEQ ID NO: 63570 - RNA, 22 nt, Human
acucugaggcaggucagggcag

SEQ ID NO: 63571 - RNA, 22 nt, Human
acucugagucaugcacuccuug

SEQ ID NO: 63572 - RNA, 22 nt, Human
acucugcccuaggccucugggg

SEQ ID NO: 63573 - RNA, 22 nt, Human
acucugccuuggugucacaaga

SEQ ID NO: 63574 - RNA, 18 nt, Human
acucugcggaggccccag

SEQ ID NO: 63575 - RNA, 22 nt, Human
acucugcuaaauguaaguuggu

SEQ ID NO: 63576 - RNA, 22 nt, Human
acucugcuugcccaauggaaac

SEQ ID NO: 63577 - RNA, 22 nt, Human
acucuggcccuccugcugccag

SEQ ID NO: 63578 - RNA, 22 nt, Human
acucuggcgggcgggcgagcca

SEQ ID NO: 63579 - RNA, 18 nt, Human
acucugggaccuguuauu

SEQ ID NO: 63580 - RNA, 22 nt, Human
acucugggagaggacaaacaaa

SEQ ID NO: 63581 - RNA, 22 nt, Human
acucugggaucuugaaaagagu

SEQ ID NO: 63582 - RNA, 22 nt, Human
acucugggcuguuaggagcugu

SEQ ID NO: 63583 - RNA, 22 nt, Human
acucugggcuuugauuuguuac

SEQ ID NO: 63584 - RNA, 22 nt, Human
acucuggguccugccauucacu

SEQ ID NO: 63585 - RNA, 22 nt, Human
acucuguaauucuauaugcagu

SEQ ID NO: 63586 - RNA, 22 nt, Human
acucuguacgcaagagauggag

SEQ ID NO: 63587 - RNA, 22 nt, Human
acucuguacucuagaggaagug

SEQ ID NO: 63588 - RNA, 22 nt, Human
acucuguaucccucucaaauug

SEQ ID NO: 63589 - RNA, 22 nt, Human
acucugugccaggcacuuuggg

SEQ ID NO: 63590 - RNA, 22 nt, Human
acucuuauaguauugguuauua

SEQ ID NO: 63591 - RNA, 22 nt, Human
acucuuaugggaacaaggauua

SEQ ID NO: 63592 - RNA, 22 nt, Human
acucuucaagggccuagaggug

SEQ ID NO: 63593 - RNA, 22 nt, Human
acucuucacacaugcugcccuc

SEQ ID NO: 63594 - RNA, 22 nt, Human
acucuucaccgcuacugaaaua

SEQ ID NO: 63595 - RNA, 22 nt, Human
acucuucaguacaauaauaucu

SEQ ID NO: 63596 - RNA, 20 nt, Human
acucuugagaaauucucugu

SEQ ID NO: 63597 - RNA, 22 nt, Human
acucuugucucaacuuuuguau

SEQ ID NO: 63598 - RNA, 22 nt, Human
acucuuguuuguagagcccacc

SEQ ID NO: 63599 - RNA, 19 nt, Human
acucuuuuccuuuugaauc

SEQ ID NO: 63600 - RNA, 22 nt, Human
acugaaaaagacaucuugguaa

SEQ ID NO: 63601 - RNA, 22 nt, Human
acugaaaaaguaugauucacug

SEQ ID NO: 63602 - RNA, 22 nt, Human
acugaaaaugaauuagaaacag

SEQ ID NO: 63603 - RNA, 22 nt, Human
acugaaacacugagugaauugu

SEQ ID NO: 63604 - RNA, 22 nt, Human
acugaaagaaccuuccuguugc

SEQ ID NO: 63605 - RNA, 22 nt, Human
acugaaagauaaaucaguuagc

SEQ ID NO: 63606 - RNA, 23 nt, Human
acugaaaggauccuagcagagac

SEQ ID NO: 63607 - RNA, 22 nt, Human
acugaaauggggacaguccuua

SEQ ID NO: 63608 - RNA, 22 nt, Human
acugaacacaccugcagcacgu

SEQ ID NO: 63609 - RNA, 22 nt, Human
acugaacagccugaggagucac

SEQ ID NO: 63610 - RNA, 22 nt, Human
acugaacagccuuucaaacuua

SEQ ID NO: 63611 - RNA, 22 nt, Human
acugaacauccauaagauuuuu

SEQ ID NO: 63612 - RNA, 22 nt, Human
acugaagaacgcaucagugguu

SEQ ID NO: 63613 - RNA, 22 nt, Human
acugaagcugggcgaugccucc

SEQ ID NO: 63614 - RNA, 22 nt, Human
acugaaggaagcgggcaggggu

SEQ ID NO: 63615 - RNA, 22 nt, Human
acugaaggguaaugugggagcc

SEQ ID NO: 63616 - RNA, 22 nt, Human
acugaaggucucagcaaggaug

SEQ ID NO: 63617 - RNA, 22 nt, Human
acugaagucucuuuuguucucu

SEQ ID NO: 63618 - RNA, 22 nt, Human
acugaaguguagguguuuuccu

SEQ ID NO: 63619 - RNA, 19 nt, Human
acugaaguuacccaaaugg

SEQ ID NO: 63620 - RNA, 22 nt, Human
acugaauaauggucugugaucu

SEQ ID NO: 63621 - RNA, 22 nt, Human
acugaauagaaaugcucauagg

SEQ ID NO: 63622 - RNA, 22 nt, Human
acugaauagcccuucugucucc

SEQ ID NO: 63623 - RNA, 22 nt, Human
acugacaccaccaauauguuca

SEQ ID NO: 63624 - RNA, 22 nt, Human
acugaccagauaugucauaccu

SEQ ID NO: 63625 - RNA, 22 nt, Human
acugagaacuugccaaggacug

SEQ ID NO: 63626 - RNA, 22 nt, Human
acugagaagcucgcagugaugc

SEQ ID NO: 63627 - RNA, 19 nt, Human
acugagaccacagacaagu

SEQ ID NO: 63628 - RNA, 22 nt, Human
acugagagggaggcuguccggu

SEQ ID NO: 63629 - RNA, 22 nt, Human
acugagcagaacaaugggagcc

SEQ ID NO: 63630 - RNA, 22 nt, Human
acugagcagaagagaucuguga

SEQ ID NO: 63631 - RNA, 22 nt, Human
acugagcaguagauuuucuguu

SEQ ID NO: 63632 - RNA, 22 nt, Human
acugagcaucagggcugggaac

SEQ ID NO: 63633 - RNA, 22 nt, Human
acugagccugugcccucaucag

SEQ ID NO: 63634 - RNA, 22 nt, Human
acugagcucugaugagauuugg

SEQ ID NO: 63635 - RNA, 22 nt, Human
acugaggacagugaggagggcu

SEQ ID NO: 63636 - RNA, 22 nt, Human
acugaggauggauaggucauau

SEQ ID NO: 63637 - RNA, 22 nt, Human
acugaggcagaaggguaagugg

SEQ ID NO: 63638 - RNA, 22 nt, Human
acugaggcgcaguccggcuguc

SEQ ID NO: 63639 - RNA, 22 nt, Human
acugaggcuagauugcuguucu

SEQ ID NO: 63640 - RNA, 22 nt, Human
acuucugauaaagagcaugugc

SEQ ID NO: 63641 - RNA, 22 nt, Human
acuucuuuucaaaucaugcaaa

SEQ ID NO: 63642 - RNA, 22 nt, Human
acuugaauuuaguuuuuccuaa

SEQ ID NO: 63643 - RNA, 22 nt, Human
acuugagagaaucggaggaguc

SEQ ID NO: 63644 - RNA, 22 nt, Human
acuugcagcagcagcuauuggc

SEQ ID NO: 63645 - RNA, 22 nt, Human
acuugcaucuuagagacucacc

SEQ ID NO: 63646 - RNA, 22 nt, Human
acuugcucaaugcuugaagcca

SEQ ID NO: 63647 - RNA, 20 nt, Human
acuugcuuuugucaggaaaa

SEQ ID NO: 63648 - RNA, 22 nt, Human
acuuggagagcauugcugggga

SEQ ID NO: 63649 - RNA, 22 nt, Human
acuuggcaaguaucuauaaagu

SEQ ID NO: 63650 - RNA, 22 nt, Human
acuuggcugggagaguugaaga

SEQ ID NO: 63651 - RNA, 22 nt, Human
acuuggcuuaaaguagugaucg

SEQ ID NO: 63652 - RNA, 22 nt, Human
acuuggcuuuaguaguaacuga

SEQ ID NO: 63653 - RNA, 18 nt, Human
acuugggacuuuugcauu

SEQ ID NO: 63654 - RNA, 22 nt, Human
acuugggauuucagaugcugug

SEQ ID NO: 63655 - RNA, 22 nt, Human
acuugguggcgaacgaggguca

SEQ ID NO: 63656 - RNA, 22 nt, Human
acuugguuguuuuaacuuggca

SEQ ID NO: 63657 - RNA, 22 nt, Human
acuugucuaugguuacauccua

SEQ ID NO: 63658 - RNA, 22 nt, Human
acuugucuuuaauccgaaugua

SEQ ID NO: 63659 - RNA, 22 nt, Human
acuuguuuuaucugucaauaga

SEQ ID NO: 63660 - RNA, 19 nt, Human
acuuguuuuggaggugaug

SEQ ID NO: 63661 - RNA, 22 nt, Human
acuuuaauuaaugaacuguggc

SEQ ID NO: 63662 - RNA, 22 nt, Human
acuuuacaagcuuauagccuag

SEQ ID NO: 63663 - RNA, 22 nt, Human
acuuuacacaucuuuucucauu

SEQ ID NO: 63664 - RNA, 22 nt, Human
acuuuacaggcacuucaaguau

SEQ ID NO: 63665 - RNA, 22 nt, Human
acuuuacucuucauaugugaca

SEQ ID NO: 63666 - RNA, 22 nt, Human
acuuuaguaaacuuauguuacu

SEQ ID NO: 63667 - RNA, 22 nt, Human
acuuuaucaggaaucacacagc

SEQ ID NO: 63668 - RNA, 22 nt, Human
acuuuaugacacccuuuaguga

SEQ ID NO: 63669 - RNA, 21 nt, Human
acuuuaugaccuacccuuuuu

SEQ ID NO: 63670 - RNA, 22 nt, Human
acuuuauguuugauaucuaugg

SEQ ID NO: 63671 - RNA, 22 nt, Human
acuuucaagcccucuagagaca

SEQ ID NO: 63672 - RNA, 22 nt, Human
acuuucaauucacugagauaua

SEQ ID NO: 63673 - RNA, 22 nt, Human
acuuucaugguaguuguauucu

SEQ ID NO: 63674 - RNA, 23 nt, Human
acuuucccauagcauggcuuccu

SEQ ID NO: 63675 - RNA, 22 nt, Human
acuuuccuagacuucagugaca

SEQ ID NO: 63676 - RNA, 22 nt, Human
acuuuccugccaaggccagagu

SEQ ID NO: 63677 - RNA, 22 nt, Human
acuuucuaggugcuauugugau

SEQ ID NO: 63678 - RNA, 22 nt, Human
acuuucugucaucuagacaagu

SEQ ID NO: 63679 - RNA, 22 nt, Human
acuuucuuauccaugaucucac

SEQ ID NO: 63680 - RNA, 22 nt, Human
acuuucuuggucccauguuuga

SEQ ID NO: 63681 - RNA, 22 nt, Human
acaugcuuugauguauuuugca

SEQ ID NO: 63682 - RNA, 22 nt, Human
acaugcuuugcacuuacaucau

SEQ ID NO: 63683 - RNA, 22 nt, Human
acaugcuuuucccacaauuaua

SEQ ID NO: 63684 - RNA, 21 nt, Human
acauggaagagaaauuaacca

SEQ ID NO: 63685 - RNA, 21 nt, Human
acauggacugugaauggggac

SEQ ID NO: 63686 - RNA, 22 nt, Human
acauggagaccagauggaagua

SEQ ID NO: 63687 - RNA, 22 nt, Human
acauggcaaaagggacuuuaca

SEQ ID NO: 63688 - RNA, 19 nt, Human
acauggcaucccaggaggu

SEQ ID NO: 63689 - RNA, 20 nt, Human
acauggcauucccacguggu

SEQ ID NO: 63690 - RNA, 22 nt, Human
acaugggacagagaaagaggcc

SEQ ID NO: 63691 - RNA, 22 nt, Human
acaugguauuucuauuauaauu

SEQ ID NO: 63692 - RNA, 22 nt, Human
acaugguugaaugcuuuauuug

SEQ ID NO: 63693 - RNA, 22 nt, Human
acauguaagacuagcuuaaagu

SEQ ID NO: 63694 - RNA, 21 nt, Human
acauguaagagaguuucaaga

SEQ ID NO: 63695 - RNA, 22 nt, Human
acauguauacaauguguaauga

SEQ ID NO: 63696 - RNA, 22 nt, Human
acauguaucugaucugcaauug

SEQ ID NO: 63697 - RNA, 22 nt, Human
acaugucaauuuaguacucuua

SEQ ID NO: 63698 - RNA, 21 nt, Human
acauguccccuaugcuuaagg

SEQ ID NO: 63699 - RNA, 22 nt, Human
acaugucuccacccaucuuaaa

SEQ ID NO: 63700 - RNA, 22 nt, Human
acaugucuguaauuauuuuagg

SEQ ID NO: 63701 - RNA, 22 nt, Human
acaugucuuguggcuuugaucu

SEQ ID NO: 63702 - RNA, 22 nt, Human
acaugugaggugugagugauac

SEQ ID NO: 63703 - RNA, 22 nt, Human
acaugugcagacagcaagcagg

SEQ ID NO: 63704 - RNA, 23 nt, Human
acauguggagagaacagauaucu

SEQ ID NO: 63705 - RNA, 22 nt, Human
acauguguaagaugugauauau

SEQ ID NO: 63706 - RNA, 22 nt, Human
acauguguauagccuguauaga

SEQ ID NO: 63707 - RNA, 22 nt, Human
acaugugugacaacagagguga

SEQ ID NO: 63708 - RNA, 22 nt, Human
acauguguguauacguauuuau

SEQ ID NO: 63709 - RNA, 22 nt, Human
acauguguuaaaauucucacca

SEQ ID NO: 63710 - RNA, 22 nt, Human
acauguguuuuccuacuuauga

SEQ ID NO: 63711 - RNA, 22 nt, Human
acauguuaaacaucauggaaug

SEQ ID NO: 63712 - RNA, 22 nt, Human
acauguuagaaaugcagaaucu

SEQ ID NO: 63713 - RNA, 22 nt, Human
acauguucaugcaugcacaggu

SEQ ID NO: 63714 - RNA, 22 nt, Human
acauguuuaaguuuaaugaaaa

SEQ ID NO: 63715 - RNA, 22 nt, Human
acauguuuaaguuuguuauaug

SEQ ID NO: 63716 - RNA, 22 nt, Human
acauguuuugugccuugacuag

SEQ ID NO: 63717 - RNA, 22 nt, Human
acauuaaauuucauagugauua

SEQ ID NO: 63718 - RNA, 23 nt, Human
acauuacacgcaguaauugcccc

SEQ ID NO: 63719 - RNA, 22 nt, Human
acauuaccuggcauuugaucuu

SEQ ID NO: 63720 - RNA, 22 nt, Human
acauucaaggcagcacugagug

SEQ ID NO: 63721 - RNA, 21 nt, Human
acauucacaggauauuaucau

SEQ ID NO: 63722 - RNA, 22 nt, Human
acauucauuccaggucagucag

SEQ ID NO: 63723 - RNA, 22 nt, Human
acauucauugagcaacaacaau

SEQ ID NO: 63724 - RNA, 22 nt, Human
acauuccaaaaacuagcagaua

SEQ ID NO: 63725 - RNA, 22 nt, Human
acauucccaccaacaguguaaa

SEQ ID NO: 63726 - RNA, 22 nt, Human
acauuccucagugccaguugag

SEQ ID NO: 63727 - RNA, 22 nt, Human
acauuccugaaugggcacauuu

SEQ ID NO: 63728 - RNA, 22 nt, Human
acauuccugccauaaauuuuuu

SEQ ID NO: 63729 - RNA, 22 nt, Human
acauuccuuucuugagcacagu

SEQ ID NO: 63730 - RNA, 22 nt, Human
acauucuauucugcaggacaag

SEQ ID NO: 63731 - RNA, 22 nt, Human
acauucucauuuggugaucauu

SEQ ID NO: 63732 - RNA, 22 nt, Human
acauucucuuuuagaaagcugu

SEQ ID NO: 63733 - RNA, 22 nt, Human
acauucugaaugccugacagua

SEQ ID NO: 63734 - RNA, 22 nt, Human
acauucuggaugucugaugaga

SEQ ID NO: 63735 - RNA, 22 nt, Human
acauucuuccagcuggcuguug

SEQ ID NO: 63736 - RNA, 22 nt, Human
acauucuuggacuccacucuag

SEQ ID NO: 63737 - RNA, 22 nt, Human
acauucuuucaccuugugucca

SEQ ID NO: 63738 - RNA, 22 nt, Human
acauucuuucucuucaggaaac

SEQ ID NO: 63739 - RNA, 22 nt, Human
acauucuuugaguuuuguuaaa

SEQ ID NO: 63740 - RNA, 22 nt, Human
acauugaacauggcaggacauu

SEQ ID NO: 63741 - RNA, 22 nt, Human
acauugaacuacuuguaaugag

SEQ ID NO: 63742 - RNA, 22 nt, Human
acauugaagugucuggccuccu

SEQ ID NO: 63743 - RNA, 22 nt, Human
acauugaauguaugugaugaaa

SEQ ID NO: 63744 - RNA, 22 nt, Human
acauugaauucaaaauuacuga

SEQ ID NO: 63745 - RNA, 22 nt, Human
acauugaccugauuuugaagac

SEQ ID NO: 63746 - RNA, 22 nt, Human
acauugauacugagauacaaag

SEQ ID NO: 63747 - RNA, 22 nt, Human
acauugauauuucaaauacagg

SEQ ID NO: 63748 - RNA, 22 nt, Human
acauugaugaucccacuuacag

SEQ ID NO: 63749 - RNA, 19 nt, Human
accaggccucagaggcccu

SEQ ID NO: 63750 - RNA, 22 nt, Human
accaggccuggcugggcagcca

SEQ ID NO: 63751 - RNA, 22 nt, Human
accaggcuccccuuggauccug

SEQ ID NO: 63752 - RNA, 22 nt, Human
accaggcuggagugcaguggcg

SEQ ID NO: 63753 - RNA, 19 nt, Human
accaggcuuauggucagug

SEQ ID NO: 63754 - RNA, 22 nt, Human
accaggcuugauaccaagaaau

SEQ ID NO: 63755 - RNA, 22 nt, Human
accagggaccgccacacugcaa

SEQ ID NO: 63756 - RNA, 22 nt, Human
accagggcggcuugaggaggca

SEQ ID NO: 63757 - RNA, 22 nt, Human
accagggcugggauaggucagg

SEQ ID NO: 63758 - RNA, 22 nt, Human
accagucauagaaagcaguggu

SEQ ID NO: 63759 - RNA, 22 nt, Human
accagucuguuguugcagagug

SEQ ID NO: 63760 - RNA, 22 nt, Human
accaguuuaauaacugcucaag

SEQ ID NO: 63761 - RNA, 22 nt, Human
accauacauuaaaugacuuuca

SEQ ID NO: 63762 - RNA, 22 nt, Human
accauaguuauaacaaaguguu

SEQ ID NO: 63763 - RNA, 22 nt, Human
accauccaaacugcuuucugug

SEQ ID NO: 63764 - RNA, 22 nt, Human
accaugaugggaagcucagggc

SEQ ID NO: 63765 - RNA, 22 nt, Human
accaugcaucaaagcuaauaua

SEQ ID NO: 63766 - RNA, 22 nt, Human
accauggaccauaguuccuauu

SEQ ID NO: 63767 - RNA, 22 nt, Human
accaugugaucaaaacaaaucc

SEQ ID NO: 63768 - RNA, 22 nt, Human
accauguuaguuacugggaaug

SEQ ID NO: 63769 - RNA, 22 nt, Human
accauuaacaugauuuugggga

SEQ ID NO: 63770 - RNA, 22 nt, Human
accauuaagaaucugguuuccu

SEQ ID NO: 63771 - RNA, 22 nt, Human
accauuacaugauccuuaccca

SEQ ID NO: 63772 - RNA, 22 nt, Human
accauucugguccauacuguuc

SEQ ID NO: 63773 - RNA, 22 nt, Human
accauuugaaggaaucauugac

SEQ ID NO: 63774 - RNA, 22 nt, Human
acccacagaaccugugacaaca

SEQ ID NO: 63775 - RNA, 22 nt, Human
acccacccuacuagcagugucc

SEQ ID NO: 63776 - RNA, 22 nt, Human
acccagagaacugaggcaugaa

SEQ ID NO: 63777 - RNA, 22 nt, Human
acccagagauggaccuggcugc

SEQ ID NO: 63778 - RNA, 22 nt, Human
acccagagcacagaugcaacgu

SEQ ID NO: 63779 - RNA, 22 nt, Human
acccagagcacugggugugggc

SEQ ID NO: 63780 - RNA, 22 nt, Human
acccagagcagagcuuggcuuc

SEQ ID NO: 63781 - RNA, 22 nt, Human
acccagagccagggucaggagc

SEQ ID NO: 63782 - RNA, 22 nt, Human
acccagagcccuuagcacagac

SEQ ID NO: 63783 - RNA, 22 nt, Human
acccagagucauggcacuuagc

SEQ ID NO: 63784 - RNA, 22 nt, Human
acccagagucauguuuauuccc

SEQ ID NO: 63785 - RNA, 22 nt, Human
acccagauaaaugacagggcuu

SEQ ID NO: 63786 - RNA, 22 nt, Human
acccagccuacaaagcucaccu

SEQ ID NO: 63787 - RNA, 22 nt, Human
acccagcuguuucccgugucau

SEQ ID NO: 63788 - RNA, 22 nt, Human
acccaggacuuggcaaccucau

SEQ ID NO: 63789 - RNA, 22 nt, Human
acccaggagacggaggugcagu

SEQ ID NO: 63790 - RNA, 22 nt, Human
acccaggagccgugagagguua

SEQ ID NO: 63791 - RNA, 22 nt, Human
acccaggaggcagagguugcag

SEQ ID NO: 63792 - RNA, 22 nt, Human
acccaggcuagggugcaguggc

SEQ ID NO: 63793 - RNA, 22 nt, Human
acccaggcugcuucucaguggc

SEQ ID NO: 63794 - RNA, 22 nt, Human
acccaggcuggaaugcaguggc

SEQ ID NO: 63795 - RNA, 22 nt, Human
acccaggcuggaaugcaguggu

SEQ ID NO: 63796 - RNA, 22 nt, Human
acccaggcuggagugcagugac

SEQ ID NO: 63797 - RNA, 22 nt, Human
acccaggcuggagugcaguggu

SEQ ID NO: 63798 - RNA, 22 nt, Human
acuguauuccuacuagaaucua

SEQ ID NO: 63799 - RNA, 22 nt, Human
acuguauucuagucauguuugu

SEQ ID NO: 63800 - RNA, 21 nt, Human
acuguauuguuuucaaggauc

SEQ ID NO: 63801 - RNA, 22 nt, Human
acuguauuuggauauaagaucu

SEQ ID NO: 63802 - RNA, 22 nt, Human
acugucaaaugcaaugaacuca

SEQ ID NO: 63803 - RNA, 22 nt, Human
acugucaagagauucaaauuca

SEQ ID NO: 63804 - RNA, 19 nt, Human
acugucacauaaaggaagg

SEQ ID NO: 63805 - RNA, 22 nt, Human
acugucaccaucagagcgggaa

SEQ ID NO: 63806 - RNA, 22 nt, Human
acugucaccuaaauuuucauug

SEQ ID NO: 63807 - RNA, 22 nt, Human
acugucacuugcaacugugagg

SEQ ID NO: 63808 - RNA, 22 nt, Human
acugucagggaucaugaaagcu

SEQ ID NO: 63809 - RNA, 22 nt, Human
acuguccuuuuaaugcagccgu

SEQ ID NO: 63810 - RNA, 22 nt, Human
acugucugcaaaacucauacuc

SEQ ID NO: 63811 - RNA, 22 nt, Human
acugucugcccugagaugccag

SEQ ID NO: 63812 - RNA, 22 nt, Human
acugucugcuggccccugguua

SEQ ID NO: 63813 - RNA, 22 nt, Human
acugucuuccaggucuggaggu

SEQ ID NO: 63814 - RNA, 22 nt, Human
acugucuuugagcuggaggagg

SEQ ID NO: 63815 - RNA, 22 nt, Human
acugugaugaugaagcaugguu

SEQ ID NO: 63816 - RNA, 22 nt, Human
acugugaugcaguugccaucca

SEQ ID NO: 63817 - RNA, 22 nt, Human
acugugauguucucuaucuugg

SEQ ID NO: 63818 - RNA, 22 nt, Human
acugugcaaaugacaggcacac

SEQ ID NO: 63819 - RNA, 22 nt, Human
acugugcaagucaaagaugggc

SEQ ID NO: 63820 - RNA, 22 nt, Human
acugugcaaugaguaauaaacu

SEQ ID NO: 63821 - RNA, 22 nt, Human
acugugcaggggaagagagaaa

SEQ ID NO: 63822 - RNA, 22 nt, Human
acugugcaggugaacuguuugc

SEQ ID NO: 63823 - RNA, 22 nt, Human
acugugcaugaaccgaaacaaa

SEQ ID NO: 63824 - RNA, 22 nt, Human
acugugcauuugucaugggguu

SEQ ID NO: 63825 - RNA, 22 nt, Human
acugugccacaauucaccaggg

SEQ ID NO: 63826 - RNA, 22 nt, Human
acugugcuaucuacugaauuau

SEQ ID NO: 63827 - RNA, 22 nt, Human
acugugcuggcaaugacucagg

SEQ ID NO: 63828 - RNA, 22 nt, Human
acuguggagcaguggcuaggga

SEQ ID NO: 63829 - RNA, 22 nt, Human
acuguggcaaagaagcaggcuc

SEQ ID NO: 63830 - RNA, 22 nt, Human
acuguggccggaacagugggac

SEQ ID NO: 63831 - RNA, 22 nt, Human
acuguggcucaucaggcuggug

SEQ ID NO: 63832 - RNA, 22 nt, Human
acugugggccuuuccuuugacc

SEQ ID NO: 63833 - RNA, 22 nt, Human
acuguggggggcuuugcucagu

SEQ ID NO: 63834 - RNA, 22 nt, Human
acuguggggugcgaggcaguga

SEQ ID NO: 63835 - RNA, 22 nt, Human
acuguguauuccuauauaguaa

SEQ ID NO: 63836 - RNA, 22 nt, Human
acuguguauucuaaugacuaaa

SEQ ID NO: 63837 - RNA, 18 nt, Human
acugugugaauuagcucc

SEQ ID NO: 63838 - RNA, 22 nt, Human
acugugugaggcugggugaguc

SEQ ID NO: 63839 - RNA, 22 nt, Human
acugugugccaggcgcuggucu

SEQ ID NO: 63840 - RNA, 22 nt, Human
acuguguggaccacucugaggc

SEQ ID NO: 63841 - RNA, 22 nt, Human
acugugugggccgcucacuggg

SEQ ID NO: 63842 - RNA, 22 nt, Human
acuguguugccuucccccagcc

SEQ ID NO: 63843 - RNA, 22 nt, Human
acuguuaacgguaugaugcucg

SEQ ID NO: 63844 - RNA, 22 nt, Human
acuguuaaguaugaaguaaggc

SEQ ID NO: 63845 - RNA, 20 nt, Human
acuguuaguauacuugugcc

SEQ ID NO: 63846 - RNA, 22 nt, Human
acuguucacagauuagucgaug

SEQ ID NO: 63847 - RNA, 22 nt, Human
acuguucacccagcacuagcag

SEQ ID NO: 63848 - RNA, 22 nt, Human
acuguucacuagugaggguuga

SEQ ID NO: 63849 - RNA, 21 nt, Human
acuguucaucuguucagaagc

SEQ ID NO: 63850 - RNA, 18 nt, Human
acuguucucuccugcccu

SEQ ID NO: 63851 - RNA, 22 nt, Human
acuguucugcaugcugugaggg

SEQ ID NO: 63852 - RNA, 19 nt, Human
acuguucuguauguugauu

SEQ ID NO: 63853 - RNA, 20 nt, Human
acuguuggaaguggagaaug

SEQ ID NO: 63854 - RNA, 22 nt, Human
acuguugucaggcugcuuugga

SEQ ID NO: 63855 - RNA, 22 nt, Human
acuguuuaguaaauugaaaugg

SEQ ID NO: 63856 - RNA, 22 nt, Human
acuguuuucuaaagaacagaug

SEQ ID NO: 63857 - RNA, 22 nt, Human
acuguuuucuguaaagggccag

SEQ ID NO: 63858 - RNA, 23 nt, Human
accaggagaaaagcuuugcggga

SEQ ID NO: 63859 - RNA, 20 nt, Human
accaggagauggaggcaggg

SEQ ID NO: 63860 - RNA, 22 nt, Human
accaggagccauagagucaggc

SEQ ID NO: 63861 - RNA, 22 nt, Human
accaggaggccuugguucugag

SEQ ID NO: 63862 - RNA, 19 nt, Human
accaggaguaucagagcug

SEQ ID NO: 63863 - RNA, 22 nt, Human
accaggagucuagccuagucaa

SEQ ID NO: 63864 - RNA, 17 nt, Human
accaggcaacacgccca

SEQ ID NO: 63865 - RNA, 22 nt, Human
accaggcacuccugaggucuga

SEQ ID NO: 63866 - RNA, 22 nt, Human
accaggcagucaccguccagga

SEQ ID NO: 63867 - RNA, 22 nt, Human
accaggcccgcugcuauggugg

SEQ ID NO: 63868 - RNA, 22 nt, Human
accaggcuugaugauuugcuua

SEQ ID NO: 63869 - RNA, 22 nt, Human
accagggcagccgagguguguc

SEQ ID NO: 63870 - RNA, 22 nt, Human
accagggcccgggagagcucuc

SEQ ID NO: 63871 - RNA, 22 nt, Human
accagggccgcgggcgacuagc

SEQ ID NO: 63872 - RNA, 22 nt, Human
accaggguugagucagcugcgu

SEQ ID NO: 63873 - RNA, 22 nt, Human
accagguaauguaaagcagggu

SEQ ID NO: 63874 - RNA, 22 nt, Human
accaguaagauccuguacauac

SEQ ID NO: 63875 - RNA, 23 nt, Human
accaguccauuccccucaugauu

SEQ ID NO: 63876 - RNA, 22 nt, Human
accagugcuuccugcuggagcu

SEQ ID NO: 63877 - RNA, 22 nt, Human
accaguggaauuauucuguggu

SEQ ID NO: 63878 - RNA, 22 nt, Human
accaguggaugaaugcuggacc

SEQ ID NO: 63879 - RNA, 22 nt, Human
accaguuucugggggagguugg

SEQ ID NO: 63880 - RNA, 22 nt, Human
accauacuugaaauggauagga

SEQ ID NO: 63881 - RNA, 22 nt, Human
accaucaagaccuuaucuaguu

SEQ ID NO: 63882 - RNA, 22 nt, Human
accaucaguacuggaugcugac

SEQ ID NO: 63883 - RNA, 22 nt, Human
accaucagucauugucaguggg

SEQ ID NO: 63884 - RNA, 22 nt, Human
accaucugaguagagagaagua

SEQ ID NO: 63885 - RNA, 22 nt, Human
accaucuuaguggccagcucuc

SEQ ID NO: 63886 - RNA, 22 nt, Human
accaugacgucacagaggcuuc

SEQ ID NO: 63887 - RNA, 22 nt, Human
accaugaugcauccuuaaggaa

SEQ ID NO: 63888 - RNA, 23 nt, Human
accaugaugggagugcaaauaag

SEQ ID NO: 63889 - RNA, 22 nt, Human
accaugcacagcuguucuauua

SEQ ID NO: 63890 - RNA, 22 nt, Human
accauuaaagagauccugggga

SEQ ID NO: 63891 - RNA, 22 nt, Human
accauuaaucucacaaggauaa

SEQ ID NO: 63892 - RNA, 20 nt, Human
accauuaauguaagcuuugu

SEQ ID NO: 63893 - RNA, 22 nt, Human
accauucuuuacacuuauuucu

SEQ ID NO: 63894 - RNA, 22 nt, Human
acccaaagcaauauucaucagu

SEQ ID NO: 63895 - RNA, 22 nt, Human
acccacacaucucuaauucagu

SEQ ID NO: 63896 - RNA, 22 nt, Human
acccaccacaguggcuggcaca

SEQ ID NO: 63897 - RNA, 22 nt, Human
acccagagaacugugccuugag

SEQ ID NO: 63898 - RNA, 19 nt, Human
acccagagcccuuugcagg

SEQ ID NO: 63899 - RNA, 22 nt, Human
acccagagcugggcuuggcaaa

SEQ ID NO: 63900 - RNA, 22 nt, Human
acccagaguaacagauggauuc

SEQ ID NO: 63901 - RNA, 22 nt, Human
acccagagucagacagccaugg

SEQ ID NO: 63902 - RNA, 22 nt, Human
acccagagugucugucucaguc

SEQ ID NO: 63903 - RNA, 22 nt, Human
acccagcaugacaccugcacau

SEQ ID NO: 63904 - RNA, 22 nt, Human
acccagcccagaaucuggggcc

SEQ ID NO: 63905 - RNA, 19 nt, Human
acccagcccaggaguggca

SEQ ID NO: 63906 - RNA, 22 nt, Human
acccagcuaacccuacccugga

SEQ ID NO: 63907 - RNA, 20 nt, Human
acccagcucugugcccuggg

SEQ ID NO: 63908 - RNA, 22 nt, Human
acccagcucuuugauggucuug

SEQ ID NO: 63909 - RNA, 22 nt, Human
acccaggaaaacauggugcaga

SEQ ID NO: 63910 - RNA, 22 nt, Human
acccaggacacagagaugaccc

SEQ ID NO: 63911 - RNA, 22 nt, Human
acccaggagcaggcugggcagu

SEQ ID NO: 63912 - RNA, 22 nt, Human
acccaggaugauaauguucaca

SEQ ID NO: 63913 - RNA, 22 nt, Human
acccaggcagcaggagcuaaag

SEQ ID NO: 63914 - RNA, 22 nt, Human
acccaggcgggagugcaguguc

SEQ ID NO: 63915 - RNA, 22 nt, Human
acccaggcuagaagugaauuau

SEQ ID NO: 63916 - RNA, 21 nt, Human
accuuagagagaaagccauca

SEQ ID NO: 63917 - RNA, 22 nt, Human
accuucaaguaugugggcugaa

SEQ ID NO: 63918 - RNA, 22 nt, Human
accuucagacaucaacuaucuc

SEQ ID NO: 63919 - RNA, 19 nt, Human
accuucagaguggcacaaa

SEQ ID NO: 63920 - RNA, 22 nt, Human
accuucauauucucugauaccu

SEQ ID NO: 63921 - RNA, 18 nt, Human
accuucauuccuuugccu

SEQ ID NO: 63922 - RNA, 22 nt, Human
accuuccucuaagacauuuagc

SEQ ID NO: 63923 - RNA, 21 nt, Human
accuucugaauuaccuaccaa

SEQ ID NO: 63924 - RNA, 22 nt, Human
accuucuuccaccaaaaacguc

SEQ ID NO: 63925 - RNA, 22 nt, Human
accuugaaagcugguuguuagg

SEQ ID NO: 63926 - RNA, 22 nt, Human
accuugauggggcuguuggagu

SEQ ID NO: 63927 - RNA, 22 nt, Human
accuuggaaaugcccauugccu

SEQ ID NO: 63928 - RNA, 22 nt, Human
accuuggcaguuucuaccuuuu

SEQ ID NO: 63929 - RNA, 22 nt, Human
accuugggcaaguuggaaacug

SEQ ID NO: 63930 - RNA, 22 nt, Human
accuugucuuuuauagaacaag

SEQ ID NO: 63931 - RNA, 22 nt, Human
accuuuauauaucaacuucucc

SEQ ID NO: 63932 - RNA, 22 nt, Human
accuuuaucgccaucauugugc

SEQ ID NO: 63933 - RNA, 22 nt, Human
accuuuaugaaacagcugucgu

SEQ ID NO: 63934 - RNA, 22 nt, Human
accuuucauuaaagucuguagu

SEQ ID NO: 63935 - RNA, 22 nt, Human
accuuuccaaguaucagguggu

SEQ ID NO: 63936 - RNA, 22 nt, Human
accuuuccuggcugaccgagga

SEQ ID NO: 63937 - RNA, 22 nt, Human
accuuugacgcuauuuaauuug

SEQ ID NO: 63938 - RNA, 22 nt, Human
accuuuggagcaugcauuuucu

SEQ ID NO: 63939 - RNA, 22 nt, Human
accuuuggucauuuacuuuuca

SEQ ID NO: 63940 - RNA, 22 nt, Human
accuuuuacggugugacuagca

SEQ ID NO: 63941 - RNA, 22 nt, Human
accuuuucaucugaaacuuuua

SEQ ID NO: 63942 - RNA, 22 nt, Human
acgaauaaaucuauuucacaca

SEQ ID NO: 63943 - RNA, 22 nt, Human
acgagagguccuuagaaucugu

SEQ ID NO: 63944 - RNA, 22 nt, Human
acgaugcuggauuaucucaagg

SEQ ID NO: 63945 - RNA, 22 nt, Human
acgauguggccugaaucaggca

SEQ ID NO: 63946 - RNA, 22 nt, Human
acgauugaagaauagucuuaac

SEQ ID NO: 63947 - RNA, 20 nt, Human
acgcacacgcgggggcgugc

SEQ ID NO: 63948 - RNA, 22 nt, Human
acgcagcacaaaggaaaggauc

SEQ ID NO: 63949 - RNA, 22 nt, Human
acgcccggucuccauaguuuuu

SEQ ID NO: 63950 - RNA, 23 nt, Human
acgcccucgcauccugagagccc

SEQ ID NO: 63951 - RNA, 22 nt, Human
acgccucugcagcugccgggcc

SEQ ID NO: 63952 - RNA, 22 nt, Human
acgcggugcggcaaguucaugg

SEQ ID NO: 63953 - RNA, 22 nt, Human
acgcuggugaaagggugguuuu

SEQ ID NO: 63954 - RNA, 22 nt, Human
acggaaugagucuugaaaagug

SEQ ID NO: 63955 - RNA, 22 nt, Human
acggagcccgugucagguggga

SEQ ID NO: 63956 - RNA, 22 nt, Human
acggcaggcucagagcuggaau

SEQ ID NO: 63957 - RNA, 22 nt, Human
acggcuucuugacuguggguug

SEQ ID NO: 63958 - RNA, 22 nt, Human
acgggcugggacggggaagcuc

SEQ ID NO: 63959 - RNA, 22 nt, Human
acggugaccaagcaucaccgag

SEQ ID NO: 63960 - RNA, 22 nt, Human
acggugcuggguauugggguuc

SEQ ID NO: 63961 - RNA, 22 nt, Human
acguaauauaagaaaguguggu

SEQ ID NO: 63962 - RNA, 22 nt, Human
acguggcggccgccgugagcgg

SEQ ID NO: 63963 - RNA, 22 nt, Human
acguguaaugaucaccacaauc

SEQ ID NO: 63964 - RNA, 22 nt, Human
acguguguaugaguguacauau

SEQ ID NO: 63965 - RNA, 22 nt, Human
acguguguuggucagggggccc

SEQ ID NO: 63966 - RNA, 22 nt, Human
acguguguuuaacaaaccugca

SEQ ID NO: 63967 - RNA, 22 nt, Human
agaggccucccucccagcuggu

SEQ ID NO: 63968 - RNA, 22 nt, Human
agaggccucuagggccccucag

SEQ ID NO: 63969 - RNA, 22 nt, Human
agaggccucuguuguucagacg

SEQ ID NO: 63970 - RNA, 22 nt, Human
agaggcucuggugcagcaugca

SEQ ID NO: 63971 - RNA, 22 nt, Human
agaggcucuggugggaguuggu

SEQ ID NO: 63972 - RNA, 22 nt, Human
agaggcucuuugagcugggaga

SEQ ID NO: 63973 - RNA, 22 nt, Human
agaggcugcaggcuggaaauca

SEQ ID NO: 63974 - RNA, 22 nt, Human
agaggcugggcaggacccacag

SEQ ID NO: 63975 - RNA, 22 nt, Human
agaggcugugcccaccaggcaa

SEQ ID NO: 63976 - RNA, 22 nt, Human
agaggcuguuacacucccagau

SEQ ID NO: 63977 - RNA, 20 nt, Human
agaggcuuccuugggaggag

SEQ ID NO: 63978 - RNA, 22 nt, Human
agaggcuugacaauaugauugg

SEQ ID NO: 63979 - RNA, 22 nt, Human
agaggcuuggccucaguucugu

SEQ ID NO: 63980 - RNA, 20 nt, Human
agaggcuuucuuguagucag

SEQ ID NO: 63981 - RNA, 17 nt, Human
agagggaaaaugcgguu

SEQ ID NO: 63982 - RNA, 22 nt, Human
agagggaagaugguccaaucuu

SEQ ID NO: 63983 - RNA, 22 nt, Human
agagggcauaaaauagagcacg

SEQ ID NO: 63984 - RNA, 22 nt, Human
agagggcuaacugggaagcagg

SEQ ID NO: 63985 - RNA, 17 nt, Human
agagggcucaaggcauc

SEQ ID NO: 63986 - RNA, 22 nt, Human
agaggggacagccaccugcccg

SEQ ID NO: 63987 - RNA, 22 nt, Human
agaggggcaaguaaagagucuu

SEQ ID NO: 63988 - RNA, 22 nt, Human
agaggggcccgguucuccgucu

SEQ ID NO: 63989 - RNA, 22 nt, Human
agaggggguguuccagaagcau

SEQ ID NO: 63990 - RNA, 22 nt, Human
agaggggugggcacagcgccca

SEQ ID NO: 63991 - RNA, 22 nt, Human
agaggguaacaagaggccugga

SEQ ID NO: 63992 - RNA, 22 nt, Human
agaggguaugaguggggcuaaa

SEQ ID NO: 63993 - RNA, 22 nt, Human
agagguauuagguaauucagua

SEQ ID NO: 63994 - RNA, 22 nt, Human
agaggucagagcaggaaaggca

SEQ ID NO: 63995 - RNA, 22 nt, Human
agaggucagauuucuccuggug

SEQ ID NO: 63996 - RNA, 22 nt, Human
agaggucauaucucagaagaga

SEQ ID NO: 63997 - RNA, 21 nt, Human
agaggucauugggcugguucu

SEQ ID NO: 63998 - RNA, 22 nt, Human
agaggucuuaagaucuagacug

SEQ ID NO: 63999 - RNA, 22 nt, Human
agaggugggagccuggucacau

SEQ ID NO: 64000 - RNA, 22 nt, Human
agaguaaaguacuuggaauacc

SEQ ID NO: 64001 - RNA, 22 nt, Human
agaguaauuucugcugaaaagg

SEQ ID NO: 64002 - RNA, 22 nt, Human
agaguacugcugcuggguacug

SEQ ID NO: 64003 - RNA, 22 nt, Human
agaguaguucuuugcagagugg

SEQ ID NO: 64004 - RNA, 22 nt, Human
agaguauaauuagugucuucua

SEQ ID NO: 64005 - RNA, 19 nt, Human
agaguauugaauuugcccu

SEQ ID NO: 64006 - RNA, 22 nt, Human
agaguauugugaccauuuguca

SEQ ID NO: 64007 - RNA, 22 nt, Human
agaguauuuugauuauccugga

SEQ ID NO: 64008 - RNA, 22 nt, Human
agagucaaaauuuaccagaaug

SEQ ID NO: 64009 - RNA, 22 nt, Human
agagucaaguagggcaugggcu

SEQ ID NO: 64010 - RNA, 22 nt, Human
agagucagacuaagccauggug

SEQ ID NO: 64011 - RNA, 22 nt, Human
agaguccaaaugugcaguuaug

SEQ ID NO: 64012 - RNA, 22 nt, Human
agaguccaggggccuggugugu

SEQ ID NO: 64013 - RNA, 22 nt, Human
agaguccauaugugggaggagu

SEQ ID NO: 64014 - RNA, 22 nt, Human
agaguccaugaagacagcugag

SEQ ID NO: 64015 - RNA, 22 nt, Human
agagucugaugucaacaguucu

SEQ ID NO: 64016 - RNA, 22 nt, Human
agagucugcauuguaacaagau

SEQ ID NO: 64017 - RNA, 19 nt, Human
agagucugugcucuuccua

SEQ ID NO: 64018 - RNA, 22 nt, Human
agagucugugcuggggccagcu

SEQ ID NO: 64019 - RNA, 22 nt, Human
agagucuuguuaacuugcuaag

SEQ ID NO: 64020 - RNA, 22 nt, Human
agagucuuuugucaguaauguu

SEQ ID NO: 64021 - RNA, 22 nt, Human
agagugaaguaauuguuaggau

SEQ ID NO: 64022 - RNA, 22 nt, Human
agagugacagccacugcaguaa

SEQ ID NO: 64023 - RNA, 20 nt, Human
agagugagacuccaucucag

SEQ ID NO: 64024 - RNA, 22 nt, Human
agagugagggggcacugagacg

SEQ ID NO: 64025 - RNA, 22 nt, Human
agagugaucagauaucaggugu

SEQ ID NO: 64026 - RNA, 22 nt, Human
agagugauggguugugcugacc

SEQ ID NO: 64027 - RNA, 22 nt, Human
agagugauucuaguuagggaau

SEQ ID NO: 64028 - RNA, 22 nt, Human
agagugcaugacaugaucuugg

SEQ ID NO: 64029 - RNA, 22 nt, Human
agagugccacugacaggucccu

SEQ ID NO: 64030 - RNA, 22 nt, Human
agagugcccugcucugagcucu

SEQ ID NO: 64031 - RNA, 22 nt, Human
agagugcuaaaaucuuaucuuu

SEQ ID NO: 64032 - RNA, 22 nt, Human
agagugcuagccugagggaggu

SEQ ID NO: 64033 - RNA, 21 nt, Human
agaguggcaaaguguccaaga

SEQ ID NO: 64034 - RNA, 22 nt, Human
agaguggcaccuuaccugagac

SEQ ID NO: 64035 - RNA, 22 nt, Human
agaguggcagcaaaaagugugc

SEQ ID NO: 64036 - RNA, 22 nt, Human
agaguggcccguuggccugaac

SEQ ID NO: 64037 - RNA, 22 nt, Human
agagugggcaggagccucgacu

SEQ ID NO: 64038 - RNA, 22 nt, Human
agagugggccuagcuguaaaag

SEQ ID NO: 64039 - RNA, 22 nt, Human
agaguguguggggcugagguca

SEQ ID NO: 64040 - RNA, 18 nt, Human
agaguguucucagugaaa

SEQ ID NO: 64041 - RNA, 22 nt, Human
agaguguuucagucuuccuaga

SEQ ID NO: 64042 - RNA, 22 nt, Human
agaguuauauugguugagaauu

SEQ ID NO: 64043 - RNA, 22 nt, Human
agaguuauggacuuaaugcagg

SEQ ID NO: 64044 - RNA, 22 nt, Human
agaguucuugcccuagaaaaug

SEQ ID NO: 64045 - RNA, 22 nt, Human
agaguuggccaaaaggggcauu

SEQ ID NO: 64046 - RNA, 22 nt, Human
agaguuuaccacuauuuuuggu

SEQ ID NO: 64047 - RNA, 22 nt, Human
agaguuucuugugagcacugac

SEQ ID NO: 64048 - RNA, 22 nt, Human
acucucugagcuaccaggugag

SEQ ID NO: 64049 - RNA, 22 nt, Human
acucucugguauuggcaaguuu

SEQ ID NO: 64050 - RNA, 22 nt, Human
acucugagaacugagauucccu

SEQ ID NO: 64051 - RNA, 22 nt, Human
acucugagcaucccaagucuua

SEQ ID NO: 64052 - RNA, 22 nt, Human
acucugaggagugacuagaggu

SEQ ID NO: 64053 - RNA, 22 nt, Human
acucugcaauguggcaagaaca

SEQ ID NO: 64054 - RNA, 21 nt, Human
acucugccagucuccugcacu

SEQ ID NO: 64055 - RNA, 22 nt, Human
acucugccaucccaggugcugu

SEQ ID NO: 64056 - RNA, 22 nt, Human
acucugccccgaguucugggaa

SEQ ID NO: 64057 - RNA, 22 nt, Human
acucugccugaaccuccugcaa

SEQ ID NO: 64058 - RNA, 22 nt, Human
acucugcuaucuuagcaaaagg

SEQ ID NO: 64059 - RNA, 22 nt, Human
acucugcucccuaagccaugau

SEQ ID NO: 64060 - RNA, 22 nt, Human
acucugcucuuuggacaaugcc

SEQ ID NO: 64061 - RNA, 22 nt, Human
acucugcuguuuacucucuaua

SEQ ID NO: 64062 - RNA, 22 nt, Human
acucugcuuaauuaaaaccagg

SEQ ID NO: 64063 - RNA, 22 nt, Human
acucugcuuccacuuuugcuaa

SEQ ID NO: 64064 - RNA, 22 nt, Human
acucugcuugggccauaucugg

SEQ ID NO: 64065 - RNA, 22 nt, Human
acucuggagauggaugucagga

SEQ ID NO: 64066 - RNA, 22 nt, Human
acucuggcacuggguaccucag

SEQ ID NO: 64067 - RNA, 22 nt, Human
acucuggcagcagaaccagugu

SEQ ID NO: 64068 - RNA, 22 nt, Human
acucuggggcgcuacuccaacu

SEQ ID NO: 64069 - RNA, 20 nt, Human
acucuguacugucaauguug

SEQ ID NO: 64070 - RNA, 22 nt, Human
acucuguagaucucccgggagc

SEQ ID NO: 64071 - RNA, 22 nt, Human
acucuguagauguggaaaugcg

SEQ ID NO: 64072 - RNA, 23 nt, Human
acucuguaggcuguccaugugca

SEQ ID NO: 64073 - RNA, 20 nt, Human
acucuguagguaaugagacu

SEQ ID NO: 64074 - RNA, 22 nt, Human
acucugugaagaugcaggcuug

SEQ ID NO: 64075 - RNA, 22 nt, Human
acucugugugaguagagccugu

SEQ ID NO: 64076 - RNA, 22 nt, Human
acuuguuuggucucauguuuaa

SEQ ID NO: 64077 - RNA, 22 nt, Human
acuuuacauuugaucucucuaa

SEQ ID NO: 64078 - RNA, 22 nt, Human
acuuuacuccccaacauaaaug

SEQ ID NO: 64079 - RNA, 22 nt, Human
acuuuagaaguaaggaugaguu

SEQ ID NO: 64080 - RNA, 22 nt, Human
acuuuagagaaauguagaagua

SEQ ID NO: 64081 - RNA, 22 nt, Human
acuuuagucuguuucauuaucu

SEQ ID NO: 64082 - RNA, 23 nt, Human
acuuuauccuauaucuuuguucu

SEQ ID NO: 64083 - RNA, 20 nt, Human
acuuuaugaguucaauuuug

SEQ ID NO: 64084 - RNA, 22 nt, Human
acuuuaugugcuugcucuuucc

SEQ ID NO: 64085 - RNA, 22 nt, Human
acuuucaaaagagaagucauga

SEQ ID NO: 64086 - RNA, 22 nt, Human
acuuucaacuuggugggagagc

SEQ ID NO: 64087 - RNA, 22 nt, Human
acuuucaagcaagaacacuuug

SEQ ID NO: 64088 - RNA, 22 nt, Human
acuuucaauuugcacuaaccua

SEQ ID NO: 64089 - RNA, 22 nt, Human
acuuucauguucauuuggaacc

SEQ ID NO: 64090 - RNA, 22 nt, Human
acuuucauuuguaauaaacuuc

SEQ ID NO: 64091 - RNA, 22 nt, Human
acuuucauuugugaagacugua

SEQ ID NO: 64092 - RNA, 22 nt, Human
acuuuccuggcccuguccucug

SEQ ID NO: 64093 - RNA, 22 nt, Human
acuuucuaggucucaguccuuu

SEQ ID NO: 64094 - RNA, 22 nt, Human
acuuucucaggaauucacagac

SEQ ID NO: 64095 - RNA, 19 nt, Human
acuuucuccaggaccuguu

SEQ ID NO: 64096 - RNA, 22 nt, Human
acuuucugccuuacaggagucc

SEQ ID NO: 64097 - RNA, 22 nt, Human
acuuucuguuagaugaauggau

SEQ ID NO: 64098 - RNA, 22 nt, Human
acuuucuucuacuacuuggaga

SEQ ID NO: 64099 - RNA, 22 nt, Human
acuuugaaaagacaguagcucu

SEQ ID NO: 64100 - RNA, 22 nt, Human
acuuugaaggggaacauuuuaa

SEQ ID NO: 64101 - RNA, 22 nt, Human
acuuugacagcauuuuaauuau

SEQ ID NO: 64102 - RNA, 22 nt, Human
acuuugcaaaauaaugcugauu

SEQ ID NO: 64103 - RNA, 22 nt, Human
acuuugcacuaaguuacucauu

SEQ ID NO: 64104 - RNA, 18 nt, Human
acuuugcaggcucccauu

SEQ ID NO: 64105 - RNA, 22 nt, Human
acuuugcugcagguuuaaagag

SEQ ID NO: 64106 - RNA, 22 nt, Human
acuuuggggaacuuuucuccuc

SEQ ID NO: 64107 - RNA, 22 nt, Human
acuuuggguaagccaggugcua

SEQ ID NO: 64108 - RNA, 22 nt, Human
acuuuggugcgaagucacuuua

SEQ ID NO: 64109 - RNA, 22 nt, Human
acuuugugcccaacagaaagaa

SEQ ID NO: 64110 - RNA, 22 nt, Human
acuuuguuuucaugaaacagcu

SEQ ID NO: 64111 - RNA, 22 nt, Human
acuuuuaaaugaguuucaguug

SEQ ID NO: 64112 - RNA, 22 nt, Human
acuuuuaaggggccuugauuua

SEQ ID NO: 64113 - RNA, 22 nt, Human
acuuuuaucaaggaagugaucu

SEQ ID NO: 64114 - RNA, 16 nt, Human
acuuuuccaccuuuuu

SEQ ID NO: 64115 - RNA, 22 nt, Human
acuuuuuaguuuccucaaacau

SEQ ID NO: 64116 - RNA, 22 nt, Human
acuuuuugcuggucucuuccau

SEQ ID NO: 64117 - RNA, 21 nt, Human
agaaaaacacgauauaagccc

SEQ ID NO: 64118 - RNA, 23 nt, Human
agaaaaacaggauuguguuccua

SEQ ID NO: 64119 - RNA, 19 nt, Human
agaaaaacugguacugcug

SEQ ID NO: 64120 - RNA, 22 nt, Human
agaaaaagucaaggaauuggac

SEQ ID NO: 64121 - RNA, 22 nt, Human
agaaaacucuacaucuguaugu

SEQ ID NO: 64122 - RNA, 22 nt, Human
agaaaacugcagaguagccuca

SEQ ID NO: 64123 - RNA, 22 nt, Human
agaaaacuggagccugggguug

SEQ ID NO: 64124 - RNA, 22 nt, Human
agaaaagcggucaggacccuca

SEQ ID NO: 64125 - RNA, 21 nt, Human
agaaaaguagaguuuucagag

SEQ ID NO: 64126 - RNA, 21 nt, Human
agaaaaguauuugaaucaaga

SEQ ID NO: 64127 - RNA, 22 nt, Human
agaaaauauucauugagaggcu

SEQ ID NO: 64128 - RNA, 22 nt, Human
agaaaauuagauuuuacugugu

SEQ ID NO: 64129 - RNA, 22 nt, Human
agaaaauuuaaagagacacaca

SEQ ID NO: 64130 - RNA, 22 nt, Human
agaaacaagguguagguugacc

SEQ ID NO: 64131 - RNA, 22 nt, Human
agaaacagaagggaaagcuuuu

SEQ ID NO: 64132 - RNA, 22 nt, Human
agaaacagcauuagcaucaauu

SEQ ID NO: 64133 - RNA, 22 nt, Human
agaaacauauucagugaguaau

SEQ ID NO: 64134 - RNA, 22 nt, Human
agaaacaucauuggaacacaag

SEQ ID NO: 64135 - RNA, 20 nt, Human
agaaacauuucuugagaacu

SEQ ID NO: 64136 - RNA, 22 nt, Human
agaaaccagggcuuaccagugc

SEQ ID NO: 64137 - RNA, 22 nt, Human
agaaacuaagucauaacucuuu

SEQ ID NO: 64138 - RNA, 22 nt, Human
agaaacuauccugaguagcaaa

SEQ ID NO: 64139 - RNA, 22 nt, Human
agaaacuauuaugguaaacaaa

SEQ ID NO: 64140 - RNA, 22 nt, Human
agaaacugcagcucagagaagu

SEQ ID NO: 64141 - RNA, 22 nt, Human
agaaacuucagcuauucuuuug

SEQ ID NO: 64142 - RNA, 22 nt, Human
agaaagagcucgggauuaacag

SEQ ID NO: 64143 - RNA, 22 nt, Human
agaaagaggaugcagaucucau

SEQ ID NO: 64144 - RNA, 22 nt, Human
agaaagcuggagucaagcagag

SEQ ID NO: 64145 - RNA, 22 nt, Human
agaaagggaacuggcaaagcca

SEQ ID NO: 64146 - RNA, 22 nt, Human
agaaagggagcguggaucaauu

SEQ ID NO: 64147 - RNA, 22 nt, Human
agaaagggcuauuuugagguag

SEQ ID NO: 64148 - RNA, 22 nt, Human
agaaaggucaaaaucgugacau

SEQ ID NO: 64149 - RNA, 22 nt, Human
agaaaguuagcagacucuuggc

SEQ ID NO: 64150 - RNA, 22 nt, Human
agaaaguucugugaguuguuca

SEQ ID NO: 64151 - RNA, 22 nt, Human
agaaaguuuauuccuaucuagc

SEQ ID NO: 64152 - RNA, 22 nt, Human
agaaauaaucagcuuaggggca

SEQ ID NO: 64153 - RNA, 22 nt, Human
agaaauacaaaguacuaagaua

SEQ ID NO: 64154 - RNA, 20 nt, Human
agaaauaccacauuuggcaa

SEQ ID NO: 64155 - RNA, 22 nt, Human
agaaauacugccuaagacugua

SEQ ID NO: 64156 - RNA, 22 nt, Human
agaaauagucacauuggaggaa

SEQ ID NO: 64157 - RNA, 22 nt, Human
agaaauaugcugauuagaugaa

SEQ ID NO: 64158 - RNA, 20 nt, Human
agaaauauugaguucagagg

SEQ ID NO: 64159 - RNA, 22 nt, Human
agaaaucaaugaagucugcuaa

SEQ ID NO: 64160 - RNA, 20 nt, Human
agaaaucagaccacacacua

SEQ ID NO: 64161 - RNA, 23 nt, Human
agaaaucaucuccaccccauguc

SEQ ID NO: 64162 - RNA, 22 nt, Human
agaaaucauucccaaacccaua

SEQ ID NO: 64163 - RNA, 22 nt, Human
agaaaucccaaggcaucaacca

SEQ ID NO: 64164 - RNA, 22 nt, Human
agaaauccugauggagucugaa

SEQ ID NO: 64165 - RNA, 22 nt, Human
agauuggguuugcuucugugcc

SEQ ID NO: 64166 - RNA, 22 nt, Human
agauuguagaaacuguagcauu

SEQ ID NO: 64167 - RNA, 22 nt, Human
agauugugucaauuucucuuua

SEQ ID NO: 64168 - RNA, 18 nt, Human
agauugugucuacaaauc

SEQ ID NO: 64169 - RNA, 22 nt, Human
agauuuaaauuugcuacaauuc

SEQ ID NO: 64170 - RNA, 22 nt, Human
agauuuagacugccuuaaucau

SEQ ID NO: 64171 - RNA, 22 nt, Human
agauuuauguggucacacucag

SEQ ID NO: 64172 - RNA, 22 nt, Human
agauuucaauggauauugcaag

SEQ ID NO: 64173 - RNA, 22 nt, Human
agauuucaaugugagcauuagu

SEQ ID NO: 64174 - RNA, 22 nt, Human
agauuucacaugcugcucuauu

SEQ ID NO: 64175 - RNA, 22 nt, Human
agauuucagaugcucggcaguu

SEQ ID NO: 64176 - RNA, 22 nt, Human
agauuucccucuuguauuugca

SEQ ID NO: 64177 - RNA, 22 nt, Human
agauuucucuuucccuggcuga

SEQ ID NO: 64178 - RNA, 22 nt, Human
agauuucuguggucauguaaug

SEQ ID NO: 64179 - RNA, 22 nt, Human
agauuugggggcuagggcuggu

SEQ ID NO: 64180 - RNA, 22 nt, Human
agauuuguaugucuaaauguaa

SEQ ID NO: 64181 - RNA, 22 nt, Human
agauuugucuuggucucaucug

SEQ ID NO: 64182 - RNA, 22 nt, Human
agauuuuaguuuggggaggugc

SEQ ID NO: 64183 - RNA, 22 nt, Human
agauuuuggcuggcuggagaga

SEQ ID NO: 64184 - RNA, 22 nt, Human
agcaaaauaagguaauuuauug

SEQ ID NO: 64185 - RNA, 22 nt, Human
agacuacauaugccacaugaag

SEQ ID NO: 64186 - RNA, 22 nt, Human
agacuacauuaugacagcauuu

SEQ ID NO: 64187 - RNA, 22 nt, Human
agacuauuaccuaaaagauaca

SEQ ID NO: 64188 - RNA, 22 nt, Human
agacuauuuugugauaacuaau

SEQ ID NO: 64189 - RNA, 22 nt, Human
agacucaagacugcagaagacg

SEQ ID NO: 64190 - RNA, 22 nt, Human
agacucaagcagauaggaauua

SEQ ID NO: 64191 - RNA, 22 nt, Human
agacuccaaaaguuugguggaa

SEQ ID NO: 64192 - RNA, 22 nt, Human
agacuccaggagggaggcugcu

SEQ ID NO: 64193 - RNA, 22 nt, Human
agacuccuucucacugccugua

SEQ ID NO: 64194 - RNA, 22 nt, Human
agacucugcauuucuaauaagc

SEQ ID NO: 64195 - RNA, 22 nt, Human
agacucugcuaagaauauaauu

SEQ ID NO: 64196 - RNA, 22 nt, Human
agacucuuggucauuggcauua

SEQ ID NO: 64197 - RNA, 22 nt, Human
agacugaaauagugcacaccaa

SEQ ID NO: 64198 - RNA, 23 nt, Human
agacugaggcugccagggucaga

SEQ ID NO: 64199 - RNA, 22 nt, Human
agacugggauucucccugauca

SEQ ID NO: 64200 - RNA, 22 nt, Human
agacugggccauuuccccagcu

SEQ ID NO: 64201 - RNA, 22 nt, Human
agacugguuuuuaacuucaccu

SEQ ID NO: 64202 - RNA, 17 nt, Human
agacuguacuguaaagc

SEQ ID NO: 64203 - RNA, 22 nt, Human
agacugugagaagauggcugcg

SEQ ID NO: 64204 - RNA, 21 nt, Human
agacuguggauuuugacaugu

SEQ ID NO: 64205 - RNA, 22 nt, Human
agacuguugccugaacuuagcc

SEQ ID NO: 64206 - RNA, 22 nt, Human
agacuuaggagcugacaucucu

SEQ ID NO: 64207 - RNA, 20 nt, Human
agacuuaggcaauuuaggcu

SEQ ID NO: 64208 - RNA, 22 nt, Human
agacuuaggugagauguuugua

SEQ ID NO: 64209 - RNA, 22 nt, Human
agacuucuaaauagcagcuucu

SEQ ID NO: 64210 - RNA, 22 nt, Human
agacuucucaguuuuauuagua

SEQ ID NO: 64211 - RNA, 23 nt, Human
agacuucuccaacaagcuuggcu

SEQ ID NO: 64212 - RNA, 22 nt, Human
agacuuuaucccuguuuuucuc

SEQ ID NO: 64213 - RNA, 21 nt, Human
agacuuugcuugcagagaguc

SEQ ID NO: 64214 - RNA, 19 nt, Human
agacuuuuguaaguugaga

SEQ ID NO: 64215 - RNA, 22 nt, Human
agagaaacaggucagcugggag

SEQ ID NO: 64216 - RNA, 22 nt, Human
agagaaacccuucaguguuuug

SEQ ID NO: 64217 - RNA, 18 nt, Human
agagaaagaccaaagcau

SEQ ID NO: 64218 - RNA, 23 nt, Human
agagaaagggauaacacguugaa

SEQ ID NO: 64219 - RNA, 21 nt, Human
agagaaagucauggcuguggc

SEQ ID NO: 64220 - RNA, 22 nt, Human
agagaaaguccugaucucucua

SEQ ID NO: 64221 - RNA, 22 nt, Human
agagaacagcauugcagcuuug

SEQ ID NO: 64222 - RNA, 22 nt, Human
agagaacauauuuuguaugauu

SEQ ID NO: 64223 - RNA, 22 nt, Human
agagaacaugacguaauagugg

SEQ ID NO: 64224 - RNA, 22 nt, Human
agagaacuacuuuuuauaugug

SEQ ID NO: 64225 - RNA, 22 nt, Human
agagaagacuuacagccacagu

SEQ ID NO: 64226 - RNA, 18 nt, Human
agagaagagguguuaguc

SEQ ID NO: 64227 - RNA, 22 nt, Human
agagaagcugacaggggcgugc

SEQ ID NO: 64228 - RNA, 22 nt, Human
agagaaggcauagaacuugagu

SEQ ID NO: 64229 - RNA, 22 nt, Human
agagaagggaagggauucaccc

SEQ ID NO: 64230 - RNA, 22 nt, Human
agagaaggucacuaaggaccca

SEQ ID NO: 64231 - RNA, 22 nt, Human
agagaauacaaagaagauaugu

SEQ ID NO: 64232 - RNA, 22 nt, Human
agagaaugcagggcuucggaca

SEQ ID NO: 64233 - RNA, 22 nt, Human
agagaauuaacauuccauggcu

SEQ ID NO: 64234 - RNA, 22 nt, Human
agagaauuaauuaggagcacug

SEQ ID NO: 64235 - RNA, 22 nt, Human
agagaauucuggugcuaacaag

SEQ ID NO: 64236 - RNA, 22 nt, Human
agagacaaugccaaugcacacg

SEQ ID NO: 64237 - RNA, 22 nt, Human
agagacacaucauauaaguaua

SEQ ID NO: 64238 - RNA, 22 nt, Human
agagacaccgcgcaucauggcu

SEQ ID NO: 64239 - RNA, 22 nt, Human
agagacaggguuuugccauguu

SEQ ID NO: 64240 - RNA, 22 nt, Human
agagacauggagaggcaaaguu

SEQ ID NO: 64241 - RNA, 22 nt, Human
agagaccaagggaauagucuca

SEQ ID NO: 64242 - RNA, 19 nt, Human
agagaccacagagcugccu

SEQ ID NO: 64243 - RNA, 21 nt, Human
agagaccagcuguuacuccca

SEQ ID NO: 64244 - RNA, 22 nt, Human
agagacccgcagccucggagcu

SEQ ID NO: 64245 - RNA, 22 nt, Human
agagacccuggaguucuucacu

SEQ ID NO: 64246 - RNA, 22 nt, Human
agagacuaagccagcauagugc

SEQ ID NO: 64247 - RNA, 22 nt, Human
agagacugauggaucaccaaau

SEQ ID NO: 64248 - RNA, 22 nt, Human
agagacugcaaugagugguagg

SEQ ID NO: 64249 - RNA, 22 nt, Human
agagacugcuuuauauuguacu

SEQ ID NO: 64250 - RNA, 22 nt, Human
agagacuguaaugagagguaca

SEQ ID NO: 64251 - RNA, 22 nt, Human
agagacuguguccaucgugccu

SEQ ID NO: 64252 - RNA, 17 nt, Human
agagagaaaagggccau

SEQ ID NO: 64253 - RNA, 22 nt, Human
agagagaacacccucggcaugg

SEQ ID NO: 64254 - RNA, 22 nt, Human
agagagcaguggaucaccuagc

SEQ ID NO: 64255 - RNA, 22 nt, Human
agagagcucugaugggagguga

SEQ ID NO: 64256 - RNA, 22 nt, Human
agagagcuuccauucuagugau

SEQ ID NO: 64257 - RNA, 22 nt, Human
agagaggauuuguuuuucuccu

SEQ ID NO: 64258 - RNA, 22 nt, Human
agagaggcugcuggacuauaug

SEQ ID NO: 64259 - RNA, 22 nt, Human
agagaggcugggcguagggcuu

SEQ ID NO: 64260 - RNA, 21 nt, Human
agagagggagaugaaacaucc

SEQ ID NO: 64261 - RNA, 22 nt, Human
agagagguuugcuggaagauuc

SEQ ID NO: 64262 - RNA, 22 nt, Human
agagagucuuucucuuccuguu

SEQ ID NO: 64263 - RNA, 22 nt, Human
agagaguucuuucuaguugaag

SEQ ID NO: 64264 - RNA, 22 nt, Human
agagaguugaggaagcaacacu

SEQ ID NO: 64265 - RNA, 22 nt, Human
agagauaugcugccuaaauuua

SEQ ID NO: 64266 - RNA, 22 nt, Human
agagaucaaagcuugccaagua

SEQ ID NO: 64267 - RNA, 22 nt, Human
agagaucugugcuuacuacaag

SEQ ID NO: 64268 - RNA, 22 nt, Human
agagaucuguggauucauuguc

SEQ ID NO: 64269 - RNA, 22 nt, Human
agagaugaagggcauuccccag

SEQ ID NO: 64270 - RNA, 22 nt, Human
agagaugcauucagcauggaug

SEQ ID NO: 64271 - RNA, 22 nt, Human
agagaugcgguuccaugguuau

SEQ ID NO: 64272 - RNA, 22 nt, Human
agagaugcugcccgcagacgug

SEQ ID NO: 64273 - RNA, 22 nt, Human
agagauggauguuauuaugggu

SEQ ID NO: 64274 - RNA, 22 nt, Human
agagauuacagcaggguccagc

SEQ ID NO: 64275 - RNA, 22 nt, Human
agagauuagccuggauuaugca

SEQ ID NO: 64276 - RNA, 22 nt, Human
agagauuccuuuggggaaagca

SEQ ID NO: 64277 - RNA, 22 nt, Human
agagauucugugucaaaacgaa

SEQ ID NO: 64278 - RNA, 21 nt, Human
acugugggucugaccaccugg

SEQ ID NO: 64279 - RNA, 22 nt, Human
acugugguuaccucuugucuua

SEQ ID NO: 64280 - RNA, 18 nt, Human
acugugguuuauguguag

SEQ ID NO: 64281 - RNA, 22 nt, Human
acugugugacuguuauuacugu

SEQ ID NO: 64282 - RNA, 20 nt, Human
acugugugaucuggaaagcu

SEQ ID NO: 64283 - RNA, 19 nt, Human
acuguguggaagugugauu

SEQ ID NO: 64284 - RNA, 21 nt, Human
acuguuaagacguagcugggg

SEQ ID NO: 64285 - RNA, 22 nt, Human
acuguuaugggugucagcuuaa

SEQ ID NO: 64286 - RNA, 22 nt, Human
acuguuauguuauuacccaugu

SEQ ID NO: 64287 - RNA, 22 nt, Human
acuguucauauucuuagaaauu

SEQ ID NO: 64288 - RNA, 22 nt, Human
acuguucauccuuuuugaacaa

SEQ ID NO: 64289 - RNA, 21 nt, Human
acuguucauuugaugaacugg

SEQ ID NO: 64290 - RNA, 22 nt, Human
acuguucauuuguccuguaucu

SEQ ID NO: 64291 - RNA, 22 nt, Human
acuguucuccuuuggcuauauc

SEQ ID NO: 64292 - RNA, 22 nt, Human
acuguugaagugccagcuugau

SEQ ID NO: 64293 - RNA, 23 nt, Human
acuguuggugcagaagugccuug

SEQ ID NO: 64294 - RNA, 22 nt, Human
caugggggcugaggcugcugua

SEQ ID NO: 64295 - RNA, 21 nt, Human
caugggguugcuauagcaaaa

SEQ ID NO: 64296 - RNA, 22 nt, Human
cauggugaggggugaagggcag

SEQ ID NO: 64297 - RNA, 22 nt, Human
caugguuuauuagagcuuauuu

SEQ ID NO: 64298 - RNA, 22 nt, Human
caugguuucaugagaauuaccc

SEQ ID NO: 64299 - RNA, 22 nt, Human
caugguuugaugacuggaagga

SEQ ID NO: 64300 - RNA, 22 nt, Human
cauguauacaguagaauacuau

SEQ ID NO: 64301 - RNA, 22 nt, Human
cauguauagguccauagugaau

SEQ ID NO: 64302 - RNA, 22 nt, Human
cauguaucccuaauuguguuaa

SEQ ID NO: 64303 - RNA, 22 nt, Human
caugucaaccaguuguuugaau

SEQ ID NO: 64304 - RNA, 22 nt, Human
cauguccuucucauugccucau

SEQ ID NO: 64305 - RNA, 18 nt, Human
caugucugcgccacaagg

SEQ ID NO: 64306 - RNA, 23 nt, Human
caugucugcuuucaugcuacaac

SEQ ID NO: 64307 - RNA, 22 nt, Human
caugucuuuguuaugcucacca

SEQ ID NO: 64308 - RNA, 22 nt, Human
caugugacaggagcagcucuaa

SEQ ID NO: 64309 - RNA, 22 nt, Human
caugugcauuggggccagggag

SEQ ID NO: 64310 - RNA, 22 nt, Human
caugugcuguagcagagaggaa

SEQ ID NO: 64311 - RNA, 22 nt, Human
cauguggauaugaauuguagaa

SEQ ID NO: 64312 - RNA, 22 nt, Human
cauguguaugcauucauacaua

SEQ ID NO: 64313 - RNA, 19 nt, Human
caugugucaauacuguacc

SEQ ID NO: 64314 - RNA, 21 nt, Human
caugugucauuggagagcaau

SEQ ID NO: 64315 - RNA, 22 nt, Human
cauguguccacccuugaacaca

SEQ ID NO: 64316 - RNA, 22 nt, Human
caugugugaguauaucuuaucc

SEQ ID NO: 64317 - RNA, 22 nt, Human
caugugugugagggaaacaugu

SEQ ID NO: 64318 - RNA, 22 nt, Human
cauguguguggacgagcguggc

SEQ ID NO: 64319 - RNA, 22 nt, Human
cauguuaaauugaguuugcaau

SEQ ID NO: 64320 - RNA, 22 nt, Human
cauguuaaugaauuuuugcagu

SEQ ID NO: 64321 - RNA, 22 nt, Human
cauguugaauggccuugauuuu

SEQ ID NO: 64322 - RNA, 22 nt, Human
cauguuuuguguacagaauauu

SEQ ID NO: 64323 - RNA, 23 nt, Human
cauguuuuucuaucucagcgugu

SEQ ID NO: 64324 - RNA, 22 nt, Human
cauuaaaauaucucaugguguu

SEQ ID NO: 64325 - RNA, 22 nt, Human
cauuacaaaguuauaaacaguu

SEQ ID NO: 64326 - RNA, 22 nt, Human
cauuacuucucaugcuucaugc

SEQ ID NO: 64327 - RNA, 23 nt, Human
cauuagaagguagaguggaauga

SEQ ID NO: 64328 - RNA, 22 nt, Human
cauuagauuggugcaaaaauaa

SEQ ID NO: 64329 - RNA, 22 nt, Human
cauuagcaaucauaaaccuuua

SEQ ID NO: 64330 - RNA, 22 nt, Human
cauuagcacucuaaggaagaga

SEQ ID NO: 64331 - RNA, 22 nt, Human
cauuagcaggcacuaagaaggu

SEQ ID NO: 64332 - RNA, 22 nt, Human
cauuagcuaucuguuuacauua

SEQ ID NO: 64333 - RNA, 19 nt, Human
cauuaggauuagagacaag

SEQ ID NO: 64334 - RNA, 22 nt, Human
cauuagggacugaggaauaagg

SEQ ID NO: 64335 - RNA, 22 nt, Human
cauuagguauuuaagcacacag

SEQ ID NO: 64336 - RNA, 22 nt, Human
cauuaucucuucuauaugcuag

SEQ ID NO: 64337 - RNA, 22 nt, Human
cauuaugugcguacauguaucu

SEQ ID NO: 64338 - RNA, 22 nt, Human
cauuaugugggaaaauguucuu

SEQ ID NO: 64339 - RNA, 22 nt, Human
cauuauguucaguagcuuaaaa

SEQ ID NO: 64340 - RNA, 22 nt, Human
cauuauuaauucagcacaugcu

SEQ ID NO: 64341 - RNA, 22 nt, Human
cauucaaaggcauguccuauuu

SEQ ID NO: 64342 - RNA, 22 nt, Human
cauucaaauuaagauuuuguua

SEQ ID NO: 64343 - RNA, 22 nt, Human
cauucacaaagcugauugaugg

SEQ ID NO: 64344 - RNA, 22 nt, Human
cauucacaacugagcauuguug

SEQ ID NO: 64345 - RNA, 22 nt, Human
cauucacaauggauugcuucaa

SEQ ID NO: 64346 - RNA, 22 nt, Human
cauucagagcuuucuuaucaua

SEQ ID NO: 64347 - RNA, 22 nt, Human
cauucauuagaauagauaugua

SEQ ID NO: 64348 - RNA, 22 nt, Human
cauuccaaggccaagucuaaga

SEQ ID NO: 64349 - RNA, 22 nt, Human
cauuccaaguauauacaugaua

SEQ ID NO: 64350 - RNA, 22 nt, Human
cauucccuuggggaguucaugc

SEQ ID NO: 64351 - RNA, 22 nt, Human
cauuccgcuccccuuccuugcg

SEQ ID NO: 64352 - RNA, 22 nt, Human
cauuccuacaugauaagaauua

SEQ ID NO: 64353 - RNA, 19 nt, Human
cauuccuuugucugccaaa

SEQ ID NO: 64354 - RNA, 22 nt, Human
cauucggagguaguugagguua

SEQ ID NO: 64355 - RNA, 22 nt, Human
cauucguggcccucuggauaag

SEQ ID NO: 64356 - RNA, 22 nt, Human
cauucucugaucuucacauacc

SEQ ID NO: 64357 - RNA, 22 nt, Human
cauucugagucacucuuuagca

SEQ ID NO: 64358 - RNA, 22 nt, Human
cauggcuucuaagugauaacgu

SEQ ID NO: 64359 - RNA, 22 nt, Human
cauggcuugcuaguggcccaag

SEQ ID NO: 64360 - RNA, 22 nt, Human
cauggcuuuccaguccuccacu

SEQ ID NO: 64361 - RNA, 22 nt, Human
cauggcuuucccucaagagcaa

SEQ ID NO: 64362 - RNA, 22 nt, Human
cauggcuuuguucauauaauuu

SEQ ID NO: 64363 - RNA, 22 nt, Human
caugggagcuaucuccaucacu

SEQ ID NO: 64364 - RNA, 22 nt, Human
caugggaggccugcugcuggug

SEQ ID NO: 64365 - RNA, 22 nt, Human
caugggccauggugaagccagg

SEQ ID NO: 64366 - RNA, 22 nt, Human
caugggcuacagaagcaugcug

SEQ ID NO: 64367 - RNA, 22 nt, Human
cauggguaagacucuuuugccc

SEQ ID NO: 64368 - RNA, 18 nt, Human
caugggugacagguggau

SEQ ID NO: 64369 - RNA, 22 nt, Human
cauggucuacaauuucauuuua

SEQ ID NO: 64370 - RNA, 22 nt, Human
caugguuuugagccuauuaugc

SEQ ID NO: 64371 - RNA, 22 nt, Human
caugguuuuuacccuacaccau

SEQ ID NO: 64372 - RNA, 22 nt, Human
cauguaaaaaauuaggucaucu

SEQ ID NO: 64373 - RNA, 22 nt, Human
cauguaaaaagaagaaucugga

SEQ ID NO: 64374 - RNA, 22 nt, Human
cauguaaaacacucagaacagu

SEQ ID NO: 64375 - RNA, 22 nt, Human
cauguaaagcacuucauaacag

SEQ ID NO: 64376 - RNA, 22 nt, Human
cauguaaagcauccuucuaggg

SEQ ID NO: 64377 - RNA, 22 nt, Human
cauguaaauccuucuuuaggcc

SEQ ID NO: 64378 - RNA, 22 nt, Human
cauguacaaaaggcaaaugccu

SEQ ID NO: 64379 - RNA, 22 nt, Human
cauguacacucauguaacuaua

SEQ ID NO: 64380 - RNA, 22 nt, Human
cauguacaguuuuucuguccug

SEQ ID NO: 64381 - RNA, 22 nt, Human
cauguacaugcaugggcacugu

SEQ ID NO: 64382 - RNA, 22 nt, Human
cauguauauuucuguaugugca

SEQ ID NO: 64383 - RNA, 22 nt, Human
cauguauauuuuauguggagag

SEQ ID NO: 64384 - RNA, 22 nt, Human
cauguauugaagugugcaucug

SEQ ID NO: 64385 - RNA, 22 nt, Human
caugucacuuuaacaaauuagu

SEQ ID NO: 64386 - RNA, 22 nt, Human
caugucagggaagagagucagu

SEQ ID NO: 64387 - RNA, 22 nt, Human
caugucccaaaugcaggcaaag

SEQ ID NO: 64388 - RNA, 22 nt, Human
caugucuuaggaaagcagagga

SEQ ID NO: 64389 - RNA, 22 nt, Human
caugucuuccuugcacacacac

SEQ ID NO: 64390 - RNA, 22 nt, Human
caugucuuggcuuaggcacaga

SEQ ID NO: 64391 - RNA, 22 nt, Human
caugugaauuccaaagcuaggu

SEQ ID NO: 64392 - RNA, 22 nt, Human
caugugcagacucugacaggcu

SEQ ID NO: 64393 - RNA, 22 nt, Human
caugugcauccuuaaucucccu

SEQ ID NO: 64394 - RNA, 22 nt, Human
caugugggacaaucucagguau

SEQ ID NO: 64395 - RNA, 22 nt, Human
cauguguagguauacaaaauuc

SEQ ID NO: 64396 - RNA, 22 nt, Human
cauguguagugaaauaagcagu

SEQ ID NO: 64397 - RNA, 17 nt, Human
cauguguaugugggagu

SEQ ID NO: 64398 - RNA, 22 nt, Human
caugugucaaaugauguagcug

SEQ ID NO: 64399 - RNA, 22 nt, Human
caugugucacagccuuuuauug

SEQ ID NO: 64400 - RNA, 20 nt, Human
caugugucaguucucaccca

SEQ ID NO: 64401 - RNA, 22 nt, Human
caugugugacaaacugccugca

SEQ ID NO: 64402 - RNA, 23 nt, Human
caugugugacaguaucacuguuu

SEQ ID NO: 64403 - RNA, 22 nt, Human
cauuucaaaagaauugccagaa

SEQ ID NO: 64404 - RNA, 22 nt, Human
cauuucaauacaguuuguaaau

SEQ ID NO: 64405 - RNA, 22 nt, Human
cauuucaauacuaucugagaau

SEQ ID NO: 64406 - RNA, 22 nt, Human
cauuucacaaauggccacauca

SEQ ID NO: 64407 - RNA, 22 nt, Human
cauuucacacauaaacuugggu

SEQ ID NO: 64408 - RNA, 22 nt, Human
cauuucacgcacacucauuacu

SEQ ID NO: 64409 - RNA, 22 nt, Human
cauuucauaguugucacaauaa

SEQ ID NO: 64410 - RNA, 22 nt, Human
cauuucauuccuuugaaagugg

SEQ ID NO: 64411 - RNA, 20 nt, Human
cauuucauugugucuucacu

SEQ ID NO: 64412 - RNA, 22 nt, Human
cauuuccuuccugcugcuccuc

SEQ ID NO: 64413 - RNA, 22 nt, Human
cauuucuacagcuucuucagaa

SEQ ID NO: 64414 - RNA, 22 nt, Human
cauuucuagggaucauaaagua

SEQ ID NO: 64415 - RNA, 23 nt, Human
cauuucuagguguguuuggccau

SEQ ID NO: 64416 - RNA, 22 nt, Human
cauuucucacuccagcaacuuu

SEQ ID NO: 64417 - RNA, 22 nt, Human
cauuucugauuacagaauacua

SEQ ID NO: 64418 - RNA, 23 nt, Human
cauuucugggagauuuauaaaau

SEQ ID NO: 64419 - RNA, 22 nt, Human
cauuucugucacguucuuuuau

SEQ ID NO: 64420 - RNA, 22 nt, Human
cauuugaaaccuggaaucuacc

SEQ ID NO: 64421 - RNA, 22 nt, Human
cauuugaagaagaaacguacua

SEQ ID NO: 64422 - RNA, 22 nt, Human
cauuugaagacuuagaagagga

SEQ ID NO: 64423 - RNA, 22 nt, Human
cauuugaauuguucugugggaa

SEQ ID NO: 64424 - RNA, 22 nt, Human
cauuugaucuccugaauaaaca

SEQ ID NO: 64425 - RNA, 22 nt, Human
cauuugaugacucaacucauaa

SEQ ID NO: 64426 - RNA, 22 nt, Human
cauuugcagagggugacacucu

SEQ ID NO: 64427 - RNA, 22 nt, Human
cauuugcuagcaggccuuuuau

SEQ ID NO: 64428 - RNA, 22 nt, Human
cauuugcucugugucaguggca

SEQ ID NO: 64429 - RNA, 17 nt, Human
cauuugcugguuggcuc

SEQ ID NO: 64430 - RNA, 22 nt, Human
cauuugcuuccugggucuugaa

SEQ ID NO: 64431 - RNA, 22 nt, Human
cauuuggccauuccagucacau

SEQ ID NO: 64432 - RNA, 22 nt, Human
cauuuguaagcauggcguugga

SEQ ID NO: 64433 - RNA, 22 nt, Human
cauuuguaauacugacuugcag

SEQ ID NO: 64434 - RNA, 22 nt, Human
cauuuguaggaugcuucuuguu

SEQ ID NO: 64435 - RNA, 22 nt, Human
cauuuguaguaucuguuuauau

SEQ ID NO: 64436 - RNA, 22 nt, Human
cauuuguaucauauguaucuua

SEQ ID NO: 64437 - RNA, 22 nt, Human
cauuuguaucugggcugcugug

SEQ ID NO: 64438 - RNA, 22 nt, Human
cauuugugcuuuuauaaaauag

SEQ ID NO: 64439 - RNA, 22 nt, Human
cauuugugugggaacccaucag

SEQ ID NO: 64440 - RNA, 20 nt, Human
cauuuguuagcuuucuacug

SEQ ID NO: 64441 - RNA, 22 nt, Human
cauuuguucugauuucaaaagg

SEQ ID NO: 64442 - RNA, 22 nt, Human
cauuuuaaaugauuuaagccaa

SEQ ID NO: 64443 - RNA, 22 nt, Human
cauuuuacgacauagggcaggc

SEQ ID NO: 64444 - RNA, 22 nt, Human
cauuuuauguuuauggagugcu

SEQ ID NO: 64445 - RNA, 22 nt, Human
cauuuucaugaguuucuguuca

SEQ ID NO: 64446 - RNA, 23 nt, Human
ccaaaagcgagucuguuguuccc

SEQ ID NO: 64447 - RNA, 22 nt, Human
ccaaacuguuucguauuuaugc

SEQ ID NO: 64448 - RNA, 22 nt, Human
ccaaagaaacccaagcucaggg

SEQ ID NO: 64449 - RNA, 22 nt, Human
ccaaagagcuagaauuauaggc

SEQ ID NO: 64450 - RNA, 19 nt, Human
ccaaaggaaguuucccucc

SEQ ID NO: 64451 - RNA, 22 nt, Human
ccaaaggaugucccuguguuuu

SEQ ID NO: 64452 - RNA, 22 nt, Human
ccaaaggccaagcucagguaaa

SEQ ID NO: 64453 - RNA, 22 nt, Human
ccaaaguaaggcaauuccuaaa

SEQ ID NO: 64454 - RNA, 22 nt, Human
ccaaaguauuaaaucuuagcaa

SEQ ID NO: 64455 - RNA, 22 nt, Human
ccaaaguccauaguuuacuuua

SEQ ID NO: 64456 - RNA, 22 nt, Human
ccaaagugauaugugcuguaag

SEQ ID NO: 64457 - RNA, 22 nt, Human
ccaaagugugggagaagaggua

SEQ ID NO: 64458 - RNA, 22 nt, Human
ccaaauagucuuucauugaauu

SEQ ID NO: 64459 - RNA, 22 nt, Human
ccaaaucaccagcacgaucauu

SEQ ID NO: 64460 - RNA, 22 nt, Human
ccaaaugcuccacugacuuugg

SEQ ID NO: 64461 - RNA, 22 nt, Human
ccaaauucuguguucaaacuca

SEQ ID NO: 64462 - RNA, 19 nt, Human
ccaacaguacugaagcacu

SEQ ID NO: 64463 - RNA, 22 nt, Human
ccaacucugaaaauccagauau

SEQ ID NO: 64464 - RNA, 20 nt, Human
ccaagagcaugcaugaggaa

SEQ ID NO: 64465 - RNA, 22 nt, Human
ccaagagguugaggcugcagug

SEQ ID NO: 64466 - RNA, 22 nt, Human
ccaagauaagagacaagauuua

SEQ ID NO: 64467 - RNA, 22 nt, Human
ccaagaugagcuggcuccaugg

SEQ ID NO: 64468 - RNA, 22 nt, Human
ccaagcagucugcuaggaguuu

SEQ ID NO: 64469 - RNA, 22 nt, Human
ccaagcuggauuuagcugcaca

SEQ ID NO: 64470 - RNA, 22 nt, Human
ccaagcuucuuuccuacuacag

SEQ ID NO: 64471 - RNA, 22 nt, Human
ccaaggacuggacacacagguu

SEQ ID NO: 64472 - RNA, 22 nt, Human
ccaaggagaaaugcugugcuuu

SEQ ID NO: 64473 - RNA, 22 nt, Human
ccaaggagaaugacaccaugga

SEQ ID NO: 64474 - RNA, 22 nt, Human
ccaaggagcaaguuuacaccug

SEQ ID NO: 64475 - RNA, 20 nt, Human
cauuggcauucacagaagcu

SEQ ID NO: 64476 - RNA, 22 nt, Human
cauugguugucauggcaggagg

SEQ ID NO: 64477 - RNA, 22 nt, Human
cauuguauugaggauacuuaag

SEQ ID NO: 64478 - RNA, 22 nt, Human
cauugucacccaaagcucauag

SEQ ID NO: 64479 - RNA, 22 nt, Human
cauuguguauuucuguaguacu

SEQ ID NO: 64480 - RNA, 22 nt, Human
cauuguuaccaucuuuuaccua

SEQ ID NO: 64481 - RNA, 22 nt, Human
cauuguucaacacugacuugca

SEQ ID NO: 64482 - RNA, 22 nt, Human
cauuguuuguaaaauuccagua

SEQ ID NO: 64483 - RNA, 22 nt, Human
cauuuaaagguuguggguaaaa

SEQ ID NO: 64484 - RNA, 22 nt, Human
cauuuaagagaaauauuuaguu

SEQ ID NO: 64485 - RNA, 22 nt, Human
cauuuacauaacaguaacgcug

SEQ ID NO: 64486 - RNA, 22 nt, Human
cauuuacuuaaaucuuuacaag

SEQ ID NO: 64487 - RNA, 20 nt, Human
cauuuagaaauuggcaugga

SEQ ID NO: 64488 - RNA, 19 nt, Human
cauuuagaaguacauauua

SEQ ID NO: 64489 - RNA, 22 nt, Human
cauuuagagaagauuacaagga

SEQ ID NO: 64490 - RNA, 22 nt, Human
cauuuagagucuugcaauuuua

SEQ ID NO: 64491 - RNA, 22 nt, Human
cauuuaguccuugacuucucuc

SEQ ID NO: 64492 - RNA, 22 nt, Human
cauuuauuggcauguaguaggu

SEQ ID NO: 64493 - RNA, 22 nt, Human
cauuuauugguuaggccagcag

SEQ ID NO: 64494 - RNA, 23 nt, Human
cauuucaacgaauuuuccuucug

SEQ ID NO: 64495 - RNA, 22 nt, Human
cauuucaaguaacagauugcuu

SEQ ID NO: 64496 - RNA, 22 nt, Human
cauuucacaguaaagugauuuc

SEQ ID NO: 64497 - RNA, 22 nt, Human
cauuucacaguauauucaaaau

SEQ ID NO: 64498 - RNA, 22 nt, Human
cauuucacuauucacuaaaagg

SEQ ID NO: 64499 - RNA, 22 nt, Human
cauuucaguguuauucuaauuu

SEQ ID NO: 64500 - RNA, 22 nt, Human
cauuuccacucugggagucaga

SEQ ID NO: 64501 - RNA, 22 nt, Human
cauuucuaagaagaucugggua

SEQ ID NO: 64502 - RNA, 22 nt, Human
cauuucuaagaaggcugcacau

SEQ ID NO: 64503 - RNA, 22 nt, Human
cauuucuaccaaaugugacugg

SEQ ID NO: 64504 - RNA, 22 nt, Human
cauuucuagagucccaagaggu

SEQ ID NO: 64505 - RNA, 22 nt, Human
cauuucuauggcaaugggaaaa

SEQ ID NO: 64506 - RNA, 21 nt, Human
cauuucuauugaugagaaaag

SEQ ID NO: 64507 - RNA, 22 nt, Human
cauuucugggagacaugcuaga

SEQ ID NO: 64508 - RNA, 22 nt, Human
cauuucuguacauguuuuggug

SEQ ID NO: 64509 - RNA, 22 nt, Human
cauuucugugacacuuccaucu

SEQ ID NO: 64510 - RNA, 22 nt, Human
cauuugaaauaguucauucuug

SEQ ID NO: 64511 - RNA, 22 nt, Human
cauuugaaauucuuagaacaaa

SEQ ID NO: 64512 - RNA, 20 nt, Human
cuuagaagggacauccuggg

SEQ ID NO: 64513 - RNA, 22 nt, Human
cuuagaauaaaagggggcuaua

SEQ ID NO: 64514 - RNA, 22 nt, Human
cuuagaauuuuaauccagaaag

SEQ ID NO: 64515 - RNA, 22 nt, Human
cuuagacauggcagcuccaagu

SEQ ID NO: 64516 - RNA, 22 nt, Human
cuuagaguuauggaaauguuga

SEQ ID NO: 64517 - RNA, 22 nt, Human
cuuagcaagaaucagcugcugg

SEQ ID NO: 64518 - RNA, 22 nt, Human
cuuagcaagcauucaagugccu

SEQ ID NO: 64519 - RNA, 22 nt, Human
cuuagcaaggcugccuggagaa

SEQ ID NO: 64520 - RNA, 22 nt, Human
cuuagcuucauuauugguggcc

SEQ ID NO: 64521 - RNA, 20 nt, Human
cuuagcuucuaagguucugg

SEQ ID NO: 64522 - RNA, 22 nt, Human
cuuaggaagcgggaccugugca

SEQ ID NO: 64523 - RNA, 22 nt, Human
cuuaggaauauccacagcaggu

SEQ ID NO: 64524 - RNA, 22 nt, Human
cuuaggcauccaggguucuucc

SEQ ID NO: 64525 - RNA, 22 nt, Human
cuuaguuugcaugauuauggag

SEQ ID NO: 64526 - RNA, 22 nt, Human
cuuaguuuuugcccuggaguuu

SEQ ID NO: 64527 - RNA, 22 nt, Human
cuuauacauaaaauggguguag

SEQ ID NO: 64528 - RNA, 22 nt, Human
cuuauagaauuagagagauuuu

SEQ ID NO: 64529 - RNA, 22 nt, Human
cuuauagauggcgaucuucuug

SEQ ID NO: 64530 - RNA, 22 nt, Human
cuuaucugagaaagaugcuaca

SEQ ID NO: 64531 - RNA, 22 nt, Human
cuuaucuguaaaauggauacaa

SEQ ID NO: 64532 - RNA, 22 nt, Human
cuuaugauucaaauaggaucuu

SEQ ID NO: 64533 - RNA, 22 nt, Human
cuuaugcugagaaugaaagaau

SEQ ID NO: 64534 - RNA, 22 nt, Human
cuuauggaagaaaccucagaga

SEQ ID NO: 64535 - RNA, 22 nt, Human
cuuauguacacacauauauugu

SEQ ID NO: 64536 - RNA, 22 nt, Human
cuuauguaugcuacuuuguggu

SEQ ID NO: 64537 - RNA, 22 nt, Human
cuuauuaauggaauccuaauga

SEQ ID NO: 64538 - RNA, 22 nt, Human
cuuauuauaaaauccuguuuga

SEQ ID NO: 64539 - RNA, 21 nt, Human
cuuauucacuguuauuuauca

SEQ ID NO: 64540 - RNA, 22 nt, Human
cuuauucagcaaguuuggguac

SEQ ID NO: 64541 - RNA, 22 nt, Human
cuuauuguccugacucauggcc

SEQ ID NO: 64542 - RNA, 22 nt, Human
cuuauugugucuuugaauaagu

SEQ ID NO: 64543 - RNA, 22 nt, Human
cuuauuuacugauccacagaug

SEQ ID NO: 64544 - RNA, 22 nt, Human
cuuauuugaauguaugaguuuu

SEQ ID NO: 64545 - RNA, 22 nt, Human
cuuauuugagagaaaagaaacu

SEQ ID NO: 64546 - RNA, 22 nt, Human
cuucaaacacuagaaacacagg

SEQ ID NO: 64547 - RNA, 22 nt, Human
cuucaaagggucacuauuuauc

SEQ ID NO: 64548 - RNA, 22 nt, Human
cuucaaauccuguguagggcua

SEQ ID NO: 64549 - RNA, 22 nt, Human
cuucaacauacacagagagagg

SEQ ID NO: 64550 - RNA, 22 nt, Human
cuucaaggccuuccagguugaa

SEQ ID NO: 64551 - RNA, 22 nt, Human
cuucaaguccagcucaugcucu

SEQ ID NO: 64552 - RNA, 22 nt, Human
cuucaagucgccaaaugcugaa

SEQ ID NO: 64553 - RNA, 22 nt, Human
cuucaaguugucugaggguggg

SEQ ID NO: 64554 - RNA, 21 nt, Human
cuucaauucaacacugccaug

SEQ ID NO: 64555 - RNA, 22 nt, Human
cuucaauuuuugguaugaugga

SEQ ID NO: 64556 - RNA, 22 nt, Human
cuucacaaagcucucuuuaugu

SEQ ID NO: 64557 - RNA, 22 nt, Human
cuucacaacgacaucugguuag

SEQ ID NO: 64558 - RNA, 22 nt, Human
cuucacaauucuaacagggcaa

SEQ ID NO: 64559 - RNA, 22 nt, Human
cuucacacccacuaaaaugaug

SEQ ID NO: 64560 - RNA, 22 nt, Human
cuucacaguauaggucccugag

SEQ ID NO: 64561 - RNA, 22 nt, Human
cuucacauaaacaaagggccau

SEQ ID NO: 64562 - RNA, 22 nt, Human
cuucacaugauguccgugcugu

SEQ ID NO: 64563 - RNA, 22 nt, Human
cuucacauuaguuuggaucaaa

SEQ ID NO: 64564 - RNA, 22 nt, Human
cuucacauugggcuugauauga

SEQ ID NO: 64565 - RNA, 22 nt, Human
cuucacugaugggacagcucaa

SEQ ID NO: 64566 - RNA, 22 nt, Human
cuucacugcagucauggcucug

SEQ ID NO: 64567 - RNA, 22 nt, Human
cuucacuguuugguucacagca

SEQ ID NO: 64568 - RNA, 22 nt, Human
cuucagaacuauaaaaaguacu

SEQ ID NO: 64569 - RNA, 22 nt, Human
cuucagagcaucacuucagcug

SEQ ID NO: 64570 - RNA, 22 nt, Human
cuucagagcuuguuaaaacugu

SEQ ID NO: 64571 - RNA, 22 nt, Human
cuucagcaccauagcuccuucu

SEQ ID NO: 64572 - RNA, 22 nt, Human
cuucagcagccucuugcauaaa

SEQ ID NO: 64573 - RNA, 22 nt, Human
cuucagccagcuggggaugcgg

SEQ ID NO: 64574 - RNA, 22 nt, Human
cuucagccucaucucagcccgu

SEQ ID NO: 64575 - RNA, 22 nt, Human
cuucagccucguuacuccugcg

SEQ ID NO: 64576 - RNA, 22 nt, Human
cuucagcugcaguuauguuuag

SEQ ID NO: 64577 - RNA, 22 nt, Human
cuucagcuguggucuccaaggc

SEQ ID NO: 64578 - RNA, 22 nt, Human
cuucagcuuucagcuucccuga

SEQ ID NO: 64579 - RNA, 22 nt, Human
cuucagggaggagcauggguuc

SEQ ID NO: 64580 - RNA, 22 nt, Human
cuucagugaauguugaguaagg

SEQ ID NO: 64581 - RNA, 22 nt, Human
cuucagugacagccacccaggc

SEQ ID NO: 64582 - RNA, 22 nt, Human
cuucagugauauaggcuucucc

SEQ ID NO: 64583 - RNA, 22 nt, Human
cuucaguggucauuugugauaa

SEQ ID NO: 64584 - RNA, 22 nt, Human
cuucaguguccucucuaguaga

SEQ ID NO: 64585 - RNA, 22 nt, Human
cuucaguguugguucauuacga

SEQ ID NO: 64586 - RNA, 22 nt, Human
cuucauacaauuuuuugacaua

SEQ ID NO: 64587 - RNA, 22 nt, Human
cuucaugagacuccacugccau

SEQ ID NO: 64588 - RNA, 23 nt, Human
cuucaugagagcccugaggaaaa

SEQ ID NO: 64589 - RNA, 22 nt, Human
cuucaugaggguaaucuacaaa

SEQ ID NO: 64590 - RNA, 22 nt, Human
cuucaugauccuaccacauuga

SEQ ID NO: 64591 - RNA, 22 nt, Human
cuucaugcucccauuuccuaca

SEQ ID NO: 64592 - RNA, 22 nt, Human
cuucaugcugauauccucgaug

SEQ ID NO: 64593 - RNA, 22 nt, Human
cuucauguucugccuguggaag

SEQ ID NO: 64594 - RNA, 22 nt, Human
cuucauuaacuauuggaaugca

SEQ ID NO: 64595 - RNA, 22 nt, Human
cuuccaaacccaggguaugggc

SEQ ID NO: 64596 - RNA, 22 nt, Human
cuuccaaagcacuuuauggacc

SEQ ID NO: 64597 - RNA, 22 nt, Human
cuuccaaauguaaauaaguuuc

SEQ ID NO: 64598 - RNA, 22 nt, Human
cuuccaagaugaacagcaagcg

SEQ ID NO: 64599 - RNA, 20 nt, Human
cuuccacacaagaagcacag

SEQ ID NO: 64600 - RNA, 20 nt, Human
cuuccaccagggccgcugau

SEQ ID NO: 64601 - RNA, 22 nt, Human
cuuccagagauagggccucaag

SEQ ID NO: 64602 - RNA, 22 nt, Human
cuuccagguaggccuaaggcag

SEQ ID NO: 64603 - RNA, 22 nt, Human
cuuccagguccuucuugagaag

SEQ ID NO: 64604 - RNA, 22 nt, Human
cuuccagguucugguugggaag

SEQ ID NO: 64605 - RNA, 22 nt, Human
cuuccagucuuuucaguggagu

SEQ ID NO: 64606 - RNA, 22 nt, Human
cuuccagugcauagguagauca

SEQ ID NO: 64607 - RNA, 22 nt, Human
cuuccaguggcaccaacaugca

SEQ ID NO: 64608 - RNA, 22 nt, Human
cuucccaagacuguauugcaag

SEQ ID NO: 64609 - RNA, 22 nt, Human
cuucccacuaguaucacagagc

SEQ ID NO: 64610 - RNA, 22 nt, Human
cuucccagaacaauguaggcuu

SEQ ID NO: 64611 - RNA, 22 nt, Human
cuucccagaccuuagagugcag

SEQ ID NO: 64612 - RNA, 22 nt, Human
cuucccagacgggguggcagcc

SEQ ID NO: 64613 - RNA, 22 nt, Human
cuucccagcaccucagucuggc

SEQ ID NO: 64614 - RNA, 22 nt, Human
cuuccccaaguagagaggggag

SEQ ID NO: 64615 - RNA, 19 nt, Human
cuuccccuguuaccucacu

SEQ ID NO: 64616 - RNA, 22 nt, Human
cuucccugguguuagcccaaug

SEQ ID NO: 64617 - RNA, 22 nt, Human
cuucccuuccccucacggagac

SEQ ID NO: 64618 - RNA, 22 nt, Human
cuucccuucugcagaucuuugg

SEQ ID NO: 64619 - RNA, 22 nt, Human
cuucccuuuuuaugucuucagc

SEQ ID NO: 64620 - RNA, 22 nt, Human
cuuccucaugugcaaugcaagc

SEQ ID NO: 64621 - RNA, 22 nt, Human
ccauuuguaccauuucuuugua

SEQ ID NO: 64622 - RNA, 22 nt, Human
ccauuuguauuacugccccagg

SEQ ID NO: 64623 - RNA, 22 nt, Human
ccauuugugguuuauuugcucu

SEQ ID NO: 64624 - RNA, 22 nt, Human
ccauuuuucacaagacucacuu

SEQ ID NO: 64625 - RNA, 22 nt, Human
ccauuuuugacagaaggccuaa

SEQ ID NO: 64626 - RNA, 22 nt, Human
cccaaagcagggucauugggcc

SEQ ID NO: 64627 - RNA, 22 nt, Human
ccagccaguauauuccaaagcc

SEQ ID NO: 64628 - RNA, 22 nt, Human
ccagccagucccgcaugaccgc

SEQ ID NO: 64629 - RNA, 22 nt, Human
ccagccaugcacaaaccaugag

SEQ ID NO: 64630 - RNA, 22 nt, Human
ccagcccaaagucaccccggga

SEQ ID NO: 64631 - RNA, 21 nt, Human
ccagcccagccuccuucucuu

SEQ ID NO: 64632 - RNA, 21 nt, Human
ccagcccagcugugucccagc

SEQ ID NO: 64633 - RNA, 22 nt, Human
ccagccccuauccucgcuccac

SEQ ID NO: 64634 - RNA, 22 nt, Human
ccagcccgaaucccuaaagcaa

SEQ ID NO: 64635 - RNA, 17 nt, Human
ccagcccucgcgcuuuu

SEQ ID NO: 64636 - RNA, 22 nt, Human
ccagcccucgguagucccauag

SEQ ID NO: 64637 - RNA, 22 nt, Human
ccagcccugaacccugcugcau

SEQ ID NO: 64638 - RNA, 22 nt, Human
ccagcccugccucucagggccc

SEQ ID NO: 64639 - RNA, 22 nt, Human
ccagcccuugaggucuguccau

SEQ ID NO: 64640 - RNA, 22 nt, Human
ccagccucacuggcaucaccua

SEQ ID NO: 64641 - RNA, 22 nt, Human
ccagccuccauguagauagcug

SEQ ID NO: 64642 - RNA, 23 nt, Human
ccagccucugggucuucauccag

SEQ ID NO: 64643 - RNA, 22 nt, Human
ccagccugguucagaauuggcu

SEQ ID NO: 64644 - RNA, 22 nt, Human
ccagccuucugggacucucauc

SEQ ID NO: 64645 - RNA, 19 nt, Human
ccagccuuuccagugauug

SEQ ID NO: 64646 - RNA, 22 nt, Human
ccagccuuugcaucccccaucu

SEQ ID NO: 64647 - RNA, 23 nt, Human
ccagcgcucacucagagcauguu

SEQ ID NO: 64648 - RNA, 22 nt, Human
ccagcucaagcacugugugaag

SEQ ID NO: 64649 - RNA, 22 nt, Human
ccagcucauauuuuaugugcag

SEQ ID NO: 64650 - RNA, 23 nt, Human
ccagcucauccauuaccucucuu

SEQ ID NO: 64651 - RNA, 22 nt, Human
ccagcucaucucagugaaaugc

SEQ ID NO: 64652 - RNA, 22 nt, Human
ccagcuccacugucagaugaga

SEQ ID NO: 64653 - RNA, 22 nt, Human
ccagcucuagccccauguggcu

SEQ ID NO: 64654 - RNA, 22 nt, Human
ccagcucucagcgggagacuca

SEQ ID NO: 64655 - RNA, 22 nt, Human
ccagcucugauuuugaccucca

SEQ ID NO: 64656 - RNA, 22 nt, Human
ccagcucugcagggccuggggu

SEQ ID NO: 64657 - RNA, 22 nt, Human
ccagcucuuggugcacuuacau

SEQ ID NO: 64658 - RNA, 20 nt, Human
ccagcugagccaaggggaga

SEQ ID NO: 64659 - RNA, 22 nt, Human
ccagcugcaggggagcagugga

SEQ ID NO: 64660 - RNA, 22 nt, Human
ccagcugcagguguuccagaug

SEQ ID NO: 64661 - RNA, 22 nt, Human
ccagcugccuaagcaauccaua

SEQ ID NO: 64662 - RNA, 22 nt, Human
ccagcugcucucuucuccgcca

SEQ ID NO: 64663 - RNA, 22 nt, Human
ccagcugcuuuuugucacaugg

SEQ ID NO: 64664 - RNA, 22 nt, Human
ccagcuggaacggcagcccagc

SEQ ID NO: 64665 - RNA, 22 nt, Human
ccagcuggggaaguggggcaua

SEQ ID NO: 64666 - RNA, 22 nt, Human
ccagcuggugggucuuucucug

SEQ ID NO: 64667 - RNA, 22 nt, Human
ccagcugguuaaaauagagaaa

SEQ ID NO: 64668 - RNA, 22 nt, Human
ccagcugguuuauauuccccac

SEQ ID NO: 64669 - RNA, 22 nt, Human
ccagcuguaggcaggggguuua

SEQ ID NO: 64670 - RNA, 21 nt, Human
ccagcugucuguccuuaggca

SEQ ID NO: 64671 - RNA, 23 nt, Human
ccagcugugccuggcccaggagc

SEQ ID NO: 64672 - RNA, 21 nt, Human
ccagcuguuccucguccgaug

SEQ ID NO: 64673 - RNA, 22 nt, Human
ccagcuguuucugaugcuaggc

SEQ ID NO: 64674 - RNA, 22 nt, Human
ccagcuucggcaagcagacuuu

SEQ ID NO: 64675 - RNA, 22 nt, Human
ccagcuuuauagcuucaaagga

SEQ ID NO: 64676 - RNA, 22 nt, Human
ccagcuuucauaucaugaggua

SEQ ID NO: 64677 - RNA, 22 nt, Human
ccagcuuuccaggguugacugg

SEQ ID NO: 64678 - RNA, 22 nt, Human
ccagcuuucucagaggcuucua

SEQ ID NO: 64679 - RNA, 22 nt, Human
ccagcuuuucuuaucauuauaa

SEQ ID NO: 64680 - RNA, 22 nt, Human
ccaggaaaccugcgccauccag

SEQ ID NO: 64681 - RNA, 22 nt, Human
ccaggaaauagugcugugaucu

SEQ ID NO: 64682 - RNA, 22 nt, Human
ccaggaacaaagccccauccac

SEQ ID NO: 64683 - RNA, 22 nt, Human
ccaggaaccgaugaucagaggg

SEQ ID NO: 64684 - RNA, 22 nt, Human
ccaggaacuaagaauccuuuag

SEQ ID NO: 64685 - RNA, 22 nt, Human
ccaggaagaaacagucuuuaua

SEQ ID NO: 64686 - RNA, 23 nt, Human
ccaggaagaggccauccacaguc

SEQ ID NO: 64687 - RNA, 22 nt, Human
ccaggaagauuuauuuuggcuu

SEQ ID NO: 64688 - RNA, 22 nt, Human
ccaggaagccugugucucugga

SEQ ID NO: 64689 - RNA, 21 nt, Human
ccaggaaggacugagcucccu

SEQ ID NO: 64690 - RNA, 22 nt, Human
ccaggaaggccuggaugccccc

SEQ ID NO: 64691 - RNA, 22 nt, Human
ccaggaagguaugggaagaaaa

SEQ ID NO: 64692 - RNA, 22 nt, Human
ccaggacacugcuucacagcag

SEQ ID NO: 64693 - RNA, 22 nt, Human
ccaggacucaauuaaccucacu

SEQ ID NO: 64694 - RNA, 21 nt, Human
ccaggacuccauggggucucu

SEQ ID NO: 64695 - RNA, 20 nt, Human
ccaggacugcuggggacucu

SEQ ID NO: 64696 - RNA, 22 nt, Human
ccaggacuucgaggcuacagug

SEQ ID NO: 64697 - RNA, 22 nt, Human
ccaggacuuuaaguccagcacu

SEQ ID NO: 64698 - RNA, 22 nt, Human
ccaggagaauaauggcagauua

SEQ ID NO: 64699 - RNA, 22 nt, Human
ccaggagacaaagaugacugcu

SEQ ID NO: 64700 - RNA, 22 nt, Human
ccaggagacuguacugauauuu

SEQ ID NO: 64701 - RNA, 17 nt, Human
ccaggagagaugcuugu

SEQ ID NO: 64702 - RNA, 22 nt, Human
ccaggagagcgcccucccggcc

SEQ ID NO: 64703 - RNA, 19 nt, Human
ccaggagagcuuggagaag

SEQ ID NO: 64704 - RNA, 22 nt, Human
ccaggagcuauguacacacuau

SEQ ID NO: 64705 - RNA, 22 nt, Human
ccaggaggaaagaccagcccau

SEQ ID NO: 64706 - RNA, 22 nt, Human
ccaggaggaugguuguuaggug

SEQ ID NO: 64707 - RNA, 22 nt, Human
ccaggaggcagagguuguagug

SEQ ID NO: 64708 - RNA, 22 nt, Human
ccaggaggcucugacuggaccc

SEQ ID NO: 64709 - RNA, 22 nt, Human
ccaggaggcucuugucccuggu

SEQ ID NO: 64710 - RNA, 22 nt, Human
ccaggagggugguuacucaauc

SEQ ID NO: 64711 - RNA, 22 nt, Human
ccaggaguuugaggcugcagug

SEQ ID NO: 64712 - RNA, 22 nt, Human
ccaggauacugcucucugcugc

SEQ ID NO: 64713 - RNA, 22 nt, Human
ccaggaucugauauugggcucc

SEQ ID NO: 64714 - RNA, 22 nt, Human
ccaggcaaagcccaugcaagag

SEQ ID NO: 64715 - RNA, 22 nt, Human
ccaggcaaaucccucuggcaga

SEQ ID NO: 64716 - RNA, 22 nt, Human
ccaggcaaggucuccuagagag

SEQ ID NO: 64717 - RNA, 22 nt, Human
ccaggcaaguagaagcuguggu

SEQ ID NO: 64718 - RNA, 22 nt, Human
ccaggcacucacggggcacugg

SEQ ID NO: 64719 - RNA, 22 nt, Human
ccaggcacuggcuggguucuuu

SEQ ID NO: 64720 - RNA, 22 nt, Human
ccaggcacuucaucauuagggu

SEQ ID NO: 64721 - RNA, 22 nt, Human
ccaggcagagggauccccaucc

SEQ ID NO: 64722 - RNA, 22 nt, Human
ccaggcagcaaauuuucugaau

SEQ ID NO: 64723 - RNA, 22 nt, Human
ccaggcagccaagugugugugu

SEQ ID NO: 64724 - RNA, 22 nt, Human
ccaggcaggcuagaauguaaau

SEQ ID NO: 64725 - RNA, 22 nt, Human
ccaggcagggcucaaggaaccu

SEQ ID NO: 64726 - RNA, 22 nt, Human
ccaggccaaauucagucagcag

SEQ ID NO: 64727 - RNA, 22 nt, Human
ccaggccagcaggcacaccugc

SEQ ID NO: 64728 - RNA, 22 nt, Human
ccaggccagcgcuggcuggagg

SEQ ID NO: 64729 - RNA, 22 nt, Human
ccaggccagggcugcagcgagc

SEQ ID NO: 64730 - RNA, 20 nt, Human
cccuggagagaagcuccacg

SEQ ID NO: 64731 - RNA, 22 nt, Human
cccuggagaucgggagaggaag

SEQ ID NO: 64732 - RNA, 22 nt, Human
cccuggagcugcuugcauguug

SEQ ID NO: 64733 - RNA, 22 nt, Human
cccuggaggaccccaauguggc

SEQ ID NO: 64734 - RNA, 22 nt, Human
cccuggaggagcuuagagcuug

SEQ ID NO: 64735 - RNA, 19 nt, Human
cccuggaggaguguuggcu

SEQ ID NO: 64736 - RNA, 22 nt, Human
cccuggaggcaaagguugcagu

SEQ ID NO: 64737 - RNA, 22 nt, Human
cccuggaggcuggaggcaguag

SEQ ID NO: 64738 - RNA, 22 nt, Human
cccuggagggacagcugcucua

SEQ ID NO: 64739 - RNA, 22 nt, Human
cccuggagggauuucucaauca

SEQ ID NO: 64740 - RNA, 23 nt, Human
cccuggaguaaauucuuggaagg

SEQ ID NO: 64741 - RNA, 22 nt, Human
cccuggaguagcacugggucgc

SEQ ID NO: 64742 - RNA, 22 nt, Human
cccuggaguccggagcucaccu

SEQ ID NO: 64743 - RNA, 22 nt, Human
cccuggagugugacgaggcauu

SEQ ID NO: 64744 - RNA, 22 nt, Human
cccuggcaaaaucccugguaca

SEQ ID NO: 64745 - RNA, 19 nt, Human
cccuggcaggcaagccugg

SEQ ID NO: 64746 - RNA, 22 nt, Human
cccuggcagugcuccuuuagac

SEQ ID NO: 64747 - RNA, 22 nt, Human
cccuggcauaaaacuucuccag

SEQ ID NO: 64748 - RNA, 22 nt, Human
cccuggccagggcacagggagg

SEQ ID NO: 64749 - RNA, 22 nt, Human
cccuggccuacaggcccagaga

SEQ ID NO: 64750 - RNA, 20 nt, Human
cccuggccuguuucaugccc

SEQ ID NO: 64751 - RNA, 22 nt, Human
cccuggcucaggcagcuuuguu

SEQ ID NO: 64752 - RNA, 17 nt, Human
cccuggcucuaggugga

SEQ ID NO: 64753 - RNA, 22 nt, Human
cccuggcugccagucaccagac

SEQ ID NO: 64754 - RNA, 22 nt, Human
cccuggcuggaaauuaaguagu

SEQ ID NO: 64755 - RNA, 22 nt, Human
cccugggaggcuuccaggcaga

SEQ ID NO: 64756 - RNA, 21 nt, Human
cccugggaugggcuuggacuu

SEQ ID NO: 64757 - RNA, 22 nt, Human
cccugggauugccuuggccuug

SEQ ID NO: 64758 - RNA, 22 nt, Human
cccugggcaagcccuauuuucc

SEQ ID NO: 64759 - RNA, 22 nt, Human
cccuggggcugagggauggccg

SEQ ID NO: 64760 - RNA, 19 nt, Human
cccuggggguuucugguac

SEQ ID NO: 64761 - RNA, 23 nt, Human
cccuguagcccaggacaggcuuu

SEQ ID NO: 64762 - RNA, 22 nt, Human
cccugucacaauggaugacauu

SEQ ID NO: 64763 - RNA, 22 nt, Human
cccuguccuggaugggagcacu

SEQ ID NO: 64764 - RNA, 22 nt, Human
cccuguccuuggcugugaggcu

SEQ ID NO: 64765 - RNA, 22 nt, Human
cccugucuguaccgugaugagc

SEQ ID NO: 64766 - RNA, 22 nt, Human
cccugugauguagcuagaguag

SEQ ID NO: 64767 - RNA, 22 nt, Human
cccuguggaggaggagagcagu

SEQ ID NO: 64768 - RNA, 22 nt, Human
cccuguggauuucaguuugugu

SEQ ID NO: 64769 - RNA, 22 nt, Human
cccugugggguccgccuguccg

SEQ ID NO: 64770 - RNA, 22 nt, Human
cccuguggugacaggccugucu

SEQ ID NO: 64771 - RNA, 22 nt, Human
cccuguguaguuaacuuuccac

SEQ ID NO: 64772 - RNA, 22 nt, Human
cccugugucuucuugccuuugu

SEQ ID NO: 64773 - RNA, 22 nt, Human
cccuguuaaugucaaccugccu

SEQ ID NO: 64774 - RNA, 22 nt, Human
cccuguugggaagagagauggc

SEQ ID NO: 64775 - RNA, 22 nt, Human
cccuguuuggauggggacccag

SEQ ID NO: 64776 - RNA, 22 nt, Human
cccuuagaauuuuguaguuauu

SEQ ID NO: 64777 - RNA, 17 nt, Human
cccuuagagcaaaagau

SEQ ID NO: 64778 - RNA, 22 nt, Human
cccuuagagggcucuccuuacu

SEQ ID NO: 64779 - RNA, 22 nt, Human
cccuuccugggugucccggagu

SEQ ID NO: 64780 - RNA, 22 nt, Human
cccuucucuuucacucacuauu

SEQ ID NO: 64781 - RNA, 21 nt, Human
cccuucuuacucaagcucauu

SEQ ID NO: 64782 - RNA, 22 nt, Human
cccuucuuuguaauaaagauua

SEQ ID NO: 64783 - RNA, 22 nt, Human
cccuugaagacuagaaugagga

SEQ ID NO: 64784 - RNA, 22 nt, Human
cccuugaaggcagggaguccug

SEQ ID NO: 64785 - RNA, 22 nt, Human
cccuugcaucccauguguggcc

SEQ ID NO: 64786 - RNA, 22 nt, Human
cccuugcuugcccagucacagg

SEQ ID NO: 64787 - RNA, 22 nt, Human
cccuuggaagguagcuggcagu

SEQ ID NO: 64788 - RNA, 22 nt, Human
cccuuggccacugcgccaguga

SEQ ID NO: 64789 - RNA, 22 nt, Human
cccuugggcuuccacccagccc

SEQ ID NO: 64790 - RNA, 22 nt, Human
cccuuggggcucuuugccaggc

SEQ ID NO: 64791 - RNA, 22 nt, Human
cccuuguuuuugaguacaauag

SEQ ID NO: 64792 - RNA, 23 nt, Human
cccuuuaagauuugaauagucag

SEQ ID NO: 64793 - RNA, 22 nt, Human
cccuuuaaguagaauauauuau

SEQ ID NO: 64794 - RNA, 22 nt, Human
cccuuuaauuccaacacaggaa

SEQ ID NO: 64795 - RNA, 22 nt, Human
cccuuuccugaagaauauuuuu

SEQ ID NO: 64796 - RNA, 22 nt, Human
cccuuuggaagaggcucacuga

SEQ ID NO: 64797 - RNA, 22 nt, Human
ccgaggcuccuccccgagucug

SEQ ID NO: 64798 - RNA, 22 nt, Human
ccgcaaggcagagguugcagug

SEQ ID NO: 64799 - RNA, 22 nt, Human
ccggaaacuccuuugagagccu

SEQ ID NO: 64800 - RNA, 22 nt, Human
ccggagagucagagcgcggccc

SEQ ID NO: 64801 - RNA, 22 nt, Human
ccggcaggcggaguugcaguga

SEQ ID NO: 64802 - RNA, 22 nt, Human
ccggcgaccgcugucggaggcg

SEQ ID NO: 64803 - RNA, 22 nt, Human
ccgggagcaggcgccaccgcca

SEQ ID NO: 64804 - RNA, 22 nt, Human
ccgggccucgggacaccgggua

SEQ ID NO: 64805 - RNA, 22 nt, Human
ccggucccaggugccccgguga

SEQ ID NO: 64806 - RNA, 22 nt, Human
ccguagcacaugcuccuggggc

SEQ ID NO: 64807 - RNA, 22 nt, Human
ccguaugucuggguuucuuaau

SEQ ID NO: 64808 - RNA, 22 nt, Human
ccguauuauaaguuuuuccuuc

SEQ ID NO: 64809 - RNA, 19 nt, Human
ccgucauggagaguggggu

SEQ ID NO: 64810 - RNA, 22 nt, Human
ccgugcuucuucagaugugaau

SEQ ID NO: 64811 - RNA, 22 nt, Human
ccguggaguugugcugaguaug

SEQ ID NO: 64812 - RNA, 22 nt, Human
ccguguacauaaagcccuggua

SEQ ID NO: 64813 - RNA, 22 nt, Human
ccuaaauagagucagauguaau

SEQ ID NO: 64814 - RNA, 22 nt, Human
ccuaacuuuaaugggaccagga

SEQ ID NO: 64815 - RNA, 22 nt, Human
ccuaagaucugguaugugacag

SEQ ID NO: 64816 - RNA, 22 nt, Human
ccuaagauugcaaacucucucc

SEQ ID NO: 64817 - RNA, 22 nt, Human
ccuaaggaaagccaaagaggcc

SEQ ID NO: 64818 - RNA, 19 nt, Human
ccuaaguaacaacaguugu

SEQ ID NO: 64819 - RNA, 22 nt, Human
ccuaaguaaguugacuuucaga

SEQ ID NO: 64820 - RNA, 22 nt, Human
ccuacaggaaauuguaucaaaa

SEQ ID NO: 64821 - RNA, 22 nt, Human
ccuacaguuauauucuugauug

SEQ ID NO: 64822 - RNA, 22 nt, Human
ccuacauaacacugccaaacug

SEQ ID NO: 64823 - RNA, 18 nt, Human
ccuacaucauugugagag

SEQ ID NO: 64824 - RNA, 22 nt, Human
ccuacauucucugaguuuuccu

SEQ ID NO: 64825 - RNA, 22 nt, Human
ccuagaacacaaccuauauuag

SEQ ID NO: 64826 - RNA, 22 nt, Human
ccuagaaugugcagacuuaggg

SEQ ID NO: 64827 - RNA, 22 nt, Human
ccuagacuagaggcagggagcc

SEQ ID NO: 64828 - RNA, 22 nt, Human
ccuagagcucugcuuuaucuaa

SEQ ID NO: 64829 - RNA, 22 nt, Human
ccuaggaacccccaggcuucug

SEQ ID NO: 64830 - RNA, 22 nt, Human
ccuaggagagguaaugaaguuc

SEQ ID NO: 64831 - RNA, 22 nt, Human
ccuaggaguucgaagcugcagu

SEQ ID NO: 64832 - RNA, 22 nt, Human
ccuaggcccauuaauuccccuu

SEQ ID NO: 64833 - RNA, 22 nt, Human
ccuaggcccucaaagagcauaa

SEQ ID NO: 64834 - RNA, 22 nt, Human
ccuaggccgcccggugcguggg

SEQ ID NO: 64835 - RNA, 22 nt, Human
ccuaggccuuacuuuccugugc

SEQ ID NO: 64836 - RNA, 22 nt, Human
ccuaggcuaauucaguccagua

SEQ ID NO: 64837 - RNA, 22 nt, Human
ccuagggauacagcagaguaca

SEQ ID NO: 64838 - RNA, 20 nt, Human
ccuagggcaagugggugggc

SEQ ID NO: 64839 - RNA, 22 nt, Human
ccuggcucugaaguccacauca

SEQ ID NO: 64840 - RNA, 19 nt, Human
ccuggcucugagcccagcc

SEQ ID NO: 64841 - RNA, 22 nt, Human
ccuggcucugccguaaccacca

SEQ ID NO: 64842 - RNA, 22 nt, Human
ccuggcugaaccaaugaagugg

SEQ ID NO: 64843 - RNA, 22 nt, Human
ccuggcugagccuccaggaaga

SEQ ID NO: 64844 - RNA, 22 nt, Human
ccuggcugagggaccucgggua

SEQ ID NO: 64845 - RNA, 21 nt, Human
ccuggcugcacaguugcuggu

SEQ ID NO: 64846 - RNA, 20 nt, Human
ccuggcugcauucaggacgg

SEQ ID NO: 64847 - RNA, 22 nt, Human
ccuggcugcauuuugcuggaug

SEQ ID NO: 64848 - RNA, 23 nt, Human
ccuggcuggauucucugcauuca

SEQ ID NO: 64849 - RNA, 20 nt, Human
ccuggcugguggaggaaagg

SEQ ID NO: 64850 - RNA, 22 nt, Human
ccuggcugucguuuugugaaau

SEQ ID NO: 64851 - RNA, 22 nt, Human
ccuggcugugcauugccggccc

SEQ ID NO: 64852 - RNA, 22 nt, Human
ccuggcuguggcggugcucuca

SEQ ID NO: 64853 - RNA, 22 nt, Human
ccuggcuuugaccuugcuguuu

SEQ ID NO: 64854 - RNA, 20 nt, Human
ccuggcuuugcaucugugau

SEQ ID NO: 64855 - RNA, 18 nt, Human
ccuggcuuuucuacuugc

SEQ ID NO: 64856 - RNA, 22 nt, Human
ccugggaagucagccaaggacg

SEQ ID NO: 64857 - RNA, 22 nt, Human
ccugggaaucggugcguugagg

SEQ ID NO: 64858 - RNA, 22 nt, Human
ccugggacgacucuguacccuu

SEQ ID NO: 64859 - RNA, 22 nt, Human
ccugggacucggccaggacaga

SEQ ID NO: 64860 - RNA, 19 nt, Human
ccugggacuuaggcugggu

SEQ ID NO: 64861 - RNA, 22 nt, Human
ccugggagaacugcuggguugg

SEQ ID NO: 64862 - RNA, 22 nt, Human
ccugggagagcugcccggguga

SEQ ID NO: 64863 - RNA, 22 nt, Human
ccugggagcuguggaaaggcug

SEQ ID NO: 64864 - RNA, 22 nt, Human
ccugggaguggcacucacagca

SEQ ID NO: 64865 - RNA, 22 nt, Human
ccugggaugcuguccucaucua

SEQ ID NO: 64866 - RNA, 22 nt, Human
ccugggauuugcgccagaccuu

SEQ ID NO: 64867 - RNA, 22 nt, Human
ccugggcaacauagggagaccc

SEQ ID NO: 64868 - RNA, 22 nt, Human
ccugggcagccugcucaaggac

SEQ ID NO: 64869 - RNA, 22 nt, Human
ccugggcaggaugggcccggug

SEQ ID NO: 64870 - RNA, 22 nt, Human
ccugggcagugcuggaguugaa

SEQ ID NO: 64871 - RNA, 22 nt, Human
ccugggcauucuuugaguucuc

SEQ ID NO: 64872 - RNA, 22 nt, Human
ccugggccaggcuugggaaugc

SEQ ID NO: 64873 - RNA, 22 nt, Human
ccugggccuauccuagaaccaa

SEQ ID NO: 64874 - RNA, 22 nt, Human
ccugggccucacccagcucuug

SEQ ID NO: 64875 - RNA, 22 nt, Human
ccugggcucaagcgaucuuguc

SEQ ID NO: 64876 - RNA, 22 nt, Human
ccugggcuccacuccaagagca

SEQ ID NO: 64877 - RNA, 22 nt, Human
ccugggcuggaguacagcagug

SEQ ID NO: 64878 - RNA, 22 nt, Human
ccugggcuguugcaucauccuu

SEQ ID NO: 64879 - RNA, 22 nt, Human
ccugggcuugguuguugagaac

SEQ ID NO: 64880 - RNA, 22 nt, Human
ccugggcuuugagggcaggaug

SEQ ID NO: 64881 - RNA, 22 nt, Human
ccuggggaaaagcaggcauuua

SEQ ID NO: 64882 - RNA, 23 nt, Human
ccuggggagcuguauccagagug

SEQ ID NO: 64883 - RNA, 23 nt, Human
ccuggggcacuugaguccucauc

SEQ ID NO: 64884 - RNA, 22 nt, Human
ccuggggccccgagccagaagc

SEQ ID NO: 64885 - RNA, 22 nt, Human
ccuggggcucaagauggcgccg

SEQ ID NO: 64886 - RNA, 22 nt, Human
ccuggggcucugcacagagcag

SEQ ID NO: 64887 - RNA, 22 nt, Human
ccugggggccaggaagguguga

SEQ ID NO: 64888 - RNA, 22 nt, Human
ccuggguagacuuugaagcauu

SEQ ID NO: 64889 - RNA, 22 nt, Human
ccugggucacucaggcaggcgg

SEQ ID NO: 64890 - RNA, 22 nt, Human
ccugggucccugagagaugauu

SEQ ID NO: 64891 - RNA, 22 nt, Human
ccugggucuguauugguaggua

SEQ ID NO: 64892 - RNA, 22 nt, Human
ccuggguggcagagguugcagu

SEQ ID NO: 64893 - RNA, 23 nt, Human
ccuggguuucagagcugcuuuuc

SEQ ID NO: 64894 - RNA, 22 nt, Human
ccugguccccaucggcccagcg

SEQ ID NO: 64895 - RNA, 17 nt, Human
gagagcugcugcuuccg

SEQ ID NO: 64896 - RNA, 20 nt, Human
gagagcuggaaauaaagucc

SEQ ID NO: 64897 - RNA, 22 nt, Human
gagagcugucagcguagcaccg

SEQ ID NO: 64898 - RNA, 22 nt, Human
gagagcuguguucauucuacca

SEQ ID NO: 64899 - RNA, 22 nt, Human
gagagcuguuuaucuucuucaa

SEQ ID NO: 64900 - RNA, 22 nt, Human
gagaggaaagauauauacuucu

SEQ ID NO: 64901 - RNA, 22 nt, Human
gagaggaaugagguuaaggacu

SEQ ID NO: 64902 - RNA, 22 nt, Human
gagaggaguuacuauuuccgag

SEQ ID NO: 64903 - RNA, 22 nt, Human
gagaggcagaggccugaaaccg

SEQ ID NO: 64904 - RNA, 22 nt, Human
gagaggcaggaauccuggguga

SEQ ID NO: 64905 - RNA, 22 nt, Human
gagaggcccugaagcccacaga

SEQ ID NO: 64906 - RNA, 21 nt, Human
gagaggccugggcccgugagc

SEQ ID NO: 64907 - RNA, 19 nt, Human
gagaggccugugcuugaag

SEQ ID NO: 64908 - RNA, 22 nt, Human
gagaggcucugaggacuggggu

SEQ ID NO: 64909 - RNA, 22 nt, Human
gagaggcugacuggcuguccug

SEQ ID NO: 64910 - RNA, 22 nt, Human
gagaggcugauccugcagagaa

SEQ ID NO: 64911 - RNA, 18 nt, Human
gagagggaucccucagga

SEQ ID NO: 64912 - RNA, 22 nt, Human
gagagggcaagguagaugcuac

SEQ ID NO: 64913 - RNA, 22 nt, Human
gagagggccagggugagaacua

SEQ ID NO: 64914 - RNA, 22 nt, Human
gagagggcugccuggugugagg

SEQ ID NO: 64915 - RNA, 22 nt, Human
gagagggcuggaaacuuccugg

SEQ ID NO: 64916 - RNA, 22 nt, Human
gagagggguuugccauccuaug

SEQ ID NO: 64917 - RNA, 22 nt, Human
gagagguacggaaagagcgugg

SEQ ID NO: 64918 - RNA, 22 nt, Human
gagagguagaggcucugcuuaa

SEQ ID NO: 64919 - RNA, 22 nt, Human
gagagguccauuccccugucag

SEQ ID NO: 64920 - RNA, 17 nt, Human
gagagucuaaugggaga

SEQ ID NO: 64921 - RNA, 22 nt, Human
gagagucuaggaaccucauaua

SEQ ID NO: 64922 - RNA, 22 nt, Human
gagagugagauaauuucacaua

SEQ ID NO: 64923 - RNA, 22 nt, Human
gagagugaggcaucaggggcag

SEQ ID NO: 64924 - RNA, 22 nt, Human
gagagugaggccugggaaucua

SEQ ID NO: 64925 - RNA, 22 nt, Human
gagagugcugaacggcaagggu

SEQ ID NO: 64926 - RNA, 22 nt, Human
gagauaaauuuuugauaaauau

SEQ ID NO: 64927 - RNA, 19 nt, Human
gagauauagaaguagaugu

SEQ ID NO: 64928 - RNA, 22 nt, Human
gagauauguuagaaagcuauug

SEQ ID NO: 64929 - RNA, 22 nt, Human
gagauauguuggcagcugguau

SEQ ID NO: 64930 - RNA, 22 nt, Human
gagaucauggcuucugcugaua

SEQ ID NO: 64931 - RNA, 22 nt, Human
gagauccagauuuccauuccuu

SEQ ID NO: 64932 - RNA, 22 nt, Human
gagaucuucaagguuuuagaua

SEQ ID NO: 64933 - RNA, 22 nt, Human
gagaugaaucauuccaugguca

SEQ ID NO: 64934 - RNA, 22 nt, Human
gagaugaauguaaacaaaggca

SEQ ID NO: 64935 - RNA, 22 nt, Human
gagaugaugagauuuggaacuu

SEQ ID NO: 64936 - RNA, 22 nt, Human
gagaugcugaaaucugagugua

SEQ ID NO: 64937 - RNA, 22 nt, Human
gagaugcugccugauuuauuca

SEQ ID NO: 64938 - RNA, 22 nt, Human
gagaugcuugucugucuuauca

SEQ ID NO: 64939 - RNA, 22 nt, Human
gagaugcuuuguguauagacaa

SEQ ID NO: 64940 - RNA, 22 nt, Human
gagauggagucuuuuucuguca

SEQ ID NO: 64941 - RNA, 17 nt, Human
gagauggcauuggcagc

SEQ ID NO: 64942 - RNA, 22 nt, Human
gagauggccagugccaggacaa

SEQ ID NO: 64943 - RNA, 22 nt, Human
gagauggcccuggcauguagcu

SEQ ID NO: 64944 - RNA, 22 nt, Human
gagauggcuugcucucacgugg

SEQ ID NO: 64945 - RNA, 22 nt, Human
gagauggggucagcugggacau

SEQ ID NO: 64946 - RNA, 22 nt, Human
gagauggggucuugcuauguug

SEQ ID NO: 64947 - RNA, 22 nt, Human
gagaugguuggguuaacaacua

SEQ ID NO: 64948 - RNA, 22 nt, Human
ccucugcaccauagccuucagc

SEQ ID NO: 64949 - RNA, 22 nt, Human
ccucugcaucuggcugcugcag

SEQ ID NO: 64950 - RNA, 20 nt, Human
ccucugccccggggcugcua

SEQ ID NO: 64951 - RNA, 20 nt, Human
ccucugccuuucuagucuga

SEQ ID NO: 64952 - RNA, 22 nt, Human
ccucugcucccuggugucugag

SEQ ID NO: 64953 - RNA, 21 nt, Human
ccucugcucgggcaugcguuu

SEQ ID NO: 64954 - RNA, 22 nt, Human
ccucugcucugguccaugugcu

SEQ ID NO: 64955 - RNA, 22 nt, Human
ccucuggaucuuucuccacacu

SEQ ID NO: 64956 - RNA, 16 nt, Human
ccucugggauguuugc

SEQ ID NO: 64957 - RNA, 22 nt, Human
ccucugggcagguagcagcagc

SEQ ID NO: 64958 - RNA, 22 nt, Human
ccucuggggcaucagacaaagg

SEQ ID NO: 64959 - RNA, 22 nt, Human
ccucugggggcuuccuuacccu

SEQ ID NO: 64960 - RNA, 22 nt, Human
ccucuggggucuagcaauagca

SEQ ID NO: 64961 - RNA, 22 nt, Human
ccucuggguuaguuuagggagc

SEQ ID NO: 64962 - RNA, 22 nt, Human
ccucuggucccagcucugcugc

SEQ ID NO: 64963 - RNA, 21 nt, Human
ccucuguaguuaaguuuccua

SEQ ID NO: 64964 - RNA, 22 nt, Human
ccucugugccucaguuucaugu

SEQ ID NO: 64965 - RNA, 21 nt, Human
ccucugugcuaaagggcuccc

SEQ ID NO: 64966 - RNA, 22 nt, Human
ccucuguggcccugacucucuu

SEQ ID NO: 64967 - RNA, 22 nt, Human
ccucuguggccuuggaccagcu

SEQ ID NO: 64968 - RNA, 19 nt, Human
ccucugugggagucaguga

SEQ ID NO: 64969 - RNA, 22 nt, Human
ccucuguguccuggucauugaa

SEQ ID NO: 64970 - RNA, 22 nt, Human
ccucugugucuugguuucaaga

SEQ ID NO: 64971 - RNA, 22 nt, Human
ccucuucauccuggaagcugcu

SEQ ID NO: 64972 - RNA, 19 nt, Human
ccucuuccucugacacuau

SEQ ID NO: 64973 - RNA, 22 nt, Human
ccucuucuaccauuuacauuuu

SEQ ID NO: 64974 - RNA, 22 nt, Human
ccucuucuagguuucagccugc

SEQ ID NO: 64975 - RNA, 22 nt, Human
ccucuuugacuauaguaguuaa

SEQ ID NO: 64976 - RNA, 22 nt, Human
ccucuuuguucaggcugcuggc

SEQ ID NO: 64977 - RNA, 22 nt, Human
ccugaacaaauggcauagccaa

SEQ ID NO: 64978 - RNA, 22 nt, Human
ccugaagaugagggacagcuaa

SEQ ID NO: 64979 - RNA, 18 nt, Human
ccugaagccugugucuuu

SEQ ID NO: 64980 - RNA, 22 nt, Human
ccugaagcucuuaagaccuuua

SEQ ID NO: 64981 - RNA, 22 nt, Human
ccugacaggcggaggcugcagu

SEQ ID NO: 64982 - RNA, 22 nt, Human
ccugacaguuaauuguccugua

SEQ ID NO: 64983 - RNA, 22 nt, Human
ccugaccagagugagggcuuag

SEQ ID NO: 64984 - RNA, 22 nt, Human
ccugaccuaccugaagucuaca

SEQ ID NO: 64985 - RNA, 22 nt, Human
ccugaccuccaaguggcucugg

SEQ ID NO: 64986 - RNA, 22 nt, Human
ccugagaaauagcaucauuuuu

SEQ ID NO: 64987 - RNA, 22 nt, Human
ccugagaagagcuuaugaguga

SEQ ID NO: 64988 - RNA, 22 nt, Human
ccugagaccaaguugcagccau

SEQ ID NO: 64989 - RNA, 22 nt, Human
ccugagagcgaguggccucaug

SEQ ID NO: 64990 - RNA, 22 nt, Human
ccugagagggggcccuagaaau

SEQ ID NO: 64991 - RNA, 22 nt, Human
ccugagagugagggccuccuua

SEQ ID NO: 64992 - RNA, 22 nt, Human
ccugagagugagugccuccuua

SEQ ID NO: 64993 - RNA, 22 nt, Human
ccugagagugguguacaggaga

SEQ ID NO: 64994 - RNA, 23 nt, Human
ccugagaucuguaagggaccuug

SEQ ID NO: 64995 - RNA, 22 nt, Human
ccugagauuggcuaguaugagu

SEQ ID NO: 64996 - RNA, 22 nt, Human
ccugagcaacuucaagggccug

SEQ ID NO: 64997 - RNA, 22 nt, Human
ccugagcacacaucagaaucac

SEQ ID NO: 64998 - RNA, 22 nt, Human
ccugagcucaaagggugccugg

SEQ ID NO: 64999 - RNA, 22 nt, Human
ccugagcucaagaaggugacca

SEQ ID NO: 65000 - RNA, 22 nt, Human
ccugagcucugcacuuuuuaga

SEQ ID NO: 65001 - RNA, 22 nt, Human
ccugagcugcggggcagugcuc

SEQ ID NO: 65002 - RNA, 22 nt, Human
ccugagcuuacaauuuaagaac

SEQ ID NO: 65003 - RNA, 22 nt, Human
ccugaggaccagcacccaucug

SEQ ID NO: 65004 - RNA, 22 nt, Human
ccugaggauuguuggugcuucc

SEQ ID NO: 65005 - RNA, 22 nt, Human
ccugaggccccugaggauagca

SEQ ID NO: 65006 - RNA, 22 nt, Human
ccugaggcccuggcugugcuga

SEQ ID NO: 65007 - RNA, 22 nt, Human
ccugaggcucgcgcgccccugg

SEQ ID NO: 65008 - RNA, 22 nt, Human
ccugaggcucuccugaauaaug

SEQ ID NO: 65009 - RNA, 22 nt, Human
ccugagggaggguauaggcugu

SEQ ID NO: 65010 - RNA, 21 nt, Human
ccucuggcuugugcugugccc

SEQ ID NO: 65011 - RNA, 22 nt, Human
ccucugggaagccaguccugcu

SEQ ID NO: 65012 - RNA, 22 nt, Human
ccucugggccagccuggacccu

SEQ ID NO: 65013 - RNA, 16 nt, Human
ccucugggccugcaag

SEQ ID NO: 65014 - RNA, 22 nt, Human
ccucugggccuggaagggcagu

SEQ ID NO: 65015 - RNA, 22 nt, Human
ccucugggcggagaucugcugc

SEQ ID NO: 65016 - RNA, 22 nt, Human
ccucugggcuggaaaauuaaug

SEQ ID NO: 65017 - RNA, 22 nt, Human
ccucugggugacagacucuugg

SEQ ID NO: 65018 - RNA, 22 nt, Human
ccucuguaagccucaguuucuu

SEQ ID NO: 65019 - RNA, 22 nt, Human
ccucuguaaugauucacugaau

SEQ ID NO: 65020 - RNA, 22 nt, Human
ccucuguacaggucagcaucua

SEQ ID NO: 65021 - RNA, 22 nt, Human
ccucuguccccagugcaggccu

SEQ ID NO: 65022 - RNA, 22 nt, Human
ccucugugacaaacaguccugg

SEQ ID NO: 65023 - RNA, 22 nt, Human
ccucugugauuucugagccaau

SEQ ID NO: 65024 - RNA, 22 nt, Human
ccucugugggccgggccugcug

SEQ ID NO: 65025 - RNA, 20 nt, Human
ccucuguguccugugucaua

SEQ ID NO: 65026 - RNA, 22 nt, Human
ccucugugugaugcgcaaagua

SEQ ID NO: 65027 - RNA, 22 nt, Human
ccucugugugugcaugcaugcg

SEQ ID NO: 65028 - RNA, 22 nt, Human
ccucuuaauuguacuccuucag

SEQ ID NO: 65029 - RNA, 22 nt, Human
ccucuucagcaaaguucggccc

SEQ ID NO: 65030 - RNA, 22 nt, Human
ccucuuccagcuguugcuucca

SEQ ID NO: 65031 - RNA, 22 nt, Human
ccucuucucaacuccagccaga

SEQ ID NO: 65032 - RNA, 22 nt, Human
ccucuucugagugagacucccu

SEQ ID NO: 65033 - RNA, 22 nt, Human
ccucuugaaccuaggcaagacu

SEQ ID NO: 65034 - RNA, 22 nt, Human
ccucuugauugguuggaagcgg

SEQ ID NO: 65035 - RNA, 22 nt, Human
ccucuugccaaucagcuacaga

SEQ ID NO: 65036 - RNA, 22 nt, Human
ccugaaaugacuccagcugagu

SEQ ID NO: 65037 - RNA, 22 nt, Human
ccugaaauuugaagaccugaau

SEQ ID NO: 65038 - RNA, 22 nt, Human
ccugaagaaaauuccacgagaa

SEQ ID NO: 65039 - RNA, 22 nt, Human
ccugaagaauucaaauccagau

SEQ ID NO: 65040 - RNA, 22 nt, Human
ccugaagagcacucuagaguug

SEQ ID NO: 65041 - RNA, 20 nt, Human
ccugaagaguuucucuuucu

SEQ ID NO: 65042 - RNA, 22 nt, Human
ccugaagcaaggguaggcaggu

SEQ ID NO: 65043 - RNA, 22 nt, Human
ccugaagcacaaaagcacagcu

SEQ ID NO: 65044 - RNA, 22 nt, Human
ccugaagcacccggagcuggca

SEQ ID NO: 65045 - RNA, 22 nt, Human
ccugaauaauuugugaaaagau

SEQ ID NO: 65046 - RNA, 22 nt, Human
ccugaauaggcucugcucaaaa

SEQ ID NO: 65047 - RNA, 23 nt, Human
ccugacacaaaaggauucuugcu

SEQ ID NO: 65048 - RNA, 22 nt, Human
ccugacaggagaagcgcagcau

SEQ ID NO: 65049 - RNA, 22 nt, Human
ccugacaguccuuuucuagugu

SEQ ID NO: 65050 - RNA, 21 nt, Human
ccugaccuaauuugccaucag

SEQ ID NO: 65051 - RNA, 22 nt, Human
ccugaccuauuuuucucagcug

SEQ ID NO: 65052 - RNA, 22 nt, Human
ccugacgaaaggcgugcuggag

SEQ ID NO: 65053 - RNA, 22 nt, Human
ccugagaaaccuggugcaauua

SEQ ID NO: 65054 - RNA, 22 nt, Human
ccugagaggcccucucacuguc

SEQ ID NO: 65055 - RNA, 22 nt, Human
ccugagaguaggugucucuuua

SEQ ID NO: 65056 - RNA, 22 nt, Human
ccugagaucagugcauuuggug

SEQ ID NO: 65057 - RNA, 22 nt, Human
cuaaagucauacaaggugggag

SEQ ID NO: 65058 - RNA, 22 nt, Human
cuaaaguccuuaucaaguguaa

SEQ ID NO: 65059 - RNA, 22 nt, Human
cuaaaugacuuccagugguuau

SEQ ID NO: 65060 - RNA, 22 nt, Human
cuaaaugccuuuccuaccuaac

SEQ ID NO: 65061 - RNA, 22 nt, Human
cuaaaugugcuaauagcaugaa

SEQ ID NO: 65062 - RNA, 22 nt, Human
cuaaauguucacaugcaauuuu

SEQ ID NO: 65063 - RNA, 22 nt, Human
cuaaauguuuuaucuuccuggc

SEQ ID NO: 65064 - RNA, 22 nt, Human
cuaacauuuggaaggcuuauga

SEQ ID NO: 65065 - RNA, 20 nt, Human
cuaaccuuaaccaucaccag

SEQ ID NO: 65066 - RNA, 21 nt, Human
cuaacuuugaguccuggcccc

SEQ ID NO: 65067 - RNA, 22 nt, Human
cuaacuuugucaucuucccuuu

SEQ ID NO: 65068 - RNA, 22 nt, Human
cuaacuuuuugauucuugggga

SEQ ID NO: 65069 - RNA, 22 nt, Human
cuaagacaugcccugcaugaua

SEQ ID NO: 65070 - RNA, 22 nt, Human
cuaagaggaaguacucuguuau

SEQ ID NO: 65071 - RNA, 20 nt, Human
cuaagaggaggacuagguuu

SEQ ID NO: 65072 - RNA, 22 nt, Human
cuaagccacucaaaucuugugg

SEQ ID NO: 65073 - RNA, 22 nt, Human
cuaaggaaauaugucacuugcu

SEQ ID NO: 65074 - RNA, 22 nt, Human
cuaaggcaccgaggcaggagcg

SEQ ID NO: 65075 - RNA, 22 nt, Human
cuaauaacaugaacuacuuucu

SEQ ID NO: 65076 - RNA, 22 nt, Human
cuaauacacccuauugcuuguu

SEQ ID NO: 65077 - RNA, 22 nt, Human
cuaaugaagcugcuuucuauga

SEQ ID NO: 65078 - RNA, 22 nt, Human
cuaauguaaugauauguugaau

SEQ ID NO: 65079 - RNA, 22 nt, Human
cuaauucuuuggagacaaucug

SEQ ID NO: 65080 - RNA, 22 nt, Human
cuaauuuuuguucugcauugaa

SEQ ID NO: 65081 - RNA, 22 nt, Human
cuacaaaaguaauugugguuuu

SEQ ID NO: 65082 - RNA, 23 nt, Human
cuacaaaguaugagaagaccccu

SEQ ID NO: 65083 - RNA, 23 nt, Human
cuacaagagcaagcauggacaag

SEQ ID NO: 65084 - RNA, 22 nt, Human
cuacaagaggaauggaggucug

SEQ ID NO: 65085 - RNA, 22 nt, Human
cuacaagauuuuuaaaacugua

SEQ ID NO: 65086 - RNA, 22 nt, Human
cuacacagagccuacuucugca

SEQ ID NO: 65087 - RNA, 20 nt, Human
cuacacaggguucgcugggc

SEQ ID NO: 65088 - RNA, 22 nt, Human
cuacagaaaaucagccacaggc

SEQ ID NO: 65089 - RNA, 22 nt, Human
cuacagaaacacuggacaugug

SEQ ID NO: 65090 - RNA, 21 nt, Human
cuacagaaucgagcauucugg

SEQ ID NO: 65091 - RNA, 22 nt, Human
cuacagaauggagggucagaga

SEQ ID NO: 65092 - RNA, 22 nt, Human
cuacagagugaaugcagaaaau

SEQ ID NO: 65093 - RNA, 22 nt, Human
cuacaggaaggaucuugcucaa

SEQ ID NO: 65094 - RNA, 22 nt, Human
cuacaggcucagggagcccucu

SEQ ID NO: 65095 - RNA, 22 nt, Human
cuacaguagagguugucaggga

SEQ ID NO: 65096 - RNA, 22 nt, Human
cuacaguaugaaaccuuuacuc

SEQ ID NO: 65097 - RNA, 22 nt, Human
cuacauaaucuggauuugucug

SEQ ID NO: 65098 - RNA, 22 nt, Human
cuacauagauggaugauuguaa

SEQ ID NO: 65099 - RNA, 22 nt, Human
cuacaugaaaauaaguuugaaa

SEQ ID NO: 65100 - RNA, 20 nt, Human
cuacauguucugcuucucuc

SEQ ID NO: 65101 - RNA, 22 nt, Human
cuacauucaacagcagaguuuu

SEQ ID NO: 65102 - RNA, 22 nt, Human
cuacauuucauccagggagagc

SEQ ID NO: 65103 - RNA, 22 nt, Human
cuacccaggcuuagagggcugg

SEQ ID NO: 65104 - RNA, 22 nt, Human
cuacccuugccugccaggugac

SEQ ID NO: 65105 - RNA, 22 nt, Human
cuaccggguucucagccaggca

SEQ ID NO: 65106 - RNA, 22 nt, Human
cuaccuuacuuuaacccugcaa

SEQ ID NO: 65107 - RNA, 22 nt, Human
cuacucucccaugauucucugu

SEQ ID NO: 65108 - RNA, 22 nt, Human
cuacucugugguguauuugcau

SEQ ID NO: 65109 - RNA, 22 nt, Human
cuacugaagauaacuggcucuu

SEQ ID NO: 65110 - RNA, 22 nt, Human
cuacugaguccuucagcugcca

SEQ ID NO: 65111 - RNA, 22 nt, Human
cuacugccauugucucugccau

SEQ ID NO: 65112 - RNA, 22 nt, Human
cuacuguaauagaugaauuuga

SEQ ID NO: 65113 - RNA, 22 nt, Human
cuacuguaguggccuauuuacc

SEQ ID NO: 65114 - RNA, 21 nt, Human
cuacuuaaguaggggauuagg

SEQ ID NO: 65115 - RNA, 22 nt, Human
cuacuuccagggguggggcuca

SEQ ID NO: 65116 - RNA, 22 nt, Human
cuacuucuaaguacauggugau

SEQ ID NO: 65117 - RNA, 22 nt, Human
cuacuucugugaugaaacuaca

SEQ ID NO: 65118 - RNA, 22 nt, Human
cuacuugguaccugaagaucgg

SEQ ID NO: 65119 - RNA, 21 nt, Human
cuagaaagaauguugucgucu

SEQ ID NO: 65120 - RNA, 22 nt, Human
cuagaaauauuuuacagucaag

SEQ ID NO: 65121 - RNA, 22 nt, Human
cuagaaaucucuguuuacauca

SEQ ID NO: 65122 - RNA, 22 nt, Human
cuagaaauguagauucuuagug

SEQ ID NO: 65123 - RNA, 22 nt, Human
cuagaacagaaaguacaggaaa

SEQ ID NO: 65124 - RNA, 22 nt, Human
cuagaaccuaggaguacuaaag

SEQ ID NO: 65125 - RNA, 22 nt, Human
cuagaagcaacuagaucuguuu

SEQ ID NO: 65126 - RNA, 20 nt, Human
cuagaagcagaauugcugau

SEQ ID NO: 65127 - RNA, 22 nt, Human
cuagaaucuaugucaggaacuc

SEQ ID NO: 65128 - RNA, 22 nt, Human
cuagaaucugggauuucugacu

SEQ ID NO: 65129 - RNA, 22 nt, Human
cuagaauuuuaauuggguauau

SEQ ID NO: 65130 - RNA, 22 nt, Human
cuagagaaaacuguguaucuug

SEQ ID NO: 65131 - RNA, 22 nt, Human
cuagagaaaaugauagcaggaa

SEQ ID NO: 65132 - RNA, 22 nt, Human
cuagagaaacagugcucugaac

SEQ ID NO: 65133 - RNA, 22 nt, Human
cuagagaaaccccaugagcuuu

SEQ ID NO: 65134 - RNA, 22 nt, Human
cuagagaaaggcaguggagcaa

SEQ ID NO: 65135 - RNA, 22 nt, Human
cuagagaacaacauucauaugg

SEQ ID NO: 65136 - RNA, 22 nt, Human
cuagagcagauugcagaguagg

SEQ ID NO: 65137 - RNA, 22 nt, Human
cuagagcuuucugcugguguug

SEQ ID NO: 65138 - RNA, 19 nt, Human
cuagaguaauaaguacuuu

SEQ ID NO: 65139 - RNA, 22 nt, Human
cuagagugaagggucuugaggc

SEQ ID NO: 65140 - RNA, 22 nt, Human
cuagauaaggauuucucaacuu

SEQ ID NO: 65141 - RNA, 22 nt, Human
cuagaucagauugcuguuucua

SEQ ID NO: 65142 - RNA, 18 nt, Human
cuagaugagcuuggcaag

SEQ ID NO: 65143 - RNA, 22 nt, Human
cuagcaagccuaccacgaaacu

SEQ ID NO: 65144 - RNA, 21 nt, Human
cuagcacgauuccaaguaaua

SEQ ID NO: 65145 - RNA, 22 nt, Human
cuagcagcucugauauuuacaa

SEQ ID NO: 65146 - RNA, 22 nt, Human
cuagcaggcuaauguaagcuug

SEQ ID NO: 65147 - RNA, 22 nt, Human
cuagcaucagaugagaagcugu

SEQ ID NO: 65148 - RNA, 22 nt, Human
cuagccaugggcauuaaaggua

SEQ ID NO: 65149 - RNA, 22 nt, Human
cuagcccaggaaugccguggcc

SEQ ID NO: 65150 - RNA, 22 nt, Human
cuagcuguguaaaccgagcugc

SEQ ID NO: 65151 - RNA, 22 nt, Human
cuagcuuagggaaacugacaga

SEQ ID NO: 65152 - RNA, 22 nt, Human
cuaggaaaugaauacaguacac

SEQ ID NO: 65153 - RNA, 20 nt, Human
cuaggaacuauggucuggcu

SEQ ID NO: 65154 - RNA, 22 nt, Human
cuaggaaucaccaagauucuag

SEQ ID NO: 65155 - RNA, 22 nt, Human
cuaggcagacugagcucuaggg

SEQ ID NO: 65156 - RNA, 23 nt, Human
cuaggcaggauuguaggcgggua

SEQ ID NO: 65157 - RNA, 22 nt, Human
cuaggcaguccugacgguacua

SEQ ID NO: 65158 - RNA, 22 nt, Human
cuaggccauauuuugagaacug

SEQ ID NO: 65159 - RNA, 22 nt, Human
cuaggcuagauaguauauuggu

SEQ ID NO: 65160 - RNA, 22 nt, Human
cuaggcucagucucuggucugu

SEQ ID NO: 65161 - RNA, 22 nt, Human
cucaaggccaguucuucugacu

SEQ ID NO: 65162 - RNA, 22 nt, Human
cucaaguaagaaacagaauugg

SEQ ID NO: 65163 - RNA, 22 nt, Human
cucaaguaauuagcaacaaaua

SEQ ID NO: 65164 - RNA, 22 nt, Human
cucaaguccauagaaucaggaa

SEQ ID NO: 65165 - RNA, 22 nt, Human
cucacaauuuuucagugacuau

SEQ ID NO: 65166 - RNA, 22 nt, Human
gcacuugggcagagacgcacag

SEQ ID NO: 65167 - RNA, 22 nt, Human
gcacuuuagcauugguuuacac

SEQ ID NO: 65168 - RNA, 22 nt, Human
gcacuuuauaguagaaagagca

SEQ ID NO: 65169 - RNA, 22 nt, Human
cuaggcugagcugggcugagcu

SEQ ID NO: 65170 - RNA, 22 nt, Human
cuaggcugcaccuaggauggcu

SEQ ID NO: 65171 - RNA, 22 nt, Human
cuaggcuguaaccccugccagg

SEQ ID NO: 65172 - RNA, 22 nt, Human
cuaggcugugcauugcaugaca

SEQ ID NO: 65173 - RNA, 22 nt, Human
cuaggcuguucaugcucagacc

SEQ ID NO: 65174 - RNA, 22 nt, Human
cuagggaaauaaacugaguggu

SEQ ID NO: 65175 - RNA, 22 nt, Human
cuagggaaugagagacuggauc

SEQ ID NO: 65176 - RNA, 22 nt, Human
cuagggacagaaagaggguaga

SEQ ID NO: 65177 - RNA, 22 nt, Human
cuagggacugggaccuuaguua

SEQ ID NO: 65178 - RNA, 22 nt, Human
cuagggagggauguuggcauga

SEQ ID NO: 65179 - RNA, 22 nt, Human
cuagggucuguuuuccaggugu

SEQ ID NO: 65180 - RNA, 22 nt, Human
cuagguuuaacuuucacagaaa

SEQ ID NO: 65181 - RNA, 22 nt, Human
cuaguaaagcuaugauucugcc

SEQ ID NO: 65182 - RNA, 22 nt, Human
cuaguaaaucagaagcuguggg

SEQ ID NO: 65183 - RNA, 23 nt, Human
cuaguaaauccugaauagcaggc

SEQ ID NO: 65184 - RNA, 22 nt, Human
cuaguauuacauuuuugugugu

SEQ ID NO: 65185 - RNA, 22 nt, Human
cuaguauuuaaaggcuaugauu

SEQ ID NO: 65186 - RNA, 22 nt, Human
cuagugaacgugguacuaugga

SEQ ID NO: 65187 - RNA, 22 nt, Human
cuagugcucuaggggcugaagg

SEQ ID NO: 65188 - RNA, 22 nt, Human
cuaguggaaacuaacuggaauu

SEQ ID NO: 65189 - RNA, 22 nt, Human
cuagugugucuaugucuguucc

SEQ ID NO: 65190 - RNA, 22 nt, Human
cuaguucuuaacuguuaugauu

SEQ ID NO: 65191 - RNA, 22 nt, Human
cuaguuuaaagcagcugaaagg

SEQ ID NO: 65192 - RNA, 22 nt, Human
cuaguuugguuagauaagucuc

SEQ ID NO: 65193 - RNA, 22 nt, Human
cuauaagacagauacugacuuu

SEQ ID NO: 65194 - RNA, 22 nt, Human
cuauaauuaugcucaaaaugua

SEQ ID NO: 65195 - RNA, 19 nt, Human
cuauacagccucugaggaa

SEQ ID NO: 65196 - RNA, 22 nt, Human
cuauacagugacuagaaguaau

SEQ ID NO: 65197 - RNA, 22 nt, Human
cuauauugguaauauuugcuca

SEQ ID NO: 65198 - RNA, 22 nt, Human
cuauccaaggaguuuuugaaau

SEQ ID NO: 65199 - RNA, 22 nt, Human
cuaucucagauaaccugcacca

SEQ ID NO: 65200 - RNA, 22 nt, Human
cuaucucaugcaucaacucuuc

SEQ ID NO: 65201 - RNA, 22 nt, Human
cuaugaaaugucagauucugca

SEQ ID NO: 65202 - RNA, 22 nt, Human
cuaugacacaggccauuauaua

SEQ ID NO: 65203 - RNA, 22 nt, Human
cuauggaaaccuaaucaggaga

SEQ ID NO: 65204 - RNA, 22 nt, Human
cuauguucucggcacuauggau

SEQ ID NO: 65205 - RNA, 22 nt, Human
cuauuacauuucuggacauuca

SEQ ID NO: 65206 - RNA, 22 nt, Human
cuauuagcugaauaaugcauug

SEQ ID NO: 65207 - RNA, 22 nt, Human
cuauuagguaugcagccuauuu

SEQ ID NO: 65208 - RNA, 22 nt, Human
cuauuuaucuauuucugaauga

SEQ ID NO: 65209 - RNA, 22 nt, Human
cuauuucagcugccuuugacug

SEQ ID NO: 65210 - RNA, 22 nt, Human
cuauuucauguuccuauggccg

SEQ ID NO: 65211 - RNA, 22 nt, Human
cuauuuggccauagugcaguua

SEQ ID NO: 65212 - RNA, 22 nt, Human
cuauuugggguagaagauggau

SEQ ID NO: 65213 - RNA, 22 nt, Human
cuauuuuaagaggccauuaggu

SEQ ID NO: 65214 - RNA, 22 nt, Human
cuauuuucugucucuauagagu

SEQ ID NO: 65215 - RNA, 22 nt, Human
cuauuuuucuguacccuaauuu

SEQ ID NO: 65216 - RNA, 22 nt, Human
cucaaaauccauaaaaucaggu

SEQ ID NO: 65217 - RNA, 21 nt, Human
cucaaaauucuuucuguugga

SEQ ID NO: 65218 - RNA, 22 nt, Human
cucaaauagaacugaucuauaa

SEQ ID NO: 65219 - RNA, 22 nt, Human
cucaaauauguggucagaaagc

SEQ ID NO: 65220 - RNA, 22 nt, Human
cucaacacguccucgagaagcg

SEQ ID NO: 65221 - RNA, 22 nt, Human
cucaacauuuaacagugaaaaa

SEQ ID NO: 65222 - RNA, 23 nt, Human
cucaacccuaguaagggaguagg

SEQ ID NO: 65223 - RNA, 22 nt, Human
cucaagaaucuagggaggauuc

SEQ ID NO: 65224 - RNA, 22 nt, Human
cucaagacugaucgcaguggaa

SEQ ID NO: 65225 - RNA, 22 nt, Human
cucaaguuggcaugaacaaauu

SEQ ID NO: 65226 - RNA, 22 nt, Human
cucaaguuucauauuugucuag

SEQ ID NO: 65227 - RNA, 22 nt, Human
cucaauaugccagaggggaaag

SEQ ID NO: 65228 - RNA, 22 nt, Human
cucacagauacggcuauuccug

SEQ ID NO: 65229 - RNA, 22 nt, Human
cucacagcauggaauuuucugg

SEQ ID NO: 65230 - RNA, 22 nt, Human
cucacagguaccagcacccucc

SEQ ID NO: 65231 - RNA, 22 nt, Human
cucacagguuaguuguguggau

SEQ ID NO: 65232 - RNA, 22 nt, Human
cucacagguucugcagcucaca

SEQ ID NO: 65233 - RNA, 22 nt, Human
cucacagugaugucuuaugaca

SEQ ID NO: 65234 - RNA, 22 nt, Human
cucacaguguaauauugaaccc

SEQ ID NO: 65235 - RNA, 22 nt, Human
cucacauaugcugggauuuccg

SEQ ID NO: 65236 - RNA, 22 nt, Human
cucaccaggaacagcugcggag

SEQ ID NO: 65237 - RNA, 20 nt, Human
cucaccagguguaggcugag

SEQ ID NO: 65238 - RNA, 22 nt, Human
cucaccauggaucuuccauuuc

SEQ ID NO: 65239 - RNA, 22 nt, Human
cucacccauaucuccaugacuc

SEQ ID NO: 65240 - RNA, 17 nt, Human
cucacggaggaugaauc

SEQ ID NO: 65241 - RNA, 22 nt, Human
cucacugacgaggaagcugaga

SEQ ID NO: 65242 - RNA, 22 nt, Human
cucacuguccaacaggcuuuac

SEQ ID NO: 65243 - RNA, 22 nt, Human
cucacugugaccucagcagaca

SEQ ID NO: 65244 - RNA, 20 nt, Human
cucagaaaagcuaaggagaa

SEQ ID NO: 65245 - RNA, 22 nt, Human
cucagacccccagagcugcuaa

SEQ ID NO: 65246 - RNA, 22 nt, Human
cucagacugguggguaaaaccu

SEQ ID NO: 65247 - RNA, 22 nt, Human
cucagacuugcuuuuuauggaa

SEQ ID NO: 65248 - RNA, 22 nt, Human
cucagagaaccuaagcggagga

SEQ ID NO: 65249 - RNA, 19 nt, Human
cucagagaggggcagugcc

SEQ ID NO: 65250 - RNA, 22 nt, Human
cucagagagguugaacaacuug

SEQ ID NO: 65251 - RNA, 22 nt, Human
cucagagagugaauuccugccu

SEQ ID NO: 65252 - RNA, 22 nt, Human
cucagagaguuaagugaauuac

SEQ ID NO: 65253 - RNA, 22 nt, Human
cucagagauauagucccugcuu

SEQ ID NO: 65254 - RNA, 18 nt, Human
cucagagaugcccuuauu

SEQ ID NO: 65255 - RNA, 22 nt, Human
cucagagccaguuagcaggugc

SEQ ID NO: 65256 - RNA, 22 nt, Human
cucagaggggaugcuuggagaa

SEQ ID NO: 65257 - RNA, 22 nt, Human
cucagaggucaagagcagagcu

SEQ ID NO: 65258 - RNA, 22 nt, Human
cucagaguccauaguuuacagu

SEQ ID NO: 65259 - RNA, 17 nt, Human
cucagaguugcuuuguc

SEQ ID NO: 65260 - RNA, 22 nt, Human
cucagauaaucuuugagucuuc

SEQ ID NO: 65261 - RNA, 22 nt, Human
cucagauguguuggauggaaaa

SEQ ID NO: 65262 - RNA, 22 nt, Human
cucagcaacagcgacuuaaggg

SEQ ID NO: 65263 - RNA, 22 nt, Human
cucagcaagauuaagcagcuug

SEQ ID NO: 65264 - RNA, 22 nt, Human
cucagcacugacccaggagaug

SEQ ID NO: 65265 - RNA, 22 nt, Human
cucagcagagaccagggaggaa

SEQ ID NO: 65266 - RNA, 22 nt, Human
cucagcaggcacugugccuuac

SEQ ID NO: 65267 - RNA, 22 nt, Human
cucagcagugacaagagaguau

SEQ ID NO: 65268 - RNA, 22 nt, Human
cucagcauucaauguccagucc

SEQ ID NO: 65269 - RNA, 22 nt, Human
cucagccaggagaguguucaca

SEQ ID NO: 65270 - RNA, 22 nt, Human
cucagccaugcaacaugcuggg

SEQ ID NO: 65271 - RNA, 22 nt, Human
cucagcccagcucaggucuuuc

SEQ ID NO: 65272 - RNA, 22 nt, Human
cucagccccaauucuccccauu

SEQ ID NO: 65273 - RNA, 22 nt, Human
cucagcuacuugggaagcuuag

SEQ ID NO: 65274 - RNA, 22 nt, Human
cucagcucugucacuuacuagc

SEQ ID NO: 65275 - RNA, 23 nt, Human
agcaguaacuucagaaacaucag

SEQ ID NO: 65276 - RNA, 22 nt, Human
agcaguaagacuuuuuucugug

SEQ ID NO: 65277 - RNA, 20 nt, Human
agcaguaggaccucugggcc

SEQ ID NO: 65278 - RNA, 20 nt, Human
agcaguccaaaagggcagac

SEQ ID NO: 65279 - RNA, 22 nt, Human
agcagugagugggaggaccaug

SEQ ID NO: 65280 - RNA, 22 nt, Human
agcagugccgcaucuugugacc

SEQ ID NO: 65281 - RNA, 22 nt, Human
agcagugcuauggccaggcuaa

SEQ ID NO: 65282 - RNA, 22 nt, Human
agcaguggagcgagauguuuaa

SEQ ID NO: 65283 - RNA, 22 nt, Human
agcaguggccuggggcucugug

SEQ ID NO: 65284 - RNA, 22 nt, Human
agcaguggcuggauggugugcu

SEQ ID NO: 65285 - RNA, 22 nt, Human
agcagugugcuucguuucauga

SEQ ID NO: 65286 - RNA, 18 nt, Human
agcaguguggcaagcaga

SEQ ID NO: 65287 - RNA, 22 nt, Human
agcagugugggcugcacgcugg

SEQ ID NO: 65288 - RNA, 20 nt, Human
agcaguguggggagacugug

SEQ ID NO: 65289 - RNA, 22 nt, Human
agcaguuauguucuauaaaguc

SEQ ID NO: 65290 - RNA, 22 nt, Human
agcaguuugaaucaauggccag

SEQ ID NO: 65291 - RNA, 22 nt, Human
agcaguuuuccugagcuccuca

SEQ ID NO: 65292 - RNA, 22 nt, Human
agcauaaaauaaauaguuugca

SEQ ID NO: 65293 - RNA, 22 nt, Human
agcauaaacucagggacacaca

SEQ ID NO: 65294 - RNA, 22 nt, Human
agcauaaaggucaacguuuuag

SEQ ID NO: 65295 - RNA, 22 nt, Human
agcauaauuccugacacacaag

SEQ ID NO: 65296 - RNA, 22 nt, Human
agcauacacccuaaacugcuua

SEQ ID NO: 65297 - RNA, 22 nt, Human
agcauauacaaacucauauaca

SEQ ID NO: 65298 - RNA, 22 nt, Human
agcauauucaugccagacuacu

SEQ ID NO: 65299 - RNA, 22 nt, Human
agcaucaacaaugaacauaaau

SEQ ID NO: 65300 - RNA, 22 nt, Human
agcaucagagagaaguuaacua

SEQ ID NO: 65301 - RNA, 22 nt, Human
agcauccacucacugggagagg

SEQ ID NO: 65302 - RNA, 19 nt, Human
agcaucucccugaucauuc

SEQ ID NO: 65303 - RNA, 22 nt, Human
agcaucuggugagggccuaguu

SEQ ID NO: 65304 - RNA, 22 nt, Human
agcaucuguugaauauaauauu

SEQ ID NO: 65305 - RNA, 22 nt, Human
agcaucuuuaggaagagaaaga

SEQ ID NO: 65306 - RNA, 22 nt, Human
agcaugaaaacaugaaacagca

SEQ ID NO: 65307 - RNA, 20 nt, Human
agcaugcagccagagccaac

SEQ ID NO: 65308 - RNA, 22 nt, Human
agcaugcuauauugauuguagu

SEQ ID NO: 65309 - RNA, 22 nt, Human
agcaugcugggucauuuuugcc

SEQ ID NO: 65310 - RNA, 22 nt, Human
agcaugcugguguucauggcag

SEQ ID NO: 65311 - RNA, 22 nt, Human
agcaugcuuggcauuugucaga

SEQ ID NO: 65312 - RNA, 19 nt, Human
agcauggccuacagugugc

SEQ ID NO: 65313 - RNA, 22 nt, Human
agcauguaaagcucuuagcacc

SEQ ID NO: 65314 - RNA, 22 nt, Human
agcauguguaaucucaauaccu

SEQ ID NO: 65315 - RNA, 23 nt, Human
agcauguugugauguuaccacug

SEQ ID NO: 65316 - RNA, 22 nt, Human
agcauuaauaagaaauggcucc

SEQ ID NO: 65317 - RNA, 22 nt, Human
agcauuagaagaaaugauuaua

SEQ ID NO: 65318 - RNA, 23 nt, Human
agcauuagagaugccagcccugu

SEQ ID NO: 65319 - RNA, 22 nt, Human
agcauuagauuaaaaauuuaga

SEQ ID NO: 65320 - RNA, 18 nt, Human
agcauuaggagguuauca

SEQ ID NO: 65321 - RNA, 21 nt, Human
agcauucaaaagaugccauaa

SEQ ID NO: 65322 - RNA, 22 nt, Human
agcauucaaugauuggacuugc

SEQ ID NO: 65323 - RNA, 22 nt, Human
agcauuccagugcacaguagaa

SEQ ID NO: 65324 - RNA, 20 nt, Human
agcauucuacuagacuuuuc

SEQ ID NO: 65325 - RNA, 22 nt, Human
agcauucuguggucuucuaugg

SEQ ID NO: 65326 - RNA, 21 nt, Human
agcauucuuggccaguccacc

SEQ ID NO: 65327 - RNA, 22 nt, Human
agcauugagguggguuucucuu

SEQ ID NO: 65328 - RNA, 22 nt, Human
agcauuuaauccuacauagauc

SEQ ID NO: 65329 - RNA, 22 nt, Human
agcauuuaauuacaguuuaauu

SEQ ID NO: 65330 - RNA, 22 nt, Human
agcauuuaccucaaugcaucug

SEQ ID NO: 65331 - RNA, 20 nt, Human
agcauuuagccuuuauccac

SEQ ID NO: 65332 - RNA, 22 nt, Human
agcauuuaucuuuuguuugagu

SEQ ID NO: 65333 - RNA, 22 nt, Human
agcauuuauuucuuagaaauug

SEQ ID NO: 65334 - RNA, 20 nt, Human
agcauuugaaauaugacuau

SEQ ID NO: 65335 - RNA, 17 nt, Human
agcauuuguguuaacag

SEQ ID NO: 65336 - RNA, 22 nt, Human
agccaaagagaccccauaucca

SEQ ID NO: 65337 - RNA, 22 nt, Human
agccaaaguccaaaugcagugu

SEQ ID NO: 65338 - RNA, 22 nt, Human
agccaacucccucucauugagc

SEQ ID NO: 65339 - RNA, 20 nt, Human
agccaagaacaggcagaacc

SEQ ID NO: 65340 - RNA, 22 nt, Human
agccaagagacagaugcccacc

SEQ ID NO: 65341 - RNA, 22 nt, Human
agccaagagcucaccucgugug

SEQ ID NO: 65342 - RNA, 22 nt, Human
agccaaggacucagugguaggc

SEQ ID NO: 65343 - RNA, 22 nt, Human
agccaaucauccucagacucuc

SEQ ID NO: 65344 - RNA, 22 nt, Human
agccacaaugccaaccucuacu

SEQ ID NO: 65345 - RNA, 22 nt, Human
agccacagcaacaagugcaauu

SEQ ID NO: 65346 - RNA, 23 nt, Human
agccacagccagagcuaucucca

SEQ ID NO: 65347 - RNA, 22 nt, Human
agccacagccugacuuaacugu

SEQ ID NO: 65348 - RNA, 22 nt, Human
agccacauggaccugaugcuag

SEQ ID NO: 65349 - RNA, 22 nt, Human
agccacauuuuucugcuccuga

SEQ ID NO: 65350 - RNA, 22 nt, Human
agccacccuaccagcccugaaa

SEQ ID NO: 65351 - RNA, 22 nt, Human
agccaccuccugcucugcucac

SEQ ID NO: 65352 - RNA, 22 nt, Human
agccacugucugaacuucugug

SEQ ID NO: 65353 - RNA, 22 nt, Human
agccacugugagaggaccaggg

SEQ ID NO: 65354 - RNA, 22 nt, Human
agccacugugugaccagcuguc

SEQ ID NO: 65355 - RNA, 22 nt, Human
agccagacauggcuccugcucc

SEQ ID NO: 65356 - RNA, 22 nt, Human
agccagacucauuuggaaguau

SEQ ID NO: 65357 - RNA, 22 nt, Human
agccagagauugagaugcaggc

SEQ ID NO: 65358 - RNA, 22 nt, Human
agccagagggaaucuuugggga

SEQ ID NO: 65359 - RNA, 21 nt, Human
agccagauccauuuugcaugg

SEQ ID NO: 65360 - RNA, 22 nt, Human
agccagcacggauuucccagga

SEQ ID NO: 65361 - RNA, 19 nt, Human
agccagcagcguagcaucu

SEQ ID NO: 65362 - RNA, 22 nt, Human
agccagcaggugcagaauucca

SEQ ID NO: 65363 - RNA, 17 nt, Human
agccagcaguagcuggu

SEQ ID NO: 65364 - RNA, 22 nt, Human
agccagcuaagggaagcaugau

SEQ ID NO: 65365 - RNA, 21 nt, Human
agccagcuaucacacagcauu

SEQ ID NO: 65366 - RNA, 22 nt, Human
agccagcucugaguugaaguac

SEQ ID NO: 65367 - RNA, 22 nt, Human
agccagcuggagaccacuguuu

SEQ ID NO: 65368 - RNA, 22 nt, Human
agccagcuguggcuauggcucc

SEQ ID NO: 65369 - RNA, 22 nt, Human
agccagcuuucacaaaugaaga

SEQ ID NO: 65370 - RNA, 22 nt, Human
agccaggaagagaggccucacc

SEQ ID NO: 65371 - RNA, 22 nt, Human
agccaggacguugcucagcucc

SEQ ID NO: 65372 - RNA, 22 nt, Human
agccaggaucacccggggcugu

SEQ ID NO: 65373 - RNA, 22 nt, Human
agccaggauggucucgaucggc

SEQ ID NO: 65374 - RNA, 22 nt, Human
agccaggauuggcugagccuua

SEQ ID NO: 65375 - RNA, 22 nt, Human
agccaggcagacucucuuucuu

SEQ ID NO: 65376 - RNA, 20 nt, Human
agccaggccucaaguuaagu

SEQ ID NO: 65377 - RNA, 22 nt, Human
acuuucuauggcuuauuaugag

SEQ ID NO: 65378 - RNA, 22 nt, Human
acuuucucccacccacccgucu

SEQ ID NO: 65379 - RNA, 22 nt, Human
acuuucugcaguguuggaaaug

SEQ ID NO: 65380 - RNA, 22 nt, Human
acuuucuuaggcuguauaaaug

SEQ ID NO: 65381 - RNA, 22 nt, Human
acuuugaaagccuuggccccgg

SEQ ID NO: 65382 - RNA, 22 nt, Human
acuuugcaaauaaacucucuaa

SEQ ID NO: 65383 - RNA, 22 nt, Human
acuuugcaagguacuaacugua

SEQ ID NO: 65384 - RNA, 22 nt, Human
agagcacagaaguuauauguua

SEQ ID NO: 65385 - RNA, 22 nt, Human
agagcacagcagaucucugaug

SEQ ID NO: 65386 - RNA, 22 nt, Human
agagcacagccaccauuuacaa

SEQ ID NO: 65387 - RNA, 22 nt, Human
agagcacaggcucaccauuguu

SEQ ID NO: 65388 - RNA, 22 nt, Human
agagcacaggcucuggagucua

SEQ ID NO: 65389 - RNA, 22 nt, Human
agagcacaggguuuugugccgg

SEQ ID NO: 65390 - RNA, 21 nt, Human
agagcacagguggacaaugcu

SEQ ID NO: 65391 - RNA, 22 nt, Human
agagcacagugcaggauccccg

SEQ ID NO: 65392 - RNA, 22 nt, Human
agagcacaugguuccugugucc

SEQ ID NO: 65393 - RNA, 22 nt, Human
agagcagaggcauggccguggg

SEQ ID NO: 65394 - RNA, 22 nt, Human
agagcagaguggcuguagcuug

SEQ ID NO: 65395 - RNA, 22 nt, Human
agagcagauggagcuggaagag

SEQ ID NO: 65396 - RNA, 22 nt, Human
agagcagauuucaaauauuggc

SEQ ID NO: 65397 - RNA, 22 nt, Human
agagcagcucgcuaccucucua

SEQ ID NO: 65398 - RNA, 22 nt, Human
agagcagcugacagccugccau

SEQ ID NO: 65399 - RNA, 22 nt, Human
agagcagcugcauucagcaccu

SEQ ID NO: 65400 - RNA, 22 nt, Human
agagcaggggcaauguguugca

SEQ ID NO: 65401 - RNA, 22 nt, Human
agagcagugcugaagaguaggg

SEQ ID NO: 65402 - RNA, 23 nt, Human
agagcaucaugaugcuaagucug

SEQ ID NO: 65403 - RNA, 23 nt, Human
agagccaagcuucuuucucacau

SEQ ID NO: 65404 - RNA, 22 nt, Human
agagccaaggccucagucucaa

SEQ ID NO: 65405 - RNA, 22 nt, Human
agagccacugggagacagagca

SEQ ID NO: 65406 - RNA, 22 nt, Human
agagccagcaagugaauaguga

SEQ ID NO: 65407 - RNA, 22 nt, Human
agagccaggcucccauggggca

SEQ ID NO: 65408 - RNA, 22 nt, Human
agagccaggcucuaccuggguu

SEQ ID NO: 65409 - RNA, 22 nt, Human
agagccaggugcugcuguuuga

SEQ ID NO: 65410 - RNA, 22 nt, Human
agagccagguguagucucggag

SEQ ID NO: 65411 - RNA, 22 nt, Human
agagcccagugacaucagcaca

SEQ ID NO: 65412 - RNA, 22 nt, Human
agagcccaucaguggcagugga

SEQ ID NO: 65413 - RNA, 22 nt, Human
agagccccucgguggagggguc

SEQ ID NO: 65414 - RNA, 22 nt, Human
agagccccugggucacacagcc

SEQ ID NO: 65415 - RNA, 22 nt, Human
agagcccuaaacccugccuugg

SEQ ID NO: 65416 - RNA, 22 nt, Human
agagcccucugcaaugccucag

SEQ ID NO: 65417 - RNA, 22 nt, Human
agagcccugaagcagagcuaaa

SEQ ID NO: 65418 - RNA, 22 nt, Human
agagcccugugguucugguaag

SEQ ID NO: 65419 - RNA, 21 nt, Human
agagccugagaucuuccagca

SEQ ID NO: 65420 - RNA, 22 nt, Human
agagccugagccugaaagcccu

SEQ ID NO: 65421 - RNA, 22 nt, Human
agagccugcagcugugaagaaa

SEQ ID NO: 65422 - RNA, 22 nt, Human
agagccugcaucuagccucaga

SEQ ID NO: 65423 - RNA, 22 nt, Human
agagccuggaccugagcuacaa

SEQ ID NO: 65424 - RNA, 22 nt, Human
agagccuggcucccagcuaccg

SEQ ID NO: 65425 - RNA, 22 nt, Human
agagccuggggauuggcaaggg

SEQ ID NO: 65426 - RNA, 22 nt, Human
agagccuggucugagauaggac

SEQ ID NO: 65427 - RNA, 22 nt, Human
agagccugguucaaauuuuacc

SEQ ID NO: 65428 - RNA, 22 nt, Human
agagccuucagagauuauuuua

SEQ ID NO: 65429 - RNA, 22 nt, Human
agagcgcacugucugcaggcaa

SEQ ID NO: 65430 - RNA, 22 nt, Human
agagcggggauaguuaauauuc

SEQ ID NO: 65431 - RNA, 22 nt, Human
agagcuccgugccuggcugcca

SEQ ID NO: 65432 - RNA, 22 nt, Human
agagcuccucacuucggguuca

SEQ ID NO: 65433 - RNA, 22 nt, Human
agagcucuuugauuugcuucuc

SEQ ID NO: 65434 - RNA, 22 nt, Human
agagcugaggauccagcugagc

SEQ ID NO: 65435 - RNA, 22 nt, Human
agagcugcgucuauucacaauc

SEQ ID NO: 65436 - RNA, 22 nt, Human
agagcuggagaugcagguuucg

SEQ ID NO: 65437 - RNA, 22 nt, Human
agagcuggcugugggugacuuu

SEQ ID NO: 65438 - RNA, 22 nt, Human
agagcugggacuuggacucaau

SEQ ID NO: 65439 - RNA, 22 nt, Human
agagcuggggccagagucaagg

SEQ ID NO: 65440 - RNA, 22 nt, Human
agagcugggugguggugacuca

SEQ ID NO: 65441 - RNA, 22 nt, Human
agagcuguguuuaguaguuacg

SEQ ID NO: 65442 - RNA, 22 nt, Human
agagcuucacuggagagcacau

SEQ ID NO: 65443 - RNA, 22 nt, Human
agagcuuguaauugagucaggu

SEQ ID NO: 65444 - RNA, 23 nt, Human
agagcuuuccaguuucuugguga

SEQ ID NO: 65445 - RNA, 22 nt, Human
agagcuuuguuugauugucaga

SEQ ID NO: 65446 - RNA, 22 nt, Human
agagcuuuucuguaauaacauc

SEQ ID NO: 65447 - RNA, 22 nt, Human
agagcuuuuugacaucucucua

SEQ ID NO: 65448 - RNA, 22 nt, Human
agaggaaauggauaaaggguga

SEQ ID NO: 65449 - RNA, 22 nt, Human
agaggaacccagacagggcuuu

SEQ ID NO: 65450 - RNA, 22 nt, Human
agaggaagcugagaugccucuu

SEQ ID NO: 65451 - RNA, 22 nt, Human
agaggaaggaugcauauccaaa

SEQ ID NO: 65452 - RNA, 21 nt, Human
agaggaagugauuggucuggc

SEQ ID NO: 65453 - RNA, 22 nt, Human
agaggaauguauuucccugcaa

SEQ ID NO: 65454 - RNA, 22 nt, Human
agaggagaauccguuuccuugc

SEQ ID NO: 65455 - RNA, 22 nt, Human
agaggagcugggaggcccucgu

SEQ ID NO: 65456 - RNA, 22 nt, Human
agaggaggcagcuuaacucagu

SEQ ID NO: 65457 - RNA, 22 nt, Human
agaggagugggaagcagugcaa

SEQ ID NO: 65458 - RNA, 22 nt, Human
agaggaguuugcuggugugugc

SEQ ID NO: 65459 - RNA, 22 nt, Human
agaggaugguugaggaagaccu

SEQ ID NO: 65460 - RNA, 22 nt, Human
agaggcaaaaaucuauggcaac

SEQ ID NO: 65461 - RNA, 19 nt, Human
agaggcaaggguggaagua

SEQ ID NO: 65462 - RNA, 23 nt, Human
agaggcacagcacuuggcuggcc

SEQ ID NO: 65463 - RNA, 22 nt, Human
agaggcaccaucuggaacagcc

SEQ ID NO: 65464 - RNA, 22 nt, Human
agaggcaccgucugcagcgugc

SEQ ID NO: 65465 - RNA, 22 nt, Human
agaggcacuguucuuagcgacu

SEQ ID NO: 65466 - RNA, 22 nt, Human
agaggcaggaagagcugauuuu

SEQ ID NO: 65467 - RNA, 22 nt, Human
agaggcaggagguugacuugag

SEQ ID NO: 65468 - RNA, 16 nt, Human
agaggccacagacaga

SEQ ID NO: 65469 - RNA, 22 nt, Human
agaggccagcccaggccaccga

SEQ ID NO: 65470 - RNA, 23 nt, Human
agaggccagccuuuggagacacc

SEQ ID NO: 65471 - RNA, 22 nt, Human
agaggccaguggcugugcuguc

SEQ ID NO: 65472 - RNA, 22 nt, Human
agaggccccaugggauggcggu

SEQ ID NO: 65473 - RNA, 21 nt, Human
agaggcccucggacugggcgu

SEQ ID NO: 65474 - RNA, 22 nt, Human
agaggccggccgagcccauggg

SEQ ID NO: 65475 - RNA, 22 nt, Human
agaggccgggugccugcucaga

SEQ ID NO: 65476 - RNA, 19 nt, Human
agaggccucagcagcuggc

SEQ ID NO: 65477 - RNA, 22 nt, Human
agaggccuccgaaaggugggcu

SEQ ID NO: 65478 - RNA, 22 nt, Human
agaggccucuuugcaaguaggu

SEQ ID NO: 65479 - RNA, 22 nt, Human
agaggcuccaccuucucugucc

SEQ ID NO: 65480 - RNA, 22 nt, Human
agaggcuccuagccacuggcuu

SEQ ID NO: 65481 - RNA, 22 nt, Human
agaggcucuaauccccuccaca

SEQ ID NO: 65482 - RNA, 22 nt, Human
agaggcucuugcccuucccaca

SEQ ID NO: 65483 - RNA, 22 nt, Human
agaggcugauggaguagugucu

SEQ ID NO: 65484 - RNA, 22 nt, Human
agaggcugcacuugcucaugau

SEQ ID NO: 65485 - RNA, 22 nt, Human
agaggcuggauugagcauagac

SEQ ID NO: 65486 - RNA, 19 nt, Human
agaggcugucaccuguagc

SEQ ID NO: 65487 - RNA, 22 nt, Human
agaggcugugcagagggagugc

SEQ ID NO: 65488 - RNA, 22 nt, Human
agaggcuucucggauggggcag

SEQ ID NO: 65489 - RNA, 22 nt, Human
agaggcuucuuucugauuugcg

SEQ ID NO: 65490 - RNA, 22 nt, Human
agaauuccuccucugggacacu

SEQ ID NO: 65491 - RNA, 22 nt, Human
agaauuccucuaggaucugccc

SEQ ID NO: 65492 - RNA, 22 nt, Human
agaauucuccacgcucaggguc

SEQ ID NO: 65493 - RNA, 22 nt, Human
agcagagcuuuuuggacucaga

SEQ ID NO: 65494 - RNA, 21 nt, Human
agcagaggcugccuggugacu

SEQ ID NO: 65495 - RNA, 22 nt, Human
agcagagugugaaggcagggcu

SEQ ID NO: 65496 - RNA, 22 nt, Human
agcagaugagccucaugacugg

SEQ ID NO: 65497 - RNA, 22 nt, Human
agcagauguuucagagcaggcu

SEQ ID NO: 65498 - RNA, 22 nt, Human
agcagcaaggaagcgaggaugg

SEQ ID NO: 65499 - RNA, 22 nt, Human
agcagcaauaauaaaguaauac

SEQ ID NO: 65500 - RNA, 22 nt, Human
agcagcacccagagccaugucu

SEQ ID NO: 65501 - RNA, 19 nt, Human
agcagcagaagugugccuu

SEQ ID NO: 65502 - RNA, 23 nt, Human
agcagcagcaauuaaguggauau

SEQ ID NO: 65503 - RNA, 22 nt, Human
agcagcagccguagccuuauua

SEQ ID NO: 65504 - RNA, 22 nt, Human
agcagcaggcugggaugagucu

SEQ ID NO: 65505 - RNA, 22 nt, Human
agcagcaggcuguguggacuga

SEQ ID NO: 65506 - RNA, 21 nt, Human
agcagcagggaagccucaucc

SEQ ID NO: 65507 - RNA, 22 nt, Human
agcagcagggcaugucuuacuc

SEQ ID NO: 65508 - RNA, 22 nt, Human
agcagcagucaugccuaugcuc

SEQ ID NO: 65509 - RNA, 22 nt, Human
agcagcaguccuuuguguaauu

SEQ ID NO: 65510 - RNA, 22 nt, Human
agcagcagugugguuuggggaa

SEQ ID NO: 65511 - RNA, 22 nt, Human
agcagcaguguguggucauguu

SEQ ID NO: 65512 - RNA, 22 nt, Human
agcagcauacacaucauguuga

SEQ ID NO: 65513 - RNA, 22 nt, Human
agcagcauagaugcuauccgag

SEQ ID NO: 65514 - RNA, 22 nt, Human
agcagcauaucagagaaaguca

SEQ ID NO: 65515 - RNA, 22 nt, Human
agcagcaucuucuguucuccgc

SEQ ID NO: 65516 - RNA, 22 nt, Human
agcuguggggaggaggcuagca

SEQ ID NO: 65517 - RNA, 22 nt, Human
agcuguggggcaggcagcgagg

SEQ ID NO: 65518 - RNA, 22 nt, Human
agcugugguguuuucaagcccu

SEQ ID NO: 65519 - RNA, 22 nt, Human
agcugugguucugggcagcgac

SEQ ID NO: 65520 - RNA, 22 nt, Human
agcugugugaccuagggcaagc

SEQ ID NO: 65521 - RNA, 23 nt, Human
agcugugugcgcguccggguucu

SEQ ID NO: 65522 - RNA, 22 nt, Human
agcuguguggugucugacagcu

SEQ ID NO: 65523 - RNA, 22 nt, Human
agcuguuccaggccucauugcu

SEQ ID NO: 65524 - RNA, 22 nt, Human
agcuguugaaaaugguguccua

SEQ ID NO: 65525 - RNA, 18 nt, Human
agcuguuguugacucugu

SEQ ID NO: 65526 - RNA, 20 nt, Human
agcuguuuacauggauuucu

SEQ ID NO: 65527 - RNA, 23 nt, Human
agcuguuucuugugaguugagug

SEQ ID NO: 65528 - RNA, 22 nt, Human
agcuguuuucuugccguccuag

SEQ ID NO: 65529 - RNA, 22 nt, Human
agcuguuuuuccagucucugga

SEQ ID NO: 65530 - RNA, 22 nt, Human
agcuguuuuugugggcauguga

SEQ ID NO: 65531 - RNA, 22 nt, Human
agcuuaaaguauuuaaauuuca

SEQ ID NO: 65532 - RNA, 22 nt, Human
agcuuacucuucaagaacaagc

SEQ ID NO: 65533 - RNA, 22 nt, Human
agcuuacuguaauuaaaagacu

SEQ ID NO: 65534 - RNA, 18 nt, Human
agcuuagcauacuuuucc

SEQ ID NO: 65535 - RNA, 22 nt, Human
agcuucaaagcuaggaagaucu

SEQ ID NO: 65536 - RNA, 22 nt, Human
agcuucaacuuacuaaaagaua

SEQ ID NO: 65537 - RNA, 22 nt, Human
agcuucaguuuucuauuguuaa

SEQ ID NO: 65538 - RNA, 23 nt, Human
agcuucaucuugcugugucucag

SEQ ID NO: 65539 - RNA, 23 nt, Human
agcuucauugaccuccgcagggg

SEQ ID NO: 65540 - RNA, 23 nt, Human
agcuuccuagugaccuggagucu

SEQ ID NO: 65541 - RNA, 22 nt, Human
agcuuccugacuggugcucuua

SEQ ID NO: 65542 - RNA, 22 nt, Human
agcuuccuguugagagagggag

SEQ ID NO: 65543 - RNA, 22 nt, Human
agcuuccuugaauucuguagaa

SEQ ID NO: 65544 - RNA, 22 nt, Human
agcuuccuuggcgcugaggccu

SEQ ID NO: 65545 - RNA, 22 nt, Human
agcuucucagauggacuguuag

SEQ ID NO: 65546 - RNA, 22 nt, Human
agcuucucggcugggaguauuu

SEQ ID NO: 65547 - RNA, 22 nt, Human
agcuucucuggucuucugccaa

SEQ ID NO: 65548 - RNA, 22 nt, Human
agcuucugaaagucuguuuucc

SEQ ID NO: 65549 - RNA, 22 nt, Human
agcuucugagaauaguaaaugc

SEQ ID NO: 65550 - RNA, 17 nt, Human
agcuucugcccuuucuu

SEQ ID NO: 65551 - RNA, 23 nt, Human
agcuucugguucaggucaagcag

SEQ ID NO: 65552 - RNA, 22 nt, Human
agcuucuugaccaagccuguaa

SEQ ID NO: 65553 - RNA, 22 nt, Human
agcuugacagacagaugguagc

SEQ ID NO: 65554 - RNA, 22 nt, Human
agcuugaguuuuggaugaagug

SEQ ID NO: 65555 - RNA, 20 nt, Human
agcuugccccugucuuugcc

SEQ ID NO: 65556 - RNA, 18 nt, Human
agcuugccucaagcuuuu

SEQ ID NO: 65557 - RNA, 22 nt, Human
agcuugccucuuaaucaccuca

SEQ ID NO: 65558 - RNA, 22 nt, Human
agcuugggcaacacagcaagac

SEQ ID NO: 65559 - RNA, 22 nt, Human
agcuugguggcccuccuggcug

SEQ ID NO: 65560 - RNA, 21 nt, Human
agcuuguguguaucacagugu

SEQ ID NO: 65561 - RNA, 22 nt, Human
agcuuguguuuuucuaaguauc

SEQ ID NO: 65562 - RNA, 22 nt, Human
agcuuguuaaggaugcauauua

SEQ ID NO: 65563 - RNA, 22 nt, Human
agcuuguuauaaaugcagaaug

SEQ ID NO: 65564 - RNA, 22 nt, Human
agcuuguucaaaugcagaauac

SEQ ID NO: 65565 - RNA, 22 nt, Human
agcuuguuggggaaggagaaag

SEQ ID NO: 65566 - RNA, 22 nt, Human
agcuuuauagaaaggaucagug

SEQ ID NO: 65567 - RNA, 22 nt, Human
agcuuuauauuuaaugaauucu

SEQ ID NO: 65568 - RNA, 22 nt, Human
agcuuuaucagaggagucucua

SEQ ID NO: 65569 - RNA, 22 nt, Human
agcuuuauucaugauuucaggg

SEQ ID NO: 65570 - RNA, 22 nt, Human
agcuuucagucucugaaggaac

SEQ ID NO: 65571 - RNA, 22 nt, Human
agcuuuccacuaucuuaggggu

SEQ ID NO: 65572 - RNA, 20 nt, Human
agcuuucuccuuggagcucc

SEQ ID NO: 65573 - RNA, 22 nt, Human
agcuuucucuucuuuagaaagu

SEQ ID NO: 65574 - RNA, 22 nt, Human
agcuuucugguuacagucuuca

SEQ ID NO: 65575 - RNA, 22 nt, Human
agcuuugaauccuggcucuguc

SEQ ID NO: 65576 - RNA, 23 nt, Human
agcuuugaggacuuuaaaagaua

SEQ ID NO: 65577 - RNA, 22 nt, Human
agcuuugauaguacaggggcuu

SEQ ID NO: 65578 - RNA, 22 nt, Human
agcuuugcagcugugggaggag

SEQ ID NO: 65579 - RNA, 22 nt, Human
agcuuuggagcugggugaaaga

SEQ ID NO: 65580 - RNA, 23 nt, Human
agcuuuggugaugugacagauaa

SEQ ID NO: 65581 - RNA, 22 nt, Human
agcuuugugacuuugagcuagu

SEQ ID NO: 65582 - RNA, 22 nt, Human
agcuuuguuucacauacaccuu

SEQ ID NO: 65583 - RNA, 22 nt, Human
agcuuuuacauaaugaucuuga

SEQ ID NO: 65584 - RNA, 22 nt, Human
agcuuuuauuggcugucauuug

SEQ ID NO: 65585 - RNA, 22 nt, Human
aggaaaaauaaggcagcagggc

SEQ ID NO: 65586 - RNA, 22 nt, Human
aggaaaacacaguauugaugga

SEQ ID NO: 65587 - RNA, 22 nt, Human
aggaaaacagaccaaggagcuc

SEQ ID NO: 65588 - RNA, 22 nt, Human
aggaaaaugaaacagcaacugu

SEQ ID NO: 65589 - RNA, 22 nt, Human
aggaaacagugaacuuggcagg

SEQ ID NO: 65590 - RNA, 22 nt, Human
aggaaacaugaaucugccuuga

SEQ ID NO: 65591 - RNA, 22 nt, Human
aggaaacauugauauugggaaa

SEQ ID NO: 65592 - RNA, 22 nt, Human
aggaaacugaagcccagagagg

SEQ ID NO: 65593 - RNA, 22 nt, Human
aggaaacuguccccucauccua

SEQ ID NO: 65594 - RNA, 22 nt, Human
aggaaagaaaggaggugcauuu

SEQ ID NO: 65595 - RNA, 18 nt, Human
aggaaagaaaggcaggug

SEQ ID NO: 65596 - RNA, 20 nt, Human
aggaaagccugugugagucu

SEQ ID NO: 65597 - RNA, 19 nt, Human
aggaaaggaucaaaauagc

SEQ ID NO: 65598 - RNA, 22 nt, Human
aggaaaggccucagcagaaacc

SEQ ID NO: 65599 - RNA, 17 nt, Human
aggaaagucugcugucc

SEQ ID NO: 65600 - RNA, 22 nt, Human
aggaaagugaauguuauuuugc

SEQ ID NO: 65601 - RNA, 22 nt, Human
aggaaauugggacacagagaaa

SEQ ID NO: 65602 - RNA, 22 nt, Human
aggagcagaccguaguccugca

SEQ ID NO: 65603 - RNA, 21 nt, Human
aggagcauuguugugguggag

SEQ ID NO: 65604 - RNA, 22 nt, Human
aggagccaaacauauugagaga

SEQ ID NO: 65605 - RNA, 22 nt, Human
aggagccaaauuacuagcucug

SEQ ID NO: 65606 - RNA, 22 nt, Human
aggagccaagaugcugucuggc

SEQ ID NO: 65607 - RNA, 22 nt, Human
aggagccacuuaggugagauaa

SEQ ID NO: 65608 - RNA, 22 nt, Human
aggagccagauucucucacuuu

SEQ ID NO: 65609 - RNA, 21 nt, Human
aggagccagccugucagucua

SEQ ID NO: 65610 - RNA, 23 nt, Human
aggagccaggaaccagcuucccc

SEQ ID NO: 65611 - RNA, 22 nt, Human
aggagcccugcgggaggcagag

SEQ ID NO: 65612 - RNA, 22 nt, Human
aggagccgggccugggcccugc

SEQ ID NO: 65613 - RNA, 18 nt, Human
aggagccuuugcacugga

SEQ ID NO: 65614 - RNA, 22 nt, Human
aggagcggauguguccugccag

SEQ ID NO: 65615 - RNA, 22 nt, Human
aggagcugagggagcgcccuug

SEQ ID NO: 65616 - RNA, 22 nt, Human
aggagcugcaaaaccggccgcu

SEQ ID NO: 65617 - RNA, 22 nt, Human
aggagcugcacugggaguuuuu

SEQ ID NO: 65618 - RNA, 22 nt, Human
aggagcugcuuaaaugguuggu

SEQ ID NO: 65619 - RNA, 22 nt, Human
aggagcuggaaugguccuuuug

SEQ ID NO: 65620 - RNA, 22 nt, Human
aggagcuggccacuaggaugca

SEQ ID NO: 65621 - RNA, 22 nt, Human
aggagcugggcccaaggaugcu

SEQ ID NO: 65622 - RNA, 22 nt, Human
aggagcugggcugcugcuggga

SEQ ID NO: 65623 - RNA, 21 nt, Human
aggagcuguguuagcuggucg

SEQ ID NO: 65624 - RNA, 20 nt, Human
aggaggaaaaaaugacgagc

SEQ ID NO: 65625 - RNA, 22 nt, Human
aggaggaagggaagacaaguaa

SEQ ID NO: 65626 - RNA, 22 nt, Human
aggaggaauugacacagaagcc

SEQ ID NO: 65627 - RNA, 22 nt, Human
aggaggacucucugagccagcc

SEQ ID NO: 65628 - RNA, 22 nt, Human
aggaggaggcuggaguacaccc

SEQ ID NO: 65629 - RNA, 20 nt, Human
aggaggcaauguagauaagc

SEQ ID NO: 65630 - RNA, 20 nt, Human
aggaggcaugaggggauuua

SEQ ID NO: 65631 - RNA, 22 nt, Human
aggaggccaggcccucaagccu

SEQ ID NO: 65632 - RNA, 21 nt, Human
aggaggccaguacugcugaac

SEQ ID NO: 65633 - RNA, 22 nt, Human
agaugguagguggcaggacuga

SEQ ID NO: 65634 - RNA, 22 nt, Human
agaugguccaugcacagauaug

SEQ ID NO: 65635 - RNA, 22 nt, Human
agauggucuaguugaaccauau

SEQ ID NO: 65636 - RNA, 22 nt, Human
agauggucuucauaaguuuuaa

SEQ ID NO: 65637 - RNA, 22 nt, Human
agauggucuuuugaguaaugaa

SEQ ID NO: 65638 - RNA, 20 nt, Human
agauggugggcuggaacacc

SEQ ID NO: 65639 - RNA, 22 nt, Human
agaugguuaucuuuucuuugua

SEQ ID NO: 65640 - RNA, 22 nt, Human
agaugguugucgcaaaugaaug

SEQ ID NO: 65641 - RNA, 22 nt, Human
agauguaagaccuucaugaggg

SEQ ID NO: 65642 - RNA, 22 nt, Human
agaugugauguuaggcccuugg

SEQ ID NO: 65643 - RNA, 22 nt, Human
agauguggaacacuagacugcu

SEQ ID NO: 65644 - RNA, 22 nt, Human
agauguggauccuaggguagaa

SEQ ID NO: 65645 - RNA, 22 nt, Human
agauguggccuuugggagauua

SEQ ID NO: 65646 - RNA, 22 nt, Human
agauguggcugcacccaccgcu

SEQ ID NO: 65647 - RNA, 22 nt, Human
agauguuaucauucagaguagc

SEQ ID NO: 65648 - RNA, 22 nt, Human
agauguuccagccaaugggaau

SEQ ID NO: 65649 - RNA, 22 nt, Human
agauguuuucuaauucuauauu

SEQ ID NO: 65650 - RNA, 22 nt, Human
agauuaacucucagaaaagagg

SEQ ID NO: 65651 - RNA, 22 nt, Human
agauuacagaagaauaaguaga

SEQ ID NO: 65652 - RNA, 20 nt, Human
agauuauuccuaagauuucu

SEQ ID NO: 65653 - RNA, 22 nt, Human
agauuauuuccagacuaaugaa

SEQ ID NO: 65654 - RNA, 21 nt, Human
agauucaggacagcagucacu

SEQ ID NO: 65655 - RNA, 22 nt, Human
agauucaugggaaagcuuuagg

SEQ ID NO: 65656 - RNA, 22 nt, Human
agauucauuguggauauuuucu

SEQ ID NO: 65657 - RNA, 22 nt, Human
agauuccagaucccaaaaauga

SEQ ID NO: 65658 - RNA, 22 nt, Human
agauuccuaaaguaagauauca

SEQ ID NO: 65659 - RNA, 22 nt, Human
agauuccuaguguuauuucugu

SEQ ID NO: 65660 - RNA, 22 nt, Human
agauucuaaacuugauucugcu

SEQ ID NO: 65661 - RNA, 22 nt, Human
agauucuaccagagcuaguuug

SEQ ID NO: 65662 - RNA, 22 nt, Human
agauucuacucuagauccaugg

SEQ ID NO: 65663 - RNA, 22 nt, Human
agauugaagacugguggagcug

SEQ ID NO: 65664 - RNA, 22 nt, Human
agauugggguccagacuccuga

SEQ ID NO: 65665 - RNA, 21 nt, Human
agauuguauggaggugagagg

SEQ ID NO: 65666 - RNA, 22 nt, Human
agauuuacucccugcuuccgcc

SEQ ID NO: 65667 - RNA, 22 nt, Human
agauuuagcugugaacagcuug

SEQ ID NO: 65668 - RNA, 22 nt, Human
agauuucagguuggggcagaag

SEQ ID NO: 65669 - RNA, 22 nt, Human
agauuuccagaccaauuucuca

SEQ ID NO: 65670 - RNA, 22 nt, Human
agauuucccaaauacuuguuau

SEQ ID NO: 65671 - RNA, 22 nt, Human
agauuuccguucucucuucagu

SEQ ID NO: 65672 - RNA, 22 nt, Human
agauuugaaacuugcuucauaa

SEQ ID NO: 65673 - RNA, 23 nt, Human
agauuuggaaagcugaguggcgu

SEQ ID NO: 65674 - RNA, 21 nt, Human
agauuugucccuucccauuua

SEQ ID NO: 65675 - RNA, 22 nt, Human
agauuuguccugcuuucuaccu

SEQ ID NO: 65676 - RNA, 22 nt, Human
agauuuguugugagcaggaaua

SEQ ID NO: 65677 - RNA, 18 nt, Human
agauuuugagaaauacaa

SEQ ID NO: 65678 - RNA, 22 nt, Human
agauuuugucucaauacuucug

SEQ ID NO: 65679 - RNA, 17 nt, Human
agcaaaaguaucaaagc

SEQ ID NO: 65680 - RNA, 22 nt, Human
agcaaacacaagagguaauuuc

SEQ ID NO: 65681 - RNA, 22 nt, Human
agcaaacagaugucuccuuuag

SEQ ID NO: 65682 - RNA, 20 nt, Human
agcaaacaggcuccaccaga

SEQ ID NO: 65683 - RNA, 22 nt, Human
agcaaacauucagcagauuggc

SEQ ID NO: 65684 - RNA, 22 nt, Human
agcaaagaaauggaggcucaga

SEQ ID NO: 65685 - RNA, 22 nt, Human
agcaaagaagacacaggcuuca

SEQ ID NO: 65686 - RNA, 22 nt, Human
agcaaagacagggacgaccaag

SEQ ID NO: 65687 - RNA, 22 nt, Human
agcaaagaguaauuuuguuuug

SEQ ID NO: 65688 - RNA, 22 nt, Human
agcaaagauguccggggcaagc

SEQ ID NO: 65689 - RNA, 22 nt, Human
agcaaagcacuuugcauacaua

SEQ ID NO: 65690 - RNA, 22 nt, Human
agcaaagcaguggcuaagcuga

SEQ ID NO: 65691 - RNA, 22 nt, Human
agcaaagccgagacagccagug

SEQ ID NO: 65692 - RNA, 21 nt, Human
agcaaaggcaggagagguuuc

SEQ ID NO: 65693 - RNA, 22 nt, Human
agcaaagucaguggaaccaucc

SEQ ID NO: 65694 - RNA, 22 nt, Human
agcaaaguccagucuguguaca

SEQ ID NO: 65695 - RNA, 23 nt, Human
agcaaauaaucugcuugcuuuuu

SEQ ID NO: 65696 - RNA, 22 nt, Human
agcaaauaauugucuuugaggg

SEQ ID NO: 65697 - RNA, 19 nt, Human
agcaaauacaucaaaauug

SEQ ID NO: 65698 - RNA, 22 nt, Human
agcaaauacauuuuuagcauaa

SEQ ID NO: 65699 - RNA, 22 nt, Human
agcaaauaccaaaggcugaugu

SEQ ID NO: 65700 - RNA, 22 nt, Human
agcaaauacuugaauaaaaaga

SEQ ID NO: 65701 - RNA, 19 nt, Human
agcaaauauaauaguguuc

SEQ ID NO: 65702 - RNA, 22 nt, Human
agcaaaucuaugaauguauauu

SEQ ID NO: 65703 - RNA, 22 nt, Human
agcaaauuaggucaaggagaug

SEQ ID NO: 65704 - RNA, 22 nt, Human
agcaacagaagauagagugaau

SEQ ID NO: 65705 - RNA, 22 nt, Human
agcaacagcccuguuucauuag

SEQ ID NO: 65706 - RNA, 22 nt, Human
agcaacagggggauggccacug

SEQ ID NO: 65707 - RNA, 22 nt, Human
agcaacaggguggucuucagaa

SEQ ID NO: 65708 - RNA, 22 nt, Human
agcaacauauaucaaugccuga

SEQ ID NO: 65709 - RNA, 22 nt, Human
agcaacccguccuugggggacu

SEQ ID NO: 65710 - RNA, 22 nt, Human
agcaacgagaagcacaaaauaa

SEQ ID NO: 65711 - RNA, 22 nt, Human
agauugguguugcagaaccaug

SEQ ID NO: 65712 - RNA, 22 nt, Human
agauugguuccuugcuuugaaa

SEQ ID NO: 65713 - RNA, 22 nt, Human
agauuuacucagcuccuggaaa

SEQ ID NO: 65714 - RNA, 22 nt, Human
agauuuccaucuuuuucaugug

SEQ ID NO: 65715 - RNA, 22 nt, Human
agauuucugggcuucaccaccu

SEQ ID NO: 65716 - RNA, 22 nt, Human
agcaaacuaauugcaguucugg

SEQ ID NO: 65717 - RNA, 22 nt, Human
agcaaagcaccauauggcaguu

SEQ ID NO: 65718 - RNA, 22 nt, Human
agcaaagcuaucucuauggaga

SEQ ID NO: 65719 - RNA, 22 nt, Human
agcaaagcucaugacauuacag

SEQ ID NO: 65720 - RNA, 22 nt, Human
agcaaagcuuccauaaagcagc

SEQ ID NO: 65721 - RNA, 22 nt, Human
agcaaaguagcugcuguucuua

SEQ ID NO: 65722 - RNA, 23 nt, Human
agcaaaguuguugcuaaccucau

SEQ ID NO: 65723 - RNA, 22 nt, Human
agcaaauaaagacaauuauguc

SEQ ID NO: 65724 - RNA, 22 nt, Human
agcaaauacuuuucacugagcc

SEQ ID NO: 65725 - RNA, 18 nt, Human
agcaaauauuaagugcau

SEQ ID NO: 65726 - RNA, 22 nt, Human
agcaaauucagaagcagaaugg

SEQ ID NO: 65727 - RNA, 20 nt, Human
agcaacaauaaaauguccug

SEQ ID NO: 65728 - RNA, 22 nt, Human
agcaacagcaacgacauuucuc

SEQ ID NO: 65729 - RNA, 22 nt, Human
agcaacaggaaauagcugauua

SEQ ID NO: 65730 - RNA, 22 nt, Human
agcaacaggaauauuauggcaa

SEQ ID NO: 65731 - RNA, 23 nt, Human
agcaacagugggugaguguugcu

SEQ ID NO: 65732 - RNA, 22 nt, Human
agcaacauuuuucaauuaacau

SEQ ID NO: 65733 - RNA, 22 nt, Human
agcaacuagccaggaugcagag

SEQ ID NO: 65734 - RNA, 22 nt, Human
agcaacuguuacaagaacaaca

SEQ ID NO: 65735 - RNA, 22 nt, Human
agcaacuucuacagauauagca

SEQ ID NO: 65736 - RNA, 17 nt, Human
agcaacuucucccacag

SEQ ID NO: 65737 - RNA, 20 nt, Human
agcaagaacguucugaggga

SEQ ID NO: 65738 - RNA, 20 nt, Human
agcaagaagguugugggagc

SEQ ID NO: 65739 - RNA, 22 nt, Human
agcaagcauugcugguuagguc

SEQ ID NO: 65740 - RNA, 22 nt, Human
agcaagcuguucuuggagagua

SEQ ID NO: 65741 - RNA, 22 nt, Human
agcaaggauuauccugggaagg

SEQ ID NO: 65742 - RNA, 22 nt, Human
agcaaggcucuuaaugcccaaa

SEQ ID NO: 65743 - RNA, 20 nt, Human
agcaaggcuggagcuuaugg

SEQ ID NO: 65744 - RNA, 22 nt, Human
agcaaggcugggucuaaugggg

SEQ ID NO: 65745 - RNA, 22 nt, Human
agcaaguaguaccaaguagcuc

SEQ ID NO: 65746 - RNA, 22 nt, Human
agcaauagauaaaacauuuacc

SEQ ID NO: 65747 - RNA, 22 nt, Human
agcaauauuucagcuagcaggu

SEQ ID NO: 65748 - RNA, 22 nt, Human
agcaaucagcuucuuuguguuu

SEQ ID NO: 65749 - RNA, 22 nt, Human
agcaaugugaccccugacagca

SEQ ID NO: 65750 - RNA, 22 nt, Human
aggaggccgcugaugggcuccc

SEQ ID NO: 65751 - RNA, 22 nt, Human
aggaggccgggauucuggagau

SEQ ID NO: 65752 - RNA, 22 nt, Human
aggaggccucuauccagagaga

SEQ ID NO: 65753 - RNA, 22 nt, Human
aggaggccuguuuucuccugga

SEQ ID NO: 65754 - RNA, 22 nt, Human
aggaggcuguggagcacuccau

SEQ ID NO: 65755 - RNA, 22 nt, Human
aggaggcuuuugcaggugccac

SEQ ID NO: 65756 - RNA, 22 nt, Human
aggagggacaccaauauauguu

SEQ ID NO: 65757 - RNA, 22 nt, Human
aggagggaccuaggaauauugc

SEQ ID NO: 65758 - RNA, 22 nt, Human
aggagggagaugcccauccugg

SEQ ID NO: 65759 - RNA, 22 nt, Human
aggagggagcuuaagccaggca

SEQ ID NO: 65760 - RNA, 21 nt, Human
aggagggcacaaggccaggaa

SEQ ID NO: 65761 - RNA, 22 nt, Human
aggagggcuaggaaaaccagga

SEQ ID NO: 65762 - RNA, 22 nt, Human
aggaggggcauagaaauguaau

SEQ ID NO: 65763 - RNA, 22 nt, Human
aggaggguacaauggguggaaa

SEQ ID NO: 65764 - RNA, 22 nt, Human
aggaggguggccucaugugagu

SEQ ID NO: 65765 - RNA, 22 nt, Human
aggaggguugaggaggauacuu

SEQ ID NO: 65766 - RNA, 20 nt, Human
aggaggucaaauggaaucug

SEQ ID NO: 65767 - RNA, 22 nt, Human
aggaggugcguggugauccccu

SEQ ID NO: 65768 - RNA, 22 nt, Human
aggaggugcuguuuguccugga

SEQ ID NO: 65769 - RNA, 22 nt, Human
aggagguugccagucugggggu

SEQ ID NO: 65770 - RNA, 22 nt, Human
aggaguaucuaauaaucugaga

SEQ ID NO: 65771 - RNA, 22 nt, Human
aggagucaccugcccaaaguca

SEQ ID NO: 65772 - RNA, 22 nt, Human
aggagucauaaaugugaacaaa

SEQ ID NO: 65773 - RNA, 20 nt, Human
aggagucccugugcucucuc

SEQ ID NO: 65774 - RNA, 17 nt, Human
aggagucucagaugagc

SEQ ID NO: 65775 - RNA, 22 nt, Human
aggagugaguguccucagcaga

SEQ ID NO: 65776 - RNA, 22 nt, Human
aggaguggaauuacuggguucu

SEQ ID NO: 65777 - RNA, 22 nt, Human
aggaguggugcaggaccugcca

SEQ ID NO: 65778 - RNA, 22 nt, Human
aggaguguggccagggcucugg

SEQ ID NO: 65779 - RNA, 22 nt, Human
aggaguguugaguuggguuuug

SEQ ID NO: 65780 - RNA, 22 nt, Human
aggaguguugcuucagggaagc

SEQ ID NO: 65781 - RNA, 22 nt, Human
aggaguuuauccgagggcauaa

SEQ ID NO: 65782 - RNA, 22 nt, Human
aggaguuucaaagcuuccaugu

SEQ ID NO: 65783 - RNA, 22 nt, Human
aggauaacuauaggauaaugcu

SEQ ID NO: 65784 - RNA, 22 nt, Human
aggauaauaauagugcucacuc

SEQ ID NO: 65785 - RNA, 18 nt, Human
aggauauuaagaguacag

SEQ ID NO: 65786 - RNA, 22 nt, Human
aggaucaaguugguugagcuuu

SEQ ID NO: 65787 - RNA, 22 nt, Human
aggauccuccuuagaaaagacc

SEQ ID NO: 65788 - RNA, 22 nt, Human
aggauccugcgcuuugggggag

SEQ ID NO: 65789 - RNA, 22 nt, Human
aggaucuucauugugcugcaaa

SEQ ID NO: 65790 - RNA, 22 nt, Human
aggaucuugcuguagaggauag

SEQ ID NO: 65791 - RNA, 22 nt, Human
aggaugaauaacugaaauggug

SEQ ID NO: 65792 - RNA, 22 nt, Human
aggaugagauuccagggucaau

SEQ ID NO: 65793 - RNA, 22 nt, Human
aggaugagccgcgcaagcugac

SEQ ID NO: 65794 - RNA, 23 nt, Human
aggauguaggauguauggcagag

SEQ ID NO: 65795 - RNA, 22 nt, Human
aggauguggcugagacuucugg

SEQ ID NO: 65796 - RNA, 22 nt, Human
aggauguggguuuucacauugu

SEQ ID NO: 65797 - RNA, 22 nt, Human
aggauguguucauagcugacgc

SEQ ID NO: 65798 - RNA, 22 nt, Human
aggauguuaucugugcaggugg

SEQ ID NO: 65799 - RNA, 23 nt, Human
aggauuuaaaggcaaugcauuuu

SEQ ID NO: 65800 - RNA, 22 nt, Human
aggauuuaaauccuuaaccacu

SEQ ID NO: 65801 - RNA, 22 nt, Human
aggauuuagauuuggaggaacu

SEQ ID NO: 65802 - RNA, 19 nt, Human
aggauuuauuaugugcuca

SEQ ID NO: 65803 - RNA, 22 nt, Human
aggauuuauuccagaaaugcaa

SEQ ID NO: 65804 - RNA, 20 nt, Human
aggauuugagaaggcgucuu

SEQ ID NO: 65805 - RNA, 22 nt, Human
aggauuuggccauggcuucggg

SEQ ID NO: 65806 - RNA, 22 nt, Human
aggauuuggggaagaaaacacu

SEQ ID NO: 65807 - RNA, 22 nt, Human
aggcaaaauuacaaaguuauua

SEQ ID NO: 65808 - RNA, 23 nt, Human
aggcaaaccuauaaaauaggaau

SEQ ID NO: 65809 - RNA, 22 nt, Human
aggcaaagaaguuggucaggag

SEQ ID NO: 65810 - RNA, 22 nt, Human
aggcaaagagccagcaaaucug

SEQ ID NO: 65811 - RNA, 22 nt, Human
aggcaaagaggauauuuugggg

SEQ ID NO: 65812 - RNA, 22 nt, Human
aggcaaagcgauaccagagcua

SEQ ID NO: 65813 - RNA, 22 nt, Human
aggcaaaucucaguuggccucu

SEQ ID NO: 65814 - RNA, 22 nt, Human
aggcaaaugauccugcuccuug

SEQ ID NO: 65815 - RNA, 22 nt, Human
aggcaacaaggguagucaguga

SEQ ID NO: 65816 - RNA, 22 nt, Human
aggcaacacuugcauuuuuuag

SEQ ID NO: 65817 - RNA, 22 nt, Human
aggcaacaggaaaccacaugau

SEQ ID NO: 65818 - RNA, 22 nt, Human
aggcaacauaacacgaaagucu

SEQ ID NO: 65819 - RNA, 19 nt, Human
aggcaaccaaugaggcaaa

SEQ ID NO: 65820 - RNA, 22 nt, Human
aggccagcucacccuggcuccu

SEQ ID NO: 65821 - RNA, 22 nt, Human
aggccagcucuacccuuggacu

SEQ ID NO: 65822 - RNA, 22 nt, Human
aggccagcuuccagaggggcag

SEQ ID NO: 65823 - RNA, 22 nt, Human
aggccagcuucuacccucuguu

SEQ ID NO: 65824 - RNA, 20 nt, Human
aggccaggaaauguaguucu

SEQ ID NO: 65825 - RNA, 22 nt, Human
aggccaggcaacauucugaagu

SEQ ID NO: 65826 - RNA, 22 nt, Human
aggccagguuccucaaucuuga

SEQ ID NO: 65827 - RNA, 22 nt, Human
aggcccaaaagaaaccacuggg

SEQ ID NO: 65828 - RNA, 23 nt, Human
aggcccaacucugugagggcugc

SEQ ID NO: 65829 - RNA, 22 nt, Human
aggcccagagcaggaaaggguu

SEQ ID NO: 65830 - RNA, 22 nt, Human
aggcccaguccucugccgucug

SEQ ID NO: 65831 - RNA, 20 nt, Human
aggcccagugaauauauugc

SEQ ID NO: 65832 - RNA, 22 nt, Human
aggcccagugccauuaguuuug

SEQ ID NO: 65833 - RNA, 22 nt, Human
aggcccaguguggcuuccugga

SEQ ID NO: 65834 - RNA, 22 nt, Human
aggcccaguuauccuacuuguu

SEQ ID NO: 65835 - RNA, 20 nt, Human
aggccccagguggacacuag

SEQ ID NO: 65836 - RNA, 20 nt, Human
aggcccuccccacuguugcu

SEQ ID NO: 65837 - RNA, 22 nt, Human
aggcccugagcauccgagggca

SEQ ID NO: 65838 - RNA, 22 nt, Human
aggcccugauccgaauccagau

SEQ ID NO: 65839 - RNA, 22 nt, Human
aggcccugcccagagcuccucg

SEQ ID NO: 65840 - RNA, 22 nt, Human
aggcccugcugaggccucccuc

SEQ ID NO: 65841 - RNA, 21 nt, Human
aggcccuggaggucagagaaa

SEQ ID NO: 65842 - RNA, 22 nt, Human
aggcccuggccugacucaaugu

SEQ ID NO: 65843 - RNA, 22 nt, Human
aggcccuggcuggguuucuuua

SEQ ID NO: 65844 - RNA, 22 nt, Human
aggcccugggcaguucuguagc

SEQ ID NO: 65845 - RNA, 22 nt, Human
aggcccuguccauggugcugaa

SEQ ID NO: 65846 - RNA, 22 nt, Human
aggcccuguuaugagccacugu

SEQ ID NO: 65847 - RNA, 22 nt, Human
aggcccuguuguagcauuuugg

SEQ ID NO: 65848 - RNA, 22 nt, Human
aggcccuucuugguggcucagg

SEQ ID NO: 65849 - RNA, 22 nt, Human
aggcccuuggacucaugcucga

SEQ ID NO: 65850 - RNA, 22 nt, Human
aggcccuuggguccucuccaca

SEQ ID NO: 65851 - RNA, 22 nt, Human
aggccggcgcuucccaggaggc

SEQ ID NO: 65852 - RNA, 22 nt, Human
aggccucagccugccaggccug

SEQ ID NO: 65853 - RNA, 22 nt, Human
aggccucaggaagguaaagaag

SEQ ID NO: 65854 - RNA, 22 nt, Human
aggccucaguuugucaucugua

SEQ ID NO: 65855 - RNA, 22 nt, Human
aggccucauaguagaccugccc

SEQ ID NO: 65856 - RNA, 22 nt, Human
aggccuccugcagggaugagug

SEQ ID NO: 65857 - RNA, 21 nt, Human
aggccucuucauggccaugau

SEQ ID NO: 65858 - RNA, 22 nt, Human
aggccugcagcaggagcaaacc

SEQ ID NO: 65859 - RNA, 22 nt, Human
aggccugcugucuugaggccaa

SEQ ID NO: 65860 - RNA, 22 nt, Human
aggccuggcuuugguuugcuga

SEQ ID NO: 65861 - RNA, 22 nt, Human
aggccuggugaaugaaguaucu

SEQ ID NO: 65862 - RNA, 22 nt, Human
aggccuguuccaggccccuuuu

SEQ ID NO: 65863 - RNA, 22 nt, Human
aggccuguuccuuccugggcac

SEQ ID NO: 65864 - RNA, 22 nt, Human
aggccuguuucuuguccagcuc

SEQ ID NO: 65865 - RNA, 22 nt, Human
aggccuuaagaacaaaacuauu

SEQ ID NO: 65866 - RNA, 22 nt, Human
aggccuuaccauagcuguagca

SEQ ID NO: 65867 - RNA, 22 nt, Human
aggccuugccaaugagagaacu

SEQ ID NO: 65868 - RNA, 22 nt, Human
aggccuuggaagccagggagcc

SEQ ID NO: 65869 - RNA, 22 nt, Human
aggccuugugagaagcagagaa

SEQ ID NO: 65870 - RNA, 19 nt, Human
agcagcuggagguggagug

SEQ ID NO: 65871 - RNA, 17 nt, Human
agcagcuggcacaggag

SEQ ID NO: 65872 - RNA, 22 nt, Human
agcagcugggcucagagcuggg

SEQ ID NO: 65873 - RNA, 17 nt, Human
agcagcuggguugaucu

SEQ ID NO: 65874 - RNA, 22 nt, Human
agcagcugguaggaguggccac

SEQ ID NO: 65875 - RNA, 22 nt, Human
agcagcuggugcaacucuaaga

SEQ ID NO: 65876 - RNA, 22 nt, Human
agcagcugguucccgagggcgu

SEQ ID NO: 65877 - RNA, 18 nt, Human
agcagcugugccacacug

SEQ ID NO: 65878 - RNA, 22 nt, Human
agcagcuuacauguggccuauc

SEQ ID NO: 65879 - RNA, 22 nt, Human
agcagcuuagggaauucucccu

SEQ ID NO: 65880 - RNA, 22 nt, Human
agcagcuuccuguuugcaggca

SEQ ID NO: 65881 - RNA, 21 nt, Human
agcagcuugagucuggagcuc

SEQ ID NO: 65882 - RNA, 21 nt, Human
agcagcuuugguugaagcaga

SEQ ID NO: 65883 - RNA, 23 nt, Human
agcaggaaaccgagggugauguu

SEQ ID NO: 65884 - RNA, 22 nt, Human
agcaggaaagaaaaaucugugu

SEQ ID NO: 65885 - RNA, 22 nt, Human
agcaggaacugacaccaagcca

SEQ ID NO: 65886 - RNA, 17 nt, Human
agcaggaccccagagca

SEQ ID NO: 65887 - RNA, 22 nt, Human
agcaggagacauggggguggug

SEQ ID NO: 65888 - RNA, 22 nt, Human
agcaggagagcagugcgugguc

SEQ ID NO: 65889 - RNA, 22 nt, Human
agcaggagcccuuaucaccagg

SEQ ID NO: 65890 - RNA, 22 nt, Human
agcaggaggagagccuggcggu

SEQ ID NO: 65891 - RNA, 22 nt, Human
agcaggauuuugaagugcaagu

SEQ ID NO: 65892 - RNA, 22 nt, Human
agcaggcacgcucccugcgcga

SEQ ID NO: 65893 - RNA, 17 nt, Human
agcaggcacgucagcac

SEQ ID NO: 65894 - RNA, 22 nt, Human
agcaggcagccuaggaagugaa

SEQ ID NO: 65895 - RNA, 22 nt, Human
agcaggcaggcccagcggcugg

SEQ ID NO: 65896 - RNA, 22 nt, Human
agcaggcauagaguagcacuca

SEQ ID NO: 65897 - RNA, 19 nt, Human
agcaggccacagggccagc

SEQ ID NO: 65898 - RNA, 22 nt, Human
agcaggcuaaauaauaauacau

SEQ ID NO: 65899 - RNA, 19 nt, Human
agcaggcuaggcugccucu

SEQ ID NO: 65900 - RNA, 22 nt, Human
agcaggcugagcacccaggggg

SEQ ID NO: 65901 - RNA, 22 nt, Human
agcaggcuuuccacagaaggag

SEQ ID NO: 65902 - RNA, 22 nt, Human
agcagggacuacgugaaaguga

SEQ ID NO: 65903 - RNA, 22 nt, Human
agcagggacugagccaguggga

SEQ ID NO: 65904 - RNA, 22 nt, Human
agcagggcccacuaggggagau

SEQ ID NO: 65905 - RNA, 22 nt, Human
agcagggcucuguggagggugg

SEQ ID NO: 65906 - RNA, 22 nt, Human
agcagggcugcagugugucuuu

SEQ ID NO: 65907 - RNA, 22 nt, Human
agcagggcuuugucucugugaa

SEQ ID NO: 65908 - RNA, 22 nt, Human
agcaggggcaggguuuugugcu

SEQ ID NO: 65909 - RNA, 22 nt, Human
agcaggggcuccuccacagcca

SEQ ID NO: 65910 - RNA, 22 nt, Human
agcagggggaguuagacuagau

SEQ ID NO: 65911 - RNA, 22 nt, Human
agcaggguauguuagagcugua

SEQ ID NO: 65912 - RNA, 22 nt, Human
agcaggguuccuuaaggccaua

SEQ ID NO: 65913 - RNA, 22 nt, Human
agcagguaugacauagauaugu

SEQ ID NO: 65914 - RNA, 22 nt, Human
agcaggugccagguguacccgc

SEQ ID NO: 65915 - RNA, 18 nt, Human
agcaggugcuguuucuuu

SEQ ID NO: 65916 - RNA, 22 nt, Human
agcagguggucuguugcugcug

SEQ ID NO: 65917 - RNA, 16 nt, Human
agcagguguauagugu

SEQ ID NO: 65918 - RNA, 22 nt, Human
agcagguguaucggucaccuac

SEQ ID NO: 65919 - RNA, 22 nt, Human
agcagguguuggcugggccauc

SEQ ID NO: 65920 - RNA, 22 nt, Human
agcagguuaccauugauuuccu

SEQ ID NO: 65921 - RNA, 22 nt, Human
agcagguugugauacacucaga

SEQ ID NO: 65922 - RNA, 22 nt, Human
agcagguuguuuuguggccagg

SEQ ID NO: 65923 - RNA, 22 nt, Human
agcagguuuguuuucuucugag

SEQ ID NO: 65924 - RNA, 22 nt, Human
agcaguagugauggccccugag

SEQ ID NO: 65925 - RNA, 22 nt, Human
agcaguauucuccuguggugga

SEQ ID NO: 65926 - RNA, 22 nt, Human
agcagucaggccucagagccgu

SEQ ID NO: 65927 - RNA, 23 nt, Human
agcagucagggugguaagccauc

SEQ ID NO: 65928 - RNA, 22 nt, Human
agcaguccuccaguguguuuua

SEQ ID NO: 65929 - RNA, 22 nt, Human
agcagugaugaaaugagcaucc

SEQ ID NO: 65930 - RNA, 17 nt, Human
agcugaaauugcugaag

SEQ ID NO: 65931 - RNA, 22 nt, Human
agcugaagauccaggguugggg

SEQ ID NO: 65932 - RNA, 20 nt, Human
agcugaagaucuggaugggg

SEQ ID NO: 65933 - RNA, 22 nt, Human
agcugaagcaacaacaggaugg

SEQ ID NO: 65934 - RNA, 22 nt, Human
agcugaaguuuagaauugugaa

SEQ ID NO: 65935 - RNA, 22 nt, Human
agcugaaucucaggcauccuuu

SEQ ID NO: 65936 - RNA, 22 nt, Human
agcugaauguucucagaccaga

SEQ ID NO: 65937 - RNA, 22 nt, Human
agcugacaggauggcauuauua

SEQ ID NO: 65938 - RNA, 22 nt, Human
agcugacugaugaagaggccuu

SEQ ID NO: 65939 - RNA, 22 nt, Human
agcugacuucuugauccaauga

SEQ ID NO: 65940 - RNA, 22 nt, Human
agcugagaaucuuccccagugu

SEQ ID NO: 65941 - RNA, 22 nt, Human
agcugagagcugugucaagaua

SEQ ID NO: 65942 - RNA, 21 nt, Human
agcugagcccagaagacuggu

SEQ ID NO: 65943 - RNA, 22 nt, Human
agcugaggaauaauaacaaggu

SEQ ID NO: 65944 - RNA, 20 nt, Human
agcugaggcaccugagguua

SEQ ID NO: 65945 - RNA, 22 nt, Human
agcugaggccacgagugaaggg

SEQ ID NO: 65946 - RNA, 22 nt, Human
agcugagggcaggaugggguga

SEQ ID NO: 65947 - RNA, 22 nt, Human
agcugauacauuucuuguagcc

SEQ ID NO: 65948 - RNA, 22 nt, Human
agcugaugccauguggaacagu

SEQ ID NO: 65949 - RNA, 22 nt, Human
agcugauuuuuaggagacagga

SEQ ID NO: 65950 - RNA, 22 nt, Human
agcugcaaagaugauuuguugu

SEQ ID NO: 65951 - RNA, 22 nt, Human
agcugcaaaggcacacuugggc

SEQ ID NO: 65952 - RNA, 22 nt, Human
agcugcaagaagaggucccuga

SEQ ID NO: 65953 - RNA, 22 nt, Human
agcugcaagauuucuuuuguau

SEQ ID NO: 65954 - RNA, 22 nt, Human
agcugcaaguguugccuccuac

SEQ ID NO: 65955 - RNA, 22 nt, Human
agcugcaauuaaagacugugaa

SEQ ID NO: 65956 - RNA, 22 nt, Human
agcugcaauucuggacauaguc

SEQ ID NO: 65957 - RNA, 22 nt, Human
agcugcagaucaauaggcucac

SEQ ID NO: 65958 - RNA, 22 nt, Human
agcugcagauucuaucuagaag

SEQ ID NO: 65959 - RNA, 22 nt, Human
agcugcagcuguuuucugagug

SEQ ID NO: 65960 - RNA, 22 nt, Human
agcugcagcuuccuaguccagc

SEQ ID NO: 65961 - RNA, 21 nt, Human
agcugcaggccucccagggau

SEQ ID NO: 65962 - RNA, 22 nt, Human
agcugcagguggacccguaccg

SEQ ID NO: 65963 - RNA, 22 nt, Human
agcugcagugaacuguuuuguc

SEQ ID NO: 65964 - RNA, 22 nt, Human
agcugcaguucguuccagcucu

SEQ ID NO: 65965 - RNA, 22 nt, Human
agcugccacaugcccaagggca

SEQ ID NO: 65966 - RNA, 22 nt, Human
agcugccaccucugccuuuggg

SEQ ID NO: 65967 - RNA, 22 nt, Human
agcugccagcaucccggaaggg

SEQ ID NO: 65968 - RNA, 22 nt, Human
agcugccaucagccuuuggaug

SEQ ID NO: 65969 - RNA, 22 nt, Human
agcugccauccuguucagcacc

SEQ ID NO: 65970 - RNA, 22 nt, Human
agcugcccaaggucacagagcu

SEQ ID NO: 65971 - RNA, 22 nt, Human
agcugcccugggcuggagaugg

SEQ ID NO: 65972 - RNA, 22 nt, Human
agcugcccugggucuugcugcu

SEQ ID NO: 65973 - RNA, 22 nt, Human
agcugcccuuaauaggcauuca

SEQ ID NO: 65974 - RNA, 20 nt, Human
agcugcccuuuucacauguu

SEQ ID NO: 65975 - RNA, 17 nt, Human
agcugccucucccacca

SEQ ID NO: 65976 - RNA, 22 nt, Human
agcugccucucuugagguuacg

SEQ ID NO: 65977 - RNA, 22 nt, Human
agcugccucugcugguuuagaa

SEQ ID NO: 65978 - RNA, 22 nt, Human
agcugccuggccggagccacug

SEQ ID NO: 65979 - RNA, 22 nt, Human
agcugccuguccuaggccauca

SEQ ID NO: 65980 - RNA, 22 nt, Human
agcugccuuaaauuacuuugug

SEQ ID NO: 65981 - RNA, 22 nt, Human
agcugccuuauggaguaugaaa

SEQ ID NO: 65982 - RNA, 22 nt, Human
agcugccuuugcaucacuuuaa

SEQ ID NO: 65983 - RNA, 22 nt, Human
agcugccuuuugagaaagcuca

SEQ ID NO: 65984 - RNA, 22 nt, Human
agcugcuacugcucugccagag

SEQ ID NO: 65985 - RNA, 22 nt, Human
agcugcucuucauuucccccca

SEQ ID NO: 65986 - RNA, 22 nt, Human
agcugcugagccaggcugaugu

SEQ ID NO: 65987 - RNA, 22 nt, Human
agcugcugagccauguccugcu

SEQ ID NO: 65988 - RNA, 22 nt, Human
agcugcugcccauaggugacau

SEQ ID NO: 65989 - RNA, 22 nt, Human
agcugcugccgguggccacccu

SEQ ID NO: 65990 - RNA, 22 nt, Human
agcugcugggagaagugagcca

SEQ ID NO: 65991 - RNA, 23 nt, Human
agcugcugggccugccguggccu

SEQ ID NO: 65992 - RNA, 22 nt, Human
agcugcuuccucuuugauguca

SEQ ID NO: 65993 - RNA, 22 nt, Human
agcugcuuguacaugaccacau

SEQ ID NO: 65994 - RNA, 22 nt, Human
agcugcuuguugaaauccaaac

SEQ ID NO: 65995 - RNA, 23 nt, Human
agcuggaaauggccgagcucugc

SEQ ID NO: 65996 - RNA, 22 nt, Human
agcuggaagauccugguuuugu

SEQ ID NO: 65997 - RNA, 22 nt, Human
agcuggaagcugaugagcacag

SEQ ID NO: 65998 - RNA, 22 nt, Human
agcuggaauccuacuucuaaca

SEQ ID NO: 65999 - RNA, 22 nt, Human
agcuggaauuacaggcacgcac

SEQ ID NO: 66000 - RNA, 20 nt, Human
agcuggagaagggcccuucc

SEQ ID NO: 66001 - RNA, 22 nt, Human
agcuggagaauaggaauuagug

SEQ ID NO: 66002 - RNA, 22 nt, Human
agcuggagaguuuccaggaagg

SEQ ID NO: 66003 - RNA, 22 nt, Human
agcuggagaucaugcugauacu

SEQ ID NO: 66004 - RNA, 22 nt, Human
agcuggagauucuggggacagu

SEQ ID NO: 66005 - RNA, 22 nt, Human
agcuggagcuucaagcagguaa

SEQ ID NO: 66006 - RNA, 22 nt, Human
agcuggaggaguuucuccuagc

SEQ ID NO: 66007 - RNA, 22 nt, Human
agcuugguguugccugcuugag

SEQ ID NO: 66008 - RNA, 22 nt, Human
agcuugucuuucaaaggaguuu

SEQ ID NO: 66009 - RNA, 22 nt, Human
agcuuguuagggcaguggucgc

SEQ ID NO: 66010 - RNA, 22 nt, Human
agcuuguucucauccauucuuc

SEQ ID NO: 66011 - RNA, 22 nt, Human
agcuuguuguuacugaugcauu

SEQ ID NO: 66012 - RNA, 22 nt, Human
agcuuuaccugaaauuugaucc

SEQ ID NO: 66013 - RNA, 22 nt, Human
agcuuuagaauuguucagcaag

SEQ ID NO: 66014 - RNA, 22 nt, Human
agcuuuauauguuguuucucca

SEQ ID NO: 66015 - RNA, 22 nt, Human
agcuuuauggugccucacuuga

SEQ ID NO: 66016 - RNA, 22 nt, Human
agcuuucaguuacuaaugaagg

SEQ ID NO: 66017 - RNA, 22 nt, Human
agcuuucuauauaugaguugcu

SEQ ID NO: 66018 - RNA, 22 nt, Human
agcuuucucucagccaggcugc

SEQ ID NO: 66019 - RNA, 22 nt, Human
agcuuugcaaccugaggccagu

SEQ ID NO: 66020 - RNA, 22 nt, Human
agcuuugcacaacagagaggug

SEQ ID NO: 66021 - RNA, 22 nt, Human
agcuuugcugcuggagaagggu

SEQ ID NO: 66022 - RNA, 22 nt, Human
agcuuuggagacugacuccauc

SEQ ID NO: 66023 - RNA, 22 nt, Human
agcuuuggauuucuuauagccc

SEQ ID NO: 66024 - RNA, 22 nt, Human
agcuuuggggacagccaagguu

SEQ ID NO: 66025 - RNA, 22 nt, Human
agcuuugggggagguagucugu

SEQ ID NO: 66026 - RNA, 22 nt, Human
agcuuuggggguagguauagag

SEQ ID NO: 66027 - RNA, 22 nt, Human
agcuuuguauuugagcauacga

SEQ ID NO: 66028 - RNA, 22 nt, Human
agcuuuguggcuuugcaagacu

SEQ ID NO: 66029 - RNA, 19 nt, Human
agcuuuuacuaacagcaga

SEQ ID NO: 66030 - RNA, 22 nt, Human
agcuuuuucacuuuggauggga

SEQ ID NO: 66031 - RNA, 22 nt, Human
aggaaaaaagucugugauuaua

SEQ ID NO: 66032 - RNA, 22 nt, Human
aggaaaaaccuguuaaugguag

SEQ ID NO: 66033 - RNA, 22 nt, Human
aggaaaaagaguugcugccuuc

SEQ ID NO: 66034 - RNA, 22 nt, Human
aggaaaagugugaaguauggag

SEQ ID NO: 66035 - RNA, 21 nt, Human
aggaaaauugaggguuguugu

SEQ ID NO: 66036 - RNA, 22 nt, Human
aggaaacaacuuggcaugagcc

SEQ ID NO: 66037 - RNA, 22 nt, Human
aggaaacauccuuaucuauucu

SEQ ID NO: 66038 - RNA, 22 nt, Human
aggaaacuaacuuaucuuuaua

SEQ ID NO: 66039 - RNA, 18 nt, Human
agucauuuacuuuuguga

SEQ ID NO: 66040 - RNA, 22 nt, Human
agucauuucuguagucauguuu

SEQ ID NO: 66041 - RNA, 22 nt, Human
agucauuuucugccuguaaucu

SEQ ID NO: 66042 - RNA, 22 nt, Human
aguccaaacaaacuucccgagg

SEQ ID NO: 66043 - RNA, 20 nt, Human
aguccaaagccuguuuacuu

SEQ ID NO: 66044 - RNA, 22 nt, Human
aguccaaaucuuguuucauauc

SEQ ID NO: 66045 - RNA, 22 nt, Human
aguccaagauuagggugacagc

SEQ ID NO: 66046 - RNA, 22 nt, Human
aguccacagagucucuccugaa

SEQ ID NO: 66047 - RNA, 22 nt, Human
aguccacugccccagcuccucg

SEQ ID NO: 66048 - RNA, 22 nt, Human
aguccaggaguugggugacauu

SEQ ID NO: 66049 - RNA, 22 nt, Human
aguccaggcaaguuguugugua

SEQ ID NO: 66050 - RNA, 22 nt, Human
aguccaggcauuccagccauuc

SEQ ID NO: 66051 - RNA, 22 nt, Human
aguccaggccucccucuccugc

SEQ ID NO: 66052 - RNA, 22 nt, Human
aguccaggcucuuccugaagaa

SEQ ID NO: 66053 - RNA, 22 nt, Human
aguccagggcucucugugggau

SEQ ID NO: 66054 - RNA, 22 nt, Human
aguccauaacuucagaguguca

SEQ ID NO: 66055 - RNA, 22 nt, Human
aguccauaggcaguucauaaca

SEQ ID NO: 66056 - RNA, 22 nt, Human
agucccagaucuacaggaggga

SEQ ID NO: 66057 - RNA, 22 nt, Human
agucccagaugacccagcuacu

SEQ ID NO: 66058 - RNA, 22 nt, Human
agucccagcccaguccuguaag

SEQ ID NO: 66059 - RNA, 22 nt, Human
agucccagcucagaaccacuag

SEQ ID NO: 66060 - RNA, 21 nt, Human
agucccaggggugagugaugu

SEQ ID NO: 66061 - RNA, 22 nt, Human
agucccagugagaugaaccagg

SEQ ID NO: 66062 - RNA, 21 nt, Human
agucccauccgguaagcaagc

SEQ ID NO: 66063 - RNA, 22 nt, Human
aguccccuggcaggagggacgu

SEQ ID NO: 66064 - RNA, 22 nt, Human
agucccuugagggaguacuguu

SEQ ID NO: 66065 - RNA, 22 nt, Human
aguccgcgcuccaugggagucc

SEQ ID NO: 66066 - RNA, 22 nt, Human
aguccguggccagacucaagag

SEQ ID NO: 66067 - RNA, 22 nt, Human
aguccuagcccuggauccauca

SEQ ID NO: 66068 - RNA, 22 nt, Human
aguccuaggcccugcuccagau

SEQ ID NO: 66069 - RNA, 22 nt, Human
aguccuggacuuggagucaggg

SEQ ID NO: 66070 - RNA, 22 nt, Human
aguccugugcaaaugcaucuga

SEQ ID NO: 66071 - RNA, 22 nt, Human
aguccuucacguccugcuuauu

SEQ ID NO: 66072 - RNA, 22 nt, Human
aguccuugaauguuuugaaauc

SEQ ID NO: 66073 - RNA, 23 nt, Human
aguccuuuuuauaaaauugagga

SEQ ID NO: 66074 - RNA, 22 nt, Human
agucgcagacaugguccccuuu

SEQ ID NO: 66075 - RNA, 22 nt, Human
agucuacaaagaaaaguuauug

SEQ ID NO: 66076 - RNA, 22 nt, Human
agucuacaaucuuaaaugaacu

SEQ ID NO: 66077 - RNA, 22 nt, Human
agucuagaaacaagguagagcu

SEQ ID NO: 66078 - RNA, 22 nt, Human
agucuagaggauggguccagau

SEQ ID NO: 66079 - RNA, 22 nt, Human
agucuagauccccagugcuguc

SEQ ID NO: 66080 - RNA, 22 nt, Human
agucuaguaggaucucugggcu

SEQ ID NO: 66081 - RNA, 22 nt, Human
agucuauuucagucuuacuagu

SEQ ID NO: 66082 - RNA, 22 nt, Human
agucuauuuuagcugcauaugu

SEQ ID NO: 66083 - RNA, 22 nt, Human
agucucaaagucagugucaugg

SEQ ID NO: 66084 - RNA, 22 nt, Human
agucucaagggaugucucuaua

SEQ ID NO: 66085 - RNA, 22 nt, Human
agucucagaguaccugagggac

SEQ ID NO: 66086 - RNA, 22 nt, Human
agucucagcaagcauggcuagu

SEQ ID NO: 66087 - RNA, 22 nt, Human
agucuccacaacagcccugaua

SEQ ID NO: 66088 - RNA, 22 nt, Human
agucucuaggaucagacaccca

SEQ ID NO: 66089 - RNA, 21 nt, Human
agucucucuaauaaaugcuug

SEQ ID NO: 66090 - RNA, 22 nt, Human
agucucugcugguugugccuau

SEQ ID NO: 66091 - RNA, 22 nt, Human
agucucugucguagaucagcgu

SEQ ID NO: 66092 - RNA, 22 nt, Human
agucucugugagcucccaaugg

SEQ ID NO: 66093 - RNA, 19 nt, Human
agucucuucggaggagguu

SEQ ID NO: 66094 - RNA, 22 nt, Human
agucucuugcuagaaucagcca

SEQ ID NO: 66095 - RNA, 22 nt, Human
agucugaaaguauguuguaaug

SEQ ID NO: 66096 - RNA, 22 nt, Human
agucugaagacucaugucugaa

SEQ ID NO: 66097 - RNA, 22 nt, Human
agucugaagauauucuugcagg

SEQ ID NO: 66098 - RNA, 22 nt, Human
agucugaaggauggaagguacc

SEQ ID NO: 66099 - RNA, 20 nt, Human
agucugacauuuuucucuca

SEQ ID NO: 66100 - RNA, 22 nt, Human
agucugacuagacucugcucac

SEQ ID NO: 66101 - RNA, 22 nt, Human
agucugagguaauauuuuucuc

SEQ ID NO: 66102 - RNA, 19 nt, Human
agucugcauuucuagcaag

SEQ ID NO: 66103 - RNA, 22 nt, Human
agucugcuuuugugaagagcug

SEQ ID NO: 66104 - RNA, 22 nt, Human
agucuggaauuuggccugagca

SEQ ID NO: 66105 - RNA, 22 nt, Human
agucuggagugauuauguggga

SEQ ID NO: 66106 - RNA, 22 nt, Human
agucugggaacugggaacguuu

SEQ ID NO: 66107 - RNA, 22 nt, Human
agucuggguggcugagcuacag

SEQ ID NO: 66108 - RNA, 22 nt, Human
agucuggucaucugauucuuuu

SEQ ID NO: 66109 - RNA, 22 nt, Human
agucugguguaugaaagugaau

SEQ ID NO: 66110 - RNA, 20 nt, Human
agucugucaauuuacagugg

SEQ ID NO: 66111 - RNA, 22 nt, Human
agucugucuaauauuauucagg

SEQ ID NO: 66112 - RNA, 22 nt, Human
agucugucucugcuaaucacua

SEQ ID NO: 66113 - RNA, 22 nt, Human
agucugucuuuggcuucaccac

SEQ ID NO: 66114 - RNA, 22 nt, Human
agucuguggauggacuggcaga

SEQ ID NO: 66115 - RNA, 22 nt, Human
agucuguggggucccuggggca

SEQ ID NO: 66116 - RNA, 22 nt, Human
agucuguguaccuuuggccuuc

SEQ ID NO: 66117 - RNA, 23 nt, Human
agucuuaauacagcucuuuucua

SEQ ID NO: 66118 - RNA, 21 nt, Human
agucuuaggcacagcuguguc

SEQ ID NO: 66119 - RNA, 22 nt, Human
agucuuauaucacuaugcucug

SEQ ID NO: 66120 - RNA, 22 nt, Human
agucuuauguuugugaagaacu

SEQ ID NO: 66121 - RNA, 22 nt, Human
agucuucacaucagucuaaaga

SEQ ID NO: 66122 - RNA, 22 nt, Human
agucuucacucuucacuacuau

SEQ ID NO: 66123 - RNA, 22 nt, Human
agucuucagcaggguuaaaccc

SEQ ID NO: 66124 - RNA, 23 nt, Human
agcuggaggcugucuacucccaa

SEQ ID NO: 66125 - RNA, 22 nt, Human
agcuggaggggccagcaggugu

SEQ ID NO: 66126 - RNA, 22 nt, Human
agcuggcaaggcuuuagauuca

SEQ ID NO: 66127 - RNA, 22 nt, Human
agcuggcaaguugaagguggcu

SEQ ID NO: 66128 - RNA, 22 nt, Human
agcuggcaauguaagucccugg

SEQ ID NO: 66129 - RNA, 21 nt, Human
agcuggcaauguuguccucuu

SEQ ID NO: 66130 - RNA, 21 nt, Human
agcuggcagauauggugucug

SEQ ID NO: 66131 - RNA, 19 nt, Human
agcuggcagcuuccacuuc

SEQ ID NO: 66132 - RNA, 22 nt, Human
agcuggcaguugcgauaaugca

SEQ ID NO: 66133 - RNA, 22 nt, Human
agcuggcauugcagggagcugc

SEQ ID NO: 66134 - RNA, 22 nt, Human
agcuggccagaugucccaaaga

SEQ ID NO: 66135 - RNA, 22 nt, Human
agcuggccagcaccuccagguc

SEQ ID NO: 66136 - RNA, 20 nt, Human
agcuggcccacagguguggg

SEQ ID NO: 66137 - RNA, 22 nt, Human
agcuggcccacuguguggucca

SEQ ID NO: 66138 - RNA, 22 nt, Human
agcuggccuccgggugccuggg

SEQ ID NO: 66139 - RNA, 22 nt, Human
agcuggccuuagugagcaccug

SEQ ID NO: 66140 - RNA, 21 nt, Human
agcuggcuauaguuagugaug

SEQ ID NO: 66141 - RNA, 22 nt, Human
agcuggcuggccccuuccugcc

SEQ ID NO: 66142 - RNA, 22 nt, Human
agcuggcuucacaggcagugug

SEQ ID NO: 66143 - RNA, 22 nt, Human
agcugggaagacuggaagacag

SEQ ID NO: 66144 - RNA, 22 nt, Human
agcugggagcagagccacagcc

SEQ ID NO: 66145 - RNA, 22 nt, Human
agcugggagcugaaggcugauu

SEQ ID NO: 66146 - RNA, 22 nt, Human
agcugggaggugggcagugaga

SEQ ID NO: 66147 - RNA, 22 nt, Human
agcugggaugaggagcauccuu

SEQ ID NO: 66148 - RNA, 22 nt, Human
gcccagaacagugucacauguc

SEQ ID NO: 66149 - RNA, 22 nt, Human
gcccagaaguugaggcugcagu

SEQ ID NO: 66150 - RNA, 21 nt, Human
gcccagagggagccaagccca

SEQ ID NO: 66151 - RNA, 22 nt, Human
gcccagcacaucuggccuugaa

SEQ ID NO: 66152 - RNA, 22 nt, Human
gcccagcacauugcugaggacc

SEQ ID NO: 66153 - RNA, 22 nt, Human
gcccagcccagaaagguucgga

SEQ ID NO: 66154 - RNA, 22 nt, Human
gcccagccccuggguggacgug

SEQ ID NO: 66155 - RNA, 22 nt, Human
gcccagccuccaagcuccaagg

SEQ ID NO: 66156 - RNA, 22 nt, Human
gcccagcgagcagagguggacg

SEQ ID NO: 66157 - RNA, 22 nt, Human
gcccagcuccauucuuggugag

SEQ ID NO: 66158 - RNA, 22 nt, Human
gcccagcugcacccuggugggu

SEQ ID NO: 66159 - RNA, 22 nt, Human
gcccagcuggcuuccagcacau

SEQ ID NO: 66160 - RNA, 22 nt, Human
gcccagcuuuucacuuccacac

SEQ ID NO: 66161 - RNA, 16 nt, Human
gcccaggacgggaggc

SEQ ID NO: 66162 - RNA, 22 nt, Human
gcccaggagccuggagaugugu

SEQ ID NO: 66163 - RNA, 22 nt, Human
gcccaggaguugaaugcagcag

SEQ ID NO: 66164 - RNA, 22 nt, Human
gcccaggauucuuucuuccuua

SEQ ID NO: 66165 - RNA, 22 nt, Human
gcccagggcgauggucggggcc

SEQ ID NO: 66166 - RNA, 22 nt, Human
gcccagugcugagggugcugcu

SEQ ID NO: 66167 - RNA, 22 nt, Human
gcccaguggcaucuucacugcu

SEQ ID NO: 66168 - RNA, 22 nt, Human
gcccauccauggggucauggcc

SEQ ID NO: 66169 - RNA, 22 nt, Human
gcccaucccugaaccaacuggg

SEQ ID NO: 66170 - RNA, 23 nt, Human
gcccauggagucuggaucuggcc

SEQ ID NO: 66171 - RNA, 18 nt, Human
gcccaugguaaaugcugu

SEQ ID NO: 66172 - RNA, 22 nt, Human
gcccaugguccaggaagacaga

SEQ ID NO: 66173 - RNA, 22 nt, Human
gcccauuuguuuauauacuguc

SEQ ID NO: 66174 - RNA, 22 nt, Human
gccccagaaaguucaaggcaca

SEQ ID NO: 66175 - RNA, 22 nt, Human
gccccagccaaggugacacgaa

SEQ ID NO: 66176 - RNA, 22 nt, Human
gccccagcccuguggaccaugg

SEQ ID NO: 66177 - RNA, 22 nt, Human
gccccagcucugccacaacuag

SEQ ID NO: 66178 - RNA, 22 nt, Human
gccccaggggaggugcccugca

SEQ ID NO: 66179 - RNA, 22 nt, Human
gcccccagaccucagugggcug

SEQ ID NO: 66180 - RNA, 22 nt, Human
gcccccagagaaugagguacga

SEQ ID NO: 66181 - RNA, 22 nt, Human
gccccuggcuggccagcuccuc

SEQ ID NO: 66182 - RNA, 22 nt, Human
gccccugggagcagagccacca

SEQ ID NO: 66183 - RNA, 22 nt, Human
gcccggcagucacacacccagg

SEQ ID NO: 66184 - RNA, 22 nt, Human
gcccgugugcagagugggagcu

SEQ ID NO: 66185 - RNA, 22 nt, Human
gcccuaccucaguccagaucug

SEQ ID NO: 66186 - RNA, 22 nt, Human
gcccucagaguuccccacagug

SEQ ID NO: 66187 - RNA, 22 nt, Human
gcccucaggacaagguuacgcu

SEQ ID NO: 66188 - RNA, 19 nt, Human
gcccucaggcagcuccauc

SEQ ID NO: 66189 - RNA, 21 nt, Human
gcccucaggggaggauggccu

SEQ ID NO: 66190 - RNA, 23 nt, Human
gcccucaguagaaaauguuagaa

SEQ ID NO: 66191 - RNA, 22 nt, Human
gcccuccagcuguugcgcgucg

SEQ ID NO: 66192 - RNA, 22 nt, Human
gcccuccauggugauccaggcc

SEQ ID NO: 66193 - RNA, 19 nt, Human
gcccuccucacugagcucu

SEQ ID NO: 66194 - RNA, 22 nt, Human
gcccucuaccuuggcuauagaa

SEQ ID NO: 66195 - RNA, 22 nt, Human
cugcauuacaauucugcucuau

SEQ ID NO: 66196 - RNA, 22 nt, Human
cugcauuagucaugcuuugcag

SEQ ID NO: 66197 - RNA, 22 nt, Human
cugcauuauucuaguccaagcc

SEQ ID NO: 66198 - RNA, 22 nt, Human
cugccaaucugaagagcuucuu

SEQ ID NO: 66199 - RNA, 21 nt, Human
cugccaccugcuccaucagca

SEQ ID NO: 66200 - RNA, 22 nt, Human
cugccacucugggugggccugg

SEQ ID NO: 66201 - RNA, 18 nt, Human
cugccacuuaauguggug

SEQ ID NO: 66202 - RNA, 22 nt, Human
cugccacuuucacccagugcuc

SEQ ID NO: 66203 - RNA, 22 nt, Human
cugccagaucauuggauucaca

SEQ ID NO: 66204 - RNA, 22 nt, Human
cugccaggcacugggcucugca

SEQ ID NO: 66205 - RNA, 22 nt, Human
cugccaggcagcagagggagaa

SEQ ID NO: 66206 - RNA, 22 nt, Human
cugccaggccucaucccagcca

SEQ ID NO: 66207 - RNA, 22 nt, Human
cugccaggcgauggauuggcug

SEQ ID NO: 66208 - RNA, 22 nt, Human
cugccagggaggcugggaaguu

SEQ ID NO: 66209 - RNA, 22 nt, Human
cugccaggggccucacaggcca

SEQ ID NO: 66210 - RNA, 22 nt, Human
cugccaggugccuuugugcagu

SEQ ID NO: 66211 - RNA, 22 nt, Human
cugccagguuggcgcucgcucu

SEQ ID NO: 66212 - RNA, 22 nt, Human
cugccagucuaugcugcucggc

SEQ ID NO: 66213 - RNA, 18 nt, Human
cugccagugugcucuccg

SEQ ID NO: 66214 - RNA, 22 nt, Human
cugccauguuaccugcacaggu

SEQ ID NO: 66215 - RNA, 22 nt, Human
cugcccaccacaccugcuccug

SEQ ID NO: 66216 - RNA, 22 nt, Human
cugcccaccgugugcacgugcg

SEQ ID NO: 66217 - RNA, 22 nt, Human
cugcccacuuggccaccuucua

SEQ ID NO: 66218 - RNA, 22 nt, Human
cugcccagaagccagaugggca

SEQ ID NO: 66219 - RNA, 20 nt, Human
cugcccagccacugagggau

SEQ ID NO: 66220 - RNA, 22 nt, Human
cugcccaggaaggagaggaugg

SEQ ID NO: 66221 - RNA, 22 nt, Human
cugcccaggcugaaggaacauc

SEQ ID NO: 66222 - RNA, 22 nt, Human
cugcccaggggagugcugucgg

SEQ ID NO: 66223 - RNA, 22 nt, Human
cugcccaucgucauuuaauaaa

SEQ ID NO: 66224 - RNA, 21 nt, Human
cugcccauuugugaugucccc

SEQ ID NO: 66225 - RNA, 22 nt, Human
cugccccaccccaaccugaggu

SEQ ID NO: 66226 - RNA, 22 nt, Human
cugcccgcugcuagagaggccg

SEQ ID NO: 66227 - RNA, 22 nt, Human
cugcccggagcuggcaaaggcu

SEQ ID NO: 66228 - RNA, 22 nt, Human
cugcccguaaguuagaaaagca

SEQ ID NO: 66229 - RNA, 22 nt, Human
cugcccucuagaggaggacuga

SEQ ID NO: 66230 - RNA, 22 nt, Human
cugcccugcagcuccacggacu

SEQ ID NO: 66231 - RNA, 22 nt, Human
cugcccugcccaggccuugggc

SEQ ID NO: 66232 - RNA, 20 nt, Human
cugcccugcccuggguccug

SEQ ID NO: 66233 - RNA, 22 nt, Human
cugcccugcuaaugaguuccaa

SEQ ID NO: 66234 - RNA, 22 nt, Human
cugcccugcuggagaucacagu

SEQ ID NO: 66235 - RNA, 22 nt, Human
cugcccuggcagccuaccaugg

SEQ ID NO: 66236 - RNA, 22 nt, Human
cugcccugggauggucugugcg

SEQ ID NO: 66237 - RNA, 22 nt, Human
cugcccuggguuuuaugggagu

SEQ ID NO: 66238 - RNA, 22 nt, Human
cugcccuguagcuguucuagca

SEQ ID NO: 66239 - RNA, 22 nt, Human
cugcccuguccuucccgccggc

SEQ ID NO: 66240 - RNA, 22 nt, Human
cugcccugugaggguccuuggg

SEQ ID NO: 66241 - RNA, 22 nt, Human
cugcccuguggcucugagucau

SEQ ID NO: 66242 - RNA, 22 nt, Human
cugccgaguacagccauagaaa

SEQ ID NO: 66243 - RNA, 22 nt, Human
cugccgugagcuuucgcgagcc

SEQ ID NO: 66244 - RNA, 22 nt, Human
cugccuagauuugaauccuggc

SEQ ID NO: 66245 - RNA, 22 nt, Human
cugccuagcgccaucugccucu

SEQ ID NO: 66246 - RNA, 22 nt, Human
cugccucuauucacugaggcag

SEQ ID NO: 66247 - RNA, 22 nt, Human
cugccucugcgucccacagagu

SEQ ID NO: 66248 - RNA, 22 nt, Human
cugccucuggccucaggcccag

SEQ ID NO: 66249 - RNA, 22 nt, Human
cugccucuuaaguggauggagu

SEQ ID NO: 66250 - RNA, 22 nt, Human
cugccugaguacaagucccaga

SEQ ID NO: 66251 - RNA, 22 nt, Human
cugccugcaugcugccauagcu

SEQ ID NO: 66252 - RNA, 22 nt, Human
cugccugccacguucagcugua

SEQ ID NO: 66253 - RNA, 22 nt, Human
cugccugcuaccugaaaugcca

SEQ ID NO: 66254 - RNA, 22 nt, Human
cugccuggaugaauggcgccuu

SEQ ID NO: 66255 - RNA, 22 nt, Human
cugccuggcauggagaagagaa

SEQ ID NO: 66256 - RNA, 22 nt, Human
cugccuggcuaaacucaagucg

SEQ ID NO: 66257 - RNA, 22 nt, Human
gcugcagcccggcgcgccugag

SEQ ID NO: 66258 - RNA, 22 nt, Human
gcugcagccuucuugccauuaa

SEQ ID NO: 66259 - RNA, 22 nt, Human
gcugcaggagcuggagcugugg

SEQ ID NO: 66260 - RNA, 22 nt, Human
gcugcaggcagaaucucccaau

SEQ ID NO: 66261 - RNA, 18 nt, Human
gcugcaggcgccugcggu

SEQ ID NO: 66262 - RNA, 22 nt, Human
gcugcaggcggccgugguggcg

SEQ ID NO: 66263 - RNA, 22 nt, Human
gcugcaggcucugcaggaauug

SEQ ID NO: 66264 - RNA, 22 nt, Human
gcugcagguugggcaacagagu

SEQ ID NO: 66265 - RNA, 21 nt, Human
gcugcaucaaucuacccaggg

SEQ ID NO: 66266 - RNA, 22 nt, Human
gcugcauugcuauaaaauacaa

SEQ ID NO: 66267 - RNA, 23 nt, Human
gcugccaaggaggcaggggugcc

SEQ ID NO: 66268 - RNA, 22 nt, Human
gcugccacucugagcuugcuuc

SEQ ID NO: 66269 - RNA, 22 nt, Human
gcugccacuuggucaugucaug

SEQ ID NO: 66270 - RNA, 22 nt, Human
gcugccagccaacuugcugugc

SEQ ID NO: 66271 - RNA, 22 nt, Human
gcugccagcccagcaaggugug

SEQ ID NO: 66272 - RNA, 22 nt, Human
gcugccagcgucagaccugggg

SEQ ID NO: 66273 - RNA, 21 nt, Human
gcugccaggauuuugcaggaa

SEQ ID NO: 66274 - RNA, 22 nt, Human
gcugccagucuaaugggaaaca

SEQ ID NO: 66275 - RNA, 22 nt, Human
gcugccauccccugcugggcug

SEQ ID NO: 66276 - RNA, 22 nt, Human
gcugccaucuccugaggacagg

SEQ ID NO: 66277 - RNA, 22 nt, Human
gcugccaugccacagcacucac

SEQ ID NO: 66278 - RNA, 22 nt, Human
gcugccauggcugggggccgug

SEQ ID NO: 66279 - RNA, 22 nt, Human
gcugcccagacauugaaucagg

SEQ ID NO: 66280 - RNA, 22 nt, Human
gcugcccaggagagguggggcu

SEQ ID NO: 66281 - RNA, 22 nt, Human
gcugcccagggcugaguguccu

SEQ ID NO: 66282 - RNA, 22 nt, Human
gcugcccuacccgaggcacucu

SEQ ID NO: 66283 - RNA, 22 nt, Human
gcugcccucccagggcaagcuu

SEQ ID NO: 66284 - RNA, 22 nt, Human
gcugcccucugugacccggccc

SEQ ID NO: 66285 - RNA, 22 nt, Human
gcugcccugugguagagggugg

SEQ ID NO: 66286 - RNA, 22 nt, Human
gcugccuagucugcugagcaga

SEQ ID NO: 66287 - RNA, 22 nt, Human
gcugccucaggcaccuccuggc

SEQ ID NO: 66288 - RNA, 22 nt, Human
gcugccuccaaucugugccccg

SEQ ID NO: 66289 - RNA, 22 nt, Human
gcugccuccacuggcucccagu

SEQ ID NO: 66290 - RNA, 22 nt, Human
gcugccucccagagcccugcag

SEQ ID NO: 66291 - RNA, 23 nt, Human
gcugccuccuacaaaagcccagc

SEQ ID NO: 66292 - RNA, 22 nt, Human
gcugccucuccugaguugacag

SEQ ID NO: 66293 - RNA, 22 nt, Human
gcugccucugcacagcucacuc

SEQ ID NO: 66294 - RNA, 22 nt, Human
gcugccucugcgacucugggcg

SEQ ID NO: 66295 - RNA, 22 nt, Human
gcugccucuguagcuuuggacc

SEQ ID NO: 66296 - RNA, 22 nt, Human
gcugccugaaauguugccuagc

SEQ ID NO: 66297 - RNA, 22 nt, Human
gcugccugaagugucuacacug

SEQ ID NO: 66298 - RNA, 22 nt, Human
gcugccugauuuacauagugaa

SEQ ID NO: 66299 - RNA, 17 nt, Human
gcugccugcaacugacu

SEQ ID NO: 66300 - RNA, 22 nt, Human
gcugccugccugcauuuaaucc

SEQ ID NO: 66301 - RNA, 22 nt, Human
gcugccugccuugccuggagga

SEQ ID NO: 66302 - RNA, 22 nt, Human
gcugccuggaauaacggcuggc

SEQ ID NO: 66303 - RNA, 22 nt, Human
gcugccugugcacuuucucgua

SEQ ID NO: 66304 - RNA, 22 nt, Human
gcugccugugcgggucgcuagg

SEQ ID NO: 66305 - RNA, 22 nt, Human
gcugccuguggcccuucugggu

SEQ ID NO: 66306 - RNA, 22 nt, Human
gcugccuguguggccacucacu

SEQ ID NO: 66307 - RNA, 22 nt, Human
gcugccuguugaagggucugug

SEQ ID NO: 66308 - RNA, 22 nt, Human
gcugccuucaguucugauucau

SEQ ID NO: 66309 - RNA, 22 nt, Human
gcugccuuccaaagaguuuuau

SEQ ID NO: 66310 - RNA, 22 nt, Human
gcugccuucugagaaguuaaau

SEQ ID NO: 66311 - RNA, 22 nt, Human
gcugccuugccaggggcagaaa

SEQ ID NO: 66312 - RNA, 22 nt, Human
gcugccuugcuuacuccacugc

SEQ ID NO: 66313 - RNA, 22 nt, Human
gcugcgagcucuuguucugaga

SEQ ID NO: 66314 - RNA, 22 nt, Human
gcugcggugaacuuggauggug

SEQ ID NO: 66315 - RNA, 22 nt, Human
gcugcgucgagacagccuggca

SEQ ID NO: 66316 - RNA, 22 nt, Human
gcugcucagugggccugagccu

SEQ ID NO: 66317 - RNA, 22 nt, Human
gcugcuccgucugagcucuggu

SEQ ID NO: 66318 - RNA, 22 nt, Human
gcugcucuacccaugcaucugu

SEQ ID NO: 66319 - RNA, 22 nt, Human
gcugcucucucccuaaguuggg

SEQ ID NO: 66320 - RNA, 22 nt, Human
gcugcucuguuaauugcuguaa

SEQ ID NO: 66321 - RNA, 22 nt, Human
gcugcugcuggucuggggccac

SEQ ID NO: 66322 - RNA, 16 nt, Human
gcugcugcuuccugcu

SEQ ID NO: 66323 - RNA, 22 nt, Human
gcugcuggcaucuagggggugg

SEQ ID NO: 66324 - RNA, 19 nt, Human
gcugcuggcucuggcugga

SEQ ID NO: 66325 - RNA, 22 nt, Human
gcugcugggaaugaacaguguu

SEQ ID NO: 66326 - RNA, 22 nt, Human
gcugcugggauccugggucuca

SEQ ID NO: 66327 - RNA, 22 nt, Human
gcugcuggggucacaugguaag

SEQ ID NO: 66328 - RNA, 18 nt, Human
gcugcugguggagggagc

SEQ ID NO: 66329 - RNA, 22 nt, Human
gcugcugucacggugcuaaggg

SEQ ID NO: 66330 - RNA, 22 nt, Human
gcugcuguccuucaagucugcg

SEQ ID NO: 66331 - RNA, 22 nt, Human
gcugcuguggcagauuggauuc

SEQ ID NO: 66332 - RNA, 22 nt, Human
gcugcuguguuggccacugcuu

SEQ ID NO: 66333 - RNA, 22 nt, Human
gcugcuguuaugauguuacuuu

SEQ ID NO: 66334 - RNA, 22 nt, Human
gcugcuguuccggcuacagccc

SEQ ID NO: 66335 - RNA, 22 nt, Human
gcugcuucuccucccuggggau

SEQ ID NO: 66336 - RNA, 22 nt, Human
gcugcuuuagguugagcucagc

SEQ ID NO: 66337 - RNA, 22 nt, Human
gcuggaaaaggaggcaaaauau

SEQ ID NO: 66338 - RNA, 22 nt, Human
gcuggaaaugauuaaaugguga

SEQ ID NO: 66339 - RNA, 22 nt, Human
gcuggaacagucuuuaagcagg

SEQ ID NO: 66340 - RNA, 22 nt, Human
gcuggaagaaugagugccucgu

SEQ ID NO: 66341 - RNA, 20 nt, Human
gcuggaagggcuagagggcu

SEQ ID NO: 66342 - RNA, 22 nt, Human
gcuggaauuggacccagggcuc

SEQ ID NO: 66343 - RNA, 22 nt, Human
gcuggagagauaggcauggggu

SEQ ID NO: 66344 - RNA, 21 nt, Human
gcuggagagccaggcaggggc

SEQ ID NO: 66345 - RNA, 22 nt, Human
gcuggagauagaauggccacug

SEQ ID NO: 66346 - RNA, 22 nt, Human
gcuggagcugaguucccugggc

SEQ ID NO: 66347 - RNA, 22 nt, Human
cuguccauggugcuggacgguc

SEQ ID NO: 66348 - RNA, 22 nt, Human
cuguccauugguauauuagggu

SEQ ID NO: 66349 - RNA, 22 nt, Human
cuguccauuuugaauuuucagu

SEQ ID NO: 66350 - RNA, 22 nt, Human
cugucccagauguucucagcac

SEQ ID NO: 66351 - RNA, 22 nt, Human
cugucccaggauccugacucca

SEQ ID NO: 66352 - RNA, 22 nt, Human
cugucccagugauccugagugc

SEQ ID NO: 66353 - RNA, 18 nt, Human
cugucccauccucagguu

SEQ ID NO: 66354 - RNA, 22 nt, Human
cuguccccugugcuuucacuug

SEQ ID NO: 66355 - RNA, 21 nt, Human
cugucccucuuugcuucccuc

SEQ ID NO: 66356 - RNA, 22 nt, Human
cugucccuucccaagcccagcc

SEQ ID NO: 66357 - RNA, 22 nt, Human
cuguccucaccuuggcaggggg

SEQ ID NO: 66358 - RNA, 22 nt, Human
cuguccucaucugccccaaggg

SEQ ID NO: 66359 - RNA, 22 nt, Human
cuguccugaaguuuucaugaga

SEQ ID NO: 66360 - RNA, 22 nt, Human
cuguccuggagggcauaggacg

SEQ ID NO: 66361 - RNA, 19 nt, Human
cuguccugguuuggucccu

SEQ ID NO: 66362 - RNA, 22 nt, Human
cuguccugugucagccugaaau

SEQ ID NO: 66363 - RNA, 22 nt, Human
cuguccuuacugcuucuggcuu

SEQ ID NO: 66364 - RNA, 22 nt, Human
cuguccuugcuggccagguaug

SEQ ID NO: 66365 - RNA, 19 nt, Human
cuguccuuggcugcacugu

SEQ ID NO: 66366 - RNA, 22 nt, Human
gcuggccaguguggugaccacc

SEQ ID NO: 66367 - RNA, 22 nt, Human
gcuggcccagcgcccagggcag

SEQ ID NO: 66368 - RNA, 22 nt, Human
gcuggccgaacggugcccuggc

SEQ ID NO: 66369 - RNA, 22 nt, Human
gcuggccucgcaggcaggaugu

SEQ ID NO: 66370 - RNA, 22 nt, Human
gcuggccugagggccgaggcuc

SEQ ID NO: 66371 - RNA, 22 nt, Human
gcuggcucaagagguccagagg

SEQ ID NO: 66372 - RNA, 22 nt, Human
gcuggcucaagugugcuuccca

SEQ ID NO: 66373 - RNA, 22 nt, Human
gcuggcuccaaaagcaggggcu

SEQ ID NO: 66374 - RNA, 22 nt, Human
gcuggcucccauugguccuucc

SEQ ID NO: 66375 - RNA, 21 nt, Human
gcuggcucucugacgugcuuu

SEQ ID NO: 66376 - RNA, 22 nt, Human
gcuggcucugaugggcuccagg

SEQ ID NO: 66377 - RNA, 20 nt, Human
gcuggcugaacugaaagcaa

SEQ ID NO: 66378 - RNA, 22 nt, Human
gcuggcugagaucuguuuuccu

SEQ ID NO: 66379 - RNA, 22 nt, Human
gcuggcugaggucuagcucuuu

SEQ ID NO: 66380 - RNA, 22 nt, Human
gcuggcugccugguuaugccuu

SEQ ID NO: 66381 - RNA, 22 nt, Human
gcuggcuggaacuagcaguugg

SEQ ID NO: 66382 - RNA, 21 nt, Human
gcuggcuggcugaccggccuu

SEQ ID NO: 66383 - RNA, 22 nt, Human
gcuggcugggacagauuccauu

SEQ ID NO: 66384 - RNA, 22 nt, Human
gcuggcugguccagcaggggcu

SEQ ID NO: 66385 - RNA, 21 nt, Human
gcuggcugucccagggaagca

SEQ ID NO: 66386 - RNA, 22 nt, Human
gcuggcuuaauagggaugggcu

SEQ ID NO: 66387 - RNA, 22 nt, Human
gcuggcuuaauguagcuaaaaa

SEQ ID NO: 66388 - RNA, 22 nt, Human
gcuggcuuugaucuucccaucu

SEQ ID NO: 66389 - RNA, 20 nt, Human
gcugggaacaggauugaauc

SEQ ID NO: 66390 - RNA, 22 nt, Human
gcugggaagaacaggagagaau

SEQ ID NO: 66391 - RNA, 22 nt, Human
gcugggacggcucaguaagaag

SEQ ID NO: 66392 - RNA, 22 nt, Human
gcugggagaggcagcuuucgga

SEQ ID NO: 66393 - RNA, 22 nt, Human
gcugggagaggcccugaaguga

SEQ ID NO: 66394 - RNA, 22 nt, Human
gcugggagccccgagccagcgc

SEQ ID NO: 66395 - RNA, 22 nt, Human
gcugggagcccuggucugcucc

SEQ ID NO: 66396 - RNA, 22 nt, Human
gcugggaguuacugucuccuuu

SEQ ID NO: 66397 - RNA, 22 nt, Human
gcugggaugcgucuucccaggc

SEQ ID NO: 66398 - RNA, 22 nt, Human
gcugggauggagacugcaguga

SEQ ID NO: 66399 - RNA, 22 nt, Human
gcugggcaacggaagagagaaa

SEQ ID NO: 66400 - RNA, 22 nt, Human
gcugggcaaggcugaagcuacc

SEQ ID NO: 66401 - RNA, 22 nt, Human
gcugggcaccggagagacccca

SEQ ID NO: 66402 - RNA, 22 nt, Human
gcugggcaccucucccagauug

SEQ ID NO: 66403 - RNA, 22 nt, Human
gcugggcagccuggccgcugcc

SEQ ID NO: 66404 - RNA, 22 nt, Human
gcugggccagacuuucaauguc

SEQ ID NO: 66405 - RNA, 22 nt, Human
gcugggcccagaucccaggauc

SEQ ID NO: 66406 - RNA, 20 nt, Human
gcugggcuaccacuggcccu

SEQ ID NO: 66407 - RNA, 22 nt, Human
gcugggcucagaccuagugaac

SEQ ID NO: 66408 - RNA, 22 nt, Human
gcugggcuccaggccaggguga

SEQ ID NO: 66409 - RNA, 22 nt, Human
gcugggcucguucccacacgcg

SEQ ID NO: 66410 - RNA, 22 nt, Human
gcugggcugagaaguuaagcaa

SEQ ID NO: 66411 - RNA, 22 nt, Human
gcugggcugcgucggggaagcc

SEQ ID NO: 66412 - RNA, 19 nt, Human
gcugggcuuggguuuguag

SEQ ID NO: 66413 - RNA, 20 nt, Human
gcugggcuuugacugacaca

SEQ ID NO: 66414 - RNA, 22 nt, Human
gcuggggagcuagaccucagca

SEQ ID NO: 66415 - RNA, 22 nt, Human
gcuggggugugguggauaagcu

SEQ ID NO: 66416 - RNA, 22 nt, Human
gcugggugucacggggcucgug

SEQ ID NO: 66417 - RNA, 22 nt, Human
gcuggguuuccagcaggcagga

SEQ ID NO: 66418 - RNA, 22 nt, Human
gcugguagaccucacugcacuc

SEQ ID NO: 66419 - RNA, 22 nt, Human
gcugguauuugcagccugucau

SEQ ID NO: 66420 - RNA, 22 nt, Human
gcuggucagagagaaaggaggc

SEQ ID NO: 66421 - RNA, 22 nt, Human
gcugguccacucccuggaggcu

SEQ ID NO: 66422 - RNA, 22 nt, Human
gcuggucccaauguguuuccuu

SEQ ID NO: 66423 - RNA, 22 nt, Human
gcugguccugggguugcagcau

SEQ ID NO: 66424 - RNA, 22 nt, Human
gcuggugauugccucaggaggc

SEQ ID NO: 66425 - RNA, 16 nt, Human
gcuguaaaaggauuca

SEQ ID NO: 66426 - RNA, 22 nt, Human
gcuguaaagaacauuaggaauc

SEQ ID NO: 66427 - RNA, 22 nt, Human
gcuguacaaggccucugccauc

SEQ ID NO: 66428 - RNA, 22 nt, Human
gcuguacaucacaauuugcugu

SEQ ID NO: 66429 - RNA, 22 nt, Human
gcuguagggcugagcuggaccg

SEQ ID NO: 66430 - RNA, 17 nt, Human
gcuguaguuugauaaga

SEQ ID NO: 66431 - RNA, 22 nt, Human
gcuguaugugaggccacaguga

SEQ ID NO: 66432 - RNA, 22 nt, Human
gcuguauuccugcacuguauag

SEQ ID NO: 66433 - RNA, 22 nt, Human
gcuguauuuaacaacuggcuca

SEQ ID NO: 66434 - RNA, 22 nt, Human
gcugucacauuuggagcacugg

SEQ ID NO: 66435 - RNA, 22 nt, Human
gcugucaccaaagcaggcacug

SEQ ID NO: 66436 - RNA, 22 nt, Human
gcugucacucuccggccuuccc

SEQ ID NO: 66437 - RNA, 22 nt, Human
gcugucaggaacaugccuuggu

SEQ ID NO: 66438 - RNA, 22 nt, Human
gcugucaggccaugugggccuu

SEQ ID NO: 66439 - RNA, 22 nt, Human
gcuguccacgggguugguagag

SEQ ID NO: 66440 - RNA, 22 nt, Human
gcuguccaggagugcagagauu

SEQ ID NO: 66441 - RNA, 22 nt, Human
gcugucccuugucccaccuugc

SEQ ID NO: 66442 - RNA, 23 nt, Human
gcuguccuccugggcccagcagc

SEQ ID NO: 66443 - RNA, 22 nt, Human
gcuguccucuuggacucagggc

SEQ ID NO: 66444 - RNA, 22 nt, Human
gcugucucggggcuuucuccug

SEQ ID NO: 66445 - RNA, 22 nt, Human
gcugucugagaacaugguggaa

SEQ ID NO: 66446 - RNA, 22 nt, Human
gcugucugcugugcacugagca

SEQ ID NO: 66447 - RNA, 22 nt, Human
gcugucuggauaucuuggaauu

SEQ ID NO: 66448 - RNA, 22 nt, Human
gcugucuguggugucagcugac

SEQ ID NO: 66449 - RNA, 22 nt, Human
gcugugcaaaucgauuuguugg

SEQ ID NO: 66450 - RNA, 22 nt, Human
gcugugcacuaccuauacaucc

SEQ ID NO: 66451 - RNA, 22 nt, Human
gcugugcagagcacaggguccc

SEQ ID NO: 66452 - RNA, 22 nt, Human
gcugugcagauguagggagugg

SEQ ID NO: 66453 - RNA, 22 nt, Human
gcugugcauaaguauaauaaac

SEQ ID NO: 66454 - RNA, 22 nt, Human
gcugugcaucuucauucuggac

SEQ ID NO: 66455 - RNA, 20 nt, Human
gcugugccaugacccucgag

SEQ ID NO: 66456 - RNA, 22 nt, Human
gcugugcucaacgugccuuccu

SEQ ID NO: 66457 - RNA, 22 nt, Human
gcuguggaaaugccuaacauga

SEQ ID NO: 66458 - RNA, 22 nt, Human
gcuguggcccuuggcaucugcg

SEQ ID NO: 66459 - RNA, 22 nt, Human
gcuguggcggcagcagcuggug

SEQ ID NO: 66460 - RNA, 22 nt, Human
gcuguggcuguacagagaccau

SEQ ID NO: 66461 - RNA, 22 nt, Human
gcuguggguaaacgcugagggu

SEQ ID NO: 66462 - RNA, 22 nt, Human
gcuguggguccggaccccacgg

SEQ ID NO: 66463 - RNA, 20 nt, Human
gcuguguagcagugugcagu

SEQ ID NO: 66464 - RNA, 22 nt, Human
cuucuuauuaauccuucucugu

SEQ ID NO: 66465 - RNA, 22 nt, Human
cuucuucaguugcauguauugg

SEQ ID NO: 66466 - RNA, 20 nt, Human
cuucuucauuaacccuacug

SEQ ID NO: 66467 - RNA, 22 nt, Human
cuucuuccugaaagcuggcucu

SEQ ID NO: 66468 - RNA, 22 nt, Human
cuucuuccugcugcagccucca

SEQ ID NO: 66469 - RNA, 22 nt, Human
cuucuucucuacauccuuugau

SEQ ID NO: 66470 - RNA, 22 nt, Human
cuucuucuuuugugggugguaa

SEQ ID NO: 66471 - RNA, 22 nt, Human
cuucuugaaaccugcucccuca

SEQ ID NO: 66472 - RNA, 22 nt, Human
cuucuugaaguccuccagaagu

SEQ ID NO: 66473 - RNA, 22 nt, Human
cuucuugacuucugggugcccu

SEQ ID NO: 66474 - RNA, 22 nt, Human
cuucuugagcauggguaguacu

SEQ ID NO: 66475 - RNA, 22 nt, Human
gaaagcauaacuaauauuuauu

SEQ ID NO: 66476 - RNA, 22 nt, Human
gaaagcauguagccuguaucca

SEQ ID NO: 66477 - RNA, 22 nt, Human
gaaagccaucuggcugcuggga

SEQ ID NO: 66478 - RNA, 18 nt, Human
gaaagccaugcagcagug

SEQ ID NO: 66479 - RNA, 22 nt, Human
gaaagcugugaaauagugcucu

SEQ ID NO: 66480 - RNA, 22 nt, Human
gaaagcuuccauuuuguacauu

SEQ ID NO: 66481 - RNA, 18 nt, Human
gaaaggagagacaguagg

SEQ ID NO: 66482 - RNA, 17 nt, Human
gaaaggaggcaacacug

SEQ ID NO: 66483 - RNA, 22 nt, Human
gaaaggcaguacagcugagccu

SEQ ID NO: 66484 - RNA, 22 nt, Human
gaaaggcaucuucagucucuga

SEQ ID NO: 66485 - RNA, 22 nt, Human
gaaaggccagcucacagaugag

SEQ ID NO: 66486 - RNA, 22 nt, Human
gaaaggccauuucugaggguuu

SEQ ID NO: 66487 - RNA, 22 nt, Human
gaaaggcugcaucucgccucag

SEQ ID NO: 66488 - RNA, 22 nt, Human
gaaaggcuugguuuugaauaua

SEQ ID NO: 66489 - RNA, 22 nt, Human
gaaaggggcauguagggaucac

SEQ ID NO: 66490 - RNA, 22 nt, Human
gaaagggucuuugauuucccuc

SEQ ID NO: 66491 - RNA, 21 nt, Human
gaaaggucuuaacuuacagag

SEQ ID NO: 66492 - RNA, 22 nt, Human
gaaagguuuaaguaggauuugu

SEQ ID NO: 66493 - RNA, 22 nt, Human
gaaagguuuggcuuuucaguag

SEQ ID NO: 66494 - RNA, 22 nt, Human
gaaaguaacauuucuugaauua

SEQ ID NO: 66495 - RNA, 22 nt, Human
gaaagugccagaauaggaggcc

SEQ ID NO: 66496 - RNA, 18 nt, Human
gaaagugcggggcagggg

SEQ ID NO: 66497 - RNA, 22 nt, Human
gaaagugcuuagagugugguau

SEQ ID NO: 66498 - RNA, 22 nt, Human
gaaaguuacagaaaccauuagu

SEQ ID NO: 66499 - RNA, 22 nt, Human
gaaaguuauucagccucucuga

SEQ ID NO: 66500 - RNA, 22 nt, Human
gaaaguuucuucauuaagaugu

SEQ ID NO: 66501 - RNA, 22 nt, Human
gaaauacaaagccagccauuuu

SEQ ID NO: 66502 - RNA, 22 nt, Human
gaaauacaaaugccuagauccu

SEQ ID NO: 66503 - RNA, 22 nt, Human
gaaugcuggcuuacaggcaguu

SEQ ID NO: 66504 - RNA, 22 nt, Human
gaaugcuguagacagacucuau

SEQ ID NO: 66505 - RNA, 23 nt, Human
gaauggcuaagcacauagacuug

SEQ ID NO: 66506 - RNA, 22 nt, Human
gaauggcuaucggauuauuagg

SEQ ID NO: 66507 - RNA, 22 nt, Human
gaauggcugaaugucuuaaauu

SEQ ID NO: 66508 - RNA, 22 nt, Human
gaauguaaaauugccuacaaga

SEQ ID NO: 66509 - RNA, 22 nt, Human
gaaugucccugcaguugcugcc

SEQ ID NO: 66510 - RNA, 22 nt, Human
gaaugucuucuguucccagcug

SEQ ID NO: 66511 - RNA, 22 nt, Human
gaaugugggcugugaagaggag

SEQ ID NO: 66512 - RNA, 22 nt, Human
gaauguuagagauucuuagguu

SEQ ID NO: 66513 - RNA, 22 nt, Human
gaauguuuaaaaggugcaguuu

SEQ ID NO: 66514 - RNA, 22 nt, Human
gaauguuugacuaaagguagcu

SEQ ID NO: 66515 - RNA, 19 nt, Human
gaauguuuguauucagcgc

SEQ ID NO: 66516 - RNA, 22 nt, Human
gaauguuuuucaaaccuguggc

SEQ ID NO: 66517 - RNA, 22 nt, Human
gaauuaaaauaguuuuggucga

SEQ ID NO: 66518 - RNA, 22 nt, Human
gaauuaauugugugguuugaau

SEQ ID NO: 66519 - RNA, 22 nt, Human
gaauuacagccagaagaaugaa

SEQ ID NO: 66520 - RNA, 22 nt, Human
gaauuauaggcaaagcagucau

SEQ ID NO: 66521 - RNA, 22 nt, Human
gaauuauagguuugcaugcuaa

SEQ ID NO: 66522 - RNA, 22 nt, Human
gaauucacuugucuuccauuuu

SEQ ID NO: 66523 - RNA, 22 nt, Human
gaauuccucugagcuaggagau

SEQ ID NO: 66524 - RNA, 22 nt, Human
gaauuccuuaggcucuugacug

SEQ ID NO: 66525 - RNA, 22 nt, Human
gaauucggguacucuaggccag

SEQ ID NO: 66526 - RNA, 22 nt, Human
gaauucugggagagaucugaca

SEQ ID NO: 66527 - RNA, 22 nt, Human
gaauucugguccuguccaaggu

SEQ ID NO: 66528 - RNA, 22 nt, Human
gaauucuuuaggugaauuucua

SEQ ID NO: 66529 - RNA, 22 nt, Human
gaauugcuaaccaauucaaaau

SEQ ID NO: 66530 - RNA, 22 nt, Human
gaauugcuucugguauguuacu

SEQ ID NO: 66531 - RNA, 22 nt, Human
gaauugcuugugaagugugucu

SEQ ID NO: 66532 - RNA, 22 nt, Human
gaauuguagagggaacagaagc

SEQ ID NO: 66533 - RNA, 22 nt, Human
gaauuuaaauuuaaaucuacca

SEQ ID NO: 66534 - RNA, 22 nt, Human
gaauuuaucuacguuaaguaug

SEQ ID NO: 66535 - RNA, 22 nt, Human
gaauuucaaagagguuaagagg

SEQ ID NO: 66536 - RNA, 22 nt, Human
gaauuucaagcagugcaauguu

SEQ ID NO: 66537 - RNA, 22 nt, Human
gaauuucauuuguuuccuacca

SEQ ID NO: 66538 - RNA, 22 nt, Human
gaauuucuggacccuuugagaa

SEQ ID NO: 66539 - RNA, 17 nt, Human
gaauuucuuggucaaaa

SEQ ID NO: 66540 - RNA, 22 nt, Human
gaauuuggaucuuugauagagu

SEQ ID NO: 66541 - RNA, 22 nt, Human
gaauuuuaaguguucgccucuu

SEQ ID NO: 66542 - RNA, 22 nt, Human
gaauuuuaucuuauuacuugca

SEQ ID NO: 66543 - RNA, 20 nt, Human
gaauuuuaugaacacuacca

SEQ ID NO: 66544 - RNA, 22 nt, Human
gaauuuuucuggaagcaauuau

SEQ ID NO: 66545 - RNA, 22 nt, Human
gacaaaacugagaucacacugu

SEQ ID NO: 66546 - RNA, 23 nt, Human
gacaaagcacuugaaauguguac

SEQ ID NO: 66547 - RNA, 22 nt, Human
gacaaagugcuaaaccacagag

SEQ ID NO: 66548 - RNA, 22 nt, Human
gacaaaugaaugaugaacacca

SEQ ID NO: 66549 - RNA, 20 nt, Human
gacaacagaguaccaggaag

SEQ ID NO: 66550 - RNA, 22 nt, Human
gacaacagcauauggacuguca

SEQ ID NO: 66551 - RNA, 22 nt, Human
gacaacugccccauuuuaaaug

SEQ ID NO: 66552 - RNA, 22 nt, Human
gacaagacugguuuauuuaagg

SEQ ID NO: 66553 - RNA, 22 nt, Human
gacaagaugacaucauggcuuc

SEQ ID NO: 66554 - RNA, 22 nt, Human
gacaagaugagcagcucagugu

SEQ ID NO: 66555 - RNA, 22 nt, Human
gacaaggcgcccagccugccaa

SEQ ID NO: 66556 - RNA, 22 nt, Human
gacaauaaaaugaucuuacagu

SEQ ID NO: 66557 - RNA, 22 nt, Human
gacaauaagaacagauacugug

SEQ ID NO: 66558 - RNA, 22 nt, Human
gacaaucagccauauccagggu

SEQ ID NO: 66559 - RNA, 22 nt, Human
gacaaugcagaaguacuuguuc

SEQ ID NO: 66560 - RNA, 22 nt, Human
gacaaugguggauacaugucau

SEQ ID NO: 66561 - RNA, 22 nt, Human
gacaaugugacagaccaaugau

SEQ ID NO: 66562 - RNA, 22 nt, Human
gacaaugugaggcgaguuuguu

SEQ ID NO: 66563 - RNA, 22 nt, Human
gacaaugugcaauugcagcuag

SEQ ID NO: 66564 - RNA, 22 nt, Human
gacaauugcuuuugccgaauaa

SEQ ID NO: 66565 - RNA, 22 nt, Human
gacacagagcucacagucuccu

SEQ ID NO: 66566 - RNA, 22 nt, Human
gacacagauaauuuaguuaaaa

SEQ ID NO: 66567 - RNA, 22 nt, Human
gacacagcuugaugagggcuuu

SEQ ID NO: 66568 - RNA, 22 nt, Human
gacacagguagaauaaaguacu

SEQ ID NO: 66569 - RNA, 22 nt, Human
gacacaguucuguucuaguagg

SEQ ID NO: 66570 - RNA, 22 nt, Human
gacacaugaccauaaaugcuaa

SEQ ID NO: 66571 - RNA, 22 nt, Human
gacaccagaagacauaagcaga

SEQ ID NO: 66572 - RNA, 22 nt, Human
gacaccauuaccuuucuauauu

SEQ ID NO: 66573 - RNA, 22 nt, Human
gacacucuccuccaguggauag

SEQ ID NO: 66574 - RNA, 22 nt, Human
gacacugaagucacuaagcagg

SEQ ID NO: 66575 - RNA, 22 nt, Human
gacacugcacuuggggcccaca

SEQ ID NO: 66576 - RNA, 22 nt, Human
gacacuggaaauauugaauugg

SEQ ID NO: 66577 - RNA, 22 nt, Human
gacacuucaccuuucccagccu

SEQ ID NO: 66578 - RNA, 22 nt, Human
gacacuugugcuguuucugagc

SEQ ID NO: 66579 - RNA, 22 nt, Human
gacacuuuaggauuuaaaaguc

SEQ ID NO: 66580 - RNA, 22 nt, Human
gacagacaaauguuuuuaacuu

SEQ ID NO: 66581 - RNA, 22 nt, Human
gacagacaggaggcauucaggg

SEQ ID NO: 66582 - RNA, 22 nt, Human
gacagacaggugugguaggcac

SEQ ID NO: 66583 - RNA, 22 nt, Human
gacagacugcguaguccccaaa

SEQ ID NO: 66584 - RNA, 22 nt, Human
gaacuugagauaugaguaggua

SEQ ID NO: 66585 - RNA, 22 nt, Human
gaacuugagcaacacugaguga

SEQ ID NO: 66586 - RNA, 19 nt, Human
gaacuuggccaggcacagu

SEQ ID NO: 66587 - RNA, 22 nt, Human
gaacuuuaauuagcuuuugucu

SEQ ID NO: 66588 - RNA, 22 nt, Human
gaacuuuauaacuguaaauguc

SEQ ID NO: 66589 - RNA, 22 nt, Human
gaacuuugcgcaguucccgggg

SEQ ID NO: 66590 - RNA, 22 nt, Human
gaacuuuugggaagccguguga

SEQ ID NO: 66591 - RNA, 22 nt, Human
gaagaaacaggggcuuggggag

SEQ ID NO: 66592 - RNA, 22 nt, Human
gaagaaacugaaagggguuggu

SEQ ID NO: 66593 - RNA, 22 nt, Human
gaagaaagauuggcaugcuuca

SEQ ID NO: 66594 - RNA, 22 nt, Human
gaagaaauguguucaagguagg

SEQ ID NO: 66595 - RNA, 22 nt, Human
gaagaacaccugcugcccagug

SEQ ID NO: 66596 - RNA, 22 nt, Human
gaagaacuuaacauaauaagga

SEQ ID NO: 66597 - RNA, 22 nt, Human
gaagaagagauaauggggagca

SEQ ID NO: 66598 - RNA, 16 nt, Human
gaagaaggaaaacuac

SEQ ID NO: 66599 - RNA, 22 nt, Human
gaagaaggugccagaggcuuac

SEQ ID NO: 66600 - RNA, 22 nt, Human
gaagaaggugcuacacagggca

SEQ ID NO: 66601 - RNA, 22 nt, Human
gaagaauauggcucucagcaau

SEQ ID NO: 66602 - RNA, 22 nt, Human
gaagaaucugaggacagucauu

SEQ ID NO: 66603 - RNA, 20 nt, Human
gaagacacagaguucaucuc

SEQ ID NO: 66604 - RNA, 22 nt, Human
gaagacacuaaacuggggcuuc

SEQ ID NO: 66605 - RNA, 22 nt, Human
gaagacaucauggagaggauag

SEQ ID NO: 66606 - RNA, 22 nt, Human
gaagagagagcccugggguccg

SEQ ID NO: 66607 - RNA, 22 nt, Human
gaagagcauuugcccaggcugu

SEQ ID NO: 66608 - RNA, 22 nt, Human
gaagagccaggugucgcugugg

SEQ ID NO: 66609 - RNA, 22 nt, Human
gaagagcuggaauccagucugg

SEQ ID NO: 66610 - RNA, 22 nt, Human
gaagagcuuaguuguccuagaa

SEQ ID NO: 66611 - RNA, 22 nt, Human
gaagaggaugacaggagccggu

SEQ ID NO: 66612 - RNA, 22 nt, Human
gaagaggcaauugaauaagcua

SEQ ID NO: 66613 - RNA, 22 nt, Human
gaagagguagcauuggcaggug

SEQ ID NO: 66614 - RNA, 22 nt, Human
gaagauacaaaugugggcuuuc

SEQ ID NO: 66615 - RNA, 22 nt, Human
gaagauacacagagcugucuuu

SEQ ID NO: 66616 - RNA, 22 nt, Human
gaagaucaagugucauucugug

SEQ ID NO: 66617 - RNA, 22 nt, Human
gaagaugggaaugaugaguggg

SEQ ID NO: 66618 - RNA, 22 nt, Human
gaagaugugggcccacuccaga

SEQ ID NO: 66619 - RNA, 22 nt, Human
gaagauuaaacauauuuagugu

SEQ ID NO: 66620 - RNA, 21 nt, Human
cuuugcauacagaugccaauu

SEQ ID NO: 66621 - RNA, 22 nt, Human
cuuugcuagugauuuguuuagg

SEQ ID NO: 66622 - RNA, 22 nt, Human
cuuugcugagcugguuguucaa

SEQ ID NO: 66623 - RNA, 22 nt, Human
cuuuggaaaagcauaccaagga

SEQ ID NO: 66624 - RNA, 22 nt, Human
cuuuggaacacaugggcauggu

SEQ ID NO: 66625 - RNA, 22 nt, Human
cuuuggaacuguaaggagaugg

SEQ ID NO: 66626 - RNA, 22 nt, Human
cuuuggaaggaacaggauucuc

SEQ ID NO: 66627 - RNA, 22 nt, Human
cuuuggaaguaaagucagcagg

SEQ ID NO: 66628 - RNA, 22 nt, Human
cuuuggaauaauuuccuggagu

SEQ ID NO: 66629 - RNA, 22 nt, Human
cuuuggaaugcacagaggugua

SEQ ID NO: 66630 - RNA, 20 nt, Human
cuuuggagaaagcuaacaga

SEQ ID NO: 66631 - RNA, 22 nt, Human
cuuuggauggcuguguguuuau

SEQ ID NO: 66632 - RNA, 22 nt, Human
cuuuggauuuuuaucaggcaau

SEQ ID NO: 66633 - RNA, 22 nt, Human
cuuuggcaacacaugugggaca

SEQ ID NO: 66634 - RNA, 21 nt, Human
cuuuggcaagggagaagucac

SEQ ID NO: 66635 - RNA, 22 nt, Human
cuuuggcaaggguuuuaauugu

SEQ ID NO: 66636 - RNA, 22 nt, Human
cuuuggcaaugaaacacaagaa

SEQ ID NO: 66637 - RNA, 22 nt, Human
cuuuggcacagucucauuugau

SEQ ID NO: 66638 - RNA, 17 nt, Human
cuuuggcaggagggagg

SEQ ID NO: 66639 - RNA, 22 nt, Human
cuuuggcugacgaggaggaggc

SEQ ID NO: 66640 - RNA, 22 nt, Human
cuuuggcugggcaaagggaggu

SEQ ID NO: 66641 - RNA, 22 nt, Human
cuuugggcacugaaguaugggu

SEQ ID NO: 66642 - RNA, 22 nt, Human
cuuuggucagagggauggaguu

SEQ ID NO: 66643 - RNA, 22 nt, Human
cuuuggucuguggcuugggucu

SEQ ID NO: 66644 - RNA, 20 nt, Human
cuuugguggggguagcccag

SEQ ID NO: 66645 - RNA, 21 nt, Human
cuuugguuucugacuugcaua

SEQ ID NO: 66646 - RNA, 17 nt, Human
cuuugucaccaaugcca

SEQ ID NO: 66647 - RNA, 22 nt, Human
cuuugugauaguguuaagacca

SEQ ID NO: 66648 - RNA, 22 nt, Human
cuuugugcuugacccauggguc

SEQ ID NO: 66649 - RNA, 22 nt, Human
cuuuguuacugauuucaguggg

SEQ ID NO: 66650 - RNA, 23 nt, Human
cuuuuaacuagaguaucagcugc

SEQ ID NO: 66651 - RNA, 19 nt, Human
cuuuucaagccaucaguuu

SEQ ID NO: 66652 - RNA, 22 nt, Human
cuuuuccacugagccucacaaa

SEQ ID NO: 66653 - RNA, 22 nt, Human
cuuuucucugcgggucuuucau

SEQ ID NO: 66654 - RNA, 22 nt, Human
cuuuucuggaaucaucucuaac

SEQ ID NO: 66655 - RNA, 22 nt, Human
cuuuugcacccagaguuauuug

SEQ ID NO: 66656 - RNA, 22 nt, Human
cuuuuguuaggagaaaacauca

SEQ ID NO: 66657 - RNA, 22 nt, Human
cuuuuguucuacagcuggggaa

SEQ ID NO: 66658 - RNA, 22 nt, Human
cuuuuuauagcuauguccuaug

SEQ ID NO: 66659 - RNA, 22 nt, Human
cuuuuucacuguguccucacac

SEQ ID NO: 66660 - RNA, 22 nt, Human
cuuuuucauuggcuuuaggaca

SEQ ID NO: 66661 - RNA, 22 nt, Human
cuuuuucccagguggagagagg

SEQ ID NO: 66662 - RNA, 22 nt, Human
cuuuuucuaaucauaauugucu

SEQ ID NO: 66663 - RNA, 22 nt, Human
cuuuuugucucuguccugauga

SEQ ID NO: 66664 - RNA, 22 nt, Human
cuuuuuguuguauaagcccuuu

SEQ ID NO: 66665 - RNA, 22 nt, Human
gaaaaaggauaaauacaguguu

SEQ ID NO: 66666 - RNA, 22 nt, Human
gaaaaagugaccuugguagcua

SEQ ID NO: 66667 - RNA, 22 nt, Human
gaaaaaugcuccaaaucugugg

SEQ ID NO: 66668 - RNA, 21 nt, Human
gaaaagcaagggaguagaaca

SEQ ID NO: 66669 - RNA, 22 nt, Human
gaaaaggaaauuuauagagauc

SEQ ID NO: 66670 - RNA, 22 nt, Human
gaaaaggcagaguuccggggaa

SEQ ID NO: 66671 - RNA, 22 nt, Human
gaaaauacuucaguguucuggc

SEQ ID NO: 66672 - RNA, 22 nt, Human
gaaaauaggcagaugcauugua

SEQ ID NO: 66673 - RNA, 22 nt, Human
gaaaaugagccucagcuacauu

SEQ ID NO: 66674 - RNA, 22 nt, Human
gaaaaugugucaucccuacugu

SEQ ID NO: 66675 - RNA, 22 nt, Human
gaaaauuauugaaaauggcucu

SEQ ID NO: 66676 - RNA, 22 nt, Human
gaaaauuuaauucucuucugug

SEQ ID NO: 66677 - RNA, 22 nt, Human
gaaaauuuagaacugaacuucu

SEQ ID NO: 66678 - RNA, 22 nt, Human
gaaacaauuuuuguugucuaag

SEQ ID NO: 66679 - RNA, 22 nt, Human
gaaacaugucugacaauuuacc

SEQ ID NO: 66680 - RNA, 22 nt, Human
gaaaccacaguacccaggaaaa

SEQ ID NO: 66681 - RNA, 22 nt, Human
gaaaccugagccagagugggga

SEQ ID NO: 66682 - RNA, 22 nt, Human
gaaaccuguccccucuuccuca

SEQ ID NO: 66683 - RNA, 22 nt, Human
gaaacucucgcauccugggaac

SEQ ID NO: 66684 - RNA, 22 nt, Human
gaaacugaauauaagaaaggua

SEQ ID NO: 66685 - RNA, 22 nt, Human
gaaacuuacuuacucacauuuc

SEQ ID NO: 66686 - RNA, 22 nt, Human
gaaacuugauaauugaaacaga

SEQ ID NO: 66687 - RNA, 22 nt, Human
gaaacuuuggcuaaaagccaga

SEQ ID NO: 66688 - RNA, 22 nt, Human
gaaagaaucaacuaugucucug

SEQ ID NO: 66689 - RNA, 22 nt, Human
gaaagaaugagcaucaugacuu

SEQ ID NO: 66690 - RNA, 22 nt, Human
gaaagaaugcugggagccaucu

SEQ ID NO: 66691 - RNA, 22 nt, Human
gaaagacauaguugcaagaugg

SEQ ID NO: 66692 - RNA, 22 nt, Human
gaaagagaggggcugagaugca

SEQ ID NO: 66693 - RNA, 22 nt, Human
gaggccucaugaggugagcauu

SEQ ID NO: 66694 - RNA, 22 nt, Human
gaggccuccucugagacaucug

SEQ ID NO: 66695 - RNA, 18 nt, Human
gaggccugagaaccaggu

SEQ ID NO: 66696 - RNA, 22 nt, Human
gaggccugcuuuggcacucugg

SEQ ID NO: 66697 - RNA, 22 nt, Human
gaggccuggaccagccacagag

SEQ ID NO: 66698 - RNA, 22 nt, Human
gaggccuggcucugcccuccug

SEQ ID NO: 66699 - RNA, 22 nt, Human
gaggccugggagaacuguuuuu

SEQ ID NO: 66700 - RNA, 22 nt, Human
gaggccuggguuaccuacucgu

SEQ ID NO: 66701 - RNA, 22 nt, Human
gaggccuggguuggaggugcau

SEQ ID NO: 66702 - RNA, 22 nt, Human
gaggcuagagcaggggcucaau

SEQ ID NO: 66703 - RNA, 22 nt, Human
gaggcucagagugguuaaauaa

SEQ ID NO: 66704 - RNA, 22 nt, Human
gaggcucagggaguauaugaau

SEQ ID NO: 66705 - RNA, 22 nt, Human
gaggcuccgugcugcugcccug

SEQ ID NO: 66706 - RNA, 22 nt, Human
gaggcucuggaguagguacaca

SEQ ID NO: 66707 - RNA, 22 nt, Human
gaggcucuuuucugcugugucu

SEQ ID NO: 66708 - RNA, 20 nt, Human
gaggcugaaguguuuuugcu

SEQ ID NO: 66709 - RNA, 22 nt, Human
gaggcugcagcuaucagacauu

SEQ ID NO: 66710 - RNA, 22 nt, Human
gaggcugcccaacuggagugga

SEQ ID NO: 66711 - RNA, 22 nt, Human
gaggcugcuuugaugacaggag

SEQ ID NO: 66712 - RNA, 16 nt, Human
gaggcuggcagauguc

SEQ ID NO: 66713 - RNA, 22 nt, Human
gaggcugggaaguccaagacca

SEQ ID NO: 66714 - RNA, 22 nt, Human
gaggcugggaaguccaauauca

SEQ ID NO: 66715 - RNA, 22 nt, Human
gaggcugggggcugccuuccuc

SEQ ID NO: 66716 - RNA, 22 nt, Human
gaggcuggggucugccuuucug

SEQ ID NO: 66717 - RNA, 22 nt, Human
gaggcuggucagcccuaagauc

SEQ ID NO: 66718 - RNA, 22 nt, Human
gaggcugguucugaaguacugu

SEQ ID NO: 66719 - RNA, 21 nt, Human
gaggcugucugcugcuggccu

SEQ ID NO: 66720 - RNA, 22 nt, Human
gaggcugucuguuagccuggga

SEQ ID NO: 66721 - RNA, 22 nt, Human
gaggcuguguuucagugaggcc

SEQ ID NO: 66722 - RNA, 22 nt, Human
gaggcuguucaguguccagcuu

SEQ ID NO: 66723 - RNA, 22 nt, Human
gaggcuucccgcccaugcugga

SEQ ID NO: 66724 - RNA, 22 nt, Human
gaggcuucuguucacucacgcu

SEQ ID NO: 66725 - RNA, 22 nt, Human
gagggaaaauaaaauugcagua

SEQ ID NO: 66726 - RNA, 22 nt, Human
gagggaaagguuaauacaugau

SEQ ID NO: 66727 - RNA, 22 nt, Human
gagggaagaggccugacauuuu

SEQ ID NO: 66728 - RNA, 22 nt, Human
gagggagaauugcagccagcgu

SEQ ID NO: 66729 - RNA, 22 nt, Human
gagggaggggagcuccacccuc

SEQ ID NO: 66730 - RNA, 22 nt, Human
gagggagugcuuucugauaguu

SEQ ID NO: 66731 - RNA, 22 nt, Human
gagggaugguaguugacacuga

SEQ ID NO: 66732 - RNA, 22 nt, Human
gagggcacaaaggcaacauuca

SEQ ID NO: 66733 - RNA, 22 nt, Human
gagggcacucgagacuacggca

SEQ ID NO: 66734 - RNA, 22 nt, Human
gagggcagaaaauuaugcggug

SEQ ID NO: 66735 - RNA, 22 nt, Human
gagggcaggggucuugcacggu

SEQ ID NO: 66736 - RNA, 22 nt, Human
gagggcagugaauuuugaagcu

SEQ ID NO: 66737 - RNA, 22 nt, Human
gagggccaacuagcaccacuuu

SEQ ID NO: 66738 - RNA, 22 nt, Human
gagggccaauggauuucaacug

SEQ ID NO: 66739 - RNA, 22 nt, Human
gagggccaggcagcaagaaggc

SEQ ID NO: 66740 - RNA, 22 nt, Human
gagggccauucugaggggguga

SEQ ID NO: 66741 - RNA, 22 nt, Human
gagggcccuggcuucuugcugg

SEQ ID NO: 66742 - RNA, 22 nt, Human
gagggccuacuggacaugucag

SEQ ID NO: 66743 - RNA, 22 nt, Human
gagggccucugugggugcucac

SEQ ID NO: 66744 - RNA, 22 nt, Human
gagggcucacugagaaagcagu

SEQ ID NO: 66745 - RNA, 19 nt, Human
gagggcucauuugaacaau

SEQ ID NO: 66746 - RNA, 22 nt, Human
gagggcuccacacgggcccagc

SEQ ID NO: 66747 - RNA, 22 nt, Human
gagggcuccucacauucucuau

SEQ ID NO: 66748 - RNA, 20 nt, Human
gagggcucguggauggauaa

SEQ ID NO: 66749 - RNA, 22 nt, Human
gagggcucuaccaaguaacucu

SEQ ID NO: 66750 - RNA, 22 nt, Human
gagggcucuacucaccacccug

SEQ ID NO: 66751 - RNA, 22 nt, Human
gagggcugaagauuguggcccc

SEQ ID NO: 66752 - RNA, 22 nt, Human
gagggcugauaacaggaauaca

SEQ ID NO: 66753 - RNA, 22 nt, Human
gagggcugcugccagauaugcc

SEQ ID NO: 66754 - RNA, 22 nt, Human
gagggcugugaaggagcggguu

SEQ ID NO: 66755 - RNA, 22 nt, Human
gagggcuuguaaguggguggag

SEQ ID NO: 66756 - RNA, 22 nt, Human
gaggggagaaggcacuaaccag

SEQ ID NO: 66757 - RNA, 22 nt, Human
gaggggagacagggaaaucagu

SEQ ID NO: 66758 - RNA, 22 nt, Human
gaggggagcaugaucuagauug

SEQ ID NO: 66759 - RNA, 22 nt, Human
gaggggcaaugagggaaagagu

SEQ ID NO: 66760 - RNA, 22 nt, Human
gaggggcagagguagagaacaa

SEQ ID NO: 66761 - RNA, 22 nt, Human
gaggggccuggcacugagcugg

SEQ ID NO: 66762 - RNA, 22 nt, Human
gaggggcgcugucgggucaccu

SEQ ID NO: 66763 - RNA, 22 nt, Human
gaggggcucuugggcaugaagg

SEQ ID NO: 66764 - RNA, 22 nt, Human
gaggggcugcccuggugucagg

SEQ ID NO: 66765 - RNA, 22 nt, Human
gagggggaaagucccuggaguc

SEQ ID NO: 66766 - RNA, 22 nt, Human
gagggggcgaacagaagcaagg

SEQ ID NO: 66767 - RNA, 22 nt, Human
gaggggggcgcccugcagugca

SEQ ID NO: 66768 - RNA, 22 nt, Human
gaggggucuuuuguugucaggg

SEQ ID NO: 66769 - RNA, 22 nt, Human
gagggguggcguuggcauuuag

SEQ ID NO: 66770 - RNA, 22 nt, Human
gaggggugggcuggaaguuaua

SEQ ID NO: 66771 - RNA, 22 nt, Human
gaggguccccaugcagagcuca

SEQ ID NO: 66772 - RNA, 22 nt, Human
ggcugccagcacugguguagag

SEQ ID NO: 66773 - RNA, 22 nt, Human
ggcugccaggagaagcucagug

SEQ ID NO: 66774 - RNA, 22 nt, Human
ggcugcccucggggucgcaggc

SEQ ID NO: 66775 - RNA, 22 nt, Human
ggcugccuagacuuggaauuuc

SEQ ID NO: 66776 - RNA, 22 nt, Human
ggcugccuauagaauuauuagu

SEQ ID NO: 66777 - RNA, 19 nt, Human
ggcugccuccugggagauu

SEQ ID NO: 66778 - RNA, 20 nt, Human
ggcugccuccuuccuuuccu

SEQ ID NO: 66779 - RNA, 22 nt, Human
ggcugccugaggcugaggcccg

SEQ ID NO: 66780 - RNA, 22 nt, Human
ggcugccugccgcccacuuggc

SEQ ID NO: 66781 - RNA, 22 nt, Human
ggcugccugcuccuccugcacg

SEQ ID NO: 66782 - RNA, 22 nt, Human
ggcugccugguuuagugcugac

SEQ ID NO: 66783 - RNA, 22 nt, Human
ggcugccugugcccaggcacac

SEQ ID NO: 66784 - RNA, 22 nt, Human
ggcugcggaucuaaggcuggga

SEQ ID NO: 66785 - RNA, 22 nt, Human
ggcugcucaaggacucugaucg

SEQ ID NO: 66786 - RNA, 22 nt, Human
ggcugcucacgcagcccucccu

SEQ ID NO: 66787 - RNA, 22 nt, Human
ggcugcuccuuuacccuggcag

SEQ ID NO: 66788 - RNA, 23 nt, Human
ggcugcucuuuucaugcuguuuc

SEQ ID NO: 66789 - RNA, 22 nt, Human
ggcugcugacaaacaugaucau

SEQ ID NO: 66790 - RNA, 22 nt, Human
ggcugcugagucacgacaguga

SEQ ID NO: 66791 - RNA, 22 nt, Human
ggcugcuggaagacugaacaag

SEQ ID NO: 66792 - RNA, 21 nt, Human
ggcugcugggagagcugcgug

SEQ ID NO: 66793 - RNA, 22 nt, Human
ggcugcuggggacgugggagag

SEQ ID NO: 66794 - RNA, 21 nt, Human
ggcugcuggggguuggcacag

SEQ ID NO: 66795 - RNA, 22 nt, Human
ggcugcugguagggguaggaag

SEQ ID NO: 66796 - RNA, 22 nt, Human
ggcugcugguggaaugguaggc

SEQ ID NO: 66797 - RNA, 19 nt, Human
ggcugcugguuacagaggc

SEQ ID NO: 66798 - RNA, 21 nt, Human
ggcugcugucaccgcugucac

SEQ ID NO: 66799 - RNA, 18 nt, Human
ggcugcuuaaggagaucc

SEQ ID NO: 66800 - RNA, 22 nt, Human
ggcugcuucucacucauuugca

SEQ ID NO: 66801 - RNA, 22 nt, Human
ggcugcuuuugcuguaagccag

SEQ ID NO: 66802 - RNA, 21 nt, Human
gggaagacugucaggauuccu

SEQ ID NO: 66803 - RNA, 22 nt, Human
gggaagagaccguacccuggcc

SEQ ID NO: 66804 - RNA, 22 nt, Human
gggaagagugucgguugaagug

SEQ ID NO: 66805 - RNA, 22 nt, Human
gggaagccaugcucagagguac

SEQ ID NO: 66806 - RNA, 22 nt, Human
gggaagcccugugcuugccugg

SEQ ID NO: 66807 - RNA, 22 nt, Human
gggaagcugcguggucuagggc

SEQ ID NO: 66808 - RNA, 22 nt, Human
gggaaggaaaucuugcuuguga

SEQ ID NO: 66809 - RNA, 22 nt, Human
gggaaggacacagccaugacug

SEQ ID NO: 66810 - RNA, 22 nt, Human
gggaaggagguggaccugcccc

SEQ ID NO: 66811 - RNA, 22 nt, Human
gggaaggcaggauucucuggug

SEQ ID NO: 66812 - RNA, 22 nt, Human
gggaaggcaggccucuguugga

SEQ ID NO: 66813 - RNA, 22 nt, Human
gggaaggcauaccugagggaga

SEQ ID NO: 66814 - RNA, 22 nt, Human
gggaagggacuuguuuaagguc

SEQ ID NO: 66815 - RNA, 22 nt, Human
gggaagggagcuggguauuuag

SEQ ID NO: 66816 - RNA, 22 nt, Human
gggaagggcuccuuuuauugca

SEQ ID NO: 66817 - RNA, 22 nt, Human
gggaagugaggagccccucugc

SEQ ID NO: 66818 - RNA, 23 nt, Human
gggaagugaggagccccucugcc

SEQ ID NO: 66819 - RNA, 22 nt, Human
gggaagugcccucuucaggaga

SEQ ID NO: 66820 - RNA, 22 nt, Human
gggaagugugcagaguucucuu

SEQ ID NO: 66821 - RNA, 19 nt, Human
gggaaugauggaagacuuc

SEQ ID NO: 66822 - RNA, 22 nt, Human
gggaaugugcagccacagugag

SEQ ID NO: 66823 - RNA, 22 nt, Human
gggaauguugacugagagcagg

SEQ ID NO: 66824 - RNA, 22 nt, Human
gggaauugagguaugcugggcu

SEQ ID NO: 66825 - RNA, 22 nt, Human
gggacacagagaaacuggagaa

SEQ ID NO: 66826 - RNA, 22 nt, Human
gggacacagguaucucaaauga

SEQ ID NO: 66827 - RNA, 22 nt, Human
gggacagaaggaagugagcaca

SEQ ID NO: 66828 - RNA, 22 nt, Human
gggacagacccaugggccaggu

SEQ ID NO: 66829 - RNA, 22 nt, Human
gggacagcagaaagaaggcaag

SEQ ID NO: 66830 - RNA, 22 nt, Human
gggacagcuguagugcuuggcu

SEQ ID NO: 66831 - RNA, 22 nt, Human
gggacaggcaaagguaugcuuc

SEQ ID NO: 66832 - RNA, 22 nt, Human
gggacaugccccucagugggug

SEQ ID NO: 66833 - RNA, 22 nt, Human
gggacauggaggcgcgcaggca

SEQ ID NO: 66834 - RNA, 22 nt, Human
gggaccagaggcugugcacaau

SEQ ID NO: 66835 - RNA, 23 nt, Human
gggaccaggcccuuccugguuug

SEQ ID NO: 66836 - RNA, 22 nt, Human
gggaccugaggagggguuucag

SEQ ID NO: 66837 - RNA, 22 nt, Human
gggaccugccauugcucacagg

SEQ ID NO: 66838 - RNA, 22 nt, Human
gggaccugcgccacucacuguc

SEQ ID NO: 66839 - RNA, 22 nt, Human
gggaccuggcgagggucacaca

SEQ ID NO: 66840 - RNA, 22 nt, Human
gggaccugggccagaggacagu

SEQ ID NO: 66841 - RNA, 22 nt, Human
gggacuggauagauguggguga

SEQ ID NO: 66842 - RNA, 22 nt, Human
gggacuggccaggguuuggaau

SEQ ID NO: 66843 - RNA, 22 nt, Human
gggagaaggaggacugugcugu

SEQ ID NO: 66844 - RNA, 22 nt, Human
gggagaaguggaaaucucauua

SEQ ID NO: 66845 - RNA, 23 nt, Human
gggagaauaugaggaugauggug

SEQ ID NO: 66846 - RNA, 22 nt, Human
gggagacaagaaguagccugcu

SEQ ID NO: 66847 - RNA, 20 nt, Human
gggagacagggccagugucc

SEQ ID NO: 66848 - RNA, 22 nt, Human
gggagagaagggcauguacacu

SEQ ID NO: 66849 - RNA, 22 nt, Human
gggagagagaaaacguggcgca

SEQ ID NO: 66850 - RNA, 22 nt, Human
gggagagcgcgcuagggccgag

SEQ ID NO: 66851 - RNA, 17 nt, Human
gggagaugaagggauau

SEQ ID NO: 66852 - RNA, 22 nt, Human
gggagcagccugccucccaccu

SEQ ID NO: 66853 - RNA, 22 nt, Human
gggagcauuucccuguguugaa

SEQ ID NO: 66854 - RNA, 22 nt, Human
gggagccacaguagcagcuacu

SEQ ID NO: 66855 - RNA, 22 nt, Human
gggagccacagugaggugcaug

SEQ ID NO: 66856 - RNA, 22 nt, Human
gggagccacaguuuauagugau

SEQ ID NO: 66857 - RNA, 22 nt, Human
gggagccagcagggcauggagc

SEQ ID NO: 66858 - RNA, 23 nt, Human
gggagccauggguggucauggag

SEQ ID NO: 66859 - RNA, 22 nt, Human
gggagcuccacugccucucauu

SEQ ID NO: 66860 - RNA, 22 nt, Human
gggagcugaaggagccggcggg

SEQ ID NO: 66861 - RNA, 22 nt, Human
gggagcugaauggcaauggaga

SEQ ID NO: 66862 - RNA, 22 nt, Human
gggagcugagaaacaacauucu

SEQ ID NO: 66863 - RNA, 22 nt, Human
gggagcugagcucugagccacg

SEQ ID NO: 66864 - RNA, 22 nt, Human
gggagcugcacacgccccggaa

SEQ ID NO: 66865 - RNA, 22 nt, Human
gggagcugcggucuugcgaaga

SEQ ID NO: 66866 - RNA, 22 nt, Human
gggagcugggcugguuuugcug

SEQ ID NO: 66867 - RNA, 19 nt, Human
gggagcugucugcccgugg

SEQ ID NO: 66868 - RNA, 22 nt, Human
gggagcuuaagacaguuccaau

SEQ ID NO: 66869 - RNA, 22 nt, Human
gggaggaaggcuugggugagua

SEQ ID NO: 66870 - RNA, 22 nt, Human
gggaggagugaagauucaccug

SEQ ID NO: 66871 - RNA, 22 nt, Human
gggaggcauguguuauccacuu

SEQ ID NO: 66872 - RNA, 20 nt, Human
gggaggcauuggucccucac

SEQ ID NO: 66873 - RNA, 20 nt, Human
gggaggccagccucagagaa

SEQ ID NO: 66874 - RNA, 18 nt, Human
gggaggccccagcaggag

SEQ ID NO: 66875 - RNA, 22 nt, Human
gggaggcgccgaggguagcuaa

SEQ ID NO: 66876 - RNA, 22 nt, Human
gggaggcucagugguguccucu

SEQ ID NO: 66877 - RNA, 22 nt, Human
gggaggcuggcucuggccacag

SEQ ID NO: 66878 - RNA, 22 nt, Human
gggaggguguucucccaagaac

SEQ ID NO: 66879 - RNA, 22 nt, Human
gggagguagcaagccugcagcu

SEQ ID NO: 66880 - RNA, 22 nt, Human
gggaggugaaaggucaugugug

SEQ ID NO: 66881 - RNA, 22 nt, Human
gggaggugauggcaagcagcgg

SEQ ID NO: 66882 - RNA, 22 nt, Human
gggagucagagagguaauggga

SEQ ID NO: 66883 - RNA, 22 nt, Human
gggagucaggcucccucagaga

SEQ ID NO: 66884 - RNA, 22 nt, Human
gggagucagugaaggagucaga

SEQ ID NO: 66885 - RNA, 22 nt, Human
gggaguccaaauugguacaaua

SEQ ID NO: 66886 - RNA, 16 nt, Human
gggagugaaggagggu

SEQ ID NO: 66887 - RNA, 22 nt, Human
gggaguggggcuuaccuugaag

SEQ ID NO: 66888 - RNA, 22 nt, Human
gggaguggguuuggccuaggcc

SEQ ID NO: 66889 - RNA, 20 nt, Human
gggaguggugguagccugug

SEQ ID NO: 66890 - RNA, 22 nt, Human
gggauaagagaguauuuaugca

SEQ ID NO: 66891 - RNA, 22 nt, Human
gggauaggaaacuuagguacac

SEQ ID NO: 66892 - RNA, 22 nt, Human
gagugucuguauuuugggcaag

SEQ ID NO: 66893 - RNA, 22 nt, Human
gagugucugugacagcucauga

SEQ ID NO: 66894 - RNA, 22 nt, Human
gaguguggaucccagaagcaga

SEQ ID NO: 66895 - RNA, 22 nt, Human
gagugugggcacgggggccuug

SEQ ID NO: 66896 - RNA, 22 nt, Human
gagugugggggugcugaggaca

SEQ ID NO: 66897 - RNA, 22 nt, Human
gaguguggugaacaggagcacc

SEQ ID NO: 66898 - RNA, 22 nt, Human
gagugugucggucagcguggcg

SEQ ID NO: 66899 - RNA, 22 nt, Human
gaguuaaauauuuucugaaguu

SEQ ID NO: 66900 - RNA, 22 nt, Human
gaguuaauacugaguuuauuaa

SEQ ID NO: 66901 - RNA, 22 nt, Human
gaguuaauucgaauauucuagc

SEQ ID NO: 66902 - RNA, 21 nt, Human
gaguuaauuugaccccugccu

SEQ ID NO: 66903 - RNA, 22 nt, Human
gaguuacacaaaauuucuauuu

SEQ ID NO: 66904 - RNA, 22 nt, Human
gaguuaguauguucuguaagua

SEQ ID NO: 66905 - RNA, 22 nt, Human
gaguuauagauggacuauuauu

SEQ ID NO: 66906 - RNA, 22 nt, Human
gaguuauauuugcgauauugga

SEQ ID NO: 66907 - RNA, 22 nt, Human
gaguuauuagucaaauagggaa

SEQ ID NO: 66908 - RNA, 22 nt, Human
gaguuauucuagguccuuugua

SEQ ID NO: 66909 - RNA, 22 nt, Human
gaguucaauuuccagcuguucu

SEQ ID NO: 66910 - RNA, 22 nt, Human
gaguucuguagggugaaauagu

SEQ ID NO: 66911 - RNA, 22 nt, Human
agcucagggcuccaggaccgcu

SEQ ID NO: 66912 - RNA, 22 nt, Human
agcucagguagacucagcaucu

SEQ ID NO: 66913 - RNA, 22 nt, Human
agcuccagcccaucugcucgug

SEQ ID NO: 66914 - RNA, 23 nt, Human
agcuccagggaacaggcaguagg

SEQ ID NO: 66915 - RNA, 23 nt, Human
agcuccaggugauuguaaugugu

SEQ ID NO: 66916 - RNA, 22 nt, Human
agcuccaguuacuuaccuagag

SEQ ID NO: 66917 - RNA, 22 nt, Human
agcuccaguuuccugacugagc

SEQ ID NO: 66918 - RNA, 22 nt, Human
agcucccaauugacuugaacua

SEQ ID NO: 66919 - RNA, 22 nt, Human
agcucccagagcucgagaguaa

SEQ ID NO: 66920 - RNA, 22 nt, Human
agcucccagucuccucuccaug

SEQ ID NO: 66921 - RNA, 22 nt, Human
agcuccuccugugccaggccag

SEQ ID NO: 66922 - RNA, 22 nt, Human
agcuccugaaaagcgcuugcuu

SEQ ID NO: 66923 - RNA, 23 nt, Human
agcuccugaggccagccucuccu

SEQ ID NO: 66924 - RNA, 22 nt, Human
agcuccugaguagcuuuacuca

SEQ ID NO: 66925 - RNA, 17 nt, Human
agcuccugcccauggcu

SEQ ID NO: 66926 - RNA, 22 nt, Human
agcuccugcucuuugucccuaa

SEQ ID NO: 66927 - RNA, 22 nt, Human
agcuccugcuugacagaagagg

SEQ ID NO: 66928 - RNA, 22 nt, Human
agcuccuggacgaacagggagu

SEQ ID NO: 66929 - RNA, 22 nt, Human
agcuccuggcaaggucauggug

SEQ ID NO: 66930 - RNA, 22 nt, Human
agcuccugggcaccucuuucac

SEQ ID NO: 66931 - RNA, 22 nt, Human
agcuccugggccaagcccaugc

SEQ ID NO: 66932 - RNA, 17 nt, Human
agcuccuggggucuuua

SEQ ID NO: 66933 - RNA, 18 nt, Human
agcuccuggucucaggga

SEQ ID NO: 66934 - RNA, 22 nt, Human
agcuccuggucuuuguccagag

SEQ ID NO: 66935 - RNA, 22 nt, Human
agcuccuguaguacauauuauu

SEQ ID NO: 66936 - RNA, 22 nt, Human
agcuccugucucaagggagccu

SEQ ID NO: 66937 - RNA, 22 nt, Human
agcuccuguucugagagcagga

SEQ ID NO: 66938 - RNA, 23 nt, Human
agcuccuuugaaaguauguuuuu

SEQ ID NO: 66939 - RNA, 22 nt, Human
agcucugauccauaauuuauac

SEQ ID NO: 66940 - RNA, 22 nt, Human
agcucugaugacuuuacaacuu

SEQ ID NO: 66941 - RNA, 22 nt, Human
agcucugccgccuuucaggcug

SEQ ID NO: 66942 - RNA, 22 nt, Human
agcucugccuugacaccuucuc

SEQ ID NO: 66943 - RNA, 22 nt, Human
agcucuggaagcccugguaguu

SEQ ID NO: 66944 - RNA, 22 nt, Human
agcucuggcacuggcgcgggau

SEQ ID NO: 66945 - RNA, 18 nt, Human
agcucuggggagaugggc

SEQ ID NO: 66946 - RNA, 22 nt, Human
agcucuggggccugucccacau

SEQ ID NO: 66947 - RNA, 22 nt, Human
agcucugggguggagcccagga

SEQ ID NO: 66948 - RNA, 22 nt, Human
agcucugguuauugaagcaggg

SEQ ID NO: 66949 - RNA, 22 nt, Human
agcucuguuacugauuuuccug

SEQ ID NO: 66950 - RNA, 22 nt, Human
agcucuuacauuuaggucuaug

SEQ ID NO: 66951 - RNA, 22 nt, Human
agcucuuuauggguaaaugcca

SEQ ID NO: 66952 - RNA, 22 nt, Human
agcucuuucuacaagcaggcag

SEQ ID NO: 66953 - RNA, 22 nt, Human
agcucuuugagaaggcagugug

SEQ ID NO: 66954 - RNA, 22 nt, Human
agcucuuugcuggcaguaggcu

SEQ ID NO: 66955 - RNA, 21 nt, Human
agcugaaaaguuguuuacaag

SEQ ID NO: 66956 - RNA, 22 nt, Human
agcugaaacccaggccucagcu

SEQ ID NO: 66957 - RNA, 22 nt, Human
agcugaaacuucccauuaauug

SEQ ID NO: 66958 - RNA, 22 nt, Human
agcugaagaaaugggaagcauu

SEQ ID NO: 66959 - RNA, 22 nt, Human
agcugaagcacugggauggaag

SEQ ID NO: 66960 - RNA, 22 nt, Human
agcugaaggcuagaacagcugg

SEQ ID NO: 66961 - RNA, 22 nt, Human
agcugaaguccucgcggugcua

SEQ ID NO: 66962 - RNA, 22 nt, Human
agcugaaguguuggugguuuca

SEQ ID NO: 66963 - RNA, 22 nt, Human
agcugacagugcauggagggac

SEQ ID NO: 66964 - RNA, 22 nt, Human
agcugacauaagcacuuucuaa

SEQ ID NO: 66965 - RNA, 22 nt, Human
agcugagacacuugagagacua

SEQ ID NO: 66966 - RNA, 22 nt, Human
agcugagagccccugcccugug

SEQ ID NO: 66967 - RNA, 22 nt, Human
agcugagcugcagaugacugua

SEQ ID NO: 66968 - RNA, 22 nt, Human
agcugaggacgugaagggcggc

SEQ ID NO: 66969 - RNA, 23 nt, Human
agcugaggcagaggggcauucuc

SEQ ID NO: 66970 - RNA, 22 nt, Human
agcugaggcauggacaggcugc

SEQ ID NO: 66971 - RNA, 23 nt, Human
agcugaggcugugggugucagag

SEQ ID NO: 66972 - RNA, 23 nt, Human
agcugaggugcagauccaaagaa

SEQ ID NO: 66973 - RNA, 22 nt, Human
agcugagguuaguauaaaugug

SEQ ID NO: 66974 - RNA, 22 nt, Human
agcugagguugaagagugaacg

SEQ ID NO: 66975 - RNA, 22 nt, Human
agcugaguuaauucaucacuua

SEQ ID NO: 66976 - RNA, 22 nt, Human
agcugauuccacuuuuucccca

SEQ ID NO: 66977 - RNA, 22 nt, Human
agcugcaacaucugcuuguccc

SEQ ID NO: 66978 - RNA, 22 nt, Human
agcugcaacuguccuugccuug

SEQ ID NO: 66979 - RNA, 14 nt, Human
agcugcaagcaucc

SEQ ID NO: 66980 - RNA, 22 nt, Human
agcugcaaguaagcuugcuccu

SEQ ID NO: 66981 - RNA, 22 nt, Human
agcugcaauacccuucuuccuu

SEQ ID NO: 66982 - RNA, 22 nt, Human
agcugcagagguuugugcaaca

SEQ ID NO: 66983 - RNA, 22 nt, Human
agcugcagcacuccaguagccg

SEQ ID NO: 66984 - RNA, 21 nt, Human
agcugcagccauguacauggc

SEQ ID NO: 66985 - RNA, 22 nt, Human
agcugcagccgcagcuguggcc

SEQ ID NO: 66986 - RNA, 22 nt, Human
agcugcagccucaugauucggu

SEQ ID NO: 66987 - RNA, 22 nt, Human
agcugcaggcccaugcucaguc

SEQ ID NO: 66988 - RNA, 22 nt, Human
agcugcaggccucuccugggga

SEQ ID NO: 66989 - RNA, 22 nt, Human
agcugcagggcuuggguuuccc

SEQ ID NO: 66990 - RNA, 22 nt, Human
agcugcaguaaagcucuccagg

SEQ ID NO: 66991 - RNA, 21 nt, Human
agcugcagucaagccagaggu

SEQ ID NO: 66992 - RNA, 22 nt, Human
agcugccacauggugucacugu

SEQ ID NO: 66993 - RNA, 22 nt, Human
agcugccaggccccugagaacc

SEQ ID NO: 66994 - RNA, 17 nt, Human
agcugccagggagugug

SEQ ID NO: 66995 - RNA, 22 nt, Human
agcugccauccgaggugucaga

SEQ ID NO: 66996 - RNA, 22 nt, Human
agcugccauggccugaauuuac

SEQ ID NO: 66997 - RNA, 22 nt, Human
agcugcccaauccugcagggcg

SEQ ID NO: 66998 - RNA, 22 nt, Human
agcugccccgaggcggcgggaa

SEQ ID NO: 66999 - RNA, 22 nt, Human
agcugcccuggcggagcugcuc

SEQ ID NO: 67000 - RNA, 22 nt, Human
agcugcccugguaagauugaug

SEQ ID NO: 67001 - RNA, 22 nt, Human
agcugcccuucucuugcccuug

SEQ ID NO: 67002 - RNA, 22 nt, Human
agcugcccuuuaugaugcugaa

SEQ ID NO: 67003 - RNA, 22 nt, Human
agcugccgaugcccagcugcau

SEQ ID NO: 67004 - RNA, 22 nt, Human
agugcuuugugcucucacugca

SEQ ID NO: 67005 - RNA, 22 nt, Human
agugcuuuguggagaauuugua

SEQ ID NO: 67006 - RNA, 22 nt, Human
agugcuuuuauaucauuaaucc

SEQ ID NO: 67007 - RNA, 22 nt, Human
aguggaagagccauguuccaac

SEQ ID NO: 67008 - RNA, 22 nt, Human
aguggaaggucaggggacagug

SEQ ID NO: 67009 - RNA, 20 nt, Human
aguggaauuucagauacccc

SEQ ID NO: 67010 - RNA, 22 nt, Human
aguggaccagaagacugaagcu

SEQ ID NO: 67011 - RNA, 22 nt, Human
aguggacccggaacagaggccc

SEQ ID NO: 67012 - RNA, 22 nt, Human
aguggagacaggacagucgaua

SEQ ID NO: 67013 - RNA, 22 nt, Human
aguggcaaagucuucagaaguu

SEQ ID NO: 67014 - RNA, 22 nt, Human
aguggcaagagggucuauuguu

SEQ ID NO: 67015 - RNA, 22 nt, Human
aguggcagagccaggguuggga

SEQ ID NO: 67016 - RNA, 22 nt, Human
aguggcagagugcacucaggca

SEQ ID NO: 67017 - RNA, 22 nt, Human
aguggcagccgagcaggagaug

SEQ ID NO: 67018 - RNA, 22 nt, Human
aguggcagccuuguucauuaug

SEQ ID NO: 67019 - RNA, 22 nt, Human
aguggcagcugucaugcccuag

SEQ ID NO: 67020 - RNA, 22 nt, Human
aggcaacuguuugauaauguug

SEQ ID NO: 67021 - RNA, 22 nt, Human
aggcaagaacagacaugggagu

SEQ ID NO: 67022 - RNA, 22 nt, Human
aggcaagcauugggaacagggc

SEQ ID NO: 67023 - RNA, 22 nt, Human
aggcaagcccaggcacuuggag

SEQ ID NO: 67024 - RNA, 22 nt, Human
aggcaagcuugaaauuggcucu

SEQ ID NO: 67025 - RNA, 22 nt, Human
aggcaagugcauuagaagagca

SEQ ID NO: 67026 - RNA, 22 nt, Human
aggcaauccccugaggauacuu

SEQ ID NO: 67027 - RNA, 22 nt, Human
aggcaauccucuuacagauggg

SEQ ID NO: 67028 - RNA, 22 nt, Human
aggcaaugcagauagaugaaug

SEQ ID NO: 67029 - RNA, 23 nt, Human
aggcaaugcccugcugagaacuc

SEQ ID NO: 67030 - RNA, 22 nt, Human
aggcacaagaaacugcucccca

SEQ ID NO: 67031 - RNA, 22 nt, Human
aggcacacagcuugcauaaauc

SEQ ID NO: 67032 - RNA, 22 nt, Human
aggcacagagaaugcccuccau

SEQ ID NO: 67033 - RNA, 22 nt, Human
aggcacagagagguuaaaugca

SEQ ID NO: 67034 - RNA, 22 nt, Human
aggcacagcacaccuggccccc

SEQ ID NO: 67035 - RNA, 22 nt, Human
aggcacagccucccuucacaug

SEQ ID NO: 67036 - RNA, 22 nt, Human
aggcacagggaugcggagccag

SEQ ID NO: 67037 - RNA, 19 nt, Human
aggcacagguugucuggac

SEQ ID NO: 67038 - RNA, 22 nt, Human
aggcaccaguaagaguagaacu

SEQ ID NO: 67039 - RNA, 22 nt, Human
aggcaccucagcugagccuggg

SEQ ID NO: 67040 - RNA, 22 nt, Human
aggcaccugagguggccagccu

SEQ ID NO: 67041 - RNA, 22 nt, Human
aggcaccuggccaguugucuug

SEQ ID NO: 67042 - RNA, 19 nt, Human
aggcaccuugauggcuucc

SEQ ID NO: 67043 - RNA, 22 nt, Human
aggcacgagcaauggccgagga

SEQ ID NO: 67044 - RNA, 22 nt, Human
aggcacugaaagguggccagag

SEQ ID NO: 67045 - RNA, 22 nt, Human
aggcacugaaggaagcuugcgc

SEQ ID NO: 67046 - RNA, 22 nt, Human
aggcacugacucaagggagcca

SEQ ID NO: 67047 - RNA, 22 nt, Human
aggcacugauucuguuuuccau

SEQ ID NO: 67048 - RNA, 18 nt, Human
aggcacuggaauuaaggg

SEQ ID NO: 67049 - RNA, 20 nt, Human
aggcacuggauuucuuauau

SEQ ID NO: 67050 - RNA, 22 nt, Human
aggcacugggaauaugcugagg

SEQ ID NO: 67051 - RNA, 22 nt, Human
aggcacugguccauuuucugca

SEQ ID NO: 67052 - RNA, 22 nt, Human
aggcacuguucccaguuauccu

SEQ ID NO: 67053 - RNA, 22 nt, Human
aggcacuucucaaauucaugcc

SEQ ID NO: 67054 - RNA, 22 nt, Human
aggcacuuuaggaucagguuga

SEQ ID NO: 67055 - RNA, 21 nt, Human
aggcagaaagagcccaggcug

SEQ ID NO: 67056 - RNA, 22 nt, Human
aggcagacaaggacacaguggg

SEQ ID NO: 67057 - RNA, 20 nt, Human
aggcagacaaggagucuguu

SEQ ID NO: 67058 - RNA, 22 nt, Human
aggcagacucaauggcuagaua

SEQ ID NO: 67059 - RNA, 22 nt, Human
aggcagacugugcgggaagagu

SEQ ID NO: 67060 - RNA, 22 nt, Human
aggcagacuuaccuucugggga

SEQ ID NO: 67061 - RNA, 22 nt, Human
aggcagaggagaaugaucuucc

SEQ ID NO: 67062 - RNA, 22 nt, Human
aggcagcaaaugucuggaacag

SEQ ID NO: 67063 - RNA, 22 nt, Human
aggcagcaaugaaugaaaugga

SEQ ID NO: 67064 - RNA, 22 nt, Human
aggcagcagccacaaggccuga

SEQ ID NO: 67065 - RNA, 22 nt, Human
aggcagcagggccacuggcuga

SEQ ID NO: 67066 - RNA, 22 nt, Human
aggcagcaugggcccagagucc

SEQ ID NO: 67067 - RNA, 22 nt, Human
aggcagccaaucagaggcugac

SEQ ID NO: 67068 - RNA, 21 nt, Human
aggcagccagucaugcucccu

SEQ ID NO: 67069 - RNA, 22 nt, Human
aggcagcccacaggacacagga

SEQ ID NO: 67070 - RNA, 22 nt, Human
aggcagcuaagauggauaauga

SEQ ID NO: 67071 - RNA, 22 nt, Human
aggcagcuggaggcagagacua

SEQ ID NO: 67072 - RNA, 22 nt, Human
aggcagcuggcaaauucuagag

SEQ ID NO: 67073 - RNA, 22 nt, Human
aggcagcugugaggacuggauu

SEQ ID NO: 67074 - RNA, 22 nt, Human
aggcaggaaaaucgcuugaacc

SEQ ID NO: 67075 - RNA, 22 nt, Human
aggcaggcaaccaccugggaag

SEQ ID NO: 67076 - RNA, 22 nt, Human
aggcaggcacacuuccuccagg

SEQ ID NO: 67077 - RNA, 22 nt, Human
aggcaggcagcugucaccacuc

SEQ ID NO: 67078 - RNA, 22 nt, Human
aggcaggcccucuggaaaggua

SEQ ID NO: 67079 - RNA, 22 nt, Human
aggcaggccgugucccuccuca

SEQ ID NO: 67080 - RNA, 22 nt, Human
aggcaggcucaggcccaugcuu

SEQ ID NO: 67081 - RNA, 22 nt, Human
aggcaggcuggucugaagagug

SEQ ID NO: 67082 - RNA, 22 nt, Human
aggcagggaccaguuguuuucu

SEQ ID NO: 67083 - RNA, 22 nt, Human
aggcagggugaugauaaugauu

SEQ ID NO: 67084 - RNA, 22 nt, Human
aggcaggugagucaaaacagac

SEQ ID NO: 67085 - RNA, 18 nt, Human
aggcaggugcuggaaguc

SEQ ID NO: 67086 - RNA, 22 nt, Human
aggcaggugggagugauuccuu

SEQ ID NO: 67087 - RNA, 22 nt, Human
aggcagguuacaaaaacuuuau

SEQ ID NO: 67088 - RNA, 22 nt, Human
aggcagguuggggaaaagcacu

SEQ ID NO: 67089 - RNA, 22 nt, Human
aggcagguuuacucuuauuugg

SEQ ID NO: 67090 - RNA, 19 nt, Human
aggcagucauuggaauaua

SEQ ID NO: 67091 - RNA, 22 nt, Human
aggcagucuaguccccaggcaa

SEQ ID NO: 67092 - RNA, 22 nt, Human
aggcagugagcagggugucaug

SEQ ID NO: 67093 - RNA, 22 nt, Human
aggcagugagugugacuucaca

SEQ ID NO: 67094 - RNA, 22 nt, Human
aggcaguggaaggagaaagcaa

SEQ ID NO: 67095 - RNA, 22 nt, Human
aggcaguggagaagguuuguga

SEQ ID NO: 67096 - RNA, 22 nt, Human
aggcaguggagcuggaauaggc

SEQ ID NO: 67097 - RNA, 22 nt, Human
aggcaguggcugagaccagggg

SEQ ID NO: 67098 - RNA, 22 nt, Human
aggcaguggcuuuuguuguguu

SEQ ID NO: 67099 - RNA, 22 nt, Human
aggcagugguguuugcuggugg

SEQ ID NO: 67100 - RNA, 23 nt, Human
aggcagugucucuuauccugucc

SEQ ID NO: 67101 - RNA, 22 nt, Human
aggcaguguguagcuggaagag

SEQ ID NO: 67102 - RNA, 22 nt, Human
aggcaguuguagagagggcucu

SEQ ID NO: 67103 - RNA, 20 nt, Human
aggcaguuucaauuuuguua

SEQ ID NO: 67104 - RNA, 22 nt, Human
aggcauaaccuuuuaucuggau

SEQ ID NO: 67105 - RNA, 22 nt, Human
aggcaucaggaguauagccaga

SEQ ID NO: 67106 - RNA, 21 nt, Human
aggcaucuaaagagaguagac

SEQ ID NO: 67107 - RNA, 22 nt, Human
aggcaucuauacauuauguuca

SEQ ID NO: 67108 - RNA, 22 nt, Human
aggcaucucucugcuucugagc

SEQ ID NO: 67109 - RNA, 22 nt, Human
aggcaucugcagagcuugguga

SEQ ID NO: 67110 - RNA, 22 nt, Human
aggcaucugccuccucuacccc

SEQ ID NO: 67111 - RNA, 22 nt, Human
aggcaugacuuuggcugaagaa

SEQ ID NO: 67112 - RNA, 21 nt, Human
aggcauggaaauggcacacug

SEQ ID NO: 67113 - RNA, 22 nt, Human
aggcauggacauuucggcagcu

SEQ ID NO: 67114 - RNA, 22 nt, Human
aggcauggggcugcagucaggu

SEQ ID NO: 67115 - RNA, 22 nt, Human
aggcauggguagaagagaagcc

SEQ ID NO: 67116 - RNA, 22 nt, Human
aggcaugugacccuggacucag

SEQ ID NO: 67117 - RNA, 22 nt, Human
aggcauuuaaagauguaagacu

SEQ ID NO: 67118 - RNA, 22 nt, Human
aggcauuuucacugaugucauc

SEQ ID NO: 67119 - RNA, 22 nt, Human
aggcauuuuguucaagaugaca

SEQ ID NO: 67120 - RNA, 18 nt, Human
aggccaaacuuguaagca

SEQ ID NO: 67121 - RNA, 22 nt, Human
aggccaaagugcuccuuuuaga

SEQ ID NO: 67122 - RNA, 22 nt, Human
aggccaagauuuuggaucagcu

SEQ ID NO: 67123 - RNA, 20 nt, Human
agcuucugcugccuuucggc

SEQ ID NO: 67124 - RNA, 22 nt, Human
agcuucuggaaggcaaggcuug

SEQ ID NO: 67125 - RNA, 22 nt, Human
agcuucuguucaucuuccaggc

SEQ ID NO: 67126 - RNA, 22 nt, Human
agcuucuuaguucacuuuuaau

SEQ ID NO: 67127 - RNA, 22 nt, Human
agcuucuuggcucagcacuugg

SEQ ID NO: 67128 - RNA, 22 nt, Human
agcuugaaccuaaaacaauaau

SEQ ID NO: 67129 - RNA, 22 nt, Human
agggaagaaaauccaucgcugc

SEQ ID NO: 67130 - RNA, 22 nt, Human
agggaagaaucacugggauguu

SEQ ID NO: 67131 - RNA, 22 nt, Human
agggaagaggaccagagucucu

SEQ ID NO: 67132 - RNA, 22 nt, Human
agggaagaggcaagguuuaugg

SEQ ID NO: 67133 - RNA, 22 nt, Human
agggaagcagcagccgccuguc

SEQ ID NO: 67134 - RNA, 22 nt, Human
agggaagccccgaggaggcacc

SEQ ID NO: 67135 - RNA, 22 nt, Human
agggaaggagguuagaacccac

SEQ ID NO: 67136 - RNA, 22 nt, Human
agggaaguccaugggggcggug

SEQ ID NO: 67137 - RNA, 22 nt, Human
agggaagugaaugacagauauc

SEQ ID NO: 67138 - RNA, 19 nt, Human
agggaauccggcugaggga

SEQ ID NO: 67139 - RNA, 22 nt, Human
agggaaucuaggcucagagugc

SEQ ID NO: 67140 - RNA, 22 nt, Human
agggaaugcuccguauaaaucu

SEQ ID NO: 67141 - RNA, 22 nt, Human
agggaauguagcaagaugccaa

SEQ ID NO: 67142 - RNA, 22 nt, Human
agggaauucacuggaacgcccu

SEQ ID NO: 67143 - RNA, 20 nt, Human
agggacacaauauuucugug

SEQ ID NO: 67144 - RNA, 21 nt, Human
agggacacacaggauggggcu

SEQ ID NO: 67145 - RNA, 22 nt, Human
aucaguuuuuauuaauguagcu

SEQ ID NO: 67146 - RNA, 22 nt, Human
aucauaagacccagccaguauu

SEQ ID NO: 67147 - RNA, 22 nt, Human
aucauagguguguuaccaguua

SEQ ID NO: 67148 - RNA, 22 nt, Human
aucauccauggcugaucauaaa

SEQ ID NO: 67149 - RNA, 22 nt, Human
aucauccuagaaggaagcuagg

SEQ ID NO: 67150 - RNA, 19 nt, Human
aucauccugggucaugcac

SEQ ID NO: 67151 - RNA, 22 nt, Human
aucaucuaaauugaguccagcu

SEQ ID NO: 67152 - RNA, 22 nt, Human
aucaucuaguuuaacuuucuuu

SEQ ID NO: 67153 - RNA, 20 nt, Human
aucaucucaaagcugagguu

SEQ ID NO: 67154 - RNA, 22 nt, Human
aucaucugcacagauccuauuu

SEQ ID NO: 67155 - RNA, 22 nt, Human
aucaucuuaaaucuagaaugug

SEQ ID NO: 67156 - RNA, 22 nt, Human
aucaugcaauaaggugaggccu

SEQ ID NO: 67157 - RNA, 22 nt, Human
aucaugcagcaacaagcaaggc

SEQ ID NO: 67158 - RNA, 22 nt, Human
aucaugcagcuaauccaauuca

SEQ ID NO: 67159 - RNA, 22 nt, Human
aucaugcagguuucuccuuucu

SEQ ID NO: 67160 - RNA, 22 nt, Human
aucaugcaugguacucuugugc

SEQ ID NO: 67161 - RNA, 22 nt, Human
aucaugcauuguauugaguuga

SEQ ID NO: 67162 - RNA, 22 nt, Human
aucaugcuuggauuauguuugg

SEQ ID NO: 67163 - RNA, 22 nt, Human
aucauggaaagguucagcaagc

SEQ ID NO: 67164 - RNA, 22 nt, Human
aucauggaagccuaucuugaga

SEQ ID NO: 67165 - RNA, 22 nt, Human
aucaugugacuagguuuggcca

SEQ ID NO: 67166 - RNA, 22 nt, Human
aucauguguaauuucaagcuac

SEQ ID NO: 67167 - RNA, 22 nt, Human
aucauguuaaauauuucaaucu

SEQ ID NO: 67168 - RNA, 22 nt, Human
aucauucagccuaagcaaguac

SEQ ID NO: 67169 - RNA, 22 nt, Human
aucauucagugaccacuuccca

SEQ ID NO: 67170 - RNA, 22 nt, Human
aucauucugauggucaaugcua

SEQ ID NO: 67171 - RNA, 21 nt, Human
aucauucuggaaaauucaagc

SEQ ID NO: 67172 - RNA, 22 nt, Human
aucauuggaggcacugugcagu

SEQ ID NO: 67173 - RNA, 22 nt, Human
aucauuguaaauaaugcugcca

SEQ ID NO: 67174 - RNA, 22 nt, Human
aucauuuaugccccaauuagau

SEQ ID NO: 67175 - RNA, 22 nt, Human
auccaaacauguaccacacuaa

SEQ ID NO: 67176 - RNA, 22 nt, Human
auccaaagcccuaaguuaacug

SEQ ID NO: 67177 - RNA, 22 nt, Human
auccaaggcgcaagauggcgcu

SEQ ID NO: 67178 - RNA, 22 nt, Human
auccaauuacguuuuuugucau

SEQ ID NO: 67179 - RNA, 22 nt, Human
auccacagaaggaacuugaaag

SEQ ID NO: 67180 - RNA, 22 nt, Human
auccacuucacuggaauguagg

SEQ ID NO: 67181 - RNA, 22 nt, Human
auccacuuggcugguuguucua

SEQ ID NO: 67182 - RNA, 22 nt, Human
auccagcuuugucuggucuucg

SEQ ID NO: 67183 - RNA, 22 nt, Human
auccaggagggcugacuccuua

SEQ ID NO: 67184 - RNA, 22 nt, Human
auccaggcgaaugcagaaggcc

SEQ ID NO: 67185 - RNA, 22 nt, Human
auccaggcugcuuucuaugccc

SEQ ID NO: 67186 - RNA, 22 nt, Human
auccaguuaagaugaggucaua

SEQ ID NO: 67187 - RNA, 22 nt, Human
auccaugaagguacuucucagg

SEQ ID NO: 67188 - RNA, 22 nt, Human
auccaugacccucucaacaacc

SEQ ID NO: 67189 - RNA, 22 nt, Human
auccaugaucaauuuauuacua

SEQ ID NO: 67190 - RNA, 22 nt, Human
auccaugauugcccagaggugu

SEQ ID NO: 67191 - RNA, 22 nt, Human
auccauggaggacaagagcaau

SEQ ID NO: 67192 - RNA, 22 nt, Human
auccauuugccgugcuaugugc

SEQ ID NO: 67193 - RNA, 22 nt, Human
auccauuuuuucagaaugcucu

SEQ ID NO: 67194 - RNA, 19 nt, Human
aucccaaggagcugggacu

SEQ ID NO: 67195 - RNA, 22 nt, Human
aucccaccucaaucugaagcuc

SEQ ID NO: 67196 - RNA, 22 nt, Human
aucccagagaauaaugaucagg

SEQ ID NO: 67197 - RNA, 22 nt, Human
aucccauaggguuaucauaggg

SEQ ID NO: 67198 - RNA, 19 nt, Human
aucccaucugguuuuuccc

SEQ ID NO: 67199 - RNA, 22 nt, Human
aucccauuuuauaccauaagag

SEQ ID NO: 67200 - RNA, 22 nt, Human
auccccacugcugcugguguag

SEQ ID NO: 67201 - RNA, 22 nt, Human
auccccagaaaauaggugccua

SEQ ID NO: 67202 - RNA, 22 nt, Human
auccccaggggcauucaagcuu

SEQ ID NO: 67203 - RNA, 22 nt, Human
auccccuuaucccaggcugagc

SEQ ID NO: 67204 - RNA, 22 nt, Human
auccccuugugggcuggcagca

SEQ ID NO: 67205 - RNA, 22 nt, Human
aucccucagcagacagcaaaau

SEQ ID NO: 67206 - RNA, 22 nt, Human
aucccucagccaccuuugagga

SEQ ID NO: 67207 - RNA, 22 nt, Human
aucccucugcagcugguuccug

SEQ ID NO: 67208 - RNA, 22 nt, Human
aucccugcccucauggagcuua

SEQ ID NO: 67209 - RNA, 22 nt, Human
aucccuggccacgaagcugccc

SEQ ID NO: 67210 - RNA, 22 nt, Human
auccuaaagcagacagcagguu

SEQ ID NO: 67211 - RNA, 22 nt, Human
auccuacaaagcagggcuaugg

SEQ ID NO: 67212 - RNA, 18 nt, Human
auccuagaccauacacag

SEQ ID NO: 67213 - RNA, 21 nt, Human
auccuauuucugaaaaccugc

SEQ ID NO: 67214 - RNA, 22 nt, Human
auccucacaauaaaaucagccu

SEQ ID NO: 67215 - RNA, 22 nt, Human
auccucgucugcacaucaaagg

SEQ ID NO: 67216 - RNA, 18 nt, Human
auccucuagcuucucaga

SEQ ID NO: 67217 - RNA, 22 nt, Human
auccucucucccauaccagucu

SEQ ID NO: 67218 - RNA, 22 nt, Human
auccucucugugacagggaacg

SEQ ID NO: 67219 - RNA, 22 nt, Human
auccugaaaauugaauggaagg

SEQ ID NO: 67220 - RNA, 22 nt, Human
auccugaagcaugaaugucaaa

SEQ ID NO: 67221 - RNA, 22 nt, Human
auccugagcuacaccugcuccu

SEQ ID NO: 67222 - RNA, 22 nt, Human
auccuggcaagcagaggagaac

SEQ ID NO: 67223 - RNA, 22 nt, Human
auccuggcuuuaggucagaggc

SEQ ID NO: 67224 - RNA, 22 nt, Human
auccugggaaugggagggucau

SEQ ID NO: 67225 - RNA, 18 nt, Human
auccugggccagucuuuc

SEQ ID NO: 67226 - RNA, 22 nt, Human
auccugggccucagaggugugu

SEQ ID NO: 67227 - RNA, 22 nt, Human
auccugggcugcacccucagcc

SEQ ID NO: 67228 - RNA, 22 nt, Human
auccuggguaaguuccuuuuaa

SEQ ID NO: 67229 - RNA, 22 nt, Human
auccuguagucucacagcccca

SEQ ID NO: 67230 - RNA, 22 nt, Human
auccuguggggcggcugcaggg

SEQ ID NO: 67231 - RNA, 22 nt, Human
auccuguuagcaccuucaaacu

SEQ ID NO: 67232 - RNA, 22 nt, Human
auccuguuuuagauaagcuuau

SEQ ID NO: 67233 - RNA, 22 nt, Human
auccuucuaagagggacguaug

SEQ ID NO: 67234 - RNA, 22 nt, Human
auccuucuccaaaacuggcucc

SEQ ID NO: 67235 - RNA, 22 nt, Human
auccuucuucaaagagggaaaa

SEQ ID NO: 67236 - RNA, 22 nt, Human
auccuugacacacuccaguacu

SEQ ID NO: 67237 - RNA, 22 nt, Human
auccuuuauaagacuuguauuc

SEQ ID NO: 67238 - RNA, 22 nt, Human
aggcuuagacuaccuggucugu

SEQ ID NO: 67239 - RNA, 22 nt, Human
aggcuucaccagacucuuaauc

SEQ ID NO: 67240 - RNA, 22 nt, Human
aggcuucacucgacaugccaau

SEQ ID NO: 67241 - RNA, 22 nt, Human
aggcuucagcagcccucucuug

SEQ ID NO: 67242 - RNA, 22 nt, Human
aggcuucagccuagagcuggag

SEQ ID NO: 67243 - RNA, 22 nt, Human
aggcuucaggaagucuccuggg

SEQ ID NO: 67244 - RNA, 22 nt, Human
aggcuucagguuugcuuugcag

SEQ ID NO: 67245 - RNA, 22 nt, Human
aggcuucaguagggagcauguc

SEQ ID NO: 67246 - RNA, 18 nt, Human
aggcuucccaggcaggcc

SEQ ID NO: 67247 - RNA, 22 nt, Human
aggcuucccuuccucugggggu

SEQ ID NO: 67248 - RNA, 22 nt, Human
aggcuuccgaguagcugggacu

SEQ ID NO: 67249 - RNA, 23 nt, Human
aggcuuccuaucuuagagcuggg

SEQ ID NO: 67250 - RNA, 22 nt, Human
aggcuuccucgugccuuagaua

SEQ ID NO: 67251 - RNA, 22 nt, Human
aggcuucgcaagguuagagcug

SEQ ID NO: 67252 - RNA, 22 nt, Human
aggcuucucaauagguuugaag

SEQ ID NO: 67253 - RNA, 22 nt, Human
aggcuucuccuuccuaccuucc

SEQ ID NO: 67254 - RNA, 22 nt, Human
aggcuucuucucuauguacaag

SEQ ID NO: 67255 - RNA, 22 nt, Human
aggcuucuucugccugucuuug

SEQ ID NO: 67256 - RNA, 22 nt, Human
aggcuucuugagccccacaggc

SEQ ID NO: 67257 - RNA, 22 nt, Human
aggcuucuuuuagaggggaugg

SEQ ID NO: 67258 - RNA, 22 nt, Human
aggcuugacugcugauuuugcc

SEQ ID NO: 67259 - RNA, 22 nt, Human
aggcuugcacaugcacgcacgu

SEQ ID NO: 67260 - RNA, 22 nt, Human
aggcuugccacuuguuagucua

SEQ ID NO: 67261 - RNA, 19 nt, Human
aggcuuggaacagccuuau

SEQ ID NO: 67262 - RNA, 22 nt, Human
aggcuuggaaguggcagaacug

SEQ ID NO: 67263 - RNA, 22 nt, Human
aggcuuggcugcacgccucgcu

SEQ ID NO: 67264 - RNA, 22 nt, Human
agggacacgagguccugcuggg

SEQ ID NO: 67265 - RNA, 22 nt, Human
agggacacuugcuuucaggccc

SEQ ID NO: 67266 - RNA, 22 nt, Human
agggacagaugaaugacugagu

SEQ ID NO: 67267 - RNA, 17 nt, Human
agggacagcaguuuagg

SEQ ID NO: 67268 - RNA, 22 nt, Human
agggacaguuacaucaucagac

SEQ ID NO: 67269 - RNA, 22 nt, Human
agggacaucucacaaacaacuu

SEQ ID NO: 67270 - RNA, 22 nt, Human
agggaccagggguagcugagau

SEQ ID NO: 67271 - RNA, 22 nt, Human
agggaccugcucacugccuggc

SEQ ID NO: 67272 - RNA, 22 nt, Human
agggagacaaaagcagcugcca

SEQ ID NO: 67273 - RNA, 22 nt, Human
agggagacacaugaggaaguca

SEQ ID NO: 67274 - RNA, 22 nt, Human
agggagagaaguuauacaagau

SEQ ID NO: 67275 - RNA, 18 nt, Human
agggagagaccgcggguc

SEQ ID NO: 67276 - RNA, 22 nt, Human
agggagccaggaacgcaggucg

SEQ ID NO: 67277 - RNA, 22 nt, Human
agggagccuuccuggcuguggu

SEQ ID NO: 67278 - RNA, 23 nt, Human
agggagcuaaaaggcuggagcag

SEQ ID NO: 67279 - RNA, 22 nt, Human
agggagcuaggauccugaaggu

SEQ ID NO: 67280 - RNA, 22 nt, Human
agggagcucaguuggaagcggu

SEQ ID NO: 67281 - RNA, 22 nt, Human
agggagcucuaaguagagggac

SEQ ID NO: 67282 - RNA, 21 nt, Human
agggagcugcgucuugaaaga

SEQ ID NO: 67283 - RNA, 22 nt, Human
agggagcugcucugcuuccgug

SEQ ID NO: 67284 - RNA, 22 nt, Human
agggagcuuuuucaugugucua

SEQ ID NO: 67285 - RNA, 22 nt, Human
agggaggaaggauguuccaaag

SEQ ID NO: 67286 - RNA, 22 nt, Human
agggaggagaauggacuccuuc

SEQ ID NO: 67287 - RNA, 22 nt, Human
agggaggcauuagcuacugcga

SEQ ID NO: 67288 - RNA, 22 nt, Human
agggaguuagaaauccaggaua

SEQ ID NO: 67289 - RNA, 22 nt, Human
agggaucacgguggacuuggau

SEQ ID NO: 67290 - RNA, 18 nt, Human
agggaucaucacugcagc

SEQ ID NO: 67291 - RNA, 22 nt, Human
agggaugcugcuaaguggucua

SEQ ID NO: 67292 - RNA, 22 nt, Human
agggauggaucuuggcccugga

SEQ ID NO: 67293 - RNA, 22 nt, Human
agggaugguggaggaauuucaa

SEQ ID NO: 67294 - RNA, 22 nt, Human
agggauguaaauucuucuucuu

SEQ ID NO: 67295 - RNA, 22 nt, Human
agggaugugacauuacagaagc

SEQ ID NO: 67296 - RNA, 22 nt, Human
agggaugugcagcauccagaca

SEQ ID NO: 67297 - RNA, 22 nt, Human
agggauguggugggagagaaag

SEQ ID NO: 67298 - RNA, 22 nt, Human
agggauguugucaaggaugugg

SEQ ID NO: 67299 - RNA, 19 nt, Human
agggcacagggacagaagg

SEQ ID NO: 67300 - RNA, 22 nt, Human
agggcacaucugcugggaaugg

SEQ ID NO: 67301 - RNA, 22 nt, Human
agggcacuggcuugcaaacuca

SEQ ID NO: 67302 - RNA, 22 nt, Human
agggcacuucagucagacugag

SEQ ID NO: 67303 - RNA, 22 nt, Human
agggcagaaauauugauacugu

SEQ ID NO: 67304 - RNA, 22 nt, Human
agggcagaaaucgauuacaccu

SEQ ID NO: 67305 - RNA, 22 nt, Human
agggcagagacaugcuuccuga

SEQ ID NO: 67306 - RNA, 20 nt, Human
agggcagagggauuacaggc

SEQ ID NO: 67307 - RNA, 22 nt, Human
agggcagauggaacuuccccga

SEQ ID NO: 67308 - RNA, 21 nt, Human
agggcagauuagcuguaagag

SEQ ID NO: 67309 - RNA, 22 nt, Human
agggcagcaaugcagcugcugc

SEQ ID NO: 67310 - RNA, 22 nt, Human
agggcagcagcccauggcucug

SEQ ID NO: 67311 - RNA, 22 nt, Human
agggcagcagcggcccaggccu

SEQ ID NO: 67312 - RNA, 22 nt, Human
agggcagccucucagccuaggu

SEQ ID NO: 67313 - RNA, 22 nt, Human
agggcagcucucaccucuggcc

SEQ ID NO: 67314 - RNA, 22 nt, Human
agggccacaguggggccugaga

SEQ ID NO: 67315 - RNA, 22 nt, Human
agggccaccagggagucucagg

SEQ ID NO: 67316 - RNA, 16 nt, Human
agggccagaagcauca

SEQ ID NO: 67317 - RNA, 22 nt, Human
agggccagaaucccucagucua

SEQ ID NO: 67318 - RNA, 21 nt, Human
agggccagaucaccaaggagc

SEQ ID NO: 67319 - RNA, 22 nt, Human
agggccagcccauaaugccaaa

SEQ ID NO: 67320 - RNA, 22 nt, Human
agggccagcuagagcccucgcc

SEQ ID NO: 67321 - RNA, 22 nt, Human
agggccaguauuaagguaauua

SEQ ID NO: 67322 - RNA, 22 nt, Human
agggccaguggguugaaaggca

SEQ ID NO: 67323 - RNA, 22 nt, Human
agggcccacaguuccuauggcc

SEQ ID NO: 67324 - RNA, 22 nt, Human
agggcccauagaucgucagcuu

SEQ ID NO: 67325 - RNA, 22 nt, Human
agggcccaugugggagcacuug

SEQ ID NO: 67326 - RNA, 22 nt, Human
agggcccuccccgcucagggca

SEQ ID NO: 67327 - RNA, 22 nt, Human
agggccucgggcucaguggguc

SEQ ID NO: 67328 - RNA, 21 nt, Human
agggccucucauuugugccag

SEQ ID NO: 67329 - RNA, 22 nt, Human
agggccugagcucuccuccagu

SEQ ID NO: 67330 - RNA, 22 nt, Human
agggccugagcuggcugaccuc

SEQ ID NO: 67331 - RNA, 23 nt, Human
agggccugauggcucccgcuggc

SEQ ID NO: 67332 - RNA, 19 nt, Human
agggccugcagcucaagcu

SEQ ID NO: 67333 - RNA, 22 nt, Human
agggccugggucuguacuccuc

SEQ ID NO: 67334 - RNA, 22 nt, Human
agggccugucagcgguguccug

SEQ ID NO: 67335 - RNA, 22 nt, Human
agggccuguccgcucccgcccg

SEQ ID NO: 67336 - RNA, 22 nt, Human
agggccugugcugaguagacga

SEQ ID NO: 67337 - RNA, 22 nt, Human
agggcgacaauggagagcguuu

SEQ ID NO: 67338 - RNA, 19 nt, Human
agggcgugguggcacaugu

SEQ ID NO: 67339 - RNA, 22 nt, Human
agggcucaagaaaguguaccuc

SEQ ID NO: 67340 - RNA, 22 nt, Human
agggcucacugggaggcuauaa

SEQ ID NO: 67341 - RNA, 22 nt, Human
agggcucagagcaaaagggcac

SEQ ID NO: 67342 - RNA, 22 nt, Human
agggcucagcaucucauucugu

SEQ ID NO: 67343 - RNA, 22 nt, Human
agggcucagccagccugugugc

SEQ ID NO: 67344 - RNA, 22 nt, Human
agggcucaucugagacugacau

SEQ ID NO: 67345 - RNA, 22 nt, Human
agggcucauugacauggaaaag

SEQ ID NO: 67346 - RNA, 22 nt, Human
agggcuccuaugaugcucugcc

SEQ ID NO: 67347 - RNA, 22 nt, Human
augacauaagugaaaaacauca

SEQ ID NO: 67348 - RNA, 22 nt, Human
augaccaagaguccaggucaag

SEQ ID NO: 67349 - RNA, 19 nt, Human
augacucuuauugucugaa

SEQ ID NO: 67350 - RNA, 22 nt, Human
augacugcucugggcucccaug

SEQ ID NO: 67351 - RNA, 22 nt, Human
augacuuaaucauacuugcauu

SEQ ID NO: 67352 - RNA, 22 nt, Human
augacuuauuacaagucauauu

SEQ ID NO: 67353 - RNA, 22 nt, Human
augacuucaccucugugaagca

SEQ ID NO: 67354 - RNA, 22 nt, Human
augacuuuccuggcaaaaguug

SEQ ID NO: 67355 - RNA, 22 nt, Human
augacuuuguuguuuuccagcg

SEQ ID NO: 67356 - RNA, 22 nt, Human
augagaaaauucauuccaucca

SEQ ID NO: 67357 - RNA, 22 nt, Human
augagaaggacauaaauuauag

SEQ ID NO: 67358 - RNA, 22 nt, Human
augagacaagagucuaaauuca

SEQ ID NO: 67359 - RNA, 22 nt, Human
augagacaggacuguaugcagg

SEQ ID NO: 67360 - RNA, 22 nt, Human
augagagcucuaugaucuguuu

SEQ ID NO: 67361 - RNA, 22 nt, Human
augagagcugaugacuuuacaa

SEQ ID NO: 67362 - RNA, 22 nt, Human
augagagguuucgucagaggaa

SEQ ID NO: 67363 - RNA, 22 nt, Human
augagauaggaacaaacuuaca

SEQ ID NO: 67364 - RNA, 22 nt, Human
augagaugugucuaauggaacc

SEQ ID NO: 67365 - RNA, 22 nt, Human
augagauuuuaaaacuucacuu

SEQ ID NO: 67366 - RNA, 22 nt, Human
augagcaaggcuuugugauagu

SEQ ID NO: 67367 - RNA, 22 nt, Human
augagcaauuaggaagaaaaca

SEQ ID NO: 67368 - RNA, 22 nt, Human
augagcagcauugcuccucuua

SEQ ID NO: 67369 - RNA, 22 nt, Human
augagcaguuuuuaaguagcaa

SEQ ID NO: 67370 - RNA, 22 nt, Human
augagcuagaaaaccaugugga

SEQ ID NO: 67371 - RNA, 22 nt, Human
augaggcaaggaucagguaagg

SEQ ID NO: 67372 - RNA, 22 nt, Human
augaggcaauagaauauugaau

SEQ ID NO: 67373 - RNA, 22 nt, Human
augaggcacagagauguuaaug

SEQ ID NO: 67374 - RNA, 22 nt, Human
augaggcacaucacagccaaug

SEQ ID NO: 67375 - RNA, 22 nt, Human
augaggcagcccuucccuucuc

SEQ ID NO: 67376 - RNA, 22 nt, Human
augaggcaggauuaagcuauca

SEQ ID NO: 67377 - RNA, 22 nt, Human
augaggcagguggaggcugcca

SEQ ID NO: 67378 - RNA, 21 nt, Human
augaggcaugagaggguuucu

SEQ ID NO: 67379 - RNA, 23 nt, Human
augaggcauuaaacaggcuuuuu

SEQ ID NO: 67380 - RNA, 22 nt, Human
augaggccaccuucuacauuuc

SEQ ID NO: 67381 - RNA, 22 nt, Human
augaggcuaugaauggggagau

SEQ ID NO: 67382 - RNA, 22 nt, Human
augagggcagcuauguaagugu

SEQ ID NO: 67383 - RNA, 22 nt, Human
augagguagcuguggcuggcug

SEQ ID NO: 67384 - RNA, 22 nt, Human
augagguaguauuagaaggaga

SEQ ID NO: 67385 - RNA, 22 nt, Human
augagguauuagcaguaacuga

SEQ ID NO: 67386 - RNA, 23 nt, Human
augaggucagccauaagacggaa

SEQ ID NO: 67387 - RNA, 22 nt, Human
augaggugauggacauauuaac

SEQ ID NO: 67388 - RNA, 22 nt, Human
augagguggucuucaguagguc

SEQ ID NO: 67389 - RNA, 22 nt, Human
augagguuuagguuccuccucu

SEQ ID NO: 67390 - RNA, 19 nt, Human
augaguacacuuguacauu

SEQ ID NO: 67391 - RNA, 22 nt, Human
augagugcaacagaucagcaug

SEQ ID NO: 67392 - RNA, 22 nt, Human
augagugcuuagagaguaaucc

SEQ ID NO: 67393 - RNA, 22 nt, Human
augaguguuuagaaaacacugg

SEQ ID NO: 67394 - RNA, 22 nt, Human
augaguuaggggccugagugga

SEQ ID NO: 67395 - RNA, 22 nt, Human
augaguucaauuguuucaguca

SEQ ID NO: 67396 - RNA, 22 nt, Human
augauaagaacacaguaugggg

SEQ ID NO: 67397 - RNA, 22 nt, Human
augauacaucuuguuuauuuca

SEQ ID NO: 67398 - RNA, 22 nt, Human
augauauagagaguagauuaaa

SEQ ID NO: 67399 - RNA, 22 nt, Human
augauauauguguugagcuugc

SEQ ID NO: 67400 - RNA, 22 nt, Human
augaucaagaauuuuguauucc

SEQ ID NO: 67401 - RNA, 22 nt, Human
augaugaaaugauagguuuguu

SEQ ID NO: 67402 - RNA, 22 nt, Human
augaugcaccauuauaagaguu

SEQ ID NO: 67403 - RNA, 22 nt, Human
augaugcuguuuaucauauacu

SEQ ID NO: 67404 - RNA, 22 nt, Human
augaugguggguaauguguaaa

SEQ ID NO: 67405 - RNA, 22 nt, Human
augaugguuguccuaggugcau

SEQ ID NO: 67406 - RNA, 22 nt, Human
augauguaccacuuucucaguu

SEQ ID NO: 67407 - RNA, 22 nt, Human
augauguacuaguuaaauauua

SEQ ID NO: 67408 - RNA, 22 nt, Human
augauguagacaaaaauaugcu

SEQ ID NO: 67409 - RNA, 22 nt, Human
augaugugugcugaucaagcuu

SEQ ID NO: 67410 - RNA, 22 nt, Human
augauguuaccaguacuuagag

SEQ ID NO: 67411 - RNA, 22 nt, Human
augauguuauuuucagaaacau

SEQ ID NO: 67412 - RNA, 22 nt, Human
augauucaagaaaauaggaugg

SEQ ID NO: 67413 - RNA, 22 nt, Human
augauucaggauugaaccauuu

SEQ ID NO: 67414 - RNA, 22 nt, Human
augauucucugcuacucuaaau

SEQ ID NO: 67415 - RNA, 22 nt, Human
augauucuggcaaauuuauuau

SEQ ID NO: 67416 - RNA, 22 nt, Human
augauugguggucagcaguaug

SEQ ID NO: 67417 - RNA, 22 nt, Human
augauuuucugauaaagaacug

SEQ ID NO: 67418 - RNA, 22 nt, Human
augauuuuuucuaacacagucg

SEQ ID NO: 67419 - RNA, 22 nt, Human
augcaaaaguaacugugauuuu

SEQ ID NO: 67420 - RNA, 22 nt, Human
augcaaacauguuuccucuaag

SEQ ID NO: 67421 - RNA, 20 nt, Human
augcaaacccugcuuugugg

SEQ ID NO: 67422 - RNA, 22 nt, Human
augcaaauaagugcaggcgugg

SEQ ID NO: 67423 - RNA, 19 nt, Human
augcaaauagauuuggaau

SEQ ID NO: 67424 - RNA, 22 nt, Human
augcaaauguuuaaguuacuau

SEQ ID NO: 67425 - RNA, 22 nt, Human
augcaaauuaacauauaguaga

SEQ ID NO: 67426 - RNA, 22 nt, Human
augcaacacauuugaugagcga

SEQ ID NO: 67427 - RNA, 22 nt, Human
augcaacaccccuauggaugga

SEQ ID NO: 67428 - RNA, 22 nt, Human
augcaacaggucagccaggaag

SEQ ID NO: 67429 - RNA, 22 nt, Human
augcaagaaacagagacgcuga

SEQ ID NO: 67430 - RNA, 22 nt, Human
augcaagagcaauaugguaugc

SEQ ID NO: 67431 - RNA, 22 nt, Human
augcaagauguauagaagacuu

SEQ ID NO: 67432 - RNA, 22 nt, Human
augcaagauucagcaggaagau

SEQ ID NO: 67433 - RNA, 22 nt, Human
augcaagcaacauuuugcacau

SEQ ID NO: 67434 - RNA, 18 nt, Human
augcaagcuauggauuug

SEQ ID NO: 67435 - RNA, 22 nt, Human
augcaauguuacagaauguacu

SEQ ID NO: 67436 - RNA, 22 nt, Human
augcacaacaguggcugccuug

SEQ ID NO: 67437 - RNA, 22 nt, Human
augcacaauguuuugauuugag

SEQ ID NO: 67438 - RNA, 22 nt, Human
augcacacacauuaugucugug

SEQ ID NO: 67439 - RNA, 22 nt, Human
augcacagauccccaggacccu

SEQ ID NO: 67440 - RNA, 22 nt, Human
augcacagauccuggcacuuag

SEQ ID NO: 67441 - RNA, 22 nt, Human
augcacaggacagccucuacuc

SEQ ID NO: 67442 - RNA, 22 nt, Human
augcacaggaccacacauaaug

SEQ ID NO: 67443 - RNA, 22 nt, Human
augcacaguaaugagcugguug

SEQ ID NO: 67444 - RNA, 22 nt, Human
augcacaguacaaacuggaaac

SEQ ID NO: 67445 - RNA, 22 nt, Human
augcacaguauguagggucuau

SEQ ID NO: 67446 - RNA, 22 nt, Human
augcacauguaucuauauacaa

SEQ ID NO: 67447 - RNA, 22 nt, Human
augcacauguggcuuuauguau

SEQ ID NO: 67448 - RNA, 22 nt, Human
augcaccacaucacuucugcuc

SEQ ID NO: 67449 - RNA, 22 nt, Human
augcacccauguacauacacau

SEQ ID NO: 67450 - RNA, 22 nt, Human
augcaccccagaagcugcagug

SEQ ID NO: 67451 - RNA, 22 nt, Human
augcaccugaacuccaucagcu

SEQ ID NO: 67452 - RNA, 22 nt, Human
augcacgccccacacuggugug

SEQ ID NO: 67453 - RNA, 22 nt, Human
augcacuuaaauaacauaacuu

SEQ ID NO: 67454 - RNA, 22 nt, Human
augcagaaagcggcaaacaggu

SEQ ID NO: 67455 - RNA, 22 nt, Human
augcagaagacugaaaagcuga

SEQ ID NO: 67456 - RNA, 22 nt, Human
augcugggaaguccuaaccaca

SEQ ID NO: 67457 - RNA, 22 nt, Human
augcugggacguacuuguucau

SEQ ID NO: 67458 - RNA, 22 nt, Human
augcuggucugcagaguuggga

SEQ ID NO: 67459 - RNA, 22 nt, Human
augcugguugcuaagcagcgau

SEQ ID NO: 67460 - RNA, 22 nt, Human
augcugucaguauuaugugcag

SEQ ID NO: 67461 - RNA, 22 nt, Human
augcuguccacucuugguguuu

SEQ ID NO: 67462 - RNA, 22 nt, Human
augcugugguagacagcauucc

SEQ ID NO: 67463 - RNA, 22 nt, Human
augcuguguggucaaguuaauu

SEQ ID NO: 67464 - RNA, 22 nt, Human
augcuguguuugagaaccuagg

SEQ ID NO: 67465 - RNA, 22 nt, Human
augcuuaaccuugguguacaau

SEQ ID NO: 67466 - RNA, 22 nt, Human
augcuuaagcucaguuauauau

SEQ ID NO: 67467 - RNA, 20 nt, Human
augcuuaaguguucauuauu

SEQ ID NO: 67468 - RNA, 22 nt, Human
augcuuccaauauucucccuuu

SEQ ID NO: 67469 - RNA, 22 nt, Human
augcuuccuuaccagaagauga

SEQ ID NO: 67470 - RNA, 18 nt, Human
augcuucugauagaagca

SEQ ID NO: 67471 - RNA, 22 nt, Human
augcuucugguauaagaaaaau

SEQ ID NO: 67472 - RNA, 22 nt, Human
augcuucuguugcuuaggaggu

SEQ ID NO: 67473 - RNA, 22 nt, Human
augcuucuugagauagaaacac

SEQ ID NO: 67474 - RNA, 22 nt, Human
augcuugaaaaccccaugaaua

SEQ ID NO: 67475 - RNA, 22 nt, Human
augcuugguuccuacuucuggc

SEQ ID NO: 67476 - RNA, 22 nt, Human
augcuuguacuaaaaaaauauu

SEQ ID NO: 67477 - RNA, 22 nt, Human
augcuuuacccacaccaggaug

SEQ ID NO: 67478 - RNA, 22 nt, Human
augcuuuauuauuuugcaggga

SEQ ID NO: 67479 - RNA, 22 nt, Human
augcuuuauuggagacagucau

SEQ ID NO: 67480 - RNA, 22 nt, Human
augcuuugauuugguuucucua

SEQ ID NO: 67481 - RNA, 22 nt, Human
augcuuuguuuaaagauuuuca

SEQ ID NO: 67482 - RNA, 22 nt, Human
augcuuuuccaggagaaauaua

SEQ ID NO: 67483 - RNA, 22 nt, Human
augcuuuuccuaaaaugaugcc

SEQ ID NO: 67484 - RNA, 22 nt, Human
augcuuuuuaaacuuaauugga

SEQ ID NO: 67485 - RNA, 21 nt, Human
auggaaaaacagguagagcau

SEQ ID NO: 67486 - RNA, 22 nt, Human
auggaaaagggucuuucauuuc

SEQ ID NO: 67487 - RNA, 22 nt, Human
auggaaagugcauggaagucau

SEQ ID NO: 67488 - RNA, 22 nt, Human
auggaaauacacaagagguuuc

SEQ ID NO: 67489 - RNA, 22 nt, Human
auggaaauaucuuuagagcuua

SEQ ID NO: 67490 - RNA, 22 nt, Human
auggaaauguuaagucaguccg

SEQ ID NO: 67491 - RNA, 22 nt, Human
auggaacagacagcugagacaa

SEQ ID NO: 67492 - RNA, 22 nt, Human
auggaagcagaccggaggaaua

SEQ ID NO: 67493 - RNA, 20 nt, Human
auggaagcugcucuucuccu

SEQ ID NO: 67494 - RNA, 19 nt, Human
auggaagcugggaucaaug

SEQ ID NO: 67495 - RNA, 22 nt, Human
auggaauauagucuuauaucuc

SEQ ID NO: 67496 - RNA, 22 nt, Human
auggaauggcucccugccccag

SEQ ID NO: 67497 - RNA, 22 nt, Human
aggcuccaccagucaggugcau

SEQ ID NO: 67498 - RNA, 22 nt, Human
aggcuccacccuacagagcucc

SEQ ID NO: 67499 - RNA, 22 nt, Human
aggcuccaggcaauguuucuga

SEQ ID NO: 67500 - RNA, 22 nt, Human
aggcuccaggcccuucaccagc

SEQ ID NO: 67501 - RNA, 22 nt, Human
aggcuccagggcugugugggag

SEQ ID NO: 67502 - RNA, 22 nt, Human
aggcuccugagaggcagaggcu

SEQ ID NO: 67503 - RNA, 22 nt, Human
aggcuccugauccuggggucug

SEQ ID NO: 67504 - RNA, 22 nt, Human
aggcucuccagagagcugcuuu

SEQ ID NO: 67505 - RNA, 22 nt, Human
aggcucugaagcaacccuuuga

SEQ ID NO: 67506 - RNA, 22 nt, Human
aggcucugacccaugggaccca

SEQ ID NO: 67507 - RNA, 19 nt, Human
aggcucugagcuccuggag

SEQ ID NO: 67508 - RNA, 22 nt, Human
aggcucugaugcaagcccaggg

SEQ ID NO: 67509 - RNA, 22 nt, Human
aggcucugucaggcggagcagc

SEQ ID NO: 67510 - RNA, 22 nt, Human
aggcucuucuuuuauuaacuga

SEQ ID NO: 67511 - RNA, 22 nt, Human
aggcugagacugugcauuagug

SEQ ID NO: 67512 - RNA, 22 nt, Human
aggcugagauagguggaucauu

SEQ ID NO: 67513 - RNA, 22 nt, Human
aggcugagcggggucccagagc

SEQ ID NO: 67514 - RNA, 22 nt, Human
aggcugagcugaccugguuugg

SEQ ID NO: 67515 - RNA, 22 nt, Human
aggcugaggcagguggaucacu

SEQ ID NO: 67516 - RNA, 22 nt, Human
aggcugaggcggguagaucacc

SEQ ID NO: 67517 - RNA, 20 nt, Human
aggcugccaggucucacauc

SEQ ID NO: 67518 - RNA, 19 nt, Human
aggcugcccagucucugcc

SEQ ID NO: 67519 - RNA, 20 nt, Human
aggcugccuaaggcucugca

SEQ ID NO: 67520 - RNA, 19 nt, Human
aggcugccucacccucccu

SEQ ID NO: 67521 - RNA, 22 nt, Human
aggcugccucuuuugagagggu

SEQ ID NO: 67522 - RNA, 22 nt, Human
aggcugccuguuccaaucuccu

SEQ ID NO: 67523 - RNA, 22 nt, Human
aggcugcucugcgaagucagcu

SEQ ID NO: 67524 - RNA, 17 nt, Human
aggcugcugggccaggg

SEQ ID NO: 67525 - RNA, 23 nt, Human
aggcugcuuacugguaucagagc

SEQ ID NO: 67526 - RNA, 22 nt, Human
aggcugcuucagcugcagggag

SEQ ID NO: 67527 - RNA, 22 nt, Human
aggcuggcaaggcagaugugug

SEQ ID NO: 67528 - RNA, 17 nt, Human
aggcuggccuucacagu

SEQ ID NO: 67529 - RNA, 22 nt, Human
aggcuggcgacaucuggcgggc

SEQ ID NO: 67530 - RNA, 22 nt, Human
aggcuggcuuggcucuccugug

SEQ ID NO: 67531 - RNA, 22 nt, Human
aggcugggaaaccugaaguugu

SEQ ID NO: 67532 - RNA, 22 nt, Human
aggcugggcaccguuuugaucc

SEQ ID NO: 67533 - RNA, 22 nt, Human
aggcuggggaauugaauuugcu

SEQ ID NO: 67534 - RNA, 22 nt, Human
aggcugguaguauuuagucaca

SEQ ID NO: 67535 - RNA, 22 nt, Human
aggcuggucuguuggcauuuuu

SEQ ID NO: 67536 - RNA, 22 nt, Human
aggcuggugauuagaagcagcc

SEQ ID NO: 67537 - RNA, 22 nt, Human
aggcuggugccugcagugaauc

SEQ ID NO: 67538 - RNA, 22 nt, Human
aggcuguagaucuagacaugua

SEQ ID NO: 67539 - RNA, 22 nt, Human
aggcuguauguuuccauuugaa

SEQ ID NO: 67540 - RNA, 22 nt, Human
aggcuguccaagguggcgaagu

SEQ ID NO: 67541 - RNA, 22 nt, Human
aggcugucugaccccagagccc

SEQ ID NO: 67542 - RNA, 22 nt, Human
aggcugugaaauguggcaagga

SEQ ID NO: 67543 - RNA, 22 nt, Human
aggcugugacuacgcagggaag

SEQ ID NO: 67544 - RNA, 22 nt, Human
aggcugugagagguggcuccca

SEQ ID NO: 67545 - RNA, 22 nt, Human
aggcugugagcaagaacaccua

SEQ ID NO: 67546 - RNA, 22 nt, Human
aggcugugaugagccucaugga

SEQ ID NO: 67547 - RNA, 22 nt, Human
aggcugugcacagggcaccugc

SEQ ID NO: 67548 - RNA, 22 nt, Human
aggcugugcauuuuggagggcc

SEQ ID NO: 67549 - RNA, 22 nt, Human
aggcugugcucagccaauggga

SEQ ID NO: 67550 - RNA, 22 nt, Human
aggcugugggugauuuacugug

SEQ ID NO: 67551 - RNA, 22 nt, Human
aggcuguggugaugauuggguc

SEQ ID NO: 67552 - RNA, 22 nt, Human
aggcugugugcuccuuaugaga

SEQ ID NO: 67553 - RNA, 22 nt, Human
aggcuguguggucaugguggcu

SEQ ID NO: 67554 - RNA, 22 nt, Human
aggcuguguuuaagugguaaug

SEQ ID NO: 67555 - RNA, 22 nt, Human
aggcuguguuuccccuggagcu

SEQ ID NO: 67556 - RNA, 20 nt, Human
aggcuguugacggcugccuc

SEQ ID NO: 67557 - RNA, 22 nt, Human
aggcuguugcaugccacagaua

SEQ ID NO: 67558 - RNA, 22 nt, Human
aggcuuaaaugcucauaucagu

SEQ ID NO: 67559 - RNA, 22 nt, Human
aggcuuaacuuaacuuuagagc

SEQ ID NO: 67560 - RNA, 22 nt, Human
aggcuucaaggacagcagccac

SEQ ID NO: 67561 - RNA, 22 nt, Human
aggcuucaauuccuuacccagu

SEQ ID NO: 67562 - RNA, 22 nt, Human
aggcuucagaggaagugcggcc

SEQ ID NO: 67563 - RNA, 22 nt, Human
aggcuucaggaaauauacauuu

SEQ ID NO: 67564 - RNA, 22 nt, Human
aggcuucaguuguaccuucuug

SEQ ID NO: 67565 - RNA, 22 nt, Human
aggguccaguaacagaugccag

SEQ ID NO: 67566 - RNA, 22 nt, Human
agggucccgaaggagacagcaa

SEQ ID NO: 67567 - RNA, 22 nt, Human
aggguccuaagccucagauaag

SEQ ID NO: 67568 - RNA, 22 nt, Human
aggguccugagccuggggcgca

SEQ ID NO: 67569 - RNA, 22 nt, Human
aggguccugggugcaguugcuu

SEQ ID NO: 67570 - RNA, 22 nt, Human
agggucucuugccaugccucag

SEQ ID NO: 67571 - RNA, 22 nt, Human
agggucugaccaccaguaggga

SEQ ID NO: 67572 - RNA, 22 nt, Human
agggucuucccaccauuccugc

SEQ ID NO: 67573 - RNA, 22 nt, Human
agggugagggucuggccuugag

SEQ ID NO: 67574 - RNA, 22 nt, Human
agggugcagaaggagccuagga

SEQ ID NO: 67575 - RNA, 22 nt, Human
agggugcagggacaggugugca

SEQ ID NO: 67576 - RNA, 22 nt, Human
agggugcagguguggagucuag

SEQ ID NO: 67577 - RNA, 22 nt, Human
agggugcccaccgcuucugccc

SEQ ID NO: 67578 - RNA, 22 nt, Human
agggugcugccggacagguggg

SEQ ID NO: 67579 - RNA, 19 nt, Human
aggguggcaaaggagggug

SEQ ID NO: 67580 - RNA, 22 nt, Human
aggguggcaccuggaagggaug

SEQ ID NO: 67581 - RNA, 21 nt, Human
aggguggcucugggucagaac

SEQ ID NO: 67582 - RNA, 22 nt, Human
aggguggcuuaauuccaaaggg

SEQ ID NO: 67583 - RNA, 22 nt, Human
agggugggcuagacucuucccc

SEQ ID NO: 67584 - RNA, 22 nt, Human
agggugguauuuaacaacugga

SEQ ID NO: 67585 - RNA, 22 nt, Human
aggguugaagucugguccucau

SEQ ID NO: 67586 - RNA, 22 nt, Human
aggguugcauuuuuagaggcuc

SEQ ID NO: 67587 - RNA, 23 nt, Human
aggguugugugcuucaugaucau

SEQ ID NO: 67588 - RNA, 19 nt, Human
aggguuucuugacuuugcu

SEQ ID NO: 67589 - RNA, 22 nt, Human
agguaaaauagauaguauuucu

SEQ ID NO: 67590 - RNA, 22 nt, Human
agguaaauauaaaucuuacucu

SEQ ID NO: 67591 - RNA, 22 nt, Human
agguaacagcuucagcuucaga

SEQ ID NO: 67592 - RNA, 22 nt, Human
agguaacuguggcuagguaacu

SEQ ID NO: 67593 - RNA, 22 nt, Human
agguaagaauagaggauugggg

SEQ ID NO: 67594 - RNA, 20 nt, Human
agguaaugggagaaaauguu

SEQ ID NO: 67595 - RNA, 22 nt, Human
agguacaggagguuggggcuac

SEQ ID NO: 67596 - RNA, 22 nt, Human
agguacauuugauaaaaauagc

SEQ ID NO: 67597 - RNA, 21 nt, Human
agguacuaaugaaaagugauu

SEQ ID NO: 67598 - RNA, 22 nt, Human
agguagaggccuccaggcagca

SEQ ID NO: 67599 - RNA, 22 nt, Human
agguagcgcaauuuccugggac

SEQ ID NO: 67600 - RNA, 22 nt, Human
agguagcuauccagacgcugaa

SEQ ID NO: 67601 - RNA, 19 nt, Human
agguagcucagacucaaag

SEQ ID NO: 67602 - RNA, 22 nt, Human
agguaggaaagucuccuuguau

SEQ ID NO: 67603 - RNA, 22 nt, Human
agguaggaguugauggauguuc

SEQ ID NO: 67604 - RNA, 22 nt, Human
agguaggauagauaggaagacc

SEQ ID NO: 67605 - RNA, 22 nt, Human
agguagggaagaaggcaugaaa

SEQ ID NO: 67606 - RNA, 22 nt, Human
agguagggcuaggcugcgucug

SEQ ID NO: 67607 - RNA, 23 nt, Human
agguagguuauugcugcuaccug

SEQ ID NO: 67608 - RNA, 22 nt, Human
agguaguguagcugagugggau

SEQ ID NO: 67609 - RNA, 17 nt, Human
agguauaaaaugguagc

SEQ ID NO: 67610 - RNA, 22 nt, Human
agguauaacuuuaugcauggaa

SEQ ID NO: 67611 - RNA, 20 nt, Human
agguauaagaaaugugauuu

SEQ ID NO: 67612 - RNA, 18 nt, Human
agguauaugaaucucuuu

SEQ ID NO: 67613 - RNA, 22 nt, Human
agguauaugcuauuacuucugc

SEQ ID NO: 67614 - RNA, 22 nt, Human
agguauauguucauguaugugu

SEQ ID NO: 67615 - RNA, 22 nt, Human
agguauauuuuguauauacucu

SEQ ID NO: 67616 - RNA, 22 nt, Human
agguaucaacagcagagucuga

SEQ ID NO: 67617 - RNA, 22 nt, Human
agguaugagauaaaucaaugaa

SEQ ID NO: 67618 - RNA, 22 nt, Human
agguauuaugcugcugaaugcu

SEQ ID NO: 67619 - RNA, 22 nt, Human
agguauuauuagcaucucuauu

SEQ ID NO: 67620 - RNA, 22 nt, Human
agguauucagaugaagugcuga

SEQ ID NO: 67621 - RNA, 22 nt, Human
agguauuucaaagcccacuucc

SEQ ID NO: 67622 - RNA, 22 nt, Human
aggucaaaagcaaggccagguu

SEQ ID NO: 67623 - RNA, 22 nt, Human
aggucaaaaucaggcagggaag

SEQ ID NO: 67624 - RNA, 22 nt, Human
aggucaaaaugcuuuucagguc

SEQ ID NO: 67625 - RNA, 22 nt, Human
aggucaaagaaccuagcuauag

SEQ ID NO: 67626 - RNA, 21 nt, Human
aggucaaaggcauccaugagg

SEQ ID NO: 67627 - RNA, 22 nt, Human
aggucagcaugcuccucucugu

SEQ ID NO: 67628 - RNA, 22 nt, Human
aggucagcccucucugggcagg

SEQ ID NO: 67629 - RNA, 22 nt, Human
aggucaggguauucacgucugu

SEQ ID NO: 67630 - RNA, 22 nt, Human
aggucauugaaguuauuuucuu

SEQ ID NO: 67631 - RNA, 22 nt, Human
agguccaaauguugagacugau

SEQ ID NO: 67632 - RNA, 21 nt, Human
aggucccagguuugggcagca

SEQ ID NO: 67633 - RNA, 22 nt, Human
aggucccagucugugaugacuc

SEQ ID NO: 67634 - RNA, 22 nt, Human
agguccugaugaucucugagag

SEQ ID NO: 67635 - RNA, 22 nt, Human
agguccuggucuugagucuuaa

SEQ ID NO: 67636 - RNA, 22 nt, Human
agguccugugguuuggguaaaa

SEQ ID NO: 67637 - RNA, 22 nt, Human
agguccuguuucuucccugggg

SEQ ID NO: 67638 - RNA, 19 nt, Human
agguccuuggcuggaaguu

SEQ ID NO: 67639 - RNA, 22 nt, Human
aggucgaguuucggggcuacuu

SEQ ID NO: 67640 - RNA, 22 nt, Human
aggucuaacugauagaauucau

SEQ ID NO: 67641 - RNA, 22 nt, Human
aggucuaggagucugaaaguau

SEQ ID NO: 67642 - RNA, 22 nt, Human
aggucucaaacuggcacccugu

SEQ ID NO: 67643 - RNA, 22 nt, Human
aggucucaaucucaggugguca

SEQ ID NO: 67644 - RNA, 22 nt, Human
aggucucacuuuguggaaguga

SEQ ID NO: 67645 - RNA, 22 nt, Human
aggucucccaagggccagggag

SEQ ID NO: 67646 - RNA, 22 nt, Human
aggucugagcucagggccuggc

SEQ ID NO: 67647 - RNA, 22 nt, Human
aggucugagcuccuuccucuga

SEQ ID NO: 67648 - RNA, 22 nt, Human
aggucugauauuuguuguauga

SEQ ID NO: 67649 - RNA, 20 nt, Human
aggucugauuccagaaucag

SEQ ID NO: 67650 - RNA, 22 nt, Human
aggucuggagugggaucugaga

SEQ ID NO: 67651 - RNA, 22 nt, Human
aggucugggaguucauucccug

SEQ ID NO: 67652 - RNA, 22 nt, Human
aggucugggcaccacuggcugc

SEQ ID NO: 67653 - RNA, 22 nt, Human
aggucuuaggagcauggugcug

SEQ ID NO: 67654 - RNA, 22 nt, Human
aggugagaaaacgaggguugca

SEQ ID NO: 67655 - RNA, 22 nt, Human
aggugaggauagguggccaagg

SEQ ID NO: 67656 - RNA, 22 nt, Human
aggugagugugacugcaagaga

SEQ ID NO: 67657 - RNA, 22 nt, Human
aggugaguugguaggaaguuug

SEQ ID NO: 67658 - RNA, 22 nt, Human
aggugauuuucuccuuacgauu

SEQ ID NO: 67659 - RNA, 20 nt, Human
aggugcaagcaguaaauugc

SEQ ID NO: 67660 - RNA, 22 nt, Human
aggugcagcugacaccaugugg

SEQ ID NO: 67661 - RNA, 22 nt, Human
aggugcaguggcucaugccugu

SEQ ID NO: 67662 - RNA, 22 nt, Human
aggugccaccucuggugcuguc

SEQ ID NO: 67663 - RNA, 17 nt, Human
aggugccagugauauac

SEQ ID NO: 67664 - RNA, 22 nt, Human
aggugcccaugagcuccauggc

SEQ ID NO: 67665 - RNA, 22 nt, Human
aggugccugucgucucugguua

SEQ ID NO: 67666 - RNA, 22 nt, Human
aggugcuggaguagaagaaaaa

SEQ ID NO: 67667 - RNA, 22 nt, Human
aggugcugggcagcagucauug

SEQ ID NO: 67668 - RNA, 22 nt, Human
aggugcuguuggcagcgggcag

SEQ ID NO: 67669 - RNA, 22 nt, Human
aggugcuugguaaauauuuuag

SEQ ID NO: 67670 - RNA, 22 nt, Human
agguggaacguucaggugcuag

SEQ ID NO: 67671 - RNA, 22 nt, Human
agguggagaagagaugggcagu

SEQ ID NO: 67672 - RNA, 16 nt, Human
agguggagaaguucac

SEQ ID NO: 67673 - RNA, 22 nt, Human
agguggagaucagggacuaagg

SEQ ID NO: 67674 - RNA, 22 nt, Human
aguauacaaauaaauguguaau

SEQ ID NO: 67675 - RNA, 22 nt, Human
aguauacuccccauccuagaaa

SEQ ID NO: 67676 - RNA, 22 nt, Human
aguauaugccagagagauagcu

SEQ ID NO: 67677 - RNA, 22 nt, Human
aguauauggggaauugcauaau

SEQ ID NO: 67678 - RNA, 22 nt, Human
aguaucaaucacccuuugaagu

SEQ ID NO: 67679 - RNA, 22 nt, Human
aguaucagaugugauuaaaggg

SEQ ID NO: 67680 - RNA, 22 nt, Human
aguaucauuuuggcauuaguau

SEQ ID NO: 67681 - RNA, 22 nt, Human
aguaucuucaaguuucuucuag

SEQ ID NO: 67682 - RNA, 22 nt, Human
aguaugaacggaaggccuggga

SEQ ID NO: 67683 - RNA, 22 nt, Human
aguaugcauauuucaaaguaag

SEQ ID NO: 67684 - RNA, 22 nt, Human
aguaugucagagugaaaauggu

SEQ ID NO: 67685 - RNA, 22 nt, Human
aguauucuggaauucuauguga

SEQ ID NO: 67686 - RNA, 22 nt, Human
aguauuuagcugacucgcuaca

SEQ ID NO: 67687 - RNA, 22 nt, Human
aguauuucaguuacuuuaaaau

SEQ ID NO: 67688 - RNA, 22 nt, Human
aguauuugagagguccaggugu

SEQ ID NO: 67689 - RNA, 22 nt, Human
aguauuuggugugguauugacc

SEQ ID NO: 67690 - RNA, 22 nt, Human
agucaaauaagagagagauguu

SEQ ID NO: 67691 - RNA, 15 nt, Human
agucaaaucuguuuu

SEQ ID NO: 67692 - RNA, 22 nt, Human
agucaacaaaaauguggagccu

SEQ ID NO: 67693 - RNA, 22 nt, Human
agucaagauucuggcacuagca

SEQ ID NO: 67694 - RNA, 22 nt, Human
agucaauuaucucuaggucauc

SEQ ID NO: 67695 - RNA, 22 nt, Human
agucacaauaccgugugucagu

SEQ ID NO: 67696 - RNA, 22 nt, Human
agucacacugguuguuuacagu

SEQ ID NO: 67697 - RNA, 22 nt, Human
agucacagaaacccaggugugg

SEQ ID NO: 67698 - RNA, 22 nt, Human
agucacagaaugauggcuccag

SEQ ID NO: 67699 - RNA, 22 nt, Human
agucacaggcaagagggcucca

SEQ ID NO: 67700 - RNA, 22 nt, Human
agucacagggggccccugcaac

SEQ ID NO: 67701 - RNA, 22 nt, Human
agucacaguucugcugucugag

SEQ ID NO: 67702 - RNA, 22 nt, Human
agucacaugaucccugggccug

SEQ ID NO: 67703 - RNA, 22 nt, Human
agucacauggcagagagaaguu

SEQ ID NO: 67704 - RNA, 22 nt, Human
agucacccuccaacucuccacu

SEQ ID NO: 67705 - RNA, 22 nt, Human
agucacuaggcugaaaguggag

SEQ ID NO: 67706 - RNA, 22 nt, Human
agucacugaauaccuuaauguu

SEQ ID NO: 67707 - RNA, 22 nt, Human
agucacugcuuugucccugugu

SEQ ID NO: 67708 - RNA, 22 nt, Human
agucacuguucugucaugucaa

SEQ ID NO: 67709 - RNA, 22 nt, Human
agucacuuugcuacucugccuu

SEQ ID NO: 67710 - RNA, 22 nt, Human
agucagaaucugcauuuuaacc

SEQ ID NO: 67711 - RNA, 22 nt, Human
agucagacacguuuuccauuag

SEQ ID NO: 67712 - RNA, 22 nt, Human
agucagagaaaacagcccugug

SEQ ID NO: 67713 - RNA, 22 nt, Human
agucagagaauguuuucaugga

SEQ ID NO: 67714 - RNA, 22 nt, Human
agucagagacccuagaucuaau

SEQ ID NO: 67715 - RNA, 23 nt, Human
agucagagagugugagacaacug

SEQ ID NO: 67716 - RNA, 22 nt, Human
agucagagcaaacuggacagac

SEQ ID NO: 67717 - RNA, 22 nt, Human
agucagagucgccgacagucaa

SEQ ID NO: 67718 - RNA, 22 nt, Human
agucagagugugcaggccggcu

SEQ ID NO: 67719 - RNA, 22 nt, Human
agucagauuuaaagcuguuuga

SEQ ID NO: 67720 - RNA, 22 nt, Human
agucagcacuccugaggaucac

SEQ ID NO: 67721 - RNA, 19 nt, Human
agucagcaugcaugugacu

SEQ ID NO: 67722 - RNA, 22 nt, Human
agucagcugcagcagcuuuggu

SEQ ID NO: 67723 - RNA, 22 nt, Human
agucagcuugucucuaggguug

SEQ ID NO: 67724 - RNA, 22 nt, Human
agucaggauaugccuugugggc

SEQ ID NO: 67725 - RNA, 22 nt, Human
agucaggggaucuagacuugaa

SEQ ID NO: 67726 - RNA, 22 nt, Human
agucagucugcuagccugugga

SEQ ID NO: 67727 - RNA, 22 nt, Human
agucagugaaaacuagaauguu

SEQ ID NO: 67728 - RNA, 22 nt, Human
agucagugacuuuugcugagag

SEQ ID NO: 67729 - RNA, 22 nt, Human
agucaguggauuuaccaugcgu

SEQ ID NO: 67730 - RNA, 22 nt, Human
agucagugggagaagugugaag

SEQ ID NO: 67731 - RNA, 22 nt, Human
agucagugucaacaggaaguag

SEQ ID NO: 67732 - RNA, 22 nt, Human
agucaguuaaacuuuguaaagu

SEQ ID NO: 67733 - RNA, 22 nt, Human
agucauaucugaggaggaaucc

SEQ ID NO: 67734 - RNA, 19 nt, Human
agucauauuguucaucuug

SEQ ID NO: 67735 - RNA, 22 nt, Human
agucauauuuauauaauuuccc

SEQ ID NO: 67736 - RNA, 22 nt, Human
agucauuacggacuaguacuac

SEQ ID NO: 67737 - RNA, 22 nt, Human
agucauuuugccagucuucagg

SEQ ID NO: 67738 - RNA, 22 nt, Human
aguccaaggccauacaguugug

SEQ ID NO: 67739 - RNA, 22 nt, Human
aguccaagguucauggcacaga

SEQ ID NO: 67740 - RNA, 22 nt, Human
aguccagagaggaggcugugug

SEQ ID NO: 67741 - RNA, 22 nt, Human
aguccagccuucaaucuuagug

SEQ ID NO: 67742 - RNA, 22 nt, Human
aguccaggaaaauaagcuaggu

SEQ ID NO: 67743 - RNA, 22 nt, Human
aguccaggacuguuucagcuga

SEQ ID NO: 67744 - RNA, 22 nt, Human
auucacaaagaagggaaguaca

SEQ ID NO: 67745 - RNA, 22 nt, Human
auucacaaauaacaggugcaga

SEQ ID NO: 67746 - RNA, 22 nt, Human
auucacaaugauacauaagcga

SEQ ID NO: 67747 - RNA, 22 nt, Human
auucacaugauguauguagggc

SEQ ID NO: 67748 - RNA, 22 nt, Human
auucacaugugcuucuuaucac

SEQ ID NO: 67749 - RNA, 22 nt, Human
auucacauguugaagcccuaac

SEQ ID NO: 67750 - RNA, 22 nt, Human
auucacauuuagacaucaggua

SEQ ID NO: 67751 - RNA, 22 nt, Human
auucacauuuagccucugacau

SEQ ID NO: 67752 - RNA, 22 nt, Human
auucacuggcagacagaacuca

SEQ ID NO: 67753 - RNA, 22 nt, Human
auucagaaaggguugccugguu

SEQ ID NO: 67754 - RNA, 22 nt, Human
auucagaaauagaaaauuugau

SEQ ID NO: 67755 - RNA, 22 nt, Human
auucagaagcuauucuuaguuc

SEQ ID NO: 67756 - RNA, 22 nt, Human
auucagaauggcaaacuucuag

SEQ ID NO: 67757 - RNA, 23 nt, Human
auucagaauuguguguuuguaua

SEQ ID NO: 67758 - RNA, 22 nt, Human
auucagacuaugaacacgucag

SEQ ID NO: 67759 - RNA, 22 nt, Human
auucagacucuugagcaguccc

SEQ ID NO: 67760 - RNA, 22 nt, Human
auucagagauuguuauucagac

SEQ ID NO: 67761 - RNA, 22 nt, Human
auucagagucugcacaacagca

SEQ ID NO: 67762 - RNA, 22 nt, Human
auucagauugguuuaagcuagu

SEQ ID NO: 67763 - RNA, 22 nt, Human
auucagcaaacauuuauuaucu

SEQ ID NO: 67764 - RNA, 22 nt, Human
auucagcaaugagcuuggauuu

SEQ ID NO: 67765 - RNA, 22 nt, Human
auucagcacaauuuggccaaua

SEQ ID NO: 67766 - RNA, 22 nt, Human
auucagcagccauggcuucuga

SEQ ID NO: 67767 - RNA, 22 nt, Human
auucagcugacuuugauucauu

SEQ ID NO: 67768 - RNA, 22 nt, Human
auucagggaggaaaggggccuc

SEQ ID NO: 67769 - RNA, 22 nt, Human
auucaguaggugugaacuuauu

SEQ ID NO: 67770 - RNA, 22 nt, Human
auucagugaccuaauuacuuac

SEQ ID NO: 67771 - RNA, 22 nt, Human
auucaguggauaucuucacuuu

SEQ ID NO: 67772 - RNA, 22 nt, Human
auucagugugagguuuucaagu

SEQ ID NO: 67773 - RNA, 22 nt, Human
auucaguguuugcagcaacuuu

SEQ ID NO: 67774 - RNA, 22 nt, Human
auucaguuaagggucuugagau

SEQ ID NO: 67775 - RNA, 22 nt, Human
auucaguucuggcugccuuccu

SEQ ID NO: 67776 - RNA, 23 nt, Human
auucaguugugagagaagacaca

SEQ ID NO: 67777 - RNA, 22 nt, Human
auucaucagcuaauggacauuu

SEQ ID NO: 67778 - RNA, 22 nt, Human
auucaucuaugacucuaaugug

SEQ ID NO: 67779 - RNA, 22 nt, Human
auucaugaccccaugguugauu

SEQ ID NO: 67780 - RNA, 22 nt, Human
auucauguuagcccacauguag

SEQ ID NO: 67781 - RNA, 22 nt, Human
auucauguuuucuugcuucaag

SEQ ID NO: 67782 - RNA, 22 nt, Human
auucauuugcuauuguguaugg

SEQ ID NO: 67783 - RNA, 22 nt, Human
gauggcaaacugggaccagagg

SEQ ID NO: 67784 - RNA, 22 nt, Human
gauggcaccuugaacgcugcgu

SEQ ID NO: 67785 - RNA, 22 nt, Human
gauggcagcagcagccagggau

SEQ ID NO: 67786 - RNA, 22 nt, Human
gauggcaggcaggugaguagag

SEQ ID NO: 67787 - RNA, 22 nt, Human
gauggcagguaguggucucauc

SEQ ID NO: 67788 - RNA, 22 nt, Human
gauggcaggugauagccgaguc

SEQ ID NO: 67789 - RNA, 22 nt, Human
gauggcagugggccucgagucc

SEQ ID NO: 67790 - RNA, 22 nt, Human
gauggcuggcuauaucagggga

SEQ ID NO: 67791 - RNA, 22 nt, Human
gauggcuuacagacaguuagga

SEQ ID NO: 67792 - RNA, 22 nt, Human
gaugggaggaaccugggucccu

SEQ ID NO: 67793 - RNA, 22 nt, Human
gaugggauuuuuuauguguuca

SEQ ID NO: 67794 - RNA, 22 nt, Human
gaugggcugucugagcgcugug

SEQ ID NO: 67795 - RNA, 17 nt, Human
gauggggcugacaucag

SEQ ID NO: 67796 - RNA, 18 nt, Human
gauggguaaaggcauaaa

SEQ ID NO: 67797 - RNA, 22 nt, Human
gauggguacucguuggacugag

SEQ ID NO: 67798 - RNA, 22 nt, Human
gauggguagaaguggaagaggu

SEQ ID NO: 67799 - RNA, 20 nt, Human
gauggguauugaagucaccu

SEQ ID NO: 67800 - RNA, 22 nt, Human
gaugguccuccugcugccucuc

SEQ ID NO: 67801 - RNA, 22 nt, Human
gauggugucccaggcucaggcu

SEQ ID NO: 67802 - RNA, 19 nt, Human
gcaccagauugagugacac

SEQ ID NO: 67803 - RNA, 22 nt, Human
gcaccagccugagccucuugca

SEQ ID NO: 67804 - RNA, 22 nt, Human
gcaccagcugcaggguggcuga

SEQ ID NO: 67805 - RNA, 22 nt, Human
gcaccaggagaaucacguuaga

SEQ ID NO: 67806 - RNA, 22 nt, Human
gcaccaugacagugaggagaac

SEQ ID NO: 67807 - RNA, 22 nt, Human
gcacccagauauugccuugacc

SEQ ID NO: 67808 - RNA, 22 nt, Human
gcaccccucagcuuguuuacua

SEQ ID NO: 67809 - RNA, 19 nt, Human
gcacccugaggucauggcc

SEQ ID NO: 67810 - RNA, 22 nt, Human
gcacccugaguguucagcucca

SEQ ID NO: 67811 - RNA, 22 nt, Human
gcaccgagaaggaagcaugccu

SEQ ID NO: 67812 - RNA, 20 nt, Human
gcaccugaaugcaucuugga

SEQ ID NO: 67813 - RNA, 22 nt, Human
gcaccugcaggaugagccaggg

SEQ ID NO: 67814 - RNA, 22 nt, Human
gcaccuggacagugacccuagc

SEQ ID NO: 67815 - RNA, 22 nt, Human
gcaccuuagccugaauuugugu

SEQ ID NO: 67816 - RNA, 22 nt, Human
gcaccuuauuuaaaugauguuu

SEQ ID NO: 67817 - RNA, 22 nt, Human
gcaccuuggcuuucuugguggc

SEQ ID NO: 67818 - RNA, 22 nt, Human
gcacguggaaugcucaugagcc

SEQ ID NO: 67819 - RNA, 22 nt, Human
gcacuagaaucccuucaagaag

SEQ ID NO: 67820 - RNA, 22 nt, Human
gcacuagagcagcucucagaga

SEQ ID NO: 67821 - RNA, 22 nt, Human
gcacuagucaagugaacaauuu

SEQ ID NO: 67822 - RNA, 22 nt, Human
gcacucaggacucucaucagua

SEQ ID NO: 67823 - RNA, 22 nt, Human
gcacucuguuucuccugucagc

SEQ ID NO: 67824 - RNA, 20 nt, Human
gcacugaagguuccagggga

SEQ ID NO: 67825 - RNA, 22 nt, Human
gcacugaaugcuuuuacuguaa

SEQ ID NO: 67826 - RNA, 17 nt, Human
gcacugagccacaguuu

SEQ ID NO: 67827 - RNA, 22 nt, Human
gcacugagcuuuggaggagcag

SEQ ID NO: 67828 - RNA, 22 nt, Human
gcacugauuacccauugcugcu

SEQ ID NO: 67829 - RNA, 22 nt, Human
gcacugcagguggguggagagg

SEQ ID NO: 67830 - RNA, 23 nt, Human
gcacugccaugugcucugcaggc

SEQ ID NO: 67831 - RNA, 22 nt, Human
gcacugcuccagguguggcuug

SEQ ID NO: 67832 - RNA, 22 nt, Human
gcacugcuuuuaccuaggugag

SEQ ID NO: 67833 - RNA, 22 nt, Human
gcacuggaaauaccuagaugaa

SEQ ID NO: 67834 - RNA, 22 nt, Human
gcacuggagaauggcuguauuc

SEQ ID NO: 67835 - RNA, 22 nt, Human
gcacugggaagaaugagccugu

SEQ ID NO: 67836 - RNA, 22 nt, Human
gcacugggaaugcugaugggcu

SEQ ID NO: 67837 - RNA, 22 nt, Human
gcacugggagcugccugccggu

SEQ ID NO: 67838 - RNA, 22 nt, Human
gcacugggggcagcagugaggg

SEQ ID NO: 67839 - RNA, 22 nt, Human
gcacugguguguuaguaaggga

SEQ ID NO: 67840 - RNA, 22 nt, Human
gcacugguuacccugaguggcu

SEQ ID NO: 67841 - RNA, 22 nt, Human
gcacugugaauauacuagcaaa

SEQ ID NO: 67842 - RNA, 22 nt, Human
gcacugugacccagagcaggug

SEQ ID NO: 67843 - RNA, 22 nt, Human
gcacuguucuaggugcagagcu

SEQ ID NO: 67844 - RNA, 18 nt, Human
gcacuucacagggauagu

SEQ ID NO: 67845 - RNA, 18 nt, Human
gcacuucacccagcuagu

SEQ ID NO: 67846 - RNA, 22 nt, Human
gcacuucaugacuuugucaaau

SEQ ID NO: 67847 - RNA, 22 nt, Human
gcacuugauuacauuagugccu

SEQ ID NO: 67848 - RNA, 22 nt, Human
gcacuugucaaauauuauagua

SEQ ID NO: 67849 - RNA, 22 nt, Human
gcacuuuggaaaauuuugaguu

SEQ ID NO: 67850 - RNA, 17 nt, Human
gcagaaaagucaaggga

SEQ ID NO: 67851 - RNA, 22 nt, Human
gcagaaagcuuagaggguuugc

SEQ ID NO: 67852 - RNA, 22 nt, Human
gcagaacauuucacaguaucuu

SEQ ID NO: 67853 - RNA, 22 nt, Human
gcagaagcagggcaggggcaaa

SEQ ID NO: 67854 - RNA, 22 nt, Human
gcagaagcugggagaagggauu

SEQ ID NO: 67855 - RNA, 22 nt, Human
gcagaagcuguucgaaggccgc

SEQ ID NO: 67856 - RNA, 22 nt, Human
gcagaaguggauucuacaauuu

SEQ ID NO: 67857 - RNA, 21 nt, Human
gcagaauagucucugucuuca

SEQ ID NO: 67858 - RNA, 22 nt, Human
gcagaauuggauaguugugaua

SEQ ID NO: 67859 - RNA, 22 nt, Human
gcagaauuuaggaauuaggaaa

SEQ ID NO: 67860 - RNA, 22 nt, Human
gcagacaaagcagcaugccuau

SEQ ID NO: 67861 - RNA, 22 nt, Human
gcagacacauccacuccuacag

SEQ ID NO: 67862 - RNA, 22 nt, Human
gcagacagaagcuaaguagaca

SEQ ID NO: 67863 - RNA, 22 nt, Human
gcagacagaugagggugcuggg

SEQ ID NO: 67864 - RNA, 22 nt, Human
gcagacagcauguugggcuauu

SEQ ID NO: 67865 - RNA, 22 nt, Human
gcagacauuuugaaucuaggcu

SEQ ID NO: 67866 - RNA, 22 nt, Human
gcagacggaguaucuuguacau

SEQ ID NO: 67867 - RNA, 22 nt, Human
gcagacucugagagugagugcc

SEQ ID NO: 67868 - RNA, 21 nt, Human
gcagacugcccugcugucccc

SEQ ID NO: 67869 - RNA, 22 nt, Human
gcagacuguaucaaugucagua

SEQ ID NO: 67870 - RNA, 22 nt, Human
gcagagaagaugcccaggcuuc

SEQ ID NO: 67871 - RNA, 22 nt, Human
gcagagaccccgcagugaggcc

SEQ ID NO: 67872 - RNA, 22 nt, Human
gcagagauccaggguauagguu

SEQ ID NO: 67873 - RNA, 22 nt, Human
gcagagcaccaaagugaaagau

SEQ ID NO: 67874 - RNA, 22 nt, Human
gcagagcaggaaggaagucagg

SEQ ID NO: 67875 - RNA, 22 nt, Human
gcagagcaggggcugaaccugg

SEQ ID NO: 67876 - RNA, 22 nt, Human
gcagagccagaauggccaggac

SEQ ID NO: 67877 - RNA, 22 nt, Human
gcagagccaggcuggggcaggu

SEQ ID NO: 67878 - RNA, 22 nt, Human
gcagagccaugggagguuuuug

SEQ ID NO: 67879 - RNA, 22 nt, Human
gcagagccccucaagccagccu

SEQ ID NO: 67880 - RNA, 22 nt, Human
gcagagcccuggggguauggug

SEQ ID NO: 67881 - RNA, 21 nt, Human
gcagagccggggcgagaaggc

SEQ ID NO: 67882 - RNA, 22 nt, Human
gcagagccugacgggauuuuuc

SEQ ID NO: 67883 - RNA, 22 nt, Human
gcagagcuaucuucuggauuug

SEQ ID NO: 67884 - RNA, 22 nt, Human
gcagagcucaagguguucagcu

SEQ ID NO: 67885 - RNA, 22 nt, Human
gcagagcugguacuugagccug

SEQ ID NO: 67886 - RNA, 22 nt, Human
gcagagcuucuguccuucagga

SEQ ID NO: 67887 - RNA, 21 nt, Human
gcagaggaaugguauacauaa

SEQ ID NO: 67888 - RNA, 22 nt, Human
gcagaggagcaaguugcuacag

SEQ ID NO: 67889 - RNA, 22 nt, Human
gcagaggaggacccaggaauua

SEQ ID NO: 67890 - RNA, 22 nt, Human
gcagaggaucaggcucuggaaa

SEQ ID NO: 67891 - RNA, 22 nt, Human
gcagaggcacagccccagauga

SEQ ID NO: 67892 - RNA, 22 nt, Human
guaaacaaacucucaggccagu

SEQ ID NO: 67893 - RNA, 22 nt, Human
guaaacaagucuaccauuagaa

SEQ ID NO: 67894 - RNA, 22 nt, Human
guaaacaccuguuaaauucaga

SEQ ID NO: 67895 - RNA, 22 nt, Human
guaaacaucagccacucuauuu

SEQ ID NO: 67896 - RNA, 22 nt, Human
guaaagaaguuuuugaaugcau

SEQ ID NO: 67897 - RNA, 22 nt, Human
guaaagcaaaauguagagauug

SEQ ID NO: 67898 - RNA, 22 nt, Human
guaaagcucucauuuaauauca

SEQ ID NO: 67899 - RNA, 22 nt, Human
guaaagcuggagaggucuuuua

SEQ ID NO: 67900 - RNA, 22 nt, Human
guaaaguacaagccucauuaca

SEQ ID NO: 67901 - RNA, 22 nt, Human
guaaaguacauacaugaacuca

SEQ ID NO: 67902 - RNA, 22 nt, Human
guaaauauaaaugcuagcugcc

SEQ ID NO: 67903 - RNA, 22 nt, Human
guaaaucagugucauuuuagaa

SEQ ID NO: 67904 - RNA, 22 nt, Human
guaaaucauggucagaauaaau

SEQ ID NO: 67905 - RNA, 22 nt, Human
guaaaugccacuuaauguaaag

SEQ ID NO: 67906 - RNA, 22 nt, Human
guaacacuagcucugucacuuu

SEQ ID NO: 67907 - RNA, 22 nt, Human
guaacauuuacaguuccuagag

SEQ ID NO: 67908 - RNA, 22 nt, Human
guaaggcaauaguaaggagucc

SEQ ID NO: 67909 - RNA, 22 nt, Human
guaaguuaguuccuguguuagu

SEQ ID NO: 67910 - RNA, 22 nt, Human
guaauaagaaacagcaauuauu

SEQ ID NO: 67911 - RNA, 22 nt, Human
guaauagguuuucuugcuccag

SEQ ID NO: 67912 - RNA, 22 nt, Human
guaauauucagcuauugaguug

SEQ ID NO: 67913 - RNA, 22 nt, Human
guaaugaauagaugguggcagg

SEQ ID NO: 67914 - RNA, 22 nt, Human
guaaugaugucugagaaguaug

SEQ ID NO: 67915 - RNA, 22 nt, Human
guaauuaggaauaaaaugggaa

SEQ ID NO: 67916 - RNA, 22 nt, Human
guaauugaaauugccuuggguu

SEQ ID NO: 67917 - RNA, 22 nt, Human
guaauugacucagcucuguuca

SEQ ID NO: 67918 - RNA, 22 nt, Human
guacaaaaguuauugcgguuuu

SEQ ID NO: 67919 - RNA, 22 nt, Human
guacaaauacauucugaaggua

SEQ ID NO: 67920 - RNA, 22 nt, Human
gcaacuuucaagcaccaugggg

SEQ ID NO: 67921 - RNA, 22 nt, Human
gcaagaaaaaggcuucaugaac

SEQ ID NO: 67922 - RNA, 22 nt, Human
gcaagaguggaacaaaggcagc

SEQ ID NO: 67923 - RNA, 22 nt, Human
gcaagauuccgcucuagagccu

SEQ ID NO: 67924 - RNA, 22 nt, Human
gcaagauuccuugagccuaguu

SEQ ID NO: 67925 - RNA, 22 nt, Human
gcaagcagacauucagguaggu

SEQ ID NO: 67926 - RNA, 22 nt, Human
gcaagcagacugggccccugug

SEQ ID NO: 67927 - RNA, 22 nt, Human
gcaagcaggguuccuuagggca

SEQ ID NO: 67928 - RNA, 22 nt, Human
gcaagcaguuguggcuucugag

SEQ ID NO: 67929 - RNA, 22 nt, Human
gcaagcuauagaauauaagggg

SEQ ID NO: 67930 - RNA, 22 nt, Human
gcaagcucucugcaggcagagc

SEQ ID NO: 67931 - RNA, 22 nt, Human
gcaagcugcucuuauguggagg

SEQ ID NO: 67932 - RNA, 22 nt, Human
gcaagcuguccuuuugcauggc

SEQ ID NO: 67933 - RNA, 22 nt, Human
gcaagcugugauuuaugugaau

SEQ ID NO: 67934 - RNA, 22 nt, Human
gcaaggaacaaaugcucugcuu

SEQ ID NO: 67935 - RNA, 17 nt, Human
gcaaggaaguucuuugc

SEQ ID NO: 67936 - RNA, 22 nt, Human
gcaaggagccuggaggugagug

SEQ ID NO: 67937 - RNA, 22 nt, Human
gcaaggauguacugcaauagga

SEQ ID NO: 67938 - RNA, 21 nt, Human
gcaaggcaaugccaugauuuc

SEQ ID NO: 67939 - RNA, 20 nt, Human
gcaaggcagguugaccaaga

SEQ ID NO: 67940 - RNA, 21 nt, Human
gcaaggccuaucauggcagcu

SEQ ID NO: 67941 - RNA, 22 nt, Human
gcaaggcugagcacauuugcau

SEQ ID NO: 67942 - RNA, 22 nt, Human
gcaaggcugugcacuuugcauu

SEQ ID NO: 67943 - RNA, 22 nt, Human
gcaagggugugaaccaaugaga

SEQ ID NO: 67944 - RNA, 22 nt, Human
gcaagguguuuuaacaggaaaa

SEQ ID NO: 67945 - RNA, 19 nt, Human
gcaagguucacucccagag

SEQ ID NO: 67946 - RNA, 22 nt, Human
gcaagugucugagguuuuguau

SEQ ID NO: 67947 - RNA, 22 nt, Human
gcaaguuuagcuaacuggccca

SEQ ID NO: 67948 - RNA, 22 nt, Human
gcaauaaacucucucaagccac

SEQ ID NO: 67949 - RNA, 22 nt, Human
gcaauaaauaacauggaagaca

SEQ ID NO: 67950 - RNA, 22 nt, Human
gcaauacaguugaagagauuga

SEQ ID NO: 67951 - RNA, 22 nt, Human
gcaauacuaagugacuuuuggg

SEQ ID NO: 67952 - RNA, 22 nt, Human
gcaaucaaugauuuauauuugu

SEQ ID NO: 67953 - RNA, 17 nt, Human
gcaaucucagucuccuu

SEQ ID NO: 67954 - RNA, 22 nt, Human
gcaaugauugcauuagaagaug

SEQ ID NO: 67955 - RNA, 22 nt, Human
gcaaugucuagucugagggcuu

SEQ ID NO: 67956 - RNA, 22 nt, Human
gcaauguuguguuggcauucua

SEQ ID NO: 67957 - RNA, 20 nt, Human
gcaauuaauuuuugguuaca

SEQ ID NO: 67958 - RNA, 22 nt, Human
gcaauuauuaugugacuuuuac

SEQ ID NO: 67959 - RNA, 17 nt, Human
gcaauuauugggcauuu

SEQ ID NO: 67960 - RNA, 21 nt, Human
gcaauucgcuaugaugguggc

SEQ ID NO: 67961 - RNA, 22 nt, Human
gcacaaagguggaaggaggaag

SEQ ID NO: 67962 - RNA, 22 nt, Human
gcacaagaaaucauggacugaa

SEQ ID NO: 67963 - RNA, 22 nt, Human
gcacaauggaccgugugcucug

SEQ ID NO: 67964 - RNA, 22 nt, Human
gcacacagagaggugguauguc

SEQ ID NO: 67965 - RNA, 22 nt, Human
gcacacagcuagauuaccauuc

SEQ ID NO: 67966 - RNA, 22 nt, Human
gcacacaggcaguuuccagcca

SEQ ID NO: 67967 - RNA, 22 nt, Human
gcacacaguagggauucaauga

SEQ ID NO: 67968 - RNA, 22 nt, Human
gcacacauucuagccuuuugug

SEQ ID NO: 67969 - RNA, 22 nt, Human
gcacacuggagccuggaagauu

SEQ ID NO: 67970 - RNA, 22 nt, Human
gcacagaacacuggugaguccc

SEQ ID NO: 67971 - RNA, 22 nt, Human
gcacagagacaguccugagauc

SEQ ID NO: 67972 - RNA, 23 nt, Human
gcacagagcaguuaggggaagau

SEQ ID NO: 67973 - RNA, 22 nt, Human
gcacagaggaugaggcagcucu

SEQ ID NO: 67974 - RNA, 22 nt, Human
gcacagagggcagugagccucu

SEQ ID NO: 67975 - RNA, 22 nt, Human
gcacagcagccgaaaugcccuu

SEQ ID NO: 67976 - RNA, 22 nt, Human
gcacagcaguggcauaaacaau

SEQ ID NO: 67977 - RNA, 22 nt, Human
gcacagcccuggucggggcccc

SEQ ID NO: 67978 - RNA, 22 nt, Human
gcacagccuugcccugugcccu

SEQ ID NO: 67979 - RNA, 22 nt, Human
gcacagcuccugguaagcuggg

SEQ ID NO: 67980 - RNA, 22 nt, Human
gcacagcucuccccaagacgaa

SEQ ID NO: 67981 - RNA, 20 nt, Human
gcacagcugaguucaggguc

SEQ ID NO: 67982 - RNA, 22 nt, Human
gcacaggaaaugacucauguua

SEQ ID NO: 67983 - RNA, 22 nt, Human
gcacaggaaucuucauuuuuua

SEQ ID NO: 67984 - RNA, 22 nt, Human
gcacaggaggccgaugcucaug

SEQ ID NO: 67985 - RNA, 22 nt, Human
gcacaggcacagagggccacug

SEQ ID NO: 67986 - RNA, 22 nt, Human
gcacaggcaucaggcuuuuucu

SEQ ID NO: 67987 - RNA, 22 nt, Human
gcacaggcuccggaggagagcu

SEQ ID NO: 67988 - RNA, 22 nt, Human
gcacaggcucucuuggggacac

SEQ ID NO: 67989 - RNA, 22 nt, Human
gcacagggcccugugcguaggu

SEQ ID NO: 67990 - RNA, 22 nt, Human
gcacaguaggcucagcucuauc

SEQ ID NO: 67991 - RNA, 21 nt, Human
gcacagugccaggcacacagu

SEQ ID NO: 67992 - RNA, 22 nt, Human
gcacaguggguggucauguaca

SEQ ID NO: 67993 - RNA, 22 nt, Human
gcacaguguaccacagucccua

SEQ ID NO: 67994 - RNA, 22 nt, Human
gcacauaaagggcaugggaggu

SEQ ID NO: 67995 - RNA, 23 nt, Human
gcacauacuacacagaaaauggc

SEQ ID NO: 67996 - RNA, 22 nt, Human
gcacauaugcuguaagcacaug

SEQ ID NO: 67997 - RNA, 20 nt, Human
gcacaucugcuuuggauuuc

SEQ ID NO: 67998 - RNA, 22 nt, Human
gcacaugacaguaaguagagca

SEQ ID NO: 67999 - RNA, 22 nt, Human
gcacaugagcugcugggauggg

SEQ ID NO: 68000 - RNA, 22 nt, Human
gcacauggacaauggaggugca

SEQ ID NO: 68001 - RNA, 22 nt, Human
gcauggugacaucaugugaaug

SEQ ID NO: 68002 - RNA, 22 nt, Human
gcauguaaucacucuaggaagg

SEQ ID NO: 68003 - RNA, 22 nt, Human
gcaugucuguaauuacagagcc

SEQ ID NO: 68004 - RNA, 22 nt, Human
gcauguggaaucucuccauggu

SEQ ID NO: 68005 - RNA, 22 nt, Human
gcaugugggagggucuucccac

SEQ ID NO: 68006 - RNA, 22 nt, Human
gcauguguaugguaggaauauu

SEQ ID NO: 68007 - RNA, 22 nt, Human
gcaugugucccucagucugugc

SEQ ID NO: 68008 - RNA, 22 nt, Human
gcaugugucuccccaguggagg

SEQ ID NO: 68009 - RNA, 22 nt, Human
gcauguguggaggagaugugcu

SEQ ID NO: 68010 - RNA, 21 nt, Human
gcaugugugggacuggauccu

SEQ ID NO: 68011 - RNA, 22 nt, Human
gcauuaauguaagacccacucc

SEQ ID NO: 68012 - RNA, 22 nt, Human
gcauuagagcccaucaccugua

SEQ ID NO: 68013 - RNA, 22 nt, Human
gcauuagauauccuugaaguua

SEQ ID NO: 68014 - RNA, 22 nt, Human
gcauucauauggaaggaaacua

SEQ ID NO: 68015 - RNA, 22 nt, Human
gcauucaucuaguaucacucug

SEQ ID NO: 68016 - RNA, 18 nt, Human
gcauucuguuaaugugga

SEQ ID NO: 68017 - RNA, 22 nt, Human
gcauucuucacuaggugagagc

SEQ ID NO: 68018 - RNA, 22 nt, Human
gcauucuucgaaguaaguagug

SEQ ID NO: 68019 - RNA, 22 nt, Human
gcauucuugguaugaaggacag

SEQ ID NO: 68020 - RNA, 22 nt, Human
gcauucuuuccacgaggaggua

SEQ ID NO: 68021 - RNA, 22 nt, Human
gcauucuuuuugacuccugguu

SEQ ID NO: 68022 - RNA, 22 nt, Human
gcauugaauccuaucaggcaaa

SEQ ID NO: 68023 - RNA, 22 nt, Human
gcauugauucugaagugaaaug

SEQ ID NO: 68024 - RNA, 22 nt, Human
gcauuggcauuucuccagcgga

SEQ ID NO: 68025 - RNA, 22 nt, Human
gcauugguuaagagcuuugggg

SEQ ID NO: 68026 - RNA, 23 nt, Human
gcauugucuccccacuucugggc

SEQ ID NO: 68027 - RNA, 22 nt, Human
gcauuuagcuuuaaaauauuuc

SEQ ID NO: 68028 - RNA, 22 nt, Human
gcauuuauauucuguucggaua

SEQ ID NO: 68029 - RNA, 22 nt, Human
gcauuucagaaagguuaccaac

SEQ ID NO: 68030 - RNA, 22 nt, Human
gcauuucagaagcaugcccucu

SEQ ID NO: 68031 - RNA, 19 nt, Human
gcauuucaggcauguuugc

SEQ ID NO: 68032 - RNA, 22 nt, Human
gcauuucauguagauugagaac

SEQ ID NO: 68033 - RNA, 19 nt, Human
gcauuucauuuaaccauca

SEQ ID NO: 68034 - RNA, 19 nt, Human
gcauuucucuuuacagcca

SEQ ID NO: 68035 - RNA, 22 nt, Human
gcauuucuuccuggugugagcc

SEQ ID NO: 68036 - RNA, 22 nt, Human
gcauuugaaaugcaagaaagug

SEQ ID NO: 68037 - RNA, 22 nt, Human
gcauuugagcacauuuuaaaga

SEQ ID NO: 68038 - RNA, 22 nt, Human
gcauuuguguggcggaaggauu

SEQ ID NO: 68039 - RNA, 22 nt, Human
gcauuuguguucuuccuagagc

SEQ ID NO: 68040 - RNA, 22 nt, Human
gcauuuuaauaagauucauagg

SEQ ID NO: 68041 - RNA, 22 nt, Human
gccaaagcccaggagacagcca

SEQ ID NO: 68042 - RNA, 22 nt, Human
gccaaagugcugcucuuuacca

SEQ ID NO: 68043 - RNA, 22 nt, Human
gccaaaucacagggccaaaagc

SEQ ID NO: 68044 - RNA, 22 nt, Human
gccaaaucuugcacacucuugu

SEQ ID NO: 68045 - RNA, 22 nt, Human
gccaacagcugggugcaugucc

SEQ ID NO: 68046 - RNA, 22 nt, Human
gccaacaggccuugcucugcuc

SEQ ID NO: 68047 - RNA, 20 nt, Human
gccaacgcgcuggggcugcc

SEQ ID NO: 68048 - RNA, 22 nt, Human
gccaagaaagaacagcagggaa

SEQ ID NO: 68049 - RNA, 22 nt, Human
gccaagaaaugccccucacaga

SEQ ID NO: 68050 - RNA, 22 nt, Human
gccaagaagguggggacaugca

SEQ ID NO: 68051 - RNA, 22 nt, Human
gccaagagaaugugagagaaau

SEQ ID NO: 68052 - RNA, 22 nt, Human
gccaagcuuauaugaugcuuga

SEQ ID NO: 68053 - RNA, 22 nt, Human
gccaagcuuggaaggaucaugg

SEQ ID NO: 68054 - RNA, 22 nt, Human
gccaaggagacacgguguugua

SEQ ID NO: 68055 - RNA, 20 nt, Human
gccaaggaggagaaacaggc

SEQ ID NO: 68056 - RNA, 22 nt, Human
gccaaggccugcagcaccucau

SEQ ID NO: 68057 - RNA, 22 nt, Human
gccaagggaacugagccggagg

SEQ ID NO: 68058 - RNA, 23 nt, Human
gccaauuuaguaaaggcaguggg

SEQ ID NO: 68059 - RNA, 22 nt, Human
gccacacugcuucuuugagccu

SEQ ID NO: 68060 - RNA, 22 nt, Human
gccacagcaacaauaaugcagc

SEQ ID NO: 68061 - RNA, 22 nt, Human
gccacagccucugggaaaacuc

SEQ ID NO: 68062 - RNA, 22 nt, Human
gccacagcucacguuccccauu

SEQ ID NO: 68063 - RNA, 22 nt, Human
gccacagcuuuuaaccucgggg

SEQ ID NO: 68064 - RNA, 22 nt, Human
gccacaggaaagcacccuggag

SEQ ID NO: 68065 - RNA, 22 nt, Human
gccacaggcacuuaagggcugg

SEQ ID NO: 68066 - RNA, 22 nt, Human
gccacaggcuuaggagggaggu

SEQ ID NO: 68067 - RNA, 22 nt, Human
gccacagguggaauuaagaaau

SEQ ID NO: 68068 - RNA, 22 nt, Human
gccacagucaggacggggagag

SEQ ID NO: 68069 - RNA, 22 nt, Human
gccacagugggcuggggccaga

SEQ ID NO: 68070 - RNA, 22 nt, Human
gccacaugucaugugcucagua

SEQ ID NO: 68071 - RNA, 22 nt, Human
gccaccauguagcccauuagag

SEQ ID NO: 68072 - RNA, 22 nt, Human
gccacccugacgccgcagaccc

SEQ ID NO: 68073 - RNA, 22 nt, Human
gccacccugcaaaugcccagga

SEQ ID NO: 68074 - RNA, 21 nt, Human
gccauguuuccuuacuaagag

SEQ ID NO: 68075 - RNA, 22 nt, Human
gccauugaugugaaaguaagac

SEQ ID NO: 68076 - RNA, 22 nt, Human
gccauugggcuguaguuuuuug

SEQ ID NO: 68077 - RNA, 22 nt, Human
gccauuuggcaaaacugacuuc

SEQ ID NO: 68078 - RNA, 22 nt, Human
gcccaaagagcuuugaucucag

SEQ ID NO: 68079 - RNA, 22 nt, Human
gcccaaagccagugugcucucc

SEQ ID NO: 68080 - RNA, 22 nt, Human
gcccaaagucacucagcuagga

SEQ ID NO: 68081 - RNA, 22 nt, Human
gcccaagaucaguggggcagau

SEQ ID NO: 68082 - RNA, 22 nt, Human
gcccaagcagcuucccgagcuu

SEQ ID NO: 68083 - RNA, 22 nt, Human
gcccaagccggagcugggagag

SEQ ID NO: 68084 - RNA, 22 nt, Human
gcccaagcuggacugcaguggc

SEQ ID NO: 68085 - RNA, 22 nt, Human
gcccaagguauaucagagacag

SEQ ID NO: 68086 - RNA, 22 nt, Human
gcccaaggucccauggcagcac

SEQ ID NO: 68087 - RNA, 22 nt, Human
gcccacacaccagcucaggagg

SEQ ID NO: 68088 - RNA, 22 nt, Human
gcccacacagcagauccuuugg

SEQ ID NO: 68089 - RNA, 22 nt, Human
gcccacaccauuuauucuuugu

SEQ ID NO: 68090 - RNA, 22 nt, Human
gcccacaggggaccugguggcu

SEQ ID NO: 68091 - RNA, 22 nt, Human
gcccacagucuaucaguuugcg

SEQ ID NO: 68092 - RNA, 21 nt, Human
gcccacagugaggaggauccc

SEQ ID NO: 68093 - RNA, 22 nt, Human
gcccacaguguagcagguacuc

SEQ ID NO: 68094 - RNA, 22 nt, Human
gcccacaguuaguuugcauggc

SEQ ID NO: 68095 - RNA, 22 nt, Human
gcccacucuggagccuguuccc

SEQ ID NO: 68096 - RNA, 22 nt, Human
gcccacugagugacucccucag

SEQ ID NO: 68097 - RNA, 22 nt, Human
gcccagaaagacugccuaacag

SEQ ID NO: 68098 - RNA, 22 nt, Human
gcccagaaagcaucauugugga

SEQ ID NO: 68099 - RNA, 21 nt, Human
gcccagaagacuggcucugcc

SEQ ID NO: 68100 - RNA, 18 nt, Human
gcccagagcccucuuauu

SEQ ID NO: 68101 - RNA, 22 nt, Human
gcccagagugaguccugggccc

SEQ ID NO: 68102 - RNA, 22 nt, Human
gcccagcaccucucucaggguu

SEQ ID NO: 68103 - RNA, 22 nt, Human
gcccagcacuaaaagcuuugcu

SEQ ID NO: 68104 - RNA, 22 nt, Human
gcccagcuccucugcagacccu

SEQ ID NO: 68105 - RNA, 22 nt, Human
gcccagcugucuggcagggaug

SEQ ID NO: 68106 - RNA, 22 nt, Human
gcccaggaaaugccccguggug

SEQ ID NO: 68107 - RNA, 22 nt, Human
gcccaggaagccaccgggaagu

SEQ ID NO: 68108 - RNA, 22 nt, Human
gcccaggaagugacucagaugu

SEQ ID NO: 68109 - RNA, 22 nt, Human
gcccaggaggcagagguugugg

SEQ ID NO: 68110 - RNA, 20 nt, Human
gccagcacagggagcaguuc

SEQ ID NO: 68111 - RNA, 22 nt, Human
gccagcagcgagaguuuaaccu

SEQ ID NO: 68112 - RNA, 22 nt, Human
gccagcagggcccaaaugcugg

SEQ ID NO: 68113 - RNA, 22 nt, Human
gccagcaguauguccuggcagu

SEQ ID NO: 68114 - RNA, 22 nt, Human
gccagccaagauugagaaggua

SEQ ID NO: 68115 - RNA, 23 nt, Human
gccagccagaauuucuccacugu

SEQ ID NO: 68116 - RNA, 22 nt, Human
gccagccagaguccaucugaga

SEQ ID NO: 68117 - RNA, 22 nt, Human
gccagccaguuugcugauggcu

SEQ ID NO: 68118 - RNA, 20 nt, Human
gccagcccugacacaggagc

SEQ ID NO: 68119 - RNA, 23 nt, Human
gccagccuugcucuccugcagcc

SEQ ID NO: 68120 - RNA, 22 nt, Human
gccagcugaagcccugguggaa

SEQ ID NO: 68121 - RNA, 22 nt, Human
gccagcugaagggaagcuccug

SEQ ID NO: 68122 - RNA, 22 nt, Human
gccagcugaauuuccaacuguu

SEQ ID NO: 68123 - RNA, 22 nt, Human
gccagcugccaaguugugagau

SEQ ID NO: 68124 - RNA, 22 nt, Human
gccagcugcuggaacagcgcga

SEQ ID NO: 68125 - RNA, 22 nt, Human
gccagcugggccuuagggcugg

SEQ ID NO: 68126 - RNA, 22 nt, Human
gccagcugguaggcaccuagcc

SEQ ID NO: 68127 - RNA, 22 nt, Human
gccagcuguaagcuggggugau

SEQ ID NO: 68128 - RNA, 22 nt, Human
gccagcuguaggugguggguug

SEQ ID NO: 68129 - RNA, 22 nt, Human
gccagcuuuggcacaggguggu

SEQ ID NO: 68130 - RNA, 22 nt, Human
gccaggaaaaacguggugggag

SEQ ID NO: 68131 - RNA, 22 nt, Human
gccaggaaaagaagcuggugcu

SEQ ID NO: 68132 - RNA, 22 nt, Human
gccaggaaagcaaaaucaccca

SEQ ID NO: 68133 - RNA, 22 nt, Human
gccaggaaagccacuggcauac

SEQ ID NO: 68134 - RNA, 18 nt, Human
gccaggaagaggaaugug

SEQ ID NO: 68135 - RNA, 22 nt, Human
gccaggaagugcagcccugcca

SEQ ID NO: 68136 - RNA, 22 nt, Human
gccaggaauggagagguggccu

SEQ ID NO: 68137 - RNA, 22 nt, Human
gccaggaggcuuaacuggacag

SEQ ID NO: 68138 - RNA, 19 nt, Human
gccaggagggcucuggcug

SEQ ID NO: 68139 - RNA, 22 nt, Human
gccaggcaaauuaaggaaugca

SEQ ID NO: 68140 - RNA, 22 nt, Human
gccaggcaauguguuagaagcg

SEQ ID NO: 68141 - RNA, 22 nt, Human
gccaggcagcaggaagccagug

SEQ ID NO: 68142 - RNA, 22 nt, Human
gccaggcagccacccucugcga

SEQ ID NO: 68143 - RNA, 22 nt, Human
gccaggcaggccacgcuguguu

SEQ ID NO: 68144 - RNA, 22 nt, Human
gccaggcaggugucggagcccu

SEQ ID NO: 68145 - RNA, 22 nt, Human
gccaggcaugggcuucugggcg

SEQ ID NO: 68146 - RNA, 22 nt, Human
gccaggcauuuauugauugaau

SEQ ID NO: 68147 - RNA, 22 nt, Human
gccaggcuccaggcccuccuga

SEQ ID NO: 68148 - RNA, 19 nt, Human
gccaggcuccauagccggc

SEQ ID NO: 68149 - RNA, 23 nt, Human
gccaggcuccggucuguggccac

SEQ ID NO: 68150 - RNA, 22 nt, Human
gccaggcucucagugacugccc

SEQ ID NO: 68151 - RNA, 22 nt, Human
gccaggcucuugguuauguuuu

SEQ ID NO: 68152 - RNA, 22 nt, Human
gccaggcuggcaaaaggaaacc

SEQ ID NO: 68153 - RNA, 22 nt, Human
gccaggcuggccagcaccuucu

SEQ ID NO: 68154 - RNA, 22 nt, Human
gccaggcuggugcaaggauauu

SEQ ID NO: 68155 - RNA, 22 nt, Human
gccagggaggcuguaggguccu

SEQ ID NO: 68156 - RNA, 22 nt, Human
gccagggcaggggagcaucugc

SEQ ID NO: 68157 - RNA, 22 nt, Human
gccagggcucgcggucccucgu

SEQ ID NO: 68158 - RNA, 22 nt, Human
gccagggcugugcagguuuguu

SEQ ID NO: 68159 - RNA, 22 nt, Human
gccagggggucagcaggcacuu

SEQ ID NO: 68160 - RNA, 22 nt, Human
gccaggguccugaagaccaagu

SEQ ID NO: 68161 - RNA, 22 nt, Human
gccaggguugccaaugggggca

SEQ ID NO: 68162 - RNA, 22 nt, Human
gccagguccccucauggcuccu

SEQ ID NO: 68163 - RNA, 20 nt, Human
gccaguaccauucugccacu

SEQ ID NO: 68164 - RNA, 22 nt, Human
gccaguggcccucuggagaagg

SEQ ID NO: 68165 - RNA, 22 nt, Human
gccaguggugagauucccuggg

SEQ ID NO: 68166 - RNA, 22 nt, Human
gccagugugcaagaaaacagaa

SEQ ID NO: 68167 - RNA, 22 nt, Human
gccaguuccuguggagucagag

SEQ ID NO: 68168 - RNA, 22 nt, Human
gccauaaauugcuggucaaaau

SEQ ID NO: 68169 - RNA, 22 nt, Human
gccaucaucaagaauguacagc

SEQ ID NO: 68170 - RNA, 22 nt, Human
gccauccucugagcacuaggca

SEQ ID NO: 68171 - RNA, 22 nt, Human
gccaugcauccuuggacuuggc

SEQ ID NO: 68172 - RNA, 22 nt, Human
gccaugcuugguaugcugugag

SEQ ID NO: 68173 - RNA, 22 nt, Human
gccauggggacuucauggauuu

SEQ ID NO: 68174 - RNA, 22 nt, Human
gccauggggcucagcugcacua

SEQ ID NO: 68175 - RNA, 22 nt, Human
gccaugggucugcuggcucagc

SEQ ID NO: 68176 - RNA, 22 nt, Human
gccauuaaugugaaggaaggaa

SEQ ID NO: 68177 - RNA, 22 nt, Human
gccauuuugaaaaccguugcua

SEQ ID NO: 68178 - RNA, 22 nt, Human
gcccaagaucuggagcugcagg

SEQ ID NO: 68179 - RNA, 20 nt, Human
gcccaagcgccggccgcaga

SEQ ID NO: 68180 - RNA, 22 nt, Human
gcccaagcuccgccuccugucg

SEQ ID NO: 68181 - RNA, 22 nt, Human
gcccacagaggcaccaccaggc

SEQ ID NO: 68182 - RNA, 22 nt, Human
gcccacagguccuaccucuuuc

SEQ ID NO: 68183 - RNA, 22 nt, Human
gcccacaguacgaggcucaggc

SEQ ID NO: 68184 - RNA, 22 nt, Human
gcccacaguuaaugggggcucu

SEQ ID NO: 68185 - RNA, 17 nt, Human
gcccacccuuaggagcu

SEQ ID NO: 68186 - RNA, 22 nt, Human
gcccacuccagcuucucccaca

SEQ ID NO: 68187 - RNA, 22 nt, Human
gcccacuggcuggagugcuggu

SEQ ID NO: 68188 - RNA, 22 nt, Human
gcccagaaaugaacuugcugug

SEQ ID NO: 68189 - RNA, 22 nt, Human
gcccagagagaugaagugaugg

SEQ ID NO: 68190 - RNA, 22 nt, Human
gcccagagggaagaggugucau

SEQ ID NO: 68191 - RNA, 22 nt, Human
gcccugucggaacugcgaccuc

SEQ ID NO: 68192 - RNA, 20 nt, Human
gcccugugaugucuugaccu

SEQ ID NO: 68193 - RNA, 22 nt, Human
gcccugugcgcugaguucaggg

SEQ ID NO: 68194 - RNA, 22 nt, Human
gcccuguggacccaggaacucu

SEQ ID NO: 68195 - RNA, 22 nt, Human
gcccuguggauuaaugagcagg

SEQ ID NO: 68196 - RNA, 22 nt, Human
gcccuguuuucuggguuccuug

SEQ ID NO: 68197 - RNA, 22 nt, Human
gcccuuagccuuauagccucua

SEQ ID NO: 68198 - RNA, 22 nt, Human
gcccuucaguuacuccuugaug

SEQ ID NO: 68199 - RNA, 22 nt, Human
gcccuuccaacccagagggcaa

SEQ ID NO: 68200 - RNA, 22 nt, Human
gcccuugacaguggcagaagca

SEQ ID NO: 68201 - RNA, 22 nt, Human
gcccuuggaacagccuccugcu

SEQ ID NO: 68202 - RNA, 22 nt, Human
gcccuuggaagcggcagguagc

SEQ ID NO: 68203 - RNA, 22 nt, Human
gccgaagacgcugggcgugggc

SEQ ID NO: 68204 - RNA, 22 nt, Human
gccgcggcauggcgagcaggac

SEQ ID NO: 68205 - RNA, 22 nt, Human
gccgggcccugaccucagaguu

SEQ ID NO: 68206 - RNA, 22 nt, Human
gccgugcgugcgcaggugcugu

SEQ ID NO: 68207 - RNA, 22 nt, Human
gccguuauucugcuggccccgg

SEQ ID NO: 68208 - RNA, 22 nt, Human
gccuaagauuguguuuuccuga

SEQ ID NO: 68209 - RNA, 22 nt, Human
gccuaauaugcaaaauugauac

SEQ ID NO: 68210 - RNA, 22 nt, Human
gccuagagaagcuuacugaagc

SEQ ID NO: 68211 - RNA, 22 nt, Human
gccuaggaguacagaaugguuu

SEQ ID NO: 68212 - RNA, 20 nt, Human
gccuagggguugggaaagca

SEQ ID NO: 68213 - RNA, 22 nt, Human
gccuaggguuggccugagaauc

SEQ ID NO: 68214 - RNA, 22 nt, Human
gccuagugcacuggcagggcuc

SEQ ID NO: 68215 - RNA, 22 nt, Human
gccucacagacugacugaaagc

SEQ ID NO: 68216 - RNA, 21 nt, Human
gccucaccaugucaagccagg

SEQ ID NO: 68217 - RNA, 22 nt, Human
gccucacugcagccccaggaag

SEQ ID NO: 68218 - RNA, 22 nt, Human
gccucagaaagcuuuuauucau

SEQ ID NO: 68219 - RNA, 19 nt, Human
uacauacuuauucuaaaag

SEQ ID NO: 68220 - RNA, 22 nt, Human
uacauagaacauguuuaauguc

SEQ ID NO: 68221 - RNA, 22 nt, Human
uacauagaauauuucacuuaaa

SEQ ID NO: 68222 - RNA, 22 nt, Human
uacauaguuccauuuacaggaa

SEQ ID NO: 68223 - RNA, 20 nt, Human
uacauauuauaucagcugca

SEQ ID NO: 68224 - RNA, 22 nt, Human
uacauauuguccauaguugcuu

SEQ ID NO: 68225 - RNA, 22 nt, Human
uacaucaaaucaauguuccagu

SEQ ID NO: 68226 - RNA, 21 nt, Human
uacaucaguuuucuuggcuca

SEQ ID NO: 68227 - RNA, 22 nt, Human
uacaucauaauaauacuuagaa

SEQ ID NO: 68228 - RNA, 22 nt, Human
uacaucaugaaagcauacauca

SEQ ID NO: 68229 - RNA, 22 nt, Human
uacaucccagccagcagaauca

SEQ ID NO: 68230 - RNA, 18 nt, Human
uacaucuauauaguguuu

SEQ ID NO: 68231 - RNA, 22 nt, Human
uacaucugauuuaccuacugaa

SEQ ID NO: 68232 - RNA, 22 nt, Human
uacaugaaguugucuaaacugg

SEQ ID NO: 68233 - RNA, 22 nt, Human
uacaugcaugucacagaaugaa

SEQ ID NO: 68234 - RNA, 22 nt, Human
gcucaggcaggagugcaguggc

SEQ ID NO: 68235 - RNA, 23 nt, Human
gcucaggcaucauucuuccuggc

SEQ ID NO: 68236 - RNA, 18 nt, Human
gcucaggcccuagucagu

SEQ ID NO: 68237 - RNA, 22 nt, Human
gcucaggccucggacacacaau

SEQ ID NO: 68238 - RNA, 20 nt, Human
gcucagggaauucaggaagc

SEQ ID NO: 68239 - RNA, 22 nt, Human
gcucagggccauggaccagcag

SEQ ID NO: 68240 - RNA, 20 nt, Human
gcucagggccugggucugga

SEQ ID NO: 68241 - RNA, 22 nt, Human
gcucaggggaaugggcugccgu

SEQ ID NO: 68242 - RNA, 18 nt, Human
gcucagguauagacaggg

SEQ ID NO: 68243 - RNA, 20 nt, Human
gcucaggugacagucaggag

SEQ ID NO: 68244 - RNA, 23 nt, Human
gcucagguggcucagggacugau

SEQ ID NO: 68245 - RNA, 20 nt, Human
gcucaguggagaaaugcacc

SEQ ID NO: 68246 - RNA, 22 nt, Human
gcucagugguauucggaaacug

SEQ ID NO: 68247 - RNA, 21 nt, Human
gcucaugguggagaaaagcag

SEQ ID NO: 68248 - RNA, 22 nt, Human
gcuccaaaguacagugacuuac

SEQ ID NO: 68249 - RNA, 22 nt, Human
gcuccaaaguccagcuguuucc

SEQ ID NO: 68250 - RNA, 22 nt, Human
gcuccacuugcagcuaggcuug

SEQ ID NO: 68251 - RNA, 21 nt, Human
gcuccagaacucuaugcuaac

SEQ ID NO: 68252 - RNA, 22 nt, Human
gcuccagaugaaaggccagagg

SEQ ID NO: 68253 - RNA, 22 nt, Human
gcuccagcuccggcuccgaagc

SEQ ID NO: 68254 - RNA, 22 nt, Human
gcuccaggagcucacagcucgc

SEQ ID NO: 68255 - RNA, 22 nt, Human
gcuccaggccccagcguuccgc

SEQ ID NO: 68256 - RNA, 22 nt, Human
gcuccagggaguacauuuauca

SEQ ID NO: 68257 - RNA, 22 nt, Human
gcuccaggguggaugacaauuc

SEQ ID NO: 68258 - RNA, 22 nt, Human
gcucccaccuuugcuaucagua

SEQ ID NO: 68259 - RNA, 22 nt, Human
gcucccagacugaccagaggug

SEQ ID NO: 68260 - RNA, 20 nt, Human
gcucccagccugcagucccc

SEQ ID NO: 68261 - RNA, 22 nt, Human
gcucccagcuggagccucaaca

SEQ ID NO: 68262 - RNA, 22 nt, Human
gcucccagggacacuggccacu

SEQ ID NO: 68263 - RNA, 22 nt, Human
gcucccagguucuugggccuug

SEQ ID NO: 68264 - RNA, 22 nt, Human
gcuccccagcuuagcccuggcu

SEQ ID NO: 68265 - RNA, 20 nt, Human
gcuccccuucucugggccuc

SEQ ID NO: 68266 - RNA, 22 nt, Human
gcucccuccaugaggcagaccg

SEQ ID NO: 68267 - RNA, 22 nt, Human
gcucccucugcucaggcacuug

SEQ ID NO: 68268 - RNA, 22 nt, Human
gcucccugcacucugcagcccu

SEQ ID NO: 68269 - RNA, 22 nt, Human
gcucccugcagcugagaguucc

SEQ ID NO: 68270 - RNA, 22 nt, Human
gcucccuggaauguuggcugcc

SEQ ID NO: 68271 - RNA, 20 nt, Human
gcucccugguagaaauguuu

SEQ ID NO: 68272 - RNA, 22 nt, Human
gcucccugguauugcugccacu

SEQ ID NO: 68273 - RNA, 22 nt, Human
gcucccugugcucugagugaua

SEQ ID NO: 68274 - RNA, 22 nt, Human
gcucccuguucucagccaugau

SEQ ID NO: 68275 - RNA, 22 nt, Human
gcuccgugggcauugcuaggug

SEQ ID NO: 68276 - RNA, 22 nt, Human
gcuccucugucaaaugagagug

SEQ ID NO: 68277 - RNA, 22 nt, Human
gcuccucuucucccacugaaug

SEQ ID NO: 68278 - RNA, 22 nt, Human
gcuccugcagagauguuccaug

SEQ ID NO: 68279 - RNA, 17 nt, Human
gcuccugcaggucagga

SEQ ID NO: 68280 - RNA, 22 nt, Human
gcuccuggagagauugagaaag

SEQ ID NO: 68281 - RNA, 22 nt, Human
gcuccuggcauccugcuuuuaa

SEQ ID NO: 68282 - RNA, 22 nt, Human
gcuccugucaucaaacaauccu

SEQ ID NO: 68283 - RNA, 22 nt, Human
gcuccugucuuggggcacuggc

SEQ ID NO: 68284 - RNA, 22 nt, Human
gcucggccccgacggccggcgg

SEQ ID NO: 68285 - RNA, 21 nt, Human
gcucuaagcuuugggaagaau

SEQ ID NO: 68286 - RNA, 22 nt, Human
gcucuagcaaggcuggccuggg

SEQ ID NO: 68287 - RNA, 22 nt, Human
gcucuaugucgaaagccaguua

SEQ ID NO: 68288 - RNA, 22 nt, Human
gcucuauuacuuucaauaaaaa

SEQ ID NO: 68289 - RNA, 22 nt, Human
gcucucaaguccuuuugcucag

SEQ ID NO: 68290 - RNA, 22 nt, Human
gcucucagaugcuccagcagcc

SEQ ID NO: 68291 - RNA, 22 nt, Human
gcucuccacugaccacggggca

SEQ ID NO: 68292 - RNA, 21 nt, Human
gcucuccagggccagcccagg

SEQ ID NO: 68293 - RNA, 22 nt, Human
gcucuccaggucucaugcacug

SEQ ID NO: 68294 - RNA, 22 nt, Human
gcucucccgcagccuggugggc

SEQ ID NO: 68295 - RNA, 22 nt, Human
gcucucucgugaacaggugguu

SEQ ID NO: 68296 - RNA, 22 nt, Human
gcucucucuuggggauucagca

SEQ ID NO: 68297 - RNA, 22 nt, Human
gcucucugaggugcuggcagag

SEQ ID NO: 68298 - RNA, 22 nt, Human
gcucucugcagccuccuuggag

SEQ ID NO: 68299 - RNA, 22 nt, Human
gcucucugccuuucucaaugac

SEQ ID NO: 68300 - RNA, 22 nt, Human
gcucucuggaggccauggacag

SEQ ID NO: 68301 - RNA, 22 nt, Human
gcucucuguuauuaagaucuuu

SEQ ID NO: 68302 - RNA, 22 nt, Human
gcucucuuugugccacuuaagg

SEQ ID NO: 68303 - RNA, 22 nt, Human
gcucugaacuuccaccuuuuca

SEQ ID NO: 68304 - RNA, 22 nt, Human
gcucugaaucaaucagauaagg

SEQ ID NO: 68305 - RNA, 22 nt, Human
gcucugagagagcaaagucacc

SEQ ID NO: 68306 - RNA, 22 nt, Human
gcucugagaucauucacuguaa

SEQ ID NO: 68307 - RNA, 22 nt, Human
gcucugagcugucuugcagguc

SEQ ID NO: 68308 - RNA, 22 nt, Human
gcucugaggcugugaggugcug

SEQ ID NO: 68309 - RNA, 22 nt, Human
gcucugccaaggacccauucuc

SEQ ID NO: 68310 - RNA, 22 nt, Human
gcucugcccaggaccguccuug

SEQ ID NO: 68311 - RNA, 17 nt, Human
gcucugccccagccucu

SEQ ID NO: 68312 - RNA, 22 nt, Human
gcucugccuccccuaguguuac

SEQ ID NO: 68313 - RNA, 22 nt, Human
gcucugccucuuugcugcguca

SEQ ID NO: 68314 - RNA, 22 nt, Human
gcucugccuggucgcgugcugg

SEQ ID NO: 68315 - RNA, 22 nt, Human
gcucugcugacagcugggacag

SEQ ID NO: 68316 - RNA, 22 nt, Human
gcucugcuggagggaaagagaa

SEQ ID NO: 68317 - RNA, 22 nt, Human
gcucuggacccuggaguggcug

SEQ ID NO: 68318 - RNA, 22 nt, Human
gcucuggagagccauaggcccu

SEQ ID NO: 68319 - RNA, 22 nt, Human
gcucuggccagacccucagugg

SEQ ID NO: 68320 - RNA, 22 nt, Human
gcucuggcccaaacccuuucua

SEQ ID NO: 68321 - RNA, 22 nt, Human
gcucuggcuacuguggcuaccg

SEQ ID NO: 68322 - RNA, 22 nt, Human
gcucuggcucaaaccaccggcu

SEQ ID NO: 68323 - RNA, 18 nt, Human
gcucuggcucaccuccag

SEQ ID NO: 68324 - RNA, 20 nt, Human
gcucugggagggaugugaug

SEQ ID NO: 68325 - RNA, 22 nt, Human
gcucugggguuggaaagugauc

SEQ ID NO: 68326 - RNA, 22 nt, Human
gcucuggguucugauuuaugag

SEQ ID NO: 68327 - RNA, 22 nt, Human
gcucugguaccagcuacuccua

SEQ ID NO: 68328 - RNA, 22 nt, Human
gcucugguggugaucagacgcu

SEQ ID NO: 68329 - RNA, 17 nt, Human
gcugccaccuuuggagc

SEQ ID NO: 68330 - RNA, 22 nt, Human
gcugccagaagaggagggguua

SEQ ID NO: 68331 - RNA, 22 nt, Human
gcugccagcacaguucagcugu

SEQ ID NO: 68332 - RNA, 22 nt, Human
gcugccagcucacucuccugag

SEQ ID NO: 68333 - RNA, 22 nt, Human
gcugccaguaguuggagcucca

SEQ ID NO: 68334 - RNA, 22 nt, Human
gcugccaguuccuucuuacucc

SEQ ID NO: 68335 - RNA, 22 nt, Human
gcugccaugguccaggcuccag

SEQ ID NO: 68336 - RNA, 22 nt, Human
gcugccauguugugaggacacu

SEQ ID NO: 68337 - RNA, 22 nt, Human
gcugccauuaugggaacgagaa

SEQ ID NO: 68338 - RNA, 22 nt, Human
gcugcccaauuacagggccgug

SEQ ID NO: 68339 - RNA, 22 nt, Human
gcugcccacaaccccgugucua

SEQ ID NO: 68340 - RNA, 22 nt, Human
gcugcccacaaugauuacaugg

SEQ ID NO: 68341 - RNA, 22 nt, Human
gcugcccaggguggagccggcu

SEQ ID NO: 68342 - RNA, 22 nt, Human
gcugcccaguucugcugcugcc

SEQ ID NO: 68343 - RNA, 22 nt, Human
gcugcccauugcacguuguggc

SEQ ID NO: 68344 - RNA, 18 nt, Human
gcugcccuagcuccccuc

SEQ ID NO: 68345 - RNA, 22 nt, Human
gcugcccucuguguuuguccuu

SEQ ID NO: 68346 - RNA, 22 nt, Human
gcugcccugacaagcuacuccc

SEQ ID NO: 68347 - RNA, 22 nt, Human
gcugcccugacuccagcagccu

SEQ ID NO: 68348 - RNA, 22 nt, Human
gcugcccuguccggcucuccug

SEQ ID NO: 68349 - RNA, 22 nt, Human
gcugcccuguuuagccaggguu

SEQ ID NO: 68350 - RNA, 22 nt, Human
gcugcccuucgucaucuauaaa

SEQ ID NO: 68351 - RNA, 22 nt, Human
gcugccguuggcucuucaggcc

SEQ ID NO: 68352 - RNA, 22 nt, Human
gcugccugcucacccggccugg

SEQ ID NO: 68353 - RNA, 22 nt, Human
gcugccuggagcucagccugcc

SEQ ID NO: 68354 - RNA, 22 nt, Human
gcugccugggcaggaggcgcug

SEQ ID NO: 68355 - RNA, 16 nt, Human
gcuggagggagggguu

SEQ ID NO: 68356 - RNA, 22 nt, Human
gcuggagguagggagguccugu

SEQ ID NO: 68357 - RNA, 22 nt, Human
gcuggaguaggaccaugcuuga

SEQ ID NO: 68358 - RNA, 22 nt, Human
gcuggaguccagugguaugauc

SEQ ID NO: 68359 - RNA, 22 nt, Human
gcuggagucccugccuuuccuu

SEQ ID NO: 68360 - RNA, 16 nt, Human
gcuggaguccuggagc

SEQ ID NO: 68361 - RNA, 22 nt, Human
gcuggagugcugaggugcagug

SEQ ID NO: 68362 - RNA, 22 nt, Human
gcuggaguuguggguuuacuaa

SEQ ID NO: 68363 - RNA, 22 nt, Human
gcuggaucaaguccuucaccca

SEQ ID NO: 68364 - RNA, 19 nt, Human
gcuggauggauccuggagu

SEQ ID NO: 68365 - RNA, 22 nt, Human
gcuggauuggagcaauagaguc

SEQ ID NO: 68366 - RNA, 22 nt, Human
gcuggcaccugcaccaagcagg

SEQ ID NO: 68367 - RNA, 22 nt, Human
gcuggcagaauuucuucuugcu

SEQ ID NO: 68368 - RNA, 19 nt, Human
gcuggcagauguggccgug

SEQ ID NO: 68369 - RNA, 22 nt, Human
gcuggcagccaagugaagaggg

SEQ ID NO: 68370 - RNA, 22 nt, Human
gcuggcagcuggaaguugggcu

SEQ ID NO: 68371 - RNA, 22 nt, Human
gcuggcaguaaaggguuuggca

SEQ ID NO: 68372 - RNA, 22 nt, Human
gcuggccagcccucuuccucca

SEQ ID NO: 68373 - RNA, 22 nt, Human
gcuggcccagcguggggccgug

SEQ ID NO: 68374 - RNA, 22 nt, Human
gcuggcccagggucaccuagga

SEQ ID NO: 68375 - RNA, 22 nt, Human
gcuggcccagugacccacagug

SEQ ID NO: 68376 - RNA, 22 nt, Human
gcuggccccgagugcuacgcuc

SEQ ID NO: 68377 - RNA, 22 nt, Human
gcuggccucaucacugacuucu

SEQ ID NO: 68378 - RNA, 22 nt, Human
gcuggccuccugcuagauggaa

SEQ ID NO: 68379 - RNA, 22 nt, Human
gcuggccucuacaggccggcca

SEQ ID NO: 68380 - RNA, 22 nt, Human
gcuggccugaccagccacaggc

SEQ ID NO: 68381 - RNA, 22 nt, Human
gcuggccugaccugaggcuggg

SEQ ID NO: 68382 - RNA, 22 nt, Human
gcuggccugucuagagccuuac

SEQ ID NO: 68383 - RNA, 22 nt, Human
gcuggccuugaggugucuuuau

SEQ ID NO: 68384 - RNA, 21 nt, Human
gcuggcucaaaugcuuguguc

SEQ ID NO: 68385 - RNA, 22 nt, Human
gcuggcucagggacuagaguuu

SEQ ID NO: 68386 - RNA, 22 nt, Human
gcuggcucagggggauuagcaa

SEQ ID NO: 68387 - RNA, 22 nt, Human
gcuggcucugccccaccuguuc

SEQ ID NO: 68388 - RNA, 22 nt, Human
gcuggcucuucaguggagauag

SEQ ID NO: 68389 - RNA, 22 nt, Human
gcuggcucuuuuugccgggcuc

SEQ ID NO: 68390 - RNA, 17 nt, Human
gcuggcugacccaugcc

SEQ ID NO: 68391 - RNA, 18 nt, Human
gcuggcugcacuucugcu

SEQ ID NO: 68392 - RNA, 22 nt, Human
gcuggcugcgucaucacagggc

SEQ ID NO: 68393 - RNA, 22 nt, Human
gcuggcuggaugguugguucgc

SEQ ID NO: 68394 - RNA, 22 nt, Human
gcuggcugugggcuccacgcuc

SEQ ID NO: 68395 - RNA, 22 nt, Human
gcuggcuucccuaccugcaccu

SEQ ID NO: 68396 - RNA, 21 nt, Human
gcuggcuuccugagggcugag

SEQ ID NO: 68397 - RNA, 18 nt, Human
gcuggcuugcuggguuug

SEQ ID NO: 68398 - RNA, 22 nt, Human
gcuggcuugucccaggacaaag

SEQ ID NO: 68399 - RNA, 21 nt, Human
gcuggcuuuccuggaugugca

SEQ ID NO: 68400 - RNA, 22 nt, Human
gcuggcuuugcacugggugcau

SEQ ID NO: 68401 - RNA, 22 nt, Human
gcugggaaccaugggaaggcag

SEQ ID NO: 68402 - RNA, 22 nt, Human
gcugggaagagaugcacaugau

SEQ ID NO: 68403 - RNA, 22 nt, Human
gcugggaaugauuuuggagagg

SEQ ID NO: 68404 - RNA, 22 nt, Human
gcugggacaacaggugagcacc

SEQ ID NO: 68405 - RNA, 22 nt, Human
gcugggacugagacagugaccu

SEQ ID NO: 68406 - RNA, 22 nt, Human
gcugggagcaaguacucaucuu

SEQ ID NO: 68407 - RNA, 19 nt, Human
gcugggagcagacccuccc

SEQ ID NO: 68408 - RNA, 22 nt, Human
gcugggaggaucucucccuguc

SEQ ID NO: 68409 - RNA, 16 nt, Human
gcugggagggagaggu

SEQ ID NO: 68410 - RNA, 22 nt, Human
gcugggagggaggcuauacccu

SEQ ID NO: 68411 - RNA, 22 nt, Human
gcugggcaacgggcagaaagau

SEQ ID NO: 68412 - RNA, 22 nt, Human
gcugggcacugucccauaggcu

SEQ ID NO: 68413 - RNA, 22 nt, Human
gcugggcagccccuacagagag

SEQ ID NO: 68414 - RNA, 22 nt, Human
gcugggcaggccucgugagggc

SEQ ID NO: 68415 - RNA, 22 nt, Human
gcugggcaugugaccaacagaa

SEQ ID NO: 68416 - RNA, 22 nt, Human
gcugggccagagcagcagcacu

SEQ ID NO: 68417 - RNA, 22 nt, Human
gcugggcucaccaggccacuag

SEQ ID NO: 68418 - RNA, 22 nt, Human
gcugggcucuuuaccccuguac

SEQ ID NO: 68419 - RNA, 22 nt, Human
gcugggcugcccaaccucugac

SEQ ID NO: 68420 - RNA, 22 nt, Human
gcugggcuucacagagccuuua

SEQ ID NO: 68421 - RNA, 22 nt, Human
gcugggcuugguuucccugcuu

SEQ ID NO: 68422 - RNA, 22 nt, Human
gcuggggagaauuggguuaucu

SEQ ID NO: 68423 - RNA, 22 nt, Human
gcuggggcugggcugaggaaga

SEQ ID NO: 68424 - RNA, 20 nt, Human
gcugggggugugcugaguga

SEQ ID NO: 68425 - RNA, 21 nt, Human
gcugggucagcagguccucug

SEQ ID NO: 68426 - RNA, 22 nt, Human
gcugggucccaagccuggggag

SEQ ID NO: 68427 - RNA, 22 nt, Human
gcugggucucucccugguccug

SEQ ID NO: 68428 - RNA, 22 nt, Human
gcugggucuggaugcucaggug

SEQ ID NO: 68429 - RNA, 22 nt, Human
gcugggugauucauuuccauaa

SEQ ID NO: 68430 - RNA, 22 nt, Human
gcuggguuuucuuccgggccua

SEQ ID NO: 68431 - RNA, 16 nt, Human
gcuggucaagcagcag

SEQ ID NO: 68432 - RNA, 22 nt, Human
gcugguccagggccucuguggg

SEQ ID NO: 68433 - RNA, 22 nt, Human
gcuggucuccgccgcucccuga

SEQ ID NO: 68434 - RNA, 20 nt, Human
gcuggugggggcuugacaug

SEQ ID NO: 68435 - RNA, 22 nt, Human
gcuggugugugaaccuagggac

SEQ ID NO: 68436 - RNA, 22 nt, Human
gcugguuucacccaaccgaugu

SEQ ID NO: 68437 - RNA, 22 nt, Human
gcugguuuccuuaucuauaaag

SEQ ID NO: 68438 - RNA, 22 nt, Human
gcuguacaaauuccacaagaga

SEQ ID NO: 68439 - RNA, 22 nt, Human
ggcacacagauggagcacuagc

SEQ ID NO: 68440 - RNA, 22 nt, Human
ggcacacagcuuggcaggagau

SEQ ID NO: 68441 - RNA, 22 nt, Human
ggcacagcaggagcuaugugaa

SEQ ID NO: 68442 - RNA, 21 nt, Human
ggcacagccugaaaugccuca

SEQ ID NO: 68443 - RNA, 22 nt, Human
ggcacagcucaggucccagcuc

SEQ ID NO: 68444 - RNA, 22 nt, Human
ggcacagucccuggcacagagu

SEQ ID NO: 68445 - RNA, 22 nt, Human
ggcaccagcaggcaccgaugcc

SEQ ID NO: 68446 - RNA, 22 nt, Human
ggcaccagccaccuauuucuag

SEQ ID NO: 68447 - RNA, 22 nt, Human
ggcaccaggaucagucugucau

SEQ ID NO: 68448 - RNA, 22 nt, Human
ggcaccaggcugggcauaggcc

SEQ ID NO: 68449 - RNA, 22 nt, Human
ggcaccugcucaucuggacuca

SEQ ID NO: 68450 - RNA, 22 nt, Human
ggcaccugguaagugcucagua

SEQ ID NO: 68451 - RNA, 19 nt, Human
ggcaccuuggucuuggacu

SEQ ID NO: 68452 - RNA, 22 nt, Human
ggcaccuuucaucccaucuaga

SEQ ID NO: 68453 - RNA, 19 nt, Human
ggcaccuuucugcuguguc

SEQ ID NO: 68454 - RNA, 22 nt, Human
ggcacucaauaaauguugccaa

SEQ ID NO: 68455 - RNA, 22 nt, Human
ggcacucagagauucaggcugu

SEQ ID NO: 68456 - RNA, 23 nt, Human
ggcacucggccgugaacucgugc

SEQ ID NO: 68457 - RNA, 22 nt, Human
ggcacugaaccaggacacaagc

SEQ ID NO: 68458 - RNA, 22 nt, Human
ggcacugaauuucuuggcaucu

SEQ ID NO: 68459 - RNA, 21 nt, Human
ggcacugagccagauggacuc

SEQ ID NO: 68460 - RNA, 22 nt, Human
ggcacugaucugauuucccucc

SEQ ID NO: 68461 - RNA, 22 nt, Human
ggcacugauuccauucaugaag

SEQ ID NO: 68462 - RNA, 22 nt, Human
ggcacugcagguaagugcuguc

SEQ ID NO: 68463 - RNA, 22 nt, Human
ggcacugcccacccucacaggg

SEQ ID NO: 68464 - RNA, 21 nt, Human
ggcacugcugggccaucugcu

SEQ ID NO: 68465 - RNA, 22 nt, Human
ggcacugcuguaggcagugagg

SEQ ID NO: 68466 - RNA, 18 nt, Human
ggcacugcuguuccccuu

SEQ ID NO: 68467 - RNA, 22 nt, Human
ggcacugcuuccugagccugag

SEQ ID NO: 68468 - RNA, 22 nt, Human
ggcacuggagacuguuaugaga

SEQ ID NO: 68469 - RNA, 22 nt, Human
ggcacugggaaugcagugauga

SEQ ID NO: 68470 - RNA, 22 nt, Human
ggcacuguuuuuguauucaguu

SEQ ID NO: 68471 - RNA, 22 nt, Human
ggcagaaggcaauuagagacug

SEQ ID NO: 68472 - RNA, 22 nt, Human
ggcagaagguugaaguaauuug

SEQ ID NO: 68473 - RNA, 22 nt, Human
ggcagacuguaauaggagaauu

SEQ ID NO: 68474 - RNA, 22 nt, Human
ggcagagaaucuggcuguuuac

SEQ ID NO: 68475 - RNA, 22 nt, Human
ggcagagccucagcccuccacc

SEQ ID NO: 68476 - RNA, 22 nt, Human
ggcagagcugcaugagcacuca

SEQ ID NO: 68477 - RNA, 20 nt, Human
ggcagagggccugggagaag

SEQ ID NO: 68478 - RNA, 22 nt, Human
ggcagagugcucugggcagggg

SEQ ID NO: 68479 - RNA, 18 nt, Human
ggcagaugacaggagaga

SEQ ID NO: 68480 - RNA, 22 nt, Human
ggcagauggaaggacagacgga

SEQ ID NO: 68481 - RNA, 22 nt, Human
ggcagauguuauaugaucugag

SEQ ID NO: 68482 - RNA, 22 nt, Human
ggcagauguugcagugagcaga

SEQ ID NO: 68483 - RNA, 22 nt, Human
ggcagcaacagguguguuguga

SEQ ID NO: 68484 - RNA, 20 nt, Human
ggcagcaaccauaugcuaca

SEQ ID NO: 68485 - RNA, 22 nt, Human
ggcagcaagcagaaguucuaug

SEQ ID NO: 68486 - RNA, 19 nt, Human
ggcagcaagcucugaaggc

SEQ ID NO: 68487 - RNA, 22 nt, Human
ggcagcaaugcugugcaggcau

SEQ ID NO: 68488 - RNA, 22 nt, Human
ggcagcaauucuucagaaucau

SEQ ID NO: 68489 - RNA, 22 nt, Human
ggcagcagaacuggcccuguau

SEQ ID NO: 68490 - RNA, 22 nt, Human
ggcagcaggcgacuucccuauu

SEQ ID NO: 68491 - RNA, 22 nt, Human
ggcagcagggucuagauugaug

SEQ ID NO: 68492 - RNA, 22 nt, Human
ggcagcaguaggagcuaaucuu

SEQ ID NO: 68493 - RNA, 22 nt, Human
ggcagcaguccauggcccaagg

SEQ ID NO: 68494 - RNA, 22 nt, Human
ggcagcauauauucagugggca

SEQ ID NO: 68495 - RNA, 22 nt, Human
ggcagcaucccauggaccgcau

SEQ ID NO: 68496 - RNA, 22 nt, Human
ggcagcauccgcccggcacccu

SEQ ID NO: 68497 - RNA, 22 nt, Human
ggcagcauugccaauccagaca

SEQ ID NO: 68498 - RNA, 22 nt, Human
ggcagcauugccuuugcaguga

SEQ ID NO: 68499 - RNA, 22 nt, Human
ggcagcauuuagagcacagugu

SEQ ID NO: 68500 - RNA, 22 nt, Human
ggcagccagcggguggacgcgc

SEQ ID NO: 68501 - RNA, 22 nt, Human
ggcagccaggaggguguaguuu

SEQ ID NO: 68502 - RNA, 22 nt, Human
ggcagccaguagggccagccug

SEQ ID NO: 68503 - RNA, 22 nt, Human
ggcagccccaucagagacgcug

SEQ ID NO: 68504 - RNA, 21 nt, Human
ggcagcccgcccucuccuggc

SEQ ID NO: 68505 - RNA, 18 nt, Human
ggcagccuacccacuugu

SEQ ID NO: 68506 - RNA, 22 nt, Human
ggcagccuugagggaggccugg

SEQ ID NO: 68507 - RNA, 22 nt, Human
ggcagcgcccgaguccgcagcu

SEQ ID NO: 68508 - RNA, 22 nt, Human
ggaggccuccugggggagguuc

SEQ ID NO: 68509 - RNA, 19 nt, Human
ggaggccuggguauuugcc

SEQ ID NO: 68510 - RNA, 22 nt, Human
ggaggcggggaaggcaucccau

SEQ ID NO: 68511 - RNA, 22 nt, Human
ggaggcuccacugcucuuccug

SEQ ID NO: 68512 - RNA, 22 nt, Human
ggaggcucccacgcagcucaca

SEQ ID NO: 68513 - RNA, 22 nt, Human
ggaggcucuaaacuuuccuugg

SEQ ID NO: 68514 - RNA, 18 nt, Human
ggaggcucugugguuucc

SEQ ID NO: 68515 - RNA, 22 nt, Human
ggaggcugcugccucacguggg

SEQ ID NO: 68516 - RNA, 19 nt, Human
ggaggcuucuuggggucgg

SEQ ID NO: 68517 - RNA, 22 nt, Human
ggagggagcauccccuugcuga

SEQ ID NO: 68518 - RNA, 22 nt, Human
ggagggcaacuuuucaguaggu

SEQ ID NO: 68519 - RNA, 22 nt, Human
ggagggcagaguccccugcuga

SEQ ID NO: 68520 - RNA, 20 nt, Human
ggagggcagcugagaguugg

SEQ ID NO: 68521 - RNA, 22 nt, Human
ggagggcgacagggcgaccgcg

SEQ ID NO: 68522 - RNA, 22 nt, Human
ggagggcucaauugacuccuga

SEQ ID NO: 68523 - RNA, 22 nt, Human
ggagggcugagacuggggucug

SEQ ID NO: 68524 - RNA, 22 nt, Human
ggagggcugccagguggagcgg

SEQ ID NO: 68525 - RNA, 22 nt, Human
ggaggggauuuaguagaugcua

SEQ ID NO: 68526 - RNA, 22 nt, Human
ggaggggcaggucccaaguugu

SEQ ID NO: 68527 - RNA, 22 nt, Human
ggaggggccggcugccugccac

SEQ ID NO: 68528 - RNA, 22 nt, Human
ggagggggaauucagccccagc

SEQ ID NO: 68529 - RNA, 22 nt, Human
ggagggguggucgcgaagagca

SEQ ID NO: 68530 - RNA, 22 nt, Human
ggaggguccccagcagcaugaa

SEQ ID NO: 68531 - RNA, 22 nt, Human
ggaggucacgacugggaugccu

SEQ ID NO: 68532 - RNA, 22 nt, Human
ggagguccaugugaauguggcc

SEQ ID NO: 68533 - RNA, 22 nt, Human
ggagguggagcuggaaguucca

SEQ ID NO: 68534 - RNA, 16 nt, Human
ggagguggguaaggug

SEQ ID NO: 68535 - RNA, 22 nt, Human
ggagguucucucuuugcagagc

SEQ ID NO: 68536 - RNA, 22 nt, Human
ggaguauuguagcuuccaguuc

SEQ ID NO: 68537 - RNA, 20 nt, Human
ggagucacauucuuuacugc

SEQ ID NO: 68538 - RNA, 22 nt, Human
ggagucaggagcaggcugggcu

SEQ ID NO: 68539 - RNA, 22 nt, Human
ggagucaggauccuggggaugg

SEQ ID NO: 68540 - RNA, 21 nt, Human
ggagucagggucuggcugggg

SEQ ID NO: 68541 - RNA, 21 nt, Human
ggagucauuagucauuuccuu

SEQ ID NO: 68542 - RNA, 22 nt, Human
ggagucccuguccccauacgag

SEQ ID NO: 68543 - RNA, 22 nt, Human
ggagucugacucugacccugga

SEQ ID NO: 68544 - RNA, 19 nt, Human
ggagucugagcccagguau

SEQ ID NO: 68545 - RNA, 21 nt, Human
ggagucugaggaagaaaacug

SEQ ID NO: 68546 - RNA, 22 nt, Human
ggagucugggaauuggagagaa

SEQ ID NO: 68547 - RNA, 22 nt, Human
ggagucugugucuugaagcagu

SEQ ID NO: 68548 - RNA, 22 nt, Human
ggagugaagcaaauaaugcugg

SEQ ID NO: 68549 - RNA, 22 nt, Human
uauuaggguaaauuugacaugc

SEQ ID NO: 68550 - RNA, 22 nt, Human
uauuaggguuuugaagguuugu

SEQ ID NO: 68551 - RNA, 22 nt, Human
uauuagguaugaacuggcaacc

SEQ ID NO: 68552 - RNA, 22 nt, Human
uauuagguuagugcaaaaguuu

SEQ ID NO: 68553 - RNA, 22 nt, Human
uauuagguuggugcaaaaguaa

SEQ ID NO: 68554 - RNA, 20 nt, Human
uauuaugaccuguguucugg

SEQ ID NO: 68555 - RNA, 22 nt, Human
uauuaugagguauuuggacuuu

SEQ ID NO: 68556 - RNA, 22 nt, Human
uauuauggggggaacaucacuc

SEQ ID NO: 68557 - RNA, 22 nt, Human
uauuauuaaauggcagaauuuu

SEQ ID NO: 68558 - RNA, 22 nt, Human
uauuauugacuauucagaaugu

SEQ ID NO: 68559 - RNA, 22 nt, Human
uauuauuuuagcacugaggauu

SEQ ID NO: 68560 - RNA, 22 nt, Human
uauucagaauaaagacuacauu

SEQ ID NO: 68561 - RNA, 22 nt, Human
uauucagaggugaaguagggag

SEQ ID NO: 68562 - RNA, 19 nt, Human
uauucaggaugauggcaca

SEQ ID NO: 68563 - RNA, 22 nt, Human
uauucauauuguaaaagaagug

SEQ ID NO: 68564 - RNA, 22 nt, Human
uauucaucuucauagucacagu

SEQ ID NO: 68565 - RNA, 22 nt, Human
uauucauuaugaccaaaucuag

SEQ ID NO: 68566 - RNA, 22 nt, Human
uauuccaaaauaguuaagcacu

SEQ ID NO: 68567 - RNA, 22 nt, Human
uauuccaacugucauagucaua

SEQ ID NO: 68568 - RNA, 22 nt, Human
uauuccaaugucaguuauauca

SEQ ID NO: 68569 - RNA, 22 nt, Human
uauuccaccagagaugugaauu

SEQ ID NO: 68570 - RNA, 22 nt, Human
uauuccaguccuauccucuuuu

SEQ ID NO: 68571 - RNA, 22 nt, Human
uauuccaguucaccuuuucauc

SEQ ID NO: 68572 - RNA, 22 nt, Human
uauuccuaauacuuguuuuggg

SEQ ID NO: 68573 - RNA, 22 nt, Human
uauuccuaauuugcagggcaug

SEQ ID NO: 68574 - RNA, 22 nt, Human
uauuccuauggccacugcuacu

SEQ ID NO: 68575 - RNA, 22 nt, Human
uauuccuguuccccaucaccac

SEQ ID NO: 68576 - RNA, 22 nt, Human
uauucuacaguguuaguguuag

SEQ ID NO: 68577 - RNA, 22 nt, Human
uauucucagugcuauaaguaga

SEQ ID NO: 68578 - RNA, 22 nt, Human
uauucuggguaccaaacuucaa

SEQ ID NO: 68579 - RNA, 22 nt, Human
uauucugugugauauguaaaug

SEQ ID NO: 68580 - RNA, 22 nt, Human
uauucuuacucucgacugcauu

SEQ ID NO: 68581 - RNA, 22 nt, Human
uauugaagauuuugugguugcu

SEQ ID NO: 68582 - RNA, 22 nt, Human
uauugacaauuugugaaacuau

SEQ ID NO: 68583 - RNA, 22 nt, Human
uauugaccagacugacacacau

SEQ ID NO: 68584 - RNA, 17 nt, Human
uauugaccuuuguaugu

SEQ ID NO: 68585 - RNA, 22 nt, Human
uauugacuuuuaaagugauaua

SEQ ID NO: 68586 - RNA, 22 nt, Human
uauugaggaucuccugcuaauu

SEQ ID NO: 68587 - RNA, 22 nt, Human
uauugaggauugaggaaagcac

SEQ ID NO: 68588 - RNA, 22 nt, Human
uauugaggugcuuagcuggggg

SEQ ID NO: 68589 - RNA, 20 nt, Human
uauugaguaccuacuguaua

SEQ ID NO: 68590 - RNA, 22 nt, Human
uauugauaaggauggcugcaau

SEQ ID NO: 68591 - RNA, 22 nt, Human
uauugauaugcagaacugacuu

SEQ ID NO: 68592 - RNA, 21 nt, Human
uauugauucaauuucuugagu

SEQ ID NO: 68593 - RNA, 22 nt, Human
uauugcaagcaauuccaaaagg

SEQ ID NO: 68594 - RNA, 23 nt, Human
uauugcaagcucugccucccggg

SEQ ID NO: 68595 - RNA, 22 nt, Human
uauugcagaauucgcuggaaca

SEQ ID NO: 68596 - RNA, 22 nt, Human
uauugcauauuauucuaguggc

SEQ ID NO: 68597 - RNA, 22 nt, Human
uauugcauauuguacuugaaug

SEQ ID NO: 68598 - RNA, 22 nt, Human
uauugcauccccauugugcccc

SEQ ID NO: 68599 - RNA, 22 nt, Human
uauugcugacuuguucaguguu

SEQ ID NO: 68600 - RNA, 22 nt, Human
uauugcugccauuuuccaaugu

SEQ ID NO: 68601 - RNA, 22 nt, Human
uauugcuggaaaauggugugau

SEQ ID NO: 68602 - RNA, 22 nt, Human
uauugcuucagcuuccugggcu

SEQ ID NO: 68603 - RNA, 21 nt, Human
uauugcuuguaggucauccug

SEQ ID NO: 68604 - RNA, 22 nt, Human
uauuggaauuuaguuagagaau

SEQ ID NO: 68605 - RNA, 22 nt, Human
uauugguagauggagagagaca

SEQ ID NO: 68606 - RNA, 22 nt, Human
uauugguauaggcauugaaacu

SEQ ID NO: 68607 - RNA, 22 nt, Human
uauugguaugguaagaauugaa

SEQ ID NO: 68608 - RNA, 19 nt, Human
uauugguaugugugaggca

SEQ ID NO: 68609 - RNA, 22 nt, Human
uauugguguacuuauagcagag

SEQ ID NO: 68610 - RNA, 22 nt, Human
uauuguacauuucaaaauugcu

SEQ ID NO: 68611 - RNA, 22 nt, Human
uauuguccaauaggauguuccu

SEQ ID NO: 68612 - RNA, 22 nt, Human
uauugucuaggaauuguuuaaa

SEQ ID NO: 68613 - RNA, 22 nt, Human
uauugucuaucgcugcuuucau

SEQ ID NO: 68614 - RNA, 22 nt, Human
uauugucucacaguuuuggagg

SEQ ID NO: 68615 - RNA, 22 nt, Human
uauugugaguauaacugcauuu

SEQ ID NO: 68616 - RNA, 22 nt, Human
uauugugccccucccaggaaca

SEQ ID NO: 68617 - RNA, 22 nt, Human
uauuguuucuggcuguggcagc

SEQ ID NO: 68618 - RNA, 22 nt, Human
uauuuaaaaagaggccagcugg

SEQ ID NO: 68619 - RNA, 22 nt, Human
uauuuaagaugugucauaaaga

SEQ ID NO: 68620 - RNA, 22 nt, Human
uauuuaauuagugauuguagag

SEQ ID NO: 68621 - RNA, 22 nt, Human
uauuuacuguauuugaaguuga

SEQ ID NO: 68622 - RNA, 22 nt, Human
uauuuagaggagaaaaguggcu

SEQ ID NO: 68623 - RNA, 20 nt, Human
uauuuagauucaaguaugga

SEQ ID NO: 68624 - RNA, 22 nt, Human
uauuuagugauagaagcaagga

SEQ ID NO: 68625 - RNA, 22 nt, Human
uauuuauaacagugagaacggg

SEQ ID NO: 68626 - RNA, 22 nt, Human
ggcagcuaggggcagggaauuc

SEQ ID NO: 68627 - RNA, 22 nt, Human
ggcagcuccucaaaaaauuaaa

SEQ ID NO: 68628 - RNA, 22 nt, Human
ggcagcucugaugaugcucugg

SEQ ID NO: 68629 - RNA, 22 nt, Human
ggcagcucugcuccuuggcucc

SEQ ID NO: 68630 - RNA, 22 nt, Human
ggcagcugaccuagcaccaucc

SEQ ID NO: 68631 - RNA, 22 nt, Human
ggcagcugcacguugucccguc

SEQ ID NO: 68632 - RNA, 17 nt, Human
ggcagcugccacuuuuu

SEQ ID NO: 68633 - RNA, 22 nt, Human
ggcagcugggugccuaauaaug

SEQ ID NO: 68634 - RNA, 22 nt, Human
ggcagcugguucuuuccauuaa

SEQ ID NO: 68635 - RNA, 22 nt, Human
ggcagcuguggacgucgucauu

SEQ ID NO: 68636 - RNA, 17 nt, Human
ggcagcugugugcaugc

SEQ ID NO: 68637 - RNA, 23 nt, Human
ggcagcuuauacuuucauagaca

SEQ ID NO: 68638 - RNA, 22 nt, Human
ggcagcuuccuaggagagggca

SEQ ID NO: 68639 - RNA, 22 nt, Human
ggcagcuuccugagccagcagc

SEQ ID NO: 68640 - RNA, 18 nt, Human
ggcagcuugacuagcaac

SEQ ID NO: 68641 - RNA, 22 nt, Human
ggcagcuuucaauaggguuaug

SEQ ID NO: 68642 - RNA, 22 nt, Human
ggcagcuuuuaucccugacaga

SEQ ID NO: 68643 - RNA, 22 nt, Human
ggcaggaagaggagggugaacu

SEQ ID NO: 68644 - RNA, 22 nt, Human
ggcaggaaguagcagucugagc

SEQ ID NO: 68645 - RNA, 22 nt, Human
ggcaggacucuucugugggccg

SEQ ID NO: 68646 - RNA, 22 nt, Human
ggcaggagaaaggucucuucuu

SEQ ID NO: 68647 - RNA, 22 nt, Human
ggcaggagcucuccaguuugcc

SEQ ID NO: 68648 - RNA, 21 nt, Human
ggcaggauggcaguggacccc

SEQ ID NO: 68649 - RNA, 22 nt, Human
ggcaggcaccagcucagcaaua

SEQ ID NO: 68650 - RNA, 22 nt, Human
ggcaggcgugguggccucagaa

SEQ ID NO: 68651 - RNA, 22 nt, Human
ggcaggcuccagagcccucucc

SEQ ID NO: 68652 - RNA, 22 nt, Human
ggcaggcugcuugggucauguc

SEQ ID NO: 68653 - RNA, 22 nt, Human
ggcaggcugggugucauggagu

SEQ ID NO: 68654 - RNA, 22 nt, Human
ggcaggcuugguggcaccgguu

SEQ ID NO: 68655 - RNA, 22 nt, Human
ggcagggaaacagcugauccca

SEQ ID NO: 68656 - RNA, 22 nt, Human
ggcagggaagcuggcaucacgg

SEQ ID NO: 68657 - RNA, 22 nt, Human
ggcagggacuuugcaaaucuuu

SEQ ID NO: 68658 - RNA, 22 nt, Human
agugugugcuguuccccggagg

SEQ ID NO: 68659 - RNA, 21 nt, Human
aguguguguggaaugagaaua

SEQ ID NO: 68660 - RNA, 22 nt, Human
aguguguguuugggcgguuuau

SEQ ID NO: 68661 - RNA, 22 nt, Human
aguguguucucaaugaaaagaa

SEQ ID NO: 68662 - RNA, 23 nt, Human
aguguuaaauuucgcaccuaaau

SEQ ID NO: 68663 - RNA, 22 nt, Human
aguguuaagagaaaauucugcu

SEQ ID NO: 68664 - RNA, 22 nt, Human
aguguuaauaucuggcccuagg

SEQ ID NO: 68665 - RNA, 22 nt, Human
aguguuacuacagacugguuaa

SEQ ID NO: 68666 - RNA, 22 nt, Human
aguguuagauucuuacucaguu

SEQ ID NO: 68667 - RNA, 22 nt, Human
aguguuauaaaggccaaguuuu

SEQ ID NO: 68668 - RNA, 22 nt, Human
aguguuauuuauuguuucauaa

SEQ ID NO: 68669 - RNA, 22 nt, Human
aguguucacucuguggagccca

SEQ ID NO: 68670 - RNA, 22 nt, Human
aguguuccacacaucuggggaa

SEQ ID NO: 68671 - RNA, 22 nt, Human
aguguuccuugcuuucccagag

SEQ ID NO: 68672 - RNA, 22 nt, Human
aguguucuagcgcugugcuugu

SEQ ID NO: 68673 - RNA, 22 nt, Human
aguguuguaugggaugacugcu

SEQ ID NO: 68674 - RNA, 22 nt, Human
aguguuuaaaaauggaaaugca

SEQ ID NO: 68675 - RNA, 22 nt, Human
aguguuuaaacugaagugauga

SEQ ID NO: 68676 - RNA, 22 nt, Human
aguguuuaacuucguccugaag

SEQ ID NO: 68677 - RNA, 22 nt, Human
aguguuuacucccugcccucca

SEQ ID NO: 68678 - RNA, 22 nt, Human
aguguuucaagugaugcuuugg

SEQ ID NO: 68679 - RNA, 22 nt, Human
aguguuucacagcacuuuuucu

SEQ ID NO: 68680 - RNA, 20 nt, Human
aguguuucucaacauggggc

SEQ ID NO: 68681 - RNA, 22 nt, Human
aguguuucucagaagggccuau

SEQ ID NO: 68682 - RNA, 22 nt, Human
aguguuucuggaaucaguguuu

SEQ ID NO: 68683 - RNA, 22 nt, Human
aguguuugagacacauuucacu

SEQ ID NO: 68684 - RNA, 22 nt, Human
aguguuuggggugauuguaacc

SEQ ID NO: 68685 - RNA, 22 nt, Human
aguguuuuauuagaacacagcc

SEQ ID NO: 68686 - RNA, 22 nt, Human
aguguuuuuacaagcacucugg

SEQ ID NO: 68687 - RNA, 22 nt, Human
aguuaaacucuaguagauacaa

SEQ ID NO: 68688 - RNA, 22 nt, Human
aguuaaagucugaaauagagaa

SEQ ID NO: 68689 - RNA, 22 nt, Human
aguuaaaucauuacugacagag

SEQ ID NO: 68690 - RNA, 22 nt, Human
aguuaacacauccagaauagag

SEQ ID NO: 68691 - RNA, 22 nt, Human
aguuaacucauuuuauaaugcc

SEQ ID NO: 68692 - RNA, 22 nt, Human
aguuaaguaaacauuucccaga

SEQ ID NO: 68693 - RNA, 22 nt, Human
aguuaauaauggaaagacacau

SEQ ID NO: 68694 - RNA, 22 nt, Human
aguuacaaacacuaucaguucu

SEQ ID NO: 68695 - RNA, 22 nt, Human
aguuacaacuguuugaauguca

SEQ ID NO: 68696 - RNA, 22 nt, Human
aguuacacaacuuaucacaucu

SEQ ID NO: 68697 - RNA, 22 nt, Human
aguuacacagugucacuucuac

SEQ ID NO: 68698 - RNA, 22 nt, Human
aguuacagcuggcguggggaaa

SEQ ID NO: 68699 - RNA, 22 nt, Human
aguuacaguguucuauuacucu

SEQ ID NO: 68700 - RNA, 22 nt, Human
aguuacauaaucugugaauuuu

SEQ ID NO: 68701 - RNA, 20 nt, Human
aguuacgcuauuacucuccu

SEQ ID NO: 68702 - RNA, 20 nt, Human
aguuacuaagugcuggaacc

SEQ ID NO: 68703 - RNA, 22 nt, Human
aguuacucaaggcugauauaag

SEQ ID NO: 68704 - RNA, 22 nt, Human
aguuacucacugaggguuuauu

SEQ ID NO: 68705 - RNA, 22 nt, Human
aguuagaagugugucaucugug

SEQ ID NO: 68706 - RNA, 22 nt, Human
aguuagugugauggagguacga

SEQ ID NO: 68707 - RNA, 22 nt, Human
aguuauaaaaggagcacugauu

SEQ ID NO: 68708 - RNA, 22 nt, Human
aguuauagaaccagguccucac

SEQ ID NO: 68709 - RNA, 22 nt, Human
aguuauguccucagcaaaucaa

SEQ ID NO: 68710 - RNA, 22 nt, Human
aguuauuacucuuuaacauauu

SEQ ID NO: 68711 - RNA, 19 nt, Human
aguuauugaucuauucagg

SEQ ID NO: 68712 - RNA, 22 nt, Human
aguuauuuggcuauagauggua

SEQ ID NO: 68713 - RNA, 22 nt, Human
aguucagaggcaggagaaggcu

SEQ ID NO: 68714 - RNA, 22 nt, Human
aguucagcaaauaaaacauagu

SEQ ID NO: 68715 - RNA, 22 nt, Human
aguucauauugaaagcagguga

SEQ ID NO: 68716 - RNA, 20 nt, Human
aguuccacauggcuggggag

SEQ ID NO: 68717 - RNA, 23 nt, Human
aguuccagaaaaaugcucaagca

SEQ ID NO: 68718 - RNA, 22 nt, Human
aguuccagcugugaccagaaaa

SEQ ID NO: 68719 - RNA, 22 nt, Human
aguucccaaauuacaggccaca

SEQ ID NO: 68720 - RNA, 22 nt, Human
aguuccugaacuucuuaaugac

SEQ ID NO: 68721 - RNA, 22 nt, Human
aguucuagaagacuuuuccauu

SEQ ID NO: 68722 - RNA, 22 nt, Human
aguucucuccccugcuguucag

SEQ ID NO: 68723 - RNA, 22 nt, Human
aguucucuuggaaguuauguga

SEQ ID NO: 68724 - RNA, 22 nt, Human
aguucugaaugaggaaucuggg

SEQ ID NO: 68725 - RNA, 22 nt, Human
aguucuggaacucuacagcaac

SEQ ID NO: 68726 - RNA, 22 nt, Human
aguucuggugguuuggagaucu

SEQ ID NO: 68727 - RNA, 22 nt, Human
aguucugguuaaccugcaaccu

SEQ ID NO: 68728 - RNA, 22 nt, Human
aguucugguugcccaugacauc

SEQ ID NO: 68729 - RNA, 21 nt, Human
aguucuguuaugcuggacuca

SEQ ID NO: 68730 - RNA, 22 nt, Human
aguucuucccuuuucuauggag

SEQ ID NO: 68731 - RNA, 22 nt, Human
aguucuuuucuagauucuggau

SEQ ID NO: 68732 - RNA, 22 nt, Human
aguugaaagccuuauuucucug

SEQ ID NO: 68733 - RNA, 22 nt, Human
aguugaacaguauuugcuucug

SEQ ID NO: 68734 - RNA, 22 nt, Human
aguugaauaauuagacauaucu

SEQ ID NO: 68735 - RNA, 22 nt, Human
aguugacauccagagacauucu

SEQ ID NO: 68736 - RNA, 22 nt, Human
aguugacucucaagauccuguu

SEQ ID NO: 68737 - RNA, 22 nt, Human
aguugcagacgcagagauguug

SEQ ID NO: 68738 - RNA, 22 nt, Human
aguugcucuaggugaggucuuu

SEQ ID NO: 68739 - RNA, 23 nt, Human
aguuggaccuggguaagaaaaug

SEQ ID NO: 68740 - RNA, 21 nt, Human
aguuggaggcaguuuggcaau

SEQ ID NO: 68741 - RNA, 23 nt, Human
aguuggcauauucaagcacaguc

SEQ ID NO: 68742 - RNA, 22 nt, Human
aguugggaguuauagacucuau

SEQ ID NO: 68743 - RNA, 22 nt, Human
agucacugguucuguaauuaau

SEQ ID NO: 68744 - RNA, 22 nt, Human
agucacugucuugcaaagguca

SEQ ID NO: 68745 - RNA, 22 nt, Human
agucacuugauucuccugagcu

SEQ ID NO: 68746 - RNA, 22 nt, Human
agucacuuuaugagagaaccau

SEQ ID NO: 68747 - RNA, 22 nt, Human
agucagagagcucucagcauag

SEQ ID NO: 68748 - RNA, 22 nt, Human
agucagagucuauugcuguggu

SEQ ID NO: 68749 - RNA, 22 nt, Human
agucagauuuagauguagcaag

SEQ ID NO: 68750 - RNA, 22 nt, Human
agucagcagccuggccaggaga

SEQ ID NO: 68751 - RNA, 22 nt, Human
agucaggaaaagcuuuccugga

SEQ ID NO: 68752 - RNA, 22 nt, Human
agucaggaaccucagcaagucu

SEQ ID NO: 68753 - RNA, 22 nt, Human
agucaggcugacaggcuaggag

SEQ ID NO: 68754 - RNA, 22 nt, Human
agucagggccuggccugcugaa

SEQ ID NO: 68755 - RNA, 19 nt, Human
agucagguggcuggugcca

SEQ ID NO: 68756 - RNA, 22 nt, Human
agucaguaugacuuauaguucu

SEQ ID NO: 68757 - RNA, 22 nt, Human
agucagucaccauuuaagaaca

SEQ ID NO: 68758 - RNA, 22 nt, Human
agucaguggcuccgagccuggu

SEQ ID NO: 68759 - RNA, 22 nt, Human
agucagugggcuuggcacagaa

SEQ ID NO: 68760 - RNA, 22 nt, Human
agucaguguucuggguuguaau

SEQ ID NO: 68761 - RNA, 22 nt, Human
agucaguugcaguuuauggaug

SEQ ID NO: 68762 - RNA, 22 nt, Human
agucaguuucccuggaaagcag

SEQ ID NO: 68763 - RNA, 22 nt, Human
agucaguuuucuccagggggcu

SEQ ID NO: 68764 - RNA, 22 nt, Human
agucaguuuucuuaaagggaag

SEQ ID NO: 68765 - RNA, 22 nt, Human
agucauaauuauaaacaucagu

SEQ ID NO: 68766 - RNA, 22 nt, Human
agucauaugacccuucacaaac

SEQ ID NO: 68767 - RNA, 22 nt, Human
aguuucauuucuuaguaccagu

SEQ ID NO: 68768 - RNA, 22 nt, Human
aguuucuaccgguacauucagg

SEQ ID NO: 68769 - RNA, 22 nt, Human
aguuucucuuugacaccaaaau

SEQ ID NO: 68770 - RNA, 22 nt, Human
aguuucugcaaaucauuuuuau

SEQ ID NO: 68771 - RNA, 22 nt, Human
aguuucuguuaccauauuugac

SEQ ID NO: 68772 - RNA, 22 nt, Human
aguuucuuggucacaguuuuca

SEQ ID NO: 68773 - RNA, 23 nt, Human
aguuucuuugagacuugcccugu

SEQ ID NO: 68774 - RNA, 22 nt, Human
aguuugaaauguuggcaauauu

SEQ ID NO: 68775 - RNA, 22 nt, Human
aguuugaagaaggaucuaugaa

SEQ ID NO: 68776 - RNA, 22 nt, Human
aguuugauaaacaccagcuagu

SEQ ID NO: 68777 - RNA, 22 nt, Human
aguuugccccgucacccuggug

SEQ ID NO: 68778 - RNA, 22 nt, Human
aguuuggaagaauuuggucugu

SEQ ID NO: 68779 - RNA, 22 nt, Human
aguuuguaaacuugagcuagcc

SEQ ID NO: 68780 - RNA, 22 nt, Human
aguuuguaaccuaagauucagg

SEQ ID NO: 68781 - RNA, 22 nt, Human
aguuuguacugaauucaauuua

SEQ ID NO: 68782 - RNA, 22 nt, Human
aguuuguaucaauuugcuuuau

SEQ ID NO: 68783 - RNA, 22 nt, Human
aguuuuauaucuuccauugguu

SEQ ID NO: 68784 - RNA, 22 nt, Human
aguuuuauggcucaaccuaaua

SEQ ID NO: 68785 - RNA, 22 nt, Human
aguuuucaauauaugauaguga

SEQ ID NO: 68786 - RNA, 22 nt, Human
aguuuucaguaaauauuaguga

SEQ ID NO: 68787 - RNA, 21 nt, Human
aguuuuccauuagggagggag

SEQ ID NO: 68788 - RNA, 22 nt, Human
aguuuucucacaucaaaaauga

SEQ ID NO: 68789 - RNA, 22 nt, Human
aguuuucugcuaaaccagcuaa

SEQ ID NO: 68790 - RNA, 22 nt, Human
aguuuucuuucaucuaucagca

SEQ ID NO: 68791 - RNA, 21 nt, Human
aguuuugagaguggguagugu

SEQ ID NO: 68792 - RNA, 23 nt, Human
aguuuuuaauggucauagcugag

SEQ ID NO: 68793 - RNA, 22 nt, Human
aguuuuuccguggcuacgauaa

SEQ ID NO: 68794 - RNA, 17 nt, Human
aguuuuuggaccugugu

SEQ ID NO: 68795 - RNA, 22 nt, Human
auaaaaaggacagauguggucu

SEQ ID NO: 68796 - RNA, 20 nt, Human
auaaaauaacugccacaaga

SEQ ID NO: 68797 - RNA, 22 nt, Human
auaaaaucuuuaugugcucugc

SEQ ID NO: 68798 - RNA, 22 nt, Human
auaaaauuugcuacuguuaaau

SEQ ID NO: 68799 - RNA, 22 nt, Human
auaaacacuucuagggcacaca

SEQ ID NO: 68800 - RNA, 21 nt, Human
auaaacagcaugugauccaug

SEQ ID NO: 68801 - RNA, 22 nt, Human
auaaacuauguaauuugcucua

SEQ ID NO: 68802 - RNA, 22 nt, Human
auaaacucaugcugaaaaccca

SEQ ID NO: 68803 - RNA, 21 nt, Human
auaaacugcaucaaguuggug

SEQ ID NO: 68804 - RNA, 22 nt, Human
auaaacugguaggaaaacagua

SEQ ID NO: 68805 - RNA, 22 nt, Human
auaaagauuuuuaggcauuucu

SEQ ID NO: 68806 - RNA, 22 nt, Human
auaaagcaauagauuguguaau

SEQ ID NO: 68807 - RNA, 22 nt, Human
auaaagcagguccccagacacu

SEQ ID NO: 68808 - RNA, 22 nt, Human
auaaagcaucuagucugucacu

SEQ ID NO: 68809 - RNA, 22 nt, Human
auaaagcauuuccccugugugg

SEQ ID NO: 68810 - RNA, 22 nt, Human
auaaagcuaagacuuacaugaa

SEQ ID NO: 68811 - RNA, 22 nt, Human
auaaagcucuuaguagcagccu

SEQ ID NO: 68812 - RNA, 22 nt, Human
auaaagcuuugaaauggagaua

SEQ ID NO: 68813 - RNA, 22 nt, Human
auaaaggcagauuuuggaccuc

SEQ ID NO: 68814 - RNA, 22 nt, Human
auaaaggccaaaauuugcauuu

SEQ ID NO: 68815 - RNA, 22 nt, Human
auaaagucauggcagcuagaau

SEQ ID NO: 68816 - RNA, 22 nt, Human
auaaagucugggccaggcaugg

SEQ ID NO: 68817 - RNA, 22 nt, Human
auaaaguggagguaguauucau

SEQ ID NO: 68818 - RNA, 22 nt, Human
auaaaguucugcuggcauauau

SEQ ID NO: 68819 - RNA, 22 nt, Human
auaaauagugaagggagccggu

SEQ ID NO: 68820 - RNA, 22 nt, Human
auaaaugugaaaugagcaguua

SEQ ID NO: 68821 - RNA, 22 nt, Human
auaaauucucugauguauagua

SEQ ID NO: 68822 - RNA, 21 nt, Human
auaaauucugagaggcucugc

SEQ ID NO: 68823 - RNA, 22 nt, Human
auaacaauagugguagugcugg

SEQ ID NO: 68824 - RNA, 22 nt, Human
auaacacuaaauguauguaaca

SEQ ID NO: 68825 - RNA, 22 nt, Human
auaacagaauaagucauuaccg

SEQ ID NO: 68826 - RNA, 22 nt, Human
auaacagagagcuacugaacug

SEQ ID NO: 68827 - RNA, 22 nt, Human
auaacagugaccucucagcacc

SEQ ID NO: 68828 - RNA, 22 nt, Human
auaacauuuugacaacugguga

SEQ ID NO: 68829 - RNA, 22 nt, Human
auaaccuggauauaaacagaug

SEQ ID NO: 68830 - RNA, 22 nt, Human
auaaccuguuucagacauuugu

SEQ ID NO: 68831 - RNA, 22 nt, Human
auaacugagugagcagcgacuc

SEQ ID NO: 68832 - RNA, 22 nt, Human
auaacuuucuucacccuugcug

SEQ ID NO: 68833 - RNA, 17 nt, Human
auaagacagaagacaau

SEQ ID NO: 68834 - RNA, 22 nt, Human
auaagagcuacagccaguucug

SEQ ID NO: 68835 - RNA, 22 nt, Human
auaagagcuagucuuuuccuug

SEQ ID NO: 68836 - RNA, 22 nt, Human
auaagauauaaauccacagagu

SEQ ID NO: 68837 - RNA, 22 nt, Human
auaagcagggucaaaugccuac

SEQ ID NO: 68838 - RNA, 22 nt, Human
auaagcaugauuaccgggagca

SEQ ID NO: 68839 - RNA, 21 nt, Human
auaagcaugcugauuacauuu

SEQ ID NO: 68840 - RNA, 22 nt, Human
auaagcauuucacagguguguu

SEQ ID NO: 68841 - RNA, 22 nt, Human
auaagccugauucacuugucau

SEQ ID NO: 68842 - RNA, 22 nt, Human
auaagcugaauagucaacacaa

SEQ ID NO: 68843 - RNA, 22 nt, Human
auaaggaaaugaaacucuaaua

SEQ ID NO: 68844 - RNA, 22 nt, Human
auaaggaaccugggcuuaagag

SEQ ID NO: 68845 - RNA, 19 nt, Human
auaaggcaauuggauuugg

SEQ ID NO: 68846 - RNA, 22 nt, Human
auaaggcagucacuggaauguu

SEQ ID NO: 68847 - RNA, 22 nt, Human
auaaggcaucucucaguuagca

SEQ ID NO: 68848 - RNA, 22 nt, Human
auaagguaaggguauugucaga

SEQ ID NO: 68849 - RNA, 22 nt, Human
auaagguuaacaucaucaguga

SEQ ID NO: 68850 - RNA, 22 nt, Human
auaagugacugcagggaauuca

SEQ ID NO: 68851 - RNA, 22 nt, Human
auaaguguuagguaaacaucuu

SEQ ID NO: 68852 - RNA, 22 nt, Human
auaauaaaccaggaugggucug

SEQ ID NO: 68853 - RNA, 22 nt, Human
auaauacaugguugaucuuuuc

SEQ ID NO: 68854 - RNA, 22 nt, Human
auaauauugagucaggaccuga

SEQ ID NO: 68855 - RNA, 22 nt, Human
auaauauuuggauaggacagua

SEQ ID NO: 68856 - RNA, 22 nt, Human
auaauccaugucuagaguaaag

SEQ ID NO: 68857 - RNA, 22 nt, Human
auaaucugacaaagacuuaagc

SEQ ID NO: 68858 - RNA, 22 nt, Human
auaaucuggcuuguuugcuuaa

SEQ ID NO: 68859 - RNA, 22 nt, Human
auaaucuggucuuuguaugagu

SEQ ID NO: 68860 - RNA, 22 nt, Human
auaaugaggauuugcauauuag

SEQ ID NO: 68861 - RNA, 22 nt, Human
agucugguugauuccuuugcac

SEQ ID NO: 68862 - RNA, 17 nt, Human
agucugucuuuccuugu

SEQ ID NO: 68863 - RNA, 22 nt, Human
agucuguguacuggguuucugu

SEQ ID NO: 68864 - RNA, 22 nt, Human
agucuguguauauucacugccc

SEQ ID NO: 68865 - RNA, 22 nt, Human
agucuuagagucugugucauga

SEQ ID NO: 68866 - RNA, 22 nt, Human
agucuuauggccaucucugauu

SEQ ID NO: 68867 - RNA, 19 nt, Human
agucuucaucugccaggcc

SEQ ID NO: 68868 - RNA, 21 nt, Human
agucuucuccagaggcugggg

SEQ ID NO: 68869 - RNA, 22 nt, Human
agucuucugaauaagaaucacu

SEQ ID NO: 68870 - RNA, 22 nt, Human
agucuucuguuuuucagcagcu

SEQ ID NO: 68871 - RNA, 22 nt, Human
agucuucuuuguguucucucau

SEQ ID NO: 68872 - RNA, 22 nt, Human
agucuugaaagcacauuagagu

SEQ ID NO: 68873 - RNA, 22 nt, Human
agucuugguccaggcucauuuc

SEQ ID NO: 68874 - RNA, 22 nt, Human
agucuugucuugcaagggcuga

SEQ ID NO: 68875 - RNA, 18 nt, Human
agucuuuaaagauguuac

SEQ ID NO: 68876 - RNA, 22 nt, Human
caauauauaaugaguacuuucc

SEQ ID NO: 68877 - RNA, 22 nt, Human
caauauauaggaacaacuuagg

SEQ ID NO: 68878 - RNA, 22 nt, Human
caaucaaugcugcuaguuccuu

SEQ ID NO: 68879 - RNA, 22 nt, Human
caaucacugggauauuggugug

SEQ ID NO: 68880 - RNA, 22 nt, Human
caaucagauaugugacauauuu

SEQ ID NO: 68881 - RNA, 21 nt, Human
caaucaguuggcauuugagca

SEQ ID NO: 68882 - RNA, 22 nt, Human
aguuuagaguucaaauuaguuc

SEQ ID NO: 68883 - RNA, 22 nt, Human
aguuuaguauaccaguacaucu

SEQ ID NO: 68884 - RNA, 22 nt, Human
aguuuauguaaaauuaguaaug

SEQ ID NO: 68885 - RNA, 22 nt, Human
aguuuauucugcuuggcccucc

SEQ ID NO: 68886 - RNA, 22 nt, Human
aguuucacaaauugucaauagc

SEQ ID NO: 68887 - RNA, 22 nt, Human
aguuucacagucugucauuguu

SEQ ID NO: 68888 - RNA, 23 nt, Human
aguuucacauuuuacauguggcu

SEQ ID NO: 68889 - RNA, 22 nt, Human
aguuucagaauuuaugcagaca

SEQ ID NO: 68890 - RNA, 21 nt, Human
aguuucaggaaguucagcugc

SEQ ID NO: 68891 - RNA, 18 nt, Human
aguuucagggcaggaaac

SEQ ID NO: 68892 - RNA, 22 nt, Human
aguuucaguguugacagauggu

SEQ ID NO: 68893 - RNA, 22 nt, Human
aguuucauccgaucuggucuca

SEQ ID NO: 68894 - RNA, 22 nt, Human
aguuuccaaaaggagacaggga

SEQ ID NO: 68895 - RNA, 23 nt, Human
aguuuccacccaggguagaaggg

SEQ ID NO: 68896 - RNA, 22 nt, Human
aguuuccacuggagacacugug

SEQ ID NO: 68897 - RNA, 22 nt, Human
aguuuccaggcaggagcuaauu

SEQ ID NO: 68898 - RNA, 22 nt, Human
aguuucccccuucacagcuuaa

SEQ ID NO: 68899 - RNA, 22 nt, Human
aguuuccuugggcauuuguuua

SEQ ID NO: 68900 - RNA, 22 nt, Human
aguuucuauguaagcuacguga

SEQ ID NO: 68901 - RNA, 22 nt, Human
aguuucuaugugaaaugcacau

SEQ ID NO: 68902 - RNA, 22 nt, Human
aguuucuauuuucaugucuguu

SEQ ID NO: 68903 - RNA, 22 nt, Human
aguuucucuuaaucuaguaucu

SEQ ID NO: 68904 - RNA, 22 nt, Human
aguuucuucauccaaaaaaugg

SEQ ID NO: 68905 - RNA, 22 nt, Human
aguuucuugccgugcuuuccau

SEQ ID NO: 68906 - RNA, 22 nt, Human
aguuugaaagcuuaacaguaca

SEQ ID NO: 68907 - RNA, 18 nt, Human
aguuugaacaaggaagaa

SEQ ID NO: 68908 - RNA, 22 nt, Human
aguuugaagauuaugccagagu

SEQ ID NO: 68909 - RNA, 22 nt, Human
aguuugaagcacaugaauggca

SEQ ID NO: 68910 - RNA, 22 nt, Human
aguuugaauugaaaugcagaug

SEQ ID NO: 68911 - RNA, 22 nt, Human
aguuugaucugacagauuuuaa

SEQ ID NO: 68912 - RNA, 22 nt, Human
aguuugauuguauggguuuuaa

SEQ ID NO: 68913 - RNA, 22 nt, Human
aguuuggacaaaagacuccuua

SEQ ID NO: 68914 - RNA, 22 nt, Human
aguuuggaguguggucuuugag

SEQ ID NO: 68915 - RNA, 22 nt, Human
aguuuggggcaagaggacagau

SEQ ID NO: 68916 - RNA, 22 nt, Human
aguuuguaaaauguggccugga

SEQ ID NO: 68917 - RNA, 22 nt, Human
aguuugucugucuucaaagccu

SEQ ID NO: 68918 - RNA, 20 nt, Human
aguuugugugucuaugcgcu

SEQ ID NO: 68919 - RNA, 22 nt, Human
aguuuuauguagacaauucauu

SEQ ID NO: 68920 - RNA, 22 nt, Human
aguuuuauuccaaugugcagca

SEQ ID NO: 68921 - RNA, 21 nt, Human
aguuuucugaguuauaaaaua

SEQ ID NO: 68922 - RNA, 22 nt, Human
aguuuucuucauuuuguggcca

SEQ ID NO: 68923 - RNA, 22 nt, Human
aguuuucuuucgcaaagguaca

SEQ ID NO: 68924 - RNA, 22 nt, Human
aguuuugacuaagauggcuugg

SEQ ID NO: 68925 - RNA, 18 nt, Human
aguuuuuaggaagaaaug

SEQ ID NO: 68926 - RNA, 22 nt, Human
aguuuuucugcuggucucacua

SEQ ID NO: 68927 - RNA, 22 nt, Human
aguuuuucugggaggcacugcu

SEQ ID NO: 68928 - RNA, 22 nt, Human
auaaaacuuauuagaauugugu

SEQ ID NO: 68929 - RNA, 22 nt, Human
auaaaacuuggguaugaucccu

SEQ ID NO: 68930 - RNA, 22 nt, Human
auaaaagaaguuuugguacuug

SEQ ID NO: 68931 - RNA, 22 nt, Human
auaaaaggaaagccuguuguga

SEQ ID NO: 68932 - RNA, 22 nt, Human
auaaaaucagaguuggauugga

SEQ ID NO: 68933 - RNA, 22 nt, Human
auaaacaucuguuucucuucug

SEQ ID NO: 68934 - RNA, 22 nt, Human
auaaacuggguaucaagaggcc

SEQ ID NO: 68935 - RNA, 22 nt, Human
auaaacuuuagcggaaggagga

SEQ ID NO: 68936 - RNA, 21 nt, Human
auaaagacaaacacuauuugg

SEQ ID NO: 68937 - RNA, 22 nt, Human
auaaagaccaguaucuuauguu

SEQ ID NO: 68938 - RNA, 22 nt, Human
auaaagcaaauaggacuauugc

SEQ ID NO: 68939 - RNA, 22 nt, Human
auaaagcuauuuuuaauucugu

SEQ ID NO: 68940 - RNA, 22 nt, Human
auaaaggauaauccauuagacu

SEQ ID NO: 68941 - RNA, 22 nt, Human
auaaaggcagaguagggaggaa

SEQ ID NO: 68942 - RNA, 22 nt, Human
auaaaggcuggcugcugugagc

SEQ ID NO: 68943 - RNA, 22 nt, Human
auaaagucuaccguauuaaaga

SEQ ID NO: 68944 - RNA, 21 nt, Human
auaaaguuuuacaggaaugca

SEQ ID NO: 68945 - RNA, 22 nt, Human
auaaauagugcugccaugagua

SEQ ID NO: 68946 - RNA, 22 nt, Human
auaaaucucuuaagacucaaca

SEQ ID NO: 68947 - RNA, 22 nt, Human
auaaauuaggaucugggguucc

SEQ ID NO: 68948 - RNA, 22 nt, Human
auaaauuuauaauuguuuccug

SEQ ID NO: 68949 - RNA, 22 nt, Human
auaacaaguauuuauugagcau

SEQ ID NO: 68950 - RNA, 22 nt, Human
auaacagacugauuuuuaaaug

SEQ ID NO: 68951 - RNA, 22 nt, Human
auaacagacuuagaguuacaag

SEQ ID NO: 68952 - RNA, 22 nt, Human
auaacagaguugggaagugaaa

SEQ ID NO: 68953 - RNA, 22 nt, Human
auaacagaugcuucagcauaaa

SEQ ID NO: 68954 - RNA, 22 nt, Human
auaacaugaccugugcuucaca

SEQ ID NO: 68955 - RNA, 22 nt, Human
auaaccugagauugagcugccu

SEQ ID NO: 68956 - RNA, 22 nt, Human
auaaccugguaguauuaaaugu

SEQ ID NO: 68957 - RNA, 19 nt, Human
auaacuacauuggcucagu

SEQ ID NO: 68958 - RNA, 22 nt, Human
auaacucuguuuuuuucaugca

SEQ ID NO: 68959 - RNA, 22 nt, Human
auaacugagagcaaucuuucuu

SEQ ID NO: 68960 - RNA, 22 nt, Human
auaacugccugaugacucucaa

SEQ ID NO: 68961 - RNA, 22 nt, Human
auaacuucagggcugugacaga

SEQ ID NO: 68962 - RNA, 22 nt, Human
auaagaaacauuauucuuucca

SEQ ID NO: 68963 - RNA, 22 nt, Human
auaagauugucauaguauggac

SEQ ID NO: 68964 - RNA, 22 nt, Human
auaagcauguuagaauauuuga

SEQ ID NO: 68965 - RNA, 22 nt, Human
auaaggcagaaauagggaaagu

SEQ ID NO: 68966 - RNA, 23 nt, Human
auaaggcauaaagguacauugga

SEQ ID NO: 68967 - RNA, 22 nt, Human
auaaggcuuaaaccuuguugcc

SEQ ID NO: 68968 - RNA, 22 nt, Human
auaagguaugaaaaguaaaugg

SEQ ID NO: 68969 - RNA, 22 nt, Human
auaagguuggucuuaacuaccu

SEQ ID NO: 68970 - RNA, 22 nt, Human
auaaguaggaaaauuugaauau

SEQ ID NO: 68971 - RNA, 22 nt, Human
auaagugagaacaaaaauuaga

SEQ ID NO: 68972 - RNA, 22 nt, Human
auaagugauauuuagcuauaga

SEQ ID NO: 68973 - RNA, 22 nt, Human
auaaguguguaaggcauucugu

SEQ ID NO: 68974 - RNA, 22 nt, Human
auaauaacuccuguugaagaac

SEQ ID NO: 68975 - RNA, 22 nt, Human
auaauacaugguuaaccucuuu

SEQ ID NO: 68976 - RNA, 18 nt, Human
auaauaggagauaaaaau

SEQ ID NO: 68977 - RNA, 22 nt, Human
auaauauaauccuacuucccau

SEQ ID NO: 68978 - RNA, 22 nt, Human
auaauauugaagagccuuggcc

SEQ ID NO: 68979 - RNA, 22 nt, Human
auaaucauucacauaaggugcu

SEQ ID NO: 68980 - RNA, 22 nt, Human
auaaucuuguauuuccuaaagu

SEQ ID NO: 68981 - RNA, 22 nt, Human
auaaugagaauacaguaacuau

SEQ ID NO: 68982 - RNA, 22 nt, Human
auaaugcagcuuuucaauggcc

SEQ ID NO: 68983 - RNA, 22 nt, Human
auaaugcauuuagaauaauuca

SEQ ID NO: 68984 - RNA, 22 nt, Human
auaaugcgaggagaaaaugaag

SEQ ID NO: 68985 - RNA, 22 nt, Human
aucauaaaccacuuuguaaucu

SEQ ID NO: 68986 - RNA, 22 nt, Human
aucauaauugcuccagugauau

SEQ ID NO: 68987 - RNA, 22 nt, Human
aucauacacucacauaaacaga

SEQ ID NO: 68988 - RNA, 22 nt, Human
aucauacagccuuuguuagugu

SEQ ID NO: 68989 - RNA, 22 nt, Human
aucauacauguaacuaaguaaa

SEQ ID NO: 68990 - RNA, 22 nt, Human
aucauagaacaccuaccuaccu

SEQ ID NO: 68991 - RNA, 22 nt, Human
aucauagguauaaguaaauuag

SEQ ID NO: 68992 - RNA, 22 nt, Human
aucaucaugcacucucagguuu

SEQ ID NO: 68993 - RNA, 22 nt, Human
aucauccacuggagccggcagg

SEQ ID NO: 68994 - RNA, 22 nt, Human
aucaucugccucaucacugcau

SEQ ID NO: 68995 - RNA, 22 nt, Human
aucaucuggguuaaugugcuca

SEQ ID NO: 68996 - RNA, 22 nt, Human
aucaucuugaaagucuauguuu

SEQ ID NO: 68997 - RNA, 22 nt, Human
caaucaugguauaauuccuuuu

SEQ ID NO: 68998 - RNA, 22 nt, Human
caaucuauaaauaucaguuucc

SEQ ID NO: 68999 - RNA, 22 nt, Human
caaucuauccucugauuuugua

SEQ ID NO: 69000 - RNA, 22 nt, Human
caaucuguacuugaaaaauuau

SEQ ID NO: 69001 - RNA, 22 nt, Human
caaucuuacuuuugaaaaguga

SEQ ID NO: 69002 - RNA, 22 nt, Human
caaugauaauggcuguauuuau

SEQ ID NO: 69003 - RNA, 22 nt, Human
caaugauguuuagauaaaaucc

SEQ ID NO: 69004 - RNA, 22 nt, Human
caaugcaagcaagauggucaca

SEQ ID NO: 69005 - RNA, 22 nt, Human
caaugcaaugcaaugcaaugca

SEQ ID NO: 69006 - RNA, 22 nt, Human
caaugcacgcucagauuugacc

SEQ ID NO: 69007 - RNA, 22 nt, Human
caaugcagauaccuuccagaga

SEQ ID NO: 69008 - RNA, 22 nt, Human
caaugcaugauggaauugccuu

SEQ ID NO: 69009 - RNA, 22 nt, Human
caaugcuaucaugucagagaua

SEQ ID NO: 69010 - RNA, 22 nt, Human
caaugcuucucauuagccaaug

SEQ ID NO: 69011 - RNA, 22 nt, Human
caaugcuugcugacucccuguc

SEQ ID NO: 69012 - RNA, 22 nt, Human
caaugcuuuuagcuucagcuug

SEQ ID NO: 69013 - RNA, 22 nt, Human
caaugcuuuuguucuuuacuca

SEQ ID NO: 69014 - RNA, 22 nt, Human
caaugggagcagaaauuguuug

SEQ ID NO: 69015 - RNA, 22 nt, Human
caaugguugaacccugucauga

SEQ ID NO: 69016 - RNA, 22 nt, Human
caauguacaaaauaauuacaca

SEQ ID NO: 69017 - RNA, 22 nt, Human
caauguacuacaaagauuguca

SEQ ID NO: 69018 - RNA, 22 nt, Human
caaugucagaauuacaguugau

SEQ ID NO: 69019 - RNA, 22 nt, Human
caaugucagucaagcagcaaau

SEQ ID NO: 69020 - RNA, 22 nt, Human
caaugucuucuauaguuacuca

SEQ ID NO: 69021 - RNA, 22 nt, Human
caaugugguggcagaugucagu

SEQ ID NO: 69022 - RNA, 22 nt, Human
caaugugugcuuacaggccagu

SEQ ID NO: 69023 - RNA, 22 nt, Human
caauguuugaguaggagcauaa

SEQ ID NO: 69024 - RNA, 22 nt, Human
caauguuuuguugaaugaauag

SEQ ID NO: 69025 - RNA, 22 nt, Human
caauuaaagaagaccugccuca

SEQ ID NO: 69026 - RNA, 21 nt, Human
caauuacuaugaaccaguuga

SEQ ID NO: 69027 - RNA, 22 nt, Human
caauuauauuuagaaugauaca

SEQ ID NO: 69028 - RNA, 22 nt, Human
caauucaaccuaagugcaucca

SEQ ID NO: 69029 - RNA, 22 nt, Human
caauucaacuugccuuuguagc

SEQ ID NO: 69030 - RNA, 22 nt, Human
caauucauguuaaacagaagca

SEQ ID NO: 69031 - RNA, 22 nt, Human
caauucauuacauugcaaagac

SEQ ID NO: 69032 - RNA, 22 nt, Human
caauucuuucagcugcauuugu

SEQ ID NO: 69033 - RNA, 22 nt, Human
caauucuuuguagaagcucucc

SEQ ID NO: 69034 - RNA, 22 nt, Human
caauugcuuuuccaagggcaga

SEQ ID NO: 69035 - RNA, 22 nt, Human
caauugucguugacauccuuca

SEQ ID NO: 69036 - RNA, 22 nt, Human
caauuucaauacaaaauacauu

SEQ ID NO: 69037 - RNA, 22 nt, Human
caauuucagaccuuuccuugga

SEQ ID NO: 69038 - RNA, 17 nt, Human
caauuucauagguuuug

SEQ ID NO: 69039 - RNA, 18 nt, Human
caauuucauccuuaagcc

SEQ ID NO: 69040 - RNA, 22 nt, Human
caauuucauggauaaaagaugu

SEQ ID NO: 69041 - RNA, 22 nt, Human
caauuucuuguuaauucucagg

SEQ ID NO: 69042 - RNA, 22 nt, Human
caauuugacaaguugcauguuu

SEQ ID NO: 69043 - RNA, 22 nt, Human
caauuugauuaauaccauacuu

SEQ ID NO: 69044 - RNA, 22 nt, Human
caauuugguuacuuccuuagaa

SEQ ID NO: 69045 - RNA, 22 nt, Human
caauuuuuaaacuaugaaguug

SEQ ID NO: 69046 - RNA, 22 nt, Human
cacaaaaguaggaggcaggcgg

SEQ ID NO: 69047 - RNA, 22 nt, Human
cacaaaccugccagcccugccc

SEQ ID NO: 69048 - RNA, 22 nt, Human
cacaaaccuucugcagccugua

SEQ ID NO: 69049 - RNA, 22 nt, Human
cacaaaggagaaugucagcaua

SEQ ID NO: 69050 - RNA, 22 nt, Human
cacaaagucugcagcugcugua

SEQ ID NO: 69051 - RNA, 22 nt, Human
cacaaaguguuagaugccacuc

SEQ ID NO: 69052 - RNA, 22 nt, Human
cacaaaguuggacaacgcaccc

SEQ ID NO: 69053 - RNA, 22 nt, Human
cacaaauggccguguucaaaga

SEQ ID NO: 69054 - RNA, 20 nt, Human
cacaacuguccacaugcucc

SEQ ID NO: 69055 - RNA, 22 nt, Human
cacaagaaauaagcugccuuuc

SEQ ID NO: 69056 - RNA, 21 nt, Human
cacaagacacauaggguguuu

SEQ ID NO: 69057 - RNA, 20 nt, Human
cacaagagaauacacacugg

SEQ ID NO: 69058 - RNA, 22 nt, Human
cacaagcuccuuauguggagaa

SEQ ID NO: 69059 - RNA, 22 nt, Human
cacaaggaccucagauggauga

SEQ ID NO: 69060 - RNA, 22 nt, Human
cacaaggagguccugaggaagc

SEQ ID NO: 69061 - RNA, 22 nt, Human
cacaaggcacauuccuugucca

SEQ ID NO: 69062 - RNA, 22 nt, Human
cacaaggcccugggucaccaca

SEQ ID NO: 69063 - RNA, 22 nt, Human
cacaaggcuuucaucuggcaua

SEQ ID NO: 69064 - RNA, 22 nt, Human
cacaagggagcuuagaaaacau

SEQ ID NO: 69065 - RNA, 22 nt, Human
cacaagucauuuucagcaggcu

SEQ ID NO: 69066 - RNA, 22 nt, Human
cacaaguuugggucacucagcu

SEQ ID NO: 69067 - RNA, 22 nt, Human
cacaauauuggccgggcugguc

SEQ ID NO: 69068 - RNA, 22 nt, Human
cacaaucauaauguauguacau

SEQ ID NO: 69069 - RNA, 22 nt, Human
cacaaucucaacugccuuuuag

SEQ ID NO: 69070 - RNA, 22 nt, Human
cacaaugcagcauguaaaugca

SEQ ID NO: 69071 - RNA, 22 nt, Human
cacaauguauauguauaucaaa

SEQ ID NO: 69072 - RNA, 22 nt, Human
cacaauuuguuuuaucaguauu

SEQ ID NO: 69073 - RNA, 22 nt, Human
cacacaaauauucuggaggcaa

SEQ ID NO: 69074 - RNA, 22 nt, Human
cacacaauuaugugugcacaau

SEQ ID NO: 69075 - RNA, 22 nt, Human
cacacacugacaccuuaucuug

SEQ ID NO: 69076 - RNA, 21 nt, Human
cacacagcugcccuuagguag

SEQ ID NO: 69077 - RNA, 22 nt, Human
cacacaggcaggaucccuuccc

SEQ ID NO: 69078 - RNA, 22 nt, Human
cacacagguaagccucuuucaa

SEQ ID NO: 69079 - RNA, 21 nt, Human
cacacagugaucuauccacau

SEQ ID NO: 69080 - RNA, 22 nt, Human
cacacagugggaaaaccugaag

SEQ ID NO: 69081 - RNA, 22 nt, Human
cacacauauugucccuagugug

SEQ ID NO: 69082 - RNA, 22 nt, Human
cacacaugaaguugcugagcua

SEQ ID NO: 69083 - RNA, 22 nt, Human
cacacaugugagcagagaggcg

SEQ ID NO: 69084 - RNA, 22 nt, Human
cacacaugugugcagcuuagaa

SEQ ID NO: 69085 - RNA, 21 nt, Human
cacaccaggcaugucuugagc

SEQ ID NO: 69086 - RNA, 22 nt, Human
cacacccaaauuucucucucag

SEQ ID NO: 69087 - RNA, 23 nt, Human
cacacccaucacuaagagcuccu

SEQ ID NO: 69088 - RNA, 22 nt, Human
cacacccuugcuaacacuuguu

SEQ ID NO: 69089 - RNA, 22 nt, Human
cacacugauagcacuaagucag

SEQ ID NO: 69090 - RNA, 22 nt, Human
cacacugucagguaaauaacac

SEQ ID NO: 69091 - RNA, 22 nt, Human
cacacugucuuucagaaugguu

SEQ ID NO: 69092 - RNA, 22 nt, Human
cacacuuucagguccucuuugc

SEQ ID NO: 69093 - RNA, 20 nt, Human
cacagaacaaauugcaggac

SEQ ID NO: 69094 - RNA, 22 nt, Human
auccuuggcacaguggaauuca

SEQ ID NO: 69095 - RNA, 22 nt, Human
auccuuggcagcucagaccuac

SEQ ID NO: 69096 - RNA, 22 nt, Human
auccuuuaguccuacaacucga

SEQ ID NO: 69097 - RNA, 22 nt, Human
aucgaauaauugcauucuauaa

SEQ ID NO: 69098 - RNA, 22 nt, Human
aucgcaauguuuagaauuuugu

SEQ ID NO: 69099 - RNA, 22 nt, Human
aucggggaaaagggaggcugug

SEQ ID NO: 69100 - RNA, 22 nt, Human
aucuaaaaggagcucuuuaucu

SEQ ID NO: 69101 - RNA, 22 nt, Human
aucuaaacuguuuacucucugc

SEQ ID NO: 69102 - RNA, 22 nt, Human
aucuaaagugucauaaguagcu

SEQ ID NO: 69103 - RNA, 22 nt, Human
aucuaacagcaacaccagaaua

SEQ ID NO: 69104 - RNA, 16 nt, Human
aucuaagaauguagag

SEQ ID NO: 69105 - RNA, 22 nt, Human
aucuaagaggaugguuggaaau

SEQ ID NO: 69106 - RNA, 22 nt, Human
aucuaagauguauugagcacuu

SEQ ID NO: 69107 - RNA, 23 nt, Human
aucuaauuucuccaaaucucuac

SEQ ID NO: 69108 - RNA, 22 nt, Human
aucuacaacggguggaguaggg

SEQ ID NO: 69109 - RNA, 22 nt, Human
aucuacaaugucuggcugcacu

SEQ ID NO: 69110 - RNA, 22 nt, Human
aucuacagccagucugguuugu

SEQ ID NO: 69111 - RNA, 22 nt, Human
aucuacaggauaguuuaauauu

SEQ ID NO: 69112 - RNA, 22 nt, Human
aucuacaggauuuuacagaguu

SEQ ID NO: 69113 - RNA, 22 nt, Human
aucuagaaguggcaugaauuac

SEQ ID NO: 69114 - RNA, 22 nt, Human
cacagcauucacagaaagacau

SEQ ID NO: 69115 - RNA, 22 nt, Human
cacagcccugcgccccaguuug

SEQ ID NO: 69116 - RNA, 22 nt, Human
cacagccuugagcgaggacaag

SEQ ID NO: 69117 - RNA, 22 nt, Human
cacagcuaccugcaugccugcu

SEQ ID NO: 69118 - RNA, 22 nt, Human
cacagcuagauggauagauaga

SEQ ID NO: 69119 - RNA, 22 nt, Human
cacagcuaggaggaaagcagag

SEQ ID NO: 69120 - RNA, 22 nt, Human
cacagcugcacagaggaggugc

SEQ ID NO: 69121 - RNA, 22 nt, Human
cacagcugccaugcagucagug

SEQ ID NO: 69122 - RNA, 22 nt, Human
cacagcugcccuacuccaugug

SEQ ID NO: 69123 - RNA, 19 nt, Human
cacagcuggcgcugaccgc

SEQ ID NO: 69124 - RNA, 22 nt, Human
cacagcugggaaaauuuguaca

SEQ ID NO: 69125 - RNA, 22 nt, Human
cacagcugucagcugaccuagg

SEQ ID NO: 69126 - RNA, 22 nt, Human
cacagcuguuuucuccaggcag

SEQ ID NO: 69127 - RNA, 22 nt, Human
cacagcuucuccuugauaucgc

SEQ ID NO: 69128 - RNA, 22 nt, Human
cacagcuucuuccauuccacuc

SEQ ID NO: 69129 - RNA, 22 nt, Human
cacaggaaaaauggguccuuua

SEQ ID NO: 69130 - RNA, 20 nt, Human
cacaggaaagcuacucaguu

SEQ ID NO: 69131 - RNA, 22 nt, Human
cacaggaaagucagccagaaga

SEQ ID NO: 69132 - RNA, 22 nt, Human
cacaggaaaugauucugcagca

SEQ ID NO: 69133 - RNA, 22 nt, Human
cacaggaagaucucccagaggu

SEQ ID NO: 69134 - RNA, 22 nt, Human
cacaggaauauaaguuugaguu

SEQ ID NO: 69135 - RNA, 22 nt, Human
cacaggagauugaucuauuggu

SEQ ID NO: 69136 - RNA, 22 nt, Human
cacaggaggaggugcccgggcc

SEQ ID NO: 69137 - RNA, 22 nt, Human
cacaggccaguaagacuguguu

SEQ ID NO: 69138 - RNA, 22 nt, Human
cacaggcugcccgcagcuggga

SEQ ID NO: 69139 - RNA, 22 nt, Human
cacaggcuugucagcaugaggc

SEQ ID NO: 69140 - RNA, 22 nt, Human
cacagggaggcggucacuggcu

SEQ ID NO: 69141 - RNA, 23 nt, Human
cacagggagggaaacucuuucag

SEQ ID NO: 69142 - RNA, 22 nt, Human
cacagggccacuuucccaguaa

SEQ ID NO: 69143 - RNA, 22 nt, Human
cacagguagaugccaugcagca

SEQ ID NO: 69144 - RNA, 22 nt, Human
cacaggugcaagaaguugcagu

SEQ ID NO: 69145 - RNA, 21 nt, Human
cacaggugggucagugaggcc

SEQ ID NO: 69146 - RNA, 22 nt, Human
cacaggugucucuaguagcguu

SEQ ID NO: 69147 - RNA, 22 nt, Human
cacagguguuuguuauacucag

SEQ ID NO: 69148 - RNA, 22 nt, Human
cacaguacccagcacuacugag

SEQ ID NO: 69149 - RNA, 22 nt, Human
cacaguaugaucuaaaguaagu

SEQ ID NO: 69150 - RNA, 22 nt, Human
cacagucacauaucuaugugug

SEQ ID NO: 69151 - RNA, 22 nt, Human
cacagucaccuuaucaggaugu

SEQ ID NO: 69152 - RNA, 19 nt, Human
cacaguccuauguuuauca

SEQ ID NO: 69153 - RNA, 22 nt, Human
cacagugaauuacauagacgug

SEQ ID NO: 69154 - RNA, 22 nt, Human
cacagugacauuagugagaaaa

SEQ ID NO: 69155 - RNA, 22 nt, Human
cacagugaccucuuuaaaaggg

SEQ ID NO: 69156 - RNA, 19 nt, Human
cacagugcagccauuucuc

SEQ ID NO: 69157 - RNA, 22 nt, Human
cacagugcucaaacacaagugc

SEQ ID NO: 69158 - RNA, 16 nt, Human
cacagugcugcugcuc

SEQ ID NO: 69159 - RNA, 22 nt, Human
cacagugcuguuuguaaagaga

SEQ ID NO: 69160 - RNA, 22 nt, Human
cacagugcuuuaugagagaucu

SEQ ID NO: 69161 - RNA, 22 nt, Human
cacaguggaaguccaggauccc

SEQ ID NO: 69162 - RNA, 22 nt, Human
cacaguggauugggugaugccc

SEQ ID NO: 69163 - RNA, 22 nt, Human
cacagugucugugcuucagugu

SEQ ID NO: 69164 - RNA, 22 nt, Human
cacagugugacugaccuucagc

SEQ ID NO: 69165 - RNA, 22 nt, Human
cacagugugggcauggugccug

SEQ ID NO: 69166 - RNA, 22 nt, Human
cacaguguuccagagcaguggu

SEQ ID NO: 69167 - RNA, 22 nt, Human
cacaguuaagggaugucauguu

SEQ ID NO: 69168 - RNA, 22 nt, Human
cacaguuagagguagaguccag

SEQ ID NO: 69169 - RNA, 22 nt, Human
cacaguuaugggaaacguaguu

SEQ ID NO: 69170 - RNA, 22 nt, Human
cacauaagaaaugaauaugaga

SEQ ID NO: 69171 - RNA, 22 nt, Human
cacauaaguggguuccauugca

SEQ ID NO: 69172 - RNA, 22 nt, Human
cacauaauugaacgugaugagu

SEQ ID NO: 69173 - RNA, 22 nt, Human
cacauacaagccauggggggau

SEQ ID NO: 69174 - RNA, 22 nt, Human
cacauacuuguguguacauaug

SEQ ID NO: 69175 - RNA, 22 nt, Human
cacauauaccucuucuugaguu

SEQ ID NO: 69176 - RNA, 19 nt, Human
cacaucagcagggcugugg

SEQ ID NO: 69177 - RNA, 22 nt, Human
cacaucagggcugcuugggggu

SEQ ID NO: 69178 - RNA, 23 nt, Human
cacaucaguuuaggucagauuuu

SEQ ID NO: 69179 - RNA, 22 nt, Human
cacaucauguuaauucauuaca

SEQ ID NO: 69180 - RNA, 22 nt, Human
cacaucuauagggacagcaaca

SEQ ID NO: 69181 - RNA, 22 nt, Human
cacaucucagggcuacaggcag

SEQ ID NO: 69182 - RNA, 22 nt, Human
cacaucugaaaagaugcacaag

SEQ ID NO: 69183 - RNA, 22 nt, Human
cacaucugacuuccagugcagg

SEQ ID NO: 69184 - RNA, 22 nt, Human
cacaucuucuuaacuccaaagu

SEQ ID NO: 69185 - RNA, 22 nt, Human
cacaugaauaaggcuuuauugu

SEQ ID NO: 69186 - RNA, 22 nt, Human
cacaugacucuggcuacccaga

SEQ ID NO: 69187 - RNA, 22 nt, Human
cacaugagagcccccaagagca

SEQ ID NO: 69188 - RNA, 22 nt, Human
cacaugaguccugccagguaug

SEQ ID NO: 69189 - RNA, 22 nt, Human
cacaugaguguaggaagaggga

SEQ ID NO: 69190 - RNA, 22 nt, Human
cacaugaugguggaagccauag

SEQ ID NO: 69191 - RNA, 22 nt, Human
cacaugcaccagaaaucaacau

SEQ ID NO: 69192 - RNA, 22 nt, Human
cacaugcaucugucauguuugg

SEQ ID NO: 69193 - RNA, 22 nt, Human
cacaugccuauuaaccaaacga

SEQ ID NO: 69194 - RNA, 22 nt, Human
cacaugggcguaauguccaugg

SEQ ID NO: 69195 - RNA, 22 nt, Human
cacaugggcuuagcaggcaggg

SEQ ID NO: 69196 - RNA, 22 nt, Human
cacauggggcgcugcauuggcc

SEQ ID NO: 69197 - RNA, 21 nt, Human
cacaugugaauuacugaacug

SEQ ID NO: 69198 - RNA, 22 nt, Human
cacauguucuugaagccaacuc

SEQ ID NO: 69199 - RNA, 22 nt, Human
cacauguuuggcaugucaccaa

SEQ ID NO: 69200 - RNA, 22 nt, Human
cacauucacuucucuguccacc

SEQ ID NO: 69201 - RNA, 21 nt, Human
cacauuccaugggucuauuua

SEQ ID NO: 69202 - RNA, 22 nt, Human
cacauucuguccuugaacugca

SEQ ID NO: 69203 - RNA, 20 nt, Human
auaugggugaugaugucugu

SEQ ID NO: 69204 - RNA, 22 nt, Human
auauguauugagugccaacugu

SEQ ID NO: 69205 - RNA, 22 nt, Human
auaugucucuguacaacagucu

SEQ ID NO: 69206 - RNA, 22 nt, Human
auauguggcauuauuucugagg

SEQ ID NO: 69207 - RNA, 22 nt, Human
auauguguaaaugcauuuguuu

SEQ ID NO: 69208 - RNA, 22 nt, Human
auaugugugaugcauggacuaa

SEQ ID NO: 69209 - RNA, 22 nt, Human
auaugugugcacauauguauuu

SEQ ID NO: 69210 - RNA, 22 nt, Human
auauguguguauuucuuacuag

SEQ ID NO: 69211 - RNA, 22 nt, Human
auauguuacucuuucaagcaga

SEQ ID NO: 69212 - RNA, 22 nt, Human
auauguuucaguauucaaguca

SEQ ID NO: 69213 - RNA, 22 nt, Human
auauuacacacgguaucacggg

SEQ ID NO: 69214 - RNA, 22 nt, Human
auauuaggaguuaaauguauua

SEQ ID NO: 69215 - RNA, 22 nt, Human
auauuagggucucuaaauucua

SEQ ID NO: 69216 - RNA, 22 nt, Human
auauuauucuagcucuugugug

SEQ ID NO: 69217 - RNA, 22 nt, Human
auauucaaauuacauuuacuaa

SEQ ID NO: 69218 - RNA, 22 nt, Human
auauucacaguaaguguagcag

SEQ ID NO: 69219 - RNA, 23 nt, Human
auauucacgccgccagagguccc

SEQ ID NO: 69220 - RNA, 22 nt, Human
auauucauugaacaccuacuac

SEQ ID NO: 69221 - RNA, 22 nt, Human
auauuccugacuuaauuuuuga

SEQ ID NO: 69222 - RNA, 22 nt, Human
auauucguggucaaguaaggcc

SEQ ID NO: 69223 - RNA, 22 nt, Human
auauucuauaagcaguuggaag

SEQ ID NO: 69224 - RNA, 22 nt, Human
auauucuuccaaaacaucauuu

SEQ ID NO: 69225 - RNA, 22 nt, Human
auauucuugaaagauccuggua

SEQ ID NO: 69226 - RNA, 22 nt, Human
auauugagauaagaacugacau

SEQ ID NO: 69227 - RNA, 22 nt, Human
auauugcaguguguuuauguga

SEQ ID NO: 69228 - RNA, 22 nt, Human
auauugcauuggcuggucuuga

SEQ ID NO: 69229 - RNA, 22 nt, Human
auauuguguguacaaguaguua

SEQ ID NO: 69230 - RNA, 22 nt, Human
auauuuaaacaggguaccaaua

SEQ ID NO: 69231 - RNA, 22 nt, Human
aucuauacucagaguuaauauc

SEQ ID NO: 69232 - RNA, 22 nt, Human
aucuaugugggaaucauaauag

SEQ ID NO: 69233 - RNA, 22 nt, Human
aucuauucucuacaguagacag

SEQ ID NO: 69234 - RNA, 22 nt, Human
aucuauuuuaaauggcaguaaa

SEQ ID NO: 69235 - RNA, 22 nt, Human
aucucaacuaagccuaacuuuu

SEQ ID NO: 69236 - RNA, 22 nt, Human
aucucacagaggcccaccagga

SEQ ID NO: 69237 - RNA, 22 nt, Human
aucucacaggacugaaacguaa

SEQ ID NO: 69238 - RNA, 22 nt, Human
aucucagaaacauaucuaaucc

SEQ ID NO: 69239 - RNA, 22 nt, Human
aucucagacauguuguccauga

SEQ ID NO: 69240 - RNA, 22 nt, Human
aucucagaucuacagaucuaca

SEQ ID NO: 69241 - RNA, 22 nt, Human
aucucagggguuccuucuagag

SEQ ID NO: 69242 - RNA, 22 nt, Human
aucucagucagguugaauuugg

SEQ ID NO: 69243 - RNA, 22 nt, Human
aucucauaacucauuugaagac

SEQ ID NO: 69244 - RNA, 22 nt, Human
aucuccagaggagucauggucu

SEQ ID NO: 69245 - RNA, 22 nt, Human
aucuccagcucgcagagcuccu

SEQ ID NO: 69246 - RNA, 22 nt, Human
aucuccagcuggcugugauaaa

SEQ ID NO: 69247 - RNA, 22 nt, Human
aucuccaggauuuucacacuca

SEQ ID NO: 69248 - RNA, 22 nt, Human
aucuccaggcauuucaagagac

SEQ ID NO: 69249 - RNA, 22 nt, Human
aucuccaguauccuaguauugu

SEQ ID NO: 69250 - RNA, 22 nt, Human
aucuccagugaggcagauucug

SEQ ID NO: 69251 - RNA, 22 nt, Human
aucuccgccaucgcgaacgccu

SEQ ID NO: 69252 - RNA, 22 nt, Human
aucuccuaaaguuuccagaaga

SEQ ID NO: 69253 - RNA, 20 nt, Human
aucuccugcuaccacccauu

SEQ ID NO: 69254 - RNA, 22 nt, Human
aucuccuuggucucguuccagg

SEQ ID NO: 69255 - RNA, 19 nt, Human
aucuccuuucuucaagcuu

SEQ ID NO: 69256 - RNA, 22 nt, Human
aucucguuuugagaacuguguu

SEQ ID NO: 69257 - RNA, 22 nt, Human
aucucuaaucaccagcucuagc

SEQ ID NO: 69258 - RNA, 17 nt, Human
aucucucuaaggcaggc

SEQ ID NO: 69259 - RNA, 23 nt, Human
aucucucugguggucacagucag

SEQ ID NO: 69260 - RNA, 22 nt, Human
aucucugcaucccucaagguug

SEQ ID NO: 69261 - RNA, 22 nt, Human
aucucuggcaaugcagcaucgu

SEQ ID NO: 69262 - RNA, 22 nt, Human
aucucuggccuuccuuuuccaa

SEQ ID NO: 69263 - RNA, 22 nt, Human
aucucugugccaucauugcccc

SEQ ID NO: 69264 - RNA, 22 nt, Human
aucucuuugauggcuccuguga

SEQ ID NO: 69265 - RNA, 23 nt, Human
aucugaaaagcauuugcaguuug

SEQ ID NO: 69266 - RNA, 22 nt, Human
aucugaaauagucuuaucugag

SEQ ID NO: 69267 - RNA, 22 nt, Human
aucugacaaccuauugacuuga

SEQ ID NO: 69268 - RNA, 22 nt, Human
aucugacaaguuguguguauag

SEQ ID NO: 69269 - RNA, 22 nt, Human
aucugacaucucccucugacau

SEQ ID NO: 69270 - RNA, 19 nt, Human
aucugaggccucaucuggg

SEQ ID NO: 69271 - RNA, 22 nt, Human
aucugaggguuugggcaucagc

SEQ ID NO: 69272 - RNA, 22 nt, Human
aucugagguauaugacuggcua

SEQ ID NO: 69273 - RNA, 22 nt, Human
aucugaguguuggauuuauugu

SEQ ID NO: 69274 - RNA, 22 nt, Human
aucugcaucagacuuugcauga

SEQ ID NO: 69275 - RNA, 17 nt, Human
aucugcauuucuaauga

SEQ ID NO: 69276 - RNA, 22 nt, Human
aucugccaaugccaugagaaga

SEQ ID NO: 69277 - RNA, 22 nt, Human
aucugcccaucuguccugcuuc

SEQ ID NO: 69278 - RNA, 22 nt, Human
aucugccucuucuucauugcga

SEQ ID NO: 69279 - RNA, 22 nt, Human
aucugccugcuuaugaugccug

SEQ ID NO: 69280 - RNA, 22 nt, Human
aucugccuguauuuaccaucau

SEQ ID NO: 69281 - RNA, 19 nt, Human
aucugccuguuaucacaua

SEQ ID NO: 69282 - RNA, 22 nt, Human
aucugcugucacauguuugaag

SEQ ID NO: 69283 - RNA, 22 nt, Human
aucugcuguguguaauggaaug

SEQ ID NO: 69284 - RNA, 22 nt, Human
aucugcuucagugauaugugaa

SEQ ID NO: 69285 - RNA, 22 nt, Human
aucugcuuccuccuuagggaaa

SEQ ID NO: 69286 - RNA, 22 nt, Human
aucugcuugaaugagcaacagg

SEQ ID NO: 69287 - RNA, 22 nt, Human
aucugcuugcaggcuggcccuu

SEQ ID NO: 69288 - RNA, 22 nt, Human
aucuggaauccuuguggacaau

SEQ ID NO: 69289 - RNA, 22 nt, Human
aucuggagagaucuucacaaaa

SEQ ID NO: 69290 - RNA, 22 nt, Human
aucuggagcaagauuaagagau

SEQ ID NO: 69291 - RNA, 22 nt, Human
aucuggaggauucugggacuug

SEQ ID NO: 69292 - RNA, 22 nt, Human
aucuggaggcauuacucugucu

SEQ ID NO: 69293 - RNA, 22 nt, Human
aucuggaggccugucuuauccc

SEQ ID NO: 69294 - RNA, 22 nt, Human
aucuggcucauucagggaacgg

SEQ ID NO: 69295 - RNA, 22 nt, Human
aucuggcucgcuaggcucuggg

SEQ ID NO: 69296 - RNA, 22 nt, Human
aucuggcugagcgaggcccaca

SEQ ID NO: 69297 - RNA, 22 nt, Human
aucuggcuugacuuugcgacuu

SEQ ID NO: 69298 - RNA, 23 nt, Human
aucugggcaucuggagugguccu

SEQ ID NO: 69299 - RNA, 22 nt, Human
aucugggccaauccuaguacca

SEQ ID NO: 69300 - RNA, 22 nt, Human
aucuggguucaccaugcuccug

SEQ ID NO: 69301 - RNA, 22 nt, Human
aucugguaugagguuuugcuuu

SEQ ID NO: 69302 - RNA, 22 nt, Human
aucugguauuuccuuugauagc

SEQ ID NO: 69303 - RNA, 22 nt, Human
aucugguucuucuuaggcauca

SEQ ID NO: 69304 - RNA, 22 nt, Human
aucugguuuggggauccuugug

SEQ ID NO: 69305 - RNA, 22 nt, Human
aucuguagucacugcacagcuc

SEQ ID NO: 69306 - RNA, 22 nt, Human
aucugucagccugggauuaggg

SEQ ID NO: 69307 - RNA, 22 nt, Human
aucugucaucagcaccacaggu

SEQ ID NO: 69308 - RNA, 22 nt, Human
aucuguccuggagcuaggcuuc

SEQ ID NO: 69309 - RNA, 18 nt, Human
aucuguccuuucucugcc

SEQ ID NO: 69310 - RNA, 22 nt, Human
aucugucugggugcagcagucc

SEQ ID NO: 69311 - RNA, 22 nt, Human
aucugucuugccuugcauauuu

SEQ ID NO: 69312 - RNA, 22 nt, Human
cagaaguucuagauuugagucc

SEQ ID NO: 69313 - RNA, 22 nt, Human
cagaaguuggagcuuuccauca

SEQ ID NO: 69314 - RNA, 22 nt, Human
cagaauaaacagaaacguagcu

SEQ ID NO: 69315 - RNA, 22 nt, Human
cagaauaaagguacaauugagu

SEQ ID NO: 69316 - RNA, 22 nt, Human
cagaauaagcuguguugucaag

SEQ ID NO: 69317 - RNA, 22 nt, Human
cagaauacccuauagacagaau

SEQ ID NO: 69318 - RNA, 22 nt, Human
cagaauaugacucgggcacuac

SEQ ID NO: 69319 - RNA, 22 nt, Human
cagaaucagcccuugcuauuaa

SEQ ID NO: 69320 - RNA, 22 nt, Human
cagaauccagaauugcugaggu

SEQ ID NO: 69321 - RNA, 22 nt, Human
cagaauccaugacagacguuga

SEQ ID NO: 69322 - RNA, 22 nt, Human
cagaaucuacacccucagaaau

SEQ ID NO: 69323 - RNA, 22 nt, Human
cagaaucugagucgugauugua

SEQ ID NO: 69324 - RNA, 22 nt, Human
cagaaucuguugggguugcaga

SEQ ID NO: 69325 - RNA, 22 nt, Human
cagaaugcagaauguucauuuu

SEQ ID NO: 69326 - RNA, 22 nt, Human
cagaaugcauugcuucugaugg

SEQ ID NO: 69327 - RNA, 22 nt, Human
cagaauggcuuuuauggcucag

SEQ ID NO: 69328 - RNA, 22 nt, Human
cagaauguauucucauaaagcc

SEQ ID NO: 69329 - RNA, 22 nt, Human
cagaauuucagugauguuuucu

SEQ ID NO: 69330 - RNA, 22 nt, Human
cagaauuucccacacugggacu

SEQ ID NO: 69331 - RNA, 22 nt, Human
cagaauuugaaguaauauucca

SEQ ID NO: 69332 - RNA, 22 nt, Human
cagacaacuggacuaagaucac

SEQ ID NO: 69333 - RNA, 22 nt, Human
cagacacacaagcaaucuaagu

SEQ ID NO: 69334 - RNA, 22 nt, Human
cagacacagcaauucuguguug

SEQ ID NO: 69335 - RNA, 22 nt, Human
cagacacuaggugacagagugc

SEQ ID NO: 69336 - RNA, 22 nt, Human
cagacacuaugcuaagguacua

SEQ ID NO: 69337 - RNA, 22 nt, Human
cagacagagucuucccaucagu

SEQ ID NO: 69338 - RNA, 22 nt, Human
cagacaggagacuggaucaugg

SEQ ID NO: 69339 - RNA, 22 nt, Human
cagacaggcaggugagagcucc

SEQ ID NO: 69340 - RNA, 17 nt, Human
cagacaggcugucaccc

SEQ ID NO: 69341 - RNA, 22 nt, Human
cagacagggcccugugauggua

SEQ ID NO: 69342 - RNA, 22 nt, Human
cagacaggguuuuggucuuugg

SEQ ID NO: 69343 - RNA, 22 nt, Human
cagacauaucccugcucccuua

SEQ ID NO: 69344 - RNA, 22 nt, Human
aucuuucuauuucuaaaaacua

SEQ ID NO: 69345 - RNA, 22 nt, Human
aucuuucuccauauacaucuuu

SEQ ID NO: 69346 - RNA, 22 nt, Human
aucuuugaagaggacuugaagu

SEQ ID NO: 69347 - RNA, 22 nt, Human
aucuuugaaucaaugaaucagu

SEQ ID NO: 69348 - RNA, 22 nt, Human
aucuuuggccacuugugcugca

SEQ ID NO: 69349 - RNA, 22 nt, Human
aucuuugggauccugauuuacu

SEQ ID NO: 69350 - RNA, 19 nt, Human
aucuuuggguccugaaggg

SEQ ID NO: 69351 - RNA, 22 nt, Human
aucuuuggugcuuggugcuccc

SEQ ID NO: 69352 - RNA, 22 nt, Human
aucuuugucacucuacugucua

SEQ ID NO: 69353 - RNA, 22 nt, Human
aucuuugugcuaauguaguucu

SEQ ID NO: 69354 - RNA, 22 nt, Human
aucuuuuacuacaaaucaggug

SEQ ID NO: 69355 - RNA, 22 nt, Human
aucuuuuuacuaacacugcuua

SEQ ID NO: 69356 - RNA, 22 nt, Human
augaaaagggagugauauuugu

SEQ ID NO: 69357 - RNA, 22 nt, Human
augaaacaacagacuuggucaa

SEQ ID NO: 69358 - RNA, 22 nt, Human
augaaacaaggguauuuucucu

SEQ ID NO: 69359 - RNA, 22 nt, Human
augaaacaugcuuuguggauga

SEQ ID NO: 69360 - RNA, 23 nt, Human
augaaacucaagccagauccaag

SEQ ID NO: 69361 - RNA, 22 nt, Human
augaaacugggauaacuauagc

SEQ ID NO: 69362 - RNA, 22 nt, Human
augaaagaugauuuaaaguacu

SEQ ID NO: 69363 - RNA, 22 nt, Human
augaaagcaaauuauaggccau

SEQ ID NO: 69364 - RNA, 22 nt, Human
augaaagcaacuuauuugagau

SEQ ID NO: 69365 - RNA, 22 nt, Human
augaaaguaggguaaaaucaca

SEQ ID NO: 69366 - RNA, 22 nt, Human
augaaaguggcuugauuaaaug

SEQ ID NO: 69367 - RNA, 22 nt, Human
augaaaguguuuaaguuuaugu

SEQ ID NO: 69368 - RNA, 22 nt, Human
augaaaguuugcauuccucagu

SEQ ID NO: 69369 - RNA, 23 nt, Human
augaaaugcuggcucagggaggu

SEQ ID NO: 69370 - RNA, 22 nt, Human
augaaauguaaguagagaguuu

SEQ ID NO: 69371 - RNA, 22 nt, Human
augaaauucaucugagaaugcu

SEQ ID NO: 69372 - RNA, 22 nt, Human
augaaauugaucuugaacuuuu

SEQ ID NO: 69373 - RNA, 22 nt, Human
augaaauuugcugcuaaguucc

SEQ ID NO: 69374 - RNA, 22 nt, Human
augaacaaucuggcaagaacuu

SEQ ID NO: 69375 - RNA, 22 nt, Human
augaacagcauugaaauccagc

SEQ ID NO: 69376 - RNA, 22 nt, Human
augaacaguaugcaacaugauu

SEQ ID NO: 69377 - RNA, 22 nt, Human
augaacuaagagucauuagugu

SEQ ID NO: 69378 - RNA, 22 nt, Human
augaacucauuuauuuuccucu

SEQ ID NO: 69379 - RNA, 22 nt, Human
augaacucuucugguuauuuuu

SEQ ID NO: 69380 - RNA, 22 nt, Human
augaagacaaacgacguugcaa

SEQ ID NO: 69381 - RNA, 22 nt, Human
augaagacaaacuggguagaaa

SEQ ID NO: 69382 - RNA, 22 nt, Human
augaagacaggucucaucacca

SEQ ID NO: 69383 - RNA, 22 nt, Human
augaagacuaaugugaauggga

SEQ ID NO: 69384 - RNA, 22 nt, Human
augaagauaauagcauugguug

SEQ ID NO: 69385 - RNA, 22 nt, Human
augaagauucuauuuaucacuu

SEQ ID NO: 69386 - RNA, 22 nt, Human
augaagauuuauaauugccuuu

SEQ ID NO: 69387 - RNA, 22 nt, Human
augaagcagacucagguggugc

SEQ ID NO: 69388 - RNA, 22 nt, Human
augaagcaggcacagcuucagg

SEQ ID NO: 69389 - RNA, 19 nt, Human
augaagcauuguuuuugua

SEQ ID NO: 69390 - RNA, 22 nt, Human
augaagcguucgagauagguag

SEQ ID NO: 69391 - RNA, 22 nt, Human
augaagcuguuuauuuuagcag

SEQ ID NO: 69392 - RNA, 22 nt, Human
augaaggcuguguagauggaug

SEQ ID NO: 69393 - RNA, 22 nt, Human
augaagggugucccugugagca

SEQ ID NO: 69394 - RNA, 22 nt, Human
augaagucugcacaugcaugug

SEQ ID NO: 69395 - RNA, 22 nt, Human
augaagucugccaaggaaaggc

SEQ ID NO: 69396 - RNA, 22 nt, Human
augaaguuccaguauaugcagu

SEQ ID NO: 69397 - RNA, 22 nt, Human
augaaguucucaauaaucaugu

SEQ ID NO: 69398 - RNA, 22 nt, Human
augaauacgcggucauacacau

SEQ ID NO: 69399 - RNA, 22 nt, Human
augaauauugaaugucuuauga

SEQ ID NO: 69400 - RNA, 22 nt, Human
augaaucagaaucugcauuuua

SEQ ID NO: 69401 - RNA, 23 nt, Human
augaaugaauaaggcaggaaagc

SEQ ID NO: 69402 - RNA, 19 nt, Human
augaaugagcugugagguu

SEQ ID NO: 69403 - RNA, 22 nt, Human
augaaugaugccaguugaaaug

SEQ ID NO: 69404 - RNA, 22 nt, Human
augaaugauuaaagaguacagu

SEQ ID NO: 69405 - RNA, 22 nt, Human
augaaugcugaauuaugaacug

SEQ ID NO: 69406 - RNA, 22 nt, Human
augaauuguaaauuccuugaaa

SEQ ID NO: 69407 - RNA, 22 nt, Human
augaauuuuucuaagcuuuugu

SEQ ID NO: 69408 - RNA, 22 nt, Human
augacaaauucagaccauagca

SEQ ID NO: 69409 - RNA, 22 nt, Human
augacaagaguguucagggaga

SEQ ID NO: 69410 - RNA, 22 nt, Human
augacaauauagcuuugauuuu

SEQ ID NO: 69411 - RNA, 22 nt, Human
augacaauggacauaguuaaaa

SEQ ID NO: 69412 - RNA, 22 nt, Human
augacaccauauuagccuagag

SEQ ID NO: 69413 - RNA, 22 nt, Human
augacacugagaauaacaggua

SEQ ID NO: 69414 - RNA, 22 nt, Human
augacacuuggugauacuuugu

SEQ ID NO: 69415 - RNA, 22 nt, Human
augacagaaggccucccugaca

SEQ ID NO: 69416 - RNA, 22 nt, Human
augacagacccucuaaagacaa

SEQ ID NO: 69417 - RNA, 22 nt, Human
augacagcauucaagacauaga

SEQ ID NO: 69418 - RNA, 22 nt, Human
augacagcauuuucuucuaagg

SEQ ID NO: 69419 - RNA, 22 nt, Human
augacagcucuagcacacagua

SEQ ID NO: 69420 - RNA, 22 nt, Human
augacaguagguaaaugauagc

SEQ ID NO: 69421 - RNA, 22 nt, Human
augacccagucaaagggaaugg

SEQ ID NO: 69422 - RNA, 22 nt, Human
augacuaagugcauuuuaauug

SEQ ID NO: 69423 - RNA, 22 nt, Human
augacuaauggaaaauacaaug

SEQ ID NO: 69424 - RNA, 22 nt, Human
augacucuaagaauucuagaug

SEQ ID NO: 69425 - RNA, 22 nt, Human
augacucuuagcuaaagguaag

SEQ ID NO: 69426 - RNA, 22 nt, Human
augacuucugcaaggucauuug

SEQ ID NO: 69427 - RNA, 22 nt, Human
augacuucugcuuuacagaguu

SEQ ID NO: 69428 - RNA, 22 nt, Human
augacuuuuaggagcagugcuc

SEQ ID NO: 69429 - RNA, 22 nt, Human
augagaaagaguuguaucuaga

SEQ ID NO: 69430 - RNA, 22 nt, Human
augagaaaguuaaucaucauga

SEQ ID NO: 69431 - RNA, 22 nt, Human
augagagacaggaacgagcugg

SEQ ID NO: 69432 - RNA, 22 nt, Human
augagagacuguguguugggag

SEQ ID NO: 69433 - RNA, 18 nt, Human
augagaggugucagaaga

SEQ ID NO: 69434 - RNA, 22 nt, Human
augagagucucagagucucuuc

SEQ ID NO: 69435 - RNA, 22 nt, Human
augagauaauucauguggaaug

SEQ ID NO: 69436 - RNA, 22 nt, Human
augagcagaugcuccugccucu

SEQ ID NO: 69437 - RNA, 22 nt, Human
augagcaggaagagcacaaaga

SEQ ID NO: 69438 - RNA, 19 nt, Human
augagcaggcaagacaagc

SEQ ID NO: 69439 - RNA, 23 nt, Human
augagcauuuuuaauuucugugg

SEQ ID NO: 69440 - RNA, 22 nt, Human
augagcccagggaauuccuuuc

SEQ ID NO: 69441 - RNA, 22 nt, Human
augagcucauccgagucacacu

SEQ ID NO: 69442 - RNA, 22 nt, Human
augagcuucccagacaggaugg

SEQ ID NO: 69443 - RNA, 22 nt, Human
augaggagaccaaggccugaug

SEQ ID NO: 69444 - RNA, 22 nt, Human
augaggagcuguuuuaacugcu

SEQ ID NO: 69445 - RNA, 22 nt, Human
augaggauuaacuguugucaua

SEQ ID NO: 69446 - RNA, 22 nt, Human
augaggcaaagguggagguggg

SEQ ID NO: 69447 - RNA, 22 nt, Human
augaggcagagggcugugccag

SEQ ID NO: 69448 - RNA, 22 nt, Human
augaggcagcugacagcuguuc

SEQ ID NO: 69449 - RNA, 22 nt, Human
augaggcagcuggcuuucuccc

SEQ ID NO: 69450 - RNA, 22 nt, Human
augaggcaggagugcaguggca

SEQ ID NO: 69451 - RNA, 22 nt, Human
augaggcaggauauuaacuuuu

SEQ ID NO: 69452 - RNA, 22 nt, Human
augaggcagucuggccugaggg

SEQ ID NO: 69453 - RNA, 22 nt, Human
augaggcauauccuccuauggu

SEQ ID NO: 69454 - RNA, 22 nt, Human
augaggcaugggaucaaaauga

SEQ ID NO: 69455 - RNA, 22 nt, Human
augaggcaugugaggagaaggg

SEQ ID NO: 69456 - RNA, 22 nt, Human
augaggcauucacagaaggcac

SEQ ID NO: 69457 - RNA, 20 nt, Human
augaggccagcagggcucag

SEQ ID NO: 69458 - RNA, 22 nt, Human
augaggccauggcugucacuaa

SEQ ID NO: 69459 - RNA, 22 nt, Human
augaggcuauuucauagauuuu

SEQ ID NO: 69460 - RNA, 22 nt, Human
augagguaguuuggagaagagc

SEQ ID NO: 69461 - RNA, 22 nt, Human
augagguccagggaaguuaaau

SEQ ID NO: 69462 - RNA, 22 nt, Human
augagguuuuacugccauuuuc

SEQ ID NO: 69463 - RNA, 22 nt, Human
augagguuuugauuggcacagg

SEQ ID NO: 69464 - RNA, 22 nt, Human
augaguaagauaggcaaugugu

SEQ ID NO: 69465 - RNA, 22 nt, Human
augagucacucagcagaaaagg

SEQ ID NO: 69466 - RNA, 20 nt, Human
augagucuacacacuggcuu

SEQ ID NO: 69467 - RNA, 22 nt, Human
augaguuaguuucuugucuaga

SEQ ID NO: 69468 - RNA, 22 nt, Human
augaguucauugcauuugacag

SEQ ID NO: 69469 - RNA, 20 nt, Human
augaguuuaaacauucagag

SEQ ID NO: 69470 - RNA, 22 nt, Human
augauaacaacagcagugcugg

SEQ ID NO: 69471 - RNA, 22 nt, Human
augauaagccaugucgugguca

SEQ ID NO: 69472 - RNA, 22 nt, Human
augauacaccuaggagugggag

SEQ ID NO: 69473 - RNA, 22 nt, Human
augauacaucuucaugucagug

SEQ ID NO: 69474 - RNA, 22 nt, Human
augauacauuuaccuauggucu

SEQ ID NO: 69475 - RNA, 22 nt, Human
augauacucuaggugauuuaca

SEQ ID NO: 69476 - RNA, 21 nt, Human
augauacugaagcacaacuau

SEQ ID NO: 69477 - RNA, 22 nt, Human
aucuuucacuuuuuguggauga

SEQ ID NO: 69478 - RNA, 22 nt, Human
aucuuucaggccuaguguuuaa

SEQ ID NO: 69479 - RNA, 18 nt, Human
aucuuuccauagcauguu

SEQ ID NO: 69480 - RNA, 22 nt, Human
aucuuucucugcacuauacaau

SEQ ID NO: 69481 - RNA, 22 nt, Human
aucuuugacugccauucuugac

SEQ ID NO: 69482 - RNA, 22 nt, Human
aucuuuggaaagccaagcacag

SEQ ID NO: 69483 - RNA, 22 nt, Human
aucuuuggacggucccaacuga

SEQ ID NO: 69484 - RNA, 20 nt, Human
aucuuuggcucagaagccuu

SEQ ID NO: 69485 - RNA, 22 nt, Human
aucuuugggauauuugugauua

SEQ ID NO: 69486 - RNA, 22 nt, Human
aucuuuggucuugagugcaucu

SEQ ID NO: 69487 - RNA, 22 nt, Human
aucuuuucuguuugcuaugucu

SEQ ID NO: 69488 - RNA, 22 nt, Human
aucuuuuugacauggugauggu

SEQ ID NO: 69489 - RNA, 22 nt, Human
aucuuuuuugucuuggucacug

SEQ ID NO: 69490 - RNA, 22 nt, Human
augaaaacagccuccugugaua

SEQ ID NO: 69491 - RNA, 22 nt, Human
augaaaagcauaaacgcugaag

SEQ ID NO: 69492 - RNA, 22 nt, Human
augaaaauacugugguugauag

SEQ ID NO: 69493 - RNA, 22 nt, Human
augaaacuaaacuacauaaguu

SEQ ID NO: 69494 - RNA, 22 nt, Human
augaaacugaaggacaaccaga

SEQ ID NO: 69495 - RNA, 22 nt, Human
augaaagcaagaagugaguuga

SEQ ID NO: 69496 - RNA, 22 nt, Human
augaaagcaggaauuguucugu

SEQ ID NO: 69497 - RNA, 22 nt, Human
augaaauauuucagagcagagu

SEQ ID NO: 69498 - RNA, 22 nt, Human
augaaaugcuauuuuggcuaga

SEQ ID NO: 69499 - RNA, 22 nt, Human
augaaaugcugagaggugcuuc

SEQ ID NO: 69500 - RNA, 22 nt, Human
augaaauguaugagucuggguu

SEQ ID NO: 69501 - RNA, 22 nt, Human
augaaauuaaucaacacauaca

SEQ ID NO: 69502 - RNA, 20 nt, Human
augaaauuccuguuuucuga

SEQ ID NO: 69503 - RNA, 22 nt, Human
augaaauuuuaauuauaccucu

SEQ ID NO: 69504 - RNA, 22 nt, Human
augaacaacuugaagcuccaug

SEQ ID NO: 69505 - RNA, 22 nt, Human
augaacagaggaauagaauucu

SEQ ID NO: 69506 - RNA, 22 nt, Human
augaacaguacaaagcacagac

SEQ ID NO: 69507 - RNA, 22 nt, Human
augaacaugugacucagaccug

SEQ ID NO: 69508 - RNA, 23 nt, Human
augaacauuaguuucagauauug

SEQ ID NO: 69509 - RNA, 22 nt, Human
augaaccauaggcaagacaaua

SEQ ID NO: 69510 - RNA, 22 nt, Human
augaagaaaaauccagcugucc

SEQ ID NO: 69511 - RNA, 19 nt, Human
augaagauugguaaauuca

SEQ ID NO: 69512 - RNA, 22 nt, Human
augaagcaucucacaaucuagu

SEQ ID NO: 69513 - RNA, 22 nt, Human
augaagcugaaaaaggcauaua

SEQ ID NO: 69514 - RNA, 22 nt, Human
augaagcugaccuugucuugcu

SEQ ID NO: 69515 - RNA, 22 nt, Human
augaagcugguuuuggcuuggg

SEQ ID NO: 69516 - RNA, 22 nt, Human
augaaggauggcuggcugcccu

SEQ ID NO: 69517 - RNA, 22 nt, Human
augaaggcaagacugaggugug

SEQ ID NO: 69518 - RNA, 21 nt, Human
augaaggcagugccaagggcu

SEQ ID NO: 69519 - RNA, 22 nt, Human
augaaggcaguuaaacgucauc

SEQ ID NO: 69520 - RNA, 22 nt, Human
augaaggcuguguggagccccc

SEQ ID NO: 69521 - RNA, 22 nt, Human
augaagucuagcaagcauugaa

SEQ ID NO: 69522 - RNA, 21 nt, Human
augaagucuaugcuucugugu

SEQ ID NO: 69523 - RNA, 22 nt, Human
augaagucuauuuaccuaagcu

SEQ ID NO: 69524 - RNA, 22 nt, Human
augaaguucuagugagaaaugc

SEQ ID NO: 69525 - RNA, 22 nt, Human
augaauauguacacaucuguca

SEQ ID NO: 69526 - RNA, 22 nt, Human
augaaucaaacuguacacugag

SEQ ID NO: 69527 - RNA, 22 nt, Human
augaaucaaaguucauuugauc

SEQ ID NO: 69528 - RNA, 22 nt, Human
augaaugagaaagcugaaaucu

SEQ ID NO: 69529 - RNA, 22 nt, Human
augaaugagugcuagguuuguc

SEQ ID NO: 69530 - RNA, 22 nt, Human
augcacuugcguguuugcaaau

SEQ ID NO: 69531 - RNA, 22 nt, Human
augcagaagcagaacuuacaca

SEQ ID NO: 69532 - RNA, 22 nt, Human
augcagaaggagccaugcuugc

SEQ ID NO: 69533 - RNA, 22 nt, Human
augcagaauugcuaaguaucug

SEQ ID NO: 69534 - RNA, 22 nt, Human
augcagaugguggauggagaaa

SEQ ID NO: 69535 - RNA, 22 nt, Human
augcagauuuaauuaguauagg

SEQ ID NO: 69536 - RNA, 22 nt, Human
augcagcuagauuuuccagugu

SEQ ID NO: 69537 - RNA, 22 nt, Human
augcagcugacauuuucauguu

SEQ ID NO: 69538 - RNA, 22 nt, Human
augcagcuuccauauuuugcug

SEQ ID NO: 69539 - RNA, 23 nt, Human
augcaggacuuauaagguaaggu

SEQ ID NO: 69540 - RNA, 22 nt, Human
augcaggggcagcagagccugg

SEQ ID NO: 69541 - RNA, 23 nt, Human
augcaggguuacagggcugacuu

SEQ ID NO: 69542 - RNA, 22 nt, Human
augcagguccaaacgcuagugu

SEQ ID NO: 69543 - RNA, 22 nt, Human
augcaguaaaauaggagguaau

SEQ ID NO: 69544 - RNA, 22 nt, Human
augcaguaaauguuaagaaaaa

SEQ ID NO: 69545 - RNA, 22 nt, Human
augcaguacauacaaacacuga

SEQ ID NO: 69546 - RNA, 22 nt, Human
augcaguagauaggcacuuuua

SEQ ID NO: 69547 - RNA, 23 nt, Human
augcaguauaugucaguaguuua

SEQ ID NO: 69548 - RNA, 22 nt, Human
augcaguccaagcucuagaguu

SEQ ID NO: 69549 - RNA, 22 nt, Human
augcaguuaguauacuuccagu

SEQ ID NO: 69550 - RNA, 22 nt, Human
augcaguuccacaggcgcaugg

SEQ ID NO: 69551 - RNA, 22 nt, Human
augcaguuuaaggcacaauuag

SEQ ID NO: 69552 - RNA, 22 nt, Human
augcaguuuucaaagacuauuc

SEQ ID NO: 69553 - RNA, 22 nt, Human
augcauaucacagucuccaugu

SEQ ID NO: 69554 - RNA, 22 nt, Human
augcauaucuccuaucuccuca

SEQ ID NO: 69555 - RNA, 22 nt, Human
augcauaugcaucuguguacau

SEQ ID NO: 69556 - RNA, 18 nt, Human
augcauauuuuaaguugu

SEQ ID NO: 69557 - RNA, 22 nt, Human
augcaucaauuaggggcagaca

SEQ ID NO: 69558 - RNA, 22 nt, Human
augcaucaggcacuaggaauag

SEQ ID NO: 69559 - RNA, 22 nt, Human
augcaucuaugacuuagacauu

SEQ ID NO: 69560 - RNA, 22 nt, Human
augcaucuauucccaagggcag

SEQ ID NO: 69561 - RNA, 22 nt, Human
augcaucuguaguguuauauga

SEQ ID NO: 69562 - RNA, 22 nt, Human
augcaugagaauaucccaugcu

SEQ ID NO: 69563 - RNA, 22 nt, Human
augcaugagucacucagugcag

SEQ ID NO: 69564 - RNA, 22 nt, Human
augcaugcagggaagacaguag

SEQ ID NO: 69565 - RNA, 20 nt, Human
augcaugcaugcacaugcac

SEQ ID NO: 69566 - RNA, 22 nt, Human
augcaugcauuguuuaucaugg

SEQ ID NO: 69567 - RNA, 22 nt, Human
augcauguaacaguguuaugaa

SEQ ID NO: 69568 - RNA, 22 nt, Human
augcaugucugccaguugcuua

SEQ ID NO: 69569 - RNA, 22 nt, Human
augcauucuagccuggacaaca

SEQ ID NO: 69570 - RNA, 22 nt, Human
augcauucuguagagcauuuau

SEQ ID NO: 69571 - RNA, 22 nt, Human
augcauugaggaugacaugagu

SEQ ID NO: 69572 - RNA, 22 nt, Human
augcauuggauaagaaccccau

SEQ ID NO: 69573 - RNA, 20 nt, Human
augcauugugauucuguuuu

SEQ ID NO: 69574 - RNA, 22 nt, Human
augcauuuauguguguacauug

SEQ ID NO: 69575 - RNA, 22 nt, Human
augcauuuguaaaauauaaucg

SEQ ID NO: 69576 - RNA, 22 nt, Human
augcauuuuugaguaugaauga

SEQ ID NO: 69577 - RNA, 22 nt, Human
augccaaaauguuacauuucuu

SEQ ID NO: 69578 - RNA, 22 nt, Human
augccaaauucuacuuucagca

SEQ ID NO: 69579 - RNA, 22 nt, Human
augccacauaauuacaaauaga

SEQ ID NO: 69580 - RNA, 22 nt, Human
augccacuguacucaacaauag

SEQ ID NO: 69581 - RNA, 22 nt, Human
augccagccucuaagcacuuua

SEQ ID NO: 69582 - RNA, 22 nt, Human
augccagggucacagucauauu

SEQ ID NO: 69583 - RNA, 22 nt, Human
augccaguaagucucagcuagg

SEQ ID NO: 69584 - RNA, 22 nt, Human
augccccagugugugcuuccuu

SEQ ID NO: 69585 - RNA, 22 nt, Human
augcccugaggaaugucacgcu

SEQ ID NO: 69586 - RNA, 22 nt, Human
augcccuggacuucuaguauuc

SEQ ID NO: 69587 - RNA, 23 nt, Human
augcccuguagaggcugcugacc

SEQ ID NO: 69588 - RNA, 22 nt, Human
augcccuguggcaguacauauu

SEQ ID NO: 69589 - RNA, 22 nt, Human
augccuccaagauucuuacguu

SEQ ID NO: 69590 - RNA, 22 nt, Human
augccuccccugugucuuuuau

SEQ ID NO: 69591 - RNA, 22 nt, Human
augccuccgcaugugccuuuga

SEQ ID NO: 69592 - RNA, 22 nt, Human
augccucugcucuugguccuca

SEQ ID NO: 69593 - RNA, 22 nt, Human
augccugagacuguuaauuggc

SEQ ID NO: 69594 - RNA, 22 nt, Human
augccugccauuuagaagucuu

SEQ ID NO: 69595 - RNA, 22 nt, Human
augaggauaccgcagggggcag

SEQ ID NO: 69596 - RNA, 22 nt, Human
augaggauguuaguggacugga

SEQ ID NO: 69597 - RNA, 22 nt, Human
augaggcacuuaaaagugaaga

SEQ ID NO: 69598 - RNA, 22 nt, Human
augaggcagaaaaaagucggag

SEQ ID NO: 69599 - RNA, 22 nt, Human
augaggcagauguugcaugagg

SEQ ID NO: 69600 - RNA, 22 nt, Human
augaggcagcugcuggagaacg

SEQ ID NO: 69601 - RNA, 22 nt, Human
augaggcaggagcggggacccu

SEQ ID NO: 69602 - RNA, 22 nt, Human
augaggcaguacacacaaagcc

SEQ ID NO: 69603 - RNA, 22 nt, Human
augaggcauagcagggaucgga

SEQ ID NO: 69604 - RNA, 16 nt, Human
augaggcauaggcugc

SEQ ID NO: 69605 - RNA, 22 nt, Human
augaggcaucuaacauugcaaa

SEQ ID NO: 69606 - RNA, 22 nt, Human
augaggcaucugcagucacuag

SEQ ID NO: 69607 - RNA, 22 nt, Human
augaggcauuccacucaaacuc

SEQ ID NO: 69608 - RNA, 15 nt, Human
augaggcauuugggg

SEQ ID NO: 69609 - RNA, 22 nt, Human
augaggccagaccacucugcau

SEQ ID NO: 69610 - RNA, 22 nt, Human
augaggcccaaacauuacaaau

SEQ ID NO: 69611 - RNA, 22 nt, Human
augaggcccaggaaucuguauu

SEQ ID NO: 69612 - RNA, 22 nt, Human
augaggccuuucuucacccuuu

SEQ ID NO: 69613 - RNA, 22 nt, Human
augaggcucucaacaccuugag

SEQ ID NO: 69614 - RNA, 22 nt, Human
augaggcuuaaacugcugcaac

SEQ ID NO: 69615 - RNA, 22 nt, Human
augagguaaaguuuaagcuaag

SEQ ID NO: 69616 - RNA, 22 nt, Human
augagguaagguauucagggaa

SEQ ID NO: 69617 - RNA, 22 nt, Human
augagguaauacuuucaguccu

SEQ ID NO: 69618 - RNA, 22 nt, Human
augagguacuaguauauacgua

SEQ ID NO: 69619 - RNA, 22 nt, Human
augagguagcuuggcccagggg

SEQ ID NO: 69620 - RNA, 22 nt, Human
augagguaggacaucaggaaau

SEQ ID NO: 69621 - RNA, 22 nt, Human
augaggucacaguguuuggcau

SEQ ID NO: 69622 - RNA, 22 nt, Human
augaggucaucuugaaguaggg

SEQ ID NO: 69623 - RNA, 22 nt, Human
augaggucuggcaaucagaaac

SEQ ID NO: 69624 - RNA, 22 nt, Human
augagguuauauuuaauucacu

SEQ ID NO: 69625 - RNA, 22 nt, Human
augagguuugagccucuugacc

SEQ ID NO: 69626 - RNA, 22 nt, Human
augaguaaaaccacuauuuaca

SEQ ID NO: 69627 - RNA, 22 nt, Human
augaguguacgugaaaguagau

SEQ ID NO: 69628 - RNA, 22 nt, Human
augagugucauguaugagauau

SEQ ID NO: 69629 - RNA, 22 nt, Human
augaguucccaggugauuugug

SEQ ID NO: 69630 - RNA, 22 nt, Human
augaguugaagcuacaagaggc

SEQ ID NO: 69631 - RNA, 22 nt, Human
augaguuuugggggauguuaga

SEQ ID NO: 69632 - RNA, 19 nt, Human
augauacaggugaaaauug

SEQ ID NO: 69633 - RNA, 20 nt, Human
augauagucagaaaacuagc

SEQ ID NO: 69634 - RNA, 22 nt, Human
augauauacuuccuagaacagu

SEQ ID NO: 69635 - RNA, 21 nt, Human
augauaugcuuguauuuccaa

SEQ ID NO: 69636 - RNA, 22 nt, Human
augauauuauucuagcccagag

SEQ ID NO: 69637 - RNA, 22 nt, Human
augauauuuuaguaaagugaua

SEQ ID NO: 69638 - RNA, 22 nt, Human
augaugaaaacugaagguuagg

SEQ ID NO: 69639 - RNA, 22 nt, Human
ucaucagaggcaucuggcaagg

SEQ ID NO: 69640 - RNA, 22 nt, Human
ucaucaguccuuuucauuauga

SEQ ID NO: 69641 - RNA, 22 nt, Human
ucaucaguuuagaaaaaauaug

SEQ ID NO: 69642 - RNA, 22 nt, Human
ucaucauaauauggaaucuugu

SEQ ID NO: 69643 - RNA, 22 nt, Human
ucaucauccuuuuuugaagagu

SEQ ID NO: 69644 - RNA, 22 nt, Human
ucaucaucugcaagcucauguc

SEQ ID NO: 69645 - RNA, 22 nt, Human
ucauccaaggagaccuugcaga

SEQ ID NO: 69646 - RNA, 22 nt, Human
ucauccaggaaaagauuuggaa

SEQ ID NO: 69647 - RNA, 20 nt, Human
ucauccaggacaggaguggc

SEQ ID NO: 69648 - RNA, 22 nt, Human
ucauccaguaccauggaaggca

SEQ ID NO: 69649 - RNA, 20 nt, Human
ucauccaguugguuuauggu

SEQ ID NO: 69650 - RNA, 22 nt, Human
ucauccauccucgccuuugcuu

SEQ ID NO: 69651 - RNA, 22 nt, Human
ucauccaucuuugauuucauag

SEQ ID NO: 69652 - RNA, 22 nt, Human
ucauccaugugcaaacuuuggu

SEQ ID NO: 69653 - RNA, 22 nt, Human
ucauccgugaagccaaagaaau

SEQ ID NO: 69654 - RNA, 22 nt, Human
ggcuggcgggugggugaaagac

SEQ ID NO: 69655 - RNA, 22 nt, Human
ggcuggcuaucugugguugccu

SEQ ID NO: 69656 - RNA, 22 nt, Human
ggcuggcucaugcaaaggguga

SEQ ID NO: 69657 - RNA, 22 nt, Human
ggcuggcuccaccuagguagcu

SEQ ID NO: 69658 - RNA, 22 nt, Human
ggcuggcuggaugaauggauua

SEQ ID NO: 69659 - RNA, 22 nt, Human
ggcuggcuugcggagucacaga

SEQ ID NO: 69660 - RNA, 22 nt, Human
ggcugggaggaugacuugcuac

SEQ ID NO: 69661 - RNA, 22 nt, Human
ggcugggcaggucugcacaggg

SEQ ID NO: 69662 - RNA, 19 nt, Human
ggcugggcccuguuucucc

SEQ ID NO: 69663 - RNA, 22 nt, Human
ggcuggguuugacuccuggcuu

SEQ ID NO: 69664 - RNA, 22 nt, Human
ggcuggucacaccacugcaggg

SEQ ID NO: 69665 - RNA, 22 nt, Human
ggcuggucccggguccuccggc

SEQ ID NO: 69666 - RNA, 21 nt, Human
ggcuggucgcgugcaugucuc

SEQ ID NO: 69667 - RNA, 23 nt, Human
ggcuggugcccuuggccagucgg

SEQ ID NO: 69668 - RNA, 22 nt, Human
ggcuguaguuaccugaugaaau

SEQ ID NO: 69669 - RNA, 19 nt, Human
ggcugucuacgaaccaguc

SEQ ID NO: 69670 - RNA, 22 nt, Human
ggcugugaacacucuuagcauc

SEQ ID NO: 69671 - RNA, 22 nt, Human
ggcugugacccccacaggggug

SEQ ID NO: 69672 - RNA, 22 nt, Human
ggcugugagcaggcagaaugcu

SEQ ID NO: 69673 - RNA, 22 nt, Human
ggcugugccucaaggcuacuca

SEQ ID NO: 69674 - RNA, 22 nt, Human
ggcugugccucuggcagcacau

SEQ ID NO: 69675 - RNA, 22 nt, Human
ggcugugcgggcagccguggga

SEQ ID NO: 69676 - RNA, 22 nt, Human
ggcuguggacacugagcucaga

SEQ ID NO: 69677 - RNA, 22 nt, Human
ggcugugggugugacaggccuc

SEQ ID NO: 69678 - RNA, 22 nt, Human
ggcuguggucauuaggagguug

SEQ ID NO: 69679 - RNA, 22 nt, Human
ggcuuaaaucacagugacuuuu

SEQ ID NO: 69680 - RNA, 22 nt, Human
ggcuuagcaacuccugaggcuc

SEQ ID NO: 69681 - RNA, 22 nt, Human
ggcuucaaaaccuaucuuugau

SEQ ID NO: 69682 - RNA, 22 nt, Human
ggcuucaagucguauauuuggg

SEQ ID NO: 69683 - RNA, 22 nt, Human
ggcuucaauguauucacauuca

SEQ ID NO: 69684 - RNA, 22 nt, Human
ggcuucaccugugcacucuacc

SEQ ID NO: 69685 - RNA, 20 nt, Human
ggcuucacucugcaccacca

SEQ ID NO: 69686 - RNA, 22 nt, Human
ggcuucacugacugguucuagg

SEQ ID NO: 69687 - RNA, 22 nt, Human
ggcuucagaagacuggacaggu

SEQ ID NO: 69688 - RNA, 22 nt, Human
ggcuucagaggggagguagugc

SEQ ID NO: 69689 - RNA, 22 nt, Human
ggcuucagauuucucaguuguu

SEQ ID NO: 69690 - RNA, 19 nt, Human
ggcuucagggaguuagcau

SEQ ID NO: 69691 - RNA, 22 nt, Human
ggcuucaggggucugucugcac

SEQ ID NO: 69692 - RNA, 22 nt, Human
ggcuucaguggccagagaugau

SEQ ID NO: 69693 - RNA, 22 nt, Human
ggcuucaucucguugacaccuc

SEQ ID NO: 69694 - RNA, 22 nt, Human
ggcuucauuucuguccuugauu

SEQ ID NO: 69695 - RNA, 22 nt, Human
ggcuucccaaggagccaggaug

SEQ ID NO: 69696 - RNA, 22 nt, Human
ggcuucccagcagagggcgcac

SEQ ID NO: 69697 - RNA, 22 nt, Human
ggcuuccuaucccaucugagug

SEQ ID NO: 69698 - RNA, 22 nt, Human
ggcuuccuggagaaggucugag

SEQ ID NO: 69699 - RNA, 22 nt, Human
ggcuuccugggcauguguucua

SEQ ID NO: 69700 - RNA, 22 nt, Human
ggcuuccuggggccuccugcaa

SEQ ID NO: 69701 - RNA, 22 nt, Human
ggcuuccuuucacuacccucag

SEQ ID NO: 69702 - RNA, 22 nt, Human
ggcuucuaaggaguauccuuug

SEQ ID NO: 69703 - RNA, 18 nt, Human
ggcuucucacugaccuca

SEQ ID NO: 69704 - RNA, 22 nt, Human
ggcuucucccauucuucagggg

SEQ ID NO: 69705 - RNA, 22 nt, Human
ggcuucucucccccagcuccac

SEQ ID NO: 69706 - RNA, 22 nt, Human
ggcuucucugucuaguuucuac

SEQ ID NO: 69707 - RNA, 18 nt, Human
ggcuucucuguuuauuuc

SEQ ID NO: 69708 - RNA, 22 nt, Human
ggcuucugccacgagagggaag

SEQ ID NO: 69709 - RNA, 22 nt, Human
ggcuucugguaaagaccacacc

SEQ ID NO: 69710 - RNA, 22 nt, Human
ggcuucuggugggagcaugacu

SEQ ID NO: 69711 - RNA, 22 nt, Human
ggcuugaagacuaugacauuuc

SEQ ID NO: 69712 - RNA, 23 nt, Human
ggcuugagcuggaacagcuuggu

SEQ ID NO: 69713 - RNA, 22 nt, Human
ggcuugcacacagccucaguuu

SEQ ID NO: 69714 - RNA, 22 nt, Human
ggcuugcuucuuguccaggaau

SEQ ID NO: 69715 - RNA, 22 nt, Human
ggcuuggaaacuagagugugca

SEQ ID NO: 69716 - RNA, 22 nt, Human
ggcuuggaaauugcaggacaca

SEQ ID NO: 69717 - RNA, 22 nt, Human
ggcuuggaccagucacaguggu

SEQ ID NO: 69718 - RNA, 22 nt, Human
ggcuuggagucauacugagaau

SEQ ID NO: 69719 - RNA, 22 nt, Human
ggcuugggagcaggcaugugac

SEQ ID NO: 69720 - RNA, 21 nt, Human
ggcuugucaccauagcuacug

SEQ ID NO: 69721 - RNA, 22 nt, Human
ggcuuuaauagauaagguuucu

SEQ ID NO: 69722 - RNA, 16 nt, Human
ggcuuuaauuuauccc

SEQ ID NO: 69723 - RNA, 22 nt, Human
ggcuuuagggcaggcaguguua

SEQ ID NO: 69724 - RNA, 22 nt, Human
ggcuuuaguguagguuucuguu

SEQ ID NO: 69725 - RNA, 22 nt, Human
ggcuuuaucaaaugagacccug

SEQ ID NO: 69726 - RNA, 22 nt, Human
ggcuuuauguuuuucauguggu

SEQ ID NO: 69727 - RNA, 22 nt, Human
ggcuuuauuucacuguaccaua

SEQ ID NO: 69728 - RNA, 22 nt, Human
ggcuuuauuugcagccauuguu

SEQ ID NO: 69729 - RNA, 22 nt, Human
ggcuuucaaggaaaggccucau

SEQ ID NO: 69730 - RNA, 22 nt, Human
ggcuuucuagaucuagcucugu

SEQ ID NO: 69731 - RNA, 22 nt, Human
ggcuuucuuguuaaauguccau

SEQ ID NO: 69732 - RNA, 22 nt, Human
ggcuuugacaugcugaauuaaa

SEQ ID NO: 69733 - RNA, 22 nt, Human
ggcuuugcaaaaucggcuucug

SEQ ID NO: 69734 - RNA, 22 nt, Human
ggcuuugcccuggacugaggca

SEQ ID NO: 69735 - RNA, 22 nt, Human
ggcuuugggauucagcaugaga

SEQ ID NO: 69736 - RNA, 22 nt, Human
ggcuuuggggugugcagagaug

SEQ ID NO: 69737 - RNA, 22 nt, Human
gggaaaauauuaagcaggacuu

SEQ ID NO: 69738 - RNA, 22 nt, Human
gggaaacuagaagcaggguuau

SEQ ID NO: 69739 - RNA, 22 nt, Human
gggaaacucacaggugcagggg

SEQ ID NO: 69740 - RNA, 22 nt, Human
gggaaacuucugcuaaaaccag

SEQ ID NO: 69741 - RNA, 22 nt, Human
gggaaacuuucacaauguccag

SEQ ID NO: 69742 - RNA, 22 nt, Human
gggaaagagagguggacgcagg

SEQ ID NO: 69743 - RNA, 22 nt, Human
gggaaaggauuuacaguuugau

SEQ ID NO: 69744 - RNA, 22 nt, Human
gggaaauuaaugacugguugga

SEQ ID NO: 69745 - RNA, 19 nt, Human
gggaaauucacuugcuucc

SEQ ID NO: 69746 - RNA, 22 nt, Human
gggaaauugucaacacucucaa

SEQ ID NO: 69747 - RNA, 22 nt, Human
gggaaauugugugagaucuuug

SEQ ID NO: 69748 - RNA, 22 nt, Human
gggcuggaccgcgaccccugag

SEQ ID NO: 69749 - RNA, 22 nt, Human
gggcuggaccgcucgccucccu

SEQ ID NO: 69750 - RNA, 22 nt, Human
gggcuggacugcauugccucgc

SEQ ID NO: 69751 - RNA, 22 nt, Human
gggcuggagacaagugagccgc

SEQ ID NO: 69752 - RNA, 22 nt, Human
gggcuggagagucccacguggg

SEQ ID NO: 69753 - RNA, 22 nt, Human
gggcuggaggccugccugguua

SEQ ID NO: 69754 - RNA, 21 nt, Human
gggcuggauauuggaaagagg

SEQ ID NO: 69755 - RNA, 20 nt, Human
gggcuggcucaacuggaucc

SEQ ID NO: 69756 - RNA, 22 nt, Human
gggcugggcaugguguucccuc

SEQ ID NO: 69757 - RNA, 22 nt, Human
gggcuggggcucaauaauuugu

SEQ ID NO: 69758 - RNA, 22 nt, Human
gggcugucaugugucagugacc

SEQ ID NO: 69759 - RNA, 18 nt, Human
gggcugugagaugggaag

SEQ ID NO: 69760 - RNA, 20 nt, Human
gggcugugccuccucguggu

SEQ ID NO: 69761 - RNA, 22 nt, Human
gggcugugggacccggcacuuu

SEQ ID NO: 69762 - RNA, 22 nt, Human
gggcuguguacuaugaggaggg

SEQ ID NO: 69763 - RNA, 22 nt, Human
gggcugugugcccacuucccau

SEQ ID NO: 69764 - RNA, 22 nt, Human
gggcuguguuaggugcgguuac

SEQ ID NO: 69765 - RNA, 22 nt, Human
gggcuucaggguacuuccuccu

SEQ ID NO: 69766 - RNA, 22 nt, Human
gggcuucauucaggcagaauuu

SEQ ID NO: 69767 - RNA, 23 nt, Human
ggcuucagugagagucccugcug

SEQ ID NO: 69768 - RNA, 17 nt, Human
ggcuuccagguggcucu

SEQ ID NO: 69769 - RNA, 22 nt, Human
ggcuuccaugugaaauucuuug

SEQ ID NO: 69770 - RNA, 22 nt, Human
ggcuucccagucccugcucuca

SEQ ID NO: 69771 - RNA, 22 nt, Human
ggcuucccuaaaccuuuccacu

SEQ ID NO: 69772 - RNA, 22 nt, Human
ggcuucccuguuugcugugccu

SEQ ID NO: 69773 - RNA, 22 nt, Human
ggcuucuccagguacugagcau

SEQ ID NO: 69774 - RNA, 22 nt, Human
ggcuucuccccuuugagucuuc

SEQ ID NO: 69775 - RNA, 22 nt, Human
ggcuucucccuucuucugauug

SEQ ID NO: 69776 - RNA, 22 nt, Human
ggcuucuccuggaaguacagag

SEQ ID NO: 69777 - RNA, 22 nt, Human
ggcuucucgugccgaagcaaga

SEQ ID NO: 69778 - RNA, 22 nt, Human
ggcuucucuaaagaucaugcgu

SEQ ID NO: 69779 - RNA, 22 nt, Human
ggcuucucuccaguaugcauuc

SEQ ID NO: 69780 - RNA, 22 nt, Human
ggcuucugagugcucugcuguu

SEQ ID NO: 69781 - RNA, 22 nt, Human
ggcuucuuagaauuugacuuac

SEQ ID NO: 69782 - RNA, 22 nt, Human
ggcuucuuccuggcuccuauua

SEQ ID NO: 69783 - RNA, 20 nt, Human
ggcuucuuuacaucuguguu

SEQ ID NO: 69784 - RNA, 22 nt, Human
ggcuucuuuguaacgugccagc

SEQ ID NO: 69785 - RNA, 22 nt, Human
ggcuucuuuuuaguaaauguca

SEQ ID NO: 69786 - RNA, 22 nt, Human
ggcuugcuucaccuacccccag

SEQ ID NO: 69787 - RNA, 22 nt, Human
ggcuuggaaaugguaaugagcu

SEQ ID NO: 69788 - RNA, 22 nt, Human
ggcuuggcaggugcccugcgca

SEQ ID NO: 69789 - RNA, 22 nt, Human
ggcuuggcccaggccucacucc

SEQ ID NO: 69790 - RNA, 20 nt, Human
ggcuuggcugccuggggagg

SEQ ID NO: 69791 - RNA, 22 nt, Human
ggcuugucauguugauguucuu

SEQ ID NO: 69792 - RNA, 22 nt, Human
ggcuuguccuugggcugugcau

SEQ ID NO: 69793 - RNA, 22 nt, Human
ggcuuguggcaaguguuuuaag

SEQ ID NO: 69794 - RNA, 19 nt, Human
ggcuuuaacucuuguagcu

SEQ ID NO: 69795 - RNA, 17 nt, Human
ggcuuuagggacaccac

SEQ ID NO: 69796 - RNA, 22 nt, Human
ggcuuuauuaagcaggguaagu

SEQ ID NO: 69797 - RNA, 22 nt, Human
ggcuuuauuuugcaugaaugcu

SEQ ID NO: 69798 - RNA, 22 nt, Human
ggcuuucugucugcgucugugu

SEQ ID NO: 69799 - RNA, 20 nt, Human
ggcuuucugugauccucagu

SEQ ID NO: 69800 - RNA, 22 nt, Human
ggcuuugcaaacucauuccaca

SEQ ID NO: 69801 - RNA, 22 nt, Human
ggcuuugcaggcagcaucaagg

SEQ ID NO: 69802 - RNA, 22 nt, Human
ggcuuugcauuuugauggaggu

SEQ ID NO: 69803 - RNA, 21 nt, Human
ggcuuugcucagcuuaccaaa

SEQ ID NO: 69804 - RNA, 18 nt, Human
ggcuuugcugggguuucu

SEQ ID NO: 69805 - RNA, 22 nt, Human
ggcuuugcuucuccagaugcuu

SEQ ID NO: 69806 - RNA, 22 nt, Human
ggcuuuugaauuccaaggcauu

SEQ ID NO: 69807 - RNA, 22 nt, Human
gggaaaaauaaugcacagauau

SEQ ID NO: 69808 - RNA, 22 nt, Human
gggaaacugaauucaggacucu

SEQ ID NO: 69809 - RNA, 22 nt, Human
gggaaacuguccaguucucccc

SEQ ID NO: 69810 - RNA, 22 nt, Human
gggaaagaagaagagccauuuu

SEQ ID NO: 69811 - RNA, 22 nt, Human
gggaaagagugcuuguccagag

SEQ ID NO: 69812 - RNA, 22 nt, Human
gggaaaggaucagugggaggcu

SEQ ID NO: 69813 - RNA, 21 nt, Human
gggaaauuaggauugcucauc

SEQ ID NO: 69814 - RNA, 22 nt, Human
gggaacacagacuugaugauga

SEQ ID NO: 69815 - RNA, 22 nt, Human
gggaacagaggaggguguugcu

SEQ ID NO: 69816 - RNA, 22 nt, Human
gggaacagagugccagacugac

SEQ ID NO: 69817 - RNA, 22 nt, Human
gggaacagcauaucugaagggu

SEQ ID NO: 69818 - RNA, 22 nt, Human
gggaacagccucaccagcccug

SEQ ID NO: 69819 - RNA, 22 nt, Human
gggaacuugcuaaaauacagac

SEQ ID NO: 69820 - RNA, 22 nt, Human
gggaagagaggaggugguuucg

SEQ ID NO: 69821 - RNA, 22 nt, Human
gggaagagggagcuggaaugau

SEQ ID NO: 69822 - RNA, 22 nt, Human
gggaagauaguguugagggccc

SEQ ID NO: 69823 - RNA, 22 nt, Human
gggaagcagacggcggggaaau

SEQ ID NO: 69824 - RNA, 18 nt, Human
gggaagccgggaagccgg

SEQ ID NO: 69825 - RNA, 23 nt, Human
gggaagcuccauggaggugcugg

SEQ ID NO: 69826 - RNA, 22 nt, Human
gggaaggcagugggaggaacug

SEQ ID NO: 69827 - RNA, 22 nt, Human
gggaaggcugccugagggaugg

SEQ ID NO: 69828 - RNA, 22 nt, Human
gggaagggagggaccucagucu

SEQ ID NO: 69829 - RNA, 22 nt, Human
gggaagggagggccuccaguca

SEQ ID NO: 69830 - RNA, 22 nt, Human
gggaaggguguugucuuaucuu

SEQ ID NO: 69831 - RNA, 22 nt, Human
gggaagucggguugagcacuua

SEQ ID NO: 69832 - RNA, 22 nt, Human
gggaagugaaguguagcugucu

SEQ ID NO: 69833 - RNA, 22 nt, Human
gggaagugagcuggaaucaagg

SEQ ID NO: 69834 - RNA, 23 nt, Human
gggaaguggggauuugaagucau

SEQ ID NO: 69835 - RNA, 22 nt, Human
gggaagugugguuucuuuacag

SEQ ID NO: 69836 - RNA, 22 nt, Human
gggaaguuugugggaggaauau

SEQ ID NO: 69837 - RNA, 22 nt, Human
gggaauaggacaaaugaaggag

SEQ ID NO: 69838 - RNA, 22 nt, Human
gggaaugagagucagcccagga

SEQ ID NO: 69839 - RNA, 21 nt, Human
gggaaugagauucuuggagau

SEQ ID NO: 69840 - RNA, 22 nt, Human
gggaaugaggcagauagauaaa

SEQ ID NO: 69841 - RNA, 22 nt, Human
gggacaggccccucgcuagcuu

SEQ ID NO: 69842 - RNA, 22 nt, Human
gggacaugaagcaucggaggca

SEQ ID NO: 69843 - RNA, 22 nt, Human
gggaccaggugggugcauuccg

SEQ ID NO: 69844 - RNA, 22 nt, Human
gggaccuggacaugugugugcu

SEQ ID NO: 69845 - RNA, 22 nt, Human
gggaccuggucuagcacugagc

SEQ ID NO: 69846 - RNA, 22 nt, Human
gggacuggcacagggcugggag

SEQ ID NO: 69847 - RNA, 22 nt, Human
gggacuguccuacauggagagg

SEQ ID NO: 69848 - RNA, 22 nt, Human
gggacuuaaugcagagagggac

SEQ ID NO: 69849 - RNA, 22 nt, Human
gggacuucauagcuaggcacuu

SEQ ID NO: 69850 - RNA, 22 nt, Human
gggagaaaugucuggccugcug

SEQ ID NO: 69851 - RNA, 22 nt, Human
gggagacaaaggugagguucuu

SEQ ID NO: 69852 - RNA, 22 nt, Human
gggagagagagcucauguugaa

SEQ ID NO: 69853 - RNA, 22 nt, Human
gggagagaugcugauugccaau

SEQ ID NO: 69854 - RNA, 22 nt, Human
gggagaugaaucagaagugauc

SEQ ID NO: 69855 - RNA, 22 nt, Human
gggagaugacucagugaccucg

SEQ ID NO: 69856 - RNA, 23 nt, Human
gggagaugggaaaugaaggcucu

SEQ ID NO: 69857 - RNA, 22 nt, Human
gguauucacaauauuuaaagag

SEQ ID NO: 69858 - RNA, 23 nt, Human
gguauucauucauuuaugcuaag

SEQ ID NO: 69859 - RNA, 22 nt, Human
gguauuuauaguggugcuuagu

SEQ ID NO: 69860 - RNA, 22 nt, Human
ggucaacagagguaaugguaac

SEQ ID NO: 69861 - RNA, 22 nt, Human
ggucaaguaacaaaucaggagc

SEQ ID NO: 69862 - RNA, 19 nt, Human
ggucacaaggaguugugaa

SEQ ID NO: 69863 - RNA, 21 nt, Human
ggucacacagcugguaaauag

SEQ ID NO: 69864 - RNA, 22 nt, Human
ggucacagcuuuuucagcagca

SEQ ID NO: 69865 - RNA, 23 nt, Human
ggucacaugugagauuaaacuug

SEQ ID NO: 69866 - RNA, 22 nt, Human
ggucacugcccucccuuuugca

SEQ ID NO: 69867 - RNA, 22 nt, Human
ggucacugucugagguacugga

SEQ ID NO: 69868 - RNA, 22 nt, Human
ggucagaacaaggguaaauaaa

SEQ ID NO: 69869 - RNA, 22 nt, Human
ggucagaaggcaguuaaacaaa

SEQ ID NO: 69870 - RNA, 22 nt, Human
ggucagaauuaggucuagagua

SEQ ID NO: 69871 - RNA, 19 nt, Human
ggucagagagauccaggcu

SEQ ID NO: 69872 - RNA, 22 nt, Human
ggucagagccauggagcaacug

SEQ ID NO: 69873 - RNA, 22 nt, Human
ggucagaggucacaagcuggca

SEQ ID NO: 69874 - RNA, 22 nt, Human
ggucagaggucccagaagaagc

SEQ ID NO: 69875 - RNA, 20 nt, Human
ggucagccccaccuggcagc

SEQ ID NO: 69876 - RNA, 21 nt, Human
ggucagcucuauccacgccuu

SEQ ID NO: 69877 - RNA, 22 nt, Human
ggucagggcuggguaugaagag

SEQ ID NO: 69878 - RNA, 22 nt, Human
ggucaggguuccagguaucuuc

SEQ ID NO: 69879 - RNA, 22 nt, Human
ggucagguagcucugacaggcc

SEQ ID NO: 69880 - RNA, 22 nt, Human
ggucagugacuuuuuucugugg

SEQ ID NO: 69881 - RNA, 23 nt, Human
ggucagugaguucguuucucugg

SEQ ID NO: 69882 - RNA, 22 nt, Human
ggucaucuguaauucuguuccu

SEQ ID NO: 69883 - RNA, 22 nt, Human
ggucaucuugaauuuccauucu

SEQ ID NO: 69884 - RNA, 22 nt, Human
ggucauguguccaggagguagc

SEQ ID NO: 69885 - RNA, 22 nt, Human
gguccagaguccuugcuagaga

SEQ ID NO: 69886 - RNA, 22 nt, Human
gguccaggaucaaggcaucacc

SEQ ID NO: 69887 - RNA, 22 nt, Human
ggucccaagcaaugcccuuggc

SEQ ID NO: 69888 - RNA, 22 nt, Human
ggucccaaggaggaugaggcua

SEQ ID NO: 69889 - RNA, 22 nt, Human
ggucccaaucuaaucacaugag

SEQ ID NO: 69890 - RNA, 22 nt, Human
ggucccagcuggucacugucag

SEQ ID NO: 69891 - RNA, 22 nt, Human
ggucccaggagaauaggugcaa

SEQ ID NO: 69892 - RNA, 22 nt, Human
ggucccaggcugcgggcuggug

SEQ ID NO: 69893 - RNA, 22 nt, Human
ggucccagucccuuuccaccgu

SEQ ID NO: 69894 - RNA, 22 nt, Human
ggucccaugacugacacagcag

SEQ ID NO: 69895 - RNA, 21 nt, Human
ggucccauugugaggcuugaa

SEQ ID NO: 69896 - RNA, 22 nt, Human
gguccccguggaggcuggagcg

SEQ ID NO: 69897 - RNA, 20 nt, Human
ggucccugcccucugucauc

SEQ ID NO: 69898 - RNA, 22 nt, Human
ggucccuggaaggcacuaguga

SEQ ID NO: 69899 - RNA, 22 nt, Human
ggucccuggaagucccucuucu

SEQ ID NO: 69900 - RNA, 22 nt, Human
gguccguuuuugaagacagugg

SEQ ID NO: 69901 - RNA, 19 nt, Human
gguccucagcagagcaugc

SEQ ID NO: 69902 - RNA, 22 nt, Human
gguccucucccaagagcgcauc

SEQ ID NO: 69903 - RNA, 22 nt, Human
gguccugcgucuggcucgcccg

SEQ ID NO: 69904 - RNA, 22 nt, Human
gguccuugggucuccuguguuu

SEQ ID NO: 69905 - RNA, 22 nt, Human
ggucucaaggaauauaaugagu

SEQ ID NO: 69906 - RNA, 22 nt, Human
ggucucagagguuucugcucag

SEQ ID NO: 69907 - RNA, 22 nt, Human
ggucucaggagacuggagagca

SEQ ID NO: 69908 - RNA, 22 nt, Human
ggucuccaaagcuuaggacuac

SEQ ID NO: 69909 - RNA, 22 nt, Human
ggucucccuugcugguuggcug

SEQ ID NO: 69910 - RNA, 22 nt, Human
ggucuccuugggaaagcaggaa

SEQ ID NO: 69911 - RNA, 22 nt, Human
ggucucuucaggagcuugagcg

SEQ ID NO: 69912 - RNA, 22 nt, Human
ggucucuuugcuucagcuacag

SEQ ID NO: 69913 - RNA, 22 nt, Human
ggucugaaaauggugaccacca

SEQ ID NO: 69914 - RNA, 22 nt, Human
ggucugaagcccacgugguacc

SEQ ID NO: 69915 - RNA, 22 nt, Human
ggucugaauauagaacuuaagu

SEQ ID NO: 69916 - RNA, 22 nt, Human
ggucugaauuccagccccucug

SEQ ID NO: 69917 - RNA, 18 nt, Human
ggucugagaucguuuuuc

SEQ ID NO: 69918 - RNA, 22 nt, Human
ggucugagcucuaaaacuaacu

SEQ ID NO: 69919 - RNA, 22 nt, Human
ggucugaggugggacccaggaa

SEQ ID NO: 69920 - RNA, 19 nt, Human
gucuggauuuuucgguaac

SEQ ID NO: 69921 - RNA, 22 nt, Human
gucuggcuuuauauuugcuauu

SEQ ID NO: 69922 - RNA, 22 nt, Human
gucugggcaagggagauggcgc

SEQ ID NO: 69923 - RNA, 22 nt, Human
gucugggcagcagcauuucuua

SEQ ID NO: 69924 - RNA, 22 nt, Human
gucugggcaucagacugcgggc

SEQ ID NO: 69925 - RNA, 22 nt, Human
gucugggcucccagggucggcg

SEQ ID NO: 69926 - RNA, 22 nt, Human
gucugggcuccuggcaggcagc

SEQ ID NO: 69927 - RNA, 22 nt, Human
gucugggcuucagaguuagaga

SEQ ID NO: 69928 - RNA, 22 nt, Human
gucugggguacuuucaucugau

SEQ ID NO: 69929 - RNA, 22 nt, Human
gucuggggugaggcccgggauu

SEQ ID NO: 69930 - RNA, 22 nt, Human
gucuguccagcaacacaggagu

SEQ ID NO: 69931 - RNA, 22 nt, Human
gucuguccuguacccagcaucu

SEQ ID NO: 69932 - RNA, 22 nt, Human
gucuguccuuuucaucucccaa

SEQ ID NO: 69933 - RNA, 21 nt, Human
gucugugaucuuacugcugug

SEQ ID NO: 69934 - RNA, 22 nt, Human
gucugugcaguuacuagcuggu

SEQ ID NO: 69935 - RNA, 22 nt, Human
gucuguggaguugcuugcugga

SEQ ID NO: 69936 - RNA, 22 nt, Human
gucugugugcacagcgagugcc

SEQ ID NO: 69937 - RNA, 22 nt, Human
gucuuacccacagcaucuagaa

SEQ ID NO: 69938 - RNA, 22 nt, Human
gucuuauuaugagguuagacuu

SEQ ID NO: 69939 - RNA, 20 nt, Human
gucuuauuuaacacaugacu

SEQ ID NO: 69940 - RNA, 21 nt, Human
gucuucaaaggcagugggcag

SEQ ID NO: 69941 - RNA, 22 nt, Human
gucuucaguggcaaauggaucu

SEQ ID NO: 69942 - RNA, 22 nt, Human
gucuuccuaauuugcuauuagg

SEQ ID NO: 69943 - RNA, 22 nt, Human
gucuucugcccaggcagacgga

SEQ ID NO: 69944 - RNA, 22 nt, Human
gucuucuggggccaggcccgcu

SEQ ID NO: 69945 - RNA, 22 nt, Human
gucuucuguucugugaggcuuc

SEQ ID NO: 69946 - RNA, 22 nt, Human
gucuucuuuaaccuacuaaagc

SEQ ID NO: 69947 - RNA, 22 nt, Human
gucuugaaaaguggccaguuug

SEQ ID NO: 69948 - RNA, 22 nt, Human
gucuugaucuccugaccuugug

SEQ ID NO: 69949 - RNA, 21 nt, Human
gucuuggcaccaggagagaga

SEQ ID NO: 69950 - RNA, 22 nt, Human
gucuuguuugggauguggaugg

SEQ ID NO: 69951 - RNA, 21 nt, Human
gucuuuaaaaaaggcugauac

SEQ ID NO: 69952 - RNA, 23 nt, Human
gucuuuauaguggggcacuuugu

SEQ ID NO: 69953 - RNA, 22 nt, Human
gucuuuaugguaugaaaacuga

SEQ ID NO: 69954 - RNA, 22 nt, Human
gucuuucucuggaacaguaaaa

SEQ ID NO: 69955 - RNA, 22 nt, Human
gucuuucuuaaacaacagaaca

SEQ ID NO: 69956 - RNA, 22 nt, Human
gucuuuggaaagacaaaguuca

SEQ ID NO: 69957 - RNA, 22 nt, Human
gucuuuggagaggugccauuuc

SEQ ID NO: 69958 - RNA, 18 nt, Human
gucuuuucucccuuccuc

SEQ ID NO: 69959 - RNA, 22 nt, Human
gucuuuuugucuggcagagguc

SEQ ID NO: 69960 - RNA, 22 nt, Human
gugaaaaaucaucaugacuuga

SEQ ID NO: 69961 - RNA, 22 nt, Human
gugaaacagaagcuccuggaau

SEQ ID NO: 69962 - RNA, 22 nt, Human
gugaaacugcuuuguaaacugu

SEQ ID NO: 69963 - RNA, 22 nt, Human
gugaaacuucacauuuugauag

SEQ ID NO: 69964 - RNA, 22 nt, Human
gugaaauauuuuguuuauguca

SEQ ID NO: 69965 - RNA, 22 nt, Human
gugaaaugaaucuggaaauauu

SEQ ID NO: 69966 - RNA, 22 nt, Human
uccugcagaccucagucagguc

SEQ ID NO: 69967 - RNA, 22 nt, Human
uccugcagagacagaggccuca

SEQ ID NO: 69968 - RNA, 22 nt, Human
uccugcagaucaaagccuuuga

SEQ ID NO: 69969 - RNA, 22 nt, Human
uccugcagccaagggucaucga

SEQ ID NO: 69970 - RNA, 22 nt, Human
uccugcagccacugcaggcaga

SEQ ID NO: 69971 - RNA, 22 nt, Human
uccugcagcugaagcucaugug

SEQ ID NO: 69972 - RNA, 22 nt, Human
uccugcagcugcagaccugggg

SEQ ID NO: 69973 - RNA, 20 nt, Human
uccugcagucgcuagcgccc

SEQ ID NO: 69974 - RNA, 20 nt, Human
uccugccacaccucaguugc

SEQ ID NO: 69975 - RNA, 17 nt, Human
uccugccaccugucagg

SEQ ID NO: 69976 - RNA, 22 nt, Human
uccugccagcccacagacucau

SEQ ID NO: 69977 - RNA, 22 nt, Human
uccugccauuugcuuuuucucc

SEQ ID NO: 69978 - RNA, 19 nt, Human
uccugcccaccagccaggg

SEQ ID NO: 69979 - RNA, 22 nt, Human
uccugccuagcaggugaccuau

SEQ ID NO: 69980 - RNA, 22 nt, Human
uccugccucacaguugaaguuu

SEQ ID NO: 69981 - RNA, 22 nt, Human
uccugccugagcguggaggagg

SEQ ID NO: 69982 - RNA, 22 nt, Human
uccugccugcaaucccagcacu

SEQ ID NO: 69983 - RNA, 22 nt, Human
uccugccuuagagcaaggaaaa

SEQ ID NO: 69984 - RNA, 22 nt, Human
uccugccuucauacugcuguau

SEQ ID NO: 69985 - RNA, 22 nt, Human
uccugcucugauggguucuccu

SEQ ID NO: 69986 - RNA, 20 nt, Human
uccugcugaccuucacaagc

SEQ ID NO: 69987 - RNA, 22 nt, Human
uccugcugagcgucugucauuu

SEQ ID NO: 69988 - RNA, 22 nt, Human
uccugcugcucuugggaaaccu

SEQ ID NO: 69989 - RNA, 22 nt, Human
uccugcuggacucugaguacaa

SEQ ID NO: 69990 - RNA, 22 nt, Human
uccugcuggcaaggaagggacu

SEQ ID NO: 69991 - RNA, 22 nt, Human
uccugcuguuuaccuacaaugg

SEQ ID NO: 69992 - RNA, 22 nt, Human
uccugcuucagguagagggggu

SEQ ID NO: 69993 - RNA, 22 nt, Human
uccugcuucuucgagcuucugg

SEQ ID NO: 69994 - RNA, 22 nt, Human
uccugcuuugugccucacacuu

SEQ ID NO: 69995 - RNA, 22 nt, Human
uccuggaagaucucugugagau

SEQ ID NO: 69996 - RNA, 22 nt, Human
uccuggaagccagaguugagga

SEQ ID NO: 69997 - RNA, 22 nt, Human
uccuggacagauccccaucauc

SEQ ID NO: 69998 - RNA, 22 nt, Human
uccuggacucaggaccacagga

SEQ ID NO: 69999 - RNA, 23 nt, Human
uccuggagaaaagaaacauuucu

SEQ ID NO: 70000 - RNA, 22 nt, Human
uccuggagccaaugugcugcug

SEQ ID NO: 70001 - RNA, 22 nt, Human
uccuggagccaggacccuuccc

SEQ ID NO: 70002 - RNA, 22 nt, Human
uccuggagccaugauuccccuc

SEQ ID NO: 70003 - RNA, 22 nt, Human
uccuggagcuuccuucauggua

SEQ ID NO: 70004 - RNA, 22 nt, Human
uccuggagggcucacaggcggc

SEQ ID NO: 70005 - RNA, 22 nt, Human
uccuggaguggagucuguuguu

SEQ ID NO: 70006 - RNA, 22 nt, Human
uccuggaguugugcagugcaca

SEQ ID NO: 70007 - RNA, 22 nt, Human
uccuggaguuuguaaggugagc

SEQ ID NO: 70008 - RNA, 22 nt, Human
uccuggaucuacucucaauugg

SEQ ID NO: 70009 - RNA, 22 nt, Human
uccuggauggagcugcccucgc

SEQ ID NO: 70010 - RNA, 22 nt, Human
uccuggcaaagcaaguuaugaa

SEQ ID NO: 70011 - RNA, 19 nt, Human
uccuggcacaguggaacca

SEQ ID NO: 70012 - RNA, 22 nt, Human
uccuggcacauugcaggggcuc

SEQ ID NO: 70013 - RNA, 22 nt, Human
uccuggcagagggcggccucga

SEQ ID NO: 70014 - RNA, 21 nt, Human
uccuggcaggcccaggacccu

SEQ ID NO: 70015 - RNA, 22 nt, Human
uccuggcaggucugagaggucu

SEQ ID NO: 70016 - RNA, 22 nt, Human
uccuggcaguaauuugauguug

SEQ ID NO: 70017 - RNA, 22 nt, Human
uccuggcauuuacaaacccacc

SEQ ID NO: 70018 - RNA, 22 nt, Human
uccuggccacccgacagaaguc

SEQ ID NO: 70019 - RNA, 22 nt, Human
uccuggccaggaugaccuaaca

SEQ ID NO: 70020 - RNA, 22 nt, Human
uccuggccaugcaagaugagga

SEQ ID NO: 70021 - RNA, 22 nt, Human
uccuggcccacuaugccagcau

SEQ ID NO: 70022 - RNA, 21 nt, Human
uccuggcccacucuaucccca

SEQ ID NO: 70023 - RNA, 22 nt, Human
uccuggcccuguggccugcagu

SEQ ID NO: 70024 - RNA, 22 nt, Human
uccuggcuaaugcugcugaugg

SEQ ID NO: 70025 - RNA, 22 nt, Human
uccuggcuccacugagcaggcc

SEQ ID NO: 70026 - RNA, 22 nt, Human
uccuggcucggcuuggggacuu

SEQ ID NO: 70027 - RNA, 22 nt, Human
uccuggcucucuacaaaccaga

SEQ ID NO: 70028 - RNA, 23 nt, Human
uccuggcucugcacuugcuaaug

SEQ ID NO: 70029 - RNA, 22 nt, Human
uccuggcuggaauuucucacuc

SEQ ID NO: 70030 - RNA, 22 nt, Human
uccuggcuuccacaccugucau

SEQ ID NO: 70031 - RNA, 22 nt, Human
uccuggcuuccacuccucuguu

SEQ ID NO: 70032 - RNA, 18 nt, Human
uccugggaacuugcuagc

SEQ ID NO: 70033 - RNA, 22 nt, Human
uccugggaagcgccggccugcg

SEQ ID NO: 70034 - RNA, 22 nt, Human
uccugggacaagccguggaagu

SEQ ID NO: 70035 - RNA, 22 nt, Human
uccugggaccgagggaagagcu

SEQ ID NO: 70036 - RNA, 22 nt, Human
uccugggacucaacuuagaagg

SEQ ID NO: 70037 - RNA, 19 nt, Human
ggugagcccucgccugccu

SEQ ID NO: 70038 - RNA, 22 nt, Human
ggugaggaauuggggacugacc

SEQ ID NO: 70039 - RNA, 22 nt, Human
ggugaggcagagggaguaaccu

SEQ ID NO: 70040 - RNA, 22 nt, Human
ggugaggcccagugaucugugu

SEQ ID NO: 70041 - RNA, 22 nt, Human
ggugagggacaucacucagcca

SEQ ID NO: 70042 - RNA, 22 nt, Human
ggugagucauuuggcucaagag

SEQ ID NO: 70043 - RNA, 22 nt, Human
ggugaguugggguucacagguc

SEQ ID NO: 70044 - RNA, 22 nt, Human
ggugcaaaaguaauuugguuuu

SEQ ID NO: 70045 - RNA, 22 nt, Human
ggugcaggacgaaguggggguu

SEQ ID NO: 70046 - RNA, 22 nt, Human
ggugcaggagcggggugcucgg

SEQ ID NO: 70047 - RNA, 22 nt, Human
ggugcauguagccaucaagaua

SEQ ID NO: 70048 - RNA, 22 nt, Human
ggugccaggcuguagucagggu

SEQ ID NO: 70049 - RNA, 22 nt, Human
ggugccagugggucucaggaua

SEQ ID NO: 70050 - RNA, 22 nt, Human
ggugccauauuauauacaguuu

SEQ ID NO: 70051 - RNA, 22 nt, Human
ggugcccuguaaaagccaugca

SEQ ID NO: 70052 - RNA, 22 nt, Human
ggugccuaauaauucuauugca

SEQ ID NO: 70053 - RNA, 22 nt, Human
ggugccugauggugaugagguc

SEQ ID NO: 70054 - RNA, 20 nt, Human
ggugcgaggccagagcagac

SEQ ID NO: 70055 - RNA, 22 nt, Human
ggugcggagacuccaugaggcc

SEQ ID NO: 70056 - RNA, 21 nt, Human
ggugcuccuccaugcugcucu

SEQ ID NO: 70057 - RNA, 21 nt, Human
ggugcucgcugaugaggagug

SEQ ID NO: 70058 - RNA, 22 nt, Human
ggugcugacucugucgugagca

SEQ ID NO: 70059 - RNA, 22 nt, Human
ggugcugacugaggauggcuug

SEQ ID NO: 70060 - RNA, 22 nt, Human
ggugcugaucuaaauuuaggac

SEQ ID NO: 70061 - RNA, 22 nt, Human
ggugcugauuuguugcugagau

SEQ ID NO: 70062 - RNA, 22 nt, Human
gguggaaggccuggaaggaggc

SEQ ID NO: 70063 - RNA, 22 nt, Human
gguggacuguguuggaguugac

SEQ ID NO: 70064 - RNA, 22 nt, Human
gguggagcgcagggugcuggcg

SEQ ID NO: 70065 - RNA, 22 nt, Human
gguggagcuggaccaggagagg

SEQ ID NO: 70066 - RNA, 22 nt, Human
gguggcaagggcagccaguaac

SEQ ID NO: 70067 - RNA, 22 nt, Human
gguggcacacuggggagcucgg

SEQ ID NO: 70068 - RNA, 22 nt, Human
gguggcacucaaccuuuuauua

SEQ ID NO: 70069 - RNA, 22 nt, Human
gguggcacucauuaucaggugc

SEQ ID NO: 70070 - RNA, 22 nt, Human
gguggcaggcccugagcauccc

SEQ ID NO: 70071 - RNA, 22 nt, Human
gguggcauucagaagagcuggc

SEQ ID NO: 70072 - RNA, 22 nt, Human
gguggccaggccagcucuggcc

SEQ ID NO: 70073 - RNA, 22 nt, Human
gguggccugaauuagcucaggg

SEQ ID NO: 70074 - RNA, 22 nt, Human
gguggccuuuuaugagcagggu

SEQ ID NO: 70075 - RNA, 22 nt, Human
gugagagccugucuggaugucg

SEQ ID NO: 70076 - RNA, 22 nt, Human
ucuccugccacugcuucccauu

SEQ ID NO: 70077 - RNA, 22 nt, Human
ucuccugcucagaacagccuca

SEQ ID NO: 70078 - RNA, 22 nt, Human
ucuccuggaagugauuccccug

SEQ ID NO: 70079 - RNA, 22 nt, Human
ucuccuggcccugucgccaucu

SEQ ID NO: 70080 - RNA, 22 nt, Human
ucuccuggcucaccaggcugga

SEQ ID NO: 70081 - RNA, 21 nt, Human
ucuccuggguccaacccaugc

SEQ ID NO: 70082 - RNA, 22 nt, Human
ucuccuugugcuggguccuucc

SEQ ID NO: 70083 - RNA, 20 nt, Human
ucucgcacucggagcagccg

SEQ ID NO: 70084 - RNA, 22 nt, Human
ucucuaaacuuauaugaacuau

SEQ ID NO: 70085 - RNA, 22 nt, Human
ucucuaacaguggcugcugccu

SEQ ID NO: 70086 - RNA, 20 nt, Human
ucucuaacaugaaugcuauc

SEQ ID NO: 70087 - RNA, 22 nt, Human
ucucuaagauaggaauacaguu

SEQ ID NO: 70088 - RNA, 22 nt, Human
ucucuaauucaaccagacacuu

SEQ ID NO: 70089 - RNA, 22 nt, Human
ucucuagagcaugugcugggca

SEQ ID NO: 70090 - RNA, 22 nt, Human
ucucuaggggagccccguuugu

SEQ ID NO: 70091 - RNA, 19 nt, Human
ucucuauauuuguuucuga

SEQ ID NO: 70092 - RNA, 22 nt, Human
ucucucagaaagcccaugucug

SEQ ID NO: 70093 - RNA, 22 nt, Human
ucucucagacuccccaugguuu

SEQ ID NO: 70094 - RNA, 22 nt, Human
ucucucagaggaagaggcagug

SEQ ID NO: 70095 - RNA, 22 nt, Human
ucucucaggaggcagguuccua

SEQ ID NO: 70096 - RNA, 18 nt, Human
ucucucagggaaacagaa

SEQ ID NO: 70097 - RNA, 22 nt, Human
ucucuccuguguucugauguuu

SEQ ID NO: 70098 - RNA, 22 nt, Human
ucucucuauuuauuugucuugu

SEQ ID NO: 70099 - RNA, 22 nt, Human
ucucucucagccauuacagaac

SEQ ID NO: 70100 - RNA, 22 nt, Human
ucucucugaguugagcaggagu

SEQ ID NO: 70101 - RNA, 22 nt, Human
ucucucugcagcccgggacacu

SEQ ID NO: 70102 - RNA, 22 nt, Human
ucucucuggagcuggggcauga

SEQ ID NO: 70103 - RNA, 19 nt, Human
ucucucuguacauuagaua

SEQ ID NO: 70104 - RNA, 23 nt, Human
ucucucuuagcuaugcuuauggc

SEQ ID NO: 70105 - RNA, 22 nt, Human
ucucucuucaugcuuuuagaau

SEQ ID NO: 70106 - RNA, 22 nt, Human
ucucucuugaaguauuagcuag

SEQ ID NO: 70107 - RNA, 22 nt, Human
ucucugaagaaucgaugauucu

SEQ ID NO: 70108 - RNA, 22 nt, Human
ucucugaagauauuuauuauua

SEQ ID NO: 70109 - RNA, 22 nt, Human
ucucugaaggcuguguugaugg

SEQ ID NO: 70110 - RNA, 22 nt, Human
ucucugaaggggagcuguuuaa

SEQ ID NO: 70111 - RNA, 22 nt, Human
ucucugaauaaugcuauucuuu

SEQ ID NO: 70112 - RNA, 22 nt, Human
ucucugaaugagauuacugccu

SEQ ID NO: 70113 - RNA, 22 nt, Human
ucucugaauucugaugcaagug

SEQ ID NO: 70114 - RNA, 22 nt, Human
ucucugagaucagccacugacu

SEQ ID NO: 70115 - RNA, 22 nt, Human
ucucugagcuuaagguguuuca

SEQ ID NO: 70116 - RNA, 22 nt, Human
ucucugaguaagugacaguuca

SEQ ID NO: 70117 - RNA, 22 nt, Human
ucucugaguauccugaacugcc

SEQ ID NO: 70118 - RNA, 22 nt, Human
ucucugaguuguaaaaaauagu

SEQ ID NO: 70119 - RNA, 22 nt, Human
ucucugcaacuacaucuuaggg

SEQ ID NO: 70120 - RNA, 22 nt, Human
ucucugcagcuaagaaauuaau

SEQ ID NO: 70121 - RNA, 22 nt, Human
ucucugcaugacccaaggcuga

SEQ ID NO: 70122 - RNA, 22 nt, Human
ucucugcccaaguuucucaagu

SEQ ID NO: 70123 - RNA, 22 nt, Human
ucucuggcacauaauaaggucu

SEQ ID NO: 70124 - RNA, 22 nt, Human
ucucuggcagacuggcugggcu

SEQ ID NO: 70125 - RNA, 22 nt, Human
ucucuggcagaggcccuauccc

SEQ ID NO: 70126 - RNA, 19 nt, Human
ucucuggcaguucagagca

SEQ ID NO: 70127 - RNA, 19 nt, Human
ucucuggcauagacucaau

SEQ ID NO: 70128 - RNA, 22 nt, Human
ucucuggcccuguuuucuaucu

SEQ ID NO: 70129 - RNA, 22 nt, Human
ucucuggccgagagucccuggg

SEQ ID NO: 70130 - RNA, 21 nt, Human
ucucuggcgguguuuggcucc

SEQ ID NO: 70131 - RNA, 22 nt, Human
ucucuggcuccugccgggucca

SEQ ID NO: 70132 - RNA, 22 nt, Human
ucucuggcugauauuccucugc

SEQ ID NO: 70133 - RNA, 22 nt, Human
ucucuggcuggcaccccaggga

SEQ ID NO: 70134 - RNA, 22 nt, Human
ucucugggauaaacugggccag

SEQ ID NO: 70135 - RNA, 22 nt, Human
ucucugggccucccuuuccaag

SEQ ID NO: 70136 - RNA, 22 nt, Human
ucucugggcuaaaaucaaggug

SEQ ID NO: 70137 - RNA, 22 nt, Human
ucucugggcucaggagcccggc

SEQ ID NO: 70138 - RNA, 22 nt, Human
ucucuggguauucacugccuuc

SEQ ID NO: 70139 - RNA, 22 nt, Human
ucucugggucucaguuuguaca

SEQ ID NO: 70140 - RNA, 22 nt, Human
ucucugguuaugucauuaagca

SEQ ID NO: 70141 - RNA, 21 nt, Human
ucucugguuggaguugugcca

SEQ ID NO: 70142 - RNA, 22 nt, Human
ucucuguaauaucuuuuacaac

SEQ ID NO: 70143 - RNA, 22 nt, Human
ucucuguagggcugcuugagua

SEQ ID NO: 70144 - RNA, 22 nt, Human
ucucuguaucagcaccugcugg

SEQ ID NO: 70145 - RNA, 21 nt, Human
ucucuguauccauggguucca

SEQ ID NO: 70146 - RNA, 22 nt, Human
ucucuguauucuucguaaugcc

SEQ ID NO: 70147 - RNA, 22 nt, Human
ucucugugagaugccuuccuga

SEQ ID NO: 70148 - RNA, 22 nt, Human
ucucugugcccaguaguucucu

SEQ ID NO: 70149 - RNA, 22 nt, Human
ucucugugggcuuuggacuuga

SEQ ID NO: 70150 - RNA, 22 nt, Human
ucucuguggugggaggcugagu

SEQ ID NO: 70151 - RNA, 22 nt, Human
ucucugugucuuagugaaggga

SEQ ID NO: 70152 - RNA, 21 nt, Human
ucucugugucuuuaagcugga

SEQ ID NO: 70153 - RNA, 22 nt, Human
ucucugugugccuucaucugcc

SEQ ID NO: 70154 - RNA, 22 nt, Human
ucucugugugugugacagcauu

SEQ ID NO: 70155 - RNA, 22 nt, Human
ucucuguguguuggcuguauau

SEQ ID NO: 70156 - RNA, 22 nt, Human
ucucuuaauaaguaaauacuga

SEQ ID NO: 70157 - RNA, 22 nt, Human
ucucuuaauuuuggaauagugu

SEQ ID NO: 70158 - RNA, 22 nt, Human
ucucuucacacuaccccugugu

SEQ ID NO: 70159 - RNA, 22 nt, Human
ucucuucacaugcuugcuccaa

SEQ ID NO: 70160 - RNA, 20 nt, Human
ucucuucaggagguccaugu

SEQ ID NO: 70161 - RNA, 22 nt, Human
ucucuucauagugacacccauc

SEQ ID NO: 70162 - RNA, 22 nt, Human
ucucuucauuugcuauggguca

SEQ ID NO: 70163 - RNA, 22 nt, Human
ucucuuccauguuucagcccca

SEQ ID NO: 70164 - RNA, 22 nt, Human
ucucuuccccuuuccuuuaaca

SEQ ID NO: 70165 - RNA, 22 nt, Human
ucucuuccucagccuggggccu

SEQ ID NO: 70166 - RNA, 22 nt, Human
ucucuucuagcuucuugugguu

SEQ ID NO: 70167 - RNA, 22 nt, Human
ucucuucuauuugagacuauuu

SEQ ID NO: 70168 - RNA, 22 nt, Human
ucucuucuuguguuuuccugcc

SEQ ID NO: 70169 - RNA, 22 nt, Human
ucucuugacugcuaaaauuaga

SEQ ID NO: 70170 - RNA, 22 nt, Human
ucucuuggggaaagagaagaau

SEQ ID NO: 70171 - RNA, 22 nt, Human
ucucuuggugauagucuuucuu

SEQ ID NO: 70172 - RNA, 22 nt, Human
ucucuuuaaaaauagugaaaua

SEQ ID NO: 70173 - RNA, 20 nt, Human
ucucuuuuagcuuacagcug

SEQ ID NO: 70174 - RNA, 22 nt, Human
ucucuuuuauguacacccugac

SEQ ID NO: 70175 - RNA, 22 nt, Human
ucugaaagaaagauuuuguuuc

SEQ ID NO: 70176 - RNA, 22 nt, Human
ucugaaagaagggcagucuuuu

SEQ ID NO: 70177 - RNA, 22 nt, Human
ucugaaagaugagugguccauu

SEQ ID NO: 70178 - RNA, 22 nt, Human
ucugaaagcauuacaguuuauu

SEQ ID NO: 70179 - RNA, 22 nt, Human
ucugaaagucugaaacaguguc

SEQ ID NO: 70180 - RNA, 22 nt, Human
ucugaaauaggagccauguaga

SEQ ID NO: 70181 - RNA, 22 nt, Human
ucugaaaugaccuuuccccacu

SEQ ID NO: 70182 - RNA, 22 nt, Human
ucugaaauuccuuccagacuuu

SEQ ID NO: 70183 - RNA, 20 nt, Human
ucugaacaaaauguaauguc

SEQ ID NO: 70184 - RNA, 17 nt, Human
ucugcagggggccgugu

SEQ ID NO: 70185 - RNA, 22 nt, Human
ucugcaggugggccccuagaau

SEQ ID NO: 70186 - RNA, 22 nt, Human
ucugcauauuuaucaugagucu

SEQ ID NO: 70187 - RNA, 22 nt, Human
ucugcaugaugaacaaaugagc

SEQ ID NO: 70188 - RNA, 22 nt, Human
ucugcauuuggaucuugagcug

SEQ ID NO: 70189 - RNA, 21 nt, Human
ucugcauuuuagcaagaucuc

SEQ ID NO: 70190 - RNA, 22 nt, Human
ucugccaccaacugucacuaca

SEQ ID NO: 70191 - RNA, 22 nt, Human
ucugccacuuuugcuuacuggg

SEQ ID NO: 70192 - RNA, 22 nt, Human
ucugccagaagccagggucugg

SEQ ID NO: 70193 - RNA, 22 nt, Human
gugcacugucuggucaagagca

SEQ ID NO: 70194 - RNA, 22 nt, Human
gugcagagaaggagcaguaguu

SEQ ID NO: 70195 - RNA, 22 nt, Human
gugcagagaggaccuuggggag

SEQ ID NO: 70196 - RNA, 22 nt, Human
gugcagagagguggagggacuu

SEQ ID NO: 70197 - RNA, 22 nt, Human
gugcagaggucacaaaagugaa

SEQ ID NO: 70198 - RNA, 22 nt, Human
gugcagagugucuguggacuga

SEQ ID NO: 70199 - RNA, 22 nt, Human
gugcagauucccgggccucucc

SEQ ID NO: 70200 - RNA, 20 nt, Human
gugcagcacuuggggguagg

SEQ ID NO: 70201 - RNA, 22 nt, Human
gugcagcuacuccuugguccua

SEQ ID NO: 70202 - RNA, 22 nt, Human
gugcagcucaguugaaaugcag

SEQ ID NO: 70203 - RNA, 16 nt, Human
gugcagcugccuggua

SEQ ID NO: 70204 - RNA, 22 nt, Human
gugcagcugguggagucugggg

SEQ ID NO: 70205 - RNA, 22 nt, Human
gugcaggagcaggagccauguc

SEQ ID NO: 70206 - RNA, 22 nt, Human
gugcaggagcuucuggccugac

SEQ ID NO: 70207 - RNA, 22 nt, Human
gugcaggaucucagaacaagug

SEQ ID NO: 70208 - RNA, 22 nt, Human
gugcaggauuuauagcccagcu

SEQ ID NO: 70209 - RNA, 22 nt, Human
gugcaggcuagauccuuccuac

SEQ ID NO: 70210 - RNA, 22 nt, Human
gugcagggagcccagaaggucc

SEQ ID NO: 70211 - RNA, 22 nt, Human
gugcagggcccuccuaacaucu

SEQ ID NO: 70212 - RNA, 22 nt, Human
gugcaggugguuggcccagccg

SEQ ID NO: 70213 - RNA, 22 nt, Human
gugcaguaucucugggaguggg

SEQ ID NO: 70214 - RNA, 22 nt, Human
gugcagugagcagugcagcacc

SEQ ID NO: 70215 - RNA, 19 nt, Human
gugcaguucagaguucaau

SEQ ID NO: 70216 - RNA, 22 nt, Human
gugcauacuuuauuuuaauacu

SEQ ID NO: 70217 - RNA, 22 nt, Human
gugcauauguguguauacaaac

SEQ ID NO: 70218 - RNA, 22 nt, Human
gugcauauuuugcacacagaug

SEQ ID NO: 70219 - RNA, 22 nt, Human
gugcaucagaguguccuagaca

SEQ ID NO: 70220 - RNA, 22 nt, Human
gugcaugaagcaggcagcuccu

SEQ ID NO: 70221 - RNA, 22 nt, Human
gugcaugcacacaugugugagg

SEQ ID NO: 70222 - RNA, 22 nt, Human
gugcaugcaguaaguguuuuaa

SEQ ID NO: 70223 - RNA, 22 nt, Human
gugcaugguaagaugcuucaca

SEQ ID NO: 70224 - RNA, 22 nt, Human
gugcaugugguaaagaggagag

SEQ ID NO: 70225 - RNA, 22 nt, Human
gugcauuauucuuaccuuucuu

SEQ ID NO: 70226 - RNA, 22 nt, Human
gugcauuggugcgccacuucac

SEQ ID NO: 70227 - RNA, 22 nt, Human
gugcauuuauauuugccuuugg

SEQ ID NO: 70228 - RNA, 22 nt, Human
gugcauuuggugacucucaccc

SEQ ID NO: 70229 - RNA, 22 nt, Human
gugcauuugugcaugcacaugu

SEQ ID NO: 70230 - RNA, 22 nt, Human
gugccacaugguccauguauca

SEQ ID NO: 70231 - RNA, 22 nt, Human
gugccaccuucaaaucacauug

SEQ ID NO: 70232 - RNA, 22 nt, Human
gugccacuuaccugggaggagu

SEQ ID NO: 70233 - RNA, 22 nt, Human
gugccagaagguucccgcugca

SEQ ID NO: 70234 - RNA, 22 nt, Human
gugccagagauuccuaaacuuu

SEQ ID NO: 70235 - RNA, 22 nt, Human
gugccagcuguccauguuccuc

SEQ ID NO: 70236 - RNA, 22 nt, Human
gugccagggggcacugaacaga

SEQ ID NO: 70237 - RNA, 22 nt, Human
gugccaucauucaauaaauuca

SEQ ID NO: 70238 - RNA, 22 nt, Human
gugcccaguccugccuugacag

SEQ ID NO: 70239 - RNA, 22 nt, Human
gugcccagugcaggcccgcagg

SEQ ID NO: 70240 - RNA, 22 nt, Human
gugccccagacacgcauguggg

SEQ ID NO: 70241 - RNA, 22 nt, Human
gugcccugagcuuaugcauucu

SEQ ID NO: 70242 - RNA, 22 nt, Human
gugcccuggagggguugaaggg

SEQ ID NO: 70243 - RNA, 22 nt, Human
gugcccuggaugacuuuggucu

SEQ ID NO: 70244 - RNA, 20 nt, Human
gugcccugugggcuauuuuc

SEQ ID NO: 70245 - RNA, 22 nt, Human
gugcccuguucauuucucuccc

SEQ ID NO: 70246 - RNA, 21 nt, Human
gugcccuguucccacaugccc

SEQ ID NO: 70247 - RNA, 22 nt, Human
gugccgcuggagcuggaauuga

SEQ ID NO: 70248 - RNA, 22 nt, Human
gugccucagcaccgccugcagc

SEQ ID NO: 70249 - RNA, 22 nt, Human
gugccugcuaccugacuuguuu

SEQ ID NO: 70250 - RNA, 22 nt, Human
gugccuggagcuaauguguaua

SEQ ID NO: 70251 - RNA, 22 nt, Human
gugccuggcagggucagcugcu

SEQ ID NO: 70252 - RNA, 22 nt, Human
gugccugggacacgagauuuuc

SEQ ID NO: 70253 - RNA, 22 nt, Human
gugccugguauguagguagcgg

SEQ ID NO: 70254 - RNA, 22 nt, Human
gugccuuccccgguggucuguu

SEQ ID NO: 70255 - RNA, 22 nt, Human
gugccuuuucuucauaguuacu

SEQ ID NO: 70256 - RNA, 22 nt, Human
gugcgccagcucaaggggaggc

SEQ ID NO: 70257 - RNA, 23 nt, Human
gugcgccaggacaaccugacgga

SEQ ID NO: 70258 - RNA, 22 nt, Human
gugcgggccuggggguuucucu

SEQ ID NO: 70259 - RNA, 22 nt, Human
gugcuaaaggguuaugaacaag

SEQ ID NO: 70260 - RNA, 22 nt, Human
gugcuacuaguuucauuuuuca

SEQ ID NO: 70261 - RNA, 22 nt, Human
gugcuaugauuggacagaauag

SEQ ID NO: 70262 - RNA, 22 nt, Human
gugcucagguucccaugagugc

SEQ ID NO: 70263 - RNA, 22 nt, Human
gugcuccauggccuguguccau

SEQ ID NO: 70264 - RNA, 22 nt, Human
gugcuccucacaguguggcccu

SEQ ID NO: 70265 - RNA, 22 nt, Human
gugcucuacaugcuccauguuu

SEQ ID NO: 70266 - RNA, 22 nt, Human
gugcucuagaaauugucagugg

SEQ ID NO: 70267 - RNA, 22 nt, Human
gugcucuccuggcugcccugac

SEQ ID NO: 70268 - RNA, 22 nt, Human
gugcucugccuggggucauggc

SEQ ID NO: 70269 - RNA, 22 nt, Human
gugcucuggccaagcgcgugcg

SEQ ID NO: 70270 - RNA, 22 nt, Human
gugcucugggcugccugacaug

SEQ ID NO: 70271 - RNA, 23 nt, Human
gugcucuucaguuuuagggucau

SEQ ID NO: 70272 - RNA, 22 nt, Human
gugcugaaauggaccucaggaa

SEQ ID NO: 70273 - RNA, 22 nt, Human
gugcugaacuauaaaaagcuuu

SEQ ID NO: 70274 - RNA, 22 nt, Human
gugcugaagaagucuguucgcc

SEQ ID NO: 70275 - RNA, 22 nt, Human
gugcugaauccacucuuaggaa

SEQ ID NO: 70276 - RNA, 22 nt, Human
gugcugaauugugcucuuuaca

SEQ ID NO: 70277 - RNA, 22 nt, Human
gugcugacaggagccuggcggu

SEQ ID NO: 70278 - RNA, 22 nt, Human
gugcugagauuggagugagcag

SEQ ID NO: 70279 - RNA, 22 nt, Human
gugcugagcacagcugcccagg

SEQ ID NO: 70280 - RNA, 22 nt, Human
gugcugagcaucaugaggcacu

SEQ ID NO: 70281 - RNA, 22 nt, Human
gugcugaggauacagcugugaa

SEQ ID NO: 70282 - RNA, 22 nt, Human
gugcugccuccauauccgucag

SEQ ID NO: 70283 - RNA, 22 nt, Human
gugcugcgaugauuuuacagag

SEQ ID NO: 70284 - RNA, 22 nt, Human
gugcugcuugggggcagagcag

SEQ ID NO: 70285 - RNA, 22 nt, Human
gugcuggcccuguccucgagcu

SEQ ID NO: 70286 - RNA, 22 nt, Human
gugcuggccucagagggucaug

SEQ ID NO: 70287 - RNA, 21 nt, Human
gugcugggacacagccaggcu

SEQ ID NO: 70288 - RNA, 22 nt, Human
gugcugggcccugagaccaggg

SEQ ID NO: 70289 - RNA, 22 nt, Human
gugcugggcuccaccccagagg

SEQ ID NO: 70290 - RNA, 22 nt, Human
gugcuguauugagacaaggucg

SEQ ID NO: 70291 - RNA, 22 nt, Human
gugcugucaauugcuuucagua

SEQ ID NO: 70292 - RNA, 22 nt, Human
gugcuguucuggcugccaccac

SEQ ID NO: 70293 - RNA, 22 nt, Human
gugcuuauccccauucuggagg

SEQ ID NO: 70294 - RNA, 22 nt, Human
gugcuucccauuagaacuguga

SEQ ID NO: 70295 - RNA, 22 nt, Human
gugcuuccuagguaaguaggua

SEQ ID NO: 70296 - RNA, 22 nt, Human
gugcuuccuccuuaaacuguca

SEQ ID NO: 70297 - RNA, 22 nt, Human
gugcuuccugccuggugccuuu

SEQ ID NO: 70298 - RNA, 22 nt, Human
gugcuucuccguucugcagcac

SEQ ID NO: 70299 - RNA, 22 nt, Human
gugcuucuuucuccucaagccu

SEQ ID NO: 70300 - RNA, 22 nt, Human
gugcuuggaccaggucaucuuc

SEQ ID NO: 70301 - RNA, 22 nt, Human
gugcuuuaaaccacugugcugu

SEQ ID NO: 70302 - RNA, 22 nt, Human
gugcuuuaccuuauuggucucg

SEQ ID NO: 70303 - RNA, 22 nt, Human
gugcuuuacuguguugccuuua

SEQ ID NO: 70304 - RNA, 22 nt, Human
uaaaaaacauuacucuguccug

SEQ ID NO: 70305 - RNA, 22 nt, Human
uaaaaaguagugagaauggcgc

SEQ ID NO: 70306 - RNA, 22 nt, Human
uaaaaaguugaaaggacuuauc

SEQ ID NO: 70307 - RNA, 22 nt, Human
uaaaaccaggucuugggauuua

SEQ ID NO: 70308 - RNA, 19 nt, Human
uaaaacgugcauggcagca

SEQ ID NO: 70309 - RNA, 22 nt, Human
uaaaacugaauacauacugagg

SEQ ID NO: 70310 - RNA, 22 nt, Human
uaaaaggagguugaagcuguca

SEQ ID NO: 70311 - RNA, 19 nt, Human
uaaaaggauguggaaggau

SEQ ID NO: 70312 - RNA, 22 nt, Human
uaaaaggcaauacuagaugagu

SEQ ID NO: 70313 - RNA, 22 nt, Human
uaaaaguauacuuucaaaggag

SEQ ID NO: 70314 - RNA, 22 nt, Human
uaaaauagcuuaugucuuuuga

SEQ ID NO: 70315 - RNA, 22 nt, Human
uaaaaugacuuccuccaacauc

SEQ ID NO: 70316 - RNA, 22 nt, Human
uaaaaugaucucucauguucuu

SEQ ID NO: 70317 - RNA, 22 nt, Human
uaaaaugguaacuuucauuugc

SEQ ID NO: 70318 - RNA, 22 nt, Human
uaaaauguagcuucuaggcugg

SEQ ID NO: 70319 - RNA, 18 nt, Human
uaaaauucaaggcagggu

SEQ ID NO: 70320 - RNA, 22 nt, Human
uaaacagaauucaggcaagaua

SEQ ID NO: 70321 - RNA, 22 nt, Human
uaaacagagagugcaguuauag

SEQ ID NO: 70322 - RNA, 22 nt, Human
uaaacagagugcuaguucacgg

SEQ ID NO: 70323 - RNA, 22 nt, Human
uaaacaguuaacaugccagaau

SEQ ID NO: 70324 - RNA, 22 nt, Human
uaaacaucugaauccugcuucc

SEQ ID NO: 70325 - RNA, 18 nt, Human
uaaaccugagaagcgugu

SEQ ID NO: 70326 - RNA, 22 nt, Human
uaaaccuuauuugaauaccaac

SEQ ID NO: 70327 - RNA, 22 nt, Human
uaaacgugcuucauauuuuuag

SEQ ID NO: 70328 - RNA, 22 nt, Human
uaaacuacuaggaugaauuuuu

SEQ ID NO: 70329 - RNA, 22 nt, Human
uaaacucuucuguagaaucaga

SEQ ID NO: 70330 - RNA, 22 nt, Human
uaaacugaagcucaacucaaau

SEQ ID NO: 70331 - RNA, 22 nt, Human
uaaacugcuucucucagucugu

SEQ ID NO: 70332 - RNA, 22 nt, Human
uaaagaacacagggaauagcac

SEQ ID NO: 70333 - RNA, 21 nt, Human
uaaagaagaugaaugugauca

SEQ ID NO: 70334 - RNA, 22 nt, Human
uaaagacaaacccacuaggguu

SEQ ID NO: 70335 - RNA, 22 nt, Human
uaaagacaaaugacauuacggc

SEQ ID NO: 70336 - RNA, 22 nt, Human
uaaagacaauuucgagcuguag

SEQ ID NO: 70337 - RNA, 22 nt, Human
uaaagacacugguuuuaaucau

SEQ ID NO: 70338 - RNA, 20 nt, Human
uaaagacauaagcuacuauc

SEQ ID NO: 70339 - RNA, 22 nt, Human
uaaagagccauuguaugguuuu

SEQ ID NO: 70340 - RNA, 22 nt, Human
uaaagcaaaaaugaacugccau

SEQ ID NO: 70341 - RNA, 22 nt, Human
uaaagcacauaucuuacaauaa

SEQ ID NO: 70342 - RNA, 20 nt, Human
uaaagcagccguggagggua

SEQ ID NO: 70343 - RNA, 22 nt, Human
uaaagcagcguggguggggcag

SEQ ID NO: 70344 - RNA, 22 nt, Human
uaaagcagucuguguaugugaa

SEQ ID NO: 70345 - RNA, 22 nt, Human
uaaagcagugguucucaaacuu

SEQ ID NO: 70346 - RNA, 17 nt, Human
uaaagccagucaaguca

SEQ ID NO: 70347 - RNA, 22 nt, Human
uaaagcuagccaaccacugucu

SEQ ID NO: 70348 - RNA, 22 nt, Human
uaaagcuaugcuuaauuuauca

SEQ ID NO: 70349 - RNA, 21 nt, Human
uaaagcucguucaggaaaguc

SEQ ID NO: 70350 - RNA, 22 nt, Human
uaaagcugaaaugauuaugaca

SEQ ID NO: 70351 - RNA, 22 nt, Human
uaaagcuuguauugcaauauuu

SEQ ID NO: 70352 - RNA, 19 nt, Human
uaaaggaagaagggaggau

SEQ ID NO: 70353 - RNA, 19 nt, Human
uaaaggaagaggaagggaa

SEQ ID NO: 70354 - RNA, 18 nt, Human
uaaaggaagugggagagg

SEQ ID NO: 70355 - RNA, 22 nt, Human
uaaaggaaucaguuuuagagau

SEQ ID NO: 70356 - RNA, 22 nt, Human
uaaaggaggaguuaaugagacu

SEQ ID NO: 70357 - RNA, 22 nt, Human
uaaaggcacugcgucccucaaa

SEQ ID NO: 70358 - RNA, 22 nt, Human
uaaaggcagccacugagcucaa

SEQ ID NO: 70359 - RNA, 22 nt, Human
uaaaggcaguaauuccugaguu

SEQ ID NO: 70360 - RNA, 22 nt, Human
uaaaggccagggccugagugcu

SEQ ID NO: 70361 - RNA, 22 nt, Human
uaaaggccuaguaaguugagac

SEQ ID NO: 70362 - RNA, 20 nt, Human
uaaaggcugugagguggccc

SEQ ID NO: 70363 - RNA, 22 nt, Human
uaaagguacgaagugagggauu

SEQ ID NO: 70364 - RNA, 22 nt, Human
uaaagguagugugacauauugu

SEQ ID NO: 70365 - RNA, 22 nt, Human
uaaagguuaguagcagggaaac

SEQ ID NO: 70366 - RNA, 22 nt, Human
uaaagguuauugcacuggaguu

SEQ ID NO: 70367 - RNA, 22 nt, Human
uaaagguugaaaacugacugcc

SEQ ID NO: 70368 - RNA, 22 nt, Human
uaaaguagcaaguuuagacuga

SEQ ID NO: 70369 - RNA, 22 nt, Human
uaaaguagcgccuaacuaaugu

SEQ ID NO: 70370 - RNA, 22 nt, Human
uaaaguauaagcauuggaguau

SEQ ID NO: 70371 - RNA, 22 nt, Human
uaaagucacagagcaggugcaa

SEQ ID NO: 70372 - RNA, 22 nt, Human
uaaagucaucuuuaaacaugcc

SEQ ID NO: 70373 - RNA, 22 nt, Human
uaaagugaaggucauaaugauu

SEQ ID NO: 70374 - RNA, 22 nt, Human
uaaagugccucagguccugggu

SEQ ID NO: 70375 - RNA, 22 nt, Human
uaaagugcgacccaguccccag

SEQ ID NO: 70376 - RNA, 23 nt, Human
uaaaguggcgcuguuacugccag

SEQ ID NO: 70377 - RNA, 22 nt, Human
uaaagugggcaaacucucaugg

SEQ ID NO: 70378 - RNA, 22 nt, Human
uaaaguguccuagcuaggaggc

SEQ ID NO: 70379 - RNA, 22 nt, Human
uaaagugugcauggucaaauau

SEQ ID NO: 70380 - RNA, 22 nt, Human
uaaaguuauaaauuaccuguca

SEQ ID NO: 70381 - RNA, 22 nt, Human
uaaaguucagugcaugaaugug

SEQ ID NO: 70382 - RNA, 22 nt, Human
uaaaguuuggcagacaauaaca

SEQ ID NO: 70383 - RNA, 17 nt, Human
uaaauacacaaggguau

SEQ ID NO: 70384 - RNA, 22 nt, Human
uaaauacuuuacaggaugucuc

SEQ ID NO: 70385 - RNA, 22 nt, Human
uaaauaugcauguauccuuauc

SEQ ID NO: 70386 - RNA, 22 nt, Human
uaaaucaagaauaucagcuugu

SEQ ID NO: 70387 - RNA, 22 nt, Human
uaaaucagggagucaucugcga

SEQ ID NO: 70388 - RNA, 22 nt, Human
uaaaucucagccuuucugcuua

SEQ ID NO: 70389 - RNA, 22 nt, Human
uaaaucucagggaauauauuga

SEQ ID NO: 70390 - RNA, 22 nt, Human
uaaaucucugcuccucuugggu

SEQ ID NO: 70391 - RNA, 22 nt, Human
uaaaugaagaaauggagauugu

SEQ ID NO: 70392 - RNA, 22 nt, Human
uaaaugaagcucaugggccaca

SEQ ID NO: 70393 - RNA, 22 nt, Human
uaaaugacauucuuaagucuug

SEQ ID NO: 70394 - RNA, 22 nt, Human
uaaaugagauguacauaacuca

SEQ ID NO: 70395 - RNA, 22 nt, Human
uaaaugaguaauauagcuguuu

SEQ ID NO: 70396 - RNA, 22 nt, Human
uaaaugauuuauguaugugaaa

SEQ ID NO: 70397 - RNA, 22 nt, Human
uaaaugcaaagcuuggcgcuua

SEQ ID NO: 70398 - RNA, 22 nt, Human
uaaaugcaagugcuccugggag

SEQ ID NO: 70399 - RNA, 22 nt, Human
uaaaugcaguacaaauuguucu

SEQ ID NO: 70400 - RNA, 22 nt, Human
uaaaugcaguuaguacuugcca

SEQ ID NO: 70401 - RNA, 20 nt, Human
uaaaugcaucuguucaacug

SEQ ID NO: 70402 - RNA, 22 nt, Human
ucuuuuuauauugacaaaaggu

SEQ ID NO: 70403 - RNA, 22 nt, Human
ugaaaacacuuuaguuuagguc

SEQ ID NO: 70404 - RNA, 22 nt, Human
ugaaaacuccaaguuucaucag

SEQ ID NO: 70405 - RNA, 22 nt, Human
ugaaaagucuuauauugucuga

SEQ ID NO: 70406 - RNA, 22 nt, Human
ugaaaagugaucauggauuagg

SEQ ID NO: 70407 - RNA, 22 nt, Human
ugaaaauauaguuuuccagacu

SEQ ID NO: 70408 - RNA, 22 nt, Human
ugaaaaugcacgcuggaaagca

SEQ ID NO: 70409 - RNA, 22 nt, Human
ugaaacaaaccaguaauuuugu

SEQ ID NO: 70410 - RNA, 22 nt, Human
ugaaacaaauuuggaaaaucua

SEQ ID NO: 70411 - RNA, 18 nt, Human
ugaaacaagaauggugca

SEQ ID NO: 70412 - RNA, 22 nt, Human
ugaaacaagauccacagacuug

SEQ ID NO: 70413 - RNA, 17 nt, Human
ugaaacaccaagacugu

SEQ ID NO: 70414 - RNA, 22 nt, Human
ugaaacacugcgauaaaauccu

SEQ ID NO: 70415 - RNA, 22 nt, Human
ugaaacagaguggauacaguga

SEQ ID NO: 70416 - RNA, 23 nt, Human
ugaaacagaugccaaugaucaag

SEQ ID NO: 70417 - RNA, 22 nt, Human
ugaaacagcuaucaguagacug

SEQ ID NO: 70418 - RNA, 22 nt, Human
ugaaacauaaaguuaucuucag

SEQ ID NO: 70419 - RNA, 22 nt, Human
ugaaaccacugaugguaccaag

SEQ ID NO: 70420 - RNA, 21 nt, Human
ugaaacuaccuacaagcuacc

SEQ ID NO: 70421 - RNA, 22 nt, Human
ugaaacuaggccaaucaaauua

SEQ ID NO: 70422 - RNA, 22 nt, Human
ugaaacuugaguauauauggau

SEQ ID NO: 70423 - RNA, 22 nt, Human
ugaaagaagccuucgaggcucg

SEQ ID NO: 70424 - RNA, 22 nt, Human
ugaaagagugcaagucaaggag

SEQ ID NO: 70425 - RNA, 22 nt, Human
ugaaagauugugauucaauaug

SEQ ID NO: 70426 - RNA, 22 nt, Human
ugaaagcagcaccaauaccauu

SEQ ID NO: 70427 - RNA, 22 nt, Human
ugaaagcauaugcuaaagacca

SEQ ID NO: 70428 - RNA, 20 nt, Human
ugaaagcaugugguauuugg

SEQ ID NO: 70429 - RNA, 22 nt, Human
ugaaagcugcccaguggaauua

SEQ ID NO: 70430 - RNA, 22 nt, Human
ugaaagguuauuuaggucugcu

SEQ ID NO: 70431 - RNA, 22 nt, Human
ugaaagugaaugucacuguuga

SEQ ID NO: 70432 - RNA, 22 nt, Human
ugaaaguuacaggaaaacagau

SEQ ID NO: 70433 - RNA, 22 nt, Human
ugaaaguucaauaccaauuugg

SEQ ID NO: 70434 - RNA, 23 nt, Human
ugaaaguucugaagagaucaugc

SEQ ID NO: 70435 - RNA, 21 nt, Human
ugaaaguuggagucaaaugua

SEQ ID NO: 70436 - RNA, 22 nt, Human
ugaaauacacaaauuuaguaag

SEQ ID NO: 70437 - RNA, 22 nt, Human
ugaaauacugagugaaagaauu

SEQ ID NO: 70438 - RNA, 22 nt, Human
ugaaauauuuagagaguaaguu

SEQ ID NO: 70439 - RNA, 23 nt, Human
ugaaaucagaacccuuaccucuc

SEQ ID NO: 70440 - RNA, 17 nt, Human
ugaaaucagcacccagg

SEQ ID NO: 70441 - RNA, 22 nt, Human
ugaaaucauaacaguuuggcuu

SEQ ID NO: 70442 - RNA, 22 nt, Human
ugaaaucaucaaaagagccauu

SEQ ID NO: 70443 - RNA, 22 nt, Human
ugaaaucaugaacaagguaggu

SEQ ID NO: 70444 - RNA, 22 nt, Human
ugaaaucauugccaaguauuga

SEQ ID NO: 70445 - RNA, 22 nt, Human
ugaaaucauugggguugaauaa

SEQ ID NO: 70446 - RNA, 21 nt, Human
ugaaaucugaugggacaaaug

SEQ ID NO: 70447 - RNA, 22 nt, Human
ugaaaugaagggcuuguucugg

SEQ ID NO: 70448 - RNA, 22 nt, Human
ugaaaugaaugugauucgauag

SEQ ID NO: 70449 - RNA, 22 nt, Human
ugaaaugacaaagguuuuucuu

SEQ ID NO: 70450 - RNA, 22 nt, Human
ugaaaugacagucuuaagcucu

SEQ ID NO: 70451 - RNA, 21 nt, Human
ugaaaugagaaugcugagcac

SEQ ID NO: 70452 - RNA, 22 nt, Human
ugaaaugauguacaagaaggca

SEQ ID NO: 70453 - RNA, 22 nt, Human
ugaaaugcaacaguuauuuuug

SEQ ID NO: 70454 - RNA, 22 nt, Human
ugaaaugccuaugaagucagga

SEQ ID NO: 70455 - RNA, 22 nt, Human
ugaaaugcuguagagacuguau

SEQ ID NO: 70456 - RNA, 22 nt, Human
guuuccugucugcuuuacuaua

SEQ ID NO: 70457 - RNA, 18 nt, Human
guuuccugucuuacgggg

SEQ ID NO: 70458 - RNA, 22 nt, Human
guuuccuguuucucagcagccc

SEQ ID NO: 70459 - RNA, 22 nt, Human
guuuccuuucuauugccuugau

SEQ ID NO: 70460 - RNA, 22 nt, Human
guuucuaaauguucugaguuuu

SEQ ID NO: 70461 - RNA, 23 nt, Human
guuucuaugucuugugccuucau

SEQ ID NO: 70462 - RNA, 22 nt, Human
guuucucacuuaccaacacaug

SEQ ID NO: 70463 - RNA, 22 nt, Human
guuucucaucaguuucugauau

SEQ ID NO: 70464 - RNA, 22 nt, Human
guuucuccucugugucuuguuu

SEQ ID NO: 70465 - RNA, 22 nt, Human
guuucucugucuguuacauugg

SEQ ID NO: 70466 - RNA, 22 nt, Human
guuucugaagggauuacuuggu

SEQ ID NO: 70467 - RNA, 22 nt, Human
guuugaaaaaagcaguauguaa

SEQ ID NO: 70468 - RNA, 22 nt, Human
guuugaaaguucaacaggaaaa

SEQ ID NO: 70469 - RNA, 22 nt, Human
guuugagauggguuauugcucu

SEQ ID NO: 70470 - RNA, 22 nt, Human
guuugcaaauuguguuaaagcu

SEQ ID NO: 70471 - RNA, 22 nt, Human
guuugcauaaaguggaugcagg

SEQ ID NO: 70472 - RNA, 22 nt, Human
guuugcauaucugugaaaugga

SEQ ID NO: 70473 - RNA, 22 nt, Human
guuugcauggaagacagugagu

SEQ ID NO: 70474 - RNA, 17 nt, Human
guuugcaugguguuaac

SEQ ID NO: 70475 - RNA, 22 nt, Human
guuugcauguauuaagucaaua

SEQ ID NO: 70476 - RNA, 22 nt, Human
guuugccugugauguacauuuc

SEQ ID NO: 70477 - RNA, 22 nt, Human
guuugccuuuuagauaggaaug

SEQ ID NO: 70478 - RNA, 22 nt, Human
guuuggauguguagugagggga

SEQ ID NO: 70479 - RNA, 22 nt, Human
guuuggcaauauuuguggaaca

SEQ ID NO: 70480 - RNA, 18 nt, Human
guuuggcauaacugaugc

SEQ ID NO: 70481 - RNA, 22 nt, Human
guuuggggaguuccuuuaggcc

SEQ ID NO: 70482 - RNA, 22 nt, Human
guuuggugguagcauuggcuau

SEQ ID NO: 70483 - RNA, 22 nt, Human
guuuguaaccagaacagagagu

SEQ ID NO: 70484 - RNA, 22 nt, Human
guuugucuuaauuaggcaucga

SEQ ID NO: 70485 - RNA, 22 nt, Human
guuuguuuuaagauaggaugga

SEQ ID NO: 70486 - RNA, 22 nt, Human
guuuuauaggugaaauauuacu

SEQ ID NO: 70487 - RNA, 22 nt, Human
guuuuauaguucgggaccuguu

SEQ ID NO: 70488 - RNA, 22 nt, Human
guuuuauaugucucugcugaca

SEQ ID NO: 70489 - RNA, 22 nt, Human
guuuucaugucuauugggcaua

SEQ ID NO: 70490 - RNA, 22 nt, Human
guuuuccagguaccuugguauu

SEQ ID NO: 70491 - RNA, 22 nt, Human
guuuucuaggauccccuccaag

SEQ ID NO: 70492 - RNA, 22 nt, Human
guuuugaaucacugcgcuucac

SEQ ID NO: 70493 - RNA, 22 nt, Human
guuuugauauaugcauacauua

SEQ ID NO: 70494 - RNA, 22 nt, Human
guuuuguuuugagucaacucca

SEQ ID NO: 70495 - RNA, 22 nt, Human
guuuuuacagcagcaaaauacu

SEQ ID NO: 70496 - RNA, 22 nt, Human
guuuuuacuaagguugcuaagu

SEQ ID NO: 70497 - RNA, 19 nt, Human
guuuuuaguuucugaacug

SEQ ID NO: 70498 - RNA, 22 nt, Human
guuuuuauuguguaaauguggg

SEQ ID NO: 70499 - RNA, 19 nt, Human
guuuuucccagacgaggca

SEQ ID NO: 70500 - RNA, 22 nt, Human
guuuuucuaaguagcgauauuu

SEQ ID NO: 70501 - RNA, 22 nt, Human
guuuuucugugagcgguaaagg

SEQ ID NO: 70502 - RNA, 22 nt, Human
guuuuuguccauggaggcaaac

SEQ ID NO: 70503 - RNA, 22 nt, Human
guuuuuuggguguauaucuucu

SEQ ID NO: 70504 - RNA, 22 nt, Human
uaaaacacauaaacucucuauu

SEQ ID NO: 70505 - RNA, 22 nt, Human
uaaaaccauaaggcuggaagga

SEQ ID NO: 70506 - RNA, 22 nt, Human
uaaaacugcuugguauggucua

SEQ ID NO: 70507 - RNA, 22 nt, Human
uaaaacuuaacuauccagauua

SEQ ID NO: 70508 - RNA, 22 nt, Human
uaaaacuucucauuuuuauggu

SEQ ID NO: 70509 - RNA, 22 nt, Human
uaaaagacauauaacuguagga

SEQ ID NO: 70510 - RNA, 22 nt, Human
uaaaagagaauggauaacagag

SEQ ID NO: 70511 - RNA, 22 nt, Human
uagaggcagaagaaauugacaa

SEQ ID NO: 70512 - RNA, 22 nt, Human
uagaggccugaaagaaugauca

SEQ ID NO: 70513 - RNA, 22 nt, Human
uagaggcuacuagaggcaccug

SEQ ID NO: 70514 - RNA, 22 nt, Human
uagagguacuccccucaaaguu

SEQ ID NO: 70515 - RNA, 22 nt, Human
uagagguagcaacaggacuaga

SEQ ID NO: 70516 - RNA, 22 nt, Human
uagaggugacacugagaccaua

SEQ ID NO: 70517 - RNA, 22 nt, Human
uagaggugagacuucagugaca

SEQ ID NO: 70518 - RNA, 22 nt, Human
uagaggugagaggaacuuugga

SEQ ID NO: 70519 - RNA, 20 nt, Human
uagaggugggauuuggguuu

SEQ ID NO: 70520 - RNA, 22 nt, Human
uagagguguugacgccaaggua

SEQ ID NO: 70521 - RNA, 22 nt, Human
uagagucuaguguauacaaagu

SEQ ID NO: 70522 - RNA, 22 nt, Human
uagagugguuaacaguuuagaa

SEQ ID NO: 70523 - RNA, 22 nt, Human
uagauaaauuagaaaguuuacu

SEQ ID NO: 70524 - RNA, 20 nt, Human
uagauacccaaugcucauca

SEQ ID NO: 70525 - RNA, 22 nt, Human
uagauauaagguccuuagaaca

SEQ ID NO: 70526 - RNA, 22 nt, Human
uagauaucagaaauagaauuua

SEQ ID NO: 70527 - RNA, 22 nt, Human
uagaucaagaauguccacuugu

SEQ ID NO: 70528 - RNA, 22 nt, Human
uagaucaucagugggcucuuau

SEQ ID NO: 70529 - RNA, 22 nt, Human
uagaucauggaguaaaauggaa

SEQ ID NO: 70530 - RNA, 22 nt, Human
uagauccagcuguuauguuaug

SEQ ID NO: 70531 - RNA, 23 nt, Human
uagauccuauggcugugugcaga

SEQ ID NO: 70532 - RNA, 22 nt, Human
uagauccugagcccuaucuacu

SEQ ID NO: 70533 - RNA, 20 nt, Human
uagauccuggggauuuauug

SEQ ID NO: 70534 - RNA, 22 nt, Human
uagaugaagcaacauguguaau

SEQ ID NO: 70535 - RNA, 22 nt, Human
uagaugaagggguucagcaugg

SEQ ID NO: 70536 - RNA, 22 nt, Human
uagaugauagggccagaauuug

SEQ ID NO: 70537 - RNA, 22 nt, Human
uagaugcugaaacauggaggcg

SEQ ID NO: 70538 - RNA, 22 nt, Human
uagauggcuuucugagguauuu

SEQ ID NO: 70539 - RNA, 22 nt, Human
uagauguaucuucucuuaucgu

SEQ ID NO: 70540 - RNA, 22 nt, Human
uagaugugagcccaggcugcuu

SEQ ID NO: 70541 - RNA, 22 nt, Human
uagauguguugccuggaguugu

SEQ ID NO: 70542 - RNA, 20 nt, Human
uagauguuuccugucauaaa

SEQ ID NO: 70543 - RNA, 18 nt, Human
uagauuaaaauugaauuc

SEQ ID NO: 70544 - RNA, 22 nt, Human
uagauucaaguauucaguuugg

SEQ ID NO: 70545 - RNA, 22 nt, Human
uagauucagauauuuaggacaa

SEQ ID NO: 70546 - RNA, 22 nt, Human
uagauuccucuacaauaaauga

SEQ ID NO: 70547 - RNA, 22 nt, Human
uagauucucccaucaugagaug

SEQ ID NO: 70548 - RNA, 22 nt, Human
uagauucuguaaauaaucaagg

SEQ ID NO: 70549 - RNA, 22 nt, Human
uagauucuucuaggucuuuagc

SEQ ID NO: 70550 - RNA, 22 nt, Human
uagauucuugaaccagugccuc

SEQ ID NO: 70551 - RNA, 22 nt, Human
uagauuuguguuugggaugaga

SEQ ID NO: 70552 - RNA, 22 nt, Human
uagauuuuacuucugucauuac

SEQ ID NO: 70553 - RNA, 22 nt, Human
uagcaaaaaaacuggcaucucc

SEQ ID NO: 70554 - RNA, 22 nt, Human
uagcaaaagcucaacaggaagg

SEQ ID NO: 70555 - RNA, 22 nt, Human
uagcaaagaaccugauacccca

SEQ ID NO: 70556 - RNA, 22 nt, Human
uagcaaagaggagaccuaggca

SEQ ID NO: 70557 - RNA, 21 nt, Human
uagcaaagccagauguauauu

SEQ ID NO: 70558 - RNA, 22 nt, Human
uagcaaagcccuugcuguguaa

SEQ ID NO: 70559 - RNA, 21 nt, Human
uagcaaauggagaguaagaga

SEQ ID NO: 70560 - RNA, 22 nt, Human
uagcaacaagugacuaucuaua

SEQ ID NO: 70561 - RNA, 22 nt, Human
uagcaacagcaauagugguauu

SEQ ID NO: 70562 - RNA, 22 nt, Human
uagcaacugcucuauucuagga

SEQ ID NO: 70563 - RNA, 22 nt, Human
uagcaagaaaacacaagaauua

SEQ ID NO: 70564 - RNA, 22 nt, Human
uagcaagaagcugucacaggug

SEQ ID NO: 70565 - RNA, 22 nt, Human
uagcaagaagggagaugggguu

SEQ ID NO: 70566 - RNA, 22 nt, Human
uagcaagaaguagcucuggauu

SEQ ID NO: 70567 - RNA, 22 nt, Human
uagcaagagugggcuuuguggg

SEQ ID NO: 70568 - RNA, 22 nt, Human
uagcaagaugaugaauuauuca

SEQ ID NO: 70569 - RNA, 22 nt, Human
uagcaagaugucacuccaaguu

SEQ ID NO: 70570 - RNA, 22 nt, Human
uagcaaguaugauacuccauga

SEQ ID NO: 70571 - RNA, 22 nt, Human
uagcaaguguuggugaagaugu

SEQ ID NO: 70572 - RNA, 22 nt, Human
uagcaauguaagauguuaacac

SEQ ID NO: 70573 - RNA, 18 nt, Human
ugaauguuuucuggaccc

SEQ ID NO: 70574 - RNA, 19 nt, Human
ugaauuaaagauuaaaguc

SEQ ID NO: 70575 - RNA, 22 nt, Human
ugaauuaucuuguaauuuugaa

SEQ ID NO: 70576 - RNA, 22 nt, Human
ugaauucauccauuuaugcaag

SEQ ID NO: 70577 - RNA, 22 nt, Human
ugaauucccugcaggcauccuc

SEQ ID NO: 70578 - RNA, 22 nt, Human
ugaauucuggcccucucacuua

SEQ ID NO: 70579 - RNA, 22 nt, Human
ugaauucuuuuagaauucagug

SEQ ID NO: 70580 - RNA, 22 nt, Human
ugaauugagauaggaucagucu

SEQ ID NO: 70581 - RNA, 22 nt, Human
ugaauuuaagcacugauguuaa

SEQ ID NO: 70582 - RNA, 23 nt, Human
ugaauuuuggcauauucugaaau

SEQ ID NO: 70583 - RNA, 22 nt, Human
ugacaaacagggaguuugcuca

SEQ ID NO: 70584 - RNA, 22 nt, Human
ugacaaagaccuucaacaagau

SEQ ID NO: 70585 - RNA, 22 nt, Human
ugacaaauacaauaagaucugu

SEQ ID NO: 70586 - RNA, 22 nt, Human
ugacaaauauuugaagaggcug

SEQ ID NO: 70587 - RNA, 22 nt, Human
ugacaaauguuaauucagugga

SEQ ID NO: 70588 - RNA, 20 nt, Human
ugacaacaaaaugguaauuu

SEQ ID NO: 70589 - RNA, 21 nt, Human
ugacaacagaacugggcaagc

SEQ ID NO: 70590 - RNA, 20 nt, Human
ugacaacaugccuuuugcuu

SEQ ID NO: 70591 - RNA, 22 nt, Human
ugacaagagaccccuccgcagg

SEQ ID NO: 70592 - RNA, 22 nt, Human
ugacaagaggcagaaucagcug

SEQ ID NO: 70593 - RNA, 19 nt, Human
ugacaagauaauagccuug

SEQ ID NO: 70594 - RNA, 22 nt, Human
ugacaagaucacagucaagugu

SEQ ID NO: 70595 - RNA, 22 nt, Human
ugacaaguacauaauuucaugu

SEQ ID NO: 70596 - RNA, 23 nt, Human
ugacaagucucagccaaugcaga

SEQ ID NO: 70597 - RNA, 22 nt, Human
ugacaaugauuagguagcuucu

SEQ ID NO: 70598 - RNA, 22 nt, Human
ugacacaaaggaaagcauaauc

SEQ ID NO: 70599 - RNA, 22 nt, Human
ugacacacagggggauggaguu

SEQ ID NO: 70600 - RNA, 22 nt, Human
ugacacacugccaggcgcucgg

SEQ ID NO: 70601 - RNA, 22 nt, Human
ugacacagaaauuaagcuguca

SEQ ID NO: 70602 - RNA, 22 nt, Human
ugacacagggaaagcggaucca

SEQ ID NO: 70603 - RNA, 22 nt, Human
ugacacagggcaugcagcagaa

SEQ ID NO: 70604 - RNA, 22 nt, Human
ugacacaggggaaggagucugg

SEQ ID NO: 70605 - RNA, 22 nt, Human
ugacacaguagaaagaugauga

SEQ ID NO: 70606 - RNA, 22 nt, Human
ugacacauaccgaaaauauuug

SEQ ID NO: 70607 - RNA, 22 nt, Human
ugacacauuaaaugcucacaaa

SEQ ID NO: 70608 - RNA, 23 nt, Human
ugacacccucauugugugucgca

SEQ ID NO: 70609 - RNA, 22 nt, Human
ugacaccuugcuaaauggcacc

SEQ ID NO: 70610 - RNA, 22 nt, Human
ugacacuucugaaacggaaguu

SEQ ID NO: 70611 - RNA, 22 nt, Human
ugacacuugggcuuugagaggu

SEQ ID NO: 70612 - RNA, 22 nt, Human
ugacagacacaccuuaggaaag

SEQ ID NO: 70613 - RNA, 17 nt, Human
ugacagacaucaugagc

SEQ ID NO: 70614 - RNA, 22 nt, Human
ugacagagacagauugaagcuu

SEQ ID NO: 70615 - RNA, 22 nt, Human
ugacagagagaugggaaagggc

SEQ ID NO: 70616 - RNA, 22 nt, Human
ugacagagagguaaguuaugaa

SEQ ID NO: 70617 - RNA, 23 nt, Human
ugacagagcaagacuuggucuca

SEQ ID NO: 70618 - RNA, 22 nt, Human
ugacagagcaagaucuagauaa

SEQ ID NO: 70619 - RNA, 22 nt, Human
ugacagagcuggagaauaauuu

SEQ ID NO: 70620 - RNA, 22 nt, Human
augaugaaauuuucuaucaugu

SEQ ID NO: 70621 - RNA, 22 nt, Human
augauggaggccgugauggacg

SEQ ID NO: 70622 - RNA, 22 nt, Human
augaugguaaauucaguauccg

SEQ ID NO: 70623 - RNA, 22 nt, Human
augauggugagguugagcacag

SEQ ID NO: 70624 - RNA, 22 nt, Human
augauguaaggguaauugucua

SEQ ID NO: 70625 - RNA, 22 nt, Human
augauguacagaaaguuggcgg

SEQ ID NO: 70626 - RNA, 22 nt, Human
augauguaugacuguguucaaa

SEQ ID NO: 70627 - RNA, 22 nt, Human
augaugucaugaauauauuagu

SEQ ID NO: 70628 - RNA, 22 nt, Human
augaugucuaucuuuguaguau

SEQ ID NO: 70629 - RNA, 22 nt, Human
augauguugguuuaauuugagu

SEQ ID NO: 70630 - RNA, 17 nt, Human
augauuacaucuuuccu

SEQ ID NO: 70631 - RNA, 22 nt, Human
augauucagcaauuuuauaucu

SEQ ID NO: 70632 - RNA, 22 nt, Human
augauucagggaguuuucagga

SEQ ID NO: 70633 - RNA, 20 nt, Human
augauucaugaugaugucuc

SEQ ID NO: 70634 - RNA, 22 nt, Human
augauucuaaacuuaaggggga

SEQ ID NO: 70635 - RNA, 22 nt, Human
augauucuaggcauugaagaua

SEQ ID NO: 70636 - RNA, 22 nt, Human
augauucucauuuuauaaacuu

SEQ ID NO: 70637 - RNA, 21 nt, Human
augauucugcaaaugaguagu

SEQ ID NO: 70638 - RNA, 22 nt, Human
augauucuggggcaaaagcugg

SEQ ID NO: 70639 - RNA, 22 nt, Human
augauucuggugagaaugagga

SEQ ID NO: 70640 - RNA, 22 nt, Human
augauucuuuuggauagaugau

SEQ ID NO: 70641 - RNA, 22 nt, Human
augauugaccaucugcugggcu

SEQ ID NO: 70642 - RNA, 22 nt, Human
augauuuccaguuguugcuaag

SEQ ID NO: 70643 - RNA, 20 nt, Human
augauuuugcacuaacuuca

SEQ ID NO: 70644 - RNA, 22 nt, Human
augauuuuucagcagaggaucu

SEQ ID NO: 70645 - RNA, 22 nt, Human
augcaaaaacugcacuuacgcu

SEQ ID NO: 70646 - RNA, 22 nt, Human
augcaaaaguaauugcaauuuu

SEQ ID NO: 70647 - RNA, 22 nt, Human
augcaaacaugaagagaaagag

SEQ ID NO: 70648 - RNA, 22 nt, Human
augcaaagcacacacagaaucc

SEQ ID NO: 70649 - RNA, 23 nt, Human
augcaaagugcugucauguagac

SEQ ID NO: 70650 - RNA, 22 nt, Human
augcaaauauuaaugguaugac

SEQ ID NO: 70651 - RNA, 22 nt, Human
augcaaaucuuaaguaugugug

SEQ ID NO: 70652 - RNA, 22 nt, Human
augcaaaugaacauguugcuag

SEQ ID NO: 70653 - RNA, 22 nt, Human
augcaaauggcaaugagugacc

SEQ ID NO: 70654 - RNA, 19 nt, Human
augcaacaaaaguguaaga

SEQ ID NO: 70655 - RNA, 22 nt, Human
augcaacaaaugcuacgaaucg

SEQ ID NO: 70656 - RNA, 22 nt, Human
augcaacaauguauuuauguau

SEQ ID NO: 70657 - RNA, 22 nt, Human
augcaacagcugggaauaugua

SEQ ID NO: 70658 - RNA, 22 nt, Human
augcaacaggguugggaggcgg

SEQ ID NO: 70659 - RNA, 22 nt, Human
augcaacagucaguacauccgg

SEQ ID NO: 70660 - RNA, 22 nt, Human
augcaacaguucauaguuuuau

SEQ ID NO: 70661 - RNA, 23 nt, Human
augcaacauugccaguaugggca

SEQ ID NO: 70662 - RNA, 22 nt, Human
augcaacuacccccaggauuuu

SEQ ID NO: 70663 - RNA, 22 nt, Human
augcaagacauaaauaaucuuu

SEQ ID NO: 70664 - RNA, 22 nt, Human
augcaagacccagaaaucauua

SEQ ID NO: 70665 - RNA, 22 nt, Human
augcaagcaaucugagcuuugg

SEQ ID NO: 70666 - RNA, 22 nt, Human
augcaaggacauguaaugaugu

SEQ ID NO: 70667 - RNA, 22 nt, Human
augcaaggguugccuuuccagc

SEQ ID NO: 70668 - RNA, 22 nt, Human
augcaagucuuaauaguuuagg

SEQ ID NO: 70669 - RNA, 22 nt, Human
augcaauauagggaagauagau

SEQ ID NO: 70670 - RNA, 22 nt, Human
augcaaucauauggcauacagc

SEQ ID NO: 70671 - RNA, 22 nt, Human
augcaauguuccuuucuucacc

SEQ ID NO: 70672 - RNA, 22 nt, Human
augcacaagaggcuagaaaaga

SEQ ID NO: 70673 - RNA, 22 nt, Human
augcacaauuaggauauagcuu

SEQ ID NO: 70674 - RNA, 22 nt, Human
augcacacugaaugcuuacuuu

SEQ ID NO: 70675 - RNA, 22 nt, Human
augcacacugggauucaacugg

SEQ ID NO: 70676 - RNA, 22 nt, Human
augcacagaacaauuuuaagag

SEQ ID NO: 70677 - RNA, 22 nt, Human
augcacagacccaaaggccauc

SEQ ID NO: 70678 - RNA, 22 nt, Human
augcacaggaaguguccccauu

SEQ ID NO: 70679 - RNA, 22 nt, Human
augcacaggugcugaugcacgc

SEQ ID NO: 70680 - RNA, 22 nt, Human
augcacauacauaugcucuaua

SEQ ID NO: 70681 - RNA, 22 nt, Human
augcacauaggccaaaucauuu

SEQ ID NO: 70682 - RNA, 22 nt, Human
augcacaugaggcaagcaaaau

SEQ ID NO: 70683 - RNA, 22 nt, Human
augcaccacagauaucugcgua

SEQ ID NO: 70684 - RNA, 22 nt, Human
augcacuaugaugagcuagucu

SEQ ID NO: 70685 - RNA, 22 nt, Human
augcacuuucuagagauucuga

SEQ ID NO: 70686 - RNA, 22 nt, Human
augcacuuuguaaucuguucaa

SEQ ID NO: 70687 - RNA, 22 nt, Human
augggcugaggugggauagaag

SEQ ID NO: 70688 - RNA, 22 nt, Human
augggcugggaauacacagggg

SEQ ID NO: 70689 - RNA, 22 nt, Human
augggcugggaucugaguguca

SEQ ID NO: 70690 - RNA, 23 nt, Human
auggggcucaacacuuaguagcu

SEQ ID NO: 70691 - RNA, 22 nt, Human
auggggcucugcggcugcuccc

SEQ ID NO: 70692 - RNA, 22 nt, Human
augggggaaaguacgagcaugg

SEQ ID NO: 70693 - RNA, 22 nt, Human
auggggggaugaaggaguccaa

SEQ ID NO: 70694 - RNA, 22 nt, Human
auggggugcaugcagauuggga

SEQ ID NO: 70695 - RNA, 22 nt, Human
auggguaaagcaggaagagagu

SEQ ID NO: 70696 - RNA, 22 nt, Human
auggguaggauuuacucagaug

SEQ ID NO: 70697 - RNA, 22 nt, Human
augggucaguucaguggccaac

SEQ ID NO: 70698 - RNA, 22 nt, Human
auggguggagggugacacggau

SEQ ID NO: 70699 - RNA, 22 nt, Human
auggguuuauagguggacuuuu

SEQ ID NO: 70700 - RNA, 22 nt, Human
auggguuucccucugaaauuau

SEQ ID NO: 70701 - RNA, 22 nt, Human
augguaaacauuuaacaacuag

SEQ ID NO: 70702 - RNA, 22 nt, Human
augguacaaaauguauaaaguc

SEQ ID NO: 70703 - RNA, 22 nt, Human
augguacuggggucccggaguu

SEQ ID NO: 70704 - RNA, 21 nt, Human
augguagguggagcaggugau

SEQ ID NO: 70705 - RNA, 22 nt, Human
augguauuggaguaggacuugc

SEQ ID NO: 70706 - RNA, 22 nt, Human
auggucaagauccucuaguuua

SEQ ID NO: 70707 - RNA, 22 nt, Human
auggucaggcaaggagggcugg

SEQ ID NO: 70708 - RNA, 22 nt, Human
auggucugaaugugugcuccaa

SEQ ID NO: 70709 - RNA, 22 nt, Human
auggugaagcuucauggguguu

SEQ ID NO: 70710 - RNA, 22 nt, Human
augguguuuauaggcaaagauc

SEQ ID NO: 70711 - RNA, 20 nt, Human
augguucaggccagcugucu

SEQ ID NO: 70712 - RNA, 22 nt, Human
augguuuaaagaguaugacuuu

SEQ ID NO: 70713 - RNA, 22 nt, Human
augguuuacaauguuuucaguu

SEQ ID NO: 70714 - RNA, 22 nt, Human
augguuuauugcuuuaaugaaa

SEQ ID NO: 70715 - RNA, 22 nt, Human
augguuuguaacccaauacucc

SEQ ID NO: 70716 - RNA, 22 nt, Human
augguuuguguggcccagauga

SEQ ID NO: 70717 - RNA, 22 nt, Human
augguuuugaagggaggucaaa

SEQ ID NO: 70718 - RNA, 22 nt, Human
augguuuuguccucuuugguuc

SEQ ID NO: 70719 - RNA, 22 nt, Human
augguuuuucaaguauucagaa

SEQ ID NO: 70720 - RNA, 20 nt, Human
auguaaaauuauaaggcuga

SEQ ID NO: 70721 - RNA, 22 nt, Human
auguaaacaagguuauugucca

SEQ ID NO: 70722 - RNA, 22 nt, Human
auguaaacuacugacuacacua

SEQ ID NO: 70723 - RNA, 23 nt, Human
auguaaacuucagagucauugcc

SEQ ID NO: 70724 - RNA, 22 nt, Human
auguaaagggcaugguauuggg

SEQ ID NO: 70725 - RNA, 22 nt, Human
auguaaaguaucugaaaugcug

SEQ ID NO: 70726 - RNA, 22 nt, Human
auguaacugaaggaaaugcaug

SEQ ID NO: 70727 - RNA, 22 nt, Human
auguaacuguuauauuuuguug

SEQ ID NO: 70728 - RNA, 22 nt, Human
auguaacuucugugaaucugac

SEQ ID NO: 70729 - RNA, 17 nt, Human
cagcucuuccucccucu

SEQ ID NO: 70730 - RNA, 22 nt, Human
cagcucuuggagaaaccagagc

SEQ ID NO: 70731 - RNA, 22 nt, Human
cagcucuuuacucugcaaugau

SEQ ID NO: 70732 - RNA, 22 nt, Human
cagcucuuuauugccaauauuc

SEQ ID NO: 70733 - RNA, 22 nt, Human
cagcugaaccuuucccuggagc

SEQ ID NO: 70734 - RNA, 23 nt, Human
cagcugaagcagccugggcugga

SEQ ID NO: 70735 - RNA, 22 nt, Human
cagcugaagcccaggcagaacc

SEQ ID NO: 70736 - RNA, 22 nt, Human
cagcugaaucagugaguggaaa

SEQ ID NO: 70737 - RNA, 22 nt, Human
cagcugacccgugggaggcggg

SEQ ID NO: 70738 - RNA, 22 nt, Human
cagcugagaaauggggaaaggg

SEQ ID NO: 70739 - RNA, 22 nt, Human
cagcugagagacaaugagucau

SEQ ID NO: 70740 - RNA, 22 nt, Human
cagcugaguuuccaagucugcc

SEQ ID NO: 70741 - RNA, 22 nt, Human
cagcugcaggaacaaaaaugug

SEQ ID NO: 70742 - RNA, 22 nt, Human
cagcugcaggagaaacagaggc

SEQ ID NO: 70743 - RNA, 22 nt, Human
cagcugcaggagcugagcacuu

SEQ ID NO: 70744 - RNA, 22 nt, Human
cagcugcaggcugugcaggaag

SEQ ID NO: 70745 - RNA, 22 nt, Human
cagcugcagugggggaccacaa

SEQ ID NO: 70746 - RNA, 22 nt, Human
cagcugcauuaauuuuagugaa

SEQ ID NO: 70747 - RNA, 22 nt, Human
cagcugccaugacauguccugc

SEQ ID NO: 70748 - RNA, 22 nt, Human
cagcugccccuccagggcuggg

SEQ ID NO: 70749 - RNA, 19 nt, Human
cagcugccuuuucuuugca

SEQ ID NO: 70750 - RNA, 22 nt, Human
cagcugcucuucuggccuguca

SEQ ID NO: 70751 - RNA, 22 nt, Human
cagcugcuuucagcaggaggga

SEQ ID NO: 70752 - RNA, 22 nt, Human
cagcuggacugggauguagcga

SEQ ID NO: 70753 - RNA, 22 nt, Human
cagcuggaucugccucgagcca

SEQ ID NO: 70754 - RNA, 22 nt, Human
cagcuggcagaaccugcaucca

SEQ ID NO: 70755 - RNA, 22 nt, Human
cagcuggccugagcgguggcgg

SEQ ID NO: 70756 - RNA, 22 nt, Human
cagcuggcgacucuccucgaug

SEQ ID NO: 70757 - RNA, 22 nt, Human
cagcuggcugcaugaugccaaa

SEQ ID NO: 70758 - RNA, 22 nt, Human
cagcugguagguagcagauuug

SEQ ID NO: 70759 - RNA, 22 nt, Human
cagcuggucaacugaaugaaca

SEQ ID NO: 70760 - RNA, 22 nt, Human
cagcuggugaacuaguuuuuca

SEQ ID NO: 70761 - RNA, 22 nt, Human
cagcugguuuuagcacaguuag

SEQ ID NO: 70762 - RNA, 22 nt, Human
cagcugucacuucuaaguuuug

SEQ ID NO: 70763 - RNA, 22 nt, Human
cagcugucagccggugcaggcu

SEQ ID NO: 70764 - RNA, 22 nt, Human
cagcuguccuuccuggugggcg

SEQ ID NO: 70765 - RNA, 22 nt, Human
cagcugugagagugcauugaag

SEQ ID NO: 70766 - RNA, 22 nt, Human
cagcugugagcagccaguugcc

SEQ ID NO: 70767 - RNA, 22 nt, Human
cagcugugauuccugcugucca

SEQ ID NO: 70768 - RNA, 22 nt, Human
cagcugugcugauugcucagua

SEQ ID NO: 70769 - RNA, 22 nt, Human
cagcugugcuguauuaagcucu

SEQ ID NO: 70770 - RNA, 22 nt, Human
cagcuguggagauggggugcau

SEQ ID NO: 70771 - RNA, 22 nt, Human
cagcuguggcugccacugcucc

SEQ ID NO: 70772 - RNA, 22 nt, Human
cagcugugucuaauuauggcug

SEQ ID NO: 70773 - RNA, 22 nt, Human
cagcuguuacucugaguaaaug

SEQ ID NO: 70774 - RNA, 22 nt, Human
cagcuguuaugagguguacaug

SEQ ID NO: 70775 - RNA, 22 nt, Human
cagcuguuccuggaaggagacc

SEQ ID NO: 70776 - RNA, 22 nt, Human
cagcuguucuugggacagacag

SEQ ID NO: 70777 - RNA, 22 nt, Human
cagcuguugucucucacauauu

SEQ ID NO: 70778 - RNA, 22 nt, Human
cagcuguugugauuuccaggag

SEQ ID NO: 70779 - RNA, 20 nt, Human
cagcuucaaugucagcuuga

SEQ ID NO: 70780 - RNA, 22 nt, Human
cagcuucagggacagcuucuuu

SEQ ID NO: 70781 - RNA, 22 nt, Human
cagcuuccauaagagauggaga

SEQ ID NO: 70782 - RNA, 22 nt, Human
cagcuuccaucuccacugcccu

SEQ ID NO: 70783 - RNA, 22 nt, Human
cagcuuccccccgggcuugaga

SEQ ID NO: 70784 - RNA, 22 nt, Human
cagcuucuaccaucaggaaauu

SEQ ID NO: 70785 - RNA, 22 nt, Human
cagcuucuccagaugacccuca

SEQ ID NO: 70786 - RNA, 21 nt, Human
cagcuucugaagguguaggaa

SEQ ID NO: 70787 - RNA, 22 nt, Human
cagcuucugcucauggaggggu

SEQ ID NO: 70788 - RNA, 22 nt, Human
cagcuuguuaccgagggagggu

SEQ ID NO: 70789 - RNA, 20 nt, Human
cagcuuuagaucuuugauua

SEQ ID NO: 70790 - RNA, 22 nt, Human
cagcuuucuaccuuaggcagug

SEQ ID NO: 70791 - RNA, 22 nt, Human
cagcuuucugucucaugacuga

SEQ ID NO: 70792 - RNA, 22 nt, Human
cagcuuugagaguugcauuuua

SEQ ID NO: 70793 - RNA, 22 nt, Human
cagcuuugccaaguaaggucuu

SEQ ID NO: 70794 - RNA, 16 nt, Human
cagcuuugucuccucg

SEQ ID NO: 70795 - RNA, 22 nt, Human
cagcuuuguggccuugaccucg

SEQ ID NO: 70796 - RNA, 22 nt, Human
caggaaaaaugccaggagucag

SEQ ID NO: 70797 - RNA, 21 nt, Human
caggaaaagcggaagucuagc

SEQ ID NO: 70798 - RNA, 17 nt, Human
caggaaaauaugaguga

SEQ ID NO: 70799 - RNA, 22 nt, Human
caggaaaaucugcccacacaag

SEQ ID NO: 70800 - RNA, 22 nt, Human
caggaaaauggaaucaccugua

SEQ ID NO: 70801 - RNA, 22 nt, Human
caggaaacauaugugcuugagg

SEQ ID NO: 70802 - RNA, 22 nt, Human
caggaaacauucuugguaagga

SEQ ID NO: 70803 - RNA, 22 nt, Human
caggaaaccgcaucccaguggg

SEQ ID NO: 70804 - RNA, 20 nt, Human
augucugaaguaauccauuu

SEQ ID NO: 70805 - RNA, 22 nt, Human
augucugcguuauaucaauauc

SEQ ID NO: 70806 - RNA, 22 nt, Human
augucugguggucgaugcuaca

SEQ ID NO: 70807 - RNA, 22 nt, Human
augucuguccccuagcccugau

SEQ ID NO: 70808 - RNA, 22 nt, Human
augucugucuauagccaugaga

SEQ ID NO: 70809 - RNA, 18 nt, Human
augucugugcacuggaua

SEQ ID NO: 70810 - RNA, 22 nt, Human
augucuguggcauuauauguuu

SEQ ID NO: 70811 - RNA, 21 nt, Human
augucuguucugauuggugcg

SEQ ID NO: 70812 - RNA, 22 nt, Human
augucuguuuauccuucaagau

SEQ ID NO: 70813 - RNA, 22 nt, Human
augucuucauagcuuauaucca

SEQ ID NO: 70814 - RNA, 22 nt, Human
augucuucuaagcucuaagcug

SEQ ID NO: 70815 - RNA, 22 nt, Human
augucuucuguggagacaggua

SEQ ID NO: 70816 - RNA, 22 nt, Human
augucuugauauuuuacuguuu

SEQ ID NO: 70817 - RNA, 21 nt, Human
augugaaaccuuccacgcuga

SEQ ID NO: 70818 - RNA, 20 nt, Human
augugaaagaucaguugucu

SEQ ID NO: 70819 - RNA, 20 nt, Human
augugaaguaggaagggugu

SEQ ID NO: 70820 - RNA, 22 nt, Human
augugacuccaggcaguuuugu

SEQ ID NO: 70821 - RNA, 18 nt, Human
augugagagaaucuucuu

SEQ ID NO: 70822 - RNA, 22 nt, Human
augugagcagggagaugcugcc

SEQ ID NO: 70823 - RNA, 22 nt, Human
augugagcaggugcuggcugcu

SEQ ID NO: 70824 - RNA, 22 nt, Human
augugaggcagcacggagauua

SEQ ID NO: 70825 - RNA, 22 nt, Human
augugcaaagggacuugcacau

SEQ ID NO: 70826 - RNA, 22 nt, Human
augugcaauggugucaccacau

SEQ ID NO: 70827 - RNA, 23 nt, Human
augugcacaucuccuuguccacc

SEQ ID NO: 70828 - RNA, 22 nt, Human
augugcagaggcuuccuugacu

SEQ ID NO: 70829 - RNA, 21 nt, Human
augugcagcaagcagcaugcu

SEQ ID NO: 70830 - RNA, 22 nt, Human
augugcaguugguggccaggag

SEQ ID NO: 70831 - RNA, 22 nt, Human
augugcauaaacauauuguugg

SEQ ID NO: 70832 - RNA, 22 nt, Human
augugcaugugcacacaugcgu

SEQ ID NO: 70833 - RNA, 22 nt, Human
augugcucuuauuacccugucg

SEQ ID NO: 70834 - RNA, 22 nt, Human
augugcuugagggaaaucaguu

SEQ ID NO: 70835 - RNA, 22 nt, Human
augugcuuggacauucuaggaa

SEQ ID NO: 70836 - RNA, 22 nt, Human
augugcuuuccaaugcuguagg

SEQ ID NO: 70837 - RNA, 22 nt, Human
auguggaaugaacaaaggaggc

SEQ ID NO: 70838 - RNA, 21 nt, Human
cagggcuagagagaaugacaa

SEQ ID NO: 70839 - RNA, 22 nt, Human
cagggcuagggagcccuccugg

SEQ ID NO: 70840 - RNA, 22 nt, Human
cagggcucagaagacagaccuc

SEQ ID NO: 70841 - RNA, 22 nt, Human
cagggcucaggaaaucagacgu

SEQ ID NO: 70842 - RNA, 22 nt, Human
cagggcucccugcagccucugu

SEQ ID NO: 70843 - RNA, 22 nt, Human
cagggcucugccuugagggaug

SEQ ID NO: 70844 - RNA, 20 nt, Human
cagggcucugggccuggccu

SEQ ID NO: 70845 - RNA, 22 nt, Human
cagggcugagaauuuagagaca

SEQ ID NO: 70846 - RNA, 22 nt, Human
cagggcuggcucaugaaaaguu

SEQ ID NO: 70847 - RNA, 22 nt, Human
cagggcuggcuguggcaaucuc

SEQ ID NO: 70848 - RNA, 22 nt, Human
cagggcuggguuaaaagcaggg

SEQ ID NO: 70849 - RNA, 23 nt, Human
cagggcugguagggaagagcgug

SEQ ID NO: 70850 - RNA, 22 nt, Human
cagggcuguggaaaacuggugc

SEQ ID NO: 70851 - RNA, 22 nt, Human
cagggcuguggcuuugugcugu

SEQ ID NO: 70852 - RNA, 22 nt, Human
cagggcuucgcuccuggugcac

SEQ ID NO: 70853 - RNA, 22 nt, Human
cagggcuucuuggcauuugcug

SEQ ID NO: 70854 - RNA, 22 nt, Human
cagggcuugccuugccccggcg

SEQ ID NO: 70855 - RNA, 22 nt, Human
cagggcuuuguaauaugagcac

SEQ ID NO: 70856 - RNA, 22 nt, Human
cagggcuuuuuauuagcugccu

SEQ ID NO: 70857 - RNA, 22 nt, Human
caggggacacuccugcuugggc

SEQ ID NO: 70858 - RNA, 22 nt, Human
caggggcgguggcucacgccug

SEQ ID NO: 70859 - RNA, 22 nt, Human
caggggcuagcacuuaauguuu

SEQ ID NO: 70860 - RNA, 22 nt, Human
cagggggcagcguagaaaauga

SEQ ID NO: 70861 - RNA, 22 nt, Human
caggggggcaggagucauugau

SEQ ID NO: 70862 - RNA, 22 nt, Human
caggguacagaguuuucuaaac

SEQ ID NO: 70863 - RNA, 22 nt, Human
cagggucaccagagaucugcau

SEQ ID NO: 70864 - RNA, 22 nt, Human
cagggucaggaggaucuggcuu

SEQ ID NO: 70865 - RNA, 22 nt, Human
cagggucaggcugcuagaagcu

SEQ ID NO: 70866 - RNA, 22 nt, Human
caggguccaucuuucaucacug

SEQ ID NO: 70867 - RNA, 22 nt, Human
cagggugacaaguggcaaggag

SEQ ID NO: 70868 - RNA, 22 nt, Human
cagggugagccucuggagcccu

SEQ ID NO: 70869 - RNA, 22 nt, Human
cagggugcauacccaugcauac

SEQ ID NO: 70870 - RNA, 22 nt, Human
cagggugccucccgcucgccgg

SEQ ID NO: 70871 - RNA, 22 nt, Human
caggguggaagcuguagagugg

SEQ ID NO: 70872 - RNA, 22 nt, Human
caggguggaauggaaugcuggc

SEQ ID NO: 70873 - RNA, 22 nt, Human
caggguggcaggcaccauggcc

SEQ ID NO: 70874 - RNA, 22 nt, Human
caggguggccagguagauaaua

SEQ ID NO: 70875 - RNA, 22 nt, Human
cagggugguaccagcaucuagu

SEQ ID NO: 70876 - RNA, 22 nt, Human
caggguggugaauagcuauagu

SEQ ID NO: 70877 - RNA, 22 nt, Human
cagggugugaacaguguaaaac

SEQ ID NO: 70878 - RNA, 22 nt, Human
caggguucuggaauauaaugug

SEQ ID NO: 70879 - RNA, 22 nt, Human
caggguuucuguugagaagucc

SEQ ID NO: 70880 - RNA, 22 nt, Human
cagguaaaaauaaauuugugag

SEQ ID NO: 70881 - RNA, 19 nt, Human
cagguaacauaugcacaaa

SEQ ID NO: 70882 - RNA, 22 nt, Human
cagguaacaugauaaaacuuac

SEQ ID NO: 70883 - RNA, 22 nt, Human
cagguaagaccguuuaggcagu

SEQ ID NO: 70884 - RNA, 22 nt, Human
cagguacacucccuugugcuga

SEQ ID NO: 70885 - RNA, 22 nt, Human
cagguacauucguagacccauu

SEQ ID NO: 70886 - RNA, 22 nt, Human
cagguaggaaaagggugucagg

SEQ ID NO: 70887 - RNA, 22 nt, Human
cagguaggaggcucccuagucc

SEQ ID NO: 70888 - RNA, 22 nt, Human
cagguaggcagccggucucugg

SEQ ID NO: 70889 - RNA, 22 nt, Human
cagguaggggagagcuccaaca

SEQ ID NO: 70890 - RNA, 22 nt, Human
cagguaugaggacacugacagc

SEQ ID NO: 70891 - RNA, 22 nt, Human
cagguauucauagaauucagag

SEQ ID NO: 70892 - RNA, 17 nt, Human
cagguauuuaggcauug

SEQ ID NO: 70893 - RNA, 22 nt, Human
caggucagaggcgcagccccca

SEQ ID NO: 70894 - RNA, 22 nt, Human
caggucagagucccccuguccu

SEQ ID NO: 70895 - RNA, 22 nt, Human
caggucagcacuuggaggugca

SEQ ID NO: 70896 - RNA, 22 nt, Human
cagguccaccaugccucaagcc

SEQ ID NO: 70897 - RNA, 22 nt, Human
cagguccagaaaccaaaggauu

SEQ ID NO: 70898 - RNA, 22 nt, Human
cagguccccuccccuaccaggc

SEQ ID NO: 70899 - RNA, 22 nt, Human
cagguccuuuaguguccagaac

SEQ ID NO: 70900 - RNA, 22 nt, Human
caggucgccagcaggaacguca

SEQ ID NO: 70901 - RNA, 22 nt, Human
caggucucucccaagcuacaau

SEQ ID NO: 70902 - RNA, 22 nt, Human
caggucuggcaucagcugugug

SEQ ID NO: 70903 - RNA, 20 nt, Human
caggucuucauguggcuguc

SEQ ID NO: 70904 - RNA, 22 nt, Human
caggucuucuucagcacuugga

SEQ ID NO: 70905 - RNA, 19 nt, Human
caggucuucuuggaggacu

SEQ ID NO: 70906 - RNA, 22 nt, Human
caggucuuuguugcagcaugga

SEQ ID NO: 70907 - RNA, 22 nt, Human
caggugaacccagucuaaucau

SEQ ID NO: 70908 - RNA, 22 nt, Human
caggugaccuauggucacuaca

SEQ ID NO: 70909 - RNA, 20 nt, Human
caggugagcagaucugggug

SEQ ID NO: 70910 - RNA, 22 nt, Human
caggugagcucuaucuagggag

SEQ ID NO: 70911 - RNA, 22 nt, Human
caggugaggcugaacagaugaa

SEQ ID NO: 70912 - RNA, 22 nt, Human
caggugaguaacaaugggugau

SEQ ID NO: 70913 - RNA, 22 nt, Human
caggugcagcuggauggaagcc

SEQ ID NO: 70914 - RNA, 22 nt, Human
caggugcccagcuccugcugug

SEQ ID NO: 70915 - RNA, 22 nt, Human
caggugcuguccugcacauguc

SEQ ID NO: 70916 - RNA, 22 nt, Human
caggugcugugaaucuucauaa

SEQ ID NO: 70917 - RNA, 22 nt, Human
cagguggagcugacugagggca

SEQ ID NO: 70918 - RNA, 22 nt, Human
cagguggaucucuaaggacuga

SEQ ID NO: 70919 - RNA, 22 nt, Human
cagguggcauugucccgccagc

SEQ ID NO: 70920 - RNA, 22 nt, Human
cagguggccaguacucaaggau

SEQ ID NO: 70921 - RNA, 22 nt, Human
cagguggcuaacggccucauag

SEQ ID NO: 70922 - RNA, 23 nt, Human
cagguggcuccacgagggguggg

SEQ ID NO: 70923 - RNA, 22 nt, Human
cagguggcuucucccuaggcca

SEQ ID NO: 70924 - RNA, 22 nt, Human
caggugggagcggagacugauu

SEQ ID NO: 70925 - RNA, 22 nt, Human
caggugggauuuugcugcuuga

SEQ ID NO: 70926 - RNA, 22 nt, Human
caggugggccgggguuuguucu

SEQ ID NO: 70927 - RNA, 22 nt, Human
caggugggcguggcgagaaggc

SEQ ID NO: 70928 - RNA, 22 nt, Human
cagguggggcagcugugggagc

SEQ ID NO: 70929 - RNA, 22 nt, Human
cagguggguacaucacagagac

SEQ ID NO: 70930 - RNA, 19 nt, Human
caggugguaaucugagccu

SEQ ID NO: 70931 - RNA, 22 nt, Human
cagguggugccuccucccuucc

SEQ ID NO: 70932 - RNA, 22 nt, Human
caggugguuaugaggaagguga

SEQ ID NO: 70933 - RNA, 20 nt, Human
cagguguacagugagcugag

SEQ ID NO: 70934 - RNA, 22 nt, Human
caggugucaaaauacuaagugg

SEQ ID NO: 70935 - RNA, 16 nt, Human
caggugucagucaccu

SEQ ID NO: 70936 - RNA, 22 nt, Human
caggugugccgggagcaguuug

SEQ ID NO: 70937 - RNA, 22 nt, Human
cagguguugauacuaaucgugg

SEQ ID NO: 70938 - RNA, 22 nt, Human
cagguguuggaagggcaguggg

SEQ ID NO: 70939 - RNA, 22 nt, Human
auuacuccuuuucuagcaggug

SEQ ID NO: 70940 - RNA, 22 nt, Human
auuacuuucagaugugcuguaa

SEQ ID NO: 70941 - RNA, 22 nt, Human
auuagaaaaucuggaggugggg

SEQ ID NO: 70942 - RNA, 22 nt, Human
auuagaacuaggcuaaguaaaa

SEQ ID NO: 70943 - RNA, 22 nt, Human
auuagaagaggcugacgaaugu

SEQ ID NO: 70944 - RNA, 22 nt, Human
auuagaagcgugaauccuuuca

SEQ ID NO: 70945 - RNA, 22 nt, Human
auuagagauuaugaauuccuag

SEQ ID NO: 70946 - RNA, 20 nt, Human
auuagagcuacauggcuaca

SEQ ID NO: 70947 - RNA, 22 nt, Human
cagugcugagagccuggccagg

SEQ ID NO: 70948 - RNA, 17 nt, Human
cagugcuucugcuucuu

SEQ ID NO: 70949 - RNA, 22 nt, Human
cagugcuuggggagcggagaga

SEQ ID NO: 70950 - RNA, 22 nt, Human
cagugcuuugggaggcugagga

SEQ ID NO: 70951 - RNA, 22 nt, Human
cagugcuuuucaaaguucuaug

SEQ ID NO: 70952 - RNA, 22 nt, Human
caguggagagacuuuuacucuu

SEQ ID NO: 70953 - RNA, 22 nt, Human
caguggaggcucaagugugcuu

SEQ ID NO: 70954 - RNA, 22 nt, Human
caguggcaagaacaguaauaau

SEQ ID NO: 70955 - RNA, 22 nt, Human
caguggcaaguccgguauugaa

SEQ ID NO: 70956 - RNA, 22 nt, Human
caguggcagagccguugccauc

SEQ ID NO: 70957 - RNA, 22 nt, Human
caguggccaacuuccugccucu

SEQ ID NO: 70958 - RNA, 22 nt, Human
caguggccaugguggcaggggu

SEQ ID NO: 70959 - RNA, 22 nt, Human
caguggccuugaugccucauuc

SEQ ID NO: 70960 - RNA, 22 nt, Human
caguggcucaugccuauaaucc

SEQ ID NO: 70961 - RNA, 22 nt, Human
caguggcuuaaauaagauuagg

SEQ ID NO: 70962 - RNA, 22 nt, Human
cagugggaaagugaagagcauu

SEQ ID NO: 70963 - RNA, 22 nt, Human
cagugggaagaaugcagccucc

SEQ ID NO: 70964 - RNA, 22 nt, Human
cagugggaagggcagaggcuuu

SEQ ID NO: 70965 - RNA, 22 nt, Human
cagugggaaugaaguggaggcc

SEQ ID NO: 70966 - RNA, 22 nt, Human
cagugggagcaaauacacucau

SEQ ID NO: 70967 - RNA, 22 nt, Human
cagugggcugugauggauucac

SEQ ID NO: 70968 - RNA, 22 nt, Human
caguggggggacugaggccuga

SEQ ID NO: 70969 - RNA, 22 nt, Human
cagugggggggccaugcugcag

SEQ ID NO: 70970 - RNA, 22 nt, Human
cagugggggugaggccgaggua

SEQ ID NO: 70971 - RNA, 22 nt, Human
caguggguaguggggauuagca

SEQ ID NO: 70972 - RNA, 22 nt, Human
caguggguccugcgucugccag

SEQ ID NO: 70973 - RNA, 22 nt, Human
cagugggugaaagauggcuaag

SEQ ID NO: 70974 - RNA, 22 nt, Human
cagugguauuugagagaaugga

SEQ ID NO: 70975 - RNA, 23 nt, Human
caguggucagaacgugggagggu

SEQ ID NO: 70976 - RNA, 22 nt, Human
caguggucccugagguugcugg

SEQ ID NO: 70977 - RNA, 22 nt, Human
cagugguuccuguucuucuggg

SEQ ID NO: 70978 - RNA, 22 nt, Human
cagugguugguagauacuugag

SEQ ID NO: 70979 - RNA, 21 nt, Human
cagugguuuauaaacaacaga

SEQ ID NO: 70980 - RNA, 22 nt, Human
cagugguuucugaacagugugc

SEQ ID NO: 70981 - RNA, 22 nt, Human
cagugguuuuauaucuaagcuu

SEQ ID NO: 70982 - RNA, 22 nt, Human
caguguaucauuagugugauga

SEQ ID NO: 70983 - RNA, 22 nt, Human
cagugucaggaucaguauauuu

SEQ ID NO: 70984 - RNA, 22 nt, Human
cagugucugaaauaacaccgga

SEQ ID NO: 70985 - RNA, 22 nt, Human
cagugucugguuggcucuacgu

SEQ ID NO: 70986 - RNA, 18 nt, Human
cagugucuugguaaaaua

SEQ ID NO: 70987 - RNA, 23 nt, Human
cagugugacgaggugaggcaggc

SEQ ID NO: 70988 - RNA, 22 nt, Human
caguguggagggagagagccug

SEQ ID NO: 70989 - RNA, 22 nt, Human
cagugugggugaaauacaaagu

SEQ ID NO: 70990 - RNA, 22 nt, Human
cagugugucucuuguccuggcu

SEQ ID NO: 70991 - RNA, 22 nt, Human
caguguuccaggcggcagugaa

SEQ ID NO: 70992 - RNA, 22 nt, Human
caguguuuccgucaguauguga

SEQ ID NO: 70993 - RNA, 22 nt, Human
caguguuuguauagaauaugca

SEQ ID NO: 70994 - RNA, 22 nt, Human
caguuaaaagguaugcuaccaa

SEQ ID NO: 70995 - RNA, 22 nt, Human
caguuaaacagauugaguguua

SEQ ID NO: 70996 - RNA, 22 nt, Human
caguuaaagugcuuaucacaga

SEQ ID NO: 70997 - RNA, 22 nt, Human
caguuaaaugaugugcccuaga

SEQ ID NO: 70998 - RNA, 22 nt, Human
caguuaaauuuggcuguuuucu

SEQ ID NO: 70999 - RNA, 22 nt, Human
caguuaauguccuauacaauag

SEQ ID NO: 71000 - RNA, 22 nt, Human
caguuaaugugggccaaguucu

SEQ ID NO: 71001 - RNA, 22 nt, Human
caguuacauauuuaguagguua

SEQ ID NO: 71002 - RNA, 22 nt, Human
caguuacaugcucaugucauca

SEQ ID NO: 71003 - RNA, 22 nt, Human
caguuacuguaugucaaagacu

SEQ ID NO: 71004 - RNA, 22 nt, Human
caguuauaggagccauuguaua

SEQ ID NO: 71005 - RNA, 22 nt, Human
caguucacacugugcuaucugc

SEQ ID NO: 71006 - RNA, 22 nt, Human
caguucauccccauguuuucaa

SEQ ID NO: 71007 - RNA, 22 nt, Human
caguuccaucuucaucuuuccc

SEQ ID NO: 71008 - RNA, 23 nt, Human
caguucccacugucugucacaag

SEQ ID NO: 71009 - RNA, 22 nt, Human
caguucccuaauguguagaaga

SEQ ID NO: 71010 - RNA, 22 nt, Human
caguuccucaaagguuaaaugu

SEQ ID NO: 71011 - RNA, 22 nt, Human
caguucuacuuggaugucugca

SEQ ID NO: 71012 - RNA, 21 nt, Human
caguucucuuagauuuccagu

SEQ ID NO: 71013 - RNA, 22 nt, Human
caguucucuuuccacuggaggc

SEQ ID NO: 71014 - RNA, 22 nt, Human
caguucuggaggauagaagucu

SEQ ID NO: 71015 - RNA, 22 nt, Human
caguugaauggucagacaaggc

SEQ ID NO: 71016 - RNA, 22 nt, Human
caguugaugggacucauguggg

SEQ ID NO: 71017 - RNA, 22 nt, Human
caguugauguuuagacucugca

SEQ ID NO: 71018 - RNA, 22 nt, Human
caguugcacuagccacauuuca

SEQ ID NO: 71019 - RNA, 22 nt, Human
caguugcagaggcagagugcua

SEQ ID NO: 71020 - RNA, 22 nt, Human
caguugcuacaguucaagugug

SEQ ID NO: 71021 - RNA, 22 nt, Human
caguuggaggaaugaggcugua

SEQ ID NO: 71022 - RNA, 23 nt, Human
caguuggagguacagagacacug

SEQ ID NO: 71023 - RNA, 22 nt, Human
caguuguccccaaaauauacgg

SEQ ID NO: 71024 - RNA, 22 nt, Human
caguuuaaagaaggaugggagu

SEQ ID NO: 71025 - RNA, 21 nt, Human
caguuuaauaacaaagaagga

SEQ ID NO: 71026 - RNA, 20 nt, Human
caguuuacaacauaaauugu

SEQ ID NO: 71027 - RNA, 22 nt, Human
caguuuagaagaaucaugaaca

SEQ ID NO: 71028 - RNA, 22 nt, Human
caguuuagcauuuaccgugaug

SEQ ID NO: 71029 - RNA, 22 nt, Human
caguuuaggagagacgcguucu

SEQ ID NO: 71030 - RNA, 22 nt, Human
caguuuaguaggugauaucaau

SEQ ID NO: 71031 - RNA, 22 nt, Human
caguuuaguguugcauuuggag

SEQ ID NO: 71032 - RNA, 22 nt, Human
caguuuauauauaagcacauug

SEQ ID NO: 71033 - RNA, 22 nt, Human
caguuuauuuccaagaugacaa

SEQ ID NO: 71034 - RNA, 22 nt, Human
caguuucccugcuugaaaacgu

SEQ ID NO: 71035 - RNA, 22 nt, Human
caguuucuacgacuuaagcaca

SEQ ID NO: 71036 - RNA, 22 nt, Human
caguuucuauggcugggcucug

SEQ ID NO: 71037 - RNA, 22 nt, Human
caguuucucagacuucccuugu

SEQ ID NO: 71038 - RNA, 22 nt, Human
caguuucugagguuccagguuu

SEQ ID NO: 71039 - RNA, 22 nt, Human
caguuucugccaggauguguua

SEQ ID NO: 71040 - RNA, 22 nt, Human
caguuucugucuguucuuaucc

SEQ ID NO: 71041 - RNA, 22 nt, Human
caguuucuuaucuucaaaauug

SEQ ID NO: 71042 - RNA, 22 nt, Human
caguuucuucaauucagacacu

SEQ ID NO: 71043 - RNA, 22 nt, Human
caguuucuucaucaguuaagca

SEQ ID NO: 71044 - RNA, 17 nt, Human
caguuucuucccccucu

SEQ ID NO: 71045 - RNA, 22 nt, Human
caguuugcauaacaagagauuc

SEQ ID NO: 71046 - RNA, 16 nt, Human
caguuuuaaggcccaa

SEQ ID NO: 71047 - RNA, 22 nt, Human
caguuuucuaugguagaagcau

SEQ ID NO: 71048 - RNA, 22 nt, Human
caguuuuuagauuaguuggugg

SEQ ID NO: 71049 - RNA, 18 nt, Human
caguuuuuauaucuggca

SEQ ID NO: 71050 - RNA, 17 nt, Human
cauaaaacaguucuauu

SEQ ID NO: 71051 - RNA, 22 nt, Human
cauaaacucucuguaccaauau

SEQ ID NO: 71052 - RNA, 22 nt, Human
cauaaacucuugagauucuugu

SEQ ID NO: 71053 - RNA, 22 nt, Human
cauaaaguagcagagcaugacu

SEQ ID NO: 71054 - RNA, 22 nt, Human
cauaaaguauagaucugugggu

SEQ ID NO: 71055 - RNA, 22 nt, Human
cauaacauccuugcuacuuuga

SEQ ID NO: 71056 - RNA, 22 nt, Human
auugauucucauaggaccaucu

SEQ ID NO: 71057 - RNA, 22 nt, Human
auugauuugaacaaagauauua

SEQ ID NO: 71058 - RNA, 22 nt, Human
auugcaaagcauugugagcgca

SEQ ID NO: 71059 - RNA, 22 nt, Human
auugcaaaugagucuuaauaua

SEQ ID NO: 71060 - RNA, 22 nt, Human
auugcacaaagagggaaacuga

SEQ ID NO: 71061 - RNA, 18 nt, Human
auugcacaccagccuggg

SEQ ID NO: 71062 - RNA, 22 nt, Human
auugagaauaugauuuaguaua

SEQ ID NO: 71063 - RNA, 22 nt, Human
auugagaauauugugacagugu

SEQ ID NO: 71064 - RNA, 23 nt, Human
auugagcuaguaauauagaccag

SEQ ID NO: 71065 - RNA, 22 nt, Human
auugagcuguuuuguaggauaa

SEQ ID NO: 71066 - RNA, 22 nt, Human
auugaguacuuagugucauaua

SEQ ID NO: 71067 - RNA, 22 nt, Human
auugauuucugcuuacucacug

SEQ ID NO: 71068 - RNA, 22 nt, Human
auugcaaaauuguccuguggaa

SEQ ID NO: 71069 - RNA, 22 nt, Human
auugcaaagaaauacaugcuua

SEQ ID NO: 71070 - RNA, 22 nt, Human
auugcaaaggucccauucaaga

SEQ ID NO: 71071 - RNA, 22 nt, Human
auugcacuuuccccugugagaa

SEQ ID NO: 71072 - RNA, 22 nt, Human
auugcagaacaugaggucuucu

SEQ ID NO: 71073 - RNA, 22 nt, Human
auugcaggccaguguccugggc

SEQ ID NO: 71074 - RNA, 22 nt, Human
auugcagggaggcagguagaug

SEQ ID NO: 71075 - RNA, 22 nt, Human
auugcaguguugccuggggccu

SEQ ID NO: 71076 - RNA, 22 nt, Human
auugcauaugcagcacaucagg

SEQ ID NO: 71077 - RNA, 22 nt, Human
auugcauuugucauuguugagg

SEQ ID NO: 71078 - RNA, 22 nt, Human
auugcccuagggcuaagcagga

SEQ ID NO: 71079 - RNA, 22 nt, Human
auugcuaaugugcgaaugugua

SEQ ID NO: 71080 - RNA, 22 nt, Human
auugcugggaauauuuagccca

SEQ ID NO: 71081 - RNA, 22 nt, Human
auugcuguaaauuaucuuauua

SEQ ID NO: 71082 - RNA, 22 nt, Human
auugcuuacuaaucaucuucag

SEQ ID NO: 71083 - RNA, 22 nt, Human
auugcuucauguccuuugccgg

SEQ ID NO: 71084 - RNA, 22 nt, Human
auugcuucccacaaagauguau

SEQ ID NO: 71085 - RNA, 22 nt, Human
auuggaaguauuucaucaaaag

SEQ ID NO: 71086 - RNA, 22 nt, Human
auuggagacagaugggcuccag

SEQ ID NO: 71087 - RNA, 22 nt, Human
auuggagccccagaagcaaggu

SEQ ID NO: 71088 - RNA, 22 nt, Human
auuggauagacauaagaaaaau

SEQ ID NO: 71089 - RNA, 22 nt, Human
auuggcaaggcugcggugucug

SEQ ID NO: 71090 - RNA, 22 nt, Human
auuggcagaaacagcagggcca

SEQ ID NO: 71091 - RNA, 22 nt, Human
auuggcaguuggcugugguuca

SEQ ID NO: 71092 - RNA, 22 nt, Human
auuggccagacuuauccuucag

SEQ ID NO: 71093 - RNA, 22 nt, Human
auuggcuccuucuaacaugucu

SEQ ID NO: 71094 - RNA, 22 nt, Human
auuggcuuccuucuuauuguca

SEQ ID NO: 71095 - RNA, 22 nt, Human
auuggggagagcuaauauuuua

SEQ ID NO: 71096 - RNA, 22 nt, Human
auuggucaccucccucagcucu

SEQ ID NO: 71097 - RNA, 22 nt, Human
auuggucuggggaaaugaagag

SEQ ID NO: 71098 - RNA, 22 nt, Human
auuggucugugagcuguugaca

SEQ ID NO: 71099 - RNA, 22 nt, Human
auuggugcaauagucaggagcu

SEQ ID NO: 71100 - RNA, 22 nt, Human
auuguaaaaguauucuaagauu

SEQ ID NO: 71101 - RNA, 22 nt, Human
auuguaaauagugccacaauaa

SEQ ID NO: 71102 - RNA, 22 nt, Human
auuguaacaacaauaguuuagg

SEQ ID NO: 71103 - RNA, 22 nt, Human
auuguaaguagaaauguuaugg

SEQ ID NO: 71104 - RNA, 22 nt, Human
auuguaauuuuagagaaagugg

SEQ ID NO: 71105 - RNA, 22 nt, Human
auuguacaacugaggguggaau

SEQ ID NO: 71106 - RNA, 22 nt, Human
auuguacaaugccuggaacauu

SEQ ID NO: 71107 - RNA, 22 nt, Human
auuguacacuaguggcagcagu

SEQ ID NO: 71108 - RNA, 22 nt, Human
auuguacaugcagugagucauc

SEQ ID NO: 71109 - RNA, 19 nt, Human
auuguacauugaguuuggc

SEQ ID NO: 71110 - RNA, 22 nt, Human
auuguacuagaaauuguauuca

SEQ ID NO: 71111 - RNA, 20 nt, Human
auuguacuucuguugauggu

SEQ ID NO: 71112 - RNA, 22 nt, Human
auuguacuuuuauuacauguag

SEQ ID NO: 71113 - RNA, 22 nt, Human
auuguagcaauuucucuuaauu

SEQ ID NO: 71114 - RNA, 22 nt, Human
auuguagcccaugcauaaaccg

SEQ ID NO: 71115 - RNA, 22 nt, Human
auuguauuagcacaauacaauu

SEQ ID NO: 71116 - RNA, 22 nt, Human
auuguauuuguacaagacaugu

SEQ ID NO: 71117 - RNA, 22 nt, Human
auugucacuuaaaagugcaugu

SEQ ID NO: 71118 - RNA, 22 nt, Human
auugucagaguuugagaaagua

SEQ ID NO: 71119 - RNA, 22 nt, Human
auugucaucgauguuagccagu

SEQ ID NO: 71120 - RNA, 22 nt, Human
auugucgcuuauuuaggugcuu

SEQ ID NO: 71121 - RNA, 22 nt, Human
auugucgucaauggacacauag

SEQ ID NO: 71122 - RNA, 17 nt, Human
auugucucuucacuuau

SEQ ID NO: 71123 - RNA, 22 nt, Human
auugucugaauccaaagcucug

SEQ ID NO: 71124 - RNA, 22 nt, Human
auugucuguacuuuaaaaaugu

SEQ ID NO: 71125 - RNA, 22 nt, Human
auugucuucugucuuaggugau

SEQ ID NO: 71126 - RNA, 22 nt, Human
auugucuuguacguuugccugu

SEQ ID NO: 71127 - RNA, 22 nt, Human
auugugaauugagaguacuucu

SEQ ID NO: 71128 - RNA, 21 nt, Human
auugugaccaucauuuuggaa

SEQ ID NO: 71129 - RNA, 22 nt, Human
auugugcaaaaccucaggccuc

SEQ ID NO: 71130 - RNA, 22 nt, Human
auugugcagcacagaucaugac

SEQ ID NO: 71131 - RNA, 22 nt, Human
auugugcagcagugguaccugg

SEQ ID NO: 71132 - RNA, 20 nt, Human
auugugcagcccuuggcaga

SEQ ID NO: 71133 - RNA, 22 nt, Human
auugugcaguaaaguccuuuuc

SEQ ID NO: 71134 - RNA, 22 nt, Human
auuguggcuagacagucacaau

SEQ ID NO: 71135 - RNA, 22 nt, Human
auuguuaaaguaauaaccaugg

SEQ ID NO: 71136 - RNA, 22 nt, Human
auuguuacuggguuaauuugga

SEQ ID NO: 71137 - RNA, 22 nt, Human
auuguucacugugaaucuugau

SEQ ID NO: 71138 - RNA, 18 nt, Human
auuguucugugacauguc

SEQ ID NO: 71139 - RNA, 22 nt, Human
auuguugaucuucugguaagcc

SEQ ID NO: 71140 - RNA, 22 nt, Human
auuguugggucucacuccuaga

SEQ ID NO: 71141 - RNA, 22 nt, Human
auuguugucuuuaccuguauuu

SEQ ID NO: 71142 - RNA, 22 nt, Human
auuuaaagugguagauuggcag

SEQ ID NO: 71143 - RNA, 22 nt, Human
auuuaacaagacagagaacugg

SEQ ID NO: 71144 - RNA, 18 nt, Human
auuuaaugaacugaaagc

SEQ ID NO: 71145 - RNA, 22 nt, Human
auuuaauuguucuucuggcuau

SEQ ID NO: 71146 - RNA, 22 nt, Human
auuuaauuugugucuuuagcug

SEQ ID NO: 71147 - RNA, 22 nt, Human
auuuacacuaaaggaaggagga

SEQ ID NO: 71148 - RNA, 22 nt, Human
auuuacacugguucucagagcu

SEQ ID NO: 71149 - RNA, 22 nt, Human
auuuacagaugaugcuauuuga

SEQ ID NO: 71150 - RNA, 22 nt, Human
auuuacagccuugaaaacagca

SEQ ID NO: 71151 - RNA, 22 nt, Human
auuuacaggacagcuuggcauu

SEQ ID NO: 71152 - RNA, 23 nt, Human
auuuacagguuaaaugaaaucag

SEQ ID NO: 71153 - RNA, 22 nt, Human
auuuacagugugccuacuauau

SEQ ID NO: 71154 - RNA, 22 nt, Human
auuuacauaauagacuuuaggu

SEQ ID NO: 71155 - RNA, 18 nt, Human
auuuacccagcaacgugg

SEQ ID NO: 71156 - RNA, 22 nt, Human
auuuacuaaugucauaucgcgu

SEQ ID NO: 71157 - RNA, 22 nt, Human
auuuacuacugcuaucuagaag

SEQ ID NO: 71158 - RNA, 22 nt, Human
auuuacuagggcuguuuaagua

SEQ ID NO: 71159 - RNA, 22 nt, Human
auuuacucgugcuucauugaau

SEQ ID NO: 71160 - RNA, 22 nt, Human
auuuacucgugucuccagugcu

SEQ ID NO: 71161 - RNA, 22 nt, Human
auuuacugagcagcuaccaugu

SEQ ID NO: 71162 - RNA, 22 nt, Human
auuuagaacuuuguuugccaau

SEQ ID NO: 71163 - RNA, 22 nt, Human
auuuagaagcuaauuuuucaga

SEQ ID NO: 71164 - RNA, 22 nt, Human
auuuagaaguuggagggcaaga

SEQ ID NO: 71165 - RNA, 22 nt, Human
cauggcagcaauuuuccugacu

SEQ ID NO: 71166 - RNA, 22 nt, Human
cauggcaggaaggacaugcacu

SEQ ID NO: 71167 - RNA, 22 nt, Human
cauggcaggcuucuucagccuu

SEQ ID NO: 71168 - RNA, 22 nt, Human
cauggcagggcugugggcaggu

SEQ ID NO: 71169 - RNA, 22 nt, Human
cauggcaggugcagauucugug

SEQ ID NO: 71170 - RNA, 22 nt, Human
cauggccacaucuagcugcaag

SEQ ID NO: 71171 - RNA, 22 nt, Human
cauggccagauucuuucuucuc

SEQ ID NO: 71172 - RNA, 22 nt, Human
cauggccagggagagagaaugu

SEQ ID NO: 71173 - RNA, 22 nt, Human
cauggcccucuucuggagcaau

SEQ ID NO: 71174 - RNA, 22 nt, Human
cauggccuugagugacugcacu

SEQ ID NO: 71175 - RNA, 23 nt, Human
cauggcugauuucaagcuaccac

SEQ ID NO: 71176 - RNA, 22 nt, Human
cauggcugcuggcucggucccu

SEQ ID NO: 71177 - RNA, 22 nt, Human
cauggcuggcacacagcaacca

SEQ ID NO: 71178 - RNA, 20 nt, Human
cauggcugugagcccacagg

SEQ ID NO: 71179 - RNA, 22 nt, Human
auuuagucaucacucauguguu

SEQ ID NO: 71180 - RNA, 22 nt, Human
auuuaucaccaguuagcugacu

SEQ ID NO: 71181 - RNA, 22 nt, Human
auuuaucucuggaaacuaagca

SEQ ID NO: 71182 - RNA, 20 nt, Human
auuuauguauagcuuguugu

SEQ ID NO: 71183 - RNA, 21 nt, Human
auuuauguuugggguggaaug

SEQ ID NO: 71184 - RNA, 22 nt, Human
auuuauuaagcaucugcuaugu

SEQ ID NO: 71185 - RNA, 22 nt, Human
auuuauuaccucggaguuucug

SEQ ID NO: 71186 - RNA, 22 nt, Human
auuuauucuccagauggcgaga

SEQ ID NO: 71187 - RNA, 22 nt, Human
auuuauugaagcuuauuacguu

SEQ ID NO: 71188 - RNA, 22 nt, Human
auuuauuggaugcuuacuuggg

SEQ ID NO: 71189 - RNA, 22 nt, Human
auuucaacguuagauguaauag

SEQ ID NO: 71190 - RNA, 22 nt, Human
auuucaaggcuacagaaaccuu

SEQ ID NO: 71191 - RNA, 22 nt, Human
auuucaaggcuauuaauauaaa

SEQ ID NO: 71192 - RNA, 22 nt, Human
auuucacaaaccauccugauuu

SEQ ID NO: 71193 - RNA, 21 nt, Human
auuucacacccuccuuuuucu

SEQ ID NO: 71194 - RNA, 22 nt, Human
auuucacaggccaguggugggg

SEQ ID NO: 71195 - RNA, 22 nt, Human
auuucacauuaauuugaugcuc

SEQ ID NO: 71196 - RNA, 17 nt, Human
auuucacuuagcaugag

SEQ ID NO: 71197 - RNA, 22 nt, Human
auuucacuuaguguaaugucuu

SEQ ID NO: 71198 - RNA, 21 nt, Human
auuucagaaauauugguggga

SEQ ID NO: 71199 - RNA, 22 nt, Human
auuucagacuguguuggaaaau

SEQ ID NO: 71200 - RNA, 21 nt, Human
auuucagagcacacaaguaaa

SEQ ID NO: 71201 - RNA, 22 nt, Human
auuucagagcuuugcagcuaau

SEQ ID NO: 71202 - RNA, 22 nt, Human
auuucagauucgagaggaagug

SEQ ID NO: 71203 - RNA, 22 nt, Human
auuucagggagucauuuacaca

SEQ ID NO: 71204 - RNA, 22 nt, Human
auuucaguguugguuagcaagc

SEQ ID NO: 71205 - RNA, 22 nt, Human
auuucauccagaguccuauuag

SEQ ID NO: 71206 - RNA, 22 nt, Human
auuucauccauuaagaguacuc

SEQ ID NO: 71207 - RNA, 22 nt, Human
auuucaugaaacauuccccuug

SEQ ID NO: 71208 - RNA, 22 nt, Human
auuucaugcagaaggaaguugg

SEQ ID NO: 71209 - RNA, 22 nt, Human
auuucaugugaagaagagauaa

SEQ ID NO: 71210 - RNA, 21 nt, Human
auuuccaaauaaggucacauu

SEQ ID NO: 71211 - RNA, 22 nt, Human
auuuccaaucucugcauauggg

SEQ ID NO: 71212 - RNA, 22 nt, Human
auuuccaauuucauccaugucc

SEQ ID NO: 71213 - RNA, 22 nt, Human
auuuccacauaagggaaauaag

SEQ ID NO: 71214 - RNA, 22 nt, Human
auuuccagacuuuuuccaggaa

SEQ ID NO: 71215 - RNA, 22 nt, Human
auuuccaggcuguuuugugaau

SEQ ID NO: 71216 - RNA, 22 nt, Human
auuuccaguacccagaacagag

SEQ ID NO: 71217 - RNA, 22 nt, Human
auuuccaguccuaaugaucugg

SEQ ID NO: 71218 - RNA, 22 nt, Human
auuuccauagagcgucucacag

SEQ ID NO: 71219 - RNA, 22 nt, Human
auuuccaucaucauuaggccua

SEQ ID NO: 71220 - RNA, 22 nt, Human
auuuccauuaucaugacaaauu

SEQ ID NO: 71221 - RNA, 22 nt, Human
auuucccaacacauuagaaaau

SEQ ID NO: 71222 - RNA, 22 nt, Human
auuucccacucuacuacaugcu

SEQ ID NO: 71223 - RNA, 17 nt, Human
auuucccagcagugcua

SEQ ID NO: 71224 - RNA, 23 nt, Human
auuuccuacuauaaaagagguaa

SEQ ID NO: 71225 - RNA, 22 nt, Human
auuuccuauagauauggugagu

SEQ ID NO: 71226 - RNA, 22 nt, Human
auuuccuauccuggucuuaaaa

SEQ ID NO: 71227 - RNA, 22 nt, Human
auuuccuauuucuuguccccua

SEQ ID NO: 71228 - RNA, 17 nt, Human
auuuccucagggcugag

SEQ ID NO: 71229 - RNA, 22 nt, Human
auuuccuguaggggcuugcgaa

SEQ ID NO: 71230 - RNA, 22 nt, Human
auuuccugugucucuauuuaug

SEQ ID NO: 71231 - RNA, 22 nt, Human
auuuccuucccagauuugguuc

SEQ ID NO: 71232 - RNA, 22 nt, Human
auuuccuugcaacuuaggcaug

SEQ ID NO: 71233 - RNA, 22 nt, Human
auuuccuugcaaguuucuguaa

SEQ ID NO: 71234 - RNA, 22 nt, Human
auuuccuuugcaaagacugugc

SEQ ID NO: 71235 - RNA, 22 nt, Human
auuucuacauugaguuuuagca

SEQ ID NO: 71236 - RNA, 18 nt, Human
auuucuacuacuauaaag

SEQ ID NO: 71237 - RNA, 22 nt, Human
auuucuacugugagaaacauga

SEQ ID NO: 71238 - RNA, 22 nt, Human
auuucuagcagggcaggaaaga

SEQ ID NO: 71239 - RNA, 22 nt, Human
auuucuauaggaggacaguauu

SEQ ID NO: 71240 - RNA, 22 nt, Human
auuucucacaaaguugcuuauc

SEQ ID NO: 71241 - RNA, 22 nt, Human
auuucucagugaaaugacaggc

SEQ ID NO: 71242 - RNA, 22 nt, Human
auuucucaguguacauuauguu

SEQ ID NO: 71243 - RNA, 22 nt, Human
auuucucauguacaaaaacacu

SEQ ID NO: 71244 - RNA, 22 nt, Human
auuucuccuuguugcaaugcag

SEQ ID NO: 71245 - RNA, 22 nt, Human
auuucucucauuguuagcuagg

SEQ ID NO: 71246 - RNA, 22 nt, Human
auuucugcuacugcacccuagu

SEQ ID NO: 71247 - RNA, 22 nt, Human
auuucuguauccugcugucaga

SEQ ID NO: 71248 - RNA, 22 nt, Human
auuucuguuauaccuuucucag

SEQ ID NO: 71249 - RNA, 22 nt, Human
auuucuguugcuuauaaauuac

SEQ ID NO: 71250 - RNA, 22 nt, Human
auuucuguuugcuacuauaagu

SEQ ID NO: 71251 - RNA, 22 nt, Human
auuucuuaucugaggucuacau

SEQ ID NO: 71252 - RNA, 22 nt, Human
auuucuuccauugccucuucaa

SEQ ID NO: 71253 - RNA, 22 nt, Human
auuucuugccccugcucccuga

SEQ ID NO: 71254 - RNA, 22 nt, Human
auuugaaccacucagaacucau

SEQ ID NO: 71255 - RNA, 22 nt, Human
auuugaagaaaguuuucuagau

SEQ ID NO: 71256 - RNA, 22 nt, Human
auuugaagucuucaugauuucu

SEQ ID NO: 71257 - RNA, 23 nt, Human
auuugacagagcauagcauuucu

SEQ ID NO: 71258 - RNA, 22 nt, Human
auuugacauugacacaccuaug

SEQ ID NO: 71259 - RNA, 23 nt, Human
auuugagaaaguauuuuuaagac

SEQ ID NO: 71260 - RNA, 22 nt, Human
auuugcaagaguaagaauuucu

SEQ ID NO: 71261 - RNA, 22 nt, Human
auuugcaaugauuucagugcuu

SEQ ID NO: 71262 - RNA, 18 nt, Human
auuugcaggcaugcaggc

SEQ ID NO: 71263 - RNA, 22 nt, Human
auuugccucugcuuucaaggau

SEQ ID NO: 71264 - RNA, 22 nt, Human
auuugccuugugaauuggauau

SEQ ID NO: 71265 - RNA, 20 nt, Human
auuugcugagcuuuuucucc

SEQ ID NO: 71266 - RNA, 20 nt, Human
auuugcuuaccuuguuucua

SEQ ID NO: 71267 - RNA, 22 nt, Human
auuugcuuccuaauacucauau

SEQ ID NO: 71268 - RNA, 22 nt, Human
auuugcuuguaaauguaugccu

SEQ ID NO: 71269 - RNA, 22 nt, Human
auuugcuuucagccuuaaggau

SEQ ID NO: 71270 - RNA, 22 nt, Human
auuugcuuucccuucccugaca

SEQ ID NO: 71271 - RNA, 22 nt, Human
auuuggaaacaauuauauucuu

SEQ ID NO: 71272 - RNA, 22 nt, Human
auuuggaaacaugcugaccaug

SEQ ID NO: 71273 - RNA, 22 nt, Human
auuuggaacaaauauuaguaaa

SEQ ID NO: 71274 - RNA, 22 nt, Human
caagccaggaaggauccagcac

SEQ ID NO: 71275 - RNA, 22 nt, Human
caagccaggugaacauaacaag

SEQ ID NO: 71276 - RNA, 22 nt, Human
caagccagucagcucaguagau

SEQ ID NO: 71277 - RNA, 22 nt, Human
caagccagugacagccagggaa

SEQ ID NO: 71278 - RNA, 22 nt, Human
caagcccuguuaggggucucua

SEQ ID NO: 71279 - RNA, 22 nt, Human
caagccuuggaaauccauucug

SEQ ID NO: 71280 - RNA, 22 nt, Human
caagcguggcugcucugaugga

SEQ ID NO: 71281 - RNA, 22 nt, Human
caagcuacucaggcaagaugug

SEQ ID NO: 71282 - RNA, 22 nt, Human
caagcucugcgggcuccaagau

SEQ ID NO: 71283 - RNA, 22 nt, Human
caagcugaacacugucuucaag

SEQ ID NO: 71284 - RNA, 22 nt, Human
caagcuggagguuggagcuacu

SEQ ID NO: 71285 - RNA, 22 nt, Human
caagcuggcugggagaggcacg

SEQ ID NO: 71286 - RNA, 22 nt, Human
caagcugguaucagcuagagcg

SEQ ID NO: 71287 - RNA, 22 nt, Human
caagcuuguuucuccugggggu

SEQ ID NO: 71288 - RNA, 22 nt, Human
caagcuuuccauuacacacauu

SEQ ID NO: 71289 - RNA, 22 nt, Human
caaggaaaaagcgagcucgggg

SEQ ID NO: 71290 - RNA, 22 nt, Human
caaggaaguuuuaggagaggaa

SEQ ID NO: 71291 - RNA, 22 nt, Human
caaggacacugauguucauccu

SEQ ID NO: 71292 - RNA, 22 nt, Human
caaggauagguacuauguaaua

SEQ ID NO: 71293 - RNA, 22 nt, Human
caaggauucucacuagacuaga

SEQ ID NO: 71294 - RNA, 22 nt, Human
caaggcagcccgcugaaccaca

SEQ ID NO: 71295 - RNA, 22 nt, Human
caaggcagcuauugucuccaua

SEQ ID NO: 71296 - RNA, 22 nt, Human
caaggcagcuguagggauuugg

SEQ ID NO: 71297 - RNA, 22 nt, Human
caaggcaggcaguucacuugag

SEQ ID NO: 71298 - RNA, 22 nt, Human
caaggcaggucugaggagguug

SEQ ID NO: 71299 - RNA, 22 nt, Human
caaggcagugggcuaggaaccu

SEQ ID NO: 71300 - RNA, 22 nt, Human
caaggcaguuccccagagggcu

SEQ ID NO: 71301 - RNA, 22 nt, Human
caaggcauuucgcuuagagaga

SEQ ID NO: 71302 - RNA, 22 nt, Human
caaggccaaagggccacuguca

SEQ ID NO: 71303 - RNA, 22 nt, Human
caaggccaagucucugugaaga

SEQ ID NO: 71304 - RNA, 22 nt, Human
caaggccacuccagagacuggu

SEQ ID NO: 71305 - RNA, 22 nt, Human
caaggccagagccagcgauaag

SEQ ID NO: 71306 - RNA, 17 nt, Human
caaggccagcaucuuca

SEQ ID NO: 71307 - RNA, 22 nt, Human
caaggccaguuucuccuaguca

SEQ ID NO: 71308 - RNA, 22 nt, Human
caaggccaugagcagcgagugu

SEQ ID NO: 71309 - RNA, 22 nt, Human
caaggccuaugcacaccuagga

SEQ ID NO: 71310 - RNA, 22 nt, Human
caaggccugacugcuugucuaa

SEQ ID NO: 71311 - RNA, 20 nt, Human
caaggccuggaucuaguugc

SEQ ID NO: 71312 - RNA, 22 nt, Human
caaccugacaagguuaaugaau

SEQ ID NO: 71313 - RNA, 21 nt, Human
caaccugagcugaacccgugc

SEQ ID NO: 71314 - RNA, 22 nt, Human
caaccugaugaauugaauuuaa

SEQ ID NO: 71315 - RNA, 22 nt, Human
caaccugaugugcaugccacgg

SEQ ID NO: 71316 - RNA, 22 nt, Human
caaccuggcccuagcccuggga

SEQ ID NO: 71317 - RNA, 22 nt, Human
caacuaauauagggcaugagaa

SEQ ID NO: 71318 - RNA, 22 nt, Human
caacuacaggaaaagucauuca

SEQ ID NO: 71319 - RNA, 22 nt, Human
caacuauagaucaaaugaguuu

SEQ ID NO: 71320 - RNA, 22 nt, Human
caacucaggcaccucauauaag

SEQ ID NO: 71321 - RNA, 22 nt, Human
caacugaaaagauucuacgcag

SEQ ID NO: 71322 - RNA, 22 nt, Human
caacugggauaaagagcuaaag

SEQ ID NO: 71323 - RNA, 22 nt, Human
caacuguaauauuggaagauca

SEQ ID NO: 71324 - RNA, 22 nt, Human
caacuucaccaggguuccuaga

SEQ ID NO: 71325 - RNA, 22 nt, Human
caacuucagggaaacaugaagc

SEQ ID NO: 71326 - RNA, 22 nt, Human
caacuuguucuugguagaucua

SEQ ID NO: 71327 - RNA, 22 nt, Human
caacuuuaaauggcuaugucug

SEQ ID NO: 71328 - RNA, 22 nt, Human
caacuuucuguuaaauguuagu

SEQ ID NO: 71329 - RNA, 23 nt, Human
caacuuuuggcuacaugcuuagc

SEQ ID NO: 71330 - RNA, 22 nt, Human
caagaaacuuuauucugccaua

SEQ ID NO: 71331 - RNA, 22 nt, Human
caagaaaucuagaagucagugg

SEQ ID NO: 71332 - RNA, 22 nt, Human
caagaaauucuguucagauagc

SEQ ID NO: 71333 - RNA, 22 nt, Human
caagaacauugugaucacuuca

SEQ ID NO: 71334 - RNA, 22 nt, Human
caagaauaaccagacaauagca

SEQ ID NO: 71335 - RNA, 18 nt, Human
caagaaucucuaaagaag

SEQ ID NO: 71336 - RNA, 22 nt, Human
caagaaucuugcagcuuagacu

SEQ ID NO: 71337 - RNA, 19 nt, Human
caagacaaagcccaucuuc

SEQ ID NO: 71338 - RNA, 22 nt, Human
caagacaagaucuaagcaugcu

SEQ ID NO: 71339 - RNA, 22 nt, Human
caagacaauggguaaguguaac

SEQ ID NO: 71340 - RNA, 22 nt, Human
caagacuuuggaaggcugaggc

SEQ ID NO: 71341 - RNA, 22 nt, Human
caagagcacgugcccuccauaa

SEQ ID NO: 71342 - RNA, 22 nt, Human
caagagcaggugcugcuuccau

SEQ ID NO: 71343 - RNA, 22 nt, Human
caagagcaucccugcauccagc

SEQ ID NO: 71344 - RNA, 22 nt, Human
caagagcauuuaguuagcuggu

SEQ ID NO: 71345 - RNA, 22 nt, Human
caagagcuacccugugccauau

SEQ ID NO: 71346 - RNA, 22 nt, Human
caagagcuagaaauugguuaga

SEQ ID NO: 71347 - RNA, 22 nt, Human
caagagcucaccggagagcauu

SEQ ID NO: 71348 - RNA, 22 nt, Human
caagagcucagaaacccuugcu

SEQ ID NO: 71349 - RNA, 22 nt, Human
caagagcugugaccucauucac

SEQ ID NO: 71350 - RNA, 22 nt, Human
caagagcuucugcucuucaugg

SEQ ID NO: 71351 - RNA, 22 nt, Human
caagagggaaccuaagauguau

SEQ ID NO: 71352 - RNA, 22 nt, Human
caagagugaaacucugucucaa

SEQ ID NO: 71353 - RNA, 22 nt, Human
caagauauugauuuccagcuga

SEQ ID NO: 71354 - RNA, 22 nt, Human
caagaucaagguaucagcagau

SEQ ID NO: 71355 - RNA, 22 nt, Human
caagaucaaggugucagcaggu

SEQ ID NO: 71356 - RNA, 22 nt, Human
caagaucacacagguaacaagu

SEQ ID NO: 71357 - RNA, 22 nt, Human
caagaugaaacuacagggagga

SEQ ID NO: 71358 - RNA, 22 nt, Human
caagaugaaugaugaagugugu

SEQ ID NO: 71359 - RNA, 22 nt, Human
caagauggguguugugaugguu

SEQ ID NO: 71360 - RNA, 22 nt, Human
caagaugugccuaaucagaccu

SEQ ID NO: 71361 - RNA, 22 nt, Human
caagauguggugggcugaguuu

SEQ ID NO: 71362 - RNA, 22 nt, Human
caagauuacuauccacugcugg

SEQ ID NO: 71363 - RNA, 22 nt, Human
caagauuugacuucgugguuug

SEQ ID NO: 71364 - RNA, 19 nt, Human
caagauuuguucacacaug

SEQ ID NO: 71365 - RNA, 22 nt, Human
caagcaaugcccugguauauua

SEQ ID NO: 71366 - RNA, 22 nt, Human
caagcagaaaucuagaacucca

SEQ ID NO: 71367 - RNA, 22 nt, Human
caagcagacaguaggccuagaa

SEQ ID NO: 71368 - RNA, 22 nt, Human
caagcagagguuuauguauuag

SEQ ID NO: 71369 - RNA, 22 nt, Human
caagcagauauuuuagucaaga

SEQ ID NO: 71370 - RNA, 22 nt, Human
caagcagccccaacaugaggau

SEQ ID NO: 71371 - RNA, 22 nt, Human
caagcagggauacugcagggag

SEQ ID NO: 71372 - RNA, 22 nt, Human
caagcauacugugagaguuuua

SEQ ID NO: 71373 - RNA, 20 nt, Human
caagccaggcccugcugcug

SEQ ID NO: 71374 - RNA, 22 nt, Human
caagccauacugggugaaauca

SEQ ID NO: 71375 - RNA, 22 nt, Human
caagcccacugcucagagccaa

SEQ ID NO: 71376 - RNA, 20 nt, Human
caagcccucuuuagccugcc

SEQ ID NO: 71377 - RNA, 22 nt, Human
caagcccuuccgggaacaguug

SEQ ID NO: 71378 - RNA, 22 nt, Human
caagcuacuuagaaagcacagu

SEQ ID NO: 71379 - RNA, 21 nt, Human
caagcugccugagggugguug

SEQ ID NO: 71380 - RNA, 22 nt, Human
caagcugcuuauucucugcucu

SEQ ID NO: 71381 - RNA, 22 nt, Human
caagcuggcucuuaugcaaaaa

SEQ ID NO: 71382 - RNA, 22 nt, Human
caagcugggucccaacaauuac

SEQ ID NO: 71383 - RNA, 20 nt, Human
ccagcucugugguuagauac

SEQ ID NO: 71384 - RNA, 22 nt, Human
ccagcugagaaguguaaaguga

SEQ ID NO: 71385 - RNA, 22 nt, Human
ccagcugaggcagccacacagg

SEQ ID NO: 71386 - RNA, 22 nt, Human
ccagcugagguugaagaaagag

SEQ ID NO: 71387 - RNA, 22 nt, Human
ccagcugauucgguggugguug

SEQ ID NO: 71388 - RNA, 22 nt, Human
ccagcugcccacuauguguucu

SEQ ID NO: 71389 - RNA, 22 nt, Human
ccagcugcugacaugggcaggu

SEQ ID NO: 71390 - RNA, 22 nt, Human
ccagcugcugcaccgugcaugg

SEQ ID NO: 71391 - RNA, 22 nt, Human
ccagcuggagccaagguggacu

SEQ ID NO: 71392 - RNA, 19 nt, Human
ccagcuggccugggaccuc

SEQ ID NO: 71393 - RNA, 22 nt, Human
ccagcugggucccugcuggggc

SEQ ID NO: 71394 - RNA, 22 nt, Human
ccagcugucagugugaaaauaa

SEQ ID NO: 71395 - RNA, 22 nt, Human
ccagcugucuugagaggaggca

SEQ ID NO: 71396 - RNA, 18 nt, Human
ccagcugugcagcaucug

SEQ ID NO: 71397 - RNA, 22 nt, Human
ccagcugugccuaggagcaggg

SEQ ID NO: 71398 - RNA, 22 nt, Human
ccagcugugcuguuggcuuguc

SEQ ID NO: 71399 - RNA, 22 nt, Human
ccagcuguuggaguuucacugc

SEQ ID NO: 71400 - RNA, 22 nt, Human
ccagcuugaagaugugcugguu

SEQ ID NO: 71401 - RNA, 22 nt, Human
ccagcuuguuugaagcucguca

SEQ ID NO: 71402 - RNA, 20 nt, Human
ccagcuuucccugcagcauc

SEQ ID NO: 71403 - RNA, 22 nt, Human
ccagcuuuccugcgaguugauu

SEQ ID NO: 71404 - RNA, 22 nt, Human
ccagcuuucugggugguuucug

SEQ ID NO: 71405 - RNA, 22 nt, Human
ccagcuuuuagugggcuuauua

SEQ ID NO: 71406 - RNA, 22 nt, Human
ccagcuuuuccucucauugcuu

SEQ ID NO: 71407 - RNA, 22 nt, Human
ccagcuuuuggggugacaauuu

SEQ ID NO: 71408 - RNA, 22 nt, Human
ccaggaaaauaccaagcuuuaa

SEQ ID NO: 71409 - RNA, 22 nt, Human
ccaggaaagaggaagaacgcau

SEQ ID NO: 71410 - RNA, 22 nt, Human
ccaggaagccuuuuucuuugac

SEQ ID NO: 71411 - RNA, 22 nt, Human
ccaggaagcugucugauaugaa

SEQ ID NO: 71412 - RNA, 22 nt, Human
ccaggaagcugugagauuccaa

SEQ ID NO: 71413 - RNA, 22 nt, Human
ccaggaaggaagcagggguuuc

SEQ ID NO: 71414 - RNA, 22 nt, Human
ccaggaaugaaauguagauaaa

SEQ ID NO: 71415 - RNA, 22 nt, Human
ccaggacaaguguggccauggc

SEQ ID NO: 71416 - RNA, 18 nt, Human
ccaggacaggcaaaaggu

SEQ ID NO: 71417 - RNA, 22 nt, Human
ccaggacccugcaaacccuguu

SEQ ID NO: 71418 - RNA, 19 nt, Human
ccaggaccuuuccaggguc

SEQ ID NO: 71419 - RNA, 22 nt, Human
ccaggacucaguggggaaaggg

SEQ ID NO: 71420 - RNA, 22 nt, Human
ccaggacugcagggggcgagga

SEQ ID NO: 71421 - RNA, 22 nt, Human
ccaggacuuauuacaguauaac

SEQ ID NO: 71422 - RNA, 22 nt, Human
ccaggagagcaggcgugcagcu

SEQ ID NO: 71423 - RNA, 22 nt, Human
ccaggagagcucuaaauggcug

SEQ ID NO: 71424 - RNA, 22 nt, Human
ccaggagagcucucguucagug

SEQ ID NO: 71425 - RNA, 22 nt, Human
ccaggagaugggaaaguagcag

SEQ ID NO: 71426 - RNA, 22 nt, Human
ccaggagauuuuuccauagcac

SEQ ID NO: 71427 - RNA, 22 nt, Human
ccaggagcaggagcuggacaga

SEQ ID NO: 71428 - RNA, 19 nt, Human
ccaggagcaguggugagcu

SEQ ID NO: 71429 - RNA, 22 nt, Human
cacaagaugguuuccagaugcu

SEQ ID NO: 71430 - RNA, 22 nt, Human
cacaagcugggcaaguguauau

SEQ ID NO: 71431 - RNA, 22 nt, Human
cacaaggccuuguagaccacgg

SEQ ID NO: 71432 - RNA, 18 nt, Human
cacaauagacaccgauaa

SEQ ID NO: 71433 - RNA, 22 nt, Human
cacaaugugguuugucaucuuu

SEQ ID NO: 71434 - RNA, 21 nt, Human
cacaauguuggccagguuggu

SEQ ID NO: 71435 - RNA, 22 nt, Human
cacaauuguaucagaaaauagu

SEQ ID NO: 71436 - RNA, 18 nt, Human
cacaauuuacagaugaca

SEQ ID NO: 71437 - RNA, 22 nt, Human
cacacagaaccgcucgccacuu

SEQ ID NO: 71438 - RNA, 22 nt, Human
cacacagaugguaagggaggga

SEQ ID NO: 71439 - RNA, 22 nt, Human
cacacaggaugaagcagcagaa

SEQ ID NO: 71440 - RNA, 22 nt, Human
cacacaguaguaugaggcaaaa

SEQ ID NO: 71441 - RNA, 22 nt, Human
cacacaguggaguauuacucag

SEQ ID NO: 71442 - RNA, 22 nt, Human
cacacaucuuaucccaguuauu

SEQ ID NO: 71443 - RNA, 22 nt, Human
cacacaugagucuccccauugg

SEQ ID NO: 71444 - RNA, 22 nt, Human
cacacaugguuccgcaggaugc

SEQ ID NO: 71445 - RNA, 22 nt, Human
cacacaugugggauccgcaggg

SEQ ID NO: 71446 - RNA, 22 nt, Human
cacacauuagagccaaugucag

SEQ ID NO: 71447 - RNA, 22 nt, Human
cacacauuccaaaaucaagggu

SEQ ID NO: 71448 - RNA, 22 nt, Human
cacacauugaauucauucuugu

SEQ ID NO: 71449 - RNA, 22 nt, Human
cacacauugguuuuacuccuuu

SEQ ID NO: 71450 - RNA, 22 nt, Human
cacaccagauggcagcguggga

SEQ ID NO: 71451 - RNA, 22 nt, Human
cacacccucgugcucccucccg

SEQ ID NO: 71452 - RNA, 22 nt, Human
cacaccucacaccucgcaugcu

SEQ ID NO: 71453 - RNA, 22 nt, Human
cacaccuguaauccuagcacuu

SEQ ID NO: 71454 - RNA, 22 nt, Human
cacaccugugagucucggcuug

SEQ ID NO: 71455 - RNA, 22 nt, Human
cacacgugugagagcuguggca

SEQ ID NO: 71456 - RNA, 22 nt, Human
cacacuaauuuuucaagaguuu

SEQ ID NO: 71457 - RNA, 22 nt, Human
cacacucauuagucauuucucu

SEQ ID NO: 71458 - RNA, 22 nt, Human
cacacugacuggaaucaaggau

SEQ ID NO: 71459 - RNA, 22 nt, Human
cacacugccacauucacucuuc

SEQ ID NO: 71460 - RNA, 22 nt, Human
cacacugucuuuaugagcugua

SEQ ID NO: 71461 - RNA, 22 nt, Human
cacacuguugaggacgagaugu

SEQ ID NO: 71462 - RNA, 22 nt, Human
cacacuugcuucagagucaagu

SEQ ID NO: 71463 - RNA, 22 nt, Human
cacacuuugugcuaaucuauuu

SEQ ID NO: 71464 - RNA, 22 nt, Human
cacacuuuuggcauguuugguu

SEQ ID NO: 71465 - RNA, 22 nt, Human
cacagaaaaaggcuugaaaauc

SEQ ID NO: 71466 - RNA, 22 nt, Human
cacagaaauauugugucccuug

SEQ ID NO: 71467 - RNA, 22 nt, Human
cacagaacaccaaagaaccuuc

SEQ ID NO: 71468 - RNA, 22 nt, Human
cacagaacauccuuagcucaug

SEQ ID NO: 71469 - RNA, 22 nt, Human
cacagaauaauucacauggcuc

SEQ ID NO: 71470 - RNA, 21 nt, Human
cacagaauauacauuuuaguu

SEQ ID NO: 71471 - RNA, 22 nt, Human
cacagaaucggccgauggugcu

SEQ ID NO: 71472 - RNA, 22 nt, Human
cacagaaucugugacuccaaga

SEQ ID NO: 71473 - RNA, 22 nt, Human
cacagacagugucccuuuguug

SEQ ID NO: 71474 - RNA, 22 nt, Human
cacagacuccccgccauagugg

SEQ ID NO: 71475 - RNA, 20 nt, Human
cacagacuguaugggcacca

SEQ ID NO: 71476 - RNA, 22 nt, Human
cacagacuugagaagcaccuua

SEQ ID NO: 71477 - RNA, 22 nt, Human
cacagagaaaauguuggugcuu

SEQ ID NO: 71478 - RNA, 22 nt, Human
cacagagaauacugcucuugcu

SEQ ID NO: 71479 - RNA, 22 nt, Human
cacagagaauucccauauguga

SEQ ID NO: 71480 - RNA, 22 nt, Human
cacagagacagaagcacuuaug

SEQ ID NO: 71481 - RNA, 22 nt, Human
cacagagacaugaugucauugc

SEQ ID NO: 71482 - RNA, 22 nt, Human
cacagagaccccuucuggggcc

SEQ ID NO: 71483 - RNA, 21 nt, Human
cacagagauauuggugagccu

SEQ ID NO: 71484 - RNA, 22 nt, Human
cacagagaucggaacagaagua

SEQ ID NO: 71485 - RNA, 22 nt, Human
cacagagauuagaauuagacua

SEQ ID NO: 71486 - RNA, 22 nt, Human
cacagagcaacucaaaucagcu

SEQ ID NO: 71487 - RNA, 22 nt, Human
cacagaggaaaugacuuucuua

SEQ ID NO: 71488 - RNA, 22 nt, Human
cacagaggaaugcaucagcaga

SEQ ID NO: 71489 - RNA, 22 nt, Human
cacagaggcaugacccugcccu

SEQ ID NO: 71490 - RNA, 21 nt, Human
cacagaggcgcuguauggcug

SEQ ID NO: 71491 - RNA, 22 nt, Human
cacagaugaaguaaacaacucu

SEQ ID NO: 71492 - RNA, 22 nt, Human
uacaagugugcaccaccauguc

SEQ ID NO: 71493 - RNA, 22 nt, Human
uacaaguuucaaagagaucaug

SEQ ID NO: 71494 - RNA, 20 nt, Human
uacaauacacaugcauauga

SEQ ID NO: 71495 - RNA, 20 nt, Human
uacaauauucccacuuugcu

SEQ ID NO: 71496 - RNA, 22 nt, Human
uacaaucacccaaaaguggcuc

SEQ ID NO: 71497 - RNA, 22 nt, Human
uacaaugagcugagccagaggc

SEQ ID NO: 71498 - RNA, 22 nt, Human
uacaaugagcuguacaucucca

SEQ ID NO: 71499 - RNA, 22 nt, Human
uacaaugaugauacuuuacugg

SEQ ID NO: 71500 - RNA, 23 nt, Human
uacaaugcaaacuuggcccaugg

SEQ ID NO: 71501 - RNA, 22 nt, Human
uacaaugcauucauuuuugagg

SEQ ID NO: 71502 - RNA, 22 nt, Human
uacaauguacuuccuugcacag

SEQ ID NO: 71503 - RNA, 16 nt, Human
uacaauguagaaaaca

SEQ ID NO: 71504 - RNA, 22 nt, Human
uacaaugucucucaccugacuu

SEQ ID NO: 71505 - RNA, 22 nt, Human
uacaauguugguaaaguaucau

SEQ ID NO: 71506 - RNA, 22 nt, Human
uacaauuacucagcucugcugu

SEQ ID NO: 71507 - RNA, 21 nt, Human
uacacaaagcgugguccagag

SEQ ID NO: 71508 - RNA, 22 nt, Human
uacacaauuaguugcaaaguga

SEQ ID NO: 71509 - RNA, 22 nt, Human
uacacagaaauuguguagggau

SEQ ID NO: 71510 - RNA, 22 nt, Human
uacacaggguauggcuugagga

SEQ ID NO: 71511 - RNA, 22 nt, Human
uacacauacauugcuuacaagg

SEQ ID NO: 71512 - RNA, 22 nt, Human
uacacauauguguguauaugug

SEQ ID NO: 71513 - RNA, 22 nt, Human
uacacaucaaccuggcuuuggc

SEQ ID NO: 71514 - RNA, 22 nt, Human
uacacaucauacacugggauua

SEQ ID NO: 71515 - RNA, 22 nt, Human
uacacauguccaaggugucacc

SEQ ID NO: 71516 - RNA, 22 nt, Human
uacacaugugcacgcguguccu

SEQ ID NO: 71517 - RNA, 22 nt, Human
uacacauuagugagguauuuug

SEQ ID NO: 71518 - RNA, 22 nt, Human
uacacauuucucuuagagacac

SEQ ID NO: 71519 - RNA, 22 nt, Human
uacaccagcuugccugggcucu

SEQ ID NO: 71520 - RNA, 22 nt, Human
uacaccauucccagguggauuu

SEQ ID NO: 71521 - RNA, 22 nt, Human
uacaccauuuucugcaguguuu

SEQ ID NO: 71522 - RNA, 22 nt, Human
uacacccacaugccuaggaggg

SEQ ID NO: 71523 - RNA, 22 nt, Human
uacaccuuaaucauaugugucu

SEQ ID NO: 71524 - RNA, 22 nt, Human
uacacgugcaaauucaauguau

SEQ ID NO: 71525 - RNA, 22 nt, Human
uacacuaagaacaaagaucugu

SEQ ID NO: 71526 - RNA, 22 nt, Human
uacacuaauagccacacuaaug

SEQ ID NO: 71527 - RNA, 22 nt, Human
uacacuacacgaaggcauugca

SEQ ID NO: 71528 - RNA, 22 nt, Human
uacacuauuuuacugauacaaa

SEQ ID NO: 71529 - RNA, 22 nt, Human
uacacugaauacuaguuuuccu

SEQ ID NO: 71530 - RNA, 22 nt, Human
uacacuggagcccuuggggucu

SEQ ID NO: 71531 - RNA, 22 nt, Human
uacacuggccaaaugccuuugg

SEQ ID NO: 71532 - RNA, 22 nt, Human
uacacuguagguggcaggcagc

SEQ ID NO: 71533 - RNA, 22 nt, Human
uacacugugguaaacucaaagu

SEQ ID NO: 71534 - RNA, 22 nt, Human
uacacuuuauggauccuacuuu

SEQ ID NO: 71535 - RNA, 22 nt, Human
uacacuuucguuuguggauuag

SEQ ID NO: 71536 - RNA, 22 nt, Human
uacacuuuuuacuacagauucu

SEQ ID NO: 71537 - RNA, 20 nt, Human
uacagaaacaggacuuuugg

SEQ ID NO: 71538 - RNA, 22 nt, Human
uacagaaauugccaccagcucu

SEQ ID NO: 71539 - RNA, 22 nt, Human
uacagaacugaaguagugaaaa

SEQ ID NO: 71540 - RNA, 22 nt, Human
uacagaaggaaguuuagcuaaa

SEQ ID NO: 71541 - RNA, 17 nt, Human
uacagaaggcaccacaa

SEQ ID NO: 71542 - RNA, 22 nt, Human
uacagaauagaauagggacagg

SEQ ID NO: 71543 - RNA, 22 nt, Human
uacagaaugauguguuuaaaua

SEQ ID NO: 71544 - RNA, 22 nt, Human
uacagaauguguaucauuacca

SEQ ID NO: 71545 - RNA, 22 nt, Human
uacagaauuagauuauuagaga

SEQ ID NO: 71546 - RNA, 22 nt, Human
uacagacagacuucccacccuc

SEQ ID NO: 71547 - RNA, 22 nt, Human
uacagacauucaauuuugaccc

SEQ ID NO: 71548 - RNA, 22 nt, Human
uacagacauuuacuccacuccu

SEQ ID NO: 71549 - RNA, 22 nt, Human
uacagaccaguaguucucagcg

SEQ ID NO: 71550 - RNA, 22 nt, Human
uacagagaggugacccuugggc

SEQ ID NO: 71551 - RNA, 22 nt, Human
uacagagaugugaaaagcucua

SEQ ID NO: 71552 - RNA, 22 nt, Human
uacagaggaggggauuuuaaua

SEQ ID NO: 71553 - RNA, 22 nt, Human
uacagaggcacaugcaauuuuc

SEQ ID NO: 71554 - RNA, 22 nt, Human
uacagagggauuaucuaagggu

SEQ ID NO: 71555 - RNA, 22 nt, Human
uacagaguuuuccugccaagaa

SEQ ID NO: 71556 - RNA, 22 nt, Human
uacagauaaauuuuaaguagaa

SEQ ID NO: 71557 - RNA, 22 nt, Human
uacagauacagaucuagauaca

SEQ ID NO: 71558 - RNA, 22 nt, Human
uacagauauagagauuuauaga

SEQ ID NO: 71559 - RNA, 22 nt, Human
uacagauauuucucuucaacaa

SEQ ID NO: 71560 - RNA, 18 nt, Human
uacagauuauagauacau

SEQ ID NO: 71561 - RNA, 22 nt, Human
uacagauuuggggaguaaaguu

SEQ ID NO: 71562 - RNA, 22 nt, Human
uacagcaagacagaccgcucaa

SEQ ID NO: 71563 - RNA, 22 nt, Human
uacagcaauaaugacaccgcuc

SEQ ID NO: 71564 - RNA, 22 nt, Human
uacagcacaaagggccuuuacc

SEQ ID NO: 71565 - RNA, 22 nt, Human
uacagcagcccaccuucuucug

SEQ ID NO: 71566 - RNA, 22 nt, Human
uacagcaugaucacaauggaaa

SEQ ID NO: 71567 - RNA, 22 nt, Human
uacagcauuuuguagaguacua

SEQ ID NO: 71568 - RNA, 22 nt, Human
uacagccucaucacgggagcug

SEQ ID NO: 71569 - RNA, 22 nt, Human
uacagccucuucccuggagugg

SEQ ID NO: 71570 - RNA, 22 nt, Human
uacagccuggcacuacccuggg

SEQ ID NO: 71571 - RNA, 22 nt, Human
uacagcuagagggcacgugaac

SEQ ID NO: 71572 - RNA, 22 nt, Human
uacagcuaggcaaaaaugacau

SEQ ID NO: 71573 - RNA, 22 nt, Human
uacagcuaugucuugguguucu

SEQ ID NO: 71574 - RNA, 22 nt, Human
uacagcugcaaggguuucuggg

SEQ ID NO: 71575 - RNA, 22 nt, Human
uacagcugcuggugcuccaugc

SEQ ID NO: 71576 - RNA, 22 nt, Human
uacagcuugauguuuguguguu

SEQ ID NO: 71577 - RNA, 18 nt, Human
uacaggaaaaguguuaca

SEQ ID NO: 71578 - RNA, 22 nt, Human
uacaggaaagaaauuugaacuc

SEQ ID NO: 71579 - RNA, 22 nt, Human
uacaggaaccagauuguucagc

SEQ ID NO: 71580 - RNA, 22 nt, Human
uacaggaagcacucaagaaaug

SEQ ID NO: 71581 - RNA, 22 nt, Human
uacaggaagucucaguacagua

SEQ ID NO: 71582 - RNA, 20 nt, Human
uacaggaccuucuuuguauc

SEQ ID NO: 71583 - RNA, 22 nt, Human
uacaggcugaacucaaugauga

SEQ ID NO: 71584 - RNA, 22 nt, Human
uacagggacauggaacaggcuc

SEQ ID NO: 71585 - RNA, 22 nt, Human
uacagggauuguuuuaaucacc

SEQ ID NO: 71586 - RNA, 22 nt, Human
uacagggcugagugagacaugg

SEQ ID NO: 71587 - RNA, 22 nt, Human
uacagguaaaauuaucagaaac

SEQ ID NO: 71588 - RNA, 22 nt, Human
uacagguagcaaaaccuuuccu

SEQ ID NO: 71589 - RNA, 22 nt, Human
uacagguuacacuuuuaaaagu

SEQ ID NO: 71590 - RNA, 22 nt, Human
uacaguaaccagucuacuuaga

SEQ ID NO: 71591 - RNA, 22 nt, Human
uacaguaaccuuauuugucauu

SEQ ID NO: 71592 - RNA, 21 nt, Human
uacaguaaguugggugguccu

SEQ ID NO: 71593 - RNA, 22 nt, Human
uaccauuucauucuuuccucau

SEQ ID NO: 71594 - RNA, 22 nt, Human
uaccauuuugaggauggagaga

SEQ ID NO: 71595 - RNA, 22 nt, Human
uacccaaggcccuuucaauuuc

SEQ ID NO: 71596 - RNA, 22 nt, Human
uacccacagccucucuucaaaa

SEQ ID NO: 71597 - RNA, 22 nt, Human
uacccacugucauauucagggu

SEQ ID NO: 71598 - RNA, 22 nt, Human
uacccagagggagagcaacuau

SEQ ID NO: 71599 - RNA, 22 nt, Human
uacccagauucacaagccaagg

SEQ ID NO: 71600 - RNA, 22 nt, Human
uacccagcccaugccuaccuca

SEQ ID NO: 71601 - RNA, 22 nt, Human
uauuaacauuuuaugaaaauaa

SEQ ID NO: 71602 - RNA, 22 nt, Human
uauuaagagauguaugaagaga

SEQ ID NO: 71603 - RNA, 22 nt, Human
uauuaagauacguaguuguaaa

SEQ ID NO: 71604 - RNA, 22 nt, Human
uauuaaguaucuugaugacaaa

SEQ ID NO: 71605 - RNA, 22 nt, Human
uauuaauaaauauguaggggcc

SEQ ID NO: 71606 - RNA, 20 nt, Human
uauuacacacaaugagcagu

SEQ ID NO: 71607 - RNA, 22 nt, Human
uauuacacuuucuucuucaagc

SEQ ID NO: 71608 - RNA, 22 nt, Human
uauuacagaaucaggcauaacu

SEQ ID NO: 71609 - RNA, 22 nt, Human
uauuacagcuuugauuaucugg

SEQ ID NO: 71610 - RNA, 22 nt, Human
uauuacuaccaucugcuacuau

SEQ ID NO: 71611 - RNA, 22 nt, Human
uauuacugagguuuuauggagu

SEQ ID NO: 71612 - RNA, 22 nt, Human
uauuagaaaggcuauugcauag

SEQ ID NO: 71613 - RNA, 22 nt, Human
uauuagauuaacuuuaaugucu

SEQ ID NO: 71614 - RNA, 22 nt, Human
uauuagauuuguuucuguagau

SEQ ID NO: 71615 - RNA, 22 nt, Human
uauuagcaaccaagagccucua

SEQ ID NO: 71616 - RNA, 22 nt, Human
uauuagcaacguaaccucugaa

SEQ ID NO: 71617 - RNA, 22 nt, Human
uauuagcacaaagcaagguauu

SEQ ID NO: 71618 - RNA, 22 nt, Human
uauuagcaguuguaugugucug

SEQ ID NO: 71619 - RNA, 21 nt, Human
uauuagcuucuggugcuguuu

SEQ ID NO: 71620 - RNA, 22 nt, Human
uauuagcuuuagccuuuggaug

SEQ ID NO: 71621 - RNA, 20 nt, Human
uauuaggaaggaggaaggaa

SEQ ID NO: 71622 - RNA, 22 nt, Human
uauuagguagauuuuacugauu

SEQ ID NO: 71623 - RNA, 22 nt, Human
uauuagguuggugcaaaaagua

SEQ ID NO: 71624 - RNA, 22 nt, Human
uauuagguuggugcaaaaguca

SEQ ID NO: 71625 - RNA, 22 nt, Human
uauuagugaaagaauuaguuug

SEQ ID NO: 71626 - RNA, 22 nt, Human
uauuaucagagcuauuuggaau

SEQ ID NO: 71627 - RNA, 22 nt, Human
uauuaucauguuaauuaguggg

SEQ ID NO: 71628 - RNA, 22 nt, Human
uauuaucauuaacuguugaauu

SEQ ID NO: 71629 - RNA, 22 nt, Human
uauuaucuaguaacugauagug

SEQ ID NO: 71630 - RNA, 22 nt, Human
uauuaugaggacugguguaagg

SEQ ID NO: 71631 - RNA, 22 nt, Human
uauuaugauucggacguggcag

SEQ ID NO: 71632 - RNA, 22 nt, Human
uauuauggcagcauucaguaug

SEQ ID NO: 71633 - RNA, 22 nt, Human
uauuauguaaagguuauugcag

SEQ ID NO: 71634 - RNA, 22 nt, Human
uauuauuaucuuugaaugggac

SEQ ID NO: 71635 - RNA, 22 nt, Human
uauuauugacauuuacuuggug

SEQ ID NO: 71636 - RNA, 19 nt, Human
uauuauuuguagcaaggcc

SEQ ID NO: 71637 - RNA, 22 nt, Human
uauucaaaguaccuucauugcc

SEQ ID NO: 71638 - RNA, 20 nt, Human
uauucaacuuuaaaaacuua

SEQ ID NO: 71639 - RNA, 22 nt, Human
uauucaagauugaacuggcaga

SEQ ID NO: 71640 - RNA, 22 nt, Human
uauucacaggcacgaaauauug

SEQ ID NO: 71641 - RNA, 22 nt, Human
uauucacaguugauuuacaguu

SEQ ID NO: 71642 - RNA, 22 nt, Human
uauucacauuaauaagucuuca

SEQ ID NO: 71643 - RNA, 22 nt, Human
uauucagaguauuccaugaggu

SEQ ID NO: 71644 - RNA, 22 nt, Human
uauucagauuacuugugccugc

SEQ ID NO: 71645 - RNA, 22 nt, Human
uauucaguggaaaauguguuga

SEQ ID NO: 71646 - RNA, 22 nt, Human
uauucaugacauugcauaugca

SEQ ID NO: 71647 - RNA, 22 nt, Human
uauucaugagauaggcaguuuu

SEQ ID NO: 71648 - RNA, 22 nt, Human
uauucaugggaggucacaacuu

SEQ ID NO: 71649 - RNA, 22 nt, Human
uauucauggggguccagguacc

SEQ ID NO: 71650 - RNA, 22 nt, Human
uauuccaaaaucccaaacugcc

SEQ ID NO: 71651 - RNA, 22 nt, Human
uauuccaagcacagcaacccag

SEQ ID NO: 71652 - RNA, 22 nt, Human
uauuccagguauucuucaagag

SEQ ID NO: 71653 - RNA, 22 nt, Human
uauuccuauuucuaaacauaug

SEQ ID NO: 71654 - RNA, 22 nt, Human
uauuccucccaguaaguacaac

SEQ ID NO: 71655 - RNA, 23 nt, Human
uauuccugguaagccugucacug

SEQ ID NO: 71656 - RNA, 22 nt, Human
uauuccugucaagaucuuacaa

SEQ ID NO: 71657 - RNA, 22 nt, Human
uauuccuuggcaaaaaauauau

SEQ ID NO: 71658 - RNA, 22 nt, Human
uauucucugcagcugaauguuu

SEQ ID NO: 71659 - RNA, 22 nt, Human
uauucugcuaagugauuucuac

SEQ ID NO: 71660 - RNA, 22 nt, Human
uauucuugacugcuuacuaugu

SEQ ID NO: 71661 - RNA, 22 nt, Human
uauucuuguauacuacaaucuu

SEQ ID NO: 71662 - RNA, 22 nt, Human
uauugacacuuuuuguguagcc

SEQ ID NO: 71663 - RNA, 22 nt, Human
uauugacagagggucagaagag

SEQ ID NO: 71664 - RNA, 22 nt, Human
uauugacagaugcauuauguug

SEQ ID NO: 71665 - RNA, 22 nt, Human
uauugagaacccucaggaggca

SEQ ID NO: 71666 - RNA, 23 nt, Human
uauugcacaaagagaugcacagg

SEQ ID NO: 71667 - RNA, 22 nt, Human
uauugcacaugcgcuagaacca

SEQ ID NO: 71668 - RNA, 21 nt, Human
uauugcauaacaaauuacccu

SEQ ID NO: 71669 - RNA, 22 nt, Human
uauugcaucuuaguguaaguca

SEQ ID NO: 71670 - RNA, 20 nt, Human
uauugccuaaauaccagaau

SEQ ID NO: 71671 - RNA, 22 nt, Human
uauugcuaugagcauuguucuu

SEQ ID NO: 71672 - RNA, 22 nt, Human
uauugcugaggauugaggcuug

SEQ ID NO: 71673 - RNA, 22 nt, Human
uauugcugccaggacccuaucc

SEQ ID NO: 71674 - RNA, 22 nt, Human
uauugcuuaaaaaauaugugag

SEQ ID NO: 71675 - RNA, 22 nt, Human
uauugcuuauaauuuguugcaa

SEQ ID NO: 71676 - RNA, 22 nt, Human
uauugcuuauucuugagaguca

SEQ ID NO: 71677 - RNA, 22 nt, Human
uauugcuucauaauuguugcca

SEQ ID NO: 71678 - RNA, 22 nt, Human
uauugcuuucucagacguuuag

SEQ ID NO: 71679 - RNA, 22 nt, Human
uauugcuuugugucauaagcaa

SEQ ID NO: 71680 - RNA, 22 nt, Human
uauuggaaugcacugggagaga

SEQ ID NO: 71681 - RNA, 22 nt, Human
uauuggaguauggggcuggagu

SEQ ID NO: 71682 - RNA, 20 nt, Human
uauuggaucuaagaaauggg

SEQ ID NO: 71683 - RNA, 22 nt, Human
uauuggaugaagaaaggaagga

SEQ ID NO: 71684 - RNA, 22 nt, Human
uauuggauugagacauuuuaga

SEQ ID NO: 71685 - RNA, 22 nt, Human
uauugguaggacucagcugaga

SEQ ID NO: 71686 - RNA, 22 nt, Human
uauugguaucugagacagaguu

SEQ ID NO: 71687 - RNA, 22 nt, Human
uauuguaucuucuguuuagaag

SEQ ID NO: 71688 - RNA, 22 nt, Human
uauugucugcaaagguuuauaa

SEQ ID NO: 71689 - RNA, 22 nt, Human
uauugugcucaccauuacaucc

SEQ ID NO: 71690 - RNA, 22 nt, Human
uauuuaaaauaagccccagugg

SEQ ID NO: 71691 - RNA, 22 nt, Human
uauuuaaccaguuaaauuucca

SEQ ID NO: 71692 - RNA, 22 nt, Human
uauuuaacuggaaacacaauga

SEQ ID NO: 71693 - RNA, 20 nt, Human
uauuuacaacuuagagccuc

SEQ ID NO: 71694 - RNA, 22 nt, Human
uauuuacccuggcagcuguagc

SEQ ID NO: 71695 - RNA, 19 nt, Human
uauuuacuucuugauugca

SEQ ID NO: 71696 - RNA, 22 nt, Human
uauuuagcuggagucagugcuu

SEQ ID NO: 71697 - RNA, 22 nt, Human
uauuuaucgagugucuacuaug

SEQ ID NO: 71698 - RNA, 22 nt, Human
uauuuauucauucagcaagcau

SEQ ID NO: 71699 - RNA, 22 nt, Human
uauuucaagaacuucuauccau

SEQ ID NO: 71700 - RNA, 22 nt, Human
uauuucaccucacccaggagaa

SEQ ID NO: 71701 - RNA, 22 nt, Human
uauuucaccuuacuaagcugug

SEQ ID NO: 71702 - RNA, 22 nt, Human
uauuucacuauucucuguaacu

SEQ ID NO: 71703 - RNA, 20 nt, Human
uauuucacucuccagauggc

SEQ ID NO: 71704 - RNA, 22 nt, Human
uauuucagacacugaucuugca

SEQ ID NO: 71705 - RNA, 22 nt, Human
uauuucagcacaugggauaggu

SEQ ID NO: 71706 - RNA, 22 nt, Human
uauuucagcccuacuacuuggc

SEQ ID NO: 71707 - RNA, 22 nt, Human
uauuucagcucuuuggauuauc

SEQ ID NO: 71708 - RNA, 22 nt, Human
uauuucaucuggaacaagguaa

SEQ ID NO: 71709 - RNA, 22 nt, Human
uauuuccauguuagaacuaagu

SEQ ID NO: 71710 - RNA, 22 nt, Human
ucaggagcagcaugggugagag

SEQ ID NO: 71711 - RNA, 20 nt, Human
ucaggagccuaggacaugau

SEQ ID NO: 71712 - RNA, 22 nt, Human
ucaggagcuauggacugucaaa

SEQ ID NO: 71713 - RNA, 22 nt, Human
ucaggaggagcucauaaguuug

SEQ ID NO: 71714 - RNA, 22 nt, Human
ucaggaggaugucggcaaauuu

SEQ ID NO: 71715 - RNA, 22 nt, Human
ucaggaggccggcaggauuuga

SEQ ID NO: 71716 - RNA, 22 nt, Human
ucaggaggcggugcugccuuug

SEQ ID NO: 71717 - RNA, 22 nt, Human
ucaggagggcuaagacuguagc

SEQ ID NO: 71718 - RNA, 22 nt, Human
ucaggagguaggacauacuggu

SEQ ID NO: 71719 - RNA, 22 nt, Human
ucaggagguccgcccgggaggg

SEQ ID NO: 71720 - RNA, 19 nt, Human
ucaggaggucgaccuggca

SEQ ID NO: 71721 - RNA, 22 nt, Human
ucaggaguaaggguaacccaga

SEQ ID NO: 71722 - RNA, 22 nt, Human
ucaggaguaaguuauaaguauu

SEQ ID NO: 71723 - RNA, 19 nt, Human
ucaggaguuaguugugcuc

SEQ ID NO: 71724 - RNA, 22 nt, Human
ucaggaguuucagguguaagug

SEQ ID NO: 71725 - RNA, 23 nt, Human
ucaggauauugugugccaaggug

SEQ ID NO: 71726 - RNA, 17 nt, Human
ucaggauccaggguucu

SEQ ID NO: 71727 - RNA, 22 nt, Human
ucaggaugaagucagagggguc

SEQ ID NO: 71728 - RNA, 22 nt, Human
ucaggaugagcucauaacuaug

SEQ ID NO: 71729 - RNA, 22 nt, Human
ucaggauggagggaagcacaga

SEQ ID NO: 71730 - RNA, 22 nt, Human
ucaggaugguccuuuaugagaa

SEQ ID NO: 71731 - RNA, 20 nt, Human
ucaggaugugcugagugaag

SEQ ID NO: 71732 - RNA, 22 nt, Human
ucaggcacccucuauuuucauc

SEQ ID NO: 71733 - RNA, 22 nt, Human
ucaggcacugcuuucugauaug

SEQ ID NO: 71734 - RNA, 23 nt, Human
ucaggcagcugggguaguuggag

SEQ ID NO: 71735 - RNA, 22 nt, Human
ucaggcaggaucccagggaagg

SEQ ID NO: 71736 - RNA, 22 nt, Human
ucaggcagguuggcugcagguc

SEQ ID NO: 71737 - RNA, 22 nt, Human
ucaggcagucugacuccggagg

SEQ ID NO: 71738 - RNA, 20 nt, Human
ucaggcaguggggaaaggca

SEQ ID NO: 71739 - RNA, 22 nt, Human
ucaggccacggcucacugagac

SEQ ID NO: 71740 - RNA, 22 nt, Human
ucaggcccagagucacggaucc

SEQ ID NO: 71741 - RNA, 22 nt, Human
ucaggccccaucccagacuuau

SEQ ID NO: 71742 - RNA, 22 nt, Human
ucaggccucaagcugcuuuaag

SEQ ID NO: 71743 - RNA, 22 nt, Human
ucaggccuggagaaaggaauga

SEQ ID NO: 71744 - RNA, 22 nt, Human
ucaggcuaagggagaggcgcuc

SEQ ID NO: 71745 - RNA, 22 nt, Human
ucaggcuagcccagugcuuggg

SEQ ID NO: 71746 - RNA, 22 nt, Human
ucaggcucccugcugggcucug

SEQ ID NO: 71747 - RNA, 22 nt, Human
ucaggcucucagaccaacagca

SEQ ID NO: 71748 - RNA, 22 nt, Human
ucaggcucugagcugaugcuaa

SEQ ID NO: 71749 - RNA, 22 nt, Human
uauauuuuagacacccucacgc

SEQ ID NO: 71750 - RNA, 22 nt, Human
uaucaaaguuguccugugaagu

SEQ ID NO: 71751 - RNA, 21 nt, Human
uaucaagauguuaugguugaa

SEQ ID NO: 71752 - RNA, 22 nt, Human
uaucaauaucucagugugcuuc

SEQ ID NO: 71753 - RNA, 22 nt, Human
uaucacacauaacuaagcugca

SEQ ID NO: 71754 - RNA, 22 nt, Human
uaucacacuagccuauagugga

SEQ ID NO: 71755 - RNA, 22 nt, Human
uaucacacucggaaaucuagga

SEQ ID NO: 71756 - RNA, 21 nt, Human
uaucacaguagaauaggaucu

SEQ ID NO: 71757 - RNA, 22 nt, Human
uaucaccagagggauagucucu

SEQ ID NO: 71758 - RNA, 22 nt, Human
uaucacugaccuguaucaguug

SEQ ID NO: 71759 - RNA, 18 nt, Human
uaucacugcugaacaaga

SEQ ID NO: 71760 - RNA, 22 nt, Human
uaucagaaacucuggggcaggg

SEQ ID NO: 71761 - RNA, 22 nt, Human
uaucagaacacagccacagcca

SEQ ID NO: 71762 - RNA, 22 nt, Human
uaucagaaggaagugccuuuaa

SEQ ID NO: 71763 - RNA, 22 nt, Human
uaucagcaggccaaagcugcaa

SEQ ID NO: 71764 - RNA, 22 nt, Human
uaucaggaggaaauuuccauug

SEQ ID NO: 71765 - RNA, 22 nt, Human
uaucaguaggguugaacuuugg

SEQ ID NO: 71766 - RNA, 22 nt, Human
uaucaguggucacaagauacau

SEQ ID NO: 71767 - RNA, 22 nt, Human
uaucagugugcaucucugaaug

SEQ ID NO: 71768 - RNA, 22 nt, Human
uaucauaaguuaauuaaacagu

SEQ ID NO: 71769 - RNA, 22 nt, Human
uaucaucacuguaauccguuga

SEQ ID NO: 71770 - RNA, 22 nt, Human
uaucaucugcaaagcacaucua

SEQ ID NO: 71771 - RNA, 22 nt, Human
uaucauguugaauuucugagaa

SEQ ID NO: 71772 - RNA, 22 nt, Human
uaucauuguguuugccagucac

SEQ ID NO: 71773 - RNA, 22 nt, Human
uaucauuuuacugugacauuuu

SEQ ID NO: 71774 - RNA, 22 nt, Human
uauccaaaguuucucagaaacu

SEQ ID NO: 71775 - RNA, 22 nt, Human
uauccacacucaaggggagggg

SEQ ID NO: 71776 - RNA, 22 nt, Human
uauccacguaugauaaaacucu

SEQ ID NO: 71777 - RNA, 22 nt, Human
uauccaggaggaacucauuuug

SEQ ID NO: 71778 - RNA, 22 nt, Human
uauccauaccacuacuucccuu

SEQ ID NO: 71779 - RNA, 22 nt, Human
uauccauaguuuauagaucaag

SEQ ID NO: 71780 - RNA, 22 nt, Human
uauccauggccaaucaaauaca

SEQ ID NO: 71781 - RNA, 22 nt, Human
uauccguuguuaccagauaaga

SEQ ID NO: 71782 - RNA, 21 nt, Human
uaucuacuggugucuuucaga

SEQ ID NO: 71783 - RNA, 22 nt, Human
uaucuagaaauuucuuuuguug

SEQ ID NO: 71784 - RNA, 22 nt, Human
uaucuagagcagugguucucaa

SEQ ID NO: 71785 - RNA, 22 nt, Human
uaucuagagccuggaagucuug

SEQ ID NO: 71786 - RNA, 22 nt, Human
uaucuagaguccugcugagaac

SEQ ID NO: 71787 - RNA, 22 nt, Human
uaucuagauggauuuuagugaa

SEQ ID NO: 71788 - RNA, 22 nt, Human
uaucuagcaaguaacaugcuga

SEQ ID NO: 71789 - RNA, 22 nt, Human
uaucuauguggugaucuuauuu

SEQ ID NO: 71790 - RNA, 22 nt, Human
uaucuauuccaaauaucagcgu

SEQ ID NO: 71791 - RNA, 22 nt, Human
uaucucuagcgcacagaagaaa

SEQ ID NO: 71792 - RNA, 22 nt, Human
uaucucuaggcugccacuuaaa

SEQ ID NO: 71793 - RNA, 22 nt, Human
uaucucuguuccaagccuuauc

SEQ ID NO: 71794 - RNA, 22 nt, Human
uaucucuugcaugcuuuuuaga

SEQ ID NO: 71795 - RNA, 22 nt, Human
uaucucuugucuguuuugcaaa

SEQ ID NO: 71796 - RNA, 22 nt, Human
uaucugaacaaccuuuauuacu

SEQ ID NO: 71797 - RNA, 22 nt, Human
uaucugcaucugcauguguauu

SEQ ID NO: 71798 - RNA, 22 nt, Human
uaucugggaaggggagaauaga

SEQ ID NO: 71799 - RNA, 17 nt, Human
uaucuguguuccuggcu

SEQ ID NO: 71800 - RNA, 22 nt, Human
uaucuguucauguuuauauguc

SEQ ID NO: 71801 - RNA, 22 nt, Human
uaucuguucuuagcuauagaug

SEQ ID NO: 71802 - RNA, 22 nt, Human
uaucuguuggcuuuggaaauaa

SEQ ID NO: 71803 - RNA, 22 nt, Human
uaucuguuguaguacagaugau

SEQ ID NO: 71804 - RNA, 22 nt, Human
uaucuguuguccaugcagaaag

SEQ ID NO: 71805 - RNA, 22 nt, Human
uaucuuacagacugaauguugg

SEQ ID NO: 71806 - RNA, 20 nt, Human
uaucuuacuuuagucauuug

SEQ ID NO: 71807 - RNA, 22 nt, Human
uaucuuagggaauuaacuaaaa

SEQ ID NO: 71808 - RNA, 22 nt, Human
uaucuucaauuuauucaaggag

SEQ ID NO: 71809 - RNA, 22 nt, Human
uaucuucucaguauaugggaug

SEQ ID NO: 71810 - RNA, 22 nt, Human
uaucuugagagacaacacagca

SEQ ID NO: 71811 - RNA, 22 nt, Human
uaucuuuagaggaagagaaucu

SEQ ID NO: 71812 - RNA, 22 nt, Human
uaucuuuauuaugucuaucugc

SEQ ID NO: 71813 - RNA, 22 nt, Human
uaucuuugaugccagauguuac

SEQ ID NO: 71814 - RNA, 22 nt, Human
uaucuuugguagcuuuccuaag

SEQ ID NO: 71815 - RNA, 22 nt, Human
uaugaaaagguggccaauguag

SEQ ID NO: 71816 - RNA, 22 nt, Human
uaugaacuguaacccucaccgc

SEQ ID NO: 71817 - RNA, 22 nt, Human
uaugaacuguacuguacuaagc

SEQ ID NO: 71818 - RNA, 22 nt, Human
uaugaacugugagugugauggg

SEQ ID NO: 71819 - RNA, 22 nt, Human
uauacacaccuccaaagcagga

SEQ ID NO: 71820 - RNA, 22 nt, Human
uauacacauauacguuugugug

SEQ ID NO: 71821 - RNA, 22 nt, Human
uauacacauccuccaaagauag

SEQ ID NO: 71822 - RNA, 23 nt, Human
uauacacauguggcaguauagug

SEQ ID NO: 71823 - RNA, 22 nt, Human
uauacacauguguguauucaua

SEQ ID NO: 71824 - RNA, 22 nt, Human
uauacagaaagaauucaagucu

SEQ ID NO: 71825 - RNA, 22 nt, Human
uauacagauaaugaagaccaag

SEQ ID NO: 71826 - RNA, 22 nt, Human
uauacagauaucuaagauguaa

SEQ ID NO: 71827 - RNA, 22 nt, Human
uauacagauuucugggcaaucu

SEQ ID NO: 71828 - RNA, 21 nt, Human
uauacaguaauuaagugguau

SEQ ID NO: 71829 - RNA, 21 nt, Human
uauacaugugcacacacaugc

SEQ ID NO: 71830 - RNA, 22 nt, Human
uauacauguuuuacauaaguga

SEQ ID NO: 71831 - RNA, 22 nt, Human
uauaccuuuaccuugaccaaau

SEQ ID NO: 71832 - RNA, 20 nt, Human
uauacuaacauauaucuguu

SEQ ID NO: 71833 - RNA, 22 nt, Human
uauacugucgcauuacacucac

SEQ ID NO: 71834 - RNA, 22 nt, Human
uauacuguguuuucaccacugu

SEQ ID NO: 71835 - RNA, 22 nt, Human
uauagacuuggcaugcauguuc

SEQ ID NO: 71836 - RNA, 22 nt, Human
uauagcaaaguacuaccaacuc

SEQ ID NO: 71837 - RNA, 22 nt, Human
uauagcaagcucuuuguaacca

SEQ ID NO: 71838 - RNA, 22 nt, Human
uauagcaagcuuugagcuuuca

SEQ ID NO: 71839 - RNA, 22 nt, Human
uauagcagcaugauuuauaguc

SEQ ID NO: 71840 - RNA, 22 nt, Human
uauagcauggcuauauuguugc

SEQ ID NO: 71841 - RNA, 22 nt, Human
uauaggaaacauacgugacuag

SEQ ID NO: 71842 - RNA, 22 nt, Human
uauaggaaauuuaucuccuggg

SEQ ID NO: 71843 - RNA, 22 nt, Human
uauaggaaggcagauuuuagcu

SEQ ID NO: 71844 - RNA, 22 nt, Human
uauaggacugaucacauuuuca

SEQ ID NO: 71845 - RNA, 22 nt, Human
uauagguacuuggaaaauaagg

SEQ ID NO: 71846 - RNA, 22 nt, Human
uauagguagccauauuugauag

SEQ ID NO: 71847 - RNA, 22 nt, Human
uauagugcauuauuuacaguaa

SEQ ID NO: 71848 - RNA, 22 nt, Human
uauaguuaguuucauaaucaug

SEQ ID NO: 71849 - RNA, 22 nt, Human
uauaguuucaugagcuuuuuaa

SEQ ID NO: 71850 - RNA, 18 nt, Human
uauauagagaaacccauu

SEQ ID NO: 71851 - RNA, 22 nt, Human
uauauauaugcacacacaccua

SEQ ID NO: 71852 - RNA, 22 nt, Human
uauauaugggggaagcuggaug

SEQ ID NO: 71853 - RNA, 22 nt, Human
uauaucaccaaaaacaguucug

SEQ ID NO: 71854 - RNA, 22 nt, Human
uauaucagcaaagcauuuaaaa

SEQ ID NO: 71855 - RNA, 22 nt, Human
uauauccauuugucugcuaauu

SEQ ID NO: 71856 - RNA, 22 nt, Human
uauaucuaggaacccugagauu

SEQ ID NO: 71857 - RNA, 22 nt, Human
uauaucuuauaugugcagguac

SEQ ID NO: 71858 - RNA, 22 nt, Human
uauaugcuaauggugccauucc

SEQ ID NO: 71859 - RNA, 22 nt, Human
uauauguaaauaagucuaaugu

SEQ ID NO: 71860 - RNA, 22 nt, Human
uauauguagucagucagaguaa

SEQ ID NO: 71861 - RNA, 20 nt, Human
uauauguguacauacacaca

SEQ ID NO: 71862 - RNA, 22 nt, Human
uauauguuucuuacaaaauauu

SEQ ID NO: 71863 - RNA, 22 nt, Human
uauauuaacacccacuugccuc

SEQ ID NO: 71864 - RNA, 22 nt, Human
ucaggcucuggguacaccugac

SEQ ID NO: 71865 - RNA, 22 nt, Human
ucaggcugaaucauccuagcuu

SEQ ID NO: 71866 - RNA, 22 nt, Human
ucaggcugauaggaggaacuga

SEQ ID NO: 71867 - RNA, 18 nt, Human
ucaggcugcccugugucu

SEQ ID NO: 71868 - RNA, 22 nt, Human
ucaggcuggaaugcaguggggc

SEQ ID NO: 71869 - RNA, 18 nt, Human
ucaggcugggccuccuuc

SEQ ID NO: 71870 - RNA, 22 nt, Human
ucaggcuguauaucuugcacuc

SEQ ID NO: 71871 - RNA, 22 nt, Human
ucaggcuuccaggcucugcuga

SEQ ID NO: 71872 - RNA, 22 nt, Human
ucaggcuugucucuagagcaau

SEQ ID NO: 71873 - RNA, 22 nt, Human
ucaggcuuugggaaugccacuu

SEQ ID NO: 71874 - RNA, 22 nt, Human
ucaggcuuuuccugccuccuac

SEQ ID NO: 71875 - RNA, 22 nt, Human
ucagggaaaacaucccgccuaa

SEQ ID NO: 71876 - RNA, 22 nt, Human
ucagggaaacagguuuucccuu

SEQ ID NO: 71877 - RNA, 22 nt, Human
ucagggaaauagcagggcugaa

SEQ ID NO: 71878 - RNA, 22 nt, Human
ucagggaaauuuccauguguuu

SEQ ID NO: 71879 - RNA, 21 nt, Human
ucagggaagugugcagaaggg

SEQ ID NO: 71880 - RNA, 19 nt, Human
ucagggaaguucaaagcuc

SEQ ID NO: 71881 - RNA, 22 nt, Human
ucagggaaucagacucugcagc

SEQ ID NO: 71882 - RNA, 17 nt, Human
ucagggaaugagguugu

SEQ ID NO: 71883 - RNA, 22 nt, Human
ucagggaaugaugcacacaguu

SEQ ID NO: 71884 - RNA, 22 nt, Human
ucagggaccaccacucacccag

SEQ ID NO: 71885 - RNA, 22 nt, Human
ucagggacugcagagggaagcu

SEQ ID NO: 71886 - RNA, 22 nt, Human
ucagggagagugacccauccac

SEQ ID NO: 71887 - RNA, 22 nt, Human
ucagggaguaguuugugcuaug

SEQ ID NO: 71888 - RNA, 22 nt, Human
ucagggcaaaagggaaaccauu

SEQ ID NO: 71889 - RNA, 22 nt, Human
ucagggcaaagggcagaguuug

SEQ ID NO: 71890 - RNA, 22 nt, Human
ucagggcaaugucccucagaag

SEQ ID NO: 71891 - RNA, 22 nt, Human
ucagggcacauucugcaguggc

SEQ ID NO: 71892 - RNA, 22 nt, Human
ucagggcaccaaaaaagaugcc

SEQ ID NO: 71893 - RNA, 22 nt, Human
ucagggcacugucaccugauau

SEQ ID NO: 71894 - RNA, 22 nt, Human
ucagggcagaauccaaagaauu

SEQ ID NO: 71895 - RNA, 22 nt, Human
ucagggcaggacaguguaggcc

SEQ ID NO: 71896 - RNA, 22 nt, Human
ucagggcaggcgagcagcugcu

SEQ ID NO: 71897 - RNA, 19 nt, Human
ucagggcaguccggucccc

SEQ ID NO: 71898 - RNA, 22 nt, Human
ucagggcauacucuucaagguc

SEQ ID NO: 71899 - RNA, 22 nt, Human
ucagggcccucacuugcauagg

SEQ ID NO: 71900 - RNA, 22 nt, Human
ucagggccggggcuguggcgag

SEQ ID NO: 71901 - RNA, 22 nt, Human
ucagggcucaccagccucugcc

SEQ ID NO: 71902 - RNA, 22 nt, Human
ucagggcuggcuuuugcagagc

SEQ ID NO: 71903 - RNA, 22 nt, Human
ucaggggagguugaaucgucuc

SEQ ID NO: 71904 - RNA, 21 nt, Human
ucaggggcuguguuuuccauc

SEQ ID NO: 71905 - RNA, 22 nt, Human
ucaggguaaaccuucacuguga

SEQ ID NO: 71906 - RNA, 22 nt, Human
ucagggucagauuccagagccu

SEQ ID NO: 71907 - RNA, 21 nt, Human
ucaggguucaaaggaacugau

SEQ ID NO: 71908 - RNA, 22 nt, Human
ucaggguugugguggaauucag

SEQ ID NO: 71909 - RNA, 22 nt, Human
ucaggguuucggcucaacagaa

SEQ ID NO: 71910 - RNA, 22 nt, Human
ucagguccaagauggccaucca

SEQ ID NO: 71911 - RNA, 22 nt, Human
ucagguccagcuccugugccuc

SEQ ID NO: 71912 - RNA, 22 nt, Human
ucagguccucugggucccagcc

SEQ ID NO: 71913 - RNA, 22 nt, Human
ucagguccuuacugugcucccu

SEQ ID NO: 71914 - RNA, 22 nt, Human
ucaggucuauacuaugagaggc

SEQ ID NO: 71915 - RNA, 22 nt, Human
ucaggucugggcacaugguaca

SEQ ID NO: 71916 - RNA, 22 nt, Human
ucaggucuguacuauugucuug

SEQ ID NO: 71917 - RNA, 22 nt, Human
ucaggucuugagccaucaggau

SEQ ID NO: 71918 - RNA, 20 nt, Human
ucaggugacacacguggcac

SEQ ID NO: 71919 - RNA, 22 nt, Human
ucaggugaccugagccacuaug

SEQ ID NO: 71920 - RNA, 22 nt, Human
ucagguggaauuaauuaagaga

SEQ ID NO: 71921 - RNA, 22 nt, Human
ucagguggcuuggagggggacg

SEQ ID NO: 71922 - RNA, 22 nt, Human
ucaggugggaccugcuaggaca

SEQ ID NO: 71923 - RNA, 22 nt, Human
ucaggugggcaguggguugagc

SEQ ID NO: 71924 - RNA, 22 nt, Human
ucaggugguccuaagugccauc

SEQ ID NO: 71925 - RNA, 22 nt, Human
ucagguguauugaugucuguga

SEQ ID NO: 71926 - RNA, 22 nt, Human
ucaggugucugccucuuugagu

SEQ ID NO: 71927 - RNA, 22 nt, Human
ucagguguucuccacucaguuu

SEQ ID NO: 71928 - RNA, 22 nt, Human
ucacauuuuccuugguaucugu

SEQ ID NO: 71929 - RNA, 22 nt, Human
ucacauuuucuuaggaaacuua

SEQ ID NO: 71930 - RNA, 22 nt, Human
ucacauuuuguucaaggcuagu

SEQ ID NO: 71931 - RNA, 22 nt, Human
ucaccacucacucaggcaaguc

SEQ ID NO: 71932 - RNA, 22 nt, Human
ucaccaggauuccuaucaguag

SEQ ID NO: 71933 - RNA, 22 nt, Human
ucaccaggcaacuauguacucc

SEQ ID NO: 71934 - RNA, 22 nt, Human
ucaccagggcuccagccagccu

SEQ ID NO: 71935 - RNA, 22 nt, Human
ucaccauacauaaauuacauug

SEQ ID NO: 71936 - RNA, 22 nt, Human
ucacccagacagcuugcacuga

SEQ ID NO: 71937 - RNA, 22 nt, Human
ucacccagcagcugcuucugcu

SEQ ID NO: 71938 - RNA, 22 nt, Human
ucacccccuguauuaguagcua

SEQ ID NO: 71939 - RNA, 22 nt, Human
ucaccccuacauuucccuugcu

SEQ ID NO: 71940 - RNA, 22 nt, Human
ucaccccuaccaaggagcacug

SEQ ID NO: 71941 - RNA, 22 nt, Human
ucaccggugacccucggcucgc

SEQ ID NO: 71942 - RNA, 22 nt, Human
ucaccucucuggccgucuaccu

SEQ ID NO: 71943 - RNA, 22 nt, Human
ucaccucuuuuuuaacaggcuu

SEQ ID NO: 71944 - RNA, 22 nt, Human
ucaccugggagggcugugguag

SEQ ID NO: 71945 - RNA, 22 nt, Human
ucaccuuaacaaucugaccauc

SEQ ID NO: 71946 - RNA, 22 nt, Human
ucaccuugaaugcagcagcgug

SEQ ID NO: 71947 - RNA, 22 nt, Human
ucaccuugugaucucccugccu

SEQ ID NO: 71948 - RNA, 21 nt, Human
ucacguggucacaugagcuuu

SEQ ID NO: 71949 - RNA, 22 nt, Human
ucacuacugacagagaugugua

SEQ ID NO: 71950 - RNA, 22 nt, Human
ucacuagugguuucuggugguu

SEQ ID NO: 71951 - RNA, 22 nt, Human
ucacuaugcccagaauacaguu

SEQ ID NO: 71952 - RNA, 22 nt, Human
ucacuauguucggagaacucug

SEQ ID NO: 71953 - RNA, 22 nt, Human
ucacucaauaucccaguggggc

SEQ ID NO: 71954 - RNA, 22 nt, Human
ucacucagagauagccucauuu

SEQ ID NO: 71955 - RNA, 22 nt, Human
ucacucagccugccugguuccu

SEQ ID NO: 71956 - RNA, 22 nt, Human
ucacuccaaaccccaggcuugu

SEQ ID NO: 71957 - RNA, 22 nt, Human
ucacuccauagcuuaacucuuu

SEQ ID NO: 71958 - RNA, 19 nt, Human
ucacucucccugucugucc

SEQ ID NO: 71959 - RNA, 22 nt, Human
ucacucugauagauaagcuaac

SEQ ID NO: 71960 - RNA, 20 nt, Human
ucacucugaugcuagggugg

SEQ ID NO: 71961 - RNA, 21 nt, Human
ucacucugauuaggugucucu

SEQ ID NO: 71962 - RNA, 22 nt, Human
ucacucugguccauccgagagc

SEQ ID NO: 71963 - RNA, 22 nt, Human
ucacucuguguuucccugggac

SEQ ID NO: 71964 - RNA, 22 nt, Human
ucacugcaaggaggcuucucaa

SEQ ID NO: 71965 - RNA, 22 nt, Human
ucacugcagguuuuucaggagg

SEQ ID NO: 71966 - RNA, 22 nt, Human
ucacugcucagucuguacuaca

SEQ ID NO: 71967 - RNA, 22 nt, Human
ucacugcugcugccaugaugga

SEQ ID NO: 71968 - RNA, 22 nt, Human
ucacugcuuaacucaagaucuc

SEQ ID NO: 71969 - RNA, 22 nt, Human
ucacugcuucuuggagaauguc

SEQ ID NO: 71970 - RNA, 22 nt, Human
ucacugcuuugagccacugagc

SEQ ID NO: 71971 - RNA, 22 nt, Human
ucacuggauccuagcugagccu

SEQ ID NO: 71972 - RNA, 22 nt, Human
ucacuggauuaguuugaacugu

SEQ ID NO: 71973 - RNA, 22 nt, Human
ucacuggcaacuugugcucccu

SEQ ID NO: 71974 - RNA, 18 nt, Human
ucacugggagaagauauu

SEQ ID NO: 71975 - RNA, 22 nt, Human
ucacuggggccuuuggucagga

SEQ ID NO: 71976 - RNA, 22 nt, Human
ucacuguaaaguaauacuguca

SEQ ID NO: 71977 - RNA, 22 nt, Human
ucacuguagugagcagaauaua

SEQ ID NO: 71978 - RNA, 22 nt, Human
ucacugugcacauaugauaggu

SEQ ID NO: 71979 - RNA, 22 nt, Human
ucacugugguauauauguauca

SEQ ID NO: 71980 - RNA, 18 nt, Human
ucacugugugucuugggu

SEQ ID NO: 71981 - RNA, 22 nt, Human
ucacuguuaauaaauagcaaag

SEQ ID NO: 71982 - RNA, 22 nt, Human
ucacuguuagagcaaacguaug

SEQ ID NO: 71983 - RNA, 22 nt, Human
ucacuguugaccuggaaguggg

SEQ ID NO: 71984 - RNA, 22 nt, Human
ucacuguuuccuguacuggaca

SEQ ID NO: 71985 - RNA, 22 nt, Human
ucacuuaaaaauucuaguuaug

SEQ ID NO: 71986 - RNA, 22 nt, Human
ucacuuauaaaaugcaagaucu

SEQ ID NO: 71987 - RNA, 21 nt, Human
ucacuuauaauguauuugcug

SEQ ID NO: 71988 - RNA, 22 nt, Human
ucacuucacacccacuaucaug

SEQ ID NO: 71989 - RNA, 22 nt, Human
ucacuugaaccugggaggcaga

SEQ ID NO: 71990 - RNA, 19 nt, Human
ucacuugaaguucagaaau

SEQ ID NO: 71991 - RNA, 22 nt, Human
ucacuugaauucauucugcgaa

SEQ ID NO: 71992 - RNA, 22 nt, Human
ucacuugacccuucucuagccu

SEQ ID NO: 71993 - RNA, 22 nt, Human
ucacuugccuagcccaguucag

SEQ ID NO: 71994 - RNA, 22 nt, Human
ucacuuuacagcuaagguuguu

SEQ ID NO: 71995 - RNA, 22 nt, Human
ucacuuuacuuuguuaaucugg

SEQ ID NO: 71996 - RNA, 22 nt, Human
ucacuuugcccuguaccuuggg

SEQ ID NO: 71997 - RNA, 22 nt, Human
ucacuuuggaagauagcacauc

SEQ ID NO: 71998 - RNA, 22 nt, Human
ucacuuuggauuauguaauuuc

SEQ ID NO: 71999 - RNA, 22 nt, Human
ucacuuuuggguuuccaguaga

SEQ ID NO: 72000 - RNA, 22 nt, Human
ucagaaaagaccacauuauucu

SEQ ID NO: 72001 - RNA, 22 nt, Human
ucagaaacagaaacuaagaacc

SEQ ID NO: 72002 - RNA, 22 nt, Human
ucagaaaggccacauggugcag

SEQ ID NO: 72003 - RNA, 22 nt, Human
ucagaaaucuugucaaggcauc

SEQ ID NO: 72004 - RNA, 23 nt, Human
ucagaacaaugccuuaggggcau

SEQ ID NO: 72005 - RNA, 21 nt, Human
ucagaacaauuccaugccucc

SEQ ID NO: 72006 - RNA, 22 nt, Human
ucagaacaauugggaaccauua

SEQ ID NO: 72007 - RNA, 22 nt, Human
ucagaacagcaggguguggcug

SEQ ID NO: 72008 - RNA, 22 nt, Human
ucagaacagcucucagauaucc

SEQ ID NO: 72009 - RNA, 22 nt, Human
ucagaacaguucuuaauauugc

SEQ ID NO: 72010 - RNA, 22 nt, Human
ucagaacauccugguuuaaaau

SEQ ID NO: 72011 - RNA, 22 nt, Human
ucagaacauguuugaguaagac

SEQ ID NO: 72012 - RNA, 22 nt, Human
ucagaacauucucauugacugc

SEQ ID NO: 72013 - RNA, 22 nt, Human
ucagaacuacauggacauguua

SEQ ID NO: 72014 - RNA, 21 nt, Human
ucagaagagcugccucuuggu

SEQ ID NO: 72015 - RNA, 22 nt, Human
ucagacccaggugccaagcugu

SEQ ID NO: 72016 - RNA, 20 nt, Human
ucagacuugauucuaugcua

SEQ ID NO: 72017 - RNA, 22 nt, Human
ucagagaaauaauugcugaguu

SEQ ID NO: 72018 - RNA, 22 nt, Human
ucagagaacuccacaccuuagg

SEQ ID NO: 72019 - RNA, 23 nt, Human
ucagagaacucgggcagaugacc

SEQ ID NO: 72020 - RNA, 22 nt, Human
ucagagaacugcagcccuuccu

SEQ ID NO: 72021 - RNA, 20 nt, Human
ucagagaaggagcuuuccug

SEQ ID NO: 72022 - RNA, 22 nt, Human
ucagagaagguaagugaccugc

SEQ ID NO: 72023 - RNA, 23 nt, Human
ucagagaaguuguaggcugggga

SEQ ID NO: 72024 - RNA, 22 nt, Human
ucagagaaucucuccuuaguuu

SEQ ID NO: 72025 - RNA, 22 nt, Human
ucagagaauucucagaugacuc

SEQ ID NO: 72026 - RNA, 22 nt, Human
ucagagaauuguuuaauggaau

SEQ ID NO: 72027 - RNA, 22 nt, Human
ucagagacuggucugcagaugc

SEQ ID NO: 72028 - RNA, 22 nt, Human
ucagagacuguaggagcagccu

SEQ ID NO: 72029 - RNA, 18 nt, Human
ucagagagaauaguaauu

SEQ ID NO: 72030 - RNA, 20 nt, Human
ucagagagagggugccacuu

SEQ ID NO: 72031 - RNA, 22 nt, Human
ucagagagcuggugggcagagg

SEQ ID NO: 72032 - RNA, 22 nt, Human
ucagagagguuaaauaucuugu

SEQ ID NO: 72033 - RNA, 22 nt, Human
ucagagaguccuggucauuugc

SEQ ID NO: 72034 - RNA, 22 nt, Human
ucagagaguuacacaaauuguu

SEQ ID NO: 72035 - RNA, 22 nt, Human
ucagagauucacgucaguccca

SEQ ID NO: 72036 - RNA, 23 nt, Human
ucagagcaagaugauguaugagc

SEQ ID NO: 72037 - RNA, 22 nt, Human
ucagcuggauguggaagugcua

SEQ ID NO: 72038 - RNA, 19 nt, Human
ucagcuggcaggccuccuc

SEQ ID NO: 72039 - RNA, 22 nt, Human
ucagcuggcaguucagaggcug

SEQ ID NO: 72040 - RNA, 22 nt, Human
ucagcuggcaucggcucaccca

SEQ ID NO: 72041 - RNA, 22 nt, Human
ucagcuggugaguggauagaca

SEQ ID NO: 72042 - RNA, 22 nt, Human
ucagcugugauccaucuaucua

SEQ ID NO: 72043 - RNA, 22 nt, Human
ucagcuucgccugagguauggg

SEQ ID NO: 72044 - RNA, 22 nt, Human
ucagcuuggacagcuugguuga

SEQ ID NO: 72045 - RNA, 22 nt, Human
ucagcuugggaaauugagcaag

SEQ ID NO: 72046 - RNA, 22 nt, Human
ucagcuuguuuaugauaagcag

SEQ ID NO: 72047 - RNA, 22 nt, Human
ucagcuuuccugcagcuaaggg

SEQ ID NO: 72048 - RNA, 22 nt, Human
ucagcuuugcaaguuagaaaau

SEQ ID NO: 72049 - RNA, 22 nt, Human
ucagcuuugggggucucaggag

SEQ ID NO: 72050 - RNA, 22 nt, Human
ucagcuuuuaaaaacaagaagu

SEQ ID NO: 72051 - RNA, 18 nt, Human
ucagcuuuugaaaaccaa

SEQ ID NO: 72052 - RNA, 22 nt, Human
ucagcuuuuuggauugcccaag

SEQ ID NO: 72053 - RNA, 22 nt, Human
ucaggaaaggcagagugucugu

SEQ ID NO: 72054 - RNA, 22 nt, Human
ucaggaaauggaauucuugugu

SEQ ID NO: 72055 - RNA, 22 nt, Human
ucaggaaauggacaucuuugcu

SEQ ID NO: 72056 - RNA, 22 nt, Human
ucaggaacagaauuuucuaaaa

SEQ ID NO: 72057 - RNA, 22 nt, Human
ucaggaacauuuaaccacaggg

SEQ ID NO: 72058 - RNA, 22 nt, Human
ucaggaagauuaguuuccuacc

SEQ ID NO: 72059 - RNA, 22 nt, Human
ucaggaagccgguuaaauagau

SEQ ID NO: 72060 - RNA, 22 nt, Human
ucaggaagcugaauuacaaaaa

SEQ ID NO: 72061 - RNA, 22 nt, Human
ucaggaagcugcucuggguggu

SEQ ID NO: 72062 - RNA, 22 nt, Human
ucaggaaggagcuggccugcca

SEQ ID NO: 72063 - RNA, 22 nt, Human
ucaggaaggcaaauugcaugau

SEQ ID NO: 72064 - RNA, 22 nt, Human
ucaggaaggcuucacacgagug

SEQ ID NO: 72065 - RNA, 22 nt, Human
ucaggaagggugguccacaggg

SEQ ID NO: 72066 - RNA, 22 nt, Human
ucaggaauccagacagggcaca

SEQ ID NO: 72067 - RNA, 22 nt, Human
ucaggacaacauguugcuaauc

SEQ ID NO: 72068 - RNA, 22 nt, Human
ucaggacagaaggcugccaggg

SEQ ID NO: 72069 - RNA, 22 nt, Human
ucaggacagccagggugcagac

SEQ ID NO: 72070 - RNA, 22 nt, Human
ucaggagaacuuccuucuaccc

SEQ ID NO: 72071 - RNA, 22 nt, Human
ucaggagagaaagaauacaauu

SEQ ID NO: 72072 - RNA, 22 nt, Human
ucaggagcagcuguaggaaggg

SEQ ID NO: 72073 - RNA, 19 nt, Human
ucaggagcagcuucugaac

SEQ ID NO: 72074 - RNA, 22 nt, Human
ucaggagcucuucccuggugug

SEQ ID NO: 72075 - RNA, 22 nt, Human
ucaggagcugugaauacaaagg

SEQ ID NO: 72076 - RNA, 22 nt, Human
ucaggaggccaccaggaccugu

SEQ ID NO: 72077 - RNA, 22 nt, Human
ucaggaggcgucucgcuggggc

SEQ ID NO: 72078 - RNA, 22 nt, Human
ucaggaggcgugcugggguaca

SEQ ID NO: 72079 - RNA, 22 nt, Human
ucaggagggucucuauuuuccu

SEQ ID NO: 72080 - RNA, 22 nt, Human
ucaggagggugacaggcccugg

SEQ ID NO: 72081 - RNA, 22 nt, Human
ucaggagguguaacgaauacag

SEQ ID NO: 72082 - RNA, 22 nt, Human
ucaggagguuuggauucaguua

SEQ ID NO: 72083 - RNA, 22 nt, Human
ucaggaguccugccugcagccu

SEQ ID NO: 72084 - RNA, 22 nt, Human
ucaggagucugugcaguuccac

SEQ ID NO: 72085 - RNA, 18 nt, Human
ucaggaguuuguggaugg

SEQ ID NO: 72086 - RNA, 22 nt, Human
ucaggauggcacccaagcucuu

SEQ ID NO: 72087 - RNA, 22 nt, Human
ucaggauggcuucugcaucaaa

SEQ ID NO: 72088 - RNA, 22 nt, Human
ucaggaugguguggaggaaaua

SEQ ID NO: 72089 - RNA, 22 nt, Human
ucaggauguccaaaauccagcc

SEQ ID NO: 72090 - RNA, 22 nt, Human
ucaggcaaggcccuuagagugu

SEQ ID NO: 72091 - RNA, 22 nt, Human
ucaggcaccccuugaguagggg

SEQ ID NO: 72092 - RNA, 22 nt, Human
ucaggcagaauuaucaaaagau

SEQ ID NO: 72093 - RNA, 22 nt, Human
ucaggcagagggagaagccaag

SEQ ID NO: 72094 - RNA, 22 nt, Human
ucaggcagcauuaaacuucagc

SEQ ID NO: 72095 - RNA, 22 nt, Human
ucaggcagcuccaggaauggua

SEQ ID NO: 72096 - RNA, 22 nt, Human
ucaggcaggaagggaggacuug

SEQ ID NO: 72097 - RNA, 22 nt, Human
ucaggcaggacaauuauuuagg

SEQ ID NO: 72098 - RNA, 21 nt, Human
ucaggcaggcgcagagggaag

SEQ ID NO: 72099 - RNA, 22 nt, Human
ucaggcaguagaauugcuugaa

SEQ ID NO: 72100 - RNA, 22 nt, Human
ucaggcagugguaaaugaguua

SEQ ID NO: 72101 - RNA, 22 nt, Human
ucaggcaugcauucugcagguu

SEQ ID NO: 72102 - RNA, 22 nt, Human
ucaggccaagguagacaugacu

SEQ ID NO: 72103 - RNA, 22 nt, Human
ucaggccacuucacaggugauu

SEQ ID NO: 72104 - RNA, 22 nt, Human
ucaggccaggagaucagauuga

SEQ ID NO: 72105 - RNA, 22 nt, Human
ucaggccccuugucagcucugu

SEQ ID NO: 72106 - RNA, 22 nt, Human
ucaggcccuucucccaggacuc

SEQ ID NO: 72107 - RNA, 22 nt, Human
ucaggccugcaaggagaguccc

SEQ ID NO: 72108 - RNA, 22 nt, Human
ucaggccugcaggcuuccugga

SEQ ID NO: 72109 - RNA, 22 nt, Human
ucaggcucaggaauguguuuau

SEQ ID NO: 72110 - RNA, 20 nt, Human
ucaggcuccgcauuaacuua

SEQ ID NO: 72111 - RNA, 22 nt, Human
ucaggcucuacacuugacacac

SEQ ID NO: 72112 - RNA, 18 nt, Human
ucaggcucucuggcuaga

SEQ ID NO: 72113 - RNA, 21 nt, Human
ucaggcugaugucgauguuag

SEQ ID NO: 72114 - RNA, 22 nt, Human
ucaggcugcaguggcaaaagac

SEQ ID NO: 72115 - RNA, 22 nt, Human
ucaggcugcuggccagcaggcu

SEQ ID NO: 72116 - RNA, 22 nt, Human
ucaggcuggggugcuaaggugu

SEQ ID NO: 72117 - RNA, 17 nt, Human
ucaggcugggugcagug

SEQ ID NO: 72118 - RNA, 22 nt, Human
ucaggcugguccccacagugga

SEQ ID NO: 72119 - RNA, 22 nt, Human
ucaggcuguaaauggugugggu

SEQ ID NO: 72120 - RNA, 22 nt, Human
ucaggcuguagggccccuggag

SEQ ID NO: 72121 - RNA, 22 nt, Human
ucaggcugugggcacuggccau

SEQ ID NO: 72122 - RNA, 22 nt, Human
ucaggcugugucuuuaaacaau

SEQ ID NO: 72123 - RNA, 22 nt, Human
ucaggcuguuccuguccaaaau

SEQ ID NO: 72124 - RNA, 22 nt, Human
ucaggcuuauuacguuauuguc

SEQ ID NO: 72125 - RNA, 22 nt, Human
ucaggcuugggaggcccagggc

SEQ ID NO: 72126 - RNA, 22 nt, Human
ucaggcuuugcucuguugauuu

SEQ ID NO: 72127 - RNA, 22 nt, Human
ucaggcuuugggucaggcucug

SEQ ID NO: 72128 - RNA, 22 nt, Human
ucaggcuuuucuucccucagug

SEQ ID NO: 72129 - RNA, 22 nt, Human
ucagggaaaagucacacugggu

SEQ ID NO: 72130 - RNA, 22 nt, Human
ucagggaaaggggagagucauu

SEQ ID NO: 72131 - RNA, 22 nt, Human
ucagggaacaucguuaaacuag

SEQ ID NO: 72132 - RNA, 22 nt, Human
ucagggaaugggcccagucccu

SEQ ID NO: 72133 - RNA, 22 nt, Human
ucagcaaaggcaauucauuauu

SEQ ID NO: 72134 - RNA, 22 nt, Human
ucagcaaccaggggcacagucc

SEQ ID NO: 72135 - RNA, 22 nt, Human
ucagcaaggcagaagggaggua

SEQ ID NO: 72136 - RNA, 22 nt, Human
ucagcaaguggaccauccuggg

SEQ ID NO: 72137 - RNA, 22 nt, Human
ucagcacugaaucuggauuugc

SEQ ID NO: 72138 - RNA, 22 nt, Human
ucagcacugauagaagucaaua

SEQ ID NO: 72139 - RNA, 22 nt, Human
ucagcacuggcgcugggcaggu

SEQ ID NO: 72140 - RNA, 22 nt, Human
ucagcacuguguccagucuccc

SEQ ID NO: 72141 - RNA, 22 nt, Human
ucagcacuuggauuucagagau

SEQ ID NO: 72142 - RNA, 22 nt, Human
ucagcacuuuuuaaagcagcau

SEQ ID NO: 72143 - RNA, 21 nt, Human
ucagcagaaagcaaggucagu

SEQ ID NO: 72144 - RNA, 21 nt, Human
ucagcagaaggaccacuaggg

SEQ ID NO: 72145 - RNA, 22 nt, Human
ucagcagaaguauagaggccau

SEQ ID NO: 72146 - RNA, 22 nt, Human
uggucaggauucucagcccuuc

SEQ ID NO: 72147 - RNA, 22 nt, Human
uggucagguaccucuggcuguc

SEQ ID NO: 72148 - RNA, 22 nt, Human
uggucauugcuauuguuucuca

SEQ ID NO: 72149 - RNA, 17 nt, Human
uggucauuuuaauuuua

SEQ ID NO: 72150 - RNA, 19 nt, Human
ugguccagcuucuucuccu

SEQ ID NO: 72151 - RNA, 22 nt, Human
ugguccaggcacccuucuagag

SEQ ID NO: 72152 - RNA, 17 nt, Human
ugguccagguggagcca

SEQ ID NO: 72153 - RNA, 22 nt, Human
ugguccaguaaggguggagaga

SEQ ID NO: 72154 - RNA, 22 nt, Human
ugguccagucguuccuuuccuu

SEQ ID NO: 72155 - RNA, 22 nt, Human
ugguccagugacagauaggcac

SEQ ID NO: 72156 - RNA, 18 nt, Human
ugguccaguucagauaua

SEQ ID NO: 72157 - RNA, 22 nt, Human
ugguccaguucugugauauugc

SEQ ID NO: 72158 - RNA, 22 nt, Human
ugguccaugcccacggaaugug

SEQ ID NO: 72159 - RNA, 22 nt, Human
uggucccuagugugggagcuug

SEQ ID NO: 72160 - RNA, 23 nt, Human
uggucccugagagcuggggaggg

SEQ ID NO: 72161 - RNA, 22 nt, Human
ugguccucagguucucugugcg

SEQ ID NO: 72162 - RNA, 22 nt, Human
ugguccugcaguaauagacauc

SEQ ID NO: 72163 - RNA, 22 nt, Human
ugguccuggccuugaccccagg

SEQ ID NO: 72164 - RNA, 22 nt, Human
ugguccugggcacaguauaugc

SEQ ID NO: 72165 - RNA, 22 nt, Human
ugguccuggggaucugcaguga

SEQ ID NO: 72166 - RNA, 22 nt, Human
ugguccuggggugcaggcugac

SEQ ID NO: 72167 - RNA, 22 nt, Human
ugguccuguagcacuugauuag

SEQ ID NO: 72168 - RNA, 22 nt, Human
uggucucuacggaggaaagcug

SEQ ID NO: 72169 - RNA, 22 nt, Human
uggucucuccaugcccuccacc

SEQ ID NO: 72170 - RNA, 22 nt, Human
uggucucugacucugaagaccc

SEQ ID NO: 72171 - RNA, 22 nt, Human
uggucucuguaggcuaccccau

SEQ ID NO: 72172 - RNA, 22 nt, Human
uggucucuucuuccaagauggc

SEQ ID NO: 72173 - RNA, 22 nt, Human
uggucugaaggacuucugaggg

SEQ ID NO: 72174 - RNA, 21 nt, Human
uccagggaacuucucaggaau

SEQ ID NO: 72175 - RNA, 22 nt, Human
uccagggaccucccugagagcu

SEQ ID NO: 72176 - RNA, 22 nt, Human
uccagggagagccgcugcucca

SEQ ID NO: 72177 - RNA, 22 nt, Human
uccagggagauacuggcugcca

SEQ ID NO: 72178 - RNA, 22 nt, Human
uccagggagauggcagaggcug

SEQ ID NO: 72179 - RNA, 22 nt, Human
uccagggaguuggcuggauagu

SEQ ID NO: 72180 - RNA, 23 nt, Human
uccagggauuaaugaagucaguc

SEQ ID NO: 72181 - RNA, 22 nt, Human
uccagggcagccgcgggugcgc

SEQ ID NO: 72182 - RNA, 19 nt, Human
uccagggcaggaacaugua

SEQ ID NO: 72183 - RNA, 22 nt, Human
uccagggcagugacuacagcgg

SEQ ID NO: 72184 - RNA, 22 nt, Human
uccagggcauccacgcgugggg

SEQ ID NO: 72185 - RNA, 21 nt, Human
uccagggcgggcgcacggaga

SEQ ID NO: 72186 - RNA, 22 nt, Human
uccagggcuacaaggcaccaga

SEQ ID NO: 72187 - RNA, 22 nt, Human
uccagggcuccccaacauccag

SEQ ID NO: 72188 - RNA, 22 nt, Human
uccagggcuguuacuuuacaua

SEQ ID NO: 72189 - RNA, 19 nt, Human
uccagggcuuuauggcuuu

SEQ ID NO: 72190 - RNA, 22 nt, Human
uccaggggagacuagacccaca

SEQ ID NO: 72191 - RNA, 22 nt, Human
uccaggggagugcuacgcacag

SEQ ID NO: 72192 - RNA, 22 nt, Human
uccagggguaccggccaggcag

SEQ ID NO: 72193 - RNA, 22 nt, Human
uccagggucagaagucacauac

SEQ ID NO: 72194 - RNA, 21 nt, Human
uccagggucagaaguucagug

SEQ ID NO: 72195 - RNA, 20 nt, Human
uccagguaacaucucucugg

SEQ ID NO: 72196 - RNA, 22 nt, Human
uccagguagauuuauuccagcc

SEQ ID NO: 72197 - RNA, 22 nt, Human
uccaggucaucuuggagagcug

SEQ ID NO: 72198 - RNA, 22 nt, Human
uccaggucccagacugggcagc

SEQ ID NO: 72199 - RNA, 22 nt, Human
uccagguccuacuggcccauag

SEQ ID NO: 72200 - RNA, 22 nt, Human
uccaggugagugcaggugcaga

SEQ ID NO: 72201 - RNA, 22 nt, Human
uccaggugccggggacugaggc

SEQ ID NO: 72202 - RNA, 23 nt, Human
uccaguagggagucugcuuacuu

SEQ ID NO: 72203 - RNA, 20 nt, Human
uccaguauguuauuuggugu

SEQ ID NO: 72204 - RNA, 22 nt, Human
uccagucaggcugaauucaagg

SEQ ID NO: 72205 - RNA, 22 nt, Human
uccagucaucucccuucacauu

SEQ ID NO: 72206 - RNA, 22 nt, Human
uccaguccagggaauggcugau

SEQ ID NO: 72207 - RNA, 18 nt, Human
uccagucccaaggccagc

SEQ ID NO: 72208 - RNA, 18 nt, Human
uccagucccagcucugcc

SEQ ID NO: 72209 - RNA, 22 nt, Human
uccagucugguaugaauccuag

SEQ ID NO: 72210 - RNA, 22 nt, Human
uccagugcuggaccagagcacc

SEQ ID NO: 72211 - RNA, 22 nt, Human
uccagugcuguuuccaauguaa

SEQ ID NO: 72212 - RNA, 22 nt, Human
uccaguggaacagauguugccu

SEQ ID NO: 72213 - RNA, 22 nt, Human
uccaguggagugugggggugaa

SEQ ID NO: 72214 - RNA, 22 nt, Human
uccaguggcacuggagacuaga

SEQ ID NO: 72215 - RNA, 19 nt, Human
uccaguguagcuggucauu

SEQ ID NO: 72216 - RNA, 22 nt, Human
uccaguguguguccagcugcug

SEQ ID NO: 72217 - RNA, 16 nt, Human
uccaguguuccuggau

SEQ ID NO: 72218 - RNA, 22 nt, Human
uccaguguugucagaucaucug

SEQ ID NO: 72219 - RNA, 23 nt, Human
uccaguuaaugguucccagucug

SEQ ID NO: 72220 - RNA, 22 nt, Human
uccaguucuaggucacucucug

SEQ ID NO: 72221 - RNA, 22 nt, Human
uccaguuugcacuguauaauag

SEQ ID NO: 72222 - RNA, 22 nt, Human
uccauaaaccagaaaaucaaga

SEQ ID NO: 72223 - RNA, 19 nt, Human
uccauaaugaagauagagg

SEQ ID NO: 72224 - RNA, 17 nt, Human
uccauacaauucucucu

SEQ ID NO: 72225 - RNA, 22 nt, Human
uccauacauacagauaugcauu

SEQ ID NO: 72226 - RNA, 22 nt, Human
uccauacccagcuuucucacac

SEQ ID NO: 72227 - RNA, 23 nt, Human
uccauacucuaaacauguuauuu

SEQ ID NO: 72228 - RNA, 22 nt, Human
uccauauaaugggauuccuuau

SEQ ID NO: 72229 - RNA, 22 nt, Human
uccauauaccugcagccugguu

SEQ ID NO: 72230 - RNA, 22 nt, Human
uccauauuaacuaaaacuagaa

SEQ ID NO: 72231 - RNA, 22 nt, Human
uccaucagcaugcaggcuguuc

SEQ ID NO: 72232 - RNA, 22 nt, Human
uccauccauaccacuuggagac

SEQ ID NO: 72233 - RNA, 22 nt, Human
uccaucuacggcuauaccaccc

SEQ ID NO: 72234 - RNA, 22 nt, Human
uccaucuggaugguauguguaa

SEQ ID NO: 72235 - RNA, 22 nt, Human
uccaucugguaaaauucauuga

SEQ ID NO: 72236 - RNA, 20 nt, Human
uccaugaguuagagacuaua

SEQ ID NO: 72237 - RNA, 22 nt, Human
uccaugaguuugaggaaaagag

SEQ ID NO: 72238 - RNA, 22 nt, Human
uccaugcagcagccucccagcc

SEQ ID NO: 72239 - RNA, 22 nt, Human
uccaugcucuugucuagccucc

SEQ ID NO: 72240 - RNA, 22 nt, Human
uccaugggaagauuuugagugg

SEQ ID NO: 72241 - RNA, 22 nt, Human
uccauggggcccaggaugagag

SEQ ID NO: 72242 - RNA, 22 nt, Human
uccauggguagcccugguugag

SEQ ID NO: 72243 - RNA, 22 nt, Human
uccaugugcuuccucaggggaa

SEQ ID NO: 72244 - RNA, 22 nt, Human
uccauguggcaauaggagacag

SEQ ID NO: 72245 - RNA, 22 nt, Human
uccauguuagguaaaggcacug

SEQ ID NO: 72246 - RNA, 22 nt, Human
uccauguuucagcaucuacauc

SEQ ID NO: 72247 - RNA, 22 nt, Human
uccauucuaugcuuacauuuau

SEQ ID NO: 72248 - RNA, 22 nt, Human
uccauugucuuugguccuagcc

SEQ ID NO: 72249 - RNA, 22 nt, Human
uccauugugauuauauacaaaa

SEQ ID NO: 72250 - RNA, 22 nt, Human
uccauuguguuacagagcauuc

SEQ ID NO: 72251 - RNA, 22 nt, Human
uccauuuggccucuguauugua

SEQ ID NO: 72252 - RNA, 22 nt, Human
uccauuuuagagaugaagaaac

SEQ ID NO: 72253 - RNA, 22 nt, Human
uccauuuucaucucauguauaa

SEQ ID NO: 72254 - RNA, 22 nt, Human
ucccaaaguauuagcauuucaa

SEQ ID NO: 72255 - RNA, 22 nt, Human
ucccaaagucaagcugugucuu

SEQ ID NO: 72256 - RNA, 22 nt, Human
ucucuuucucagaugguggaga

SEQ ID NO: 72257 - RNA, 22 nt, Human
ucucuuucuuuguaugucuauu

SEQ ID NO: 72258 - RNA, 22 nt, Human
ucucuuugucugcucuuaguug

SEQ ID NO: 72259 - RNA, 22 nt, Human
ucucuuuguggccaggagagga

SEQ ID NO: 72260 - RNA, 22 nt, Human
ucugaaaacuccaugagcucgu

SEQ ID NO: 72261 - RNA, 22 nt, Human
ucugaaaauguugacuuuguuu

SEQ ID NO: 72262 - RNA, 22 nt, Human
ucugaaagcauaauuuguccca

SEQ ID NO: 72263 - RNA, 23 nt, Human
ucugaaagggaugcugggcagga

SEQ ID NO: 72264 - RNA, 22 nt, Human
ucugaaaguaucuggaucuuuu

SEQ ID NO: 72265 - RNA, 22 nt, Human
ucugaaauaaaugcacuguuag

SEQ ID NO: 72266 - RNA, 22 nt, Human
ucugaaauaacugaugccagau

SEQ ID NO: 72267 - RNA, 22 nt, Human
ucugaaauacugcagguucucu

SEQ ID NO: 72268 - RNA, 22 nt, Human
ucugaaauaggaaagcaaaugg

SEQ ID NO: 72269 - RNA, 22 nt, Human
ucugaaauaggcuucuuuuggu

SEQ ID NO: 72270 - RNA, 22 nt, Human
ucugaaauauugguaauacuuu

SEQ ID NO: 72271 - RNA, 22 nt, Human
ucugaaaucuguaagcacuagc

SEQ ID NO: 72272 - RNA, 22 nt, Human
ucugaaaugcaaauuugacuga

SEQ ID NO: 72273 - RNA, 22 nt, Human
ucugaaaugcaggcaauuugcu

SEQ ID NO: 72274 - RNA, 22 nt, Human
ucugaaauggggcugaagcacu

SEQ ID NO: 72275 - RNA, 22 nt, Human
ucugaaauucacaguugaguca

SEQ ID NO: 72276 - RNA, 22 nt, Human
ucugaaauuguuaguaaaaaug

SEQ ID NO: 72277 - RNA, 22 nt, Human
ucugaaauuuuaguuauagaaa

SEQ ID NO: 72278 - RNA, 22 nt, Human
ucugaacagcauggaaucauuu

SEQ ID NO: 72279 - RNA, 22 nt, Human
ucugaacauuuuuugcagccua

SEQ ID NO: 72280 - RNA, 22 nt, Human
ucugaacuccagcccugcucuc

SEQ ID NO: 72281 - RNA, 20 nt, Human
ucugaagaaagacagggacu

SEQ ID NO: 72282 - RNA, 22 nt, Human
ucugaagaacugucuagagaac

SEQ ID NO: 72283 - RNA, 22 nt, Human
ucugaagauaugagcuuuauga

SEQ ID NO: 72284 - RNA, 22 nt, Human
ucugaagauggaggaacuuaga

SEQ ID NO: 72285 - RNA, 17 nt, Human
ucugaagccagucugcu

SEQ ID NO: 72286 - RNA, 18 nt, Human
ucugaaggaaugauucca

SEQ ID NO: 72287 - RNA, 22 nt, Human
ucugaaggcauccucacugcaa

SEQ ID NO: 72288 - RNA, 22 nt, Human
ucugaagugaucaucauuucuc

SEQ ID NO: 72289 - RNA, 22 nt, Human
ucugaaguucuuaaauuaguuu

SEQ ID NO: 72290 - RNA, 22 nt, Human
ucugaauaguucuauuuuaaag

SEQ ID NO: 72291 - RNA, 22 nt, Human
ucugaaugcacuuaguuaccaa

SEQ ID NO: 72292 - RNA, 22 nt, Human
ucccagaguauuagcaauugcu

SEQ ID NO: 72293 - RNA, 22 nt, Human
ucccagagugagccaggggcag

SEQ ID NO: 72294 - RNA, 22 nt, Human
ucccagaguucaaugggaaggu

SEQ ID NO: 72295 - RNA, 22 nt, Human
ucccagauuccugcucuuauau

SEQ ID NO: 72296 - RNA, 22 nt, Human
ucccagcacagggcagauguga

SEQ ID NO: 72297 - RNA, 22 nt, Human
ucccagcauaacaaacugcccg

SEQ ID NO: 72298 - RNA, 22 nt, Human
ucccagccacagguguagcccu

SEQ ID NO: 72299 - RNA, 22 nt, Human
ucccagccacaguuuccaccug

SEQ ID NO: 72300 - RNA, 22 nt, Human
ucccagccaggcucuaccacuu

SEQ ID NO: 72301 - RNA, 22 nt, Human
ucccagccuggacccugccagu

SEQ ID NO: 72302 - RNA, 22 nt, Human
ucccagcuguguggaggagaug

SEQ ID NO: 72303 - RNA, 22 nt, Human
ucccagcuuagauuugcucauu

SEQ ID NO: 72304 - RNA, 22 nt, Human
ucccaggaaggauucggcauuu

SEQ ID NO: 72305 - RNA, 23 nt, Human
ucccaggaaucugcauuuuuaac

SEQ ID NO: 72306 - RNA, 22 nt, Human
ucccaggaauugaagccagugu

SEQ ID NO: 72307 - RNA, 22 nt, Human
ucccaggacccaggcauucaca

SEQ ID NO: 72308 - RNA, 22 nt, Human
ucccaggauuuuaggcucucag

SEQ ID NO: 72309 - RNA, 20 nt, Human
ucccaggcuccacccuagac

SEQ ID NO: 72310 - RNA, 22 nt, Human
ucccaggcucuucaaggaagac

SEQ ID NO: 72311 - RNA, 20 nt, Human
ucccaggcugggcuccagcu

SEQ ID NO: 72312 - RNA, 22 nt, Human
ucccaggcugggggccugaagu

SEQ ID NO: 72313 - RNA, 22 nt, Human
ucccagggacccagccugauac

SEQ ID NO: 72314 - RNA, 22 nt, Human
ucccagggauccuccgggucgc

SEQ ID NO: 72315 - RNA, 22 nt, Human
ucccagggauuaggacauggau

SEQ ID NO: 72316 - RNA, 22 nt, Human
ucccagggccgcaaacgaguuu

SEQ ID NO: 72317 - RNA, 22 nt, Human
ucccagggcucuagagugcugg

SEQ ID NO: 72318 - RNA, 22 nt, Human
ucccaggguauccuguaguaaa

SEQ ID NO: 72319 - RNA, 22 nt, Human
ucccagggucaguggugaggcc

SEQ ID NO: 72320 - RNA, 22 nt, Human
ucccagucuguguccuuuacag

SEQ ID NO: 72321 - RNA, 22 nt, Human
ucccagugagguccuggcuguc

SEQ ID NO: 72322 - RNA, 19 nt, Human
ucccaguggggagaggugu

SEQ ID NO: 72323 - RNA, 22 nt, Human
ucccaguuuuucuccacuaagg

SEQ ID NO: 72324 - RNA, 22 nt, Human
ucccauauauguuuauauugga

SEQ ID NO: 72325 - RNA, 22 nt, Human
ucccaucuccaacauuuuucuu

SEQ ID NO: 72326 - RNA, 22 nt, Human
ucccauggauagugaccuuguu

SEQ ID NO: 72327 - RNA, 20 nt, Human
ucccauguccauaucagccc

SEQ ID NO: 72328 - RNA, 22 nt, Human
ucccauguugugccuggcugca

SEQ ID NO: 72329 - RNA, 22 nt, Human
ucccauuguggaaggcagaaga

SEQ ID NO: 72330 - RNA, 21 nt, Human
ucccauuguuccccuccagug

SEQ ID NO: 72331 - RNA, 22 nt, Human
ucccauuuuggaugcggauugg

SEQ ID NO: 72332 - RNA, 22 nt, Human
uccccaaagcuuuguggucagg

SEQ ID NO: 72333 - RNA, 19 nt, Human
uccccaagaguucuagcuc

SEQ ID NO: 72334 - RNA, 22 nt, Human
uccccacaucucugcaucaggc

SEQ ID NO: 72335 - RNA, 22 nt, Human
uccccacucaccacuggccaaa

SEQ ID NO: 72336 - RNA, 22 nt, Human
uccccacucugggccaccacaa

SEQ ID NO: 72337 - RNA, 22 nt, Human
uccccagaggugaggcagcuuu

SEQ ID NO: 72338 - RNA, 22 nt, Human
uccccagauggccagcuacaug

SEQ ID NO: 72339 - RNA, 22 nt, Human
uccccagggcugcagagggugu

SEQ ID NO: 72340 - RNA, 22 nt, Human
uccccagggucccugcuuccau

SEQ ID NO: 72341 - RNA, 22 nt, Human
uccccagguccugucggcuccu

SEQ ID NO: 72342 - RNA, 22 nt, Human
uccccagucccggcggugggug

SEQ ID NO: 72343 - RNA, 22 nt, Human
uccccccagccuuucacaugag

SEQ ID NO: 72344 - RNA, 22 nt, Human
uccccuccaacuccaacuaugg

SEQ ID NO: 72345 - RNA, 22 nt, Human
uccccugagaccccucagcacu

SEQ ID NO: 72346 - RNA, 22 nt, Human
ucccgauaggcagggcucuggc

SEQ ID NO: 72347 - RNA, 20 nt, Human
ucccuaggcaggagggcacu

SEQ ID NO: 72348 - RNA, 22 nt, Human
ucccucagacagauguguuccu

SEQ ID NO: 72349 - RNA, 21 nt, Human
ucccucagacagggugccuau

SEQ ID NO: 72350 - RNA, 22 nt, Human
ucccucagauuggcaauuagau

SEQ ID NO: 72351 - RNA, 22 nt, Human
ucccucagcuugucuccaugca

SEQ ID NO: 72352 - RNA, 20 nt, Human
ucccucaguccuggcuuugu

SEQ ID NO: 72353 - RNA, 22 nt, Human
ucccuccacaccugcugguacc

SEQ ID NO: 72354 - RNA, 22 nt, Human
ucccuccauaacagaggugagc

SEQ ID NO: 72355 - RNA, 22 nt, Human
ucccuccugcaugaggcucggc

SEQ ID NO: 72356 - RNA, 22 nt, Human
ucccuccuggugagcaggggcu

SEQ ID NO: 72357 - RNA, 22 nt, Human
ucccuccuuaauaagaggucug

SEQ ID NO: 72358 - RNA, 22 nt, Human
ucccucugggcuccagcacgga

SEQ ID NO: 72359 - RNA, 22 nt, Human
ucccucuguucuguuccaagug

SEQ ID NO: 72360 - RNA, 23 nt, Human
ucccugagaugcugcucuguccc

SEQ ID NO: 72361 - RNA, 22 nt, Human
ucccugagggcagcucaagucc

SEQ ID NO: 72362 - RNA, 22 nt, Human
ucccugagugggcugguaguau

SEQ ID NO: 72363 - RNA, 22 nt, Human
ucccugcacagccgagccaugc

SEQ ID NO: 72364 - RNA, 22 nt, Human
ucccugcacccuugcugggccc

SEQ ID NO: 72365 - RNA, 22 nt, Human
uguaucaaucauguaauuuggu

SEQ ID NO: 72366 - RNA, 22 nt, Human
uguaucauauggggaagcuuca

SEQ ID NO: 72367 - RNA, 22 nt, Human
uguaucugacaguggagcggag

SEQ ID NO: 72368 - RNA, 22 nt, Human
uguaucuuucuguacuuuuaug

SEQ ID NO: 72369 - RNA, 22 nt, Human
uguaugaaaaggaauagauuga

SEQ ID NO: 72370 - RNA, 22 nt, Human
uguaugaaccuuuaauauagug

SEQ ID NO: 72371 - RNA, 16 nt, Human
uguaugaacgucucca

SEQ ID NO: 72372 - RNA, 22 nt, Human
uguaugaagacuucuucugugu

SEQ ID NO: 72373 - RNA, 22 nt, Human
uguaugaaguuacugagccucu

SEQ ID NO: 72374 - RNA, 22 nt, Human
uguaugcaauaauaacuaugug

SEQ ID NO: 72375 - RNA, 21 nt, Human
uguaugcacgcacaugcacac

SEQ ID NO: 72376 - RNA, 22 nt, Human
uguaugcagggcuuguaugcag

SEQ ID NO: 72377 - RNA, 22 nt, Human
uguaugcauaaaauuauuuaca

SEQ ID NO: 72378 - RNA, 22 nt, Human
uguauguaaaggucuucauguu

SEQ ID NO: 72379 - RNA, 22 nt, Human
uguauguauacacugaucauca

SEQ ID NO: 72380 - RNA, 22 nt, Human
uguaugugcaauguuuauaugu

SEQ ID NO: 72381 - RNA, 17 nt, Human
uguauguggauacacua

SEQ ID NO: 72382 - RNA, 22 nt, Human
uguauguguggauagauguaua

SEQ ID NO: 72383 - RNA, 22 nt, Human
uguauuaacauuaauaaaaugg

SEQ ID NO: 72384 - RNA, 20 nt, Human
uguauuacuuggucuuacaa

SEQ ID NO: 72385 - RNA, 22 nt, Human
uguauucaacuucuuaaaaauu

SEQ ID NO: 72386 - RNA, 22 nt, Human
uguauuccaaaaugcugaggau

SEQ ID NO: 72387 - RNA, 22 nt, Human
uguauugaauuguguuauaucu

SEQ ID NO: 72388 - RNA, 22 nt, Human
uguauuguaagugguuauaugc

SEQ ID NO: 72389 - RNA, 20 nt, Human
uguauuuaaugaaggcuuuu

SEQ ID NO: 72390 - RNA, 17 nt, Human
uguauuuaucaugucag

SEQ ID NO: 72391 - RNA, 22 nt, Human
uguauuuauucuucugguguuu

SEQ ID NO: 72392 - RNA, 22 nt, Human
uguauuucgcuagguacucccu

SEQ ID NO: 72393 - RNA, 22 nt, Human
uguauuuucugaagauaaucaa

SEQ ID NO: 72394 - RNA, 22 nt, Human
uguauuuucugaggagcauuag

SEQ ID NO: 72395 - RNA, 22 nt, Human
uguauuuucuucuggaagcuua

SEQ ID NO: 72396 - RNA, 22 nt, Human
uguauuuuuagaccuuuagacc

SEQ ID NO: 72397 - RNA, 22 nt, Human
ugucaaacugugacuucuaaug

SEQ ID NO: 72398 - RNA, 22 nt, Human
ugucaaagacagaaggaaaugg

SEQ ID NO: 72399 - RNA, 22 nt, Human
ugucaacaaaacgguucaaaug

SEQ ID NO: 72400 - RNA, 23 nt, Human
ugucaacaaaacuuucaggagaa

SEQ ID NO: 72401 - RNA, 22 nt, Human
ugucaagagugcacacaucugc

SEQ ID NO: 72402 - RNA, 22 nt, Human
ugucaagucucugaaugaaaug

SEQ ID NO: 72403 - RNA, 22 nt, Human
ugucaauaacuggagucauuau

SEQ ID NO: 72404 - RNA, 22 nt, Human
ugucacaaacauacauuauaga

SEQ ID NO: 72405 - RNA, 22 nt, Human
ugucacaaguaacuggcaaugc

SEQ ID NO: 72406 - RNA, 22 nt, Human
ucugaauuaaucaugccucuuu

SEQ ID NO: 72407 - RNA, 20 nt, Human
ucugaauugagugaaugucu

SEQ ID NO: 72408 - RNA, 22 nt, Human
ucugacagggccaaacaugaca

SEQ ID NO: 72409 - RNA, 22 nt, Human
ucugacagguguucuuccaggc

SEQ ID NO: 72410 - RNA, 22 nt, Human
ucugacauuagauuaauuggaa

SEQ ID NO: 72411 - RNA, 22 nt, Human
ucugacauuuugagaaugacau

SEQ ID NO: 72412 - RNA, 22 nt, Human
ucugaccacagacaaccugcua

SEQ ID NO: 72413 - RNA, 22 nt, Human
ucugacccugagucuauuuucu

SEQ ID NO: 72414 - RNA, 22 nt, Human
ucugacuuccuccacaucuguu

SEQ ID NO: 72415 - RNA, 22 nt, Human
ucugacuuccuuuucugaucca

SEQ ID NO: 72416 - RNA, 21 nt, Human
ucugacuugaucuauucuccc

SEQ ID NO: 72417 - RNA, 22 nt, Human
ucugacuuggugcuaccagcca

SEQ ID NO: 72418 - RNA, 22 nt, Human
ucugacuuuggacaguggcgaa

SEQ ID NO: 72419 - RNA, 22 nt, Human
ucugacuuuucucacuguugug

SEQ ID NO: 72420 - RNA, 22 nt, Human
ucugagaaaucaguggugaaua

SEQ ID NO: 72421 - RNA, 22 nt, Human
ucugagaacaucauuuccuaca

SEQ ID NO: 72422 - RNA, 22 nt, Human
ucugagaacuccggguuagauc

SEQ ID NO: 72423 - RNA, 17 nt, Human
ucugagaacuugaagca

SEQ ID NO: 72424 - RNA, 22 nt, Human
ucugagaaguccuguauuucua

SEQ ID NO: 72425 - RNA, 22 nt, Human
ucugagaaugaguguuuucuua

SEQ ID NO: 72426 - RNA, 17 nt, Human
ucugagaaugcuggagg

SEQ ID NO: 72427 - RNA, 22 nt, Human
ucugagaaugguggauguggug

SEQ ID NO: 72428 - RNA, 22 nt, Human
ucugagacuccauaaguugaaa

SEQ ID NO: 72429 - RNA, 22 nt, Human
ucugagagagggucagaugcua

SEQ ID NO: 72430 - RNA, 21 nt, Human
ucugagagcaacugcccuuua

SEQ ID NO: 72431 - RNA, 22 nt, Human
ucugagagccucuagccuaagu

SEQ ID NO: 72432 - RNA, 22 nt, Human
ucugagaggcaucugcacuucu

SEQ ID NO: 72433 - RNA, 22 nt, Human
ucugagcacaauuacuuacauc

SEQ ID NO: 72434 - RNA, 22 nt, Human
ucugagcagggcaguguccaug

SEQ ID NO: 72435 - RNA, 22 nt, Human
ucugagcauaugcagcaccugg

SEQ ID NO: 72436 - RNA, 22 nt, Human
ucugagccaauuucugugucca

SEQ ID NO: 72437 - RNA, 22 nt, Human
ucugagccacagauguccuguu

SEQ ID NO: 72438 - RNA, 22 nt, Human
ucugagccaccugccagugcug

SEQ ID NO: 72439 - RNA, 22 nt, Human
ucugagccagacaagacagcca

SEQ ID NO: 72440 - RNA, 22 nt, Human
ucugagcccagugagucucgca

SEQ ID NO: 72441 - RNA, 22 nt, Human
ucugagcuauguaagacuugga

SEQ ID NO: 72442 - RNA, 22 nt, Human
ucugagcucuaucugugggaau

SEQ ID NO: 72443 - RNA, 22 nt, Human
ucugagcuucccucugaggcag

SEQ ID NO: 72444 - RNA, 22 nt, Human
ucugagcuuucuugugcucaag

SEQ ID NO: 72445 - RNA, 22 nt, Human
ucugagcuuuuauuaucaaccu

SEQ ID NO: 72446 - RNA, 22 nt, Human
ucugaggaaaagaggagguagc

SEQ ID NO: 72447 - RNA, 22 nt, Human
ucugaggaaagagagugggaug

SEQ ID NO: 72448 - RNA, 22 nt, Human
ucugaggaccaucggggagcug

SEQ ID NO: 72449 - RNA, 22 nt, Human
ucugaggccccugggcaggaug

SEQ ID NO: 72450 - RNA, 22 nt, Human
ucugaggccuugggacagaagu

SEQ ID NO: 72451 - RNA, 22 nt, Human
ucugaggcugaauggacuccgu

SEQ ID NO: 72452 - RNA, 22 nt, Human
ucugaggcugcaucuaugugac

SEQ ID NO: 72453 - RNA, 19 nt, Human
ucugagggagcacgaaggc

SEQ ID NO: 72454 - RNA, 23 nt, Human
ucugagggagugggcaguggcac

SEQ ID NO: 72455 - RNA, 22 nt, Human
ucugagggauuugucccuuauc

SEQ ID NO: 72456 - RNA, 22 nt, Human
ucugagggcuugaggggaagua

SEQ ID NO: 72457 - RNA, 22 nt, Human
ucugaggguaagguuaagguag

SEQ ID NO: 72458 - RNA, 18 nt, Human
ucugagggugcgggagcu

SEQ ID NO: 72459 - RNA, 20 nt, Human
ucugagguaugauagggucu

SEQ ID NO: 72460 - RNA, 22 nt, Human
ucugaggucauaaagcaacuuu

SEQ ID NO: 72461 - RNA, 22 nt, Human
ucugaggucauuccaaggacau

SEQ ID NO: 72462 - RNA, 23 nt, Human
ucugagguccaccaguuugcaga

SEQ ID NO: 72463 - RNA, 22 nt, Human
ucugagguggggcuggagcauu

SEQ ID NO: 72464 - RNA, 22 nt, Human
ucugagguguagcugggcuuca

SEQ ID NO: 72465 - RNA, 22 nt, Human
ucugaggugucacaaggccagg

SEQ ID NO: 72466 - RNA, 22 nt, Human
ucugagguucccucaacuaccu

SEQ ID NO: 72467 - RNA, 22 nt, Human
ucugagguugaacuuugcaaag

SEQ ID NO: 72468 - RNA, 22 nt, Human
ucugagguuuucauguuuucug

SEQ ID NO: 72469 - RNA, 22 nt, Human
ucugagugauguugagucagaa

SEQ ID NO: 72470 - RNA, 22 nt, Human
ucugagugggaacucucaugac

SEQ ID NO: 72471 - RNA, 23 nt, Human
ucugaguuauguccuuacauuug

SEQ ID NO: 72472 - RNA, 22 nt, Human
ucugaguugaggaaaugcauuu

SEQ ID NO: 72473 - RNA, 20 nt, Human
ucugauaacugguugugauu

SEQ ID NO: 72474 - RNA, 22 nt, Human
ccaggcuuccuaaugugugcag

SEQ ID NO: 72475 - RNA, 22 nt, Human
ccaggcuuuaagagguggaaac

SEQ ID NO: 72476 - RNA, 22 nt, Human
ccaggcuuuguaccaggcuuuc

SEQ ID NO: 72477 - RNA, 22 nt, Human
ccagggaaaaucaacuucuacu

SEQ ID NO: 72478 - RNA, 22 nt, Human
ccagggaaacagcccaguguga

SEQ ID NO: 72479 - RNA, 22 nt, Human
ccagggaaacuuuggaguggag

SEQ ID NO: 72480 - RNA, 22 nt, Human
ccagggaaauuaaugaguuaau

SEQ ID NO: 72481 - RNA, 22 nt, Human
ccagggaagaccacuuccugga

SEQ ID NO: 72482 - RNA, 22 nt, Human
ccagggaagauuagaagccacu

SEQ ID NO: 72483 - RNA, 22 nt, Human
ccagggaaggcugcuggcugug

SEQ ID NO: 72484 - RNA, 22 nt, Human
ccagggaaucaggcagaaguca

SEQ ID NO: 72485 - RNA, 22 nt, Human
ccagggaaucucugaguguguu

SEQ ID NO: 72486 - RNA, 22 nt, Human
ccagggagcggggcugggucuc

SEQ ID NO: 72487 - RNA, 22 nt, Human
ccagggaggagcauuucauggu

SEQ ID NO: 72488 - RNA, 17 nt, Human
ccagggaggggccgcgc

SEQ ID NO: 72489 - RNA, 22 nt, Human
ccagggaggguccuguggcuuc

SEQ ID NO: 72490 - RNA, 18 nt, Human
ccagggaugcaugguccc

SEQ ID NO: 72491 - RNA, 22 nt, Human
ccagggauguggcagcaccaua

SEQ ID NO: 72492 - RNA, 22 nt, Human
ccagggcaauuauuuggagggu

SEQ ID NO: 72493 - RNA, 22 nt, Human
ccagggcagaaaaagagggaau

SEQ ID NO: 72494 - RNA, 22 nt, Human
ccagggcagccaacccagaugc

SEQ ID NO: 72495 - RNA, 22 nt, Human
ccagggcaggagaaagacucac

SEQ ID NO: 72496 - RNA, 22 nt, Human
ccagggcauccucacaucgcag

SEQ ID NO: 72497 - RNA, 22 nt, Human
ccagggcauguccaagacuuag

SEQ ID NO: 72498 - RNA, 22 nt, Human
ccagggcccacggccagaauag

SEQ ID NO: 72499 - RNA, 23 nt, Human
ccagggcuacgggcaccguccug

SEQ ID NO: 72500 - RNA, 22 nt, Human
ccagggcucgggugcuuaguca

SEQ ID NO: 72501 - RNA, 22 nt, Human
ccagggcucuaugaggguggag

SEQ ID NO: 72502 - RNA, 22 nt, Human
ccagggcugcugugggacucca

SEQ ID NO: 72503 - RNA, 22 nt, Human
ccagggcugguggcugcagagg

SEQ ID NO: 72504 - RNA, 22 nt, Human
ccagggcuucagagguuuuggc

SEQ ID NO: 72505 - RNA, 22 nt, Human
ccagggcuucccacgugcccug

SEQ ID NO: 72506 - RNA, 22 nt, Human
ccagggcuugguggcuuguauc

SEQ ID NO: 72507 - RNA, 22 nt, Human
ccagggcuuugccaaaguccag

SEQ ID NO: 72508 - RNA, 22 nt, Human
ccaggggggcguagaugcuggg

SEQ ID NO: 72509 - RNA, 22 nt, Human
ccagggucacaaauaacugcag

SEQ ID NO: 72510 - RNA, 22 nt, Human
ccagggucucugcugccugaga

SEQ ID NO: 72511 - RNA, 22 nt, Human
ccagggugagugucauggguua

SEQ ID NO: 72512 - RNA, 22 nt, Human
ccaggguuauaaaugcaucugu

SEQ ID NO: 72513 - RNA, 22 nt, Human
ccaggguugcagggagccagca

SEQ ID NO: 72514 - RNA, 22 nt, Human
ccaggguuuagcaagccuacaa

SEQ ID NO: 72515 - RNA, 22 nt, Human
ccaggguuucuucucuguauag

SEQ ID NO: 72516 - RNA, 22 nt, Human
ccagguacuugguaugcauuca

SEQ ID NO: 72517 - RNA, 22 nt, Human
ccagguagccaaggggucuggg

SEQ ID NO: 72518 - RNA, 22 nt, Human
ccagguccuguuuucaccacag

SEQ ID NO: 72519 - RNA, 22 nt, Human
ccaggucucgggucugcucgug

SEQ ID NO: 72520 - RNA, 22 nt, Human
ccaggucugucuucuuagcuca

SEQ ID NO: 72521 - RNA, 22 nt, Human
ccaggucuuggcccccggaccu

SEQ ID NO: 72522 - RNA, 22 nt, Human
ccagguggacaaggcuuucaca

SEQ ID NO: 72523 - RNA, 22 nt, Human
ccagguggacggcgaguacagg

SEQ ID NO: 72524 - RNA, 22 nt, Human
ccagguggaggugugagguccu

SEQ ID NO: 72525 - RNA, 17 nt, Human
ccaggugggaggugggg

SEQ ID NO: 72526 - RNA, 22 nt, Human
ccaggugucaugcgugugaccc

SEQ ID NO: 72527 - RNA, 22 nt, Human
ccaggugucugucucuuuuuca

SEQ ID NO: 72528 - RNA, 22 nt, Human
ccaggugugagcauucugucuu

SEQ ID NO: 72529 - RNA, 22 nt, Human
ccaggugugauuucaucugagg

SEQ ID NO: 72530 - RNA, 22 nt, Human
ccaggugugauuuggcaguguc

SEQ ID NO: 72531 - RNA, 22 nt, Human
ccagguguggccacauggcugg

SEQ ID NO: 72532 - RNA, 22 nt, Human
cacccaggcuggauugcagugg

SEQ ID NO: 72533 - RNA, 22 nt, Human
cacccagugaaggagcaagagg

SEQ ID NO: 72534 - RNA, 22 nt, Human
caccccagucuaaaaccagccu

SEQ ID NO: 72535 - RNA, 22 nt, Human
cacccccagcagggaaaggagg

SEQ ID NO: 72536 - RNA, 22 nt, Human
caccccuguggagcaugguggc

SEQ ID NO: 72537 - RNA, 22 nt, Human
cacccucaagcaguggcacgug

SEQ ID NO: 72538 - RNA, 22 nt, Human
cacccugaggccacccagaccu

SEQ ID NO: 72539 - RNA, 22 nt, Human
cacccugcccacuagcaaucug

SEQ ID NO: 72540 - RNA, 22 nt, Human
cacccugcucugcugugcggcc

SEQ ID NO: 72541 - RNA, 22 nt, Human
cacccuggaaagaaggucuggg

SEQ ID NO: 72542 - RNA, 22 nt, Human
cacccuggaauagccccgggag

SEQ ID NO: 72543 - RNA, 22 nt, Human
cacccugggcugggccuguuaa

SEQ ID NO: 72544 - RNA, 22 nt, Human
caccgagugacaguagccauca

SEQ ID NO: 72545 - RNA, 22 nt, Human
caccuacuuugugcagauuuua

SEQ ID NO: 72546 - RNA, 22 nt, Human
caccuagcauuccucuuccuca

SEQ ID NO: 72547 - RNA, 22 nt, Human
caccucaggcagcaaagucuca

SEQ ID NO: 72548 - RNA, 22 nt, Human
caccucucauuucuacagauuc

SEQ ID NO: 72549 - RNA, 22 nt, Human
caccucugccucaagcuuccca

SEQ ID NO: 72550 - RNA, 22 nt, Human
caccucugcuguccacaggaug

SEQ ID NO: 72551 - RNA, 22 nt, Human
caccucuuugauuugaggcaag

SEQ ID NO: 72552 - RNA, 22 nt, Human
caccugagugucaguauucuca

SEQ ID NO: 72553 - RNA, 22 nt, Human
caccugcccagcaccugggauc

SEQ ID NO: 72554 - RNA, 22 nt, Human
caccugccugcaggggcuccac

SEQ ID NO: 72555 - RNA, 22 nt, Human
caccugccugcuagagccugac

SEQ ID NO: 72556 - RNA, 22 nt, Human
caccuguuagcucuaauuuucu

SEQ ID NO: 72557 - RNA, 21 nt, Human
caccuuauagauaaaauuaga

SEQ ID NO: 72558 - RNA, 22 nt, Human
caccuugcauucuuuuaauuua

SEQ ID NO: 72559 - RNA, 22 nt, Human
caccuugugauccucuugccuu

SEQ ID NO: 72560 - RNA, 22 nt, Human
caccuuuaaugagcaccagccg

SEQ ID NO: 72561 - RNA, 19 nt, Human
cacgaguucucuuagcaaa

SEQ ID NO: 72562 - RNA, 22 nt, Human
cacgcauguggaucagaugaag

SEQ ID NO: 72563 - RNA, 22 nt, Human
cacgccuggacggcggagggug

SEQ ID NO: 72564 - RNA, 22 nt, Human
cacgcuuggcuuauacagagaa

SEQ ID NO: 72565 - RNA, 22 nt, Human
cacgggcagugagcacagccug

SEQ ID NO: 72566 - RNA, 22 nt, Human
cacgguuagccacaggcuggaa

SEQ ID NO: 72567 - RNA, 22 nt, Human
cacgugcaggucuuaggagaca

SEQ ID NO: 72568 - RNA, 19 nt, Human
cacuaagaagcaggggagc

SEQ ID NO: 72569 - RNA, 22 nt, Human
cacuaaguaagcuccucuacaa

SEQ ID NO: 72570 - RNA, 22 nt, Human
cacuaagucaacagccucucuu

SEQ ID NO: 72571 - RNA, 22 nt, Human
cacuaaguugguguuaauuagu

SEQ ID NO: 72572 - RNA, 22 nt, Human
cacuaauuccaucuccuuuucc

SEQ ID NO: 72573 - RNA, 22 nt, Human
cacuacagaaucaaauacgggc

SEQ ID NO: 72574 - RNA, 19 nt, Human
cacuagucuagaugggaug

SEQ ID NO: 72575 - RNA, 22 nt, Human
cacuauaucuguucuuguuuau

SEQ ID NO: 72576 - RNA, 22 nt, Human
cacuauuucagugauucugcag

SEQ ID NO: 72577 - RNA, 22 nt, Human
cacuauuuucucuucagauggc

SEQ ID NO: 72578 - RNA, 21 nt, Human
cacucaauaaaugucauaugc

SEQ ID NO: 72579 - RNA, 22 nt, Human
cacucaauacaaugguuggcac

SEQ ID NO: 72580 - RNA, 21 nt, Human
cacuccacuuagaacaggguu

SEQ ID NO: 72581 - RNA, 22 nt, Human
cacucccucuaguugcauucug

SEQ ID NO: 72582 - RNA, 22 nt, Human
cacucugacacaugaacuugau

SEQ ID NO: 72583 - RNA, 22 nt, Human
cacauuuaucuguucuuucuag

SEQ ID NO: 72584 - RNA, 19 nt, Human
cacauuuugagucugagau

SEQ ID NO: 72585 - RNA, 21 nt, Human
caccaacaccugggauagguc

SEQ ID NO: 72586 - RNA, 17 nt, Human
caccaauuaagacccuc

SEQ ID NO: 72587 - RNA, 22 nt, Human
caccacagcauccacuagaagg

SEQ ID NO: 72588 - RNA, 22 nt, Human
caccacuggaggucuuggcuuu

SEQ ID NO: 72589 - RNA, 22 nt, Human
caccagaacaagacaggagaau

SEQ ID NO: 72590 - RNA, 22 nt, Human
caccagacagguguaugcauau

SEQ ID NO: 72591 - RNA, 22 nt, Human
caccagagugaguggacugucg

SEQ ID NO: 72592 - RNA, 22 nt, Human
caccagcaccagcucugugccu

SEQ ID NO: 72593 - RNA, 22 nt, Human
caccagcagaagacugagggug

SEQ ID NO: 72594 - RNA, 22 nt, Human
caccagcuccaccagggcaggu

SEQ ID NO: 72595 - RNA, 22 nt, Human
caccaggaaguauucaaagggu

SEQ ID NO: 72596 - RNA, 22 nt, Human
caccaggcacagcucuccugcu

SEQ ID NO: 72597 - RNA, 22 nt, Human
caccaggcugaaccagagggga

SEQ ID NO: 72598 - RNA, 22 nt, Human
caccaggcuggagugcagaggu

SEQ ID NO: 72599 - RNA, 22 nt, Human
caccagggacaaugcuaggggu

SEQ ID NO: 72600 - RNA, 22 nt, Human
caccagggcucugagcucugaa

SEQ ID NO: 72601 - RNA, 22 nt, Human
caccaggugcuggaggacauca

SEQ ID NO: 72602 - RNA, 22 nt, Human
caccagguggaaaugucacagc

SEQ ID NO: 72603 - RNA, 22 nt, Human
caccaugacugguugagagagg

SEQ ID NO: 72604 - RNA, 22 nt, Human
cacccagccuucacacaggagu

SEQ ID NO: 72605 - RNA, 22 nt, Human
cacccaggagguugggaagggc

SEQ ID NO: 72606 - RNA, 22 nt, Human
cacccaggcaaggauucugcaa

SEQ ID NO: 72607 - RNA, 22 nt, Human
cacccaggcauggguugagaug

SEQ ID NO: 72608 - RNA, 22 nt, Human
cacccaggcuagagugcagugg

SEQ ID NO: 72609 - RNA, 22 nt, Human
cacccaggcuggagugcagggg

SEQ ID NO: 72610 - RNA, 22 nt, Human
cacccauuaaccaaagagugaa

SEQ ID NO: 72611 - RNA, 22 nt, Human
caccccagcuucucaggauaga

SEQ ID NO: 72612 - RNA, 22 nt, Human
caccccugggcugggcacacag

SEQ ID NO: 72613 - RNA, 22 nt, Human
cacccuagcugucauuucaguu

SEQ ID NO: 72614 - RNA, 22 nt, Human
cacccucccgucagccccuggg

SEQ ID NO: 72615 - RNA, 22 nt, Human
cacccugcuacaaagccuccug

SEQ ID NO: 72616 - RNA, 22 nt, Human
cacccuggccucgcucucugca

SEQ ID NO: 72617 - RNA, 22 nt, Human
cacccuguacaaauggacaucu

SEQ ID NO: 72618 - RNA, 22 nt, Human
cacccugucaguugcaggauag

SEQ ID NO: 72619 - RNA, 22 nt, Human
caccgcggagugauggagaaac

SEQ ID NO: 72620 - RNA, 19 nt, Human
caccuacuuuuggauuugc

SEQ ID NO: 72621 - RNA, 22 nt, Human
caccuagcaugaaauucagcag

SEQ ID NO: 72622 - RNA, 22 nt, Human
caccuagccuucuugugccucu

SEQ ID NO: 72623 - RNA, 22 nt, Human
caccucauggauaagauaaacu

SEQ ID NO: 72624 - RNA, 22 nt, Human
caccucucagcuaggaguaagu

SEQ ID NO: 72625 - RNA, 20 nt, Human
caccucugaaaguuuccagc

SEQ ID NO: 72626 - RNA, 22 nt, Human
caccugagacuccucaccauga

SEQ ID NO: 72627 - RNA, 22 nt, Human
caccugagcacuggggccgccc

SEQ ID NO: 72628 - RNA, 22 nt, Human
caccugccaaauggggaugcug

SEQ ID NO: 72629 - RNA, 22 nt, Human
caccugcccuuucuugcuccac

SEQ ID NO: 72630 - RNA, 22 nt, Human
caccugccucauuugucccugc

SEQ ID NO: 72631 - RNA, 22 nt, Human
caccuggauauguuucagcuug

SEQ ID NO: 72632 - RNA, 22 nt, Human
caccuggaugccacaaagccac

SEQ ID NO: 72633 - RNA, 20 nt, Human
caccuggcugacugucucca

SEQ ID NO: 72634 - RNA, 22 nt, Human
caccugggcuaaacuaugcagg

SEQ ID NO: 72635 - RNA, 22 nt, Human
caccugggcuuucucugggacu

SEQ ID NO: 72636 - RNA, 22 nt, Human
caccugggucauugcugguguu

SEQ ID NO: 72637 - RNA, 22 nt, Human
caccuguccacgcagucugccu

SEQ ID NO: 72638 - RNA, 22 nt, Human
caccuucagaaugcuccaggca

SEQ ID NO: 72639 - RNA, 22 nt, Human
caccuuugcaaaccaaaucuga

SEQ ID NO: 72640 - RNA, 22 nt, Human
cacgaauggaagggucuuggcu

SEQ ID NO: 72641 - RNA, 22 nt, Human
cacgagggcacacgugggaggg

SEQ ID NO: 72642 - RNA, 22 nt, Human
cacggccagggcugugggugcg

SEQ ID NO: 72643 - RNA, 22 nt, Human
cacgggagacgugaucuuggac

SEQ ID NO: 72644 - RNA, 22 nt, Human
cacguuaacagcuaacagauga

SEQ ID NO: 72645 - RNA, 20 nt, Human
cacguuuuuccacuagcaaa

SEQ ID NO: 72646 - RNA, 20 nt, Human
cacuaacugcucaugacucc

SEQ ID NO: 72647 - RNA, 19 nt, Human
cacuaagaugagauauagc

SEQ ID NO: 72648 - RNA, 22 nt, Human
cacuaagauuuaaaguauuagu

SEQ ID NO: 72649 - RNA, 22 nt, Human
cacaugggugugccuggaggaa

SEQ ID NO: 72650 - RNA, 22 nt, Human
cacaugguggugcuugauaagc

SEQ ID NO: 72651 - RNA, 22 nt, Human
cacauguaguaagcaggcaaug

SEQ ID NO: 72652 - RNA, 22 nt, Human
cacauguccugggaaaauaacu

SEQ ID NO: 72653 - RNA, 22 nt, Human
cacaugugggaaauggugcuua

SEQ ID NO: 72654 - RNA, 22 nt, Human
cacauguuuuuggccaucaugg

SEQ ID NO: 72655 - RNA, 22 nt, Human
cacauuaaaauccuaacuucca

SEQ ID NO: 72656 - RNA, 22 nt, Human
cacauuaagaauaaugagacua

SEQ ID NO: 72657 - RNA, 22 nt, Human
cacauuaugcuacuaccaaaug

SEQ ID NO: 72658 - RNA, 22 nt, Human
cacauuauucuaaagagguacu

SEQ ID NO: 72659 - RNA, 22 nt, Human
cacauucaggauuuuccauguc

SEQ ID NO: 72660 - RNA, 22 nt, Human
cacauucagggaacauuggagg

SEQ ID NO: 72661 - RNA, 22 nt, Human
cacauucuuucacaguucugaa

SEQ ID NO: 72662 - RNA, 23 nt, Human
cacauugaacacucucuuuccug

SEQ ID NO: 72663 - RNA, 21 nt, Human
cacauugaauacagagaugga

SEQ ID NO: 72664 - RNA, 22 nt, Human
cacauugcagcuucuuuuggcu

SEQ ID NO: 72665 - RNA, 22 nt, Human
cacauugggaugaagucuaaaa

SEQ ID NO: 72666 - RNA, 22 nt, Human
cacauuuaauccuuuauaagua

SEQ ID NO: 72667 - RNA, 22 nt, Human
cacauuucauuggcuuacguaa

SEQ ID NO: 72668 - RNA, 22 nt, Human
cacauuucuggaauugacuugg

SEQ ID NO: 72669 - RNA, 22 nt, Human
cacauuugaaggaauuagcauu

SEQ ID NO: 72670 - RNA, 22 nt, Human
caccacuucauaggcuuuaagg

SEQ ID NO: 72671 - RNA, 19 nt, Human
caccacuucuuuuugcauc

SEQ ID NO: 72672 - RNA, 22 nt, Human
caccagaguuguccaaaugauu

SEQ ID NO: 72673 - RNA, 22 nt, Human
caccagcagcggugugagggug

SEQ ID NO: 72674 - RNA, 22 nt, Human
caccagcuacuccagggccgug

SEQ ID NO: 72675 - RNA, 22 nt, Human
caccagcuacucggguuuccug

SEQ ID NO: 72676 - RNA, 22 nt, Human
caccagcucuccaccagguuuc

SEQ ID NO: 72677 - RNA, 22 nt, Human
caccagcuugcagucuuaaccc

SEQ ID NO: 72678 - RNA, 22 nt, Human
caccaggaagugguggccuggg

SEQ ID NO: 72679 - RNA, 20 nt, Human
caccaggcgcucugagaaca

SEQ ID NO: 72680 - RNA, 22 nt, Human
caccaggcugagccucucaucu

SEQ ID NO: 72681 - RNA, 22 nt, Human
caccagggcagcagccuagucu

SEQ ID NO: 72682 - RNA, 20 nt, Human
caccagucaugagucaauac

SEQ ID NO: 72683 - RNA, 22 nt, Human
caccauaaccaacaugucaguu

SEQ ID NO: 72684 - RNA, 22 nt, Human
caccaucagcagcaggugucaa

SEQ ID NO: 72685 - RNA, 22 nt, Human
caccaucuuuuggaggggaauu

SEQ ID NO: 72686 - RNA, 22 nt, Human
caccauguauucaguuuggcac

SEQ ID NO: 72687 - RNA, 22 nt, Human
caccauuuucuaaaaauaugac

SEQ ID NO: 72688 - RNA, 22 nt, Human
cacccacccacugcucauuggc

SEQ ID NO: 72689 - RNA, 22 nt, Human
cacccacugagcucauguccca

SEQ ID NO: 72690 - RNA, 22 nt, Human
cacccagagccugagagggaua

SEQ ID NO: 72691 - RNA, 22 nt, Human
cacccagagggcuugcugaaca

SEQ ID NO: 72692 - RNA, 22 nt, Human
ccucagagacugcaucuucccu

SEQ ID NO: 72693 - RNA, 22 nt, Human
ccucagaggcagaugguaagaa

SEQ ID NO: 72694 - RNA, 22 nt, Human
ccucagagguucugugugggaa

SEQ ID NO: 72695 - RNA, 22 nt, Human
ccucagagguuuucauucugua

SEQ ID NO: 72696 - RNA, 22 nt, Human
ccucagagucuaguaaauaaua

SEQ ID NO: 72697 - RNA, 22 nt, Human
ccucagaguuggaaucacauuu

SEQ ID NO: 72698 - RNA, 23 nt, Human
ccucagcauggcaggagcccagc

SEQ ID NO: 72699 - RNA, 22 nt, Human
ccucagccccugaauggagaga

SEQ ID NO: 72700 - RNA, 22 nt, Human
ccucagccuuggccccaggcag

SEQ ID NO: 72701 - RNA, 22 nt, Human
ccucaggauacaggagccacag

SEQ ID NO: 72702 - RNA, 22 nt, Human
ccucaggccagggggcggccag

SEQ ID NO: 72703 - RNA, 20 nt, Human
ccucaggccaguuuuaaagu

SEQ ID NO: 72704 - RNA, 22 nt, Human
ccucaggccugccagagcccca

SEQ ID NO: 72705 - RNA, 22 nt, Human
ccucaggcucugggugccuacc

SEQ ID NO: 72706 - RNA, 22 nt, Human
ccucagggacgggaucacuugg

SEQ ID NO: 72707 - RNA, 22 nt, Human
ccucagggacuccaugcugcag

SEQ ID NO: 72708 - RNA, 22 nt, Human
ccucagggucauccuaguaaua

SEQ ID NO: 72709 - RNA, 22 nt, Human
ccucagggucucucacagcacc

SEQ ID NO: 72710 - RNA, 22 nt, Human
ccucagggucugaggagaccgu

SEQ ID NO: 72711 - RNA, 22 nt, Human
ccucagucuccgugcucaccuu

SEQ ID NO: 72712 - RNA, 22 nt, Human
ccucagucugucugaucugcca

SEQ ID NO: 72713 - RNA, 22 nt, Human
ccucagugaguguuuccuucuu

SEQ ID NO: 72714 - RNA, 22 nt, Human
ccucaguguuaggauaagagaa

SEQ ID NO: 72715 - RNA, 21 nt, Human
ccucaucaaacuuucacuugc

SEQ ID NO: 72716 - RNA, 22 nt, Human
ccucaugaguucuucugcccau

SEQ ID NO: 72717 - RNA, 22 nt, Human
ccucaugauuuuuagcccauug

SEQ ID NO: 72718 - RNA, 22 nt, Human
ccucauggaccucagacugucc

SEQ ID NO: 72719 - RNA, 22 nt, Human
ccuccaagcuucaucucaacca

SEQ ID NO: 72720 - RNA, 22 nt, Human
ccuccacaggagcugcagugcu

SEQ ID NO: 72721 - RNA, 22 nt, Human
ccuccagcugccucagucucuu

SEQ ID NO: 72722 - RNA, 22 nt, Human
ccuccaggaggaaauggaacac

SEQ ID NO: 72723 - RNA, 22 nt, Human
ccuccagggcagacggggagca

SEQ ID NO: 72724 - RNA, 21 nt, Human
ccuccaggugauuccgugcuc

SEQ ID NO: 72725 - RNA, 22 nt, Human
ccuccaguacuccaguccagcg

SEQ ID NO: 72726 - RNA, 22 nt, Human
ccuccaucuccagcuucugccu

SEQ ID NO: 72727 - RNA, 23 nt, Human
ccuccaugguaagaagcuuagag

SEQ ID NO: 72728 - RNA, 22 nt, Human
ccuccauguaaagguccccuca

SEQ ID NO: 72729 - RNA, 22 nt, Human
ccucccaccguaucucaguggc

SEQ ID NO: 72730 - RNA, 22 nt, Human
ccucccacuucuugcugagguc

SEQ ID NO: 72731 - RNA, 22 nt, Human
ccucccagugccuccagagcag

SEQ ID NO: 72732 - RNA, 22 nt, Human
ccucccaucccugcaagagagc

SEQ ID NO: 72733 - RNA, 22 nt, Human
ccuccccacagcccaggagacu

SEQ ID NO: 72734 - RNA, 23 nt, Human
ccuccccaccagacucuaacaua

SEQ ID NO: 72735 - RNA, 22 nt, Human
ccucccguauauguccugggcu

SEQ ID NO: 72736 - RNA, 22 nt, Human
ccucccucccugcagaagccac

SEQ ID NO: 72737 - RNA, 22 nt, Human
ccucccucuuucagucccacag

SEQ ID NO: 72738 - RNA, 22 nt, Human
ccucccugccggcuggacuagu

SEQ ID NO: 72739 - RNA, 22 nt, Human
ccucccugcuccucaacuggca

SEQ ID NO: 72740 - RNA, 22 nt, Human
ccucccugggugacgggcuccu

SEQ ID NO: 72741 - RNA, 22 nt, Human
ccucccugggugcugggauugc

SEQ ID NO: 72742 - RNA, 22 nt, Human
ccucccuuggccauagccagcc

SEQ ID NO: 72743 - RNA, 22 nt, Human
ccucccuuuguugcaagggaaa

SEQ ID NO: 72744 - RNA, 22 nt, Human
ccuccuagaggaaccccagggc

SEQ ID NO: 72745 - RNA, 22 nt, Human
ccuccucugugcagcugugggu

SEQ ID NO: 72746 - RNA, 22 nt, Human
ccuccugcaccuccaggaacuc

SEQ ID NO: 72747 - RNA, 22 nt, Human
ccuccugcacuugcuuuccuuc

SEQ ID NO: 72748 - RNA, 22 nt, Human
ccuccuggaaaaauucccuggc

SEQ ID NO: 72749 - RNA, 22 nt, Human
ccuccuggaggcucuaagggag

SEQ ID NO: 72750 - RNA, 22 nt, Human
ccuccuggcccugggccuggaa

SEQ ID NO: 72751 - RNA, 22 nt, Human
ccuccuggcuuuucccauugaa

SEQ ID NO: 72752 - RNA, 22 nt, Human
ccuccugggcuccugucugcac

SEQ ID NO: 72753 - RNA, 22 nt, Human
ccuccugucuccuuccuauauu

SEQ ID NO: 72754 - RNA, 22 nt, Human
ccucgcggcacucgggccggau

SEQ ID NO: 72755 - RNA, 18 nt, Human
ccucuaccuaccccuaga

SEQ ID NO: 72756 - RNA, 22 nt, Human
ccucuacuuaccacucagccag

SEQ ID NO: 72757 - RNA, 22 nt, Human
ccucucagcgauuccucuugga

SEQ ID NO: 72758 - RNA, 22 nt, Human
ccucucauagucuguauccuuu

SEQ ID NO: 72759 - RNA, 22 nt, Human
ccucucaucauuaucgcuuugu

SEQ ID NO: 72760 - RNA, 22 nt, Human
ccucuccaguuuuaacgugacc

SEQ ID NO: 72761 - RNA, 22 nt, Human
ccucucccagggagagccugag

SEQ ID NO: 72762 - RNA, 19 nt, Human
ccucucccaugcuuaccuc

SEQ ID NO: 72763 - RNA, 22 nt, Human
ccucucccgggugccgcugggc

SEQ ID NO: 72764 - RNA, 22 nt, Human
ccucucuccaauuuucaccuca

SEQ ID NO: 72765 - RNA, 22 nt, Human
ccucucucuccugcacacacac

SEQ ID NO: 72766 - RNA, 22 nt, Human
ccucucucuuguagucccugcc

SEQ ID NO: 72767 - RNA, 22 nt, Human
ccucucuguguggccucuccau

SEQ ID NO: 72768 - RNA, 22 nt, Human
ccucucuuggccgcagucuucu

SEQ ID NO: 72769 - RNA, 23 nt, Human
ccucucuuuuuaggugguguuug

SEQ ID NO: 72770 - RNA, 23 nt, Human
ccucugacaaugaugucaccugc

SEQ ID NO: 72771 - RNA, 22 nt, Human
ccucugacuucucuuuauuggc

SEQ ID NO: 72772 - RNA, 22 nt, Human
ccucugagaccagcucugcacc

SEQ ID NO: 72773 - RNA, 22 nt, Human
ccucugagccagcgucuucucu

SEQ ID NO: 72774 - RNA, 22 nt, Human
ccucugaggugagcccagcugg

SEQ ID NO: 72775 - RNA, 22 nt, Human
ccucugaguguuuuccccgggu

SEQ ID NO: 72776 - RNA, 22 nt, Human
ccucugaguuggccugucuugu

SEQ ID NO: 72777 - RNA, 22 nt, Human
ccucugcaugugcaguaccgag

SEQ ID NO: 72778 - RNA, 19 nt, Human
ccucugccagcccgccucu

SEQ ID NO: 72779 - RNA, 22 nt, Human
ccucugcccuuuuccuguauca

SEQ ID NO: 72780 - RNA, 22 nt, Human
ccucugccuuuagugaaaguug

SEQ ID NO: 72781 - RNA, 18 nt, Human
ccucugccuuuguagagc

SEQ ID NO: 72782 - RNA, 19 nt, Human
ccucugcgcuguccugcuc

SEQ ID NO: 72783 - RNA, 22 nt, Human
ccucuggcaagugauuuaucau

SEQ ID NO: 72784 - RNA, 22 nt, Human
cagaugcuaaacaaaggacuuu

SEQ ID NO: 72785 - RNA, 18 nt, Human
cagaugcuaggccuccag

SEQ ID NO: 72786 - RNA, 22 nt, Human
cagaugcuauguauuauguaug

SEQ ID NO: 72787 - RNA, 20 nt, Human
cagaugcuggaucuuggucc

SEQ ID NO: 72788 - RNA, 22 nt, Human
cagaugcuuggaggacacuugg

SEQ ID NO: 72789 - RNA, 22 nt, Human
cagauggcaacagcucugugac

SEQ ID NO: 72790 - RNA, 22 nt, Human
cagauggccagaggcagcugca

SEQ ID NO: 72791 - RNA, 22 nt, Human
cagauggcugccaagaugggcu

SEQ ID NO: 72792 - RNA, 22 nt, Human
cagauguaguagcuuuauugca

SEQ ID NO: 72793 - RNA, 22 nt, Human
cagaugucauuucccaugcagc

SEQ ID NO: 72794 - RNA, 23 nt, Human
cagaugugcaacucuaggcaaug

SEQ ID NO: 72795 - RNA, 22 nt, Human
cagauguuguuccugccuguag

SEQ ID NO: 72796 - RNA, 22 nt, Human
cagauuacuuuguagcagucag

SEQ ID NO: 72797 - RNA, 22 nt, Human
cagauucaaccuaagacaaucu

SEQ ID NO: 72798 - RNA, 20 nt, Human
cagauucuccacuaacauau

SEQ ID NO: 72799 - RNA, 22 nt, Human
cagauucuucauucauucuaca

SEQ ID NO: 72800 - RNA, 22 nt, Human
cagauucuucuguauuuuugcu

SEQ ID NO: 72801 - RNA, 22 nt, Human
cagcagaaaaugugggugauuu

SEQ ID NO: 72802 - RNA, 22 nt, Human
cagcagaaacccagcaaagcca

SEQ ID NO: 72803 - RNA, 21 nt, Human
cagcagaagcaucuauggaag

SEQ ID NO: 72804 - RNA, 18 nt, Human
cagcagagacauucaaaa

SEQ ID NO: 72805 - RNA, 22 nt, Human
cagcagagaccaagugauuuga

SEQ ID NO: 72806 - RNA, 22 nt, Human
cagcagagacgguaagcagaac

SEQ ID NO: 72807 - RNA, 23 nt, Human
cagcagagagcagaccuuugugu

SEQ ID NO: 72808 - RNA, 22 nt, Human
cagcagagcuuauuaacuaaaa

SEQ ID NO: 72809 - RNA, 22 nt, Human
cagcagaggcacgucugugaau

SEQ ID NO: 72810 - RNA, 21 nt, Human
cagcagaguaaugcauucgua

SEQ ID NO: 72811 - RNA, 22 nt, Human
cagcagaguaauucucaccucu

SEQ ID NO: 72812 - RNA, 22 nt, Human
cagcagcaaaucuagaagagga

SEQ ID NO: 72813 - RNA, 22 nt, Human
cagcagcaaggugaggguggag

SEQ ID NO: 72814 - RNA, 22 nt, Human
cagcagcacucugcgggucccc

SEQ ID NO: 72815 - RNA, 22 nt, Human
cagcagcagagauacugguuuc

SEQ ID NO: 72816 - RNA, 22 nt, Human
cagcagcagcuuaguggucccc

SEQ ID NO: 72817 - RNA, 22 nt, Human
cagcagccuaggguuccaucau

SEQ ID NO: 72818 - RNA, 22 nt, Human
cagcagccucuugugccugugg

SEQ ID NO: 72819 - RNA, 22 nt, Human
cagcagccuggccccuccucgg

SEQ ID NO: 72820 - RNA, 22 nt, Human
cagcagcucacugaauaaugac

SEQ ID NO: 72821 - RNA, 22 nt, Human
cagcagcucaggcugcuuccca

SEQ ID NO: 72822 - RNA, 22 nt, Human
cagcagcucccauccgcugagc

SEQ ID NO: 72823 - RNA, 22 nt, Human
cagcagcugaggcgcuggcgug

SEQ ID NO: 72824 - RNA, 22 nt, Human
cagcagcugauggggaagugau

SEQ ID NO: 72825 - RNA, 22 nt, Human
cagcagcuggugagacacagcc

SEQ ID NO: 72826 - RNA, 22 nt, Human
cagcagcuguuuacggaacacc

SEQ ID NO: 72827 - RNA, 22 nt, Human
cagcagcuucuguugaucagaa

SEQ ID NO: 72828 - RNA, 20 nt, Human
cagcaggaaaagugccucag

SEQ ID NO: 72829 - RNA, 22 nt, Human
cagcaggaaacuuaaagguaau

SEQ ID NO: 72830 - RNA, 22 nt, Human
cagcaggaagguuuccccugca

SEQ ID NO: 72831 - RNA, 22 nt, Human
cagcaggaggcauggcuucccu

SEQ ID NO: 72832 - RNA, 22 nt, Human
cagcaggaggugagaugugacc

SEQ ID NO: 72833 - RNA, 22 nt, Human
cagcaggauagguuucuuugga

SEQ ID NO: 72834 - RNA, 22 nt, Human
cagcaggauuggauacaucuca

SEQ ID NO: 72835 - RNA, 22 nt, Human
cagcaggcccagaguuucaugg

SEQ ID NO: 72836 - RNA, 22 nt, Human
cagcagggaagcugugcuguuu

SEQ ID NO: 72837 - RNA, 22 nt, Human
cagcaggucaugaaagaaaacc

SEQ ID NO: 72838 - RNA, 22 nt, Human
cagcaggucucagcagcuccuu

SEQ ID NO: 72839 - RNA, 22 nt, Human
cagcaggucuuguugcugcuga

SEQ ID NO: 72840 - RNA, 22 nt, Human
cagcaggugggcuuugcggaug

SEQ ID NO: 72841 - RNA, 22 nt, Human
cagcaggugucuagcaaggguc

SEQ ID NO: 72842 - RNA, 22 nt, Human
cagcaguaacucccgugcagca

SEQ ID NO: 72843 - RNA, 22 nt, Human
cagcagugacaagacuaagaag

SEQ ID NO: 72844 - RNA, 20 nt, Human
cagcaguggaugagaguuuu

SEQ ID NO: 72845 - RNA, 22 nt, Human
cagcaguggccaucuguguggu

SEQ ID NO: 72846 - RNA, 22 nt, Human
cagcaguuaugaguagaauagu

SEQ ID NO: 72847 - RNA, 22 nt, Human
cagcaguucaauccagugcacg

SEQ ID NO: 72848 - RNA, 20 nt, Human
cagcauagcggcucacaucc

SEQ ID NO: 72849 - RNA, 22 nt, Human
cagcauaggauguggagccagg

SEQ ID NO: 72850 - RNA, 22 nt, Human
cagcauaucugaguugaaagag

SEQ ID NO: 72851 - RNA, 22 nt, Human
cagcauauuacuuuaaaaaauc

SEQ ID NO: 72852 - RNA, 20 nt, Human
cagcaucaaaggaagguuug

SEQ ID NO: 72853 - RNA, 22 nt, Human
cagcaucauacuaccuaaauga

SEQ ID NO: 72854 - RNA, 22 nt, Human
cagcaucccucaggggccucug

SEQ ID NO: 72855 - RNA, 22 nt, Human
cagcaucuaaucuucaugccgg

SEQ ID NO: 72856 - RNA, 22 nt, Human
cagcaucucauucauucauguu

SEQ ID NO: 72857 - RNA, 22 nt, Human
cagcaucuccauggcuuuggag

SEQ ID NO: 72858 - RNA, 22 nt, Human
cagcaucucccaggcauuugcc

SEQ ID NO: 72859 - RNA, 22 nt, Human
cagcaucucguggcuggauaga

SEQ ID NO: 72860 - RNA, 22 nt, Human
cagcaucucugcacccuccccc

SEQ ID NO: 72861 - RNA, 22 nt, Human
cagcaucuggggaacauucaag

SEQ ID NO: 72862 - RNA, 22 nt, Human
cagcaucuuauuuucuauggaa

SEQ ID NO: 72863 - RNA, 18 nt, Human
cagcaucuucauuaggcc

SEQ ID NO: 72864 - RNA, 22 nt, Human
cagcaucuucuagauccaggcu

SEQ ID NO: 72865 - RNA, 22 nt, Human
cagcaucuuuauaaaaaguaaa

SEQ ID NO: 72866 - RNA, 22 nt, Human
cagcaugaugcucacacaaaac

SEQ ID NO: 72867 - RNA, 22 nt, Human
cagcaugcaaguccagaugugg

SEQ ID NO: 72868 - RNA, 22 nt, Human
cagcaugcuugggggagggagc

SEQ ID NO: 72869 - RNA, 22 nt, Human
cagcauggccauuucucgcugc

SEQ ID NO: 72870 - RNA, 22 nt, Human
cagcauggcuugaguguuuccu

SEQ ID NO: 72871 - RNA, 22 nt, Human
cagcauggguuccgggggccug

SEQ ID NO: 72872 - RNA, 22 nt, Human
cagcauggugccagugagucca

SEQ ID NO: 72873 - RNA, 22 nt, Human
cagcauguaucuuucaggugug

SEQ ID NO: 72874 - RNA, 22 nt, Human
cagcauucuacuuugugaacug

SEQ ID NO: 72875 - RNA, 22 nt, Human
cagcauuuaucuuguagcagga

SEQ ID NO: 72876 - RNA, 22 nt, Human
cagcauuuucuuaauguaggug

SEQ ID NO: 72877 - RNA, 22 nt, Human
cagccaagaaccacagacccag

SEQ ID NO: 72878 - RNA, 22 nt, Human
cagccacagcugggugccugac

SEQ ID NO: 72879 - RNA, 22 nt, Human
cagccaccauacagcagaagcu

SEQ ID NO: 72880 - RNA, 22 nt, Human
cagccacguagcccuuggccgu

SEQ ID NO: 72881 - RNA, 22 nt, Human
cagccacugaacuccuggcuau

SEQ ID NO: 72882 - RNA, 22 nt, Human
cagccacugacaggaauggucc

SEQ ID NO: 72883 - RNA, 22 nt, Human
cagccacuuccccucuaugggu

SEQ ID NO: 72884 - RNA, 22 nt, Human
cagccacuucgagcuuccugau

SEQ ID NO: 72885 - RNA, 22 nt, Human
cagccagaaaguauguuaggga

SEQ ID NO: 72886 - RNA, 22 nt, Human
cagccagaggcugcgaggggcc

SEQ ID NO: 72887 - RNA, 22 nt, Human
cagccagaucaaacucagaugu

SEQ ID NO: 72888 - RNA, 22 nt, Human
cagccagcuggugcggcagagc

SEQ ID NO: 72889 - RNA, 22 nt, Human
cagccagggagggcaaaugaga

SEQ ID NO: 72890 - RNA, 22 nt, Human
cagccaggggcuggcguguuga

SEQ ID NO: 72891 - RNA, 22 nt, Human
cagccagggucaggcagcuucu

SEQ ID NO: 72892 - RNA, 22 nt, Human
cagccaucccagccugugguuc

SEQ ID NO: 72893 - RNA, 23 nt, Human
cagcccaaagagagagcuacuuu

SEQ ID NO: 72894 - RNA, 22 nt, Human
cagcccacugccucugugguag

SEQ ID NO: 72895 - RNA, 22 nt, Human
cagcccagcagggucuggcccu

SEQ ID NO: 72896 - RNA, 22 nt, Human
cagcccagugcacgcccguuuc

SEQ ID NO: 72897 - RNA, 21 nt, Human
cagaggcaggcucugugugug

SEQ ID NO: 72898 - RNA, 22 nt, Human
cagaggcagugggguugcuccu

SEQ ID NO: 72899 - RNA, 22 nt, Human
cagaggcauauaauugcugggg

SEQ ID NO: 72900 - RNA, 22 nt, Human
cagaggccaggcugccugacug

SEQ ID NO: 72901 - RNA, 22 nt, Human
cagaggccauauuucuucacuc

SEQ ID NO: 72902 - RNA, 22 nt, Human
cagaggccccauuggcugugcg

SEQ ID NO: 72903 - RNA, 22 nt, Human
cagaggccuauccaguguccau

SEQ ID NO: 72904 - RNA, 22 nt, Human
cagaggcuagacugugcuuccu

SEQ ID NO: 72905 - RNA, 22 nt, Human
cagaggcucaccagccuuucac

SEQ ID NO: 72906 - RNA, 22 nt, Human
cagaggcucagauggcccuggc

SEQ ID NO: 72907 - RNA, 22 nt, Human
cagaggcucuuccucacugccc

SEQ ID NO: 72908 - RNA, 22 nt, Human
cagaggcugacccugcuguugu

SEQ ID NO: 72909 - RNA, 22 nt, Human
cagaggcugauggcuguagcca

SEQ ID NO: 72910 - RNA, 16 nt, Human
cagcccugaggaagaa

SEQ ID NO: 72911 - RNA, 22 nt, Human
cagcccugcacgcugccuccgc

SEQ ID NO: 72912 - RNA, 17 nt, Human
cagcccugccguuccca

SEQ ID NO: 72913 - RNA, 22 nt, Human
cagcccugcugacacugucuga

SEQ ID NO: 72914 - RNA, 22 nt, Human
cagcccugcuggcaaugaugag

SEQ ID NO: 72915 - RNA, 22 nt, Human
cagcccuggaacagcugacuca

SEQ ID NO: 72916 - RNA, 23 nt, Human
cagcccuggagaugugggaggca

SEQ ID NO: 72917 - RNA, 22 nt, Human
cagcccuggccccagguggucu

SEQ ID NO: 72918 - RNA, 22 nt, Human
cagcccuggcgcccccagaucu

SEQ ID NO: 72919 - RNA, 22 nt, Human
cagcccuggcuagggcgagggc

SEQ ID NO: 72920 - RNA, 22 nt, Human
cagcccuggugagguuggcuau

SEQ ID NO: 72921 - RNA, 22 nt, Human
cagcccugucuaugacugauga

SEQ ID NO: 72922 - RNA, 22 nt, Human
cagcccugugcuaagcacccuc

SEQ ID NO: 72923 - RNA, 22 nt, Human
cagcccuuaaauagauauacag

SEQ ID NO: 72924 - RNA, 22 nt, Human
cagcccuuaagagucaucccuc

SEQ ID NO: 72925 - RNA, 22 nt, Human
cagcccuucagggggcugcagg

SEQ ID NO: 72926 - RNA, 22 nt, Human
cagcccuuccaggcagaauucu

SEQ ID NO: 72927 - RNA, 22 nt, Human
cagcccuugaugauaauuuauc

SEQ ID NO: 72928 - RNA, 20 nt, Human
cagcccuugauuuacaaucc

SEQ ID NO: 72929 - RNA, 22 nt, Human
cagcccuuggcccagggcacag

SEQ ID NO: 72930 - RNA, 22 nt, Human
cagcccuugggccauccuagaa

SEQ ID NO: 72931 - RNA, 22 nt, Human
cagccgucagaugugccgcagc

SEQ ID NO: 72932 - RNA, 22 nt, Human
cagccucuguggcugccacacc

SEQ ID NO: 72933 - RNA, 22 nt, Human
cagccugacaccagcuuugggc

SEQ ID NO: 72934 - RNA, 22 nt, Human
cagccugcucucagauguugag

SEQ ID NO: 72935 - RNA, 21 nt, Human
cagccugcugcuccagggcca

SEQ ID NO: 72936 - RNA, 22 nt, Human
cagccuggccugggacugcuga

SEQ ID NO: 72937 - RNA, 22 nt, Human
cagccuucgacaguuggaguag

SEQ ID NO: 72938 - RNA, 22 nt, Human
cagccuuuuccauguauuguug

SEQ ID NO: 72939 - RNA, 22 nt, Human
cagcgcaggcgugugaaggcgc

SEQ ID NO: 72940 - RNA, 22 nt, Human
cagcgccuccuggaccuccucu

SEQ ID NO: 72941 - RNA, 22 nt, Human
cagcgcugggguaggagcaccu

SEQ ID NO: 72942 - RNA, 22 nt, Human
cagcggccggugaggaagggga

SEQ ID NO: 72943 - RNA, 22 nt, Human
cagcggggccugugcuggggag

SEQ ID NO: 72944 - RNA, 22 nt, Human
cagcgguggcaaggugacugug

SEQ ID NO: 72945 - RNA, 22 nt, Human
cagcuacuccucccaugacuuc

SEQ ID NO: 72946 - RNA, 22 nt, Human
cagcuagggaguggcagagcuu

SEQ ID NO: 72947 - RNA, 22 nt, Human
cagcuaguaaauggcaagacua

SEQ ID NO: 72948 - RNA, 22 nt, Human
cagcuauagauggacugaagag

SEQ ID NO: 72949 - RNA, 22 nt, Human
cagcuauuguucuguauaauga

SEQ ID NO: 72950 - RNA, 22 nt, Human
cagcuauuuguaggaaaacugu

SEQ ID NO: 72951 - RNA, 22 nt, Human
cagcucagacgcaggucgagca

SEQ ID NO: 72952 - RNA, 22 nt, Human
cagcucaggaaggaaggccggc

SEQ ID NO: 72953 - RNA, 22 nt, Human
cagcucagugaugccuucacag

SEQ ID NO: 72954 - RNA, 22 nt, Human
cagcucaugaccuuuguuaucu

SEQ ID NO: 72955 - RNA, 22 nt, Human
cagcuccaaagccccacugucc

SEQ ID NO: 72956 - RNA, 22 nt, Human
cagcuccagccgacuguaagaa

SEQ ID NO: 72957 - RNA, 23 nt, Human
cagcuccagugcacucagguagc

SEQ ID NO: 72958 - RNA, 22 nt, Human
cagcuccaucuugcuuauacca

SEQ ID NO: 72959 - RNA, 22 nt, Human
cagcucccagaacugaccaugu

SEQ ID NO: 72960 - RNA, 22 nt, Human
cagcuccuagaucggcgaagug

SEQ ID NO: 72961 - RNA, 22 nt, Human
cagcuccucacgagucuugaaa

SEQ ID NO: 72962 - RNA, 22 nt, Human
cagcuccugaggacugcuggga

SEQ ID NO: 72963 - RNA, 22 nt, Human
cagcuccugcagcuggcuccca

SEQ ID NO: 72964 - RNA, 22 nt, Human
cagcucugaugaaauguaccag

SEQ ID NO: 72965 - RNA, 22 nt, Human
cagcucugccacuuccuagcua

SEQ ID NO: 72966 - RNA, 22 nt, Human
cagcucugcugguggugccagg

SEQ ID NO: 72967 - RNA, 22 nt, Human
cagcucuggcgucagggagcga

SEQ ID NO: 72968 - RNA, 22 nt, Human
cagcucugggagucccaccccu

SEQ ID NO: 72969 - RNA, 22 nt, Human
cagcucuggggcagagugacua

SEQ ID NO: 72970 - RNA, 22 nt, Human
cagcucugggugacaggagggc

SEQ ID NO: 72971 - RNA, 22 nt, Human
cagcucugugcaggccugggga

SEQ ID NO: 72972 - RNA, 22 nt, Human
cagcucuguugcccuggaaacg

SEQ ID NO: 72973 - RNA, 22 nt, Human
cagcucuuaacacagcuuguau

SEQ ID NO: 72974 - RNA, 22 nt, Human
cagcucuucccucuucuuguag

SEQ ID NO: 72975 - RNA, 18 nt, Human
cagcucuucuccaguaac

SEQ ID NO: 72976 - RNA, 22 nt, Human
cagcucuuuuucacacaacaug

SEQ ID NO: 72977 - RNA, 22 nt, Human
cagcucuuuuuugcagcagcug

SEQ ID NO: 72978 - RNA, 22 nt, Human
cagcugaaagaaggaaguguca

SEQ ID NO: 72979 - RNA, 22 nt, Human
cagcugacccagugaggaggca

SEQ ID NO: 72980 - RNA, 22 nt, Human
cagcugaccuggcuaagggagc

SEQ ID NO: 72981 - RNA, 22 nt, Human
cagcugagaaggucugaucagg

SEQ ID NO: 72982 - RNA, 22 nt, Human
cagcugagcugccagacuacug

SEQ ID NO: 72983 - RNA, 22 nt, Human
cagcugaguaugcauucaagca

SEQ ID NO: 72984 - RNA, 22 nt, Human
cagcugaguuacucugaggucu

SEQ ID NO: 72985 - RNA, 19 nt, Human
cagcugcaccgugaccauc

SEQ ID NO: 72986 - RNA, 22 nt, Human
cagcugcagaucauguuuacag

SEQ ID NO: 72987 - RNA, 18 nt, Human
cagcugcaggcucaggac

SEQ ID NO: 72988 - RNA, 22 nt, Human
cagcugcaguucaaugcuugcu

SEQ ID NO: 72989 - RNA, 22 nt, Human
cagcugcaugucuguggugguc

SEQ ID NO: 72990 - RNA, 22 nt, Human
cagcugccacaccucuuucucu

SEQ ID NO: 72991 - RNA, 22 nt, Human
cagcugccagcuucucuccauc

SEQ ID NO: 72992 - RNA, 22 nt, Human
cagcugccccgcuggcugacca

SEQ ID NO: 72993 - RNA, 22 nt, Human
cagcugcccugccuugcccuua

SEQ ID NO: 72994 - RNA, 22 nt, Human
cagcugccuguauuguccucau

SEQ ID NO: 72995 - RNA, 22 nt, Human
cagcugccuucugcgggaaguc

SEQ ID NO: 72996 - RNA, 22 nt, Human
cagcugcugcccuuggcugcag

SEQ ID NO: 72997 - RNA, 19 nt, Human
cagcuggaaucaucugagg

SEQ ID NO: 72998 - RNA, 22 nt, Human
cagcuggacuuuugauagaagu

SEQ ID NO: 72999 - RNA, 22 nt, Human
cagcuggaugggagaccauguu

SEQ ID NO: 73000 - RNA, 22 nt, Human
cagcuggcauaccugggcccgg

SEQ ID NO: 73001 - RNA, 22 nt, Human
cagcuggccccacaguagaggc

SEQ ID NO: 73002 - RNA, 22 nt, Human
cagcuggcccuuugguagccuu

SEQ ID NO: 73003 - RNA, 22 nt, Human
cagcuggcugcggugaggggac

SEQ ID NO: 73004 - RNA, 22 nt, Human
cagcuggcuuguuuguucuuga

SEQ ID NO: 73005 - RNA, 22 nt, Human
cagcuggggagagacauggcag

SEQ ID NO: 73006 - RNA, 22 nt, Human
cagcugggugaucuugggcagg

SEQ ID NO: 73007 - RNA, 22 nt, Human
cagcugguggcugaugaccguc

SEQ ID NO: 73008 - RNA, 23 nt, Human
cagcugguugugggaguggcugc

SEQ ID NO: 73009 - RNA, 22 nt, Human
cagcugucuaaguugagcagga

SEQ ID NO: 73010 - RNA, 22 nt, Human
cagcugucuuugcacaguuuag

SEQ ID NO: 73011 - RNA, 22 nt, Human
cagcugucuuuucuaaauauua

SEQ ID NO: 73012 - RNA, 22 nt, Human
cagcugugaauugucuuaucua

SEQ ID NO: 73013 - RNA, 22 nt, Human
cagcugugauaugccugccuga

SEQ ID NO: 73014 - RNA, 22 nt, Human
cagcagaaguccgacuccaguc

SEQ ID NO: 73015 - RNA, 22 nt, Human
cagcagagaaauuaaacuucug

SEQ ID NO: 73016 - RNA, 22 nt, Human
cagcagagcuuauguuggguca

SEQ ID NO: 73017 - RNA, 22 nt, Human
cagcagaggugguucacauugu

SEQ ID NO: 73018 - RNA, 22 nt, Human
cagcagagguuuugcuccauga

SEQ ID NO: 73019 - RNA, 22 nt, Human
ccuggguuggagagcaauggug

SEQ ID NO: 73020 - RNA, 22 nt, Human
cagcuguggagggaggaaaugc

SEQ ID NO: 73021 - RNA, 22 nt, Human
cagcuguggggagcuugggcca

SEQ ID NO: 73022 - RNA, 22 nt, Human
cagcuguuaccaaucuuagggc

SEQ ID NO: 73023 - RNA, 22 nt, Human
cagcuguucagcaacucgcaga

SEQ ID NO: 73024 - RNA, 22 nt, Human
cagcuguucggggcuggcaugu

SEQ ID NO: 73025 - RNA, 22 nt, Human
cagcuguugugauccauuuacg

SEQ ID NO: 73026 - RNA, 22 nt, Human
cagcuguuguguaucaggcaga

SEQ ID NO: 73027 - RNA, 22 nt, Human
cagcuguuugggcauggccaga

SEQ ID NO: 73028 - RNA, 22 nt, Human
cagcuucaccagggccaugguu

SEQ ID NO: 73029 - RNA, 22 nt, Human
cagcuucagaagaagccgugag

SEQ ID NO: 73030 - RNA, 22 nt, Human
cagcuucagcgugacaccagug

SEQ ID NO: 73031 - RNA, 22 nt, Human
cagcuucauguccagguacugu

SEQ ID NO: 73032 - RNA, 22 nt, Human
cagcuucauugccugaugucuu

SEQ ID NO: 73033 - RNA, 22 nt, Human
cagcuuccacagacuuggcucg

SEQ ID NO: 73034 - RNA, 22 nt, Human
cagcuucuaaagugugaagcca

SEQ ID NO: 73035 - RNA, 22 nt, Human
cagcuucucagaaagcugaggu

SEQ ID NO: 73036 - RNA, 22 nt, Human
cagcuucuccauucuucuggcu

SEQ ID NO: 73037 - RNA, 22 nt, Human
cagcuucuccggccuggugcgg

SEQ ID NO: 73038 - RNA, 22 nt, Human
cagcuucucgggagcgcaugug

SEQ ID NO: 73039 - RNA, 22 nt, Human
cagcuucugucugauuagcaag

SEQ ID NO: 73040 - RNA, 22 nt, Human
cagcuucuguuucuagccccug

SEQ ID NO: 73041 - RNA, 22 nt, Human
cagcuucuuacgagcugguacu

SEQ ID NO: 73042 - RNA, 22 nt, Human
cagcuucuucaguccuggagcu

SEQ ID NO: 73043 - RNA, 22 nt, Human
cagcuuggaggaggaucuaaga

SEQ ID NO: 73044 - RNA, 22 nt, Human
cagcuuggauuuuggcacgugu

SEQ ID NO: 73045 - RNA, 22 nt, Human
cagcuugggaguuugguuuuau

SEQ ID NO: 73046 - RNA, 22 nt, Human
cagcuugggggcgcuggccuca

SEQ ID NO: 73047 - RNA, 22 nt, Human
cagcuuguuuuauuuggggacc

SEQ ID NO: 73048 - RNA, 22 nt, Human
cagcuuuaguaacccacugcuc

SEQ ID NO: 73049 - RNA, 22 nt, Human
cagcuuucuuccuucugucugu

SEQ ID NO: 73050 - RNA, 22 nt, Human
cagcuuucuuuccauaagguuu

SEQ ID NO: 73051 - RNA, 22 nt, Human
cagcuuugaaacauggcucuag

SEQ ID NO: 73052 - RNA, 22 nt, Human
cagcuuugcaggcuggucagug

SEQ ID NO: 73053 - RNA, 22 nt, Human
cagcuuugcccuuugcccaauc

SEQ ID NO: 73054 - RNA, 22 nt, Human
cagcuuuggcccagucgggagg

SEQ ID NO: 73055 - RNA, 22 nt, Human
cagcuuuguccugcaaaccuga

SEQ ID NO: 73056 - RNA, 22 nt, Human
cagcuuugugacuucggacaag

SEQ ID NO: 73057 - RNA, 22 nt, Human
cagcuuuuaggacugugagaaa

SEQ ID NO: 73058 - RNA, 22 nt, Human
cagcuuuuggcaggaugaccag

SEQ ID NO: 73059 - RNA, 22 nt, Human
caggaaaaggagacuuuagcac

SEQ ID NO: 73060 - RNA, 22 nt, Human
caggaaacaaagccuugcucau

SEQ ID NO: 73061 - RNA, 16 nt, Human
caggaaacuuaaagac

SEQ ID NO: 73062 - RNA, 22 nt, Human
caggaaagccgagugccauagg

SEQ ID NO: 73063 - RNA, 22 nt, Human
caggaaagucuguaaaggaacc

SEQ ID NO: 73064 - RNA, 22 nt, Human
caggaaauaaaugguaaugcau

SEQ ID NO: 73065 - RNA, 22 nt, Human
caggaaauaucuccuggcagag

SEQ ID NO: 73066 - RNA, 23 nt, Human
caggaaaucaauucuuccagcau

SEQ ID NO: 73067 - RNA, 22 nt, Human
caggaaaugaaagcuagcuaau

SEQ ID NO: 73068 - RNA, 15 nt, Human
caggaaaugaaucug

SEQ ID NO: 73069 - RNA, 22 nt, Human
caggaaaugaggcugaagggug

SEQ ID NO: 73070 - RNA, 22 nt, Human
caggaaaugcguaguugaacuu

SEQ ID NO: 73071 - RNA, 22 nt, Human
caggaaaugcuaucauagcuga

SEQ ID NO: 73072 - RNA, 23 nt, Human
caggaaaugcuuggaggggcugg

SEQ ID NO: 73073 - RNA, 22 nt, Human
caggaaauggcugaauaaauuc

SEQ ID NO: 73074 - RNA, 22 nt, Human
caggaaauuuaagaguguacaa

SEQ ID NO: 73075 - RNA, 22 nt, Human
caggaacaauaucuguccuggu

SEQ ID NO: 73076 - RNA, 22 nt, Human
caggaacaccugcagcuagugg

SEQ ID NO: 73077 - RNA, 22 nt, Human
caggaacagaguggcauugucu

SEQ ID NO: 73078 - RNA, 22 nt, Human
caggaacagcugaccugacaau

SEQ ID NO: 73079 - RNA, 22 nt, Human
caggaacaggcugaugggcagg

SEQ ID NO: 73080 - RNA, 22 nt, Human
caggaacaggggagugaaccug

SEQ ID NO: 73081 - RNA, 19 nt, Human
caggaacauggagggaggg

SEQ ID NO: 73082 - RNA, 21 nt, Human
caggaacauucuuuacauuua

SEQ ID NO: 73083 - RNA, 22 nt, Human
caggaacauuuaaccacagggu

SEQ ID NO: 73084 - RNA, 20 nt, Human
caggaaccaaagaggacucc

SEQ ID NO: 73085 - RNA, 22 nt, Human
caggaaccagaaccuucccccg

SEQ ID NO: 73086 - RNA, 22 nt, Human
caggaaccauuuucucuuuaua

SEQ ID NO: 73087 - RNA, 22 nt, Human
caggaacccccacucucagcuc

SEQ ID NO: 73088 - RNA, 22 nt, Human
caggaaccuacaucuguuuggg

SEQ ID NO: 73089 - RNA, 22 nt, Human
caggaacgccugguguuggccu

SEQ ID NO: 73090 - RNA, 22 nt, Human
caggaagagaacauggaggcug

SEQ ID NO: 73091 - RNA, 22 nt, Human
caggaagaggacaggcuucccc

SEQ ID NO: 73092 - RNA, 22 nt, Human
caggaagauuagaccaagagcu

SEQ ID NO: 73093 - RNA, 22 nt, Human
caggaagcaccagcccggcccc

SEQ ID NO: 73094 - RNA, 22 nt, Human
caggaagcugagcugcacugca

SEQ ID NO: 73095 - RNA, 22 nt, Human
caggaagcugccggugagcgag

SEQ ID NO: 73096 - RNA, 22 nt, Human
caggaagcuggguuuccauaca

SEQ ID NO: 73097 - RNA, 22 nt, Human
caggaaggcgcggcugugccug

SEQ ID NO: 73098 - RNA, 22 nt, Human
caggaaggggcucacucuggcc

SEQ ID NO: 73099 - RNA, 22 nt, Human
caggaagugccuggugagagga

SEQ ID NO: 73100 - RNA, 22 nt, Human
caggaaguggggucauggagua

SEQ ID NO: 73101 - RNA, 22 nt, Human
caggaagugugaggguggugua

SEQ ID NO: 73102 - RNA, 22 nt, Human
caggaagugugccugagcaccu

SEQ ID NO: 73103 - RNA, 22 nt, Human
caggaauaguggagcaacaaga

SEQ ID NO: 73104 - RNA, 22 nt, Human
caggaaugacugcagauggggc

SEQ ID NO: 73105 - RNA, 22 nt, Human
caggaaugggugacagucagcu

SEQ ID NO: 73106 - RNA, 22 nt, Human
caggacaauuuccacuugguaa

SEQ ID NO: 73107 - RNA, 19 nt, Human
caggacagacuucaaagcc

SEQ ID NO: 73108 - RNA, 22 nt, Human
caggacagcucaacaccuccuc

SEQ ID NO: 73109 - RNA, 22 nt, Human
caggacagcugggccaccacca

SEQ ID NO: 73110 - RNA, 22 nt, Human
caggacagguguucuagaucag

SEQ ID NO: 73111 - RNA, 22 nt, Human
caggacaucuucuguguuuuua

SEQ ID NO: 73112 - RNA, 22 nt, Human
caggaccuaacucaccugucuc

SEQ ID NO: 73113 - RNA, 22 nt, Human
caggaccuggaaugcuugugaa

SEQ ID NO: 73114 - RNA, 22 nt, Human
caggagaaauguggcugcuacc

SEQ ID NO: 73115 - RNA, 22 nt, Human
caggagacaaguuagcagcuga

SEQ ID NO: 73116 - RNA, 22 nt, Human
caggagacaauggcuguggggc

SEQ ID NO: 73117 - RNA, 22 nt, Human
caggagaccugguaagccaagu

SEQ ID NO: 73118 - RNA, 22 nt, Human
caggagagcccggguccgggcu

SEQ ID NO: 73119 - RNA, 22 nt, Human
caggagaggcuguacguuucuc

SEQ ID NO: 73120 - RNA, 22 nt, Human
caggagcaaauccaaaagaauu

SEQ ID NO: 73121 - RNA, 18 nt, Human
caggagcaggaguugaac

SEQ ID NO: 73122 - RNA, 22 nt, Human
caggagcaguuagaagcccacu

SEQ ID NO: 73123 - RNA, 22 nt, Human
caggagcaugcugaugccagaa

SEQ ID NO: 73124 - RNA, 22 nt, Human
caggagccacauuccaccuuga

SEQ ID NO: 73125 - RNA, 22 nt, Human
caggagccccaggcugacaaua

SEQ ID NO: 73126 - RNA, 22 nt, Human
caggagcucaagaccacccugg

SEQ ID NO: 73127 - RNA, 22 nt, Human
caggagcucacagucuuugggu

SEQ ID NO: 73128 - RNA, 22 nt, Human
caggcuugugucucagcugcag

SEQ ID NO: 73129 - RNA, 22 nt, Human
caggcuuuugcauagcacuggg

SEQ ID NO: 73130 - RNA, 22 nt, Human
cagggaaaguucuuguccacuc

SEQ ID NO: 73131 - RNA, 22 nt, Human
cagggaagaauaguuagcaaag

SEQ ID NO: 73132 - RNA, 22 nt, Human
cagggaaggcugcaaauguuaa

SEQ ID NO: 73133 - RNA, 22 nt, Human
cagggacagggaucauuugcuu

SEQ ID NO: 73134 - RNA, 22 nt, Human
cagggacaugacuggucucugu

SEQ ID NO: 73135 - RNA, 22 nt, Human
cagggacccgcacagguagcau

SEQ ID NO: 73136 - RNA, 22 nt, Human
cagggacuacagccagcccucc

SEQ ID NO: 73137 - RNA, 22 nt, Human
cagggagaagucuggucagucc

SEQ ID NO: 73138 - RNA, 22 nt, Human
cagggagaggcaucauagggaa

SEQ ID NO: 73139 - RNA, 22 nt, Human
cagggagcacugcgagcggcag

SEQ ID NO: 73140 - RNA, 22 nt, Human
cagggagcagcaugggcaaagg

SEQ ID NO: 73141 - RNA, 22 nt, Human
cagggagcagccccuagaagua

SEQ ID NO: 73142 - RNA, 22 nt, Human
cagggagcggagucccaugccu

SEQ ID NO: 73143 - RNA, 22 nt, Human
cagggagcuauuaggguuagug

SEQ ID NO: 73144 - RNA, 22 nt, Human
cagggagcucugggccggacuc

SEQ ID NO: 73145 - RNA, 22 nt, Human
cagggagcugacaaccaaggag

SEQ ID NO: 73146 - RNA, 22 nt, Human
cagggagcuuucccaggacccu

SEQ ID NO: 73147 - RNA, 22 nt, Human
cagggagucaacaaacagauca

SEQ ID NO: 73148 - RNA, 22 nt, Human
cagggaugagaaagcucucuaa

SEQ ID NO: 73149 - RNA, 22 nt, Human
cagggaugggauggagucaguu

SEQ ID NO: 73150 - RNA, 19 nt, Human
cagggauggguagggacuc

SEQ ID NO: 73151 - RNA, 22 nt, Human
cagggaugguugagaauuggua

SEQ ID NO: 73152 - RNA, 22 nt, Human
cagggcaaagucuucuagaacc

SEQ ID NO: 73153 - RNA, 22 nt, Human
caggcuucagcauccacuuagu

SEQ ID NO: 73154 - RNA, 22 nt, Human
caggcuucagggaacgcagucu

SEQ ID NO: 73155 - RNA, 22 nt, Human
caggcuucaugaauuaugcacc

SEQ ID NO: 73156 - RNA, 22 nt, Human
caggcuucuuuucuuuccagac

SEQ ID NO: 73157 - RNA, 22 nt, Human
caggcuugaugugucuauacuu

SEQ ID NO: 73158 - RNA, 22 nt, Human
caggcuuggcagggaggcuggu

SEQ ID NO: 73159 - RNA, 22 nt, Human
caggcuugggagcagagccacu

SEQ ID NO: 73160 - RNA, 22 nt, Human
caggcuuggguucucugaguua

SEQ ID NO: 73161 - RNA, 22 nt, Human
caggcuuuuucugcuguccucu

SEQ ID NO: 73162 - RNA, 22 nt, Human
cagggaaacuaggaaauaagcu

SEQ ID NO: 73163 - RNA, 22 nt, Human
cagggaagagccgaugcugcag

SEQ ID NO: 73164 - RNA, 22 nt, Human
cagggacaaacaagguugggga

SEQ ID NO: 73165 - RNA, 22 nt, Human
cagggacaaagugagaaaggaa

SEQ ID NO: 73166 - RNA, 20 nt, Human
cagggacagcaguggguuuu

SEQ ID NO: 73167 - RNA, 22 nt, Human
cagggacagccuugggguggcg

SEQ ID NO: 73168 - RNA, 22 nt, Human
cagggacucgcuggacauaccg

SEQ ID NO: 73169 - RNA, 22 nt, Human
cagggagccuccaaagcuuuca

SEQ ID NO: 73170 - RNA, 22 nt, Human
cagggagcuuugucuucucauu

SEQ ID NO: 73171 - RNA, 22 nt, Human
cagggagggacaauugucaccu

SEQ ID NO: 73172 - RNA, 22 nt, Human
cagggaguuuuuguuccucuag

SEQ ID NO: 73173 - RNA, 22 nt, Human
cagggaugcuguuaaacauccu

SEQ ID NO: 73174 - RNA, 22 nt, Human
cagggauggcugucaggaugua

SEQ ID NO: 73175 - RNA, 22 nt, Human
cagggaugguaaauauguaaag

SEQ ID NO: 73176 - RNA, 22 nt, Human
cagggcaaagagagcacaugcu

SEQ ID NO: 73177 - RNA, 20 nt, Human
cagggcacacugcagccucg

SEQ ID NO: 73178 - RNA, 22 nt, Human
cagggcaggaugcugugauuau

SEQ ID NO: 73179 - RNA, 22 nt, Human
cagggcagggagcuuagaauga

SEQ ID NO: 73180 - RNA, 22 nt, Human
cagggcagggauguugcggcag

SEQ ID NO: 73181 - RNA, 22 nt, Human
cagggccagccauccugcuggg

SEQ ID NO: 73182 - RNA, 22 nt, Human
cagggccagcgcccaggcccag

SEQ ID NO: 73183 - RNA, 23 nt, Human
cagggcccugcucaauuucucca

SEQ ID NO: 73184 - RNA, 22 nt, Human
cagggccucauccucagagauu

SEQ ID NO: 73185 - RNA, 22 nt, Human
cagggccucauggccggggugc

SEQ ID NO: 73186 - RNA, 22 nt, Human
cagggccucucaucccacgggc

SEQ ID NO: 73187 - RNA, 22 nt, Human
cagggccugcuuccuucuuguu

SEQ ID NO: 73188 - RNA, 22 nt, Human
cagggccuggagcugggccugc

SEQ ID NO: 73189 - RNA, 22 nt, Human
cagggccuuguucaggagugaa

SEQ ID NO: 73190 - RNA, 22 nt, Human
cagggccuuuuagcaucuucuc

SEQ ID NO: 73191 - RNA, 22 nt, Human
cagggcggggucugccggcccu

SEQ ID NO: 73192 - RNA, 22 nt, Human
cagggcucagggacugcagaaa

SEQ ID NO: 73193 - RNA, 22 nt, Human
cagggcucaucugugugaccag

SEQ ID NO: 73194 - RNA, 22 nt, Human
cagggcuccccagagagccucu

SEQ ID NO: 73195 - RNA, 22 nt, Human
cagggcucgcucgcucgcucgc

SEQ ID NO: 73196 - RNA, 22 nt, Human
cagggcucgcucuugcccuucg

SEQ ID NO: 73197 - RNA, 22 nt, Human
cagggcucgcugccagcuucag

SEQ ID NO: 73198 - RNA, 22 nt, Human
cagggcugaaaucaagguguag

SEQ ID NO: 73199 - RNA, 22 nt, Human
cagggcugaagaaauucaaaag

SEQ ID NO: 73200 - RNA, 22 nt, Human
cagggcugaggacacaaguaaa

SEQ ID NO: 73201 - RNA, 22 nt, Human
cagggcugcuggccgugcccuc

SEQ ID NO: 73202 - RNA, 22 nt, Human
cagggcuguaaauuagugcuga

SEQ ID NO: 73203 - RNA, 22 nt, Human
cagggcugugcccaucuucccc

SEQ ID NO: 73204 - RNA, 18 nt, Human
cagggcuguggggucacu

SEQ ID NO: 73205 - RNA, 22 nt, Human
cagggcuuucccuuguagaaau

SEQ ID NO: 73206 - RNA, 22 nt, Human
cagggcuuugaacaggcaucaa

SEQ ID NO: 73207 - RNA, 22 nt, Human
caggggaagaugccaagggaga

SEQ ID NO: 73208 - RNA, 22 nt, Human
caggggaaggagccuugaaacu

SEQ ID NO: 73209 - RNA, 22 nt, Human
caggggacauuaaagcuccaua

SEQ ID NO: 73210 - RNA, 22 nt, Human
caggggaguuuuaugcaacaga

SEQ ID NO: 73211 - RNA, 22 nt, Human
caggggcaggugugagaucauc

SEQ ID NO: 73212 - RNA, 22 nt, Human
caggggcagucugugugcgugg

SEQ ID NO: 73213 - RNA, 22 nt, Human
caggggccaggcugucugcugu

SEQ ID NO: 73214 - RNA, 22 nt, Human
caggggccuguccuggcuucug

SEQ ID NO: 73215 - RNA, 22 nt, Human
caggggcggguaaaaggccucc

SEQ ID NO: 73216 - RNA, 22 nt, Human
caggggcucugagauugucuaa

SEQ ID NO: 73217 - RNA, 22 nt, Human
caggggcucugggugaugugag

SEQ ID NO: 73218 - RNA, 22 nt, Human
cagggggcuguggcuguccagu

SEQ ID NO: 73219 - RNA, 22 nt, Human
cagggguauucaagguaguuua

SEQ ID NO: 73220 - RNA, 22 nt, Human
caggguaguaauuuaauacaag

SEQ ID NO: 73221 - RNA, 22 nt, Human
cagggucccaggagcugcuuuc

SEQ ID NO: 73222 - RNA, 22 nt, Human
caggguccccgggucuccugug

SEQ ID NO: 73223 - RNA, 22 nt, Human
cagggucugaugguccucacuu

SEQ ID NO: 73224 - RNA, 22 nt, Human
cagggucuuggcgccaucaccc

SEQ ID NO: 73225 - RNA, 22 nt, Human
cagggugcagagcuaggguagu

SEQ ID NO: 73226 - RNA, 22 nt, Human
cagggugccaaagaacaaauau

SEQ ID NO: 73227 - RNA, 22 nt, Human
cagggugccucugcucccacca

SEQ ID NO: 73228 - RNA, 22 nt, Human
cagggugcgccacucagaugua

SEQ ID NO: 73229 - RNA, 22 nt, Human
cagggugcugcaccaucccuca

SEQ ID NO: 73230 - RNA, 22 nt, Human
cagggugcuuccguggagcugu

SEQ ID NO: 73231 - RNA, 22 nt, Human
caggguggaaaagcuaguugga

SEQ ID NO: 73232 - RNA, 22 nt, Human
caggguggaacaggcaauacuu

SEQ ID NO: 73233 - RNA, 22 nt, Human
caggguggcacucagcgcaucu

SEQ ID NO: 73234 - RNA, 22 nt, Human
caggguguggucugcauucgga

SEQ ID NO: 73235 - RNA, 22 nt, Human
caggguuauacagcugaacaaa

SEQ ID NO: 73236 - RNA, 22 nt, Human
caggguugggcuccaaggaugg

SEQ ID NO: 73237 - RNA, 22 nt, Human
caguaauagagugccagggaug

SEQ ID NO: 73238 - RNA, 22 nt, Human
caguaauagguaacauugcccu

SEQ ID NO: 73239 - RNA, 22 nt, Human
caguaauaucuguugaagcuau

SEQ ID NO: 73240 - RNA, 22 nt, Human
caguaauauuuuacucuaggcc

SEQ ID NO: 73241 - RNA, 22 nt, Human
caguacaauguugaaaaggagu

SEQ ID NO: 73242 - RNA, 22 nt, Human
caguacaauuuuacaaaggacg

SEQ ID NO: 73243 - RNA, 22 nt, Human
caguacacaagcuuucauguau

SEQ ID NO: 73244 - RNA, 22 nt, Human
caguacagaaucuauuccugca

SEQ ID NO: 73245 - RNA, 22 nt, Human
caguacauuucauaugauucua

SEQ ID NO: 73246 - RNA, 23 nt, Human
caguacuuaguguagcguuaauu

SEQ ID NO: 73247 - RNA, 22 nt, Human
caguacuuggucaaggaagcag

SEQ ID NO: 73248 - RNA, 22 nt, Human
caguacuuuucaaccaguauga

SEQ ID NO: 73249 - RNA, 20 nt, Human
caguagcaauaauuagaagc

SEQ ID NO: 73250 - RNA, 22 nt, Human
caguagcacuagauaugugugg

SEQ ID NO: 73251 - RNA, 22 nt, Human
caguagcaugcuuaucuuuuga

SEQ ID NO: 73252 - RNA, 22 nt, Human
caguagccacuagacacaugua

SEQ ID NO: 73253 - RNA, 22 nt, Human
caguagcuucaguugaggccug

SEQ ID NO: 73254 - RNA, 22 nt, Human
caguagcuugcuuaggcuuuua

SEQ ID NO: 73255 - RNA, 22 nt, Human
caguaggagguucugagguucu

SEQ ID NO: 73256 - RNA, 22 nt, Human
caguagggaaugugggaggcug

SEQ ID NO: 73257 - RNA, 17 nt, Human
caguaguggcacuggag

SEQ ID NO: 73258 - RNA, 22 nt, Human
caguaguggucuaucacuggag

SEQ ID NO: 73259 - RNA, 22 nt, Human
caguauaaugcccccugugggg

SEQ ID NO: 73260 - RNA, 23 nt, Human
caguauaauguauggauggggca

SEQ ID NO: 73261 - RNA, 22 nt, Human
caguauaugcucuuucaucaaa

SEQ ID NO: 73262 - RNA, 19 nt, Human
caguaucauugcacauagu

SEQ ID NO: 73263 - RNA, 22 nt, Human
caguaucuccacauguaaagug

SEQ ID NO: 73264 - RNA, 22 nt, Human
caguaucuugcuuauagacaca

SEQ ID NO: 73265 - RNA, 22 nt, Human
caguauguacucuuaucaugua

SEQ ID NO: 73266 - RNA, 22 nt, Human
cucauaaacauuauucauuauu

SEQ ID NO: 73267 - RNA, 22 nt, Human
cucauaaagugagaauaugacc

SEQ ID NO: 73268 - RNA, 22 nt, Human
cucauaaggagcucacaaccua

SEQ ID NO: 73269 - RNA, 22 nt, Human
cucauagacaagccucuuuuaa

SEQ ID NO: 73270 - RNA, 22 nt, Human
cucauauugcugguggucuaag

SEQ ID NO: 73271 - RNA, 22 nt, Human
cucaucagaaauaccugacaaa

SEQ ID NO: 73272 - RNA, 22 nt, Human
cucaucugcucuuauuaucuua

SEQ ID NO: 73273 - RNA, 22 nt, Human
cucaucuguauauagugaauga

SEQ ID NO: 73274 - RNA, 22 nt, Human
cucauggagggagugcucuucc

SEQ ID NO: 73275 - RNA, 22 nt, Human
cucauggcagagucaccugucc

SEQ ID NO: 73276 - RNA, 22 nt, Human
cucaugucaggggugucaaugu

SEQ ID NO: 73277 - RNA, 22 nt, Human
cucaugucggcaggacucgccc

SEQ ID NO: 73278 - RNA, 18 nt, Human
cucauguguggucccagc

SEQ ID NO: 73279 - RNA, 22 nt, Human
cucauuuacacuaugggaacua

SEQ ID NO: 73280 - RNA, 22 nt, Human
cucauuuaccuuugcaaucaag

SEQ ID NO: 73281 - RNA, 22 nt, Human
cucauuuacuacucaugugacc

SEQ ID NO: 73282 - RNA, 21 nt, Human
cucauuuauuuuuguguccaa

SEQ ID NO: 73283 - RNA, 22 nt, Human
cuccaaaggauaaaagcagagu

SEQ ID NO: 73284 - RNA, 22 nt, Human
cuccaaauacaauauuguuguu

SEQ ID NO: 73285 - RNA, 19 nt, Human
cuccaaauacuuuucccuu

SEQ ID NO: 73286 - RNA, 22 nt, Human
cuccaaauucagucacagucug

SEQ ID NO: 73287 - RNA, 20 nt, Human
cuccaaauuccugaggauaa

SEQ ID NO: 73288 - RNA, 22 nt, Human
cuccaaggauucuggacccuug

SEQ ID NO: 73289 - RNA, 22 nt, Human
cuccaaggguugugggugguca

SEQ ID NO: 73290 - RNA, 22 nt, Human
cuccaaggugguuauuugagau

SEQ ID NO: 73291 - RNA, 22 nt, Human
cuccaaguccgagggcucucaa

SEQ ID NO: 73292 - RNA, 22 nt, Human
cuccaagucggcugcagcugga

SEQ ID NO: 73293 - RNA, 22 nt, Human
cuccacagccccuccaguggca

SEQ ID NO: 73294 - RNA, 22 nt, Human
cuccagaacugggagagaauaa

SEQ ID NO: 73295 - RNA, 22 nt, Human
cuccagaggcccuaucccacua

SEQ ID NO: 73296 - RNA, 22 nt, Human
cuccagaggcgacuugcaucac

SEQ ID NO: 73297 - RNA, 22 nt, Human
cuccagagguucucaucuggga

SEQ ID NO: 73298 - RNA, 22 nt, Human
cuccagagucacacugccuggg

SEQ ID NO: 73299 - RNA, 22 nt, Human
cuccagauaggagggggucccc

SEQ ID NO: 73300 - RNA, 22 nt, Human
cuccagcagaaagggcgagugg

SEQ ID NO: 73301 - RNA, 20 nt, Human
cuccagccccugcccugguc

SEQ ID NO: 73302 - RNA, 22 nt, Human
cuccagccucagaugacgguac

SEQ ID NO: 73303 - RNA, 22 nt, Human
cuccagcugaguaagaacacua

SEQ ID NO: 73304 - RNA, 22 nt, Human
cuccagcugccaccagauguuu

SEQ ID NO: 73305 - RNA, 22 nt, Human
cuccagcugcuggucugagacu

SEQ ID NO: 73306 - RNA, 22 nt, Human
cuccagcuucccucagcugugg

SEQ ID NO: 73307 - RNA, 22 nt, Human
cuccagcuuuuucccaguuggc

SEQ ID NO: 73308 - RNA, 22 nt, Human
cuccaggaaagccugaggcccg

SEQ ID NO: 73309 - RNA, 22 nt, Human
cuccaggacacuaacccaggcu

SEQ ID NO: 73310 - RNA, 22 nt, Human
cuccaggacucaggccccuggg

SEQ ID NO: 73311 - RNA, 22 nt, Human
cuccaggaguggccuggacacc

SEQ ID NO: 73312 - RNA, 19 nt, Human
cuccaggauggcugggcga

SEQ ID NO: 73313 - RNA, 22 nt, Human
cuccaggccagggaaguggaca

SEQ ID NO: 73314 - RNA, 22 nt, Human
cuccaggccauggcugcggagg

SEQ ID NO: 73315 - RNA, 20 nt, Human
cuccagggaacagacuggag

SEQ ID NO: 73316 - RNA, 18 nt, Human
cuccagguaauucugaua

SEQ ID NO: 73317 - RNA, 22 nt, Human
cuccagucauagccucuugagu

SEQ ID NO: 73318 - RNA, 22 nt, Human
cuccagucuagguccuacuuau

SEQ ID NO: 73319 - RNA, 22 nt, Human
cuccagucucuuucggagacac

SEQ ID NO: 73320 - RNA, 22 nt, Human
cuccagugcccuccuugggggc

SEQ ID NO: 73321 - RNA, 22 nt, Human
cuccagugcgcaggacagcccc

SEQ ID NO: 73322 - RNA, 22 nt, Human
cuccaguggcacaaaugggugc

SEQ ID NO: 73323 - RNA, 22 nt, Human
cuccauuguucgcgcagcugca

SEQ ID NO: 73324 - RNA, 22 nt, Human
cucccagaaaauucucagacaa

SEQ ID NO: 73325 - RNA, 22 nt, Human
cucccagagaccaagcugagaa

SEQ ID NO: 73326 - RNA, 22 nt, Human
cucccagaggugucauucgagc

SEQ ID NO: 73327 - RNA, 22 nt, Human
cucccaggcacagggaggagcc

SEQ ID NO: 73328 - RNA, 22 nt, Human
cucccagggucuaggcugcugg

SEQ ID NO: 73329 - RNA, 22 nt, Human
cucccagguuacaucugagccu

SEQ ID NO: 73330 - RNA, 22 nt, Human
cucccauagcauuuuaaauagu

SEQ ID NO: 73331 - RNA, 22 nt, Human
cuccccaacucagccgaggcuu

SEQ ID NO: 73332 - RNA, 22 nt, Human
cuccccauccaggcagcaggug

SEQ ID NO: 73333 - RNA, 22 nt, Human
cuccccauuaugcagucauuau

SEQ ID NO: 73334 - RNA, 22 nt, Human
cucccccuuagcucuugucuuu

SEQ ID NO: 73335 - RNA, 20 nt, Human
cuccccucuacagagggcug

SEQ ID NO: 73336 - RNA, 18 nt, Human
cuccccuguuuucccugc

SEQ ID NO: 73337 - RNA, 22 nt, Human
cuccccuuuggaagaagggucu

SEQ ID NO: 73338 - RNA, 22 nt, Human
cucccguggauguucuucaguc

SEQ ID NO: 73339 - RNA, 22 nt, Human
cucccucucaccggagcccugg

SEQ ID NO: 73340 - RNA, 22 nt, Human
cucccucuguccgaggccggcu

SEQ ID NO: 73341 - RNA, 22 nt, Human
cucccucugucuuguccagaaa

SEQ ID NO: 73342 - RNA, 23 nt, Human
cucccugaacaugacacaccaga

SEQ ID NO: 73343 - RNA, 23 nt, Human
cucccuggaguuucuggaagaug

SEQ ID NO: 73344 - RNA, 23 nt, Human
cucccuggcccuugggagaccug

SEQ ID NO: 73345 - RNA, 22 nt, Human
cucccugggcagauguggcucu

SEQ ID NO: 73346 - RNA, 22 nt, Human
cucucuggaccucaacuauuuu

SEQ ID NO: 73347 - RNA, 22 nt, Human
cucucuggauauuuguaugcug

SEQ ID NO: 73348 - RNA, 19 nt, Human
cucucuggcggugucugcg

SEQ ID NO: 73349 - RNA, 22 nt, Human
cucucuggcuuggcacggagau

SEQ ID NO: 73350 - RNA, 22 nt, Human
cucucugggaauauuuuauucu

SEQ ID NO: 73351 - RNA, 22 nt, Human
cucucugggcccaguuggcacc

SEQ ID NO: 73352 - RNA, 22 nt, Human
cucucuggguccucuuuuauag

SEQ ID NO: 73353 - RNA, 18 nt, Human
cucucugggugaggacaa

SEQ ID NO: 73354 - RNA, 22 nt, Human
cucucuucccgugaguguugca

SEQ ID NO: 73355 - RNA, 22 nt, Human
cucucuuucauuggucgccuug

SEQ ID NO: 73356 - RNA, 18 nt, Human
cucugaaagacacaccag

SEQ ID NO: 73357 - RNA, 22 nt, Human
cucugaaagaguuuaguauuau

SEQ ID NO: 73358 - RNA, 22 nt, Human
cucugaacucuugggcagcaug

SEQ ID NO: 73359 - RNA, 22 nt, Human
cucugaauggacacuccagugu

SEQ ID NO: 73360 - RNA, 22 nt, Human
cucugacaccaucucaugacag

SEQ ID NO: 73361 - RNA, 22 nt, Human
cucugacauucugugacucuga

SEQ ID NO: 73362 - RNA, 22 nt, Human
cucugaccucuagccagcucug

SEQ ID NO: 73363 - RNA, 22 nt, Human
cucugagaagaguucaaguaaa

SEQ ID NO: 73364 - RNA, 22 nt, Human
cucugagagagcuggugagcac

SEQ ID NO: 73365 - RNA, 22 nt, Human
cucugagauaguuucuaucaau

SEQ ID NO: 73366 - RNA, 22 nt, Human
cucugagcuccuggaagcgugc

SEQ ID NO: 73367 - RNA, 22 nt, Human
cucugagcucgugcaguacuuc

SEQ ID NO: 73368 - RNA, 22 nt, Human
cucugagcugaaacaugagcau

SEQ ID NO: 73369 - RNA, 20 nt, Human
cucugaggcugagaagggag

SEQ ID NO: 73370 - RNA, 22 nt, Human
cucugagggucuaaggagucac

SEQ ID NO: 73371 - RNA, 22 nt, Human
cucugaggucagggcccggcaa

SEQ ID NO: 73372 - RNA, 22 nt, Human
cucugaggucuaggaccauggc

SEQ ID NO: 73373 - RNA, 22 nt, Human
cucugaguugaggcaggagagu

SEQ ID NO: 73374 - RNA, 22 nt, Human
cucugcaacuucuagcaguguc

SEQ ID NO: 73375 - RNA, 22 nt, Human
cucugcaaggcccuccaguagc

SEQ ID NO: 73376 - RNA, 22 nt, Human
cucugcaccuuguaggaggcaa

SEQ ID NO: 73377 - RNA, 22 nt, Human
cucugcagaggcccaaggcuga

SEQ ID NO: 73378 - RNA, 21 nt, Human
cucugcagcccugcuuccagg

SEQ ID NO: 73379 - RNA, 23 nt, Human
cucugcaggagagugggcagggc

SEQ ID NO: 73380 - RNA, 21 nt, Human
cucugcagugcccaccuugcc

SEQ ID NO: 73381 - RNA, 22 nt, Human
cucugccaccaugcuuccugac

SEQ ID NO: 73382 - RNA, 22 nt, Human
cucugccaggcagaacggcuuu

SEQ ID NO: 73383 - RNA, 22 nt, Human
cagugauauuuauccuacucac

SEQ ID NO: 73384 - RNA, 22 nt, Human
cagugauguuucugcaucagag

SEQ ID NO: 73385 - RNA, 22 nt, Human
cagugauuacugugcuuuuggu

SEQ ID NO: 73386 - RNA, 22 nt, Human
cagugauucaggugccuguugg

SEQ ID NO: 73387 - RNA, 22 nt, Human
cagugcaauuacaagcuaauuc

SEQ ID NO: 73388 - RNA, 22 nt, Human
cagugcagacguggagggggca

SEQ ID NO: 73389 - RNA, 22 nt, Human
cagugcagccaaggacaggcac

SEQ ID NO: 73390 - RNA, 22 nt, Human
cagugcagcugccccgcuggua

SEQ ID NO: 73391 - RNA, 22 nt, Human
cagugcaggcugggggcccugc

SEQ ID NO: 73392 - RNA, 22 nt, Human
cagugcagguggcagaggacag

SEQ ID NO: 73393 - RNA, 22 nt, Human
cagugcauagauccugaggccu

SEQ ID NO: 73394 - RNA, 22 nt, Human
cagugccaagccacagaucacu

SEQ ID NO: 73395 - RNA, 22 nt, Human
cagugccaaggauggccuggga

SEQ ID NO: 73396 - RNA, 22 nt, Human
cagugccacuuaaugaggcugc

SEQ ID NO: 73397 - RNA, 22 nt, Human
cagugccagagguacuagugga

SEQ ID NO: 73398 - RNA, 22 nt, Human
cagugccaugaugcagagcaau

SEQ ID NO: 73399 - RNA, 19 nt, Human
cagugcccacccuagcaca

SEQ ID NO: 73400 - RNA, 21 nt, Human
cagugccccagcuacaaaagg

SEQ ID NO: 73401 - RNA, 20 nt, Human
cagugcccguggaaaagaug

SEQ ID NO: 73402 - RNA, 20 nt, Human
cagugccuaucauuaauucc

SEQ ID NO: 73403 - RNA, 22 nt, Human
cagugccugggacccggcugug

SEQ ID NO: 73404 - RNA, 22 nt, Human
cagugcuaccccggaaguuggu

SEQ ID NO: 73405 - RNA, 22 nt, Human
cagugcuagggcagagcacucc

SEQ ID NO: 73406 - RNA, 22 nt, Human
cagugcuaggucgugugcuggg

SEQ ID NO: 73407 - RNA, 22 nt, Human
cagugcuauaauccagugucgu

SEQ ID NO: 73408 - RNA, 22 nt, Human
cagugcucauagcuguuccucc

SEQ ID NO: 73409 - RNA, 22 nt, Human
cagugcugcaggcgccugcggu

SEQ ID NO: 73410 - RNA, 22 nt, Human
cagugcugccaaagggaccuug

SEQ ID NO: 73411 - RNA, 21 nt, Human
cagugcugccuaauagggagu

SEQ ID NO: 73412 - RNA, 22 nt, Human
cagugcuguguuugcugccugg

SEQ ID NO: 73413 - RNA, 22 nt, Human
cagugcuguugggcccagagag

SEQ ID NO: 73414 - RNA, 22 nt, Human
caguggaaacuaugcugcugga

SEQ ID NO: 73415 - RNA, 22 nt, Human
caguggaaauauuggcagcauc

SEQ ID NO: 73416 - RNA, 22 nt, Human
caguggaaaucagagugagagu

SEQ ID NO: 73417 - RNA, 22 nt, Human
caguggaauauauaggggauuu

SEQ ID NO: 73418 - RNA, 23 nt, Human
caguggagacucaugcuuccuua

SEQ ID NO: 73419 - RNA, 22 nt, Human
caguggagaggcaugcuuggca

SEQ ID NO: 73420 - RNA, 22 nt, Human
caguggcacgaucucagcucac

SEQ ID NO: 73421 - RNA, 21 nt, Human
caguggcacgauuucggcuca

SEQ ID NO: 73422 - RNA, 22 nt, Human
caguggcagaucaccaacugga

SEQ ID NO: 73423 - RNA, 17 nt, Human
caguggcagaucuucuc

SEQ ID NO: 73424 - RNA, 22 nt, Human
caguggcaggggaagcaggugu

SEQ ID NO: 73425 - RNA, 18 nt, Human
caguggcauaguugagua

SEQ ID NO: 73426 - RNA, 22 nt, Human
caguggccgcggggcugugggu

SEQ ID NO: 73427 - RNA, 22 nt, Human
caguggccugagccaggcuucc

SEQ ID NO: 73428 - RNA, 19 nt, Human
caguggccuggaggucucu

SEQ ID NO: 73429 - RNA, 22 nt, Human
caguggccuuuccugcugcuca

SEQ ID NO: 73430 - RNA, 22 nt, Human
caguggcgugaucucugcucac

SEQ ID NO: 73431 - RNA, 22 nt, Human
cagugggacaugggcacugggc

SEQ ID NO: 73432 - RNA, 22 nt, Human
cagugggauaugggggcagcau

SEQ ID NO: 73433 - RNA, 22 nt, Human
cagugggauugggauuggaacc

SEQ ID NO: 73434 - RNA, 23 nt, Human
cagugggcuucuaacugcuccug

SEQ ID NO: 73435 - RNA, 22 nt, Human
caguggggaggccaggauagaa

SEQ ID NO: 73436 - RNA, 22 nt, Human
caguggguaggaaaggcucuuc

SEQ ID NO: 73437 - RNA, 22 nt, Human
caguggugaagagcaggggcuc

SEQ ID NO: 73438 - RNA, 22 nt, Human
cagugguucucaaucaggaaug

SEQ ID NO: 73439 - RNA, 21 nt, Human
cagugguugcugaauuagugg

SEQ ID NO: 73440 - RNA, 22 nt, Human
cagugguugcuugcauggcucc

SEQ ID NO: 73441 - RNA, 22 nt, Human
caguguauaaacuuuaacauag

SEQ ID NO: 73442 - RNA, 22 nt, Human
cagugucaccaggcgagucucc

SEQ ID NO: 73443 - RNA, 22 nt, Human
cagugucuccagaugcuccaau

SEQ ID NO: 73444 - RNA, 22 nt, Human
cagugucugccuuucuguuugg

SEQ ID NO: 73445 - RNA, 22 nt, Human
cagugucugggacagaaaguca

SEQ ID NO: 73446 - RNA, 22 nt, Human
caguguguccucagaauauaua

SEQ ID NO: 73447 - RNA, 22 nt, Human
caguguuacugggccugggugu

SEQ ID NO: 73448 - RNA, 22 nt, Human
caguguugcuaaguucugaacu

SEQ ID NO: 73449 - RNA, 22 nt, Human
caguguuucugaguuccagcuc

SEQ ID NO: 73450 - RNA, 22 nt, Human
caguuaaacgaugaugggguca

SEQ ID NO: 73451 - RNA, 22 nt, Human
caguuaaacgggccaugugagu

SEQ ID NO: 73452 - RNA, 22 nt, Human
caguuaaagcugcaugugucag

SEQ ID NO: 73453 - RNA, 22 nt, Human
caguuaaaggcccaauaucugg

SEQ ID NO: 73454 - RNA, 18 nt, Human
caguuacaccuucauuca

SEQ ID NO: 73455 - RNA, 22 nt, Human
ucuuuuccuccucuuguuggcc

SEQ ID NO: 73456 - RNA, 22 nt, Human
ucuuuuccuucccuacagaucu

SEQ ID NO: 73457 - RNA, 21 nt, Human
ucuuuucucugcaggauuccu

SEQ ID NO: 73458 - RNA, 22 nt, Human
ucuuuucugccagcugagcccu

SEQ ID NO: 73459 - RNA, 22 nt, Human
ucuuuucuugcauuauugcacu

SEQ ID NO: 73460 - RNA, 22 nt, Human
ucuuuugagggccagaggaaga

SEQ ID NO: 73461 - RNA, 22 nt, Human
ucuuuuguacucaguauugaca

SEQ ID NO: 73462 - RNA, 18 nt, Human
ucuuuuguccccugcugc

SEQ ID NO: 73463 - RNA, 23 nt, Human
ucuuuuuaagagaucuagugacg

SEQ ID NO: 73464 - RNA, 22 nt, Human
ucuuuuucugcacacguguccc

SEQ ID NO: 73465 - RNA, 22 nt, Human
ucuuuuucuuauucccacacug

SEQ ID NO: 73466 - RNA, 22 nt, Human
ucuuuuuuuccugugcagagcu

SEQ ID NO: 73467 - RNA, 22 nt, Human
ugaaaaaacaaguuggcccauu

SEQ ID NO: 73468 - RNA, 22 nt, Human
ugaaaaaccucaguccgcuuua

SEQ ID NO: 73469 - RNA, 22 nt, Human
ugaaaacuugacaagugaggua

SEQ ID NO: 73470 - RNA, 22 nt, Human
ugaaaauuaagcagaugaauga

SEQ ID NO: 73471 - RNA, 22 nt, Human
ugaaacaagggaccguccuuuc

SEQ ID NO: 73472 - RNA, 22 nt, Human
ugaaacaaguuuaagggaucua

SEQ ID NO: 73473 - RNA, 22 nt, Human
ugaaacaauuagaauguaauga

SEQ ID NO: 73474 - RNA, 22 nt, Human
ugaaacacaagccugguuagug

SEQ ID NO: 73475 - RNA, 22 nt, Human
ugaaacacuuucaauuacauau

SEQ ID NO: 73476 - RNA, 22 nt, Human
ugaaacaggaaguaaacagaca

SEQ ID NO: 73477 - RNA, 22 nt, Human
ugaaacauuaggaaaucauuau

SEQ ID NO: 73478 - RNA, 22 nt, Human
ugaaacauuauagaauauuuau

SEQ ID NO: 73479 - RNA, 21 nt, Human
ugaaacauuugaucaaagcac

SEQ ID NO: 73480 - RNA, 22 nt, Human
ugaaacauuugaugaucuuugg

SEQ ID NO: 73481 - RNA, 22 nt, Human
ugaaacggaauguucuuuaucg

SEQ ID NO: 73482 - RNA, 22 nt, Human
ugaaacuuauaagaauaugaau

SEQ ID NO: 73483 - RNA, 22 nt, Human
ugaaacuucuaauaugaauagu

SEQ ID NO: 73484 - RNA, 22 nt, Human
ugaaacuuuugagguucuucca

SEQ ID NO: 73485 - RNA, 22 nt, Human
ugaaagaacuagcaucuucaag

SEQ ID NO: 73486 - RNA, 22 nt, Human
ugaaagaagccucccuuuggag

SEQ ID NO: 73487 - RNA, 21 nt, Human
ugaaagaaggugcagucugaa

SEQ ID NO: 73488 - RNA, 22 nt, Human
ugaaagaagugucacauugcca

SEQ ID NO: 73489 - RNA, 17 nt, Human
ugaaagaaucagggaga

SEQ ID NO: 73490 - RNA, 22 nt, Human
ugaaagacaagguuuuuucaga

SEQ ID NO: 73491 - RNA, 22 nt, Human
ugaaagauaaguuauuauguac

SEQ ID NO: 73492 - RNA, 22 nt, Human
ugaaagaugaaagcaggcuggu

SEQ ID NO: 73493 - RNA, 23 nt, Human
ugaaagcaaugggucuauaguau

SEQ ID NO: 73494 - RNA, 22 nt, Human
ugaaagcagauagcucuguugu

SEQ ID NO: 73495 - RNA, 22 nt, Human
ugaaagcaugcuugccaagcuu

SEQ ID NO: 73496 - RNA, 22 nt, Human
ugaaagcuuguuggaaauguag

SEQ ID NO: 73497 - RNA, 22 nt, Human
ugaaagcuuugggacaguguga

SEQ ID NO: 73498 - RNA, 22 nt, Human
ugaaaggaaaguacagugaugc

SEQ ID NO: 73499 - RNA, 22 nt, Human
ugaaagggaaccugcuggacug

SEQ ID NO: 73500 - RNA, 22 nt, Human
ugaaaggugacauuucuuggau

SEQ ID NO: 73501 - RNA, 22 nt, Human
ugaaagguuaaaaguaguauug

SEQ ID NO: 73502 - RNA, 22 nt, Human
ugaaaguuauuacugaugaugu

SEQ ID NO: 73503 - RNA, 22 nt, Human
ugaaauagaaaaacaggcuucu

SEQ ID NO: 73504 - RNA, 22 nt, Human
ugaaauagacacagugcuauac

SEQ ID NO: 73505 - RNA, 22 nt, Human
ugaaauagacuugcacuauaug

SEQ ID NO: 73506 - RNA, 22 nt, Human
ugaaauaucauuuucaucuccc

SEQ ID NO: 73507 - RNA, 23 nt, Human
ugaaauauucuuuugcaugagcu

SEQ ID NO: 73508 - RNA, 22 nt, Human
ugaaaucaacuaggagacacca

SEQ ID NO: 73509 - RNA, 22 nt, Human
ugaaaucagugguauaaucggg

SEQ ID NO: 73510 - RNA, 22 nt, Human
ugaaaucauguaguuauugcaa

SEQ ID NO: 73511 - RNA, 22 nt, Human
ugaaaucuacccuauucagggu

SEQ ID NO: 73512 - RNA, 22 nt, Human
ugaaaucuccucuuuauauauc

SEQ ID NO: 73513 - RNA, 22 nt, Human
ugaaaucugucccacuuuagcu

SEQ ID NO: 73514 - RNA, 22 nt, Human
ugaaaucuuagccauucugccu

SEQ ID NO: 73515 - RNA, 22 nt, Human
ugaaaucuucacuaagucucuu

SEQ ID NO: 73516 - RNA, 22 nt, Human
ugaaaugagauagauaaucagg

SEQ ID NO: 73517 - RNA, 22 nt, Human
ugaaaugauaucugauaacaaa

SEQ ID NO: 73518 - RNA, 22 nt, Human
ugaaaugcuuaggaccagaagg

SEQ ID NO: 73519 - RNA, 22 nt, Human
ugaaauguagauuaggcauucu

SEQ ID NO: 73520 - RNA, 22 nt, Human
ugaaauguauauugccagugua

SEQ ID NO: 73521 - RNA, 22 nt, Human
ugaaaugucaguguuuuauaag

SEQ ID NO: 73522 - RNA, 22 nt, Human
ugaaaugucauccuuuagccau

SEQ ID NO: 73523 - RNA, 22 nt, Human
ugaaauguguucuaguguuuug

SEQ ID NO: 73524 - RNA, 22 nt, Human
ugaaauguucuggaguuucugu

SEQ ID NO: 73525 - RNA, 22 nt, Human
ugaaauguugguaauuuuauau

SEQ ID NO: 73526 - RNA, 22 nt, Human
ugaaauguuuaucucuccugcu

SEQ ID NO: 73527 - RNA, 22 nt, Human
ugaaauuagugaaguuacaguu

SEQ ID NO: 73528 - RNA, 22 nt, Human
ugaaauucaaaacacauuuguc

SEQ ID NO: 73529 - RNA, 22 nt, Human
ugaaauuccaggagaguuaaaa

SEQ ID NO: 73530 - RNA, 18 nt, Human
ugaaauugcauccaugag

SEQ ID NO: 73531 - RNA, 22 nt, Human
ugaacaaacugcauucuucacu

SEQ ID NO: 73532 - RNA, 22 nt, Human
ugaacacaaauauuuugggguu

SEQ ID NO: 73533 - RNA, 22 nt, Human
ugaacacaucugcgugugucuc

SEQ ID NO: 73534 - RNA, 22 nt, Human
ugaacacauuuucuucaguaga

SEQ ID NO: 73535 - RNA, 20 nt, Human
ugaacacugggguguuucag

SEQ ID NO: 73536 - RNA, 22 nt, Human
ugaacaggugccuucagggagu

SEQ ID NO: 73537 - RNA, 22 nt, Human
ugaacagucaaaaagugaccau

SEQ ID NO: 73538 - RNA, 22 nt, Human
ugaacagugaucuacauguggc

SEQ ID NO: 73539 - RNA, 22 nt, Human
ugaacagugugagggugugacc

SEQ ID NO: 73540 - RNA, 22 nt, Human
ucgcaccuguccucugauuaug

SEQ ID NO: 73541 - RNA, 19 nt, Human
ucgcagaccugaguucuaa

SEQ ID NO: 73542 - RNA, 22 nt, Human
ucgcagaggcacgagugcagaa

SEQ ID NO: 73543 - RNA, 22 nt, Human
ucgcauuugggcaggagaugcu

SEQ ID NO: 73544 - RNA, 22 nt, Human
ucgccagggaugcuguaaggaa

SEQ ID NO: 73545 - RNA, 22 nt, Human
ucgccaucgucggacacaguga

SEQ ID NO: 73546 - RNA, 22 nt, Human
ucgcccaggauggagugcagua

SEQ ID NO: 73547 - RNA, 22 nt, Human
ucgcuugaacccaggaagugga

SEQ ID NO: 73548 - RNA, 22 nt, Human
ucgcuuuaauggucuucacagc

SEQ ID NO: 73549 - RNA, 22 nt, Human
ucggagagcucacagcuguggc

SEQ ID NO: 73550 - RNA, 22 nt, Human
ucggagcuguagaugaaacccu

SEQ ID NO: 73551 - RNA, 22 nt, Human
ucggggauggugucugagggag

SEQ ID NO: 73552 - RNA, 22 nt, Human
ucgucugugaaauugggauaag

SEQ ID NO: 73553 - RNA, 22 nt, Human
ucgugaagucacaauaaagucu

SEQ ID NO: 73554 - RNA, 21 nt, Human
ucgugcagcagcugaggcuug

SEQ ID NO: 73555 - RNA, 22 nt, Human
ucguuaaucagcaccagaauuc

SEQ ID NO: 73556 - RNA, 22 nt, Human
ucuaaacaguuucacucuuaau

SEQ ID NO: 73557 - RNA, 22 nt, Human
ucuaaacauugugauagaccuu

SEQ ID NO: 73558 - RNA, 22 nt, Human
ucuaaacuacgucaaaacuagu

SEQ ID NO: 73559 - RNA, 22 nt, Human
ucuaaacucucuuugaauuaug

SEQ ID NO: 73560 - RNA, 22 nt, Human
ucuaaacugcuagcugacugag

SEQ ID NO: 73561 - RNA, 22 nt, Human
ucuaaacuuguaaacaagcaua

SEQ ID NO: 73562 - RNA, 22 nt, Human
ucuaaagaagaggguucugcgg

SEQ ID NO: 73563 - RNA, 22 nt, Human
ucuaaagagaaccuuuucucau

SEQ ID NO: 73564 - RNA, 22 nt, Human
ugaagacucagaagcuaagaua

SEQ ID NO: 73565 - RNA, 22 nt, Human
ugaagagauuaaguugguuuug

SEQ ID NO: 73566 - RNA, 22 nt, Human
ugaagaggccaaacuaucauug

SEQ ID NO: 73567 - RNA, 22 nt, Human
ugaagauugugcuuggccugua

SEQ ID NO: 73568 - RNA, 22 nt, Human
ugaagcaaacgcuucuguuccu

SEQ ID NO: 73569 - RNA, 22 nt, Human
ugaagcaaauuuuucucagagu

SEQ ID NO: 73570 - RNA, 22 nt, Human
ugaagcaaugaucuuuuggugg

SEQ ID NO: 73571 - RNA, 22 nt, Human
ugaagcagaggggucuugagcu

SEQ ID NO: 73572 - RNA, 22 nt, Human
ugaagcagcaaaugaugggaga

SEQ ID NO: 73573 - RNA, 22 nt, Human
ugaagcaggaaccagcagcauu

SEQ ID NO: 73574 - RNA, 22 nt, Human
ugaagcaggcauugacugauga

SEQ ID NO: 73575 - RNA, 23 nt, Human
ugaagcauggauaacucacaccu

SEQ ID NO: 73576 - RNA, 22 nt, Human
ugaagccacagagcaucugccu

SEQ ID NO: 73577 - RNA, 22 nt, Human
ugaagccagcuuuggaagacac

SEQ ID NO: 73578 - RNA, 23 nt, Human
ugaagcccagugauuuuguuuca

SEQ ID NO: 73579 - RNA, 22 nt, Human
ugaagccugaaagcuggacagg

SEQ ID NO: 73580 - RNA, 22 nt, Human
ugaagccuuguguggccucucu

SEQ ID NO: 73581 - RNA, 22 nt, Human
ugaagcuacagaccuucgcggu

SEQ ID NO: 73582 - RNA, 22 nt, Human
ugaagcuagguucaugaggucg

SEQ ID NO: 73583 - RNA, 22 nt, Human
ugaagcuugagugucaguuccu

SEQ ID NO: 73584 - RNA, 22 nt, Human
ugaagcuuuaggauggguucau

SEQ ID NO: 73585 - RNA, 17 nt, Human
ugaaggaaggaugaugu

SEQ ID NO: 73586 - RNA, 22 nt, Human
ugaaggagaaauggaaaguggg

SEQ ID NO: 73587 - RNA, 22 nt, Human
ugaaggagggaagaaggcucug

SEQ ID NO: 73588 - RNA, 19 nt, Human
ugaaggagggggauggcca

SEQ ID NO: 73589 - RNA, 20 nt, Human
ugaaggcagguaagaaagau

SEQ ID NO: 73590 - RNA, 22 nt, Human
ugaaggccagcagagugaaggc

SEQ ID NO: 73591 - RNA, 20 nt, Human
ugaaggccauuuguuccaga

SEQ ID NO: 73592 - RNA, 22 nt, Human
ugaaggccuccccgagcauuag

SEQ ID NO: 73593 - RNA, 22 nt, Human
ugaaggcugggcucagccagcu

SEQ ID NO: 73594 - RNA, 22 nt, Human
ugaaggcugucaccugcaccuu

SEQ ID NO: 73595 - RNA, 22 nt, Human
ugaaggcuuggauuggucauuu

SEQ ID NO: 73596 - RNA, 22 nt, Human
ugaaggcuugguggcagccucu

SEQ ID NO: 73597 - RNA, 22 nt, Human
ugaaggcuuuuagcucugaaaa

SEQ ID NO: 73598 - RNA, 21 nt, Human
ugaagggcagccucaggcucc

SEQ ID NO: 73599 - RNA, 21 nt, Human
ugaaggggccaucacaaaggc

SEQ ID NO: 73600 - RNA, 22 nt, Human
ugaagggggagauauaugugug

SEQ ID NO: 73601 - RNA, 22 nt, Human
ugaagguaaaggaaggaggcuu

SEQ ID NO: 73602 - RNA, 23 nt, Human
ugaagguauuaccugagaugcuc

SEQ ID NO: 73603 - RNA, 22 nt, Human
ugaaggugauuaugaauguaua

SEQ ID NO: 73604 - RNA, 22 nt, Human
ugaagguguaugcuguggguca

SEQ ID NO: 73605 - RNA, 22 nt, Human
ugaaggugucuuugugaacauc

SEQ ID NO: 73606 - RNA, 22 nt, Human
ugaagguguuuauaccucagau

SEQ ID NO: 73607 - RNA, 22 nt, Human
ugaaguacccguuuuuauugca

SEQ ID NO: 73608 - RNA, 22 nt, Human
ugaaguaggcagcaugcugaga

SEQ ID NO: 73609 - RNA, 22 nt, Human
ugaagucccugacauuuagaaa

SEQ ID NO: 73610 - RNA, 22 nt, Human
ugaaguccuagaacuccuggua

SEQ ID NO: 73611 - RNA, 22 nt, Human
ugaagugucauuuacauuucua

SEQ ID NO: 73612 - RNA, 17 nt, Human
ugaaguuaggcugcaga

SEQ ID NO: 73613 - RNA, 23 nt, Human
ugaaguucauucucacugaugua

SEQ ID NO: 73614 - RNA, 22 nt, Human
ugaaguuguuaagguugccauu

SEQ ID NO: 73615 - RNA, 22 nt, Human
ugaaguuuccucugaggccagu

SEQ ID NO: 73616 - RNA, 22 nt, Human
ugaaguuugguggaaauuuccu

SEQ ID NO: 73617 - RNA, 22 nt, Human
ugaaguuuuacuaggugaauuu

SEQ ID NO: 73618 - RNA, 21 nt, Human
ugaauaaagcugcugucgaua

SEQ ID NO: 73619 - RNA, 22 nt, Human
ugaauaagugaugucauauaua

SEQ ID NO: 73620 - RNA, 22 nt, Human
ugaauacacuaaaaaucacuuu

SEQ ID NO: 73621 - RNA, 22 nt, Human
ugaauacaggaaaauauacuga

SEQ ID NO: 73622 - RNA, 20 nt, Human
ugaauagagagcacauaugc

SEQ ID NO: 73623 - RNA, 18 nt, Human
ugaauagggguuugcaga

SEQ ID NO: 73624 - RNA, 22 nt, Human
ugaauaguccuuggaauaacug

SEQ ID NO: 73625 - RNA, 22 nt, Human
ugaauaugugacuuugauuuca

SEQ ID NO: 73626 - RNA, 22 nt, Human
ugaaucaauaguugcaaguauu

SEQ ID NO: 73627 - RNA, 22 nt, Human
ugaaucaauugucuuaagacau

SEQ ID NO: 73628 - RNA, 22 nt, Human
ugaauccagagcuauuucgucc

SEQ ID NO: 73629 - RNA, 22 nt, Human
ugaaucuuuuuggaaauaaaga

SEQ ID NO: 73630 - RNA, 22 nt, Human
ugaaugaaugaauuaauagagu

SEQ ID NO: 73631 - RNA, 22 nt, Human
ugaaugaggauccuugaccuua

SEQ ID NO: 73632 - RNA, 22 nt, Human
ugaaugagucaaucauuuagcu

SEQ ID NO: 73633 - RNA, 22 nt, Human
ugaaugauacagaauuauguag

SEQ ID NO: 73634 - RNA, 22 nt, Human
ugaaugauauauugggaauaau

SEQ ID NO: 73635 - RNA, 22 nt, Human
ugaaugaugcauuuguuuccca

SEQ ID NO: 73636 - RNA, 23 nt, Human
ugaaugauggugcuccucaucuu

SEQ ID NO: 73637 - RNA, 22 nt, Human
ugaaugauuaaaacccggacua

SEQ ID NO: 73638 - RNA, 22 nt, Human
ugaaugcaagaaggaacaugaa

SEQ ID NO: 73639 - RNA, 22 nt, Human
ugaaugcaagucacacauuucu

SEQ ID NO: 73640 - RNA, 22 nt, Human
ugaaugcuuggagucauaaaau

SEQ ID NO: 73641 - RNA, 22 nt, Human
ugaaugcuuuggagccuucuaa

SEQ ID NO: 73642 - RNA, 22 nt, Human
ugaauggauauaacaacagugu

SEQ ID NO: 73643 - RNA, 23 nt, Human
ugaauguuuauucucggugcaga

SEQ ID NO: 73644 - RNA, 22 nt, Human
ugaauuaaaggaauucgaauuc

SEQ ID NO: 73645 - RNA, 22 nt, Human
ugaauucaggggcuauuauauu

SEQ ID NO: 73646 - RNA, 22 nt, Human
ugaauucugcuguagcaagucc

SEQ ID NO: 73647 - RNA, 22 nt, Human
ugaauucugggucagcagcuug

SEQ ID NO: 73648 - RNA, 20 nt, Human
ugaauucuggguuuaucugc

SEQ ID NO: 73649 - RNA, 22 nt, Human
ugaauugccucuuauaugacca

SEQ ID NO: 73650 - RNA, 22 nt, Human
ugaauugcugccaucauauuuc

SEQ ID NO: 73651 - RNA, 22 nt, Human
ugaauugugaccccucuguauu

SEQ ID NO: 73652 - RNA, 22 nt, Human
ugaauuuaccuugccuauauuu

SEQ ID NO: 73653 - RNA, 21 nt, Human
ugaauuucccucuaucauucu

SEQ ID NO: 73654 - RNA, 21 nt, Human
ugaauuucgguauggcuauaa

SEQ ID NO: 73655 - RNA, 23 nt, Human
ugaauuuggaacucagagaauua

SEQ ID NO: 73656 - RNA, 22 nt, Human
ugacaaagcaugauggugacag

SEQ ID NO: 73657 - RNA, 22 nt, Human
ucugagugucuuaauaggcucu

SEQ ID NO: 73658 - RNA, 22 nt, Human
ucugaguucauaccaggcuacc

SEQ ID NO: 73659 - RNA, 22 nt, Human
ucugaguuuucugagaagcuua

SEQ ID NO: 73660 - RNA, 22 nt, Human
ucugauaggugguagaaggagg

SEQ ID NO: 73661 - RNA, 22 nt, Human
ucugaucugucagucaugaagg

SEQ ID NO: 73662 - RNA, 22 nt, Human
ucugaugcaauguaagucuugg

SEQ ID NO: 73663 - RNA, 22 nt, Human
ucugauguaggcuuuucuggga

SEQ ID NO: 73664 - RNA, 22 nt, Human
ucugaugucugaaaugcucuug

SEQ ID NO: 73665 - RNA, 22 nt, Human
ucugauguugaugcuucugccu

SEQ ID NO: 73666 - RNA, 22 nt, Human
ucugauuagagcauucuugagu

SEQ ID NO: 73667 - RNA, 22 nt, Human
ucugauuagcaguuuagggaaa

SEQ ID NO: 73668 - RNA, 22 nt, Human
ucugauuagcuccauuugcuaa

SEQ ID NO: 73669 - RNA, 22 nt, Human
ucugcaaacccccaucuaucau

SEQ ID NO: 73670 - RNA, 23 nt, Human
ucugcaagauaaugaagaugaua

SEQ ID NO: 73671 - RNA, 22 nt, Human
ucugcaagaucauuaaagcaga

SEQ ID NO: 73672 - RNA, 22 nt, Human
ucugcaagauggucuuagaggu

SEQ ID NO: 73673 - RNA, 22 nt, Human
uuccaacuuugucauauauuau

SEQ ID NO: 73674 - RNA, 22 nt, Human
uuccaagaguaaauucaaauug

SEQ ID NO: 73675 - RNA, 22 nt, Human
uuccaagggaauguuuaugagu

SEQ ID NO: 73676 - RNA, 23 nt, Human
uuccaagugcuuuacuuaauccu

SEQ ID NO: 73677 - RNA, 22 nt, Human
uuccaauaaaauguuauuugca

SEQ ID NO: 73678 - RNA, 22 nt, Human
uuccaauggaaucaugucuuga

SEQ ID NO: 73679 - RNA, 22 nt, Human
uuccacagcccaagcugguggc

SEQ ID NO: 73680 - RNA, 22 nt, Human
uuccacauagaucacagguguu

SEQ ID NO: 73681 - RNA, 22 nt, Human
uuccacauuccuuacauucaua

SEQ ID NO: 73682 - RNA, 22 nt, Human
uuccacggggcuccccgcucuu

SEQ ID NO: 73683 - RNA, 22 nt, Human
uuccacucaugcaaagguccca

SEQ ID NO: 73684 - RNA, 22 nt, Human
uuccacucuaugauagaagggu

SEQ ID NO: 73685 - RNA, 22 nt, Human
uuccacugaaggaucuagggaa

SEQ ID NO: 73686 - RNA, 22 nt, Human
uuccacugauuuugguugaccu

SEQ ID NO: 73687 - RNA, 22 nt, Human
uuccacuuugggucugugcagg

SEQ ID NO: 73688 - RNA, 22 nt, Human
uuccacuuuucucucucaugcc

SEQ ID NO: 73689 - RNA, 22 nt, Human
uuccagaacaauguggacguau

SEQ ID NO: 73690 - RNA, 22 nt, Human
uuccagaagccuccauauuacu

SEQ ID NO: 73691 - RNA, 22 nt, Human
uuccagaauugggagccuugag

SEQ ID NO: 73692 - RNA, 22 nt, Human
uuccagaggcuucagggaagaa

SEQ ID NO: 73693 - RNA, 22 nt, Human
uuccagaggggagguggcagcc

SEQ ID NO: 73694 - RNA, 22 nt, Human
uuccagauuucuacacaagacc

SEQ ID NO: 73695 - RNA, 22 nt, Human
ucuugcccucaacaagagcaug

SEQ ID NO: 73696 - RNA, 22 nt, Human
ucuugccgcgcaggcgcaguuc

SEQ ID NO: 73697 - RNA, 18 nt, Human
ucuugccugcacccucuc

SEQ ID NO: 73698 - RNA, 22 nt, Human
ucuugcuguacggcuacuugca

SEQ ID NO: 73699 - RNA, 22 nt, Human
ucuugcugugccccagcagggc

SEQ ID NO: 73700 - RNA, 22 nt, Human
ucuuggaagccucaagauacuc

SEQ ID NO: 73701 - RNA, 22 nt, Human
ucuuggaaguagaacacagucu

SEQ ID NO: 73702 - RNA, 20 nt, Human
ucuuggagaggguggacuua

SEQ ID NO: 73703 - RNA, 22 nt, Human
ucuuggauuuuaauggaucaaa

SEQ ID NO: 73704 - RNA, 22 nt, Human
ucuuggcaauuugaucucaguu

SEQ ID NO: 73705 - RNA, 22 nt, Human
ucuuggcaggcagugggguaag

SEQ ID NO: 73706 - RNA, 22 nt, Human
ucuuggcaguucuugugcuuuu

SEQ ID NO: 73707 - RNA, 22 nt, Human
ucuuggcuacuuuccugucugc

SEQ ID NO: 73708 - RNA, 22 nt, Human
ucuuggcuccucacagcaucag

SEQ ID NO: 73709 - RNA, 22 nt, Human
ucuuggcucugccacuaauuag

SEQ ID NO: 73710 - RNA, 22 nt, Human
ucuuggcugucuuugaaguuag

SEQ ID NO: 73711 - RNA, 22 nt, Human
ucuugggaaauaaacagauuga

SEQ ID NO: 73712 - RNA, 22 nt, Human
ucuugggaggagcaccugccug

SEQ ID NO: 73713 - RNA, 22 nt, Human
ucuugggaucaccuccuggcuu

SEQ ID NO: 73714 - RNA, 22 nt, Human
ucuugggauugcccugcaguuc

SEQ ID NO: 73715 - RNA, 22 nt, Human
ucuugggggacuuuggcaugga

SEQ ID NO: 73716 - RNA, 21 nt, Human
ucuuguauuggaucugugugu

SEQ ID NO: 73717 - RNA, 22 nt, Human
ucuuguguggaacugcuuuucu

SEQ ID NO: 73718 - RNA, 21 nt, Human
ucuugugugggaaacaauuug

SEQ ID NO: 73719 - RNA, 22 nt, Human
ucuuuaagccaagauauauuua

SEQ ID NO: 73720 - RNA, 22 nt, Human
ucuuuaagggauguucugcuuu

SEQ ID NO: 73721 - RNA, 22 nt, Human
ucuuuaauguacuuucuuucac

SEQ ID NO: 73722 - RNA, 22 nt, Human
ucuuuacaucacaauuguaugg

SEQ ID NO: 73723 - RNA, 22 nt, Human
ucuuuagaaacuuuucuucaug

SEQ ID NO: 73724 - RNA, 22 nt, Human
ucuuuagaguuaacaauaauga

SEQ ID NO: 73725 - RNA, 22 nt, Human
ucuuuagccaguaucauaauga

SEQ ID NO: 73726 - RNA, 22 nt, Human
ucuuuagugacaguugugcaag

SEQ ID NO: 73727 - RNA, 22 nt, Human
ucuuuauguaagacugggcuug

SEQ ID NO: 73728 - RNA, 22 nt, Human
ucuuuauuuaagucuguuguaa

SEQ ID NO: 73729 - RNA, 22 nt, Human
ucuuuauuucugaaucccccau

SEQ ID NO: 73730 - RNA, 22 nt, Human
ucuuucaaaugcuugaauugga

SEQ ID NO: 73731 - RNA, 22 nt, Human
ucuuucaauccauucauauguc

SEQ ID NO: 73732 - RNA, 22 nt, Human
ucuuucagcucuucaggaccca

SEQ ID NO: 73733 - RNA, 21 nt, Human
ucuuuccaauauucaugucuc

SEQ ID NO: 73734 - RNA, 22 nt, Human
ucuuucccaguagcucucccag

SEQ ID NO: 73735 - RNA, 22 nt, Human
ucuuucccuuagaacauuaaca

SEQ ID NO: 73736 - RNA, 23 nt, Human
ucuuuccuaaugaaacagugaaa

SEQ ID NO: 73737 - RNA, 22 nt, Human
ucuuuccuaggugauaugcaau

SEQ ID NO: 73738 - RNA, 22 nt, Human
ucuuuccuguaacugcuguuca

SEQ ID NO: 73739 - RNA, 22 nt, Human
ucuuucucucuaaucaagcaca

SEQ ID NO: 73740 - RNA, 21 nt, Human
ucuuucugaaaucucagucug

SEQ ID NO: 73741 - RNA, 22 nt, Human
ucuuucugcagcacaggggcag

SEQ ID NO: 73742 - RNA, 22 nt, Human
ucuuucuggucucgccuuauuc

SEQ ID NO: 73743 - RNA, 22 nt, Human
ucuuucuuaaauagguggauug

SEQ ID NO: 73744 - RNA, 22 nt, Human
ucuuucuuuaucaccugauaug

SEQ ID NO: 73745 - RNA, 22 nt, Human
ucuuugaaacacccuaaccuuu

SEQ ID NO: 73746 - RNA, 22 nt, Human
ucuuugaaagcuguucuagagu

SEQ ID NO: 73747 - RNA, 22 nt, Human
ucuuugaacuuggcugaucucu

SEQ ID NO: 73748 - RNA, 22 nt, Human
ucuuugcaaaauacaacaaugg

SEQ ID NO: 73749 - RNA, 22 nt, Human
ucuuugcacacaucccuucccg

SEQ ID NO: 73750 - RNA, 22 nt, Human
ucuuugcagucugggcuuguuu

SEQ ID NO: 73751 - RNA, 22 nt, Human
ucuuugcaguucugauuaaaua

SEQ ID NO: 73752 - RNA, 21 nt, Human
ucuuugcaucaguuguuuucu

SEQ ID NO: 73753 - RNA, 22 nt, Human
ucuuugcaugcauuuucccuua

SEQ ID NO: 73754 - RNA, 22 nt, Human
ucuuugcauggacauguguuuu

SEQ ID NO: 73755 - RNA, 22 nt, Human
ucuuuggaaaugcuuugagaau

SEQ ID NO: 73756 - RNA, 22 nt, Human
ucuuuggauggaaaauguauuc

SEQ ID NO: 73757 - RNA, 22 nt, Human
ucuuuggcacuucuguuuuaag

SEQ ID NO: 73758 - RNA, 22 nt, Human
ucuuuggccuuaggagcccuug

SEQ ID NO: 73759 - RNA, 22 nt, Human
ucuuugggagaaggggucccag

SEQ ID NO: 73760 - RNA, 22 nt, Human
ucuuuggggcaucugggagauu

SEQ ID NO: 73761 - RNA, 23 nt, Human
ucuuugguaaauaaaguggggau

SEQ ID NO: 73762 - RNA, 22 nt, Human
ucuuuggucaucaugggaagca

SEQ ID NO: 73763 - RNA, 22 nt, Human
ucuuuggugauaucucuuuggu

SEQ ID NO: 73764 - RNA, 22 nt, Human
ucuuugguuucugucucuguaa

SEQ ID NO: 73765 - RNA, 22 nt, Human
ucuuuguaaaugccuagcauaa

SEQ ID NO: 73766 - RNA, 22 nt, Human
ucuuuguggcgggcuuaaauac

SEQ ID NO: 73767 - RNA, 20 nt, Human
ucuuugugucagauggacag

SEQ ID NO: 73768 - RNA, 22 nt, Human
ucuuuguguucaggagccacgu

SEQ ID NO: 73769 - RNA, 22 nt, Human
ucuuuguuauugugaauagggu

SEQ ID NO: 73770 - RNA, 22 nt, Human
ucuuuguuugccuuuaucaaga

SEQ ID NO: 73771 - RNA, 22 nt, Human
ucuuuuaaccuaacuagcuugg

SEQ ID NO: 73772 - RNA, 22 nt, Human
ucuuuuauccuacauuuagcuc

SEQ ID NO: 73773 - RNA, 22 nt, Human
ucuuuuauuaggcugaaauggg

SEQ ID NO: 73774 - RNA, 23 nt, Human
ucuuuucaaugguucuuuaugug

SEQ ID NO: 73775 - RNA, 22 nt, Human
ucuuuucauugagaacacacug

SEQ ID NO: 73776 - RNA, 21 nt, Human
ucuuuuccuuucugugugcaa

SEQ ID NO: 73777 - RNA, 22 nt, Human
ucuuuucuagcaaauccaggag

SEQ ID NO: 73778 - RNA, 22 nt, Human
ucuuuucuccagaccugggauc

SEQ ID NO: 73779 - RNA, 22 nt, Human
ucuuuucugccacagccugagc

SEQ ID NO: 73780 - RNA, 22 nt, Human
ucuuuucuggacucugcaugga

SEQ ID NO: 73781 - RNA, 22 nt, Human
ucuuuucuguaacucagugucu

SEQ ID NO: 73782 - RNA, 22 nt, Human
ugcagcugaaaggacugaauga

SEQ ID NO: 73783 - RNA, 21 nt, Human
ugcagcugacacccuuuggga

SEQ ID NO: 73784 - RNA, 21 nt, Human
ugcagcugacacugguaugcc

SEQ ID NO: 73785 - RNA, 22 nt, Human
ugcagcugaccagcaaguccug

SEQ ID NO: 73786 - RNA, 22 nt, Human
ugcagcugacccacuccagucc

SEQ ID NO: 73787 - RNA, 22 nt, Human
ugcagcugaugauacccccaug

SEQ ID NO: 73788 - RNA, 22 nt, Human
ugcagcugcucauucucucagu

SEQ ID NO: 73789 - RNA, 22 nt, Human
ugcagcugcuggcccaggugcu

SEQ ID NO: 73790 - RNA, 22 nt, Human
ugcagcuggaacuuagaggaga

SEQ ID NO: 73791 - RNA, 21 nt, Human
ugcagcuggguucugguuugc

SEQ ID NO: 73792 - RNA, 20 nt, Human
ugcagcugguuucacaggga

SEQ ID NO: 73793 - RNA, 19 nt, Human
ugcagcugucucuauauua

SEQ ID NO: 73794 - RNA, 22 nt, Human
ugcagcugugaaagggaaccaa

SEQ ID NO: 73795 - RNA, 22 nt, Human
ugcagcuucuccaaauauuaca

SEQ ID NO: 73796 - RNA, 22 nt, Human
ugcagcuucuccaucuccuugu

SEQ ID NO: 73797 - RNA, 22 nt, Human
ugcagcuucucugcaacaggag

SEQ ID NO: 73798 - RNA, 22 nt, Human
ugcaggaaacagaggcucaaau

SEQ ID NO: 73799 - RNA, 21 nt, Human
ugcaggaaagugcugcgaccc

SEQ ID NO: 73800 - RNA, 22 nt, Human
ugcaggaaucagaggggaagcg

SEQ ID NO: 73801 - RNA, 22 nt, Human
ugcaggaauuuuuugcagaaag

SEQ ID NO: 73802 - RNA, 22 nt, Human
ugcaggagacauaauagggacu

SEQ ID NO: 73803 - RNA, 22 nt, Human
ugcaggagcaccagcucacccu

SEQ ID NO: 73804 - RNA, 22 nt, Human
ugcaggagcuuggcucuguccc

SEQ ID NO: 73805 - RNA, 19 nt, Human
ugcaggaggacugagcaga

SEQ ID NO: 73806 - RNA, 22 nt, Human
ugcaggaggauuuuguggagcu

SEQ ID NO: 73807 - RNA, 22 nt, Human
ugcaggaggccccauggaaccg

SEQ ID NO: 73808 - RNA, 22 nt, Human
ugcaggcaccauucugccucuc

SEQ ID NO: 73809 - RNA, 22 nt, Human
ugcaggcagcugaaaggugccu

SEQ ID NO: 73810 - RNA, 21 nt, Human
ugcaggcaggcagagaugcug

SEQ ID NO: 73811 - RNA, 22 nt, Human
ugcaggcauuggugagagaagc

SEQ ID NO: 73812 - RNA, 22 nt, Human
ugcaggcuauaucuuauuugac

SEQ ID NO: 73813 - RNA, 22 nt, Human
ugcaggcuccaggugcacauau

SEQ ID NO: 73814 - RNA, 22 nt, Human
ugaagugggggaacgagaguuc

SEQ ID NO: 73815 - RNA, 22 nt, Human
ugaaguuauauauguugaaaau

SEQ ID NO: 73816 - RNA, 21 nt, Human
ugaaguucgcgggcaagauua

SEQ ID NO: 73817 - RNA, 22 nt, Human
ugaaguuuauaacauagccucc

SEQ ID NO: 73818 - RNA, 22 nt, Human
ugaaguuugaacuguguugcug

SEQ ID NO: 73819 - RNA, 22 nt, Human
ugaaguuuuacauccucuccaa

SEQ ID NO: 73820 - RNA, 22 nt, Human
ugaaguuuucugguugauuaag

SEQ ID NO: 73821 - RNA, 22 nt, Human
ugaaguuuuuccagacaagucc

SEQ ID NO: 73822 - RNA, 22 nt, Human
ugaauaaaucaaagacugcccu

SEQ ID NO: 73823 - RNA, 22 nt, Human
ugaauaaucauguccauagugu

SEQ ID NO: 73824 - RNA, 22 nt, Human
ugaauaauuccuuuuugucaag

SEQ ID NO: 73825 - RNA, 22 nt, Human
ugaauagacaucuggccauaga

SEQ ID NO: 73826 - RNA, 22 nt, Human
ugaauagacuggggcugugaag

SEQ ID NO: 73827 - RNA, 22 nt, Human
ugaauagagcuuggcacuagaa

SEQ ID NO: 73828 - RNA, 22 nt, Human
ugaauaguguucuauaauaugg

SEQ ID NO: 73829 - RNA, 22 nt, Human
ugaauaugcuuugcaauccuaa

SEQ ID NO: 73830 - RNA, 22 nt, Human
ugaauauggcaacucuuguaac

SEQ ID NO: 73831 - RNA, 22 nt, Human
ugaauauguauuucuuauuuac

SEQ ID NO: 73832 - RNA, 22 nt, Human
ugaaucaaagcugaaguuuuca

SEQ ID NO: 73833 - RNA, 22 nt, Human
ugaaucaaugaauugcacuuca

SEQ ID NO: 73834 - RNA, 22 nt, Human
ugaaucucgaggcuauagaagu

SEQ ID NO: 73835 - RNA, 22 nt, Human
ugaaugaguggauucugaguag

SEQ ID NO: 73836 - RNA, 22 nt, Human
ugaaugauaugugaaaaggaac

SEQ ID NO: 73837 - RNA, 22 nt, Human
ugaaugaugaggggagaauaau

SEQ ID NO: 73838 - RNA, 22 nt, Human
ugaaugaugcaguauaaugaua

SEQ ID NO: 73839 - RNA, 22 nt, Human
ugaaugcucacaugccuagguc

SEQ ID NO: 73840 - RNA, 22 nt, Human
ugaauggucacugagcaucugu

SEQ ID NO: 73841 - RNA, 22 nt, Human
ugaauggugauuggugcuucuc

SEQ ID NO: 73842 - RNA, 22 nt, Human
ugaauguugauaugaguacaga

SEQ ID NO: 73843 - RNA, 19 nt, Human
ugaauuagaauuauccucu

SEQ ID NO: 73844 - RNA, 18 nt, Human
ugaauuaguuugugguuu

SEQ ID NO: 73845 - RNA, 17 nt, Human
ugaauucaaucugcacu

SEQ ID NO: 73846 - RNA, 22 nt, Human
ugaauucuuaaugaaaucuacu

SEQ ID NO: 73847 - RNA, 22 nt, Human
ugaauuuaaaauaaauguaguu

SEQ ID NO: 73848 - RNA, 22 nt, Human
ugacaaaacugcaauuacuuuu

SEQ ID NO: 73849 - RNA, 22 nt, Human
ugacaaaccaguagcaauaaag

SEQ ID NO: 73850 - RNA, 22 nt, Human
ugacaaacucuuugagaacaag

SEQ ID NO: 73851 - RNA, 22 nt, Human
ugacaaagacaaagauaugucc

SEQ ID NO: 73852 - RNA, 20 nt, Human
ugacaaagaguaagaggagg

SEQ ID NO: 73853 - RNA, 22 nt, Human
ugacaacagccaucacuuuuag

SEQ ID NO: 73854 - RNA, 22 nt, Human
ugacaacucuaguuaaugaauu

SEQ ID NO: 73855 - RNA, 22 nt, Human
ugacaagauagauugaguuuua

SEQ ID NO: 73856 - RNA, 22 nt, Human
ugacaagucacuguucuucaau

SEQ ID NO: 73857 - RNA, 17 nt, Human
ugacaaugacaagcacu

SEQ ID NO: 73858 - RNA, 22 nt, Human
ugacaaugacauggacagugau

SEQ ID NO: 73859 - RNA, 22 nt, Human
ugacaauucauuauaucuacag

SEQ ID NO: 73860 - RNA, 22 nt, Human
ugacaauugcagacacagaagu

SEQ ID NO: 73861 - RNA, 22 nt, Human
ugacaauugugggcaguuugug

SEQ ID NO: 73862 - RNA, 22 nt, Human
ugacaauuuauagaaugugacu

SEQ ID NO: 73863 - RNA, 20 nt, Human
ugacacaaauugcuuucuca

SEQ ID NO: 73864 - RNA, 22 nt, Human
ugacacaagagcccuguuugcu

SEQ ID NO: 73865 - RNA, 22 nt, Human
ugacacacuaggaaaagcauuu

SEQ ID NO: 73866 - RNA, 22 nt, Human
ugacacaguaucaaacaugauu

SEQ ID NO: 73867 - RNA, 22 nt, Human
ugacacaguugucgacucuaca

SEQ ID NO: 73868 - RNA, 23 nt, Human
ugacacauuuccuuuccacugca

SEQ ID NO: 73869 - RNA, 22 nt, Human
ugacaccaaggaaguaucauuu

SEQ ID NO: 73870 - RNA, 21 nt, Human
ugacacccagagccuccuccc

SEQ ID NO: 73871 - RNA, 22 nt, Human
ugacacugaccuaaagaccugg

SEQ ID NO: 73872 - RNA, 22 nt, Human
ugacacugcauauauugaaguu

SEQ ID NO: 73873 - RNA, 22 nt, Human
ugacacuucaaagaccaggguc

SEQ ID NO: 73874 - RNA, 22 nt, Human
ugacagaaagaguauuaaagau

SEQ ID NO: 73875 - RNA, 18 nt, Human
ugacagaaccuggagccu

SEQ ID NO: 73876 - RNA, 22 nt, Human
ugacagaaugugacucucagau

SEQ ID NO: 73877 - RNA, 23 nt, Human
ugacagaccuucccagacaguca

SEQ ID NO: 73878 - RNA, 22 nt, Human
ugacagacuacugccucuauug

SEQ ID NO: 73879 - RNA, 22 nt, Human
ugacagacuuuacuucuccuau

SEQ ID NO: 73880 - RNA, 22 nt, Human
ugacagaguccagaaguagugu

SEQ ID NO: 73881 - RNA, 22 nt, Human
ugacagauuuugauggcuaaua

SEQ ID NO: 73882 - RNA, 22 nt, Human
ugacagauuuuuucugagcuaa

SEQ ID NO: 73883 - RNA, 22 nt, Human
ugacagcugaggcccagaguac

SEQ ID NO: 73884 - RNA, 22 nt, Human
ugacaggaggcuugaggccagg

SEQ ID NO: 73885 - RNA, 22 nt, Human
ugacaggaggguuguggcaggg

SEQ ID NO: 73886 - RNA, 22 nt, Human
ugacaggcagugcugggcaugu

SEQ ID NO: 73887 - RNA, 22 nt, Human
ugacaggcuaggaggcugaagg

SEQ ID NO: 73888 - RNA, 19 nt, Human
ugacaggcuguugccuuga

SEQ ID NO: 73889 - RNA, 22 nt, Human
ugacaggggcugguggauaaau

SEQ ID NO: 73890 - RNA, 22 nt, Human
ugacaggugaaauguccuuauu

SEQ ID NO: 73891 - RNA, 22 nt, Human
ugcugccaugcagagcaacaga

SEQ ID NO: 73892 - RNA, 22 nt, Human
ugcugccuccaacuccugggcu

SEQ ID NO: 73893 - RNA, 22 nt, Human
ugcugccuggagccuuuuguuu

SEQ ID NO: 73894 - RNA, 22 nt, Human
ugcugccugguuucuucuugcu

SEQ ID NO: 73895 - RNA, 22 nt, Human
ugcugccugugccaggaggguc

SEQ ID NO: 73896 - RNA, 21 nt, Human
ugcugccuguggguguuuacc

SEQ ID NO: 73897 - RNA, 22 nt, Human
ugcugccuguuguggggccacg

SEQ ID NO: 73898 - RNA, 22 nt, Human
ugcugccuugaccuccugggcu

SEQ ID NO: 73899 - RNA, 22 nt, Human
ugcugccuuucaauguugucau

SEQ ID NO: 73900 - RNA, 22 nt, Human
ugcugcuagcuguauugcaaga

SEQ ID NO: 73901 - RNA, 22 nt, Human
ugcugcuccccagcacacagca

SEQ ID NO: 73902 - RNA, 22 nt, Human
ugcugcugaaaaggugugcuua

SEQ ID NO: 73903 - RNA, 22 nt, Human
ugcugcugaugcauagucugcu

SEQ ID NO: 73904 - RNA, 22 nt, Human
ugcugcuggaucuuacucaucu

SEQ ID NO: 73905 - RNA, 22 nt, Human
ugcugcuguagcuaggcuuucu

SEQ ID NO: 73906 - RNA, 20 nt, Human
ugcugcuuugccacuaguug

SEQ ID NO: 73907 - RNA, 22 nt, Human
ugcuggaaaaagauuguguuuu

SEQ ID NO: 73908 - RNA, 22 nt, Human
ugcuggaacuuagcaugcucuc

SEQ ID NO: 73909 - RNA, 22 nt, Human
ugcuggaagaauuccaugcugg

SEQ ID NO: 73910 - RNA, 22 nt, Human
ugcuggaagagauuggagccuc

SEQ ID NO: 73911 - RNA, 22 nt, Human
ugcuggaaggguaguauuaacu

SEQ ID NO: 73912 - RNA, 22 nt, Human
ugcuggaauaauuucauguuaa

SEQ ID NO: 73913 - RNA, 22 nt, Human
ugcuggaauugaccuagaagga

SEQ ID NO: 73914 - RNA, 22 nt, Human
ugcuggagaacugcucuguguu

SEQ ID NO: 73915 - RNA, 23 nt, Human
ugcuggagaagcaaaguucugag

SEQ ID NO: 73916 - RNA, 23 nt, Human
ugcuggagacaagugugagaagg

SEQ ID NO: 73917 - RNA, 22 nt, Human
ugcuggagaccugcuugcacca

SEQ ID NO: 73918 - RNA, 22 nt, Human
ugcuggagagccuuggccaagg

SEQ ID NO: 73919 - RNA, 22 nt, Human
ugcuggagagcuaguucugcag

SEQ ID NO: 73920 - RNA, 19 nt, Human
ugcuggaggguagugaguc

SEQ ID NO: 73921 - RNA, 23 nt, Human
ugcuggaguuuacucaggccagc

SEQ ID NO: 73922 - RNA, 22 nt, Human
ugcuggaugcuugauuuugagg

SEQ ID NO: 73923 - RNA, 22 nt, Human
ugcuggcacguggaccaggaga

SEQ ID NO: 73924 - RNA, 22 nt, Human
ugcuggcaguggcagugauggu

SEQ ID NO: 73925 - RNA, 22 nt, Human
ugcuggcaugcaugcuguagga

SEQ ID NO: 73926 - RNA, 22 nt, Human
ugcuggccugguuagaaagggg

SEQ ID NO: 73927 - RNA, 22 nt, Human
ugcuggccuguccacgggcugu

SEQ ID NO: 73928 - RNA, 22 nt, Human
ugcuggcuacauuauugcuguc

SEQ ID NO: 73929 - RNA, 22 nt, Human
ugcuggcuauuuaaagaagaaa

SEQ ID NO: 73930 - RNA, 22 nt, Human
ugcuggcuggagugccucugga

SEQ ID NO: 73931 - RNA, 22 nt, Human
ugcuggcugggcugcuggagac

SEQ ID NO: 73932 - RNA, 22 nt, Human
ugcuggcuuauuuaguaaaugu

SEQ ID NO: 73933 - RNA, 23 nt, Human
ugcuggcuuccagcugcucccuc

SEQ ID NO: 73934 - RNA, 22 nt, Human
ugcuggcuuuagugauuggggu

SEQ ID NO: 73935 - RNA, 22 nt, Human
ugcuggcuuuuugguccuugcu

SEQ ID NO: 73936 - RNA, 22 nt, Human
ugcuggcuuuuugugucaaaga

SEQ ID NO: 73937 - RNA, 22 nt, Human
ugcugggauuacagucaugagc

SEQ ID NO: 73938 - RNA, 22 nt, Human
ugcugggcacugucucugggga

SEQ ID NO: 73939 - RNA, 23 nt, Human
ugcugggcagagcuggugcugag

SEQ ID NO: 73940 - RNA, 22 nt, Human
ugcugggcaucguaggagguac

SEQ ID NO: 73941 - RNA, 18 nt, Human
ugcugggcauuaggcuua

SEQ ID NO: 73942 - RNA, 22 nt, Human
ugcugggcucaaccuccagagc

SEQ ID NO: 73943 - RNA, 21 nt, Human
ugcugggcugcaggggaugca

SEQ ID NO: 73944 - RNA, 22 nt, Human
ugcugggcuugaaagcugcuaa

SEQ ID NO: 73945 - RNA, 16 nt, Human
ugcuggggcgccgucc

SEQ ID NO: 73946 - RNA, 22 nt, Human
ugcugggggcuuucuggauacc

SEQ ID NO: 73947 - RNA, 18 nt, Human
ugcugggguagaauccac

SEQ ID NO: 73948 - RNA, 22 nt, Human
ugcuggggucucuccggugccc

SEQ ID NO: 73949 - RNA, 18 nt, Human
ugcuggguaacuguaugg

SEQ ID NO: 73950 - RNA, 19 nt, Human
ugcugggucauauggaaac

SEQ ID NO: 73951 - RNA, 22 nt, Human
ugcugggugguugcuccucccg

SEQ ID NO: 73952 - RNA, 22 nt, Human
ugcugguccccugcagccugug

SEQ ID NO: 73953 - RNA, 22 nt, Human
ugcugguccuggagcuggguuc

SEQ ID NO: 73954 - RNA, 23 nt, Human
ugcugguucaaaaaggaaggagg

SEQ ID NO: 73955 - RNA, 22 nt, Human
ugcuguaauacuuaagguuaag

SEQ ID NO: 73956 - RNA, 22 nt, Human
ugcuguauauauuuugaaguga

SEQ ID NO: 73957 - RNA, 22 nt, Human
ugcugucaagaaaacaagcaau

SEQ ID NO: 73958 - RNA, 22 nt, Human
ugcugucaagguuacaugcuuu

SEQ ID NO: 73959 - RNA, 22 nt, Human
ugcugucagacagcagugguaa

SEQ ID NO: 73960 - RNA, 22 nt, Human
ugcugucaguuggcaggaugag

SEQ ID NO: 73961 - RNA, 20 nt, Human
ugcugucguguuuucugcuu

SEQ ID NO: 73962 - RNA, 17 nt, Human
ugcugucugcuucccua

SEQ ID NO: 73963 - RNA, 22 nt, Human
ugcugucuuccaggauggugaa

SEQ ID NO: 73964 - RNA, 22 nt, Human
ugcugucuucucugaggucccu

SEQ ID NO: 73965 - RNA, 22 nt, Human
ugcugugacgccucaggaaucc

SEQ ID NO: 73966 - RNA, 22 nt, Human
uuggacugagaguuccaccauu

SEQ ID NO: 73967 - RNA, 22 nt, Human
uuggacugguuuacauuucaag

SEQ ID NO: 73968 - RNA, 22 nt, Human
uuggagaauguuuuccugcagu

SEQ ID NO: 73969 - RNA, 22 nt, Human
uuggagagcaguaaaccacacu

SEQ ID NO: 73970 - RNA, 22 nt, Human
uuggagagugauauucagaugc

SEQ ID NO: 73971 - RNA, 22 nt, Human
uuggagauguaaaauucagaga

SEQ ID NO: 73972 - RNA, 22 nt, Human
uuggagcccugaggaucuggau

SEQ ID NO: 73973 - RNA, 22 nt, Human
uuggaggacuaguuaagagacc

SEQ ID NO: 73974 - RNA, 22 nt, Human
uuggaggauggaguuagcaucu

SEQ ID NO: 73975 - RNA, 18 nt, Human
uuggaggauguccaugaa

SEQ ID NO: 73976 - RNA, 22 nt, Human
uuggagucagaugacuguagga

SEQ ID NO: 73977 - RNA, 20 nt, Human
uuggagucuaaagacugggg

SEQ ID NO: 73978 - RNA, 22 nt, Human
uuggauacagaugaaaggaagg

SEQ ID NO: 73979 - RNA, 22 nt, Human
uuggaucauggaaugucugcuu

SEQ ID NO: 73980 - RNA, 22 nt, Human
uuggaugaagucuagcuuuagu

SEQ ID NO: 73981 - RNA, 22 nt, Human
uuggauuacaugaaaugcagaa

SEQ ID NO: 73982 - RNA, 22 nt, Human
uuggcacaaauuucugaaauaa

SEQ ID NO: 73983 - RNA, 22 nt, Human
uuggcaccucccuaggaagaag

SEQ ID NO: 73984 - RNA, 22 nt, Human
uuggcacuuuuaggcaguaccg

SEQ ID NO: 73985 - RNA, 22 nt, Human
uuggcagaauuaaccacugaag

SEQ ID NO: 73986 - RNA, 22 nt, Human
uuggcagagggaccagccuaca

SEQ ID NO: 73987 - RNA, 22 nt, Human
uuggcagaggucucguuguggc

SEQ ID NO: 73988 - RNA, 22 nt, Human
uuggcagcacggggaacgucug

SEQ ID NO: 73989 - RNA, 20 nt, Human
uuggcagcagcucagccacc

SEQ ID NO: 73990 - RNA, 22 nt, Human
uuggcagcauacaguuggauug

SEQ ID NO: 73991 - RNA, 22 nt, Human
uuggcagcauccaagucucggg

SEQ ID NO: 73992 - RNA, 22 nt, Human
uuggcagcauuccagccaagca

SEQ ID NO: 73993 - RNA, 22 nt, Human
uuggcagccaggacccgccugg

SEQ ID NO: 73994 - RNA, 22 nt, Human
uuggcagcccagcuuacuagca

SEQ ID NO: 73995 - RNA, 22 nt, Human
uuggcagcggggacccuggcug

SEQ ID NO: 73996 - RNA, 22 nt, Human
uuggcagcugcacagacuccau

SEQ ID NO: 73997 - RNA, 22 nt, Human
uuggcaggaggcuucaguuccu

SEQ ID NO: 73998 - RNA, 22 nt, Human
uuggcaggaugauagcuuugug

SEQ ID NO: 73999 - RNA, 22 nt, Human
uuggcaguagucucggcuaccc

SEQ ID NO: 74000 - RNA, 22 nt, Human
ugcuucagugugucauuauuua

SEQ ID NO: 74001 - RNA, 22 nt, Human
ugcuucauuaaaacaauauuuu

SEQ ID NO: 74002 - RNA, 22 nt, Human
ugcuuccaguuccucaccacau

SEQ ID NO: 74003 - RNA, 21 nt, Human
ugcuucccugggccacacuga

SEQ ID NO: 74004 - RNA, 20 nt, Human
ugcuuccuggccacugcggg

SEQ ID NO: 74005 - RNA, 22 nt, Human
ugcuuccuugagcucuccaauc

SEQ ID NO: 74006 - RNA, 22 nt, Human
ugcuucuccauugaugcuaagu

SEQ ID NO: 74007 - RNA, 22 nt, Human
ugcuucucucuaggaagacgcu

SEQ ID NO: 74008 - RNA, 22 nt, Human
ugcuucugaaaugcaggucuuc

SEQ ID NO: 74009 - RNA, 22 nt, Human
ugcuucugaugugagcagcccc

SEQ ID NO: 74010 - RNA, 19 nt, Human
ugcuucuggaaccaugauc

SEQ ID NO: 74011 - RNA, 19 nt, Human
ugcuucuggaaugcaaggc

SEQ ID NO: 74012 - RNA, 22 nt, Human
ugcuucuggggacaggcugccu

SEQ ID NO: 74013 - RNA, 22 nt, Human
ugcuucuguauugaaauuguua

SEQ ID NO: 74014 - RNA, 22 nt, Human
ugcuucugucucuuaugccuug

SEQ ID NO: 74015 - RNA, 22 nt, Human
ugcuucuguuuguuucugucau

SEQ ID NO: 74016 - RNA, 22 nt, Human
ugcuucuuacucauaugcugau

SEQ ID NO: 74017 - RNA, 22 nt, Human
ugcuugaacccaggaaguggag

SEQ ID NO: 74018 - RNA, 22 nt, Human
ugcuugaagauauacuacuucc

SEQ ID NO: 74019 - RNA, 22 nt, Human
ugcuugacuuaguuucucauuu

SEQ ID NO: 74020 - RNA, 22 nt, Human
ugcuugaugagugugccaagca

SEQ ID NO: 74021 - RNA, 22 nt, Human
ugcuugaugauugcugucuccc

SEQ ID NO: 74022 - RNA, 22 nt, Human
ugcuugauuaagccuuguuugc

SEQ ID NO: 74023 - RNA, 22 nt, Human
ugcuugauuuggcaguguauuc

SEQ ID NO: 74024 - RNA, 22 nt, Human
ugcuuggccuacuuguccuuug

SEQ ID NO: 74025 - RNA, 17 nt, Human
ugcuuggcuucuuuagg

SEQ ID NO: 74026 - RNA, 22 nt, Human
ugcuugggaauguggagucaga

SEQ ID NO: 74027 - RNA, 20 nt, Human
ugcuuguaauaccugcuuca

SEQ ID NO: 74028 - RNA, 22 nt, Human
ugcuugucagugugcuagaaac

SEQ ID NO: 74029 - RNA, 21 nt, Human
ugcuugucaugaaugggccag

SEQ ID NO: 74030 - RNA, 22 nt, Human
ugcuuguucauggccuaguggc

SEQ ID NO: 74031 - RNA, 22 nt, Human
ugcuuuaaaauggacuguuuug

SEQ ID NO: 74032 - RNA, 22 nt, Human
ugcuuuaaauaugaauuagcau

SEQ ID NO: 74033 - RNA, 22 nt, Human
ugcuuuaacgcugagggucuca

SEQ ID NO: 74034 - RNA, 22 nt, Human
ugcuuuauaggggauugcaggc

SEQ ID NO: 74035 - RNA, 22 nt, Human
ugcuuuaucugacuuggcgcug

SEQ ID NO: 74036 - RNA, 20 nt, Human
ugcuuuaugcuauacuuugu

SEQ ID NO: 74037 - RNA, 22 nt, Human
ugcuuuauggagcccaucucau

SEQ ID NO: 74038 - RNA, 21 nt, Human
ugcuuuaugggaaaaauguca

SEQ ID NO: 74039 - RNA, 22 nt, Human
ugcuuuauguggcugauacuca

SEQ ID NO: 74040 - RNA, 22 nt, Human
ugcuuuauuaagagagaaauuu

SEQ ID NO: 74041 - RNA, 22 nt, Human
ugcuuuauuggaaccucauccu

SEQ ID NO: 74042 - RNA, 22 nt, Human
ugcuuucacaccaugccuauaa

SEQ ID NO: 74043 - RNA, 22 nt, Human
ugcuuucagauaucuguuucaa

SEQ ID NO: 74044 - RNA, 22 nt, Human
ugcuuucaugaagucuauagag

SEQ ID NO: 74045 - RNA, 22 nt, Human
ugcuuucuguuuuucauauaau

SEQ ID NO: 74046 - RNA, 23 nt, Human
ugcuuugccagagcaaaagucua

SEQ ID NO: 74047 - RNA, 19 nt, Human
ugcuuugccuugauuagcu

SEQ ID NO: 74048 - RNA, 19 nt, Human
ugcuuugcucuuggacuca

SEQ ID NO: 74049 - RNA, 22 nt, Human
ugcuuugcuggcacuccuggcu

SEQ ID NO: 74050 - RNA, 22 nt, Human
ugcuuugggucucucuaguuuc

SEQ ID NO: 74051 - RNA, 22 nt, Human
ugcuuuguguacacaagaauca

SEQ ID NO: 74052 - RNA, 22 nt, Human
ugcuuuuaagaacaaugcugcu

SEQ ID NO: 74053 - RNA, 22 nt, Human
ugcuuuuaggagauuaaaauua

SEQ ID NO: 74054 - RNA, 20 nt, Human
ugcuuuuauaccuauaauga

SEQ ID NO: 74055 - RNA, 22 nt, Human
ugcuuuugcacaggugaguucc

SEQ ID NO: 74056 - RNA, 22 nt, Human
uggaaaaaacccagacucuaga

SEQ ID NO: 74057 - RNA, 22 nt, Human
uggaaaacaaagcucucauuau

SEQ ID NO: 74058 - RNA, 21 nt, Human
uggaaaacauuuaaauagcaa

SEQ ID NO: 74059 - RNA, 22 nt, Human
uggaaaauauuuaggugaauga

SEQ ID NO: 74060 - RNA, 22 nt, Human
uggaaaaucaggggacauugau

SEQ ID NO: 74061 - RNA, 22 nt, Human
uggaaaauuaguagugaaaggc

SEQ ID NO: 74062 - RNA, 22 nt, Human
uggaaacacccacgcaugcaua

SEQ ID NO: 74063 - RNA, 22 nt, Human
uggaaacacugcauguucaccc

SEQ ID NO: 74064 - RNA, 21 nt, Human
uggaaacagcgccaucugccg

SEQ ID NO: 74065 - RNA, 22 nt, Human
uggaaacaucucugccuuuauu

SEQ ID NO: 74066 - RNA, 22 nt, Human
uggaaaccuacugauacaggag

SEQ ID NO: 74067 - RNA, 22 nt, Human
uggaaacuaggauggaagaaau

SEQ ID NO: 74068 - RNA, 22 nt, Human
uggaaacuauagucacaauaga

SEQ ID NO: 74069 - RNA, 22 nt, Human
uggaaacuauccucacaacuag

SEQ ID NO: 74070 - RNA, 19 nt, Human
uggaaacuccugauauuag

SEQ ID NO: 74071 - RNA, 22 nt, Human
uggaaacugugguauuucuuua

SEQ ID NO: 74072 - RNA, 22 nt, Human
uggaaacuuaucugacacgaac

SEQ ID NO: 74073 - RNA, 22 nt, Human
uggaaagaaaaacaggccauga

SEQ ID NO: 74074 - RNA, 22 nt, Human
uggaaagaaaguaaaggcguau

SEQ ID NO: 74075 - RNA, 22 nt, Human
uggaaagacauucagccgcugg

SEQ ID NO: 74076 - RNA, 22 nt, Human
uggaaagagauguuguuucuga

SEQ ID NO: 74077 - RNA, 22 nt, Human
uggaaagagguagaggaucugg

SEQ ID NO: 74078 - RNA, 22 nt, Human
uggaaaggaggcuuguggaaua

SEQ ID NO: 74079 - RNA, 22 nt, Human
uggaaagggacuuaugaguucc

SEQ ID NO: 74080 - RNA, 22 nt, Human
uggaaauacaagaaguauguca

SEQ ID NO: 74081 - RNA, 22 nt, Human
uggaaauauuggguaauaguug

SEQ ID NO: 74082 - RNA, 22 nt, Human
uggaaauuaaaauuccucuuaa

SEQ ID NO: 74083 - RNA, 22 nt, Human
uggaacaaaauauuuauguuug

SEQ ID NO: 74084 - RNA, 22 nt, Human
ugagggaggcccuuugagcaga

SEQ ID NO: 74085 - RNA, 20 nt, Human
ugagggaguauugauuuccc

SEQ ID NO: 74086 - RNA, 22 nt, Human
ugagggagucaugauuaaggaa

SEQ ID NO: 74087 - RNA, 22 nt, Human
ugagggaguguggauacaguag

SEQ ID NO: 74088 - RNA, 22 nt, Human
ugagggaguuggguguauagga

SEQ ID NO: 74089 - RNA, 20 nt, Human
ugagggcuaaccagacucug

SEQ ID NO: 74090 - RNA, 22 nt, Human
ugagggcuccccgcugcugugu

SEQ ID NO: 74091 - RNA, 22 nt, Human
ugaggggaaggcaugauaaaua

SEQ ID NO: 74092 - RNA, 22 nt, Human
ugagggucauuuggaaguggaa

SEQ ID NO: 74093 - RNA, 19 nt, Human
ugagggugagcuuuggaga

SEQ ID NO: 74094 - RNA, 22 nt, Human
ugaggguggcacaggcacaaag

SEQ ID NO: 74095 - RNA, 22 nt, Human
ugagguaaauucuggcccaaac

SEQ ID NO: 74096 - RNA, 22 nt, Human
ugagguagaagccuggguugag

SEQ ID NO: 74097 - RNA, 22 nt, Human
ugagguagaaguugggcugcuu

SEQ ID NO: 74098 - RNA, 22 nt, Human
ugagguagagauugugacugua

SEQ ID NO: 74099 - RNA, 18 nt, Human
ugagguagcuuuccuccu

SEQ ID NO: 74100 - RNA, 22 nt, Human
ugagguaggagggugaucagca

SEQ ID NO: 74101 - RNA, 22 nt, Human
ugagguaggagugggaaaguag

SEQ ID NO: 74102 - RNA, 22 nt, Human
ugagguagggacuuaaaacugu

SEQ ID NO: 74103 - RNA, 22 nt, Human
ugagguagugauuguagaagug

SEQ ID NO: 74104 - RNA, 22 nt, Human
ugagguaguguuuaguccaguc

SEQ ID NO: 74105 - RNA, 21 nt, Human
ugagguaguguuugucaaguu

SEQ ID NO: 74106 - RNA, 22 nt, Human
ugagguaguucuaauauuaaag

SEQ ID NO: 74107 - RNA, 22 nt, Human
ugagguaguuuuucaaguauuu

SEQ ID NO: 74108 - RNA, 22 nt, Human
ugagguaugauuuacaugcagu

SEQ ID NO: 74109 - RNA, 23 nt, Human
uggaaugagcugggaagcugagc

SEQ ID NO: 74110 - RNA, 22 nt, Human
uggaaugaguggcuaagauuca

SEQ ID NO: 74111 - RNA, 22 nt, Human
uggaaugaugacuaggaauugu

SEQ ID NO: 74112 - RNA, 22 nt, Human
uggaaugcagugggagcuuacc

SEQ ID NO: 74113 - RNA, 22 nt, Human
uggaauggggacuuugggacau

SEQ ID NO: 74114 - RNA, 22 nt, Human
uggaauguaaaggguaugggau

SEQ ID NO: 74115 - RNA, 20 nt, Human
uggaauguagucggugagag

SEQ ID NO: 74116 - RNA, 22 nt, Human
uggaauguaguguccauggaau

SEQ ID NO: 74117 - RNA, 22 nt, Human
uggaaugucaagaagcaguaag

SEQ ID NO: 74118 - RNA, 22 nt, Human
uggaaugucauaccauaaaaga

SEQ ID NO: 74119 - RNA, 22 nt, Human
uggaaugucuugauauagaggu

SEQ ID NO: 74120 - RNA, 22 nt, Human
uggaaugugaacauacaaggua

SEQ ID NO: 74121 - RNA, 22 nt, Human
uggaaugugagaauaccguuuu

SEQ ID NO: 74122 - RNA, 22 nt, Human
uggaaugugcuagggcuguggc

SEQ ID NO: 74123 - RNA, 22 nt, Human
uggaauguguucuauuuuacag

SEQ ID NO: 74124 - RNA, 22 nt, Human
ugccugcaagaguuggggcuac

SEQ ID NO: 74125 - RNA, 22 nt, Human
ugccugccacgcuugcuaccac

SEQ ID NO: 74126 - RNA, 22 nt, Human
ugccugccaggcaaccugggag

SEQ ID NO: 74127 - RNA, 20 nt, Human
ugccugccccugcuuuuucc

SEQ ID NO: 74128 - RNA, 22 nt, Human
ugccugccuaggaagcugugaa

SEQ ID NO: 74129 - RNA, 22 nt, Human
ugccugccucuggagcccaucc

SEQ ID NO: 74130 - RNA, 22 nt, Human
ugccugccucuggcagcccugc

SEQ ID NO: 74131 - RNA, 22 nt, Human
ugccugccuugcugcuggacag

SEQ ID NO: 74132 - RNA, 22 nt, Human
ugccugcugauuggaguugaau

SEQ ID NO: 74133 - RNA, 22 nt, Human
ugccugcuuucugggcugccau

SEQ ID NO: 74134 - RNA, 22 nt, Human
ugccuggaaggcccaugggaag

SEQ ID NO: 74135 - RNA, 22 nt, Human
ugccuggauggcucugagcagg

SEQ ID NO: 74136 - RNA, 22 nt, Human
ugccuggcaacuguggugggcu

SEQ ID NO: 74137 - RNA, 22 nt, Human
ugccuggcaucuagcccuggga

SEQ ID NO: 74138 - RNA, 22 nt, Human
ugccuggcccugacagcccugg

SEQ ID NO: 74139 - RNA, 22 nt, Human
ugccuggcuaauuuuuguaucc

SEQ ID NO: 74140 - RNA, 22 nt, Human
ugccugggccucugaggaaggc

SEQ ID NO: 74141 - RNA, 22 nt, Human
ugccugggcucgguagccaucg

SEQ ID NO: 74142 - RNA, 22 nt, Human
ugccuggguucccaccccaaag

SEQ ID NO: 74143 - RNA, 22 nt, Human
ugccugucucugacugccauua

SEQ ID NO: 74144 - RNA, 22 nt, Human
ugccugugaucagcugaguuca

SEQ ID NO: 74145 - RNA, 22 nt, Human
ugccugugcccuuugcugggag

SEQ ID NO: 74146 - RNA, 22 nt, Human
ugccuguggaaaggcuggugcu

SEQ ID NO: 74147 - RNA, 22 nt, Human
ugccugugucacagugauguuu

SEQ ID NO: 74148 - RNA, 22 nt, Human
ugccugugugaccacgggcaag

SEQ ID NO: 74149 - RNA, 22 nt, Human
ugccuguuauuguuggcuuagu

SEQ ID NO: 74150 - RNA, 20 nt, Human
ugccuuagagauaaaggcuu

SEQ ID NO: 74151 - RNA, 22 nt, Human
ugccuuagagcacucaagagug

SEQ ID NO: 74152 - RNA, 22 nt, Human
ugccuuaggguaccuggugcuu

SEQ ID NO: 74153 - RNA, 22 nt, Human
ugccuucaagacccauccucca

SEQ ID NO: 74154 - RNA, 22 nt, Human
ugccuucauccauguuauagug

SEQ ID NO: 74155 - RNA, 22 nt, Human
ugccuucuugaauaugguucuu

SEQ ID NO: 74156 - RNA, 22 nt, Human
ugccuugcuuuggcggaggcug

SEQ ID NO: 74157 - RNA, 22 nt, Human
ugccuuggauugcagggaaccu

SEQ ID NO: 74158 - RNA, 21 nt, Human
ugccuuggcaaaugaccauga

SEQ ID NO: 74159 - RNA, 22 nt, Human
ugccuugggauauauggacacu

SEQ ID NO: 74160 - RNA, 22 nt, Human
ugccuuuuagugcucaauaaag

SEQ ID NO: 74161 - RNA, 20 nt, Human
ugccuuuuauaccuuuaaac

SEQ ID NO: 74162 - RNA, 22 nt, Human
ugccuuuuauggcuagccucag

SEQ ID NO: 74163 - RNA, 22 nt, Human
ugccuuuuguaugcaggccaug

SEQ ID NO: 74164 - RNA, 22 nt, Human
ugcgccugcgcaaagguuucug

SEQ ID NO: 74165 - RNA, 22 nt, Human
ugcggaggucggugcugcgggc

SEQ ID NO: 74166 - RNA, 22 nt, Human
ugcgucuggaguggaguuugaa

SEQ ID NO: 74167 - RNA, 22 nt, Human
ugcguggcuggucccugugacc

SEQ ID NO: 74168 - RNA, 23 nt, Human
ugcgugugugcugaggggcgucc

SEQ ID NO: 74169 - RNA, 22 nt, Human
ugcguguguguauauacacagg

SEQ ID NO: 74170 - RNA, 23 nt, Human
ugcuaaaggcagaauauucaccu

SEQ ID NO: 74171 - RNA, 22 nt, Human
ugcuaaauucauuauugauuua

SEQ ID NO: 74172 - RNA, 22 nt, Human
ugcuaacaaagucuaaaucaua

SEQ ID NO: 74173 - RNA, 22 nt, Human
ugcuaaggacugggaggcaggg

SEQ ID NO: 74174 - RNA, 22 nt, Human
ugcuacaauucacaucuggaua

SEQ ID NO: 74175 - RNA, 22 nt, Human
ugcuacauaccacgaugcagua

SEQ ID NO: 74176 - RNA, 22 nt, Human
ugcuacuacuugucaacgguca

SEQ ID NO: 74177 - RNA, 22 nt, Human
ugcuagaaaucugaaacuagca

SEQ ID NO: 74178 - RNA, 22 nt, Human
ugcuagauggagcagaauagcu

SEQ ID NO: 74179 - RNA, 22 nt, Human
ugcuaggaauacacagagcaau

SEQ ID NO: 74180 - RNA, 22 nt, Human
ugcuagggaagaacgagggaau

SEQ ID NO: 74181 - RNA, 22 nt, Human
ugcuagggauacaguggugaau

SEQ ID NO: 74182 - RNA, 22 nt, Human
ugcuaggggcacuaaaagcuga

SEQ ID NO: 74183 - RNA, 20 nt, Human
ugcuauauugaagugcaguu

SEQ ID NO: 74184 - RNA, 22 nt, Human
ugcuaugcuuucccccaauguu

SEQ ID NO: 74185 - RNA, 22 nt, Human
ugcuauuaccugcuggacaguc

SEQ ID NO: 74186 - RNA, 22 nt, Human
ugcuauuauugucaccacugua

SEQ ID NO: 74187 - RNA, 22 nt, Human
ugcuauugugaacagugccaca

SEQ ID NO: 74188 - RNA, 22 nt, Human
ugcuauuucucugcuguaaaau

SEQ ID NO: 74189 - RNA, 22 nt, Human
ugcuauuuuagacauacuuugu

SEQ ID NO: 74190 - RNA, 22 nt, Human
ugcuauuuuuaucuugaucaaa

SEQ ID NO: 74191 - RNA, 22 nt, Human
ugcucaaugucuuaugagacug

SEQ ID NO: 74192 - RNA, 18 nt, Human
ugcucacacugaccucug

SEQ ID NO: 74193 - RNA, 21 nt, Human
ugcucacagaugugcucagug

SEQ ID NO: 74194 - RNA, 22 nt, Human
ugcucagacaagcugaacagua

SEQ ID NO: 74195 - RNA, 22 nt, Human
ugcucagacuuaagaagaucag

SEQ ID NO: 74196 - RNA, 22 nt, Human
ugcucagcacagaccaggccag

SEQ ID NO: 74197 - RNA, 22 nt, Human
ugcucagcugcucuguauucuu

SEQ ID NO: 74198 - RNA, 22 nt, Human
ugcucagcuucagaggaucccc

SEQ ID NO: 74199 - RNA, 22 nt, Human
ugcucaggaaauaaugucugug

SEQ ID NO: 74200 - RNA, 19 nt, Human
ugcucaggccaaggagccc

SEQ ID NO: 74201 - RNA, 22 nt, Human
ugcucaggccagccggacagag

SEQ ID NO: 74202 - RNA, 22 nt, Human
ugcucagggagcauagugaauu

SEQ ID NO: 74203 - RNA, 22 nt, Human
ugcucaggugccuuggcugcug

SEQ ID NO: 74204 - RNA, 22 nt, Human
ugcucagugagucugugacagg

SEQ ID NO: 74205 - RNA, 19 nt, Human
ugcucaguggcuaaaagca

SEQ ID NO: 74206 - RNA, 22 nt, Human
ugcucaguuaagcagaggaaau

SEQ ID NO: 74207 - RNA, 22 nt, Human
ugcucaguucaaggaaggugga

SEQ ID NO: 74208 - RNA, 22 nt, Human
ugcuccacugugcguggccaua

SEQ ID NO: 74209 - RNA, 22 nt, Human
ugcuccacuugggcacccccca

SEQ ID NO: 74210 - RNA, 16 nt, Human
ugcuccagaggaccca

SEQ ID NO: 74211 - RNA, 22 nt, Human
ugcuccagcaacaggcuuagcu

SEQ ID NO: 74212 - RNA, 22 nt, Human
ugcuccagccccuggugcacag

SEQ ID NO: 74213 - RNA, 22 nt, Human
ugcuccagcgcugccaccaguu

SEQ ID NO: 74214 - RNA, 22 nt, Human
ugcuccagggccuccagugggg

SEQ ID NO: 74215 - RNA, 22 nt, Human
ugcuccagggcugccagacccu

SEQ ID NO: 74216 - RNA, 20 nt, Human
ugcuccaucuaaagugauua

SEQ ID NO: 74217 - RNA, 22 nt, Human
ugcuccaucuagagcucugcag

SEQ ID NO: 74218 - RNA, 22 nt, Human
uggcuucuuuguagaaauugaa

SEQ ID NO: 74219 - RNA, 22 nt, Human
uggcuugcuacugaggugucag

SEQ ID NO: 74220 - RNA, 22 nt, Human
uggcuugcuucuucugcugucg

SEQ ID NO: 74221 - RNA, 19 nt, Human
uggcuuggcugcagaugcu

SEQ ID NO: 74222 - RNA, 22 nt, Human
uggcuugguccuggcccuuccc

SEQ ID NO: 74223 - RNA, 22 nt, Human
uggcuugucauguaucugaggc

SEQ ID NO: 74224 - RNA, 20 nt, Human
uggcuuguuucuaugggcag

SEQ ID NO: 74225 - RNA, 22 nt, Human
uggcuuuaagaagacugacagc

SEQ ID NO: 74226 - RNA, 22 nt, Human
uggcuuuaggccaaagccuaac

SEQ ID NO: 74227 - RNA, 22 nt, Human
uggcuuuauaccuuugccuugg

SEQ ID NO: 74228 - RNA, 22 nt, Human
uggcuuuauguacucaagucac

SEQ ID NO: 74229 - RNA, 22 nt, Human
uggcuuucgcuauagagcacgg

SEQ ID NO: 74230 - RNA, 22 nt, Human
ugggaaaguguagccugcaggc

SEQ ID NO: 74231 - RNA, 22 nt, Human
ugggaaaguguugaggugucuu

SEQ ID NO: 74232 - RNA, 22 nt, Human
ugggaaauauaauuuagcugug

SEQ ID NO: 74233 - RNA, 22 nt, Human
ugggaacaccugcugcccagug

SEQ ID NO: 74234 - RNA, 22 nt, Human
ugggaaccauguagcugagaug

SEQ ID NO: 74235 - RNA, 22 nt, Human
ugggaacucucugggaggcauc

SEQ ID NO: 74236 - RNA, 22 nt, Human
ugggaacuggggcauuguuucu

SEQ ID NO: 74237 - RNA, 22 nt, Human
ugggaacuguacugccuugaac

SEQ ID NO: 74238 - RNA, 23 nt, Human
ugggaagauauguauguucaagg

SEQ ID NO: 74239 - RNA, 22 nt, Human
uggaauguugcucugccuugcg

SEQ ID NO: 74240 - RNA, 22 nt, Human
uggaauuuaguuaauuccauuu

SEQ ID NO: 74241 - RNA, 22 nt, Human
uggacaaauagcaugacacuug

SEQ ID NO: 74242 - RNA, 22 nt, Human
uggacaaaugauuucuaccuuu

SEQ ID NO: 74243 - RNA, 22 nt, Human
uggacaacauagugagaccuca

SEQ ID NO: 74244 - RNA, 20 nt, Human
uggacacagcccuguugagu

SEQ ID NO: 74245 - RNA, 22 nt, Human
uggacacaguggugaagguaca

SEQ ID NO: 74246 - RNA, 18 nt, Human
uggacacauggccugggu

SEQ ID NO: 74247 - RNA, 22 nt, Human
uggacagcgaaagugccuggga

SEQ ID NO: 74248 - RNA, 22 nt, Human
uggacagcuugcagagccaccc

SEQ ID NO: 74249 - RNA, 23 nt, Human
uggacaggacccccuucggaccc

SEQ ID NO: 74250 - RNA, 22 nt, Human
uggacaggggcugcuguuguca

SEQ ID NO: 74251 - RNA, 22 nt, Human
uggacagguugaguaggaggag

SEQ ID NO: 74252 - RNA, 22 nt, Human
uggacaguauugugaagcaggc

SEQ ID NO: 74253 - RNA, 22 nt, Human
uggacaguuacugagcuugagu

SEQ ID NO: 74254 - RNA, 22 nt, Human
uggacaugaccucgagcgagau

SEQ ID NO: 74255 - RNA, 22 nt, Human
uggacauguccggccagacaau

SEQ ID NO: 74256 - RNA, 22 nt, Human
uggaccagcagccccagugccu

SEQ ID NO: 74257 - RNA, 22 nt, Human
uggacccccucaaggcagagcu

SEQ ID NO: 74258 - RNA, 22 nt, Human
uggacccuacccggcccucggc

SEQ ID NO: 74259 - RNA, 23 nt, Human
uggaccugaaccagugccucugu

SEQ ID NO: 74260 - RNA, 22 nt, Human
uggaccugaagaauaggaagua

SEQ ID NO: 74261 - RNA, 22 nt, Human
uggaccugcuggaugggcaggu

SEQ ID NO: 74262 - RNA, 22 nt, Human
uggacuaaagaggaaagaugua

SEQ ID NO: 74263 - RNA, 22 nt, Human
uggacucagaaguguucuuuua

SEQ ID NO: 74264 - RNA, 22 nt, Human
uggacuccagugucuguguucu

SEQ ID NO: 74265 - RNA, 22 nt, Human
uggacucuaugaugcgccagca

SEQ ID NO: 74266 - RNA, 22 nt, Human
uggacuuuuuaacugauaggag

SEQ ID NO: 74267 - RNA, 22 nt, Human
uggagaaggggcagggucucca

SEQ ID NO: 74268 - RNA, 22 nt, Human
uggagaaucuggaaacuguuga

SEQ ID NO: 74269 - RNA, 23 nt, Human
uggagaauuuagagucucuagga

SEQ ID NO: 74270 - RNA, 20 nt, Human
uggagacaauugcccuuuuu

SEQ ID NO: 74271 - RNA, 22 nt, Human
uggagacauuucucauuaaaaa

SEQ ID NO: 74272 - RNA, 22 nt, Human
uggagacucugcaucugugaca

SEQ ID NO: 74273 - RNA, 22 nt, Human
uggagacugacugccuguauuu

SEQ ID NO: 74274 - RNA, 22 nt, Human
uggagagaagaggcagugugcu

SEQ ID NO: 74275 - RNA, 22 nt, Human
uggagagaugucuguucaaggu

SEQ ID NO: 74276 - RNA, 22 nt, Human
uggagagcaaugaggggcaggc

SEQ ID NO: 74277 - RNA, 22 nt, Human
uggagagcacugucucauuuug

SEQ ID NO: 74278 - RNA, 22 nt, Human
uggagagcccgagacauccugu

SEQ ID NO: 74279 - RNA, 21 nt, Human
uggagagcccuugccugaguc

SEQ ID NO: 74280 - RNA, 20 nt, Human
uggagagccucuggacugug

SEQ ID NO: 74281 - RNA, 22 nt, Human
uggagagccuucccggcaucgc

SEQ ID NO: 74282 - RNA, 22 nt, Human
uggagagcgcgacgggaggaag

SEQ ID NO: 74283 - RNA, 22 nt, Human
uggagagcuccuauuugcuguc

SEQ ID NO: 74284 - RNA, 22 nt, Human
uggagagcugguucaaagcaga

SEQ ID NO: 74285 - RNA, 22 nt, Human
uggagaggagcaccauggccau

SEQ ID NO: 74286 - RNA, 22 nt, Human
uggagagguugaauaacuuguc

SEQ ID NO: 74287 - RNA, 22 nt, Human
uggagagguuuaaacaaaaguu

SEQ ID NO: 74288 - RNA, 22 nt, Human
uggagagucucugagccagggc

SEQ ID NO: 74289 - RNA, 22 nt, Human
uggagaguguagacuucagagu

SEQ ID NO: 74290 - RNA, 22 nt, Human
uggagaguucuguagauaucua

SEQ ID NO: 74291 - RNA, 22 nt, Human
uggagaugcacgagcaggugga

SEQ ID NO: 74292 - RNA, 22 nt, Human
uggagaugccuggagauuaggg

SEQ ID NO: 74293 - RNA, 22 nt, Human
uggagcagaaauuugaagccau

SEQ ID NO: 74294 - RNA, 22 nt, Human
uggagcagagaugguggccuuc

SEQ ID NO: 74295 - RNA, 22 nt, Human
uggagcagcauucauccagcag

SEQ ID NO: 74296 - RNA, 22 nt, Human
uggagcagccuuuucuaagcaa

SEQ ID NO: 74297 - RNA, 22 nt, Human
uggagcagcugaacagaguuga

SEQ ID NO: 74298 - RNA, 22 nt, Human
uggagcaggugcucaggguaau

SEQ ID NO: 74299 - RNA, 22 nt, Human
uggagcaggugggaugucguga

SEQ ID NO: 74300 - RNA, 22 nt, Human
uggagcauauucuggagcuugg

SEQ ID NO: 74301 - RNA, 22 nt, Human
uggagccaaugaacauuugcug

SEQ ID NO: 74302 - RNA, 22 nt, Human
uggagccagcgagccgaggcgg

SEQ ID NO: 74303 - RNA, 22 nt, Human
uggagccaggagccugggaguc

SEQ ID NO: 74304 - RNA, 22 nt, Human
uggagccaggguagaagcagag

SEQ ID NO: 74305 - RNA, 22 nt, Human
uggagccaguguugcccaacac

SEQ ID NO: 74306 - RNA, 22 nt, Human
uggagccuccucacacuguggc

SEQ ID NO: 74307 - RNA, 23 nt, Human
uggagccugggauacaauagaug

SEQ ID NO: 74308 - RNA, 22 nt, Human
uggagccuguucugagaagccg

SEQ ID NO: 74309 - RNA, 22 nt, Human
uggagccuuuuacccacaggag

SEQ ID NO: 74310 - RNA, 22 nt, Human
uggagcugagaaguggagcucu

SEQ ID NO: 74311 - RNA, 22 nt, Human
uggagcugagaguuaauaagga

SEQ ID NO: 74312 - RNA, 18 nt, Human
uggagcugagugcugugc

SEQ ID NO: 74313 - RNA, 21 nt, Human
uggagcugccacuugagcugc

SEQ ID NO: 74314 - RNA, 21 nt, Human
uggagcugccacuuguccucc

SEQ ID NO: 74315 - RNA, 22 nt, Human
uggagcugccuggcaccuacag

SEQ ID NO: 74316 - RNA, 17 nt, Human
uggagcugcguguguuc

SEQ ID NO: 74317 - RNA, 22 nt, Human
uggagcuggaauuugagcugga

SEQ ID NO: 74318 - RNA, 23 nt, Human
uggagcugggcucagacccuggg

SEQ ID NO: 74319 - RNA, 22 nt, Human
uggagcugguaaacagugacau

SEQ ID NO: 74320 - RNA, 19 nt, Human
uggaggaaguauauuucau

SEQ ID NO: 74321 - RNA, 22 nt, Human
uggaggaaguggacaguugugu

SEQ ID NO: 74322 - RNA, 21 nt, Human
uggaggaauaaagcacagaag

SEQ ID NO: 74323 - RNA, 18 nt, Human
uggaggaaucacaauggc

SEQ ID NO: 74324 - RNA, 22 nt, Human
uggaggacaggacuggacagcc

SEQ ID NO: 74325 - RNA, 22 nt, Human
uggaggaggaacuucuuaucuc

SEQ ID NO: 74326 - RNA, 22 nt, Human
uggaggagggcuggugucugua

SEQ ID NO: 74327 - RNA, 22 nt, Human
caucagagugguggccuggugu

SEQ ID NO: 74328 - RNA, 22 nt, Human
caucagaguuaacaucaugacu

SEQ ID NO: 74329 - RNA, 22 nt, Human
caucagccuggaaggcagccug

SEQ ID NO: 74330 - RNA, 22 nt, Human
caucagcuaaacuuagugaaau

SEQ ID NO: 74331 - RNA, 22 nt, Human
caucagcuuuggcgcugagcau

SEQ ID NO: 74332 - RNA, 22 nt, Human
caucaggaauaaaugaggcugu

SEQ ID NO: 74333 - RNA, 22 nt, Human
caucaggagaccagguccugcu

SEQ ID NO: 74334 - RNA, 22 nt, Human
caucaggaggagaugaagaaaa

SEQ ID NO: 74335 - RNA, 22 nt, Human
caucagucagucucuucaguau

SEQ ID NO: 74336 - RNA, 22 nt, Human
caucagucugaaagccagggag

SEQ ID NO: 74337 - RNA, 22 nt, Human
caucagugaaagugaauguucu

SEQ ID NO: 74338 - RNA, 22 nt, Human
caucagugagccccuugaugag

SEQ ID NO: 74339 - RNA, 22 nt, Human
caucaguguugauccaccagca

SEQ ID NO: 74340 - RNA, 22 nt, Human
caucaguuuggagaggcgguuu

SEQ ID NO: 74341 - RNA, 22 nt, Human
caucauaaaauugagauaacug

SEQ ID NO: 74342 - RNA, 22 nt, Human
caucaucaaaacaaauggaguc

SEQ ID NO: 74343 - RNA, 22 nt, Human
caucaucaacuggcagguaagu

SEQ ID NO: 74344 - RNA, 22 nt, Human
caucaucucuggcccuugaagu

SEQ ID NO: 74345 - RNA, 22 nt, Human
caucaucuggcuuuuagaaaaa

SEQ ID NO: 74346 - RNA, 22 nt, Human
caucaucuugaaugacugugau

SEQ ID NO: 74347 - RNA, 23 nt, Human
caucaugcaaucuugggauuucu

SEQ ID NO: 74348 - RNA, 21 nt, Human
caucaugcuuguguuggagaa

SEQ ID NO: 74349 - RNA, 22 nt, Human
caucauuuguuugcaugcagga

SEQ ID NO: 74350 - RNA, 22 nt, Human
caucauuuuguauccaagggga

SEQ ID NO: 74351 - RNA, 22 nt, Human
caucauuuuuguaagcugguag

SEQ ID NO: 74352 - RNA, 23 nt, Human
cauccaggagcugagucugacug

SEQ ID NO: 74353 - RNA, 22 nt, Human
cauccauagauugagagauggu

SEQ ID NO: 74354 - RNA, 22 nt, Human
cauccauagcuugaucuguucc

SEQ ID NO: 74355 - RNA, 22 nt, Human
caucccugacuucuaggugaca

SEQ ID NO: 74356 - RNA, 22 nt, Human
cauccgcaugcaagugcugucc

SEQ ID NO: 74357 - RNA, 22 nt, Human
cauccguuaauaaaaagacagu

SEQ ID NO: 74358 - RNA, 22 nt, Human
cauccugacaagaaagccagaa

SEQ ID NO: 74359 - RNA, 22 nt, Human
cauccugacuguaacuaagaga

SEQ ID NO: 74360 - RNA, 22 nt, Human
cauccugcggggagcagagggc

SEQ ID NO: 74361 - RNA, 18 nt, Human
cauccuuauagcugagaa

SEQ ID NO: 74362 - RNA, 22 nt, Human
caucguauggccgaauguacau

SEQ ID NO: 74363 - RNA, 22 nt, Human
caucuacacugauuaggugaac

SEQ ID NO: 74364 - RNA, 22 nt, Human
caucuaccagaauugcuauaaa

SEQ ID NO: 74365 - RNA, 22 nt, Human
caucuauuuucugugagguauc

SEQ ID NO: 74366 - RNA, 22 nt, Human
caucucacugagggguuuacaa

SEQ ID NO: 74367 - RNA, 22 nt, Human
caucucacuucccugcagcauc

SEQ ID NO: 74368 - RNA, 22 nt, Human
caucucauagugcagugcugua

SEQ ID NO: 74369 - RNA, 22 nt, Human
caucucauuuauuccaacucag

SEQ ID NO: 74370 - RNA, 22 nt, Human
caucuccaggaguucuacucau

SEQ ID NO: 74371 - RNA, 22 nt, Human
caucuccuggcagcuguuagga

SEQ ID NO: 74372 - RNA, 22 nt, Human
caucucuccacggcagcucucg

SEQ ID NO: 74373 - RNA, 22 nt, Human
caucucugagaccucagcuggg

SEQ ID NO: 74374 - RNA, 22 nt, Human
caucucugguucagucucugug

SEQ ID NO: 74375 - RNA, 22 nt, Human
caguacaguaaagcaagcugaa

SEQ ID NO: 74376 - RNA, 22 nt, Human
caguacuaagacuccaccuagc

SEQ ID NO: 74377 - RNA, 22 nt, Human
caguacucccagaacaaacccu

SEQ ID NO: 74378 - RNA, 22 nt, Human
caguacucuuauuugaaauaug

SEQ ID NO: 74379 - RNA, 22 nt, Human
caguacuuaguucucaugguuu

SEQ ID NO: 74380 - RNA, 22 nt, Human
caguacuuauuucuauuuaggg

SEQ ID NO: 74381 - RNA, 22 nt, Human
caguacuuugcaucauuccacu

SEQ ID NO: 74382 - RNA, 22 nt, Human
caguagcaggauuugggauuau

SEQ ID NO: 74383 - RNA, 21 nt, Human
caguagugcgucgcagaggac

SEQ ID NO: 74384 - RNA, 22 nt, Human
caguaguggaagggagagaaaa

SEQ ID NO: 74385 - RNA, 22 nt, Human
caguauauucugcagagccuua

SEQ ID NO: 74386 - RNA, 22 nt, Human
caguaucugucaguaaucaggu

SEQ ID NO: 74387 - RNA, 22 nt, Human
caguaugacuacaaacagcuuu

SEQ ID NO: 74388 - RNA, 22 nt, Human
caguauguuugggagacaugac

SEQ ID NO: 74389 - RNA, 20 nt, Human
caguauugauccauugucug

SEQ ID NO: 74390 - RNA, 22 nt, Human
caguauuuaggauuaggagaga

SEQ ID NO: 74391 - RNA, 22 nt, Human
caguauuuauggcuugaguauu

SEQ ID NO: 74392 - RNA, 22 nt, Human
caguauuuguucccuaucaaug

SEQ ID NO: 74393 - RNA, 21 nt, Human
caguauuuuaagcagugaguu

SEQ ID NO: 74394 - RNA, 22 nt, Human
cagucacacaaguggacuuggg

SEQ ID NO: 74395 - RNA, 17 nt, Human
cagucacaggucuuuuc

SEQ ID NO: 74396 - RNA, 22 nt, Human
cagucacagugacaggaugugg

SEQ ID NO: 74397 - RNA, 22 nt, Human
cagucacuccagccugccucag

SEQ ID NO: 74398 - RNA, 22 nt, Human
cagucacugguucuauaggccc

SEQ ID NO: 74399 - RNA, 22 nt, Human
cagucagaaggaagaugcuuaa

SEQ ID NO: 74400 - RNA, 22 nt, Human
cagucaggaaugccuccuuccu

SEQ ID NO: 74401 - RNA, 22 nt, Human
cagucauuccuaaccaagaaca

SEQ ID NO: 74402 - RNA, 22 nt, Human
cagucauuuuauuugaaaauua

SEQ ID NO: 74403 - RNA, 22 nt, Human
caguccaaccugccccuugggc

SEQ ID NO: 74404 - RNA, 20 nt, Human
caguccacuggaguuccuac

SEQ ID NO: 74405 - RNA, 22 nt, Human
caguccagaguaccccaagaag

SEQ ID NO: 74406 - RNA, 22 nt, Human
caguccagcucaucaguggcac

SEQ ID NO: 74407 - RNA, 22 nt, Human
caguccaguccaauccucaaug

SEQ ID NO: 74408 - RNA, 18 nt, Human
cagucccaaaccuuagga

SEQ ID NO: 74409 - RNA, 19 nt, Human
cagucccaaauucuuguca

SEQ ID NO: 74410 - RNA, 15 nt, Human
cagucccagggaccc

SEQ ID NO: 74411 - RNA, 22 nt, Human
cagucccaguuugagacucugg

SEQ ID NO: 74412 - RNA, 22 nt, Human
cagucccugggggagucaccag

SEQ ID NO: 74413 - RNA, 22 nt, Human
caguccucugcaacaccccuuc

SEQ ID NO: 74414 - RNA, 22 nt, Human
caguccugaauacuggacggug

SEQ ID NO: 74415 - RNA, 22 nt, Human
caguccugaggaagagcugcug

SEQ ID NO: 74416 - RNA, 20 nt, Human
caguccugcaggcgggagaa

SEQ ID NO: 74417 - RNA, 22 nt, Human
caguccugugucccuugguggg

SEQ ID NO: 74418 - RNA, 22 nt, Human
caguccuguuccuggaguaguu

SEQ ID NO: 74419 - RNA, 18 nt, Human
caguccuguuucuacagg

SEQ ID NO: 74420 - RNA, 22 nt, Human
caguccuugcucugggaugaug

SEQ ID NO: 74421 - RNA, 22 nt, Human
cagucuaagacucacgccaaga

SEQ ID NO: 74422 - RNA, 22 nt, Human
cagucuaccuuucagacauuga

SEQ ID NO: 74423 - RNA, 22 nt, Human
cagucuccaaaucaaucugaau

SEQ ID NO: 74424 - RNA, 22 nt, Human
cagucucucagcuuucagcugu

SEQ ID NO: 74425 - RNA, 22 nt, Human
cagucucugucaucucauggga

SEQ ID NO: 74426 - RNA, 23 nt, Human
cagucugcagcccacuugggcag

SEQ ID NO: 74427 - RNA, 22 nt, Human
cagucuggcucagcacaaaggg

SEQ ID NO: 74428 - RNA, 22 nt, Human
cagucuugcuuuacugagaugg

SEQ ID NO: 74429 - RNA, 22 nt, Human
cagucuuuuguauauuagcaga

SEQ ID NO: 74430 - RNA, 22 nt, Human
cagugaaaucacaacuuuaguu

SEQ ID NO: 74431 - RNA, 22 nt, Human
cagugaaguucuacugaauggu

SEQ ID NO: 74432 - RNA, 22 nt, Human
cagugacagguuccaugccgca

SEQ ID NO: 74433 - RNA, 22 nt, Human
cagugagaccuucuaagguggu

SEQ ID NO: 74434 - RNA, 22 nt, Human
cagugagauaccacagagcaaa

SEQ ID NO: 74435 - RNA, 20 nt, Human
cagugaggaggugcuggggg

SEQ ID NO: 74436 - RNA, 22 nt, Human
caugcagggagugcuccuauua

SEQ ID NO: 74437 - RNA, 22 nt, Human
caugcaggugaccagguguggg

SEQ ID NO: 74438 - RNA, 22 nt, Human
caugcauagaaugaagaggcug

SEQ ID NO: 74439 - RNA, 22 nt, Human
caugcaucgaugaaugcguggg

SEQ ID NO: 74440 - RNA, 20 nt, Human
caugcaugacacuggaaagg

SEQ ID NO: 74441 - RNA, 22 nt, Human
caugcaugccgggcugacagag

SEQ ID NO: 74442 - RNA, 22 nt, Human
caugcauguuuacuacagugac

SEQ ID NO: 74443 - RNA, 22 nt, Human
caugcauuguaauuuuuagucu

SEQ ID NO: 74444 - RNA, 22 nt, Human
caugcauuuggaguuuucaagu

SEQ ID NO: 74445 - RNA, 22 nt, Human
caugccaagcauguucagaagu

SEQ ID NO: 74446 - RNA, 22 nt, Human
caugccagguuugaguaucuug

SEQ ID NO: 74447 - RNA, 22 nt, Human
caugccauuucuucucuuuaug

SEQ ID NO: 74448 - RNA, 22 nt, Human
caugcccauugagaagggccuc

SEQ ID NO: 74449 - RNA, 22 nt, Human
caugcccuccuugccuucacug

SEQ ID NO: 74450 - RNA, 22 nt, Human
caugccucugcagcuguuuauu

SEQ ID NO: 74451 - RNA, 22 nt, Human
caugccugccuggugggcgugg

SEQ ID NO: 74452 - RNA, 22 nt, Human
caugcggcucuuuccaaaccgg

SEQ ID NO: 74453 - RNA, 22 nt, Human
caugcuaauucccaggccccaa

SEQ ID NO: 74454 - RNA, 22 nt, Human
caugcuauauaggaagagcacu

SEQ ID NO: 74455 - RNA, 22 nt, Human
caugcuauuuuccaauaaugua

SEQ ID NO: 74456 - RNA, 22 nt, Human
caugcucacaaaagauggcaaa

SEQ ID NO: 74457 - RNA, 22 nt, Human
caugcugagcacauucuguauu

SEQ ID NO: 74458 - RNA, 20 nt, Human
caugcugccuccauugaugc

SEQ ID NO: 74459 - RNA, 22 nt, Human
caugcuguacucugugucagaa

SEQ ID NO: 74460 - RNA, 22 nt, Human
caugcuguccugaaaagauauu

SEQ ID NO: 74461 - RNA, 22 nt, Human
caugcuguccugccagggaugg

SEQ ID NO: 74462 - RNA, 22 nt, Human
caugcugugugguuagaacugu

SEQ ID NO: 74463 - RNA, 22 nt, Human
caugcuguguguuuuagcucca

SEQ ID NO: 74464 - RNA, 22 nt, Human
caugcuuacuugucucagcaga

SEQ ID NO: 74465 - RNA, 22 nt, Human
caugcuuauauggaaaggaaga

SEQ ID NO: 74466 - RNA, 22 nt, Human
caugcuuaugauuugcuaagcc

SEQ ID NO: 74467 - RNA, 22 nt, Human
caugcuuuaccaaagcagugau

SEQ ID NO: 74468 - RNA, 22 nt, Human
caugcuuugggucagaaaugcc

SEQ ID NO: 74469 - RNA, 22 nt, Human
cauggaacuucaagaagaaagc

SEQ ID NO: 74470 - RNA, 22 nt, Human
cauggaaugguugaaugacgaa

SEQ ID NO: 74471 - RNA, 22 nt, Human
cauggacagugggacagugugu

SEQ ID NO: 74472 - RNA, 22 nt, Human
cauggacucugguuuggggagc

SEQ ID NO: 74473 - RNA, 22 nt, Human
cauggagauaaacugaaauauu

SEQ ID NO: 74474 - RNA, 22 nt, Human
cauggauauauuguacaguagc

SEQ ID NO: 74475 - RNA, 23 nt, Human
cauggcagcaagagcucauggcc

SEQ ID NO: 74476 - RNA, 22 nt, Human
cauggcaggaggcugcuggcag

SEQ ID NO: 74477 - RNA, 22 nt, Human
cauggcaggugugggguuuuau

SEQ ID NO: 74478 - RNA, 22 nt, Human
cauggcagugauucagccuuug

SEQ ID NO: 74479 - RNA, 22 nt, Human
cauggccaaagaauuauauuuu

SEQ ID NO: 74480 - RNA, 22 nt, Human
cauggccagcccugagguucag

SEQ ID NO: 74481 - RNA, 22 nt, Human
cauggccaggcacgcgcauagc

SEQ ID NO: 74482 - RNA, 22 nt, Human
cauggccaggcccagggcccag

SEQ ID NO: 74483 - RNA, 22 nt, Human
cauggcggucaggauguaggug

SEQ ID NO: 74484 - RNA, 22 nt, Human
cauggcucacaggaugggcuag

SEQ ID NO: 74485 - RNA, 22 nt, Human
cauggcugaggcagaggacuga

SEQ ID NO: 74486 - RNA, 19 nt, Human
cauggcugccccauauagc

SEQ ID NO: 74487 - RNA, 22 nt, Human
cauggcugccuguggacacugc

SEQ ID NO: 74488 - RNA, 22 nt, Human
cauggcugcgagaagagugggu

SEQ ID NO: 74489 - RNA, 22 nt, Human
cauggcuggccagugggagugg

SEQ ID NO: 74490 - RNA, 22 nt, Human
cauggcuuaccccaggagcagc

SEQ ID NO: 74491 - RNA, 22 nt, Human
cauggcuuacuuucagggagua

SEQ ID NO: 74492 - RNA, 22 nt, Human
cauggcuucaugaggguuuugc

SEQ ID NO: 74493 - RNA, 22 nt, Human
caguggcuguuucuggaaggca

SEQ ID NO: 74494 - RNA, 22 nt, Human
caguggcuuacaaugaacuaga

SEQ ID NO: 74495 - RNA, 22 nt, Human
caguggcuucuuccuagagcca

SEQ ID NO: 74496 - RNA, 21 nt, Human
cagugggcugcugcgcuccag

SEQ ID NO: 74497 - RNA, 22 nt, Human
caguggguccuaaguacaguuc

SEQ ID NO: 74498 - RNA, 22 nt, Human
cagugggugaugaguccugggg

SEQ ID NO: 74499 - RNA, 22 nt, Human
cagugggugccaucgugcccuu

SEQ ID NO: 74500 - RNA, 22 nt, Human
caguggguggccucuugaguca

SEQ ID NO: 74501 - RNA, 21 nt, Human
caguggucugucuccauuuuu

SEQ ID NO: 74502 - RNA, 22 nt, Human
caguggucugugcuucuguaca

SEQ ID NO: 74503 - RNA, 18 nt, Human
caguggugcugggaugug

SEQ ID NO: 74504 - RNA, 22 nt, Human
cagugguuauacuuacuguuuc

SEQ ID NO: 74505 - RNA, 22 nt, Human
cagugguuuugagauucagggu

SEQ ID NO: 74506 - RNA, 22 nt, Human
caguguaagcucuagacuagaa

SEQ ID NO: 74507 - RNA, 22 nt, Human
cagugucuacaguggcuggagg

SEQ ID NO: 74508 - RNA, 22 nt, Human
cagugucucaaaacaaguugcu

SEQ ID NO: 74509 - RNA, 22 nt, Human
cagugucucaguuucacuugaa

SEQ ID NO: 74510 - RNA, 22 nt, Human
cagugugccugaaucaaguguu

SEQ ID NO: 74511 - RNA, 22 nt, Human
caguguggcuuagggaauaggc

SEQ ID NO: 74512 - RNA, 22 nt, Human
caguguggguuugggaggagua

SEQ ID NO: 74513 - RNA, 21 nt, Human
caguguggugaccagggucuc

SEQ ID NO: 74514 - RNA, 22 nt, Human
caguguggugagauuccaggug

SEQ ID NO: 74515 - RNA, 22 nt, Human
caguguggugugcacagcuuag

SEQ ID NO: 74516 - RNA, 22 nt, Human
cagugugugacucuggggguac

SEQ ID NO: 74517 - RNA, 22 nt, Human
caguguguggauugcccuugca

SEQ ID NO: 74518 - RNA, 22 nt, Human
caguguucccugaacauauguu

SEQ ID NO: 74519 - RNA, 21 nt, Human
caguguugauauuuaauacau

SEQ ID NO: 74520 - RNA, 22 nt, Human
caguguuuaaucauugugaauu

SEQ ID NO: 74521 - RNA, 22 nt, Human
caguguuucugugcccaguggg

SEQ ID NO: 74522 - RNA, 22 nt, Human
caguguuuugagaagggcacgu

SEQ ID NO: 74523 - RNA, 22 nt, Human
caguguuuuguuacuugggcac

SEQ ID NO: 74524 - RNA, 22 nt, Human
caguuaaaagaagucuaucuua

SEQ ID NO: 74525 - RNA, 22 nt, Human
caguuaaaaugugcuauaagaa

SEQ ID NO: 74526 - RNA, 22 nt, Human
caguuaacugagcucugugaga

SEQ ID NO: 74527 - RNA, 22 nt, Human
caguuaacuucauaugaucauu

SEQ ID NO: 74528 - RNA, 22 nt, Human
caguuaaucuugccauuauauc

SEQ ID NO: 74529 - RNA, 20 nt, Human
caguuaaugacuaggcauca

SEQ ID NO: 74530 - RNA, 21 nt, Human
caguuacacaaguguuaccag

SEQ ID NO: 74531 - RNA, 22 nt, Human
caguuacauaaaugauaaaaug

SEQ ID NO: 74532 - RNA, 22 nt, Human
caguuacauuaauaaugcacau

SEQ ID NO: 74533 - RNA, 22 nt, Human
caguuagcugacaaguaggcua

SEQ ID NO: 74534 - RNA, 22 nt, Human
caguuaucaaauacuaugaagg

SEQ ID NO: 74535 - RNA, 22 nt, Human
caguuauuuugaggauuaaaug

SEQ ID NO: 74536 - RNA, 22 nt, Human
caguucaaaguuaagcagcagu

SEQ ID NO: 74537 - RNA, 22 nt, Human
caguucaggccggcugacucag

SEQ ID NO: 74538 - RNA, 19 nt, Human
caguuccagcuucuugacc

SEQ ID NO: 74539 - RNA, 22 nt, Human
caguucuaucauuuuagagaug

SEQ ID NO: 74540 - RNA, 22 nt, Human
caguucucugugccucgcuggg

SEQ ID NO: 74541 - RNA, 22 nt, Human
caguucuuauuuggccaguguc

SEQ ID NO: 74542 - RNA, 20 nt, Human
caguugaaauaauuuguuug

SEQ ID NO: 74543 - RNA, 22 nt, Human
caguugagucugcuagcuagga

SEQ ID NO: 74544 - RNA, 22 nt, Human
caguugccuuauuuccuugcug

SEQ ID NO: 74545 - RNA, 22 nt, Human
ccacagcuccucagccucuuuc

SEQ ID NO: 74546 - RNA, 22 nt, Human
ccacagcugacaauggauagac

SEQ ID NO: 74547 - RNA, 22 nt, Human
ccacagcugaccgcaggugagc

SEQ ID NO: 74548 - RNA, 17 nt, Human
ccacagcugggugccuu

SEQ ID NO: 74549 - RNA, 22 nt, Human
ccacaggacggaggucuggccg

SEQ ID NO: 74550 - RNA, 23 nt, Human
ccacaggcacagaggcuugcauc

SEQ ID NO: 74551 - RNA, 22 nt, Human
ccacaggcggaguggcgggcag

SEQ ID NO: 74552 - RNA, 22 nt, Human
ccacaggcugcugcaggucccg

SEQ ID NO: 74553 - RNA, 22 nt, Human
ccacagggcacagacaggaagc

SEQ ID NO: 74554 - RNA, 22 nt, Human
ccacagggcucuaggcgcuucc

SEQ ID NO: 74555 - RNA, 21 nt, Human
ccacaggggcuccccugucag

SEQ ID NO: 74556 - RNA, 22 nt, Human
ccacagggucagccacucugca

SEQ ID NO: 74557 - RNA, 16 nt, Human
ccacaguaagaaauac

SEQ ID NO: 74558 - RNA, 22 nt, Human
ccacagugagugucauacuugg

SEQ ID NO: 74559 - RNA, 22 nt, Human
ccacagugccuggaauucugca

SEQ ID NO: 74560 - RNA, 22 nt, Human
ccacagugggcacagcaggacu

SEQ ID NO: 74561 - RNA, 22 nt, Human
ccacaguuauucauuugugaca

SEQ ID NO: 74562 - RNA, 23 nt, Human
ccacaguucaucguucacucacc

SEQ ID NO: 74563 - RNA, 22 nt, Human
ccacaucauggauacaguuaug

SEQ ID NO: 74564 - RNA, 22 nt, Human
ccacaucuaagccuucaugaua

SEQ ID NO: 74565 - RNA, 22 nt, Human
ccacaucucccuauugcucuuu

SEQ ID NO: 74566 - RNA, 22 nt, Human
ccacaucucgguccccucuuug

SEQ ID NO: 74567 - RNA, 22 nt, Human
ccacaucugcagucccuucugu

SEQ ID NO: 74568 - RNA, 22 nt, Human
ccacaucugcauuuaauguaua

SEQ ID NO: 74569 - RNA, 22 nt, Human
ccacaucugguggccagugcua

SEQ ID NO: 74570 - RNA, 22 nt, Human
ccacaucuuuuuuccugaacag

SEQ ID NO: 74571 - RNA, 22 nt, Human
ccacaugcucuuguuacagugu

SEQ ID NO: 74572 - RNA, 22 nt, Human
ccacauggagcaggaggugggg

SEQ ID NO: 74573 - RNA, 19 nt, Human
ccacauggcuggaugacag

SEQ ID NO: 74574 - RNA, 22 nt, Human
ccacauuuacuggaugcucagg

SEQ ID NO: 74575 - RNA, 22 nt, Human
ccacauuucuucacuuguccca

SEQ ID NO: 74576 - RNA, 22 nt, Human
ccacauuuggagaagauacuuu

SEQ ID NO: 74577 - RNA, 22 nt, Human
ccacauuuugcuuugccuaggu

SEQ ID NO: 74578 - RNA, 22 nt, Human
ccaccaagucccacuauaauuu

SEQ ID NO: 74579 - RNA, 22 nt, Human
ccaccacuucuggcuucuggug

SEQ ID NO: 74580 - RNA, 22 nt, Human
ccaccagcagugugcaaggauu

SEQ ID NO: 74581 - RNA, 22 nt, Human
ccaccaggacagcccugagggg

SEQ ID NO: 74582 - RNA, 19 nt, Human
ccaccagugugaucuaaga

SEQ ID NO: 74583 - RNA, 22 nt, Human
ccaccauucaaggucuucacag

SEQ ID NO: 74584 - RNA, 22 nt, Human
ccacccagaccagggaucuggg

SEQ ID NO: 74585 - RNA, 22 nt, Human
ccacccagccagaugcaggaag

SEQ ID NO: 74586 - RNA, 22 nt, Human
ccaccccaaaugaagaccucuc

SEQ ID NO: 74587 - RNA, 20 nt, Human
ccacccuccaggaacacaua

SEQ ID NO: 74588 - RNA, 22 nt, Human
ccacccugaggaaugguccggc

SEQ ID NO: 74589 - RNA, 22 nt, Human
ccacccuuggguucggaggccg

SEQ ID NO: 74590 - RNA, 22 nt, Human
ccaccuccaccuauugccagcc

SEQ ID NO: 74591 - RNA, 22 nt, Human
ccaccuccucggccaugugacg

SEQ ID NO: 74592 - RNA, 20 nt, Human
ccaccuggccaaggcugugc

SEQ ID NO: 74593 - RNA, 22 nt, Human
ccacgcucccugaucccugcuu

SEQ ID NO: 74594 - RNA, 23 nt, Human
ccacgucugcacuguagcuguug

SEQ ID NO: 74595 - RNA, 22 nt, Human
ccacuacuuuguuuuuggugcu

SEQ ID NO: 74596 - RNA, 22 nt, Human
ccacucaggagcuuaucuaugc

SEQ ID NO: 74597 - RNA, 20 nt, Human
ccacuccaggugauucugau

SEQ ID NO: 74598 - RNA, 22 nt, Human
ccacugagaagggguugggguc

SEQ ID NO: 74599 - RNA, 22 nt, Human
ccacugaggccugggcccaggg

SEQ ID NO: 74600 - RNA, 22 nt, Human
ccacugaggggucaugguggga

SEQ ID NO: 74601 - RNA, 22 nt, Human
ccacugagugagcagagcaggg

SEQ ID NO: 74602 - RNA, 22 nt, Human
ccacugccaugggcuaggcaug

SEQ ID NO: 74603 - RNA, 22 nt, Human
ccacugcccaccccgacgucua

SEQ ID NO: 74604 - RNA, 22 nt, Human
ccacugccgauguuccaucuug

SEQ ID NO: 74605 - RNA, 22 nt, Human
ccacugccucuccagggccauc

SEQ ID NO: 74606 - RNA, 22 nt, Human
ccacugcuguuacuuacgcaaa

SEQ ID NO: 74607 - RNA, 22 nt, Human
ccacuggaagaugcugagguca

SEQ ID NO: 74608 - RNA, 23 nt, Human
ccacuggagaaaguggcaggugg

SEQ ID NO: 74609 - RNA, 22 nt, Human
ccacuggcaguuggcuagccuu

SEQ ID NO: 74610 - RNA, 22 nt, Human
ccacugggcguuucuguccaau

SEQ ID NO: 74611 - RNA, 22 nt, Human
ccacugggggcugcaggcacuc

SEQ ID NO: 74612 - RNA, 22 nt, Human
ccacugggggcugcucccaggu

SEQ ID NO: 74613 - RNA, 21 nt, Human
ccacuguagacucauucugag

SEQ ID NO: 74614 - RNA, 22 nt, Human
ccacuguaguuaugaugaaguu

SEQ ID NO: 74615 - RNA, 22 nt, Human
ccacugucagaggggcugugcc

SEQ ID NO: 74616 - RNA, 22 nt, Human
ccacugucugcaggccucagca

SEQ ID NO: 74617 - RNA, 22 nt, Human
ccacugucuuuuccaggcugaa

SEQ ID NO: 74618 - RNA, 22 nt, Human
ccacuguggaaagcaguucaga

SEQ ID NO: 74619 - RNA, 22 nt, Human
ccacuucaucagugcuccauuu

SEQ ID NO: 74620 - RNA, 22 nt, Human
ccacuugaaauaucuuuguucu

SEQ ID NO: 74621 - RNA, 22 nt, Human
ccacuugacauuuucauuaaga

SEQ ID NO: 74622 - RNA, 22 nt, Human
ccacuugugaaauaaucaaaua

SEQ ID NO: 74623 - RNA, 19 nt, Human
ccacuuugcuucucugggu

SEQ ID NO: 74624 - RNA, 22 nt, Human
ccagaaaacucuacaugcuugu

SEQ ID NO: 74625 - RNA, 19 nt, Human
ccacaaaauuauuuuaguu

SEQ ID NO: 74626 - RNA, 22 nt, Human
ccacaaagaaugggggaagcau

SEQ ID NO: 74627 - RNA, 22 nt, Human
ccacaaaguugcugaguuucug

SEQ ID NO: 74628 - RNA, 22 nt, Human
ccacaaauuagguuuugcuugu

SEQ ID NO: 74629 - RNA, 22 nt, Human
ccacaagacucugucagcauaa

SEQ ID NO: 74630 - RNA, 20 nt, Human
ccacaagggaauauuguuga

SEQ ID NO: 74631 - RNA, 22 nt, Human
ccacaagugaaguacaccugcc

SEQ ID NO: 74632 - RNA, 22 nt, Human
ccacacugaaccucagugucuu

SEQ ID NO: 74633 - RNA, 22 nt, Human
ccacacugucuaacaaggcaua

SEQ ID NO: 74634 - RNA, 22 nt, Human
ccacagaaugaugacacuucag

SEQ ID NO: 74635 - RNA, 22 nt, Human
ccacagagacagagcccagggu

SEQ ID NO: 74636 - RNA, 22 nt, Human
ccacagagagugucagccuuug

SEQ ID NO: 74637 - RNA, 19 nt, Human
ccacagagcaugcugaggc

SEQ ID NO: 74638 - RNA, 18 nt, Human
ccacagcagaguucuuac

SEQ ID NO: 74639 - RNA, 22 nt, Human
ccacagcaugcaggccugacac

SEQ ID NO: 74640 - RNA, 22 nt, Human
ccacagccauuccagggaggcu

SEQ ID NO: 74641 - RNA, 17 nt, Human
ccacagccuggcacuug

SEQ ID NO: 74642 - RNA, 21 nt, Human
ccacagcuggucucugagccc

SEQ ID NO: 74643 - RNA, 22 nt, Human
ccacagcuucgcagucugcugc

SEQ ID NO: 74644 - RNA, 22 nt, Human
ccacaggaggauguucagacaa

SEQ ID NO: 74645 - RNA, 22 nt, Human
ccacaggauccaagggaaggca

SEQ ID NO: 74646 - RNA, 16 nt, Human
ccacagggcaaggggc

SEQ ID NO: 74647 - RNA, 22 nt, Human
ccacaggggcccacgagccgcu

SEQ ID NO: 74648 - RNA, 22 nt, Human
ccacaggggucucuguagcuga

SEQ ID NO: 74649 - RNA, 22 nt, Human
ccacaguaaagaaacaacuucg

SEQ ID NO: 74650 - RNA, 22 nt, Human
ccacaguaacuguuuuguaccg

SEQ ID NO: 74651 - RNA, 22 nt, Human
ccacaguaggaacaaguugucg

SEQ ID NO: 74652 - RNA, 22 nt, Human
ccacagugaaaucuugauggag

SEQ ID NO: 74653 - RNA, 22 nt, Human
ccacagugacacgggcuggccc

SEQ ID NO: 74654 - RNA, 20 nt, Human
ccacaguggagacuggagac

SEQ ID NO: 74655 - RNA, 22 nt, Human
cauuaaacaaccuugaaucaau

SEQ ID NO: 74656 - RNA, 22 nt, Human
cauuaacaaauggaagcaugaa

SEQ ID NO: 74657 - RNA, 22 nt, Human
cauuaacacuuuggauuuagac

SEQ ID NO: 74658 - RNA, 22 nt, Human
cauuaagauuuuuuucuacugg

SEQ ID NO: 74659 - RNA, 22 nt, Human
cauuaauaaacauuucagaaga

SEQ ID NO: 74660 - RNA, 22 nt, Human
cauuaauauuguucuucuuuag

SEQ ID NO: 74661 - RNA, 22 nt, Human
cauuaauuguauuuuucaaagu

SEQ ID NO: 74662 - RNA, 19 nt, Human
cauuacaaauuuguaggga

SEQ ID NO: 74663 - RNA, 22 nt, Human
cauuacagaauauguaaugauc

SEQ ID NO: 74664 - RNA, 22 nt, Human
cauuacaucuuugaugcaguau

SEQ ID NO: 74665 - RNA, 22 nt, Human
cauuacgagcucuaaaauacua

SEQ ID NO: 74666 - RNA, 22 nt, Human
cauuagaaaagcagcugggacc

SEQ ID NO: 74667 - RNA, 22 nt, Human
cauuagaacuaagauguccagg

SEQ ID NO: 74668 - RNA, 22 nt, Human
cauuagaagaacaguuauauua

SEQ ID NO: 74669 - RNA, 22 nt, Human
cauuagaagguuuuaaaggaau

SEQ ID NO: 74670 - RNA, 22 nt, Human
cauuagacacagauguauaaau

SEQ ID NO: 74671 - RNA, 22 nt, Human
cauuagagcagauaauaugugu

SEQ ID NO: 74672 - RNA, 22 nt, Human
cauuagggucucucagcugaau

SEQ ID NO: 74673 - RNA, 22 nt, Human
cauuauauuuuacugcauggga

SEQ ID NO: 74674 - RNA, 22 nt, Human
cauuaucugagaguguccuaca

SEQ ID NO: 74675 - RNA, 22 nt, Human
cauuaugccaaaguagaaauau

SEQ ID NO: 74676 - RNA, 22 nt, Human
cauuauggaagugaagagcucu

SEQ ID NO: 74677 - RNA, 22 nt, Human
cauucaaaagcuccauguuugu

SEQ ID NO: 74678 - RNA, 22 nt, Human
cauucaaacauuaauuuauuca

SEQ ID NO: 74679 - RNA, 22 nt, Human
cauucaaagcaggaaaggccuu

SEQ ID NO: 74680 - RNA, 22 nt, Human
cauucacaauaguugaaaggug

SEQ ID NO: 74681 - RNA, 21 nt, Human
cauucacagucuggcucuuga

SEQ ID NO: 74682 - RNA, 22 nt, Human
cauucacaucuuguuccaucac

SEQ ID NO: 74683 - RNA, 22 nt, Human
cauucacauucuucuuacuguu

SEQ ID NO: 74684 - RNA, 22 nt, Human
cauucagucaugcugguuuuga

SEQ ID NO: 74685 - RNA, 22 nt, Human
cauucaguggaguauuauucag

SEQ ID NO: 74686 - RNA, 22 nt, Human
cauucauaagacuuugcucuug

SEQ ID NO: 74687 - RNA, 22 nt, Human
cauucauacaaguuuguuucau

SEQ ID NO: 74688 - RNA, 22 nt, Human
cauucauaggaggagaugauua

SEQ ID NO: 74689 - RNA, 22 nt, Human
cauucauauuugcaguauaccu

SEQ ID NO: 74690 - RNA, 22 nt, Human
cauucauucacauuuugucuau

SEQ ID NO: 74691 - RNA, 22 nt, Human
cauucauucagcaacuguuauu

SEQ ID NO: 74692 - RNA, 22 nt, Human
cauucauuuacuuucaacagcu

SEQ ID NO: 74693 - RNA, 22 nt, Human
cauucccugucucuucaauccu

SEQ ID NO: 74694 - RNA, 22 nt, Human
cauuccuauuaugucccuagug

SEQ ID NO: 74695 - RNA, 22 nt, Human
cauuccugagggcccccuacuu

SEQ ID NO: 74696 - RNA, 22 nt, Human
cauucuaucuuggacuggaucu

SEQ ID NO: 74697 - RNA, 22 nt, Human
cauucucaauaguagaugagua

SEQ ID NO: 74698 - RNA, 22 nt, Human
cauucucucuacuuguuuucaa

SEQ ID NO: 74699 - RNA, 22 nt, Human
cauucuucuggauaguuaguug

SEQ ID NO: 74700 - RNA, 22 nt, Human
cauugaaaaacguugacugagu

SEQ ID NO: 74701 - RNA, 22 nt, Human
cauugaaaauguugcaggcugu

SEQ ID NO: 74702 - RNA, 22 nt, Human
cauugaaagagauaaagccuuu

SEQ ID NO: 74703 - RNA, 22 nt, Human
cauugaauccuuccuucagaag

SEQ ID NO: 74704 - RNA, 22 nt, Human
cauugagaaucugggcuacagc

SEQ ID NO: 74705 - RNA, 22 nt, Human
cauugagaggcugccugccuga

SEQ ID NO: 74706 - RNA, 22 nt, Human
cauugagcgacccugcaugacu

SEQ ID NO: 74707 - RNA, 22 nt, Human
cauugauuauugaagggucuuu

SEQ ID NO: 74708 - RNA, 22 nt, Human
cauugcacagcccuguggugau

SEQ ID NO: 74709 - RNA, 22 nt, Human
cauugcacuccaucuugggcaa

SEQ ID NO: 74710 - RNA, 22 nt, Human
cauugcaguaaucuggugaaau

SEQ ID NO: 74711 - RNA, 22 nt, Human
cauugcucaggcccagcaggaa

SEQ ID NO: 74712 - RNA, 22 nt, Human
cauugcugccacuggauauuuc

SEQ ID NO: 74713 - RNA, 22 nt, Human
cauugcuguuaauugucucuag

SEQ ID NO: 74714 - RNA, 22 nt, Human
cauugcuuugugcauauuuaaa

SEQ ID NO: 74715 - RNA, 22 nt, Human
cauuggaaaaugcaugcuuuuu

SEQ ID NO: 74716 - RNA, 22 nt, Human
cauuggaagacauaucaugcua

SEQ ID NO: 74717 - RNA, 22 nt, Human
cauuggaaugaucguuuugcug

SEQ ID NO: 74718 - RNA, 22 nt, Human
cauuggaaugcauuugaagaga

SEQ ID NO: 74719 - RNA, 22 nt, Human
cauuggcaccucacaggauaga

SEQ ID NO: 74720 - RNA, 22 nt, Human
cauugucauucuaugcuauuca

SEQ ID NO: 74721 - RNA, 22 nt, Human
cauugugcagggauaaugcagc

SEQ ID NO: 74722 - RNA, 22 nt, Human
cauuguuucuggagggaucugu

SEQ ID NO: 74723 - RNA, 22 nt, Human
cauuguuuugagaacaaccuga

SEQ ID NO: 74724 - RNA, 22 nt, Human
cauuuacauuuaagguuaauau

SEQ ID NO: 74725 - RNA, 22 nt, Human
cauuuagaagucuuagaacuau

SEQ ID NO: 74726 - RNA, 22 nt, Human
cauuuagacauuugauuugggg

SEQ ID NO: 74727 - RNA, 22 nt, Human
cauuuaguacaacuuuuacagu

SEQ ID NO: 74728 - RNA, 22 nt, Human
cauuuagucaaggacacguggc

SEQ ID NO: 74729 - RNA, 22 nt, Human
cauuuaugaagcacuuuagagu

SEQ ID NO: 74730 - RNA, 22 nt, Human
cauuuaugauaguaauaugaaa

SEQ ID NO: 74731 - RNA, 22 nt, Human
cauuuauucauuugcuagggcu

SEQ ID NO: 74732 - RNA, 21 nt, Human
cauuucaaagagcuggaaauc

SEQ ID NO: 74733 - RNA, 22 nt, Human
cauuucaaggaccacccuggga

SEQ ID NO: 74734 - RNA, 22 nt, Human
cauuucaaugccuucaacauag

SEQ ID NO: 74735 - RNA, 22 nt, Human
cauuucagugucuugugaugaa

SEQ ID NO: 74736 - RNA, 21 nt, Human
cauuucaugauuauagaaaug

SEQ ID NO: 74737 - RNA, 22 nt, Human
cauuuccacuucugaaaacugg

SEQ ID NO: 74738 - RNA, 22 nt, Human
cauuuccagcuccugcaucaug

SEQ ID NO: 74739 - RNA, 22 nt, Human
cauuucuagacaaguccuggag

SEQ ID NO: 74740 - RNA, 22 nt, Human
cauuucucauaauauuagcacu

SEQ ID NO: 74741 - RNA, 22 nt, Human
cauuucuccgccgagaucacug

SEQ ID NO: 74742 - RNA, 22 nt, Human
ccagagggcccuggucucagcu

SEQ ID NO: 74743 - RNA, 22 nt, Human
ccagaggggcacaaaaguagaa

SEQ ID NO: 74744 - RNA, 22 nt, Human
ccagaggggugggccugguuua

SEQ ID NO: 74745 - RNA, 18 nt, Human
ccagagggugcgucagcu

SEQ ID NO: 74746 - RNA, 22 nt, Human
ccagagguccugcucacuggug

SEQ ID NO: 74747 - RNA, 22 nt, Human
ccagagguccugugaugcugca

SEQ ID NO: 74748 - RNA, 22 nt, Human
ccagaggugagggggauucuug

SEQ ID NO: 74749 - RNA, 22 nt, Human
ccagagguggugggugcuacag

SEQ ID NO: 74750 - RNA, 22 nt, Human
ccagaggugguggugucuagaa

SEQ ID NO: 74751 - RNA, 21 nt, Human
ccagagguucugggccucccu

SEQ ID NO: 74752 - RNA, 22 nt, Human
ccagagucaggagcucauguga

SEQ ID NO: 74753 - RNA, 19 nt, Human
ccagagucaugucuccccc

SEQ ID NO: 74754 - RNA, 22 nt, Human
ccagagucccuguucucggccu

SEQ ID NO: 74755 - RNA, 22 nt, Human
ccagagucccuugcagcucagu

SEQ ID NO: 74756 - RNA, 22 nt, Human
ccagagucugugugugucaucc

SEQ ID NO: 74757 - RNA, 19 nt, Human
ccagaguuggcagagcagg

SEQ ID NO: 74758 - RNA, 22 nt, Human
ccagauagaaaagaaggcagga

SEQ ID NO: 74759 - RNA, 22 nt, Human
ccagauagcaggucagaagugc

SEQ ID NO: 74760 - RNA, 22 nt, Human
ccagauaucacugccguguugu

SEQ ID NO: 74761 - RNA, 22 nt, Human
ccagaucuucuuuucagugucu

SEQ ID NO: 74762 - RNA, 22 nt, Human
ccagauggaaaugauguucuca

SEQ ID NO: 74763 - RNA, 22 nt, Human
ccagaugguauaguagggagag

SEQ ID NO: 74764 - RNA, 19 nt, Human
cuggcucuuggguggagga

SEQ ID NO: 74765 - RNA, 22 nt, Human
cuggcugacaccuugauagcag

SEQ ID NO: 74766 - RNA, 22 nt, Human
cuggcugaggcagagccugggg

SEQ ID NO: 74767 - RNA, 22 nt, Human
cuggcugaucucaaucauggcu

SEQ ID NO: 74768 - RNA, 22 nt, Human
cuggcugcaaaaucuauucacu

SEQ ID NO: 74769 - RNA, 22 nt, Human
cuggcugcauuggcaagucaau

SEQ ID NO: 74770 - RNA, 22 nt, Human
cuggcugcgucugcucugacag

SEQ ID NO: 74771 - RNA, 22 nt, Human
cuggcugcuggccugaggaugc

SEQ ID NO: 74772 - RNA, 22 nt, Human
cuggcuggccaugcagcgccag

SEQ ID NO: 74773 - RNA, 22 nt, Human
cuggcuggccggagcgaggcgg

SEQ ID NO: 74774 - RNA, 22 nt, Human
cuggcuggccggaggcaucccu

SEQ ID NO: 74775 - RNA, 22 nt, Human
cuggcuggcugugccccugccg

SEQ ID NO: 74776 - RNA, 22 nt, Human
cuggcugggaaguagaguaggu

SEQ ID NO: 74777 - RNA, 22 nt, Human
cuggcugggagcucgccugcgg

SEQ ID NO: 74778 - RNA, 22 nt, Human
cuggcugggcagacagaaugcu

SEQ ID NO: 74779 - RNA, 22 nt, Human
cuggcuggguuccaggauucca

SEQ ID NO: 74780 - RNA, 22 nt, Human
cuggcugguagaauugugaccu

SEQ ID NO: 74781 - RNA, 22 nt, Human
cuggcuggucugagcagucgca

SEQ ID NO: 74782 - RNA, 22 nt, Human
cuggcuguaagcguguuuccua

SEQ ID NO: 74783 - RNA, 22 nt, Human
cuggcuguauuaguuugauccu

SEQ ID NO: 74784 - RNA, 22 nt, Human
cuggcugugaaauggcaguguc

SEQ ID NO: 74785 - RNA, 22 nt, Human
cuggcugugcugacugagaggg

SEQ ID NO: 74786 - RNA, 22 nt, Human
cuggcuguguccacagaguaag

SEQ ID NO: 74787 - RNA, 22 nt, Human
cuggcuguuucaaauguauaga

SEQ ID NO: 74788 - RNA, 22 nt, Human
cuggcuucagcugccaucaaug

SEQ ID NO: 74789 - RNA, 22 nt, Human
cuggcuuccaugcuguaguggc

SEQ ID NO: 74790 - RNA, 22 nt, Human
cuggcuucccugucuuauggaa

SEQ ID NO: 74791 - RNA, 22 nt, Human
cuggcuuccugaguccauuacc

SEQ ID NO: 74792 - RNA, 22 nt, Human
cuggcuucugggccagggcaga

SEQ ID NO: 74793 - RNA, 22 nt, Human
cuggcuugaaguuaugcaccag

SEQ ID NO: 74794 - RNA, 22 nt, Human
cuggcuuuaccucacuggggcu

SEQ ID NO: 74795 - RNA, 22 nt, Human
cuggcuuucauucauucaggcc

SEQ ID NO: 74796 - RNA, 22 nt, Human
cuggcuuucugaacaucaguga

SEQ ID NO: 74797 - RNA, 22 nt, Human
cuggcuuuggaacaaaucauag

SEQ ID NO: 74798 - RNA, 22 nt, Human
cuggcuuuggucaugugaucau

SEQ ID NO: 74799 - RNA, 22 nt, Human
cuggcuuuuccuaaacugggaa

SEQ ID NO: 74800 - RNA, 22 nt, Human
cuggcuuuuuucccauuaugca

SEQ ID NO: 74801 - RNA, 22 nt, Human
cugggaaaacugugaccccugu

SEQ ID NO: 74802 - RNA, 22 nt, Human
cugggaaauggcuucgagcuca

SEQ ID NO: 74803 - RNA, 22 nt, Human
cugggaaauugacacugauaaa

SEQ ID NO: 74804 - RNA, 22 nt, Human
cugggaacuguacugccuugaa

SEQ ID NO: 74805 - RNA, 22 nt, Human
cugggaagaauccaagggcccu

SEQ ID NO: 74806 - RNA, 22 nt, Human
cugggaaggggaagguccucuc

SEQ ID NO: 74807 - RNA, 22 nt, Human
cugggaaguggugagggccuga

SEQ ID NO: 74808 - RNA, 22 nt, Human
cugggaccaucugugucuacuu

SEQ ID NO: 74809 - RNA, 19 nt, Human
cugggacuccugauaccuu

SEQ ID NO: 74810 - RNA, 22 nt, Human
cugggacuggguccucaggaca

SEQ ID NO: 74811 - RNA, 22 nt, Human
cugggagacgcagcuggggauc

SEQ ID NO: 74812 - RNA, 22 nt, Human
cugggagagacacuucugauua

SEQ ID NO: 74813 - RNA, 22 nt, Human
cugggagaggcugcuccgcucu

SEQ ID NO: 74814 - RNA, 22 nt, Human
cugggagauucaggugaaguuu

SEQ ID NO: 74815 - RNA, 22 nt, Human
cugggagauugaggccauggug

SEQ ID NO: 74816 - RNA, 22 nt, Human
cugggagcccugacuagccugg

SEQ ID NO: 74817 - RNA, 22 nt, Human
cugggagcggcugucacugguu

SEQ ID NO: 74818 - RNA, 22 nt, Human
cugggagcugucaggagcgugu

SEQ ID NO: 74819 - RNA, 22 nt, Human
cugggagcuuuuagaaaugcag

SEQ ID NO: 74820 - RNA, 22 nt, Human
cugggaggauucauugagguga

SEQ ID NO: 74821 - RNA, 22 nt, Human
cugggagucuaagcuagcaccg

SEQ ID NO: 74822 - RNA, 19 nt, Human
cugggaguucacugcugcc

SEQ ID NO: 74823 - RNA, 22 nt, Human
cugggaguugacgaggcuugua

SEQ ID NO: 74824 - RNA, 22 nt, Human
cugggaugcuccggccuggaug

SEQ ID NO: 74825 - RNA, 22 nt, Human
cugggauggcuccgcugcugcu

SEQ ID NO: 74826 - RNA, 22 nt, Human
cugggcacacagugacucugca

SEQ ID NO: 74827 - RNA, 22 nt, Human
cugggcacuugcucacagcucu

SEQ ID NO: 74828 - RNA, 22 nt, Human
cugggcagccucacacaauguu

SEQ ID NO: 74829 - RNA, 20 nt, Human
cugggcagguguuugaucuc

SEQ ID NO: 74830 - RNA, 22 nt, Human
cugggcagugguggcccuuccc

SEQ ID NO: 74831 - RNA, 22 nt, Human
cugggcauuuuucucuguuaca

SEQ ID NO: 74832 - RNA, 22 nt, Human
cugggccacaaaaaacuccugu

SEQ ID NO: 74833 - RNA, 22 nt, Human
cugggccagauccagccucaca

SEQ ID NO: 74834 - RNA, 22 nt, Human
cugggccaucagaggggcugga

SEQ ID NO: 74835 - RNA, 20 nt, Human
cugggccauccuuuuacaau

SEQ ID NO: 74836 - RNA, 22 nt, Human
cugggccaucuccuuugugugg

SEQ ID NO: 74837 - RNA, 22 nt, Human
cugggccauggaagucucugcc

SEQ ID NO: 74838 - RNA, 22 nt, Human
cugggcccaggcggcucucgga

SEQ ID NO: 74839 - RNA, 22 nt, Human
cugggccuagcaacagaggagu

SEQ ID NO: 74840 - RNA, 17 nt, Human
cugggccuccccugucc

SEQ ID NO: 74841 - RNA, 22 nt, Human
cugggccugggaggccaggucu

SEQ ID NO: 74842 - RNA, 22 nt, Human
cugggccugguguggcaccugc

SEQ ID NO: 74843 - RNA, 22 nt, Human
cugggccugucccugauugagg

SEQ ID NO: 74844 - RNA, 22 nt, Human
cugggcuacguguugacagcau

SEQ ID NO: 74845 - RNA, 22 nt, Human
cugggcucaccuguggcuggca

SEQ ID NO: 74846 - RNA, 22 nt, Human
cugggcucagcaggccaaggcc

SEQ ID NO: 74847 - RNA, 22 nt, Human
cugggcucagugucucacuccu

SEQ ID NO: 74848 - RNA, 22 nt, Human
cugggcuccacuacuugcuaac

SEQ ID NO: 74849 - RNA, 22 nt, Human
cugggcuccacucccacagugu

SEQ ID NO: 74850 - RNA, 22 nt, Human
cugggcucccucaugugucugc

SEQ ID NO: 74851 - RNA, 20 nt, Human
cugggcucgguggcccuggc

SEQ ID NO: 74852 - RNA, 22 nt, Human
cugggcucugcggugucgcucu

SEQ ID NO: 74853 - RNA, 22 nt, Human
cugggcucuguguuucaguuuc

SEQ ID NO: 74854 - RNA, 22 nt, Human
cugggcugcaggaguggggcaa

SEQ ID NO: 74855 - RNA, 22 nt, Human
ccagcuccugggucuuagucag

SEQ ID NO: 74856 - RNA, 22 nt, Human
ccagcucucaaggcucccuggg

SEQ ID NO: 74857 - RNA, 21 nt, Human
ccagcucugccuccaguuggu

SEQ ID NO: 74858 - RNA, 22 nt, Human
ccagcugcauccuauucacugc

SEQ ID NO: 74859 - RNA, 22 nt, Human
ccagcugcccaagaggcauccu

SEQ ID NO: 74860 - RNA, 21 nt, Human
ccagcugccugcacuuuggac

SEQ ID NO: 74861 - RNA, 18 nt, Human
ccagcugcgcugaaccga

SEQ ID NO: 74862 - RNA, 22 nt, Human
ccagcugcggucucccaaaguu

SEQ ID NO: 74863 - RNA, 22 nt, Human
ccagcugcuaucaugccauuuc

SEQ ID NO: 74864 - RNA, 21 nt, Human
ccagcugcuccuugagguucc

SEQ ID NO: 74865 - RNA, 22 nt, Human
ccagcuggaaacaaauagagug

SEQ ID NO: 74866 - RNA, 22 nt, Human
ccagcuggaagagugcagaacu

SEQ ID NO: 74867 - RNA, 22 nt, Human
ccagcuggagcucgcagauagg

SEQ ID NO: 74868 - RNA, 22 nt, Human
ccagcuggcacuguggcugccc

SEQ ID NO: 74869 - RNA, 22 nt, Human
ccagcuggcccagcugugcucc

SEQ ID NO: 74870 - RNA, 22 nt, Human
ccagcuggucugugcucauguu

SEQ ID NO: 74871 - RNA, 22 nt, Human
ccagcugguguuccuuaggacc

SEQ ID NO: 74872 - RNA, 22 nt, Human
ccagcugucugguuccagagcc

SEQ ID NO: 74873 - RNA, 23 nt, Human
ccacucucccaccauaucuguau

SEQ ID NO: 74874 - RNA, 21 nt, Human
ccacucugaguguugaacaga

SEQ ID NO: 74875 - RNA, 22 nt, Human
ccacucugauuggucaccucug

SEQ ID NO: 74876 - RNA, 22 nt, Human
ccacucugauuuuggcuccacu

SEQ ID NO: 74877 - RNA, 22 nt, Human
ccacugaaaaauuugagaugga

SEQ ID NO: 74878 - RNA, 22 nt, Human
ccacugaaggucaacauagagc

SEQ ID NO: 74879 - RNA, 17 nt, Human
ccacugacucugacuuc

SEQ ID NO: 74880 - RNA, 22 nt, Human
ccacugagcaguagcugcgucg

SEQ ID NO: 74881 - RNA, 22 nt, Human
ccacugagguuuugugguuaug

SEQ ID NO: 74882 - RNA, 22 nt, Human
ccacugaguacccgauggcugc

SEQ ID NO: 74883 - RNA, 23 nt, Human
ccacugaugcauuuucucucugu

SEQ ID NO: 74884 - RNA, 22 nt, Human
ccacugccagcuuuguccuccc

SEQ ID NO: 74885 - RNA, 22 nt, Human
ccacugcucugccaggagcugg

SEQ ID NO: 74886 - RNA, 22 nt, Human
ccacuggagacuggucucugug

SEQ ID NO: 74887 - RNA, 22 nt, Human
ccacuggcauccagcugccauc

SEQ ID NO: 74888 - RNA, 22 nt, Human
ccacuggcugucagcaggacuc

SEQ ID NO: 74889 - RNA, 19 nt, Human
ccacuggggcuccacauua

SEQ ID NO: 74890 - RNA, 22 nt, Human
ccacuguauaagcaaaaugaaa

SEQ ID NO: 74891 - RNA, 22 nt, Human
ccacuuaagagaacagcuauag

SEQ ID NO: 74892 - RNA, 22 nt, Human
ccacuuccugcagguaaggagc

SEQ ID NO: 74893 - RNA, 22 nt, Human
ccacuugaaacuuaguggcaua

SEQ ID NO: 74894 - RNA, 22 nt, Human
ccacuuucugagggaacagcag

SEQ ID NO: 74895 - RNA, 22 nt, Human
ccacuuugaaccacugaggugg

SEQ ID NO: 74896 - RNA, 19 nt, Human
ccacuuugcagauagugag

SEQ ID NO: 74897 - RNA, 18 nt, Human
ccacuuugcagccuggcc

SEQ ID NO: 74898 - RNA, 22 nt, Human
ccacuuuguaauguguuauguu

SEQ ID NO: 74899 - RNA, 22 nt, Human
ccacuuuucuacccacugugac

SEQ ID NO: 74900 - RNA, 22 nt, Human
ccacuuuugggaacagugagua

SEQ ID NO: 74901 - RNA, 22 nt, Human
ccagaaaagcaucugguucuuu

SEQ ID NO: 74902 - RNA, 22 nt, Human
ccagaaaaugcagaacauagaa

SEQ ID NO: 74903 - RNA, 22 nt, Human
ccagaaagauaggaaaucaagu

SEQ ID NO: 74904 - RNA, 22 nt, Human
ccagaagaacuuaauucaaaac

SEQ ID NO: 74905 - RNA, 22 nt, Human
ccagaagacaagaauguucuua

SEQ ID NO: 74906 - RNA, 20 nt, Human
ccagaagagaugaucaucca

SEQ ID NO: 74907 - RNA, 22 nt, Human
ccagaagcuucuacacaggaga

SEQ ID NO: 74908 - RNA, 22 nt, Human
ccagaagggcuauugcagugac

SEQ ID NO: 74909 - RNA, 22 nt, Human
ccagaagucaaguaagaugaag

SEQ ID NO: 74910 - RNA, 22 nt, Human
ccagaagucaaugcagauguga

SEQ ID NO: 74911 - RNA, 22 nt, Human
ccagaauagaaugaaagaaggg

SEQ ID NO: 74912 - RNA, 22 nt, Human
ccagaauaggaguaauaaaacc

SEQ ID NO: 74913 - RNA, 22 nt, Human
ccagaauccaaaacguuuugag

SEQ ID NO: 74914 - RNA, 22 nt, Human
ccagacaggaacacacaucucc

SEQ ID NO: 74915 - RNA, 22 nt, Human
ccagaccagacugacuugagcc

SEQ ID NO: 74916 - RNA, 22 nt, Human
ccagacccugcucuggggcucu

SEQ ID NO: 74917 - RNA, 22 nt, Human
ccagacccuuucuuggcaugug

SEQ ID NO: 74918 - RNA, 21 nt, Human
ccagacucagaaguuuaacca

SEQ ID NO: 74919 - RNA, 22 nt, Human
ccagacugagggucccugagcu

SEQ ID NO: 74920 - RNA, 22 nt, Human
ccagacuggggcuccuugaggg

SEQ ID NO: 74921 - RNA, 22 nt, Human
ccagacuuuuaguagugaguua

SEQ ID NO: 74922 - RNA, 22 nt, Human
ccagagaaagguuugauucauu

SEQ ID NO: 74923 - RNA, 22 nt, Human
ccagagaaauaaggggaaaaug

SEQ ID NO: 74924 - RNA, 22 nt, Human
ccagagaaccaucugcuugagg

SEQ ID NO: 74925 - RNA, 22 nt, Human
ccagagaagaaaagcaccuuuu

SEQ ID NO: 74926 - RNA, 22 nt, Human
ccagagaauuuuagacaaaaau

SEQ ID NO: 74927 - RNA, 22 nt, Human
ccagagacgucggucagggcgc

SEQ ID NO: 74928 - RNA, 21 nt, Human
ccagagagagggaaguggguu

SEQ ID NO: 74929 - RNA, 22 nt, Human
ccagagagcuacaaggcauaaa

SEQ ID NO: 74930 - RNA, 22 nt, Human
ccagagaggcaaaacuccuucc

SEQ ID NO: 74931 - RNA, 22 nt, Human
ccagagauguucacauucuaau

SEQ ID NO: 74932 - RNA, 22 nt, Human
ccagagccagagaggugccugc

SEQ ID NO: 74933 - RNA, 22 nt, Human
ccagagcuaaacacacaggcug

SEQ ID NO: 74934 - RNA, 23 nt, Human
ccagagcucuuucaugcuuccau

SEQ ID NO: 74935 - RNA, 22 nt, Human
ccagagcugcagguaaaaugcu

SEQ ID NO: 74936 - RNA, 18 nt, Human
ccagagcuggcuccucgc

SEQ ID NO: 74937 - RNA, 22 nt, Human
ccagaggaggggggucuuucug

SEQ ID NO: 74938 - RNA, 22 nt, Human
ccagaggaugcuggucagccuc

SEQ ID NO: 74939 - RNA, 21 nt, Human
ccagaggccucucuuggccac

SEQ ID NO: 74940 - RNA, 16 nt, Human
ccagaggccuggccuc

SEQ ID NO: 74941 - RNA, 22 nt, Human
ccagaggcggagguuugcagug

SEQ ID NO: 74942 - RNA, 22 nt, Human
ccagaggcuggcaagggcuccu

SEQ ID NO: 74943 - RNA, 22 nt, Human
ccagagggacguuaccaguuca

SEQ ID NO: 74944 - RNA, 22 nt, Human
ccagaggggcugagcaggucac

SEQ ID NO: 74945 - RNA, 20 nt, Human
ccagaggguagggccgcccc

SEQ ID NO: 74946 - RNA, 22 nt, Human
ccagagguccccugccaggagg

SEQ ID NO: 74947 - RNA, 22 nt, Human
ccagaggugaacaggaggcugu

SEQ ID NO: 74948 - RNA, 22 nt, Human
ccagagguuacuuugccuugga

SEQ ID NO: 74949 - RNA, 19 nt, Human
ccagagguuugcugggccu

SEQ ID NO: 74950 - RNA, 22 nt, Human
ccagagugacgugaagugugaa

SEQ ID NO: 74951 - RNA, 22 nt, Human
ccagauagggaugagagugcua

SEQ ID NO: 74952 - RNA, 22 nt, Human
ccagaugagaccacacugcugg

SEQ ID NO: 74953 - RNA, 19 nt, Human
ccagaugagcagcugagau

SEQ ID NO: 74954 - RNA, 21 nt, Human
ccagaugcaaaugcagacauu

SEQ ID NO: 74955 - RNA, 17 nt, Human
ccagaugcccugucucc

SEQ ID NO: 74956 - RNA, 20 nt, Human
ccagauggucccugugaaaa

SEQ ID NO: 74957 - RNA, 22 nt, Human
ccagcaagugcagauggccaag

SEQ ID NO: 74958 - RNA, 22 nt, Human
ccagcacuccugucucaagucu

SEQ ID NO: 74959 - RNA, 22 nt, Human
ccagcacucuauugaauauucu

SEQ ID NO: 74960 - RNA, 19 nt, Human
ccagcagaagccacuccug

SEQ ID NO: 74961 - RNA, 22 nt, Human
ccagcagagcucaaacuuccug

SEQ ID NO: 74962 - RNA, 22 nt, Human
ccagcagagggucuuggccauu

SEQ ID NO: 74963 - RNA, 22 nt, Human
ccagcagcccacaggcgucccu

SEQ ID NO: 74964 - RNA, 22 nt, Human
ccagcagcuuuauuggcucucc

SEQ ID NO: 74965 - RNA, 22 nt, Human
ccagcaggaaagugacguuuga

SEQ ID NO: 74966 - RNA, 22 nt, Human
ccagcaggagacuagcaacaua

SEQ ID NO: 74967 - RNA, 19 nt, Human
ccagcagguucauuucagg

SEQ ID NO: 74968 - RNA, 22 nt, Human
ccagcaucccugggguuggcca

SEQ ID NO: 74969 - RNA, 22 nt, Human
ccagcaucuaacgcuccuggga

SEQ ID NO: 74970 - RNA, 18 nt, Human
ccagcaugccagaggcug

SEQ ID NO: 74971 - RNA, 22 nt, Human
ccagcauggcaccugagaugag

SEQ ID NO: 74972 - RNA, 22 nt, Human
ccagcauuugcuucuggugggg

SEQ ID NO: 74973 - RNA, 22 nt, Human
ccagccagcaagcucccaguuc

SEQ ID NO: 74974 - RNA, 22 nt, Human
ccagccaggcauugcaaacuga

SEQ ID NO: 74975 - RNA, 23 nt, Human
cuguaugauguuaaguggaaagc

SEQ ID NO: 74976 - RNA, 22 nt, Human
cuguaugguccacgugggugcc

SEQ ID NO: 74977 - RNA, 22 nt, Human
cuguauuaaaggcagugaucuu

SEQ ID NO: 74978 - RNA, 22 nt, Human
cuguauucaagcuucugcccaa

SEQ ID NO: 74979 - RNA, 22 nt, Human
cuguauuuguccucuauuuauu

SEQ ID NO: 74980 - RNA, 22 nt, Human
cugucaaagacuaagguucuua

SEQ ID NO: 74981 - RNA, 22 nt, Human
cugucaaauggaaacuuauccu

SEQ ID NO: 74982 - RNA, 22 nt, Human
cugucaaauucauaacacuuau

SEQ ID NO: 74983 - RNA, 22 nt, Human
ccgcccacacuaaauaugagcg

SEQ ID NO: 74984 - RNA, 22 nt, Human
ccgcggggcgugggcucuuacc

SEQ ID NO: 74985 - RNA, 22 nt, Human
ccggcaaaggccccuuccccag

SEQ ID NO: 74986 - RNA, 22 nt, Human
ccggcgucucuuccacuuccua

SEQ ID NO: 74987 - RNA, 22 nt, Human
ccgggagacuuugagcaccaug

SEQ ID NO: 74988 - RNA, 22 nt, Human
ccguauguucagauuugucaau

SEQ ID NO: 74989 - RNA, 22 nt, Human
ccguggcuucccaggcggaugu

SEQ ID NO: 74990 - RNA, 22 nt, Human
ccguguguaugguggaacugcu

SEQ ID NO: 74991 - RNA, 22 nt, Human
ccuaacuuucauuaggccccag

SEQ ID NO: 74992 - RNA, 18 nt, Human
ccuaagcuccagccccag

SEQ ID NO: 74993 - RNA, 21 nt, Human
ccuacagauggauauauauuc

SEQ ID NO: 74994 - RNA, 22 nt, Human
ccuacucugagcgccuccgcau

SEQ ID NO: 74995 - RNA, 22 nt, Human
ccuacuuagcauauuuucucuu

SEQ ID NO: 74996 - RNA, 22 nt, Human
ccuagacauuaagcuuggguuu

SEQ ID NO: 74997 - RNA, 22 nt, Human
cuugccugggacugaggcauuu

SEQ ID NO: 74998 - RNA, 22 nt, Human
cuugccuucuuuuccuauagaa

SEQ ID NO: 74999 - RNA, 22 nt, Human
cuugcuggaaacucucucugcc

SEQ ID NO: 75000 - RNA, 22 nt, Human
cuugcugggguaagucugugcu

SEQ ID NO: 75001 - RNA, 22 nt, Human
cuugcuggugguguuuucuaug

SEQ ID NO: 75002 - RNA, 22 nt, Human
cuugcuguugugggagacuggg

SEQ ID NO: 75003 - RNA, 22 nt, Human
cuugcuugccaugggcuugggc

SEQ ID NO: 75004 - RNA, 22 nt, Human
cuugcuuuugcugaugauuaag

SEQ ID NO: 75005 - RNA, 22 nt, Human
cuuggaaucaaguuuuuggaga

SEQ ID NO: 75006 - RNA, 22 nt, Human
cuuggaauggggcagaaaaugg

SEQ ID NO: 75007 - RNA, 22 nt, Human
cuuggacuuccaggaaguauuu

SEQ ID NO: 75008 - RNA, 22 nt, Human
cuuggagacauugaucuuuugc

SEQ ID NO: 75009 - RNA, 22 nt, Human
cuuggagagugguuaucccugu

SEQ ID NO: 75010 - RNA, 22 nt, Human
cuuggagauacagaggacauuu

SEQ ID NO: 75011 - RNA, 22 nt, Human
cuuggagcccagcaggccugga

SEQ ID NO: 75012 - RNA, 22 nt, Human
cuuggaggagguggugcuugau

SEQ ID NO: 75013 - RNA, 22 nt, Human
cuuggagguggaaguugcagug

SEQ ID NO: 75014 - RNA, 22 nt, Human
cuuggauuugggcccuuaaauu

SEQ ID NO: 75015 - RNA, 21 nt, Human
cuuggcacagggaagaugcac

SEQ ID NO: 75016 - RNA, 22 nt, Human
cuuggcacuugggcagugagca

SEQ ID NO: 75017 - RNA, 22 nt, Human
cuuggcagagggcugggcucag

SEQ ID NO: 75018 - RNA, 22 nt, Human
cuuggcaguuucggaaggauga

SEQ ID NO: 75019 - RNA, 22 nt, Human
cuuggcuccaaucccagcucug

SEQ ID NO: 75020 - RNA, 17 nt, Human
cuuggcugcugugcgau

SEQ ID NO: 75021 - RNA, 22 nt, Human
cuuggcugucauaagguccugg

SEQ ID NO: 75022 - RNA, 22 nt, Human
cuuggcugucuauaggaaagag

SEQ ID NO: 75023 - RNA, 19 nt, Human
cuuggcuuagcuucuuagc

SEQ ID NO: 75024 - RNA, 22 nt, Human
cuuggcuuuugcucccagauca

SEQ ID NO: 75025 - RNA, 22 nt, Human
cuugggaguagaggcaggagca

SEQ ID NO: 75026 - RNA, 22 nt, Human
cuugggcuauaaauauaaccau

SEQ ID NO: 75027 - RNA, 22 nt, Human
cuugggcucagcaccgugugga

SEQ ID NO: 75028 - RNA, 22 nt, Human
cuugggcucugugggccuuagu

SEQ ID NO: 75029 - RNA, 22 nt, Human
cuuggggaggacgcaguguccu

SEQ ID NO: 75030 - RNA, 22 nt, Human
cuuggggcuuuguguguaggau

SEQ ID NO: 75031 - RNA, 22 nt, Human
cuuggguauaaaacuuggcuau

SEQ ID NO: 75032 - RNA, 22 nt, Human
cuugggucuguccugcugugca

SEQ ID NO: 75033 - RNA, 22 nt, Human
cuuggucuauaggagagauugu

SEQ ID NO: 75034 - RNA, 22 nt, Human
cuuggucuugggagcagggaca

SEQ ID NO: 75035 - RNA, 22 nt, Human
cuuggugcaggggacagggcaa

SEQ ID NO: 75036 - RNA, 22 nt, Human
cuugguuauacuccaggaacca

SEQ ID NO: 75037 - RNA, 22 nt, Human
cuuguaaaagguacauuaugcu

SEQ ID NO: 75038 - RNA, 22 nt, Human
cuuguaaaauauccaguuaagg

SEQ ID NO: 75039 - RNA, 19 nt, Human
cuuguaaagggcuguuucu

SEQ ID NO: 75040 - RNA, 22 nt, Human
cuuguaauuauaauguacuguu

SEQ ID NO: 75041 - RNA, 22 nt, Human
cuuguacagaucuugcaaggac

SEQ ID NO: 75042 - RNA, 22 nt, Human
cuuguacauugauuucugcauu

SEQ ID NO: 75043 - RNA, 22 nt, Human
cuuguagcugacuaucuuguuc

SEQ ID NO: 75044 - RNA, 22 nt, Human
cuuguauuaagcuuagagaggc

SEQ ID NO: 75045 - RNA, 22 nt, Human
cuuguauuaggaagaaugcuuu

SEQ ID NO: 75046 - RNA, 22 nt, Human
cuuguauuccccuaucucuaaa

SEQ ID NO: 75047 - RNA, 22 nt, Human
cuugucugauaauggggccaac

SEQ ID NO: 75048 - RNA, 21 nt, Human
cuugucugcaguguuuauagc

SEQ ID NO: 75049 - RNA, 22 nt, Human
cuugugcauaagaagaccugag

SEQ ID NO: 75050 - RNA, 22 nt, Human
cuuguggcccauggcuuccugc

SEQ ID NO: 75051 - RNA, 22 nt, Human
cuuguguggucuggucuugcua

SEQ ID NO: 75052 - RNA, 22 nt, Human
cuuguuaaaaugccgauucuga

SEQ ID NO: 75053 - RNA, 20 nt, Human
cuuguuaaauaugcagguag

SEQ ID NO: 75054 - RNA, 23 nt, Human
cuuguuauaagaagacugucugg

SEQ ID NO: 75055 - RNA, 22 nt, Human
cuuguuaucugaaccaaaauua

SEQ ID NO: 75056 - RNA, 22 nt, Human
cuuguuauuggaaaugucaugc

SEQ ID NO: 75057 - RNA, 18 nt, Human
cuuguucuucucuuggcg

SEQ ID NO: 75058 - RNA, 20 nt, Human
cuuguugauucuaggaauga

SEQ ID NO: 75059 - RNA, 22 nt, Human
cuuguugcaaacauucacucca

SEQ ID NO: 75060 - RNA, 22 nt, Human
cuuguugcuaacauaugcuucu

SEQ ID NO: 75061 - RNA, 22 nt, Human
cuuguuugauuauugccugagg

SEQ ID NO: 75062 - RNA, 17 nt, Human
cuuguuuuccacuggga

SEQ ID NO: 75063 - RNA, 22 nt, Human
cuuguuuucuaaaacaucauuu

SEQ ID NO: 75064 - RNA, 22 nt, Human
cuuguuuuggaacagagugaau

SEQ ID NO: 75065 - RNA, 22 nt, Human
cuuuaagacuaaauuagaguuu

SEQ ID NO: 75066 - RNA, 22 nt, Human
cuuuaaugagucuuucugcugu

SEQ ID NO: 75067 - RNA, 22 nt, Human
cuuuaauuaggaaguauaauga

SEQ ID NO: 75068 - RNA, 22 nt, Human
cuuuacaaauagggagggagug

SEQ ID NO: 75069 - RNA, 22 nt, Human
cuuuacaaauuagcucucggga

SEQ ID NO: 75070 - RNA, 22 nt, Human
cuuuacagccccacuuccgggc

SEQ ID NO: 75071 - RNA, 22 nt, Human
cuuuacagccuccagaaggaac

SEQ ID NO: 75072 - RNA, 22 nt, Human
cuuuacuguucuucugugggaa

SEQ ID NO: 75073 - RNA, 22 nt, Human
cuuuagaauuucauguuugguc

SEQ ID NO: 75074 - RNA, 22 nt, Human
cuuuagaauuugauauaaucaa

SEQ ID NO: 75075 - RNA, 22 nt, Human
cuuuagauguugcuuuaacuau

SEQ ID NO: 75076 - RNA, 22 nt, Human
cuuuagauuucuauguaucacu

SEQ ID NO: 75077 - RNA, 21 nt, Human
cuuuagugaaaaggggcuaac

SEQ ID NO: 75078 - RNA, 22 nt, Human
cuuuaguuauuuagacuacagu

SEQ ID NO: 75079 - RNA, 22 nt, Human
cuuuaguucuaaugcauugaaa

SEQ ID NO: 75080 - RNA, 22 nt, Human
cuuuaguucuagaaagugaaac

SEQ ID NO: 75081 - RNA, 22 nt, Human
cuuuaguuguaucagucaaguu

SEQ ID NO: 75082 - RNA, 22 nt, Human
cuuuaguuguuauuucuucaca

SEQ ID NO: 75083 - RNA, 22 nt, Human
cuuuaguuugugauacgaagau

SEQ ID NO: 75084 - RNA, 22 nt, Human
cuuuauauccagauguuuggug

SEQ ID NO: 75085 - RNA, 22 nt, Human
cuuuaucauggagguaaauaug

SEQ ID NO: 75086 - RNA, 22 nt, Human
cuuuaugaaaaccagauugggg

SEQ ID NO: 75087 - RNA, 22 nt, Human
cuuuaugagccuugugaaggag

SEQ ID NO: 75088 - RNA, 22 nt, Human
cuuuauggagugacacaauggg

SEQ ID NO: 75089 - RNA, 22 nt, Human
cuuuauguccuugaagaguugu

SEQ ID NO: 75090 - RNA, 18 nt, Human
cuuuaugugcagagcuuu

SEQ ID NO: 75091 - RNA, 22 nt, Human
cuuuaugugcugggcauuaagg

SEQ ID NO: 75092 - RNA, 19 nt, Human
cccaggaggcggagguugc

SEQ ID NO: 75093 - RNA, 22 nt, Human
cccaggagguagagguugcagu

SEQ ID NO: 75094 - RNA, 22 nt, Human
cccaggagguggagcuugcagu

SEQ ID NO: 75095 - RNA, 22 nt, Human
cccaggagguggagguugcagc

SEQ ID NO: 75096 - RNA, 22 nt, Human
cccaggagguguagcugcgugg

SEQ ID NO: 75097 - RNA, 22 nt, Human
cccaggagguuggggcuacagu

SEQ ID NO: 75098 - RNA, 22 nt, Human
cccaggaguaagugacauuguu

SEQ ID NO: 75099 - RNA, 19 nt, Human
cccaggagucuggcugguu

SEQ ID NO: 75100 - RNA, 22 nt, Human
cccaggaguuagagguuguggu

SEQ ID NO: 75101 - RNA, 22 nt, Human
cccaggaguuugaguucagcau

SEQ ID NO: 75102 - RNA, 22 nt, Human
cccaggaucaccuggucaaggg

SEQ ID NO: 75103 - RNA, 22 nt, Human
cccaggcacaccccgaacggaa

SEQ ID NO: 75104 - RNA, 22 nt, Human
cccaggcagaauuaguguuuca

SEQ ID NO: 75105 - RNA, 22 nt, Human
cccaggcagucuggcucuaaag

SEQ ID NO: 75106 - RNA, 22 nt, Human
cccaggcagugcugaucccuca

SEQ ID NO: 75107 - RNA, 22 nt, Human
cccaggcagugugugcaugcgu

SEQ ID NO: 75108 - RNA, 22 nt, Human
cccaggcaucccauuaaggagc

SEQ ID NO: 75109 - RNA, 22 nt, Human
cccaggccagaacuugguugcu

SEQ ID NO: 75110 - RNA, 22 nt, Human
cccaggcucccaggugggacaa

SEQ ID NO: 75111 - RNA, 22 nt, Human
cccaggcuccuagaggcccaga

SEQ ID NO: 75112 - RNA, 22 nt, Human
cuuuccuuaauaagcagguaua

SEQ ID NO: 75113 - RNA, 23 nt, Human
cuuuccuuucuuugacacccagc

SEQ ID NO: 75114 - RNA, 22 nt, Human
cuuucgaucaagggucccuuca

SEQ ID NO: 75115 - RNA, 22 nt, Human
cuuucuaauucucccauagucu

SEQ ID NO: 75116 - RNA, 22 nt, Human
cuuucuagacuguccagaugau

SEQ ID NO: 75117 - RNA, 22 nt, Human
cuuucuaguugacagcaugcca

SEQ ID NO: 75118 - RNA, 20 nt, Human
cuuucucuaauuuauaagua

SEQ ID NO: 75119 - RNA, 22 nt, Human
cuuucucuguggugaggagggu

SEQ ID NO: 75120 - RNA, 22 nt, Human
cuuucucuguguuucacaugcu

SEQ ID NO: 75121 - RNA, 22 nt, Human
cuuucugaaguuuaaguucuaa

SEQ ID NO: 75122 - RNA, 22 nt, Human
cuuucugauuuuaagcucuaau

SEQ ID NO: 75123 - RNA, 22 nt, Human
cuuucuuucgaagacgugauua

SEQ ID NO: 75124 - RNA, 22 nt, Human
cuuucuuugcagugagccagag

SEQ ID NO: 75125 - RNA, 22 nt, Human
cuuugaaaggaagccacacagc

SEQ ID NO: 75126 - RNA, 22 nt, Human
cuuugaagaucacauguugcuc

SEQ ID NO: 75127 - RNA, 22 nt, Human
cuuugagcaauucugagaugca

SEQ ID NO: 75128 - RNA, 22 nt, Human
cuuugaucuacucacuaaacaa

SEQ ID NO: 75129 - RNA, 22 nt, Human
cuuugauuaucggugugaaugu

SEQ ID NO: 75130 - RNA, 22 nt, Human
cuuugauucagagagaauuagc

SEQ ID NO: 75131 - RNA, 22 nt, Human
cuuugcaaacugucacacuuuc

SEQ ID NO: 75132 - RNA, 21 nt, Human
cuuugcaagaugucuaugaaa

SEQ ID NO: 75133 - RNA, 22 nt, Human
cuuugcagaaauaaacuugaug

SEQ ID NO: 75134 - RNA, 22 nt, Human
cuuugcagaagaaaccuacaaa

SEQ ID NO: 75135 - RNA, 22 nt, Human
cuuugcauucucagcacagagc

SEQ ID NO: 75136 - RNA, 19 nt, Human
cuuugccaaaagaggccau

SEQ ID NO: 75137 - RNA, 20 nt, Human
cuuugccuauucucugccug

SEQ ID NO: 75138 - RNA, 22 nt, Human
cuuugccuccuagagcacguuc

SEQ ID NO: 75139 - RNA, 22 nt, Human
cuuugcuaguguuucaguagac

SEQ ID NO: 75140 - RNA, 22 nt, Human
cuuugcuugacacugugauugu

SEQ ID NO: 75141 - RNA, 22 nt, Human
cuuuggaaaaauaccuggcaua

SEQ ID NO: 75142 - RNA, 22 nt, Human
cuuuggaaaguaagcagcuaga

SEQ ID NO: 75143 - RNA, 22 nt, Human
cuuuggaacauacugcugagcu

SEQ ID NO: 75144 - RNA, 22 nt, Human
cuuuggaaggcagagcucugug

SEQ ID NO: 75145 - RNA, 22 nt, Human
cuuuggaaucauugcuuauuca

SEQ ID NO: 75146 - RNA, 20 nt, Human
cuuuggagaaagaugcaaua

SEQ ID NO: 75147 - RNA, 22 nt, Human
cuuuggaguucccuaauuuccc

SEQ ID NO: 75148 - RNA, 22 nt, Human
cuuuggcaugguccucacuaua

SEQ ID NO: 75149 - RNA, 22 nt, Human
cuuuggcugcauucgaguugcu

SEQ ID NO: 75150 - RNA, 22 nt, Human
cuuuggcuguccucuuggcugg

SEQ ID NO: 75151 - RNA, 22 nt, Human
cuuuggcuuuuagauauccauu

SEQ ID NO: 75152 - RNA, 22 nt, Human
cuuuggucuccgucaucaauca

SEQ ID NO: 75153 - RNA, 22 nt, Human
cuuugguggaggggugcaggca

SEQ ID NO: 75154 - RNA, 22 nt, Human
cuuugguucuguccuucccaga

SEQ ID NO: 75155 - RNA, 22 nt, Human
cuuuguagcugcuucugauuua

SEQ ID NO: 75156 - RNA, 22 nt, Human
cuuuguauucaguugggcugug

SEQ ID NO: 75157 - RNA, 22 nt, Human
cuuugugcguagugagugguca

SEQ ID NO: 75158 - RNA, 22 nt, Human
cuuuguggcuccugcaggccau

SEQ ID NO: 75159 - RNA, 22 nt, Human
cuuugugucuguuaauaauuau

SEQ ID NO: 75160 - RNA, 22 nt, Human
cuuuguuaggggcucagggugg

SEQ ID NO: 75161 - RNA, 22 nt, Human
cuuuguuaucuguaaaugguua

SEQ ID NO: 75162 - RNA, 22 nt, Human
cuuuguucugccaauggcccau

SEQ ID NO: 75163 - RNA, 22 nt, Human
cuuuguuguuaauuggcgcuua

SEQ ID NO: 75164 - RNA, 17 nt, Human
cuuuuaauuuacuuccc

SEQ ID NO: 75165 - RNA, 21 nt, Human
cuuuuacauucagucaugaug

SEQ ID NO: 75166 - RNA, 22 nt, Human
cuuuucacaggaggauaagccc

SEQ ID NO: 75167 - RNA, 22 nt, Human
cuuuucauuguuuguacaugca

SEQ ID NO: 75168 - RNA, 22 nt, Human
cuuuuccuauugauucuguuac

SEQ ID NO: 75169 - RNA, 22 nt, Human
cuuuucuagagccgcagcccua

SEQ ID NO: 75170 - RNA, 22 nt, Human
cuuuucucuguaccguauaucu

SEQ ID NO: 75171 - RNA, 22 nt, Human
cuuuucugagagggccaagauu

SEQ ID NO: 75172 - RNA, 22 nt, Human
cuuuucuggccaggaacuugcc

SEQ ID NO: 75173 - RNA, 22 nt, Human
cuuuucuuguauuggaugcccc

SEQ ID NO: 75174 - RNA, 22 nt, Human
cuuuugauggaguucaagaagc

SEQ ID NO: 75175 - RNA, 22 nt, Human
cuuuugcagccauuauugcugc

SEQ ID NO: 75176 - RNA, 22 nt, Human
cuuuuggccucaaaggaaagaa

SEQ ID NO: 75177 - RNA, 22 nt, Human
cuuuuguugcccuugucgcagg

SEQ ID NO: 75178 - RNA, 22 nt, Human
cuuuuuacaaagccugucuucu

SEQ ID NO: 75179 - RNA, 22 nt, Human
cuuuuuauaccgugccaguuga

SEQ ID NO: 75180 - RNA, 22 nt, Human
cuuuuuaucucuuaaugauguu

SEQ ID NO: 75181 - RNA, 22 nt, Human
cuuuuuccagcuucaggguggg

SEQ ID NO: 75182 - RNA, 20 nt, Human
cuuuuucuccagcucugagc

SEQ ID NO: 75183 - RNA, 16 nt, Human
cuuuuucuccccucuu

SEQ ID NO: 75184 - RNA, 22 nt, Human
cuuuuucuucuaggugugccug

SEQ ID NO: 75185 - RNA, 22 nt, Human
cuuuuuuaagguagcuccuccu

SEQ ID NO: 75186 - RNA, 22 nt, Human
gaaaacacuuugaucugaaagu

SEQ ID NO: 75187 - RNA, 22 nt, Human
gaaaacauccagagauagaccu

SEQ ID NO: 75188 - RNA, 22 nt, Human
gaaaagagaacaucugaggauc

SEQ ID NO: 75189 - RNA, 22 nt, Human
gaaaaggccacuccuaggagcu

SEQ ID NO: 75190 - RNA, 22 nt, Human
gaaaaggccuccccauaggaau

SEQ ID NO: 75191 - RNA, 22 nt, Human
gaaaaggcucucacucccuccg

SEQ ID NO: 75192 - RNA, 22 nt, Human
gaaaaggcugcccacuuauuga

SEQ ID NO: 75193 - RNA, 22 nt, Human
gaaaaguucaucauauauucag

SEQ ID NO: 75194 - RNA, 22 nt, Human
gaaaauacaaauagccuugaaa

SEQ ID NO: 75195 - RNA, 21 nt, Human
gaaaauacaaugagcuugacc

SEQ ID NO: 75196 - RNA, 18 nt, Human
gaaaauacucugggcuca

SEQ ID NO: 75197 - RNA, 22 nt, Human
gaaaaucugcuuauauuauuuu

SEQ ID NO: 75198 - RNA, 22 nt, Human
gaaaaugccucuggcauuaaac

SEQ ID NO: 75199 - RNA, 22 nt, Human
gaaaauguuagcuucauaguca

SEQ ID NO: 75200 - RNA, 22 nt, Human
gaaaauguuuguccggagcuga

SEQ ID NO: 75201 - RNA, 22 nt, Human
gaacauucuuggaggaaauaac

SEQ ID NO: 75202 - RNA, 22 nt, Human
gaacauugcuuuauuucuucua

SEQ ID NO: 75203 - RNA, 22 nt, Human
gaacauuuccagaaaggaacua

SEQ ID NO: 75204 - RNA, 22 nt, Human
gaacauuuggauuuguaaauuu

SEQ ID NO: 75205 - RNA, 22 nt, Human
gaacauuuggcaugagaauuug

SEQ ID NO: 75206 - RNA, 22 nt, Human
gaaccacaagauucaaaggggu

SEQ ID NO: 75207 - RNA, 22 nt, Human
gaacccaaaccuggaccucccu

SEQ ID NO: 75208 - RNA, 22 nt, Human
gaacccaaccucacuuggggua

SEQ ID NO: 75209 - RNA, 22 nt, Human
gaacccaggagguugcagugag

SEQ ID NO: 75210 - RNA, 22 nt, Human
gaacccaggcuuuugaggcugu

SEQ ID NO: 75211 - RNA, 22 nt, Human
gaaccccaacuuauaagacaga

SEQ ID NO: 75212 - RNA, 22 nt, Human
gaaccucuuuagugcauccuuc

SEQ ID NO: 75213 - RNA, 22 nt, Human
gaaccugauccaauauuuacuc

SEQ ID NO: 75214 - RNA, 22 nt, Human
gaaccuggcagcccuauaucug

SEQ ID NO: 75215 - RNA, 22 nt, Human
gaaccuguuuauguuaccugcg

SEQ ID NO: 75216 - RNA, 22 nt, Human
gaacuaaaugaaauuacuggug

SEQ ID NO: 75217 - RNA, 22 nt, Human
gaacuauucauucucauuagcg

SEQ ID NO: 75218 - RNA, 22 nt, Human
gaacucagagccugagcuagga

SEQ ID NO: 75219 - RNA, 22 nt, Human
gaacucuugcagugaaagcuua

SEQ ID NO: 75220 - RNA, 22 nt, Human
gaacugaguuuucugccuggac

SEQ ID NO: 75221 - RNA, 22 nt, Human
gaacuggguccuugagucuaga

SEQ ID NO: 75222 - RNA, 22 nt, Human
gaacugguuacagagggauguu

SEQ ID NO: 75223 - RNA, 22 nt, Human
gaacuguaguuaauacuacaca

SEQ ID NO: 75224 - RNA, 22 nt, Human
gaacuguggguaauauauuaga

SEQ ID NO: 75225 - RNA, 22 nt, Human
gaacuguguacauuguagauaa

SEQ ID NO: 75226 - RNA, 22 nt, Human
gaacuuaguagucuacuucuua

SEQ ID NO: 75227 - RNA, 22 nt, Human
gaacuucacgauagccaaagcu

SEQ ID NO: 75228 - RNA, 22 nt, Human
gaacuucagaaucagcauaucu

SEQ ID NO: 75229 - RNA, 22 nt, Human
gaacuucuucaacauaauggac

SEQ ID NO: 75230 - RNA, 22 nt, Human
gaacuugggagaagggagugug

SEQ ID NO: 75231 - RNA, 20 nt, Human
gaacuugggcaaguggcuua

SEQ ID NO: 75232 - RNA, 22 nt, Human
gaacuugguauuccuuuuaaca

SEQ ID NO: 75233 - RNA, 17 nt, Human
gaacuuguucacuguga

SEQ ID NO: 75234 - RNA, 22 nt, Human
gaacuuguuguaagaaaauaug

SEQ ID NO: 75235 - RNA, 22 nt, Human
gaacuuuaggauuuucacaggu

SEQ ID NO: 75236 - RNA, 22 nt, Human
gaacuuuguggggcugagagga

SEQ ID NO: 75237 - RNA, 22 nt, Human
gaagaacugaaaguugaugcac

SEQ ID NO: 75238 - RNA, 22 nt, Human
gaagaacugugacagaagcagu

SEQ ID NO: 75239 - RNA, 22 nt, Human
gaagaacuuauaggaaugucau

SEQ ID NO: 75240 - RNA, 22 nt, Human
gaagaagcauucugcuguuuug

SEQ ID NO: 75241 - RNA, 22 nt, Human
gaagaagccucuguggaucuga

SEQ ID NO: 75242 - RNA, 22 nt, Human
gaagaaggaagaucaugcuuga

SEQ ID NO: 75243 - RNA, 22 nt, Human
gaagaagggagugacaaaugca

SEQ ID NO: 75244 - RNA, 22 nt, Human
gaagaagggagugcguguaaua

SEQ ID NO: 75245 - RNA, 22 nt, Human
gaagaagguggcccagggguag

SEQ ID NO: 75246 - RNA, 22 nt, Human
gaagaaguguaagucuguuuca

SEQ ID NO: 75247 - RNA, 22 nt, Human
gaagaauugaggauguuuaccu

SEQ ID NO: 75248 - RNA, 22 nt, Human
gaagaauugcccauuucugucu

SEQ ID NO: 75249 - RNA, 22 nt, Human
gaagacaagcugaguguugucc

SEQ ID NO: 75250 - RNA, 22 nt, Human
gaagacaccuacugucauuucu

SEQ ID NO: 75251 - RNA, 22 nt, Human
gaagacacuaaggcccagggag

SEQ ID NO: 75252 - RNA, 22 nt, Human
gaagacagaaaccuguuuggcu

SEQ ID NO: 75253 - RNA, 22 nt, Human
gaagacauguuuuuaauaugua

SEQ ID NO: 75254 - RNA, 22 nt, Human
gaagacauuuguaacacuugca

SEQ ID NO: 75255 - RNA, 22 nt, Human
gaagacauuuuaugcauacucu

SEQ ID NO: 75256 - RNA, 22 nt, Human
gaagaccaauuugggccauggc

SEQ ID NO: 75257 - RNA, 22 nt, Human
gaagaccccagagcgagguaag

SEQ ID NO: 75258 - RNA, 22 nt, Human
gaagacgagauaaaaugguguc

SEQ ID NO: 75259 - RNA, 22 nt, Human
gaagacuuuaagccgagauuag

SEQ ID NO: 75260 - RNA, 22 nt, Human
gaagagaagcaucaauagguaa

SEQ ID NO: 75261 - RNA, 22 nt, Human
gaagagagccgcgggacaucag

SEQ ID NO: 75262 - RNA, 22 nt, Human
gaagagaugacaaaggagcaug

SEQ ID NO: 75263 - RNA, 22 nt, Human
gaagagcauaugaagagcauau

SEQ ID NO: 75264 - RNA, 22 nt, Human
gaagagcuaaaggcacaggcuu

SEQ ID NO: 75265 - RNA, 22 nt, Human
gaagagcugucagaaaagcuaa

SEQ ID NO: 75266 - RNA, 22 nt, Human
gaagagcuuagacagaaucaaa

SEQ ID NO: 75267 - RNA, 22 nt, Human
gaagaggacuguggcauccuag

SEQ ID NO: 75268 - RNA, 22 nt, Human
gaagauaacuuuaaaaaguggc

SEQ ID NO: 75269 - RNA, 22 nt, Human
gaagauaccucaauucuuugaa

SEQ ID NO: 75270 - RNA, 20 nt, Human
gaagauggguagaggcacag

SEQ ID NO: 75271 - RNA, 22 nt, Human
gaagaugugcaauacaaagaaa

SEQ ID NO: 75272 - RNA, 22 nt, Human
gaagaugugggaacugcugaaa

SEQ ID NO: 75273 - RNA, 22 nt, Human
gaagauuuaagcacaauagucu

SEQ ID NO: 75274 - RNA, 22 nt, Human
gaagauuuauaaggaccuuauu

SEQ ID NO: 75275 - RNA, 22 nt, Human
gaagauuucugaugaguuacuu

SEQ ID NO: 75276 - RNA, 22 nt, Human
gaagauuuuucuuaaugcuccg

SEQ ID NO: 75277 - RNA, 22 nt, Human
gaagcaauguguuuucaacauu

SEQ ID NO: 75278 - RNA, 22 nt, Human
gaagcaauuuagaaucagaagc

SEQ ID NO: 75279 - RNA, 22 nt, Human
gaagcacaaaguguaguuccga

SEQ ID NO: 75280 - RNA, 22 nt, Human
gaagcacacugauuuuauuucu

SEQ ID NO: 75281 - RNA, 22 nt, Human
gaagcacagaaugguuaacaug

SEQ ID NO: 75282 - RNA, 22 nt, Human
gaagcacauggcuauagcuauu

SEQ ID NO: 75283 - RNA, 22 nt, Human
gaagcagcaaguauaggacagg

SEQ ID NO: 75284 - RNA, 22 nt, Human
gaagcagcgaaguggaagggac

SEQ ID NO: 75285 - RNA, 22 nt, Human
gaagcagcuagcccacuaguca

SEQ ID NO: 75286 - RNA, 22 nt, Human
gaagcagcuaggaucuucauuu

SEQ ID NO: 75287 - RNA, 22 nt, Human
gaagcagcucagauugacugaa

SEQ ID NO: 75288 - RNA, 22 nt, Human
gaagcagcugccagagaugucu

SEQ ID NO: 75289 - RNA, 22 nt, Human
gaagcagugugaacccauguaa

SEQ ID NO: 75290 - RNA, 22 nt, Human
gaagcaguucgaaagcaguugg

SEQ ID NO: 75291 - RNA, 22 nt, Human
gaagcauauagguacugaacua

SEQ ID NO: 75292 - RNA, 22 nt, Human
gaagccaagccagcugauggag

SEQ ID NO: 75293 - RNA, 22 nt, Human
gaagccaagggcugcuuuuccu

SEQ ID NO: 75294 - RNA, 22 nt, Human
gaagccacuauagauauucuaa

SEQ ID NO: 75295 - RNA, 22 nt, Human
gaagccagcaguggagaaagga

SEQ ID NO: 75296 - RNA, 22 nt, Human
gaagccaggggccugacaggca

SEQ ID NO: 75297 - RNA, 22 nt, Human
gaagccaguguuugaagaauuu

SEQ ID NO: 75298 - RNA, 22 nt, Human
gaagcccagggcguggccgggc

SEQ ID NO: 75299 - RNA, 22 nt, Human
gaagcccauuuguacagcacau

SEQ ID NO: 75300 - RNA, 22 nt, Human
gaagccugggagggcugggcua

SEQ ID NO: 75301 - RNA, 22 nt, Human
gaagccuuugccuaaaacauua

SEQ ID NO: 75302 - RNA, 22 nt, Human
gaagcgcggcgucggcgugggu

SEQ ID NO: 75303 - RNA, 22 nt, Human
gaagcgugcagguccguauacu

SEQ ID NO: 75304 - RNA, 22 nt, Human
gaagcuaaaccacagcuaagaa

SEQ ID NO: 75305 - RNA, 22 nt, Human
gaagcucucaaacucuccccuu

SEQ ID NO: 75306 - RNA, 22 nt, Human
gaagcucuggacagugaagaag

SEQ ID NO: 75307 - RNA, 22 nt, Human
gaagcugacccaggagcgugug

SEQ ID NO: 75308 - RNA, 22 nt, Human
gaagcugcaauaauuguuuuga

SEQ ID NO: 75309 - RNA, 22 nt, Human
gaagcugugaacaagcuacgug

SEQ ID NO: 75310 - RNA, 22 nt, Human
uggcaguguuucuaaggggcuc

SEQ ID NO: 75311 - RNA, 22 nt, Human
uggcaguuauauugccuuaggg

SEQ ID NO: 75312 - RNA, 22 nt, Human
uggcaguugaguuacuggguga

SEQ ID NO: 75313 - RNA, 22 nt, Human
uggcaguugugagguucauauu

SEQ ID NO: 75314 - RNA, 22 nt, Human
uggcaguuuacagaguucugaa

SEQ ID NO: 75315 - RNA, 22 nt, Human
uggcauccuuuaucugcaggcu

SEQ ID NO: 75316 - RNA, 19 nt, Human
uggcaucugggcccuccag

SEQ ID NO: 75317 - RNA, 19 nt, Human
uggcaucuguaaaauggug

SEQ ID NO: 75318 - RNA, 22 nt, Human
uggcaucuguguugcgguuguc

SEQ ID NO: 75319 - RNA, 23 nt, Human
uggcaucuuggcaucuugcugcu

SEQ ID NO: 75320 - RNA, 17 nt, Human
uggcaucuuuugcucau

SEQ ID NO: 75321 - RNA, 22 nt, Human
uggcaugaagucagcagcuggg

SEQ ID NO: 75322 - RNA, 22 nt, Human
uggcaugcacagcccuguucgg

SEQ ID NO: 75323 - RNA, 18 nt, Human
uggcaugcuuugauacau

SEQ ID NO: 75324 - RNA, 22 nt, Human
uggcauggaccuuggaagaauu

SEQ ID NO: 75325 - RNA, 22 nt, Human
uggcauggcaacccugcaggga

SEQ ID NO: 75326 - RNA, 22 nt, Human
uggcauggcauuuagagaauua

SEQ ID NO: 75327 - RNA, 22 nt, Human
uggcauguacccaggaauggac

SEQ ID NO: 75328 - RNA, 22 nt, Human
uggcauguauacuugaguagga

SEQ ID NO: 75329 - RNA, 22 nt, Human
uggcauguggcaauguugggau

SEQ ID NO: 75330 - RNA, 22 nt, Human
uggcauguuaaaguaguauuaa

SEQ ID NO: 75331 - RNA, 22 nt, Human
uggcauugcuagugacccagca

SEQ ID NO: 75332 - RNA, 22 nt, Human
uggcauuuagaaaacaacaugu

SEQ ID NO: 75333 - RNA, 22 nt, Human
uggcauuuagagaaaugaagga

SEQ ID NO: 75334 - RNA, 22 nt, Human
uggcauuuccucagugcucaga

SEQ ID NO: 75335 - RNA, 22 nt, Human
uggcauuucuggccauuugugu

SEQ ID NO: 75336 - RNA, 22 nt, Human
uggcauuuggcuuacuuauguu

SEQ ID NO: 75337 - RNA, 22 nt, Human
uggcauuugggcuggcuuuucu

SEQ ID NO: 75338 - RNA, 23 nt, Human
uggcauuuuaguuagcuucagug

SEQ ID NO: 75339 - RNA, 21 nt, Human
uggccaaacuggagcauuuga

SEQ ID NO: 75340 - RNA, 22 nt, Human
uggccaagccacugcugggucu

SEQ ID NO: 75341 - RNA, 22 nt, Human
uggccacagccucugccaguuc

SEQ ID NO: 75342 - RNA, 23 nt, Human
uggccacagggugcuccauugua

SEQ ID NO: 75343 - RNA, 23 nt, Human
uggccacaguccaugcaugccca

SEQ ID NO: 75344 - RNA, 22 nt, Human
uggccacaguguccagcagcag

SEQ ID NO: 75345 - RNA, 22 nt, Human
uggccacaucugaaaugagugu

SEQ ID NO: 75346 - RNA, 22 nt, Human
uggccacccacccuaaucuuuc

SEQ ID NO: 75347 - RNA, 22 nt, Human
uggccacccagcugacgccuuc

SEQ ID NO: 75348 - RNA, 22 nt, Human
uggccaccccuuucucugcacu

SEQ ID NO: 75349 - RNA, 22 nt, Human
uggccacucagggaugcaggaa

SEQ ID NO: 75350 - RNA, 22 nt, Human
uggccacuccucccugcaggcu

SEQ ID NO: 75351 - RNA, 22 nt, Human
uggccagaacucagacaugugg

SEQ ID NO: 75352 - RNA, 22 nt, Human
uggccagaccugacugucaggg

SEQ ID NO: 75353 - RNA, 22 nt, Human
uggccagaguccagugagccuu

SEQ ID NO: 75354 - RNA, 22 nt, Human
uggccagccacaauauaaagua

SEQ ID NO: 75355 - RNA, 22 nt, Human
uggccagccauaaaagaaccca

SEQ ID NO: 75356 - RNA, 22 nt, Human
uggccagccuggugcuugcucc

SEQ ID NO: 75357 - RNA, 22 nt, Human
uggccagccuugucaucgcuuu

SEQ ID NO: 75358 - RNA, 22 nt, Human
uggccagcugagauuuagcaca

SEQ ID NO: 75359 - RNA, 22 nt, Human
uggccagcuuuuuguagugcuc

SEQ ID NO: 75360 - RNA, 22 nt, Human
uggccaggaggcugcuucugac

SEQ ID NO: 75361 - RNA, 22 nt, Human
uggccaggcagguagaacggcc

SEQ ID NO: 75362 - RNA, 22 nt, Human
uggccaggcauucagauaagac

SEQ ID NO: 75363 - RNA, 22 nt, Human
uggccaggccucuuggugccca

SEQ ID NO: 75364 - RNA, 23 nt, Human
uggccaggguacuacacccaccc

SEQ ID NO: 75365 - RNA, 22 nt, Human
uggccaguagauaggcaggcaa

SEQ ID NO: 75366 - RNA, 22 nt, Human
uggccagucuguggaagccagg

SEQ ID NO: 75367 - RNA, 22 nt, Human
uggccagugggguugagcagga

SEQ ID NO: 75368 - RNA, 22 nt, Human
uggccaguuugcucaggcaguc

SEQ ID NO: 75369 - RNA, 22 nt, Human
uggcccagacucugcucuuauc

SEQ ID NO: 75370 - RNA, 22 nt, Human
uggcccagaucucugaccuuga

SEQ ID NO: 75371 - RNA, 23 nt, Human
aaaaaaccauguaggcacucagu

SEQ ID NO: 75372 - RNA, 22 nt, Human
aaaaaaucagaucuuugguuaa

SEQ ID NO: 75373 - RNA, 22 nt, Human
aaaaaauuaucauaguuccuga

SEQ ID NO: 75374 - RNA, 22 nt, Human
aaaaagacuagucgagugcagu

SEQ ID NO: 75375 - RNA, 22 nt, Human
aaaaagauagcauugugcuccu

SEQ ID NO: 75376 - RNA, 22 nt, Human
aaaaaggcuaagcaucuugugc

SEQ ID NO: 75377 - RNA, 22 nt, Human
aaaaagggauuugugauccagg

SEQ ID NO: 75378 - RNA, 18 nt, Human
aaaaagugcucaggccua

SEQ ID NO: 75379 - RNA, 22 nt, Human
aaaaaguuucaacugccaacuc

SEQ ID NO: 75380 - RNA, 22 nt, Human
aaaaauacuucacuucugggug

SEQ ID NO: 75381 - RNA, 22 nt, Human
aaaaaugugaccacaggguguu

SEQ ID NO: 75382 - RNA, 20 nt, Human
aaaaauugauaucgcuuccu

SEQ ID NO: 75383 - RNA, 22 nt, Human
aaaacacaagaagcaggguaca

SEQ ID NO: 75384 - RNA, 22 nt, Human
aaaacagacagccaguguagag

SEQ ID NO: 75385 - RNA, 22 nt, Human
aaaaccacaaugacuuuugcac

SEQ ID NO: 75386 - RNA, 22 nt, Human
aaaaccacaauuacuuuugcac

SEQ ID NO: 75387 - RNA, 22 nt, Human
aaaaccacaguuacuuuugcac

SEQ ID NO: 75388 - RNA, 22 nt, Human
aaaaccacuuccuugcuauugg

SEQ ID NO: 75389 - RNA, 22 nt, Human
aaaaccagacacuguuucuggg

SEQ ID NO: 75390 - RNA, 22 nt, Human
aaaaccaggcuugcugugcucg

SEQ ID NO: 75391 - RNA, 22 nt, Human
aaaaccauguaucuauuuccuu

SEQ ID NO: 75392 - RNA, 22 nt, Human
aaaacuaaauacgcuuugccuc

SEQ ID NO: 75393 - RNA, 22 nt, Human
aaaacuguaggaauugggugcc

SEQ ID NO: 75394 - RNA, 22 nt, Human
aaaacuuagcuaggcaaguuuu

SEQ ID NO: 75395 - RNA, 22 nt, Human
aaaagacauaugugggcauucu

SEQ ID NO: 75396 - RNA, 22 nt, Human
aaaagacaucuauuucaggcag

SEQ ID NO: 75397 - RNA, 22 nt, Human
aaaagagaaaguggcaggcuuu

SEQ ID NO: 75398 - RNA, 22 nt, Human
aaaagagaauccuguacagaga

SEQ ID NO: 75399 - RNA, 22 nt, Human
aaaagagaguugccagucugua

SEQ ID NO: 75400 - RNA, 22 nt, Human
aaaagagcaaacauguaauagu

SEQ ID NO: 75401 - RNA, 22 nt, Human
aaaagagccacuuaugaccuca

SEQ ID NO: 75402 - RNA, 22 nt, Human
aaaagagguuaaccaggugugu

SEQ ID NO: 75403 - RNA, 22 nt, Human
aaaagauuguuagggagaaugu

SEQ ID NO: 75404 - RNA, 22 nt, Human
aaaagcagagacucuggagcua

SEQ ID NO: 75405 - RNA, 22 nt, Human
aaaagcaguuuauagucaguug

SEQ ID NO: 75406 - RNA, 22 nt, Human
aaaagcaucucaaaggagcuuc

SEQ ID NO: 75407 - RNA, 22 nt, Human
aaaagccuggauacuaucauua

SEQ ID NO: 75408 - RNA, 22 nt, Human
aaaagcuuugccagaugaguug

SEQ ID NO: 75409 - RNA, 22 nt, Human
aaaaggaucagauuuugagcag

SEQ ID NO: 75410 - RNA, 22 nt, Human
aaaaggcuaauuaaguuuugga

SEQ ID NO: 75411 - RNA, 22 nt, Human
aaaagggaaagcagaaugacuu

SEQ ID NO: 75412 - RNA, 22 nt, Human
aaaaguaaucgcaguuuuugcc

SEQ ID NO: 75413 - RNA, 22 nt, Human
aaaaguaauugcaguuuuguca

SEQ ID NO: 75414 - RNA, 22 nt, Human
aaaaguaauugcaguuuuugcc

SEQ ID NO: 75415 - RNA, 22 nt, Human
aaaaguaauugcgguuuuugcc

SEQ ID NO: 75416 - RNA, 22 nt, Human
aaaaguaauugugguuuuugcc

SEQ ID NO: 75417 - RNA, 22 nt, Human
aaaaguauaggguuuggaguca

SEQ ID NO: 75418 - RNA, 22 nt, Human
aaaaguauccacagcucaggag

SEQ ID NO: 75419 - RNA, 22 nt, Human
aaaaguauuuauggcuauguaa

SEQ ID NO: 75420 - RNA, 22 nt, Human
aaaagucagucucuccuagcuc

SEQ ID NO: 75421 - RNA, 22 nt, Human
aaaagucucucugaguaaaagu

SEQ ID NO: 75422 - RNA, 22 nt, Human
aaaagucuuggggaaggccagg

SEQ ID NO: 75423 - RNA, 22 nt, Human
aaaagucuugucaagguuccca

SEQ ID NO: 75424 - RNA, 22 nt, Human
aaaaguguccagauuaugaaga

SEQ ID NO: 75425 - RNA, 22 nt, Human
aaaaguguucaggaagaauaau

SEQ ID NO: 75426 - RNA, 22 nt, Human
aaaaguuaacuguguucaugca

SEQ ID NO: 75427 - RNA, 22 nt, Human
aaaaguuaccucuguaauauaa

SEQ ID NO: 75428 - RNA, 22 nt, Human
aaaaguugcaaaauugcucuuc

SEQ ID NO: 75429 - RNA, 18 nt, Human
aaaauaacaaaguuggcu

SEQ ID NO: 75430 - RNA, 22 nt, Human
aaaauacuguggaguguugaaa

SEQ ID NO: 75431 - RNA, 22 nt, Human
aaaauagauucuaggaugucuu

SEQ ID NO: 75432 - RNA, 22 nt, Human
aaaauagcauauugcuuucuuu

SEQ ID NO: 75433 - RNA, 22 nt, Human
aaaauagccucacauaauugcu

SEQ ID NO: 75434 - RNA, 22 nt, Human
aaaauaucagcaaagggugaca

SEQ ID NO: 75435 - RNA, 22 nt, Human
aaaauaugaaguugucaguaug

SEQ ID NO: 75436 - RNA, 22 nt, Human
aaaauauuuuagggccaggaga

SEQ ID NO: 75437 - RNA, 21 nt, Human
aaaaucaccuuaggucacugg

SEQ ID NO: 75438 - RNA, 22 nt, Human
aaaaucugcacaggucaguuuu

SEQ ID NO: 75439 - RNA, 22 nt, Human
aaaaucugguaauuugaaugug

SEQ ID NO: 75440 - RNA, 22 nt, Human
aaaaucuugacuguuuuuagaa

SEQ ID NO: 75441 - RNA, 22 nt, Human
aaaaugaagcaaaggcauucag

SEQ ID NO: 75442 - RNA, 22 nt, Human
aaaaugagccaugaaccaacca

SEQ ID NO: 75443 - RNA, 22 nt, Human
aaaauggauagugcgucuucuc

SEQ ID NO: 75444 - RNA, 22 nt, Human
aaaauggcuuaauaggcaauaa

SEQ ID NO: 75445 - RNA, 22 nt, Human
aaaauggguuucuucaaccuca

SEQ ID NO: 75446 - RNA, 22 nt, Human
aaaauggucucagcuggcacca

SEQ ID NO: 75447 - RNA, 22 nt, Human
aaaauguaaagcuugaguguag

SEQ ID NO: 75448 - RNA, 22 nt, Human
aaaaugugaucuacaaaugcaa

SEQ ID NO: 75449 - RNA, 22 nt, Human
aaaauguucaagcaugcugguu

SEQ ID NO: 75450 - RNA, 18 nt, Human
aaaauguucccccauuaa

SEQ ID NO: 75451 - RNA, 22 nt, Human
aaaauucauggcuugggaaaag

SEQ ID NO: 75452 - RNA, 22 nt, Human
aaaauucauuccucagacugcc

SEQ ID NO: 75453 - RNA, 22 nt, Human
aaaauucuaacaugcagccaag

SEQ ID NO: 75454 - RNA, 22 nt, Human
aaaauugaagugaucaggaacu

SEQ ID NO: 75455 - RNA, 20 nt, Human
aaaauugcucugcagucccc

SEQ ID NO: 75456 - RNA, 22 nt, Human
aaaauugucgaacaguaguaac

SEQ ID NO: 75457 - RNA, 22 nt, Human
aaaauuuuacugguguuuccuu

SEQ ID NO: 75458 - RNA, 22 nt, Human
aaaauuuugcccuauccuucau

SEQ ID NO: 75459 - RNA, 22 nt, Human
aaacaaacaauuaguugugugg

SEQ ID NO: 75460 - RNA, 22 nt, Human
aaacaaauagugcaugggaauu

SEQ ID NO: 75461 - RNA, 22 nt, Human
aaacaacaugguggguguguag

SEQ ID NO: 75462 - RNA, 23 nt, Human
aaacaagcccuaaugaagagucc

SEQ ID NO: 75463 - RNA, 22 nt, Human
aaaaaagauugaugguggaugc

SEQ ID NO: 75464 - RNA, 22 nt, Human
aaaaaauuccauucugugccuu

SEQ ID NO: 75465 - RNA, 22 nt, Human
aaaaacacaaguggcuuggucu

SEQ ID NO: 75466 - RNA, 22 nt, Human
aaaaacacugggcugggaguca

SEQ ID NO: 75467 - RNA, 22 nt, Human
aaaaaccucaauuacuuuugca

SEQ ID NO: 75468 - RNA, 22 nt, Human
aaaaaccuuucauugcaaaugu

SEQ ID NO: 75469 - RNA, 22 nt, Human
aaaaacugcaauuacuuuuguc

SEQ ID NO: 75470 - RNA, 19 nt, Human
aaaaagaggcuauaauauu

SEQ ID NO: 75471 - RNA, 21 nt, Human
aaaaagcuggggcaugcaugc

SEQ ID NO: 75472 - RNA, 22 nt, Human
aaaaaguauuggccaugguuga

SEQ ID NO: 75473 - RNA, 22 nt, Human
aaaaauaggucaaccguguaug

SEQ ID NO: 75474 - RNA, 22 nt, Human
aaaaaucacuuuuauaggcagc

SEQ ID NO: 75475 - RNA, 22 nt, Human
aaaaaugcugugguagcugugu

SEQ ID NO: 75476 - RNA, 22 nt, Human
aaaaaugcuuggacuuaauaaa

SEQ ID NO: 75477 - RNA, 22 nt, Human
aaaaauugcugagaacggaauu

SEQ ID NO: 75478 - RNA, 22 nt, Human
aaaaauuuaugguucuucucug

SEQ ID NO: 75479 - RNA, 22 nt, Human
aaaacacugcaaagcugauugg

SEQ ID NO: 75480 - RNA, 22 nt, Human
aaaacaguuauaaacagaguca

SEQ ID NO: 75481 - RNA, 22 nt, Human
aaaacaguuuuugcuaacugcu

SEQ ID NO: 75482 - RNA, 22 nt, Human
aaaacauaaacugacagcccau

SEQ ID NO: 75483 - RNA, 22 nt, Human
aaaaccacaaaaguggcuuggu

SEQ ID NO: 75484 - RNA, 22 nt, Human
aaaacuacauuugacauuuugu

SEQ ID NO: 75485 - RNA, 22 nt, Human
aaaacucugcaguuaguuucua

SEQ ID NO: 75486 - RNA, 22 nt, Human
aaaacuguaucuucuugggacu

SEQ ID NO: 75487 - RNA, 22 nt, Human
aaaagagagcugaggagcucca

SEQ ID NO: 75488 - RNA, 22 nt, Human
aaaagagugacugauaaguaua

SEQ ID NO: 75489 - RNA, 22 nt, Human
aaaagcaagaggcuggauuaaa

SEQ ID NO: 75490 - RNA, 22 nt, Human
aaaagcacuacaauuucgcuuc

SEQ ID NO: 75491 - RNA, 20 nt, Human
aaaagcagccagagauggua

SEQ ID NO: 75492 - RNA, 22 nt, Human
aaaagcaguaaauguaugaccu

SEQ ID NO: 75493 - RNA, 22 nt, Human
aaaagcaguuaucugggaggaa

SEQ ID NO: 75494 - RNA, 22 nt, Human
aaaagcauuacaugguacguau

SEQ ID NO: 75495 - RNA, 22 nt, Human
aaaagcuagucaaugauguauu

SEQ ID NO: 75496 - RNA, 22 nt, Human
aaaagcucuuucugcuguagau

SEQ ID NO: 75497 - RNA, 22 nt, Human
aaaagcuuuguuaauagguuug

SEQ ID NO: 75498 - RNA, 21 nt, Human
aaaaggaaggucuguuugggg

SEQ ID NO: 75499 - RNA, 19 nt, Human
aaaaggaauauucuuuggg

SEQ ID NO: 75500 - RNA, 22 nt, Human
aaaaggaggacaugguuacaga

SEQ ID NO: 75501 - RNA, 21 nt, Human
aaaaggaggcaggugaacagc

SEQ ID NO: 75502 - RNA, 22 nt, Human
aaaaggcagugcaagagagggu

SEQ ID NO: 75503 - RNA, 22 nt, Human
aaaaguaauugaugcaaucgua

SEQ ID NO: 75504 - RNA, 22 nt, Human
aaaaguauuggccaccauuucu

SEQ ID NO: 75505 - RNA, 22 nt, Human
aaaaguauuuugagcacuuuau

SEQ ID NO: 75506 - RNA, 22 nt, Human
aaaagucugcuuucuauuauca

SEQ ID NO: 75507 - RNA, 22 nt, Human
aaaauagaugaaaggaagucug

SEQ ID NO: 75508 - RNA, 22 nt, Human
aaaauagcagggaugugggaaa

SEQ ID NO: 75509 - RNA, 20 nt, Human
aaaauagccccaggcucauu

SEQ ID NO: 75510 - RNA, 22 nt, Human
aaaauaguuaacguucagagua

SEQ ID NO: 75511 - RNA, 22 nt, Human
aaaaucaguacacuuuauuuug

SEQ ID NO: 75512 - RNA, 22 nt, Human
aaaauccugcugacucgagaug

SEQ ID NO: 75513 - RNA, 22 nt, Human
aaaauccuuagccgagugaggu

SEQ ID NO: 75514 - RNA, 22 nt, Human
aaaaucucauuaucaggaaggg

SEQ ID NO: 75515 - RNA, 22 nt, Human
aaaaucugcuuccuuuuacaga

SEQ ID NO: 75516 - RNA, 23 nt, Human
aaaaucuucugccuaugaagaaa

SEQ ID NO: 75517 - RNA, 22 nt, Human
aaaaugaauaaguuaacccagg

SEQ ID NO: 75518 - RNA, 22 nt, Human
aaaaugacauuccagugauauu

SEQ ID NO: 75519 - RNA, 22 nt, Human
aaaaugagauacaguuugaaag

SEQ ID NO: 75520 - RNA, 22 nt, Human
aaaaugaggaacggaucauggc

SEQ ID NO: 75521 - RNA, 22 nt, Human
aaaaugauauccugacuuuuau

SEQ ID NO: 75522 - RNA, 22 nt, Human
aaaaugcaugagaaugugcucg

SEQ ID NO: 75523 - RNA, 22 nt, Human
aaaaugcugggaaaguuggaau

SEQ ID NO: 75524 - RNA, 21 nt, Human
aaaaugugagcgugaugcuua

SEQ ID NO: 75525 - RNA, 22 nt, Human
aaaauguguuuaugcauuucgu

SEQ ID NO: 75526 - RNA, 22 nt, Human
aaaauugaggcucauguuaaau

SEQ ID NO: 75527 - RNA, 22 nt, Human
aaaauugguuccuuucugaggc

SEQ ID NO: 75528 - RNA, 22 nt, Human
aaaauuguaggaacugaaucaa

SEQ ID NO: 75529 - RNA, 22 nt, Human
aaacaaacauagguuugaaagu

SEQ ID NO: 75530 - RNA, 22 nt, Human
aaacaaauuucaagcugugaca

SEQ ID NO: 75531 - RNA, 22 nt, Human
aaacaacuucugcacuaugggu

SEQ ID NO: 75532 - RNA, 22 nt, Human
aaacaagagucuugcuccaccu

SEQ ID NO: 75533 - RNA, 22 nt, Human
aaacaagguccuucugugacau

SEQ ID NO: 75534 - RNA, 22 nt, Human
aaacaaguuuguagacuagcca

SEQ ID NO: 75535 - RNA, 17 nt, Human
aaacaaugcagacaagc

SEQ ID NO: 75536 - RNA, 22 nt, Human
aaacaauguuccuauauuagag

SEQ ID NO: 75537 - RNA, 22 nt, Human
aaacaauuuccaccucuccuga

SEQ ID NO: 75538 - RNA, 22 nt, Human
aaacacacagaaaugaaugagg

SEQ ID NO: 75539 - RNA, 22 nt, Human
aaacacagguacugcagaagug

SEQ ID NO: 75540 - RNA, 22 nt, Human
aaacacaucauucaugucguca

SEQ ID NO: 75541 - RNA, 22 nt, Human
aaacacauuuuaggaaaaucua

SEQ ID NO: 75542 - RNA, 22 nt, Human
aaacacuagcaggaagcacuga

SEQ ID NO: 75543 - RNA, 22 nt, Human
aaacacuggcaauuucaugcac

SEQ ID NO: 75544 - RNA, 22 nt, Human
aaacacugguaugauguauagu

SEQ ID NO: 75545 - RNA, 22 nt, Human
aaacacuucuuaggucuuaagu

SEQ ID NO: 75546 - RNA, 22 nt, Human
aaacagaaggguagguaaacau

SEQ ID NO: 75547 - RNA, 22 nt, Human
aaacagagagauguauguggag

SEQ ID NO: 75548 - RNA, 22 nt, Human
aaacagaguuugguaaauagcc

SEQ ID NO: 75549 - RNA, 22 nt, Human
aaacagauaagggacaauuuca

SEQ ID NO: 75550 - RNA, 22 nt, Human
aaacagauaaugcuauaaaugg

SEQ ID NO: 75551 - RNA, 22 nt, Human
aaacagauugaaauucguagua

SEQ ID NO: 75552 - RNA, 22 nt, Human
aaacagcugucauuguuuuaaa

SEQ ID NO: 75553 - RNA, 22 nt, Human
aaacaggcuuauauuuugcucu

SEQ ID NO: 75554 - RNA, 22 nt, Human
aaacagguagcccuagccuucu

SEQ ID NO: 75555 - RNA, 22 nt, Human
aaacaggucugaaaauagcuac

SEQ ID NO: 75556 - RNA, 22 nt, Human
aaacaagcugcagacaagccau

SEQ ID NO: 75557 - RNA, 23 nt, Human
aaacaagucucucaauggcuugc

SEQ ID NO: 75558 - RNA, 22 nt, Human
aaacaaguuuagaauaaugaau

SEQ ID NO: 75559 - RNA, 22 nt, Human
aaacaaugaaauauuuuuaugg

SEQ ID NO: 75560 - RNA, 22 nt, Human
aaacaaugacaacacagcugcg

SEQ ID NO: 75561 - RNA, 22 nt, Human
aaacacaagaggcaggguacag

SEQ ID NO: 75562 - RNA, 22 nt, Human
aaacacagauuucuuuguccca

SEQ ID NO: 75563 - RNA, 20 nt, Human
aaacacagccucucuuuaca

SEQ ID NO: 75564 - RNA, 22 nt, Human
aaacacauuagcccuguggaaa

SEQ ID NO: 75565 - RNA, 22 nt, Human
aaacaccaagagcuagcuauua

SEQ ID NO: 75566 - RNA, 22 nt, Human
aaacacuaauaacaguggcugg

SEQ ID NO: 75567 - RNA, 22 nt, Human
aaacacucauguguuacucucc

SEQ ID NO: 75568 - RNA, 22 nt, Human
aaacacugaaaauuuuggucau

SEQ ID NO: 75569 - RNA, 22 nt, Human
aaacacugugucaaacuggggc

SEQ ID NO: 75570 - RNA, 22 nt, Human
aaacacuuuaagugaggaggau

SEQ ID NO: 75571 - RNA, 22 nt, Human
aaacagaaauuuccucaugcuc

SEQ ID NO: 75572 - RNA, 22 nt, Human
aaacagacugaagaguugaagc

SEQ ID NO: 75573 - RNA, 22 nt, Human
aaacagacugcacugccaguca

SEQ ID NO: 75574 - RNA, 22 nt, Human
aaacagagggccacugaggcuc

SEQ ID NO: 75575 - RNA, 22 nt, Human
aaacagcaauuacuuuugcacc

SEQ ID NO: 75576 - RNA, 22 nt, Human
aaacagcagcuguuuaauuugc

SEQ ID NO: 75577 - RNA, 22 nt, Human
aaacagcuacuucuguauaaug

SEQ ID NO: 75578 - RNA, 22 nt, Human
aaacagcucaagaaguuacucu

SEQ ID NO: 75579 - RNA, 22 nt, Human
aaacagcuuguuucaggaaagu

SEQ ID NO: 75580 - RNA, 22 nt, Human
aaacaggaguugaccaaguaca

SEQ ID NO: 75581 - RNA, 22 nt, Human
aaacaggcacauaguaacauuu

SEQ ID NO: 75582 - RNA, 22 nt, Human
aaacaggcgcuuacuaagaaaa

SEQ ID NO: 75583 - RNA, 22 nt, Human
aaacaggcuuccauuagagcaa

SEQ ID NO: 75584 - RNA, 22 nt, Human
aaacaguaaguucuaguauuau

SEQ ID NO: 75585 - RNA, 22 nt, Human
aaacagucgucuuaauaguauu

SEQ ID NO: 75586 - RNA, 22 nt, Human
aaacagugauguugaguguaaa

SEQ ID NO: 75587 - RNA, 22 nt, Human
aaacaguuucauuuucaugacc

SEQ ID NO: 75588 - RNA, 22 nt, Human
aaacaguuucuaaucauggaga

SEQ ID NO: 75589 - RNA, 22 nt, Human
aaacaguuuuccuagcugucug

SEQ ID NO: 75590 - RNA, 22 nt, Human
aaacaguuuugccaaaaggaca

SEQ ID NO: 75591 - RNA, 20 nt, Human
aaacauaguggauaccacag

SEQ ID NO: 75592 - RNA, 22 nt, Human
aaacaucuaucagcauuuuuua

SEQ ID NO: 75593 - RNA, 22 nt, Human
aaacaucucaaagagguauuug

SEQ ID NO: 75594 - RNA, 21 nt, Human
aaacaucucugcuuuuguguc

SEQ ID NO: 75595 - RNA, 22 nt, Human
aaacaugaauagauauuaaaca

SEQ ID NO: 75596 - RNA, 22 nt, Human
aaacaugagcaucucuucaagc

SEQ ID NO: 75597 - RNA, 22 nt, Human
aaacaugauauugaggcugggc

SEQ ID NO: 75598 - RNA, 22 nt, Human
aaacaugaucacuccggcuuuu

SEQ ID NO: 75599 - RNA, 23 nt, Human
aaacaugcagcacaugaaugcua

SEQ ID NO: 75600 - RNA, 22 nt, Human
aaacauugagugccuuugguau

SEQ ID NO: 75601 - RNA, 22 nt, Human
aaacauuuuucuucaucauccu

SEQ ID NO: 75602 - RNA, 22 nt, Human
aaaccaaacauuugcgguggug

SEQ ID NO: 75603 - RNA, 22 nt, Human
aaaccacacuuagcaguuucgu

SEQ ID NO: 75604 - RNA, 22 nt, Human
aaaccacuccugauucacuuca

SEQ ID NO: 75605 - RNA, 22 nt, Human
aaaccauggcucauuggagaug

SEQ ID NO: 75606 - RNA, 22 nt, Human
aaacccaggguuuugucuuccc

SEQ ID NO: 75607 - RNA, 22 nt, Human
aaacccugagacuuggggccag

SEQ ID NO: 75608 - RNA, 22 nt, Human
aaacccugcccuucccaagaug

SEQ ID NO: 75609 - RNA, 22 nt, Human
aaaccgcaauuacuuuugcguc

SEQ ID NO: 75610 - RNA, 22 nt, Human
aaaccggguccagaucuucagg

SEQ ID NO: 75611 - RNA, 22 nt, Human
aaaccuauauagucuuagaagc

SEQ ID NO: 75612 - RNA, 22 nt, Human
aaaccucuccacuacaugacag

SEQ ID NO: 75613 - RNA, 22 nt, Human
aaaccucugaauacuguuggca

SEQ ID NO: 75614 - RNA, 22 nt, Human
aaaccucuggguuccgugguuu

SEQ ID NO: 75615 - RNA, 22 nt, Human
aaaccugucugauuauggagac

SEQ ID NO: 75616 - RNA, 22 nt, Human
aaaccuuaaaccaagcucuuga

SEQ ID NO: 75617 - RNA, 22 nt, Human
aaacggaaugaguaagaguauc

SEQ ID NO: 75618 - RNA, 22 nt, Human
aaacgguugcucauaguuacau

SEQ ID NO: 75619 - RNA, 20 nt, Human
aaacuaaagguguuugguuu

SEQ ID NO: 75620 - RNA, 22 nt, Human
aaacuaagacuaaugaagaacu

SEQ ID NO: 75621 - RNA, 22 nt, Human
aaacuaagggagaugugggcug

SEQ ID NO: 75622 - RNA, 19 nt, Human
aaacuaaggggaaauguuu

SEQ ID NO: 75623 - RNA, 22 nt, Human
aaacuaaggugcuguggacuga

SEQ ID NO: 75624 - RNA, 23 nt, Human
aaacuacauuuauaguuuuucuc

SEQ ID NO: 75625 - RNA, 22 nt, Human
aaacuacuaugggaauguacuu

SEQ ID NO: 75626 - RNA, 22 nt, Human
aaacuagaugaaacgaguaaag

SEQ ID NO: 75627 - RNA, 22 nt, Human
aaacuagauuaccacugcuaga

SEQ ID NO: 75628 - RNA, 22 nt, Human
aaacuagccacacagaauacac

SEQ ID NO: 75629 - RNA, 22 nt, Human
aaacuaggaaguucaucuuauu

SEQ ID NO: 75630 - RNA, 22 nt, Human
aaacucaaagucagaucagaga

SEQ ID NO: 75631 - RNA, 22 nt, Human
aaacucaaauuaaacuagcuua

SEQ ID NO: 75632 - RNA, 22 nt, Human
aaacucaaggauuuagacgaag

SEQ ID NO: 75633 - RNA, 22 nt, Human
aaacucagacacaguaucuguu

SEQ ID NO: 75634 - RNA, 22 nt, Human
aaacucaugccauuaauccuuu

SEQ ID NO: 75635 - RNA, 22 nt, Human
aaacucuacauggucgcaaaaa

SEQ ID NO: 75636 - RNA, 20 nt, Human
aaacucuaccucaaucguca

SEQ ID NO: 75637 - RNA, 22 nt, Human
aaacucuagcuacuaggauaac

SEQ ID NO: 75638 - RNA, 22 nt, Human
aaacucuagggcuccacauucc

SEQ ID NO: 75639 - RNA, 22 nt, Human
aaacucuggauuggaguccagc

SEQ ID NO: 75640 - RNA, 22 nt, Human
aaacucuggggguggagcccag

SEQ ID NO: 75641 - RNA, 22 nt, Human
aaacucuguagcuaaacauaau

SEQ ID NO: 75642 - RNA, 22 nt, Human
aaacucuuuccacgauuacuuu

SEQ ID NO: 75643 - RNA, 17 nt, Human
aaacugaaaaauucacu

SEQ ID NO: 75644 - RNA, 22 nt, Human
aaacugagaccgaaagggguag

SEQ ID NO: 75645 - RNA, 22 nt, Human
aaacugaggcucccgagggugu

SEQ ID NO: 75646 - RNA, 21 nt, Human
aaacugaggcuucaagcagug

SEQ ID NO: 75647 - RNA, 22 nt, Human
aaacugaguaccucugcauuca

SEQ ID NO: 75648 - RNA, 22 nt, Human
aaacugcaauuacuuuugcacc

SEQ ID NO: 75649 - RNA, 22 nt, Human
aaacugcaauuacuuuugcagc

SEQ ID NO: 75650 - RNA, 22 nt, Human
aaacugcaauuauguuugcaga

SEQ ID NO: 75651 - RNA, 22 nt, Human
aaacugcacaagggugcauagc

SEQ ID NO: 75652 - RNA, 22 nt, Human
aaacugcagagccaugguucaa

SEQ ID NO: 75653 - RNA, 22 nt, Human
aaacugcagccuugaguucagg

SEQ ID NO: 75654 - RNA, 23 nt, Human
aaacugcaucucugagccucagc

SEQ ID NO: 75655 - RNA, 22 nt, Human
aaacugccacaagagggacauc

SEQ ID NO: 75656 - RNA, 22 nt, Human
aaacugccuccugggcaacuaa

SEQ ID NO: 75657 - RNA, 22 nt, Human
aaacugcugggcauauauuucu

SEQ ID NO: 75658 - RNA, 22 nt, Human
aaacugcugguugcuggccagc

SEQ ID NO: 75659 - RNA, 23 nt, Human
aaacugcuuccaauuccugccau

SEQ ID NO: 75660 - RNA, 22 nt, Human
aaacuggauuaccaggcuggug

SEQ ID NO: 75661 - RNA, 17 nt, Human
aaacuggggucaggagc

SEQ ID NO: 75662 - RNA, 22 nt, Human
aaacuguaaacacagcaguaca

SEQ ID NO: 75663 - RNA, 22 nt, Human
aaacuguaagugccucaagguc

SEQ ID NO: 75664 - RNA, 22 nt, Human
aaacuguagugcuucgaucuga

SEQ ID NO: 75665 - RNA, 18 nt, Human
aaacuguauuucuuucua

SEQ ID NO: 75666 - RNA, 22 nt, Human
aaacugucauuggaugcauuug

SEQ ID NO: 75667 - RNA, 21 nt, Human
uuuggugcuggaaaugccauu

SEQ ID NO: 75668 - RNA, 22 nt, Human
uuugguuuauuaaauuguaggc

SEQ ID NO: 75669 - RNA, 22 nt, Human
uuuguaaaaggaggaagcaugg

SEQ ID NO: 75670 - RNA, 22 nt, Human
uuuguaacauuauggacugcuu

SEQ ID NO: 75671 - RNA, 22 nt, Human
uuuguaacuuuagaauugaucc

SEQ ID NO: 75672 - RNA, 22 nt, Human
uuuguaagugguagaucuaaga

SEQ ID NO: 75673 - RNA, 22 nt, Human
uuuguacagugaaagcgagguu

SEQ ID NO: 75674 - RNA, 22 nt, Human
uuuguacauccuaauucugagu

SEQ ID NO: 75675 - RNA, 22 nt, Human
uuuguacaugaaugugcaccca

SEQ ID NO: 75676 - RNA, 23 nt, Human
uuuguacauugaggaggcagaau

SEQ ID NO: 75677 - RNA, 22 nt, Human
uuuguacauuucacuccauugu

SEQ ID NO: 75678 - RNA, 22 nt, Human
uuuguacugaagauuguaaacu

SEQ ID NO: 75679 - RNA, 22 nt, Human
uuuguacugccacagcugacgu

SEQ ID NO: 75680 - RNA, 22 nt, Human
uuuguacuucauugguucuacu

SEQ ID NO: 75681 - RNA, 22 nt, Human
uuuguagagaauaaaacaaauu

SEQ ID NO: 75682 - RNA, 22 nt, Human
uuuguagauucauugaacuuuu

SEQ ID NO: 75683 - RNA, 22 nt, Human
uuuguagcagcaugauuuauaa

SEQ ID NO: 75684 - RNA, 22 nt, Human
uuuguaguuguggaugcugaag

SEQ ID NO: 75685 - RNA, 22 nt, Human
uuuguauuuuucccagcuagcu

SEQ ID NO: 75686 - RNA, 22 nt, Human
uuugucaaguuugcaaauacgu

SEQ ID NO: 75687 - RNA, 22 nt, Human
uuugucaauaacuaccaacagg

SEQ ID NO: 75688 - RNA, 22 nt, Human
uuugucauaucacacaauuuug

SEQ ID NO: 75689 - RNA, 22 nt, Human
uuugucaucccuuuugaaacug

SEQ ID NO: 75690 - RNA, 22 nt, Human
uuugucauguccuuaacugucu

SEQ ID NO: 75691 - RNA, 21 nt, Human
uuuguccaccuguguucacca

SEQ ID NO: 75692 - RNA, 22 nt, Human
uuuguccagaugcacagauaau

SEQ ID NO: 75693 - RNA, 22 nt, Human
uuuguccucuccauguacaaua

SEQ ID NO: 75694 - RNA, 22 nt, Human
uuugucuuaaaucuuguuacug

SEQ ID NO: 75695 - RNA, 22 nt, Human
uuugucuuggccaagguucuga

SEQ ID NO: 75696 - RNA, 22 nt, Human
uuugucuuguguccuuaggacc

SEQ ID NO: 75697 - RNA, 22 nt, Human
uuugugaaaugaagucacaacu

SEQ ID NO: 75698 - RNA, 22 nt, Human
uuugugaacaaacaugaagaug

SEQ ID NO: 75699 - RNA, 22 nt, Human
uuugugaauagguuggcuucca

SEQ ID NO: 75700 - RNA, 23 nt, Human
uuugugcagaagacaaaguggcc

SEQ ID NO: 75701 - RNA, 22 nt, Human
uuugugcagauguauauuugug

SEQ ID NO: 75702 - RNA, 22 nt, Human
uuugugcagcuaagaaaauggc

SEQ ID NO: 75703 - RNA, 22 nt, Human
uuugugcagguauaggcggaga

SEQ ID NO: 75704 - RNA, 22 nt, Human
uuugugcuaaugcuagauuacu

SEQ ID NO: 75705 - RNA, 22 nt, Human
uuugugcugacauuugggucau

SEQ ID NO: 75706 - RNA, 22 nt, Human
uuuguguauguaugcuuguaca

SEQ ID NO: 75707 - RNA, 22 nt, Human
uuugugucgucacugucuucuc

SEQ ID NO: 75708 - RNA, 22 nt, Human
uuugugugcgucuggccugggg

SEQ ID NO: 75709 - RNA, 22 nt, Human
uuuguguguauauguauauaga

SEQ ID NO: 75710 - RNA, 21 nt, Human
uuugugugucacgugcacagg

SEQ ID NO: 75711 - RNA, 22 nt, Human
uuuguguuuaugaaguuauucu

SEQ ID NO: 75712 - RNA, 22 nt, Human
aaaagguaguugccaaauaagg

SEQ ID NO: 75713 - RNA, 22 nt, Human
aaaagguuuugaguacaaauau

SEQ ID NO: 75714 - RNA, 22 nt, Human
aaaaguaauugcgguuuuugcu

SEQ ID NO: 75715 - RNA, 22 nt, Human
aaaaguaauugugguuuuugcu

SEQ ID NO: 75716 - RNA, 22 nt, Human
aaaaguauggugguccuuuuua

SEQ ID NO: 75717 - RNA, 22 nt, Human
aaaaguauuuuggaucucagau

SEQ ID NO: 75718 - RNA, 22 nt, Human
aaaagucuacaagcuucaacaa

SEQ ID NO: 75719 - RNA, 19 nt, Human
aaaagucuauucaauuaca

SEQ ID NO: 75720 - RNA, 22 nt, Human
aaaagugaggcagcccaaggga

SEQ ID NO: 75721 - RNA, 22 nt, Human
aaaaguuauugaugcaggacaa

SEQ ID NO: 75722 - RNA, 22 nt, Human
aaaaguucauuagugagcuucu

SEQ ID NO: 75723 - RNA, 22 nt, Human
aaaaguucccugguuagaaaag

SEQ ID NO: 75724 - RNA, 21 nt, Human
aaaaguuugacaggaaaggga

SEQ ID NO: 75725 - RNA, 22 nt, Human
aaaaguuugugcaaacacucag

SEQ ID NO: 75726 - RNA, 22 nt, Human
aaaauaaguugguccuguccuu

SEQ ID NO: 75727 - RNA, 22 nt, Human
aaaauacuacugucuucuuccc

SEQ ID NO: 75728 - RNA, 22 nt, Human
aaaauagauaaugccaggguca

SEQ ID NO: 75729 - RNA, 22 nt, Human
aaaauagcaugaaaggccuuug

SEQ ID NO: 75730 - RNA, 22 nt, Human
aaaauaugacugugcuccuuaa

SEQ ID NO: 75731 - RNA, 20 nt, Human
aaaauauguauaacucuucu

SEQ ID NO: 75732 - RNA, 22 nt, Human
aaaaucuaaguagcgaguaagg

SEQ ID NO: 75733 - RNA, 20 nt, Human
aaaaucucccagaaacuuau

SEQ ID NO: 75734 - RNA, 22 nt, Human
aaaaucuggcaacacuaaguuu

SEQ ID NO: 75735 - RNA, 22 nt, Human
aaaaugaacagaacaaugggga

SEQ ID NO: 75736 - RNA, 22 nt, Human
aaaaugagcauauugauccuuu

SEQ ID NO: 75737 - RNA, 22 nt, Human
aaaaugcuauuucauggaggag

SEQ ID NO: 75738 - RNA, 20 nt, Human
aaaauggccuuguauuaaaa

SEQ ID NO: 75739 - RNA, 21 nt, Human
aaaauguagacuuuucccuga

SEQ ID NO: 75740 - RNA, 22 nt, Human
aaaaugugcaguuuuuaagcug

SEQ ID NO: 75741 - RNA, 21 nt, Human
aaaauguuuccuuguugguua

SEQ ID NO: 75742 - RNA, 22 nt, Human
aaaauuaagugucugggaagcc

SEQ ID NO: 75743 - RNA, 22 nt, Human
aaaauuacuauuguuccugggc

SEQ ID NO: 75744 - RNA, 22 nt, Human
aaaauuauagaucuagugccug

SEQ ID NO: 75745 - RNA, 22 nt, Human
aaaauuauucauggcuuuugga

SEQ ID NO: 75746 - RNA, 22 nt, Human
aaaauucucuugaucuugacag

SEQ ID NO: 75747 - RNA, 17 nt, Human
aaaauucuguaaagagg

SEQ ID NO: 75748 - RNA, 22 nt, Human
aaaauucugucauuaaauugug

SEQ ID NO: 75749 - RNA, 22 nt, Human
aaaauugagaguuauagauggu

SEQ ID NO: 75750 - RNA, 22 nt, Human
aaaauuggacguagcuacucca

SEQ ID NO: 75751 - RNA, 22 nt, Human
aaaauugugaagguuucugaaa

SEQ ID NO: 75752 - RNA, 22 nt, Human
aaaauuuccaccaucuuugugu

SEQ ID NO: 75753 - RNA, 22 nt, Human
aaaauuuucagcuugacuugau

SEQ ID NO: 75754 - RNA, 20 nt, Human
aaacugucugucaguaucua

SEQ ID NO: 75755 - RNA, 22 nt, Human
aaacuguuauagcagaaaggac

SEQ ID NO: 75756 - RNA, 22 nt, Human
aaacuguugugguuuaucauua

SEQ ID NO: 75757 - RNA, 22 nt, Human
aaacuucaaggauuugcaaauc

SEQ ID NO: 75758 - RNA, 22 nt, Human
aaacuucaguaggagccaaccu

SEQ ID NO: 75759 - RNA, 22 nt, Human
aaacuucauggauaauauaaag

SEQ ID NO: 75760 - RNA, 22 nt, Human
aaacuucauuuucaacugcaaa

SEQ ID NO: 75761 - RNA, 22 nt, Human
aaacuucuggcuacaagcaaua

SEQ ID NO: 75762 - RNA, 22 nt, Human
aaacuugagucacuucucuucc

SEQ ID NO: 75763 - RNA, 22 nt, Human
aaacuuggccgcauccaccggg

SEQ ID NO: 75764 - RNA, 22 nt, Human
aaacuugugagcuaaauaaaug

SEQ ID NO: 75765 - RNA, 22 nt, Human
aaacuuuaaauuuguaccucug

SEQ ID NO: 75766 - RNA, 22 nt, Human
aaacuuuggauugugauugugc

SEQ ID NO: 75767 - RNA, 22 nt, Human
aaagaacaaaugauauaugguu

SEQ ID NO: 75768 - RNA, 22 nt, Human
aaagaacaauguggaaucuccu

SEQ ID NO: 75769 - RNA, 22 nt, Human
aaagaacucagagaggauuuua

SEQ ID NO: 75770 - RNA, 22 nt, Human
aaagaacuuaagaaauuaggcu

SEQ ID NO: 75771 - RNA, 19 nt, Human
aaagaacuuugggcuaggc

SEQ ID NO: 75772 - RNA, 22 nt, Human
aaagaagcuguggcucugggag

SEQ ID NO: 75773 - RNA, 18 nt, Human
aaagaaggauuggagagc

SEQ ID NO: 75774 - RNA, 22 nt, Human
aaagaaucacauccuucagcaa

SEQ ID NO: 75775 - RNA, 21 nt, Human
aaagaaucauggguaauuuca

SEQ ID NO: 75776 - RNA, 22 nt, Human
aaagacacaugucucuuagauu

SEQ ID NO: 75777 - RNA, 22 nt, Human
aaagacagagcuguaggggaaa

SEQ ID NO: 75778 - RNA, 22 nt, Human
aaagacauggcaagagaugggg

SEQ ID NO: 75779 - RNA, 22 nt, Human
aaagacauuagcuuagauguca

SEQ ID NO: 75780 - RNA, 22 nt, Human
aaagacauugaagaaggacuua

SEQ ID NO: 75781 - RNA, 22 nt, Human
aaagacuaaccaguugucaaaa

SEQ ID NO: 75782 - RNA, 23 nt, Human
aaagacugcugagaauuuuagga

SEQ ID NO: 75783 - RNA, 22 nt, Human
aaagacuggaaggugaggcugu

SEQ ID NO: 75784 - RNA, 21 nt, Human
aaagagacaaauggcauauac

SEQ ID NO: 75785 - RNA, 23 nt, Human
aaagagacugauacggaaguucc

SEQ ID NO: 75786 - RNA, 22 nt, Human
aaagagaugugccaaauagccu

SEQ ID NO: 75787 - RNA, 22 nt, Human
aaagagcaagcugagauuugaa

SEQ ID NO: 75788 - RNA, 21 nt, Human
aaagagcccgcugagagguuc

SEQ ID NO: 75789 - RNA, 22 nt, Human
aaagagcuaacauugccgagau

SEQ ID NO: 75790 - RNA, 22 nt, Human
aaagagcucacaguccacugga

SEQ ID NO: 75791 - RNA, 22 nt, Human
aaagaggaaccaagagcacgug

SEQ ID NO: 75792 - RNA, 22 nt, Human
aaagaggauggaguagucagcu

SEQ ID NO: 75793 - RNA, 22 nt, Human
aaagagucaaaggcaugucucu

SEQ ID NO: 75794 - RNA, 22 nt, Human
aaagagucuggcguuuuaaugg

SEQ ID NO: 75795 - RNA, 22 nt, Human
aaagaguucacggaggccaaag

SEQ ID NO: 75796 - RNA, 22 nt, Human
aaagaguuccaagucauuuuau

SEQ ID NO: 75797 - RNA, 22 nt, Human
aaagaguucuaugaucuuucca

SEQ ID NO: 75798 - RNA, 22 nt, Human
aaagaguuguuguauaacagga

SEQ ID NO: 75799 - RNA, 22 nt, Human
aaagauaauguuuccuuauucu

SEQ ID NO: 75800 - RNA, 22 nt, Human
aaagauacuuaauaguugucug

SEQ ID NO: 75801 - RNA, 20 nt, Human
aaagauacuuuuuguaaugg

SEQ ID NO: 75802 - RNA, 22 nt, Human
aaagaucagaggauagcugagu

SEQ ID NO: 75803 - RNA, 22 nt, Human
aaagaucaugcuguuuugugau

SEQ ID NO: 75804 - RNA, 22 nt, Human
aaagaucuaugggcauuuagcu

SEQ ID NO: 75805 - RNA, 22 nt, Human
aaagaugaguccggcagacaua

SEQ ID NO: 75806 - RNA, 22 nt, Human
aaagaugcauaaaugccaaugg

SEQ ID NO: 75807 - RNA, 23 nt, Human
aaagaugugaguauucauauggc

SEQ ID NO: 75808 - RNA, 22 nt, Human
aaagauguuaugaaauaacuau

SEQ ID NO: 75809 - RNA, 22 nt, Human
aaagauuaggcggcaacugggc

SEQ ID NO: 75810 - RNA, 22 nt, Human
aaagauuuaugaaguucaauua

SEQ ID NO: 75811 - RNA, 22 nt, Human
aaagcaaacagaaccccaagcu

SEQ ID NO: 75812 - RNA, 22 nt, Human
aaagcaaucagauucagauguc

SEQ ID NO: 75813 - RNA, 22 nt, Human
aaagcaaugcccguucauuauc

SEQ ID NO: 75814 - RNA, 22 nt, Human
aaagcaauggaugagaaucugu

SEQ ID NO: 75815 - RNA, 22 nt, Human
aaagcaauggcacaugauggua

SEQ ID NO: 75816 - RNA, 22 nt, Human
aaagcacagagcucccacagga

SEQ ID NO: 75817 - RNA, 22 nt, Human
aaagcacauuacaagcucaguc

SEQ ID NO: 75818 - RNA, 22 nt, Human
aaagcacuauagccaaauagcc

SEQ ID NO: 75819 - RNA, 22 nt, Human
aaagcacucguuaguauuucug

SEQ ID NO: 75820 - RNA, 22 nt, Human
aaagcagaacugagagagcugg

SEQ ID NO: 75821 - RNA, 22 nt, Human
aaacucuauaggcagaagcaau

SEQ ID NO: 75822 - RNA, 22 nt, Human
aaacucuauuucuguuggcuua

SEQ ID NO: 75823 - RNA, 22 nt, Human
aaacucucauuuuagugcacug

SEQ ID NO: 75824 - RNA, 22 nt, Human
aaacucuggagauguuuaugca

SEQ ID NO: 75825 - RNA, 22 nt, Human
aaacucuguugagauaauauuu

SEQ ID NO: 75826 - RNA, 22 nt, Human
aaacucuucauauacauaugcu

SEQ ID NO: 75827 - RNA, 22 nt, Human
aaacucuuuugcauauuagagg

SEQ ID NO: 75828 - RNA, 21 nt, Human
aaacugaagagacaggaacuu

SEQ ID NO: 75829 - RNA, 22 nt, Human
aaacugaaguagauucugaaau

SEQ ID NO: 75830 - RNA, 22 nt, Human
aaacugaauucaaguauccagu

SEQ ID NO: 75831 - RNA, 22 nt, Human
aaacugaauucccaagggcaug

SEQ ID NO: 75832 - RNA, 22 nt, Human
aaacugacaaucucaguccuau

SEQ ID NO: 75833 - RNA, 21 nt, Human
aaacugaccuugccugagaca

SEQ ID NO: 75834 - RNA, 22 nt, Human
aaacugaggaacaaggaaggau

SEQ ID NO: 75835 - RNA, 22 nt, Human
aaacugaugcucagagaggggc

SEQ ID NO: 75836 - RNA, 22 nt, Human
aaacugcuuuccacaguggcua

SEQ ID NO: 75837 - RNA, 22 nt, Human
aaacugggauucuucacaaggu

SEQ ID NO: 75838 - RNA, 22 nt, Human
aaacuggguuguggucaguggu

SEQ ID NO: 75839 - RNA, 22 nt, Human
aaacuggugucacugagggcug

SEQ ID NO: 75840 - RNA, 22 nt, Human
aaacuguauguugagaugacag

SEQ ID NO: 75841 - RNA, 22 nt, Human
aaacugugagcuaguaaauagg

SEQ ID NO: 75842 - RNA, 22 nt, Human
aaacugugcuucccaaaugccc

SEQ ID NO: 75843 - RNA, 22 nt, Human
aaacuucaacuggaaugggcua

SEQ ID NO: 75844 - RNA, 22 nt, Human
aaacuucaagauucaagccugg

SEQ ID NO: 75845 - RNA, 17 nt, Human
aaacuucacggucagcc

SEQ ID NO: 75846 - RNA, 22 nt, Human
aaacuugacaguagacagauua

SEQ ID NO: 75847 - RNA, 22 nt, Human
aaacuugacagugagacaguuu

SEQ ID NO: 75848 - RNA, 22 nt, Human
aaacuugagcagucagaugaag

SEQ ID NO: 75849 - RNA, 23 nt, Human
aaacuugcuauggcugaaaucau

SEQ ID NO: 75850 - RNA, 22 nt, Human
aaacuuguucucauguugcaga

SEQ ID NO: 75851 - RNA, 22 nt, Human
aaacuuuaagacaguccucaag

SEQ ID NO: 75852 - RNA, 22 nt, Human
aaacuuuaggaaggaauuuaca

SEQ ID NO: 75853 - RNA, 22 nt, Human
aaacuuugguauguagcaaaac

SEQ ID NO: 75854 - RNA, 22 nt, Human
aaacuuuguucguccagacuca

SEQ ID NO: 75855 - RNA, 22 nt, Human
aaacuuuguucgucugaugugg

SEQ ID NO: 75856 - RNA, 22 nt, Human
aaacuuuuauaaagcugcagau

SEQ ID NO: 75857 - RNA, 22 nt, Human
aaacuuuucuuggggaccugcc

SEQ ID NO: 75858 - RNA, 22 nt, Human
aaacuuuugguccucauggguu

SEQ ID NO: 75859 - RNA, 22 nt, Human
aaagaaaccuaucagccacaug

SEQ ID NO: 75860 - RNA, 22 nt, Human
aaagaaauaccuuucucagcuu

SEQ ID NO: 75861 - RNA, 22 nt, Human
aaagaaauagauggcauuuaaa

SEQ ID NO: 75862 - RNA, 22 nt, Human
aaagaacagauguguggugcau

SEQ ID NO: 75863 - RNA, 22 nt, Human
aaagaacuuauccuagaauuug

SEQ ID NO: 75864 - RNA, 22 nt, Human
aaagaagacagacauuucuuuc

SEQ ID NO: 75865 - RNA, 22 nt, Human
aaagaagagcaaauuuguugua

SEQ ID NO: 75866 - RNA, 22 nt, Human
aaagaaggaugggagaaauccu

SEQ ID NO: 75867 - RNA, 22 nt, Human
aaagaagguagggcuggugacu

SEQ ID NO: 75868 - RNA, 22 nt, Human
aaagaaguguugaauuugcaag

SEQ ID NO: 75869 - RNA, 22 nt, Human
aaagaauuuguacacccuacua

SEQ ID NO: 75870 - RNA, 22 nt, Human
aaagacacacagugcuucaguu

SEQ ID NO: 75871 - RNA, 22 nt, Human
aaacaaagcaucuugcuaugca

SEQ ID NO: 75872 - RNA, 22 nt, Human
aaacaaagccagggaaguuaug

SEQ ID NO: 75873 - RNA, 22 nt, Human
aaacaacaauccaaugggagcu

SEQ ID NO: 75874 - RNA, 22 nt, Human
aaacaacucggcaacugcuuuu

SEQ ID NO: 75875 - RNA, 22 nt, Human
aaacaagguacacaguaauggu

SEQ ID NO: 75876 - RNA, 22 nt, Human
aaacaagucacuuuaucuugaa

SEQ ID NO: 75877 - RNA, 22 nt, Human
aaacaauccaggaaccuguuua

SEQ ID NO: 75878 - RNA, 22 nt, Human
aaacaaugaaauucauucuuca

SEQ ID NO: 75879 - RNA, 22 nt, Human
aaacaauguagauuaccauuua

SEQ ID NO: 75880 - RNA, 22 nt, Human
aaacacaagauggccucuucug

SEQ ID NO: 75881 - RNA, 22 nt, Human
aaacacaccuuuggaacuguga

SEQ ID NO: 75882 - RNA, 19 nt, Human
aaacacagauuucuuacca

SEQ ID NO: 75883 - RNA, 22 nt, Human
aaacacagggauauauauucca

SEQ ID NO: 75884 - RNA, 22 nt, Human
aaacaccagcacuguuuacaaa

SEQ ID NO: 75885 - RNA, 22 nt, Human
aaacaccagucccaguauacac

SEQ ID NO: 75886 - RNA, 22 nt, Human
aaacacguauaaugugacagag

SEQ ID NO: 75887 - RNA, 22 nt, Human
aaacacugauggauauuuuucc

SEQ ID NO: 75888 - RNA, 20 nt, Human
aaacacuggcuggggcacag

SEQ ID NO: 75889 - RNA, 22 nt, Human
aaacacuguacaaucugcaggg

SEQ ID NO: 75890 - RNA, 22 nt, Human
aaacacugucucugguauugaa

SEQ ID NO: 75891 - RNA, 22 nt, Human
aaacacuuccuguaacaugaca

SEQ ID NO: 75892 - RNA, 21 nt, Human
aaacagagcugaguaauagau

SEQ ID NO: 75893 - RNA, 22 nt, Human
aaacagcugcacugcugauguc

SEQ ID NO: 75894 - RNA, 22 nt, Human
aaacagcuggucucaaauguuc

SEQ ID NO: 75895 - RNA, 22 nt, Human
aaacagcuuguaagguguaauu

SEQ ID NO: 75896 - RNA, 22 nt, Human
aaacaggcaucacucagcaaag

SEQ ID NO: 75897 - RNA, 22 nt, Human
aaacaguagaaguguauuuuau

SEQ ID NO: 75898 - RNA, 22 nt, Human
aaacaguauuaucaauauauuu

SEQ ID NO: 75899 - RNA, 22 nt, Human
aaacagucaaaggccuaagcua

SEQ ID NO: 75900 - RNA, 22 nt, Human
aaacaguccucuuuauuuaguc

SEQ ID NO: 75901 - RNA, 22 nt, Human
aaacagucugaugccaucugcc

SEQ ID NO: 75902 - RNA, 22 nt, Human
aaacagucuugugggcuuggag

SEQ ID NO: 75903 - RNA, 22 nt, Human
aaacagugacugguacauaaua

SEQ ID NO: 75904 - RNA, 17 nt, Human
aaacagugaguguuaug

SEQ ID NO: 75905 - RNA, 22 nt, Human
aaacagugcaggaaguuaagca

SEQ ID NO: 75906 - RNA, 18 nt, Human
aaacagugccuaaguguc

SEQ ID NO: 75907 - RNA, 22 nt, Human
aaacaguguguuucagagaggc

SEQ ID NO: 75908 - RNA, 22 nt, Human
aaacaguuacgagcgcagaccu

SEQ ID NO: 75909 - RNA, 22 nt, Human
aaacaguucucauuuguuuaga

SEQ ID NO: 75910 - RNA, 22 nt, Human
aaacaguucuccaggaagccag

SEQ ID NO: 75911 - RNA, 22 nt, Human
aaacaguuuucucauuuagugu

SEQ ID NO: 75912 - RNA, 22 nt, Human
aaacauagcacacacagcucuu

SEQ ID NO: 75913 - RNA, 22 nt, Human
aaacaucaauugcaucucccaa

SEQ ID NO: 75914 - RNA, 22 nt, Human
aaacaucauaggcaugcaugau

SEQ ID NO: 75915 - RNA, 22 nt, Human
aaacaucugacuugcuuuuuca

SEQ ID NO: 75916 - RNA, 22 nt, Human
aaacaucuucucuugauucuuu

SEQ ID NO: 75917 - RNA, 22 nt, Human
aaacaugaugccuguacuaaga

SEQ ID NO: 75918 - RNA, 22 nt, Human
aaacaugcuggauuuagaauau

SEQ ID NO: 75919 - RNA, 22 nt, Human
aaacauggccauucagacugug

SEQ ID NO: 75920 - RNA, 22 nt, Human
aaacauguaaguucagaucacc

SEQ ID NO: 75921 - RNA, 22 nt, Human
aaacauguagugcaugaggauc

SEQ ID NO: 75922 - RNA, 22 nt, Human
aaacauguuuagaaagcagcug

SEQ ID NO: 75923 - RNA, 22 nt, Human
aaacauucacucucaauuuuag

SEQ ID NO: 75924 - RNA, 22 nt, Human
aaacauuccauauauaccuugu

SEQ ID NO: 75925 - RNA, 22 nt, Human
aaacauucccuaauguguccgu

SEQ ID NO: 75926 - RNA, 22 nt, Human
aaacauugcuaaauaaugcugc

SEQ ID NO: 75927 - RNA, 23 nt, Human
aaacauuucucuuuuccugccuc

SEQ ID NO: 75928 - RNA, 22 nt, Human
aaacauuuuucuaggucuuggu

SEQ ID NO: 75929 - RNA, 22 nt, Human
aaacccaucugucugucugcag

SEQ ID NO: 75930 - RNA, 22 nt, Human
aagaaucaucugaacuuugagg

SEQ ID NO: 75931 - RNA, 23 nt, Human
aagaaucucagaauuagaaauac

SEQ ID NO: 75932 - RNA, 22 nt, Human
aagaaucuccaucugauucacu

SEQ ID NO: 75933 - RNA, 22 nt, Human
aagaaucuccauuccuguuuua

SEQ ID NO: 75934 - RNA, 22 nt, Human
aagaaucucugaucaggcuuua

SEQ ID NO: 75935 - RNA, 22 nt, Human
aagaaucugacauaauuuccug

SEQ ID NO: 75936 - RNA, 22 nt, Human
aagaaugauuacaaagcaacga

SEQ ID NO: 75937 - RNA, 22 nt, Human
aagaaugucucuggugaggcgc

SEQ ID NO: 75938 - RNA, 22 nt, Human
aagaaugugcuaaugaaaacuu

SEQ ID NO: 75939 - RNA, 22 nt, Human
aagaauguggguggauaugaug

SEQ ID NO: 75940 - RNA, 22 nt, Human
aagaauguuaguuucugauaca

SEQ ID NO: 75941 - RNA, 22 nt, Human
aagaauguucauuaaacuguug

SEQ ID NO: 75942 - RNA, 22 nt, Human
aagaauuuaaacuaaccauaug

SEQ ID NO: 75943 - RNA, 22 nt, Human
aagacaaagggguccuuggaug

SEQ ID NO: 75944 - RNA, 17 nt, Human
aagacaagacaaaugca

SEQ ID NO: 75945 - RNA, 22 nt, Human
aagacaaugcauuacuaagaag

SEQ ID NO: 75946 - RNA, 22 nt, Human
aagacaauuugauacuaguugc

SEQ ID NO: 75947 - RNA, 22 nt, Human
aagacacaaagcuucccuuuuc

SEQ ID NO: 75948 - RNA, 22 nt, Human
aagacacagcgaaauguuccug

SEQ ID NO: 75949 - RNA, 22 nt, Human
aagacaccauuugacaguggca

SEQ ID NO: 75950 - RNA, 22 nt, Human
aagacacuggguuaggcacgug

SEQ ID NO: 75951 - RNA, 21 nt, Human
aagacagaaaagccuauuuuc

SEQ ID NO: 75952 - RNA, 22 nt, Human
aagacagagacucugcaacagg

SEQ ID NO: 75953 - RNA, 22 nt, Human
aagacagagggaagcaaugaug

SEQ ID NO: 75954 - RNA, 22 nt, Human
aagacagugaucucugagagau

SEQ ID NO: 75955 - RNA, 22 nt, Human
aagacagugugucaggcaggug

SEQ ID NO: 75956 - RNA, 22 nt, Human
aagacauuacuggaaucugacu

SEQ ID NO: 75957 - RNA, 22 nt, Human
aagacauugcugcuuuuaauug

SEQ ID NO: 75958 - RNA, 22 nt, Human
aagacauuggcauugacuguaa

SEQ ID NO: 75959 - RNA, 22 nt, Human
aagacauugucauuuuauaauu

SEQ ID NO: 75960 - RNA, 22 nt, Human
aagacauuuuagagauagggaa

SEQ ID NO: 75961 - RNA, 22 nt, Human
aagaccagaggauauaaccaga

SEQ ID NO: 75962 - RNA, 22 nt, Human
aagacccuauacucagugaccc

SEQ ID NO: 75963 - RNA, 22 nt, Human
aagaccucugaaguaccuggug

SEQ ID NO: 75964 - RNA, 22 nt, Human
aagaccugccagccucauccug

SEQ ID NO: 75965 - RNA, 22 nt, Human
aagacgggagucaggugagcuc

SEQ ID NO: 75966 - RNA, 22 nt, Human
aagacucuaucuuuagagauca

SEQ ID NO: 75967 - RNA, 22 nt, Human
aagacugaguggcuuaagaaaa

SEQ ID NO: 75968 - RNA, 22 nt, Human
aagacuguacauuuuccagucu

SEQ ID NO: 75969 - RNA, 22 nt, Human
aagacuuauagucaguaauucu

SEQ ID NO: 75970 - RNA, 22 nt, Human
aagacuugaccagguugaaggc

SEQ ID NO: 75971 - RNA, 22 nt, Human
aagacuuucaaguaugcaugca

SEQ ID NO: 75972 - RNA, 20 nt, Human
aagagaagaagucuuugaaa

SEQ ID NO: 75973 - RNA, 22 nt, Human
aagagaaggauucugagccugg

SEQ ID NO: 75974 - RNA, 22 nt, Human
aagagaaggcccugacccaccc

SEQ ID NO: 75975 - RNA, 22 nt, Human
aagagaauaucgauagcacucu

SEQ ID NO: 75976 - RNA, 22 nt, Human
aagagaaugacaaggagaaccu

SEQ ID NO: 75977 - RNA, 22 nt, Human
aagagaauucugguuuuccuau

SEQ ID NO: 75978 - RNA, 22 nt, Human
aagagacaaugucuuuuggaua

SEQ ID NO: 75979 - RNA, 22 nt, Human
aagagacagagccauguuucua

SEQ ID NO: 75980 - RNA, 22 nt, Human
aagagacuaagaaagggcaaua

SEQ ID NO: 75981 - RNA, 22 nt, Human
aagagagaacucccuucgccag

SEQ ID NO: 75982 - RNA, 22 nt, Human
aagagagaagucucucugguuc

SEQ ID NO: 75983 - RNA, 22 nt, Human
aagagagagugcgcucacagaa

SEQ ID NO: 75984 - RNA, 22 nt, Human
aagagaggacauggugaaccug

SEQ ID NO: 75985 - RNA, 17 nt, Human
aagagaggcugagcugg

SEQ ID NO: 75986 - RNA, 22 nt, Human
aagagagggauuugguuuauug

SEQ ID NO: 75987 - RNA, 22 nt, Human
aagagaugaagguccugacugu

SEQ ID NO: 75988 - RNA, 22 nt, Human
aagagauuccucacucagaaug

SEQ ID NO: 75989 - RNA, 23 nt, Human
aagagcagggaauauuuauuugc

SEQ ID NO: 75990 - RNA, 20 nt, Human
aagagcauaguacaggaaga

SEQ ID NO: 75991 - RNA, 22 nt, Human
aagagcauauauguauguuugu

SEQ ID NO: 75992 - RNA, 22 nt, Human
aagagcaucaaugacucgcagu

SEQ ID NO: 75993 - RNA, 22 nt, Human
aagagcccugguugaaaauaac

SEQ ID NO: 75994 - RNA, 21 nt, Human
aagagcucuuuuguuaugguc

SEQ ID NO: 75995 - RNA, 20 nt, Human
aagagcugacucacaguggu

SEQ ID NO: 75996 - RNA, 22 nt, Human
aagagcugcacauauuuauauc

SEQ ID NO: 75997 - RNA, 22 nt, Human
aagagcugcaucuaagccauga

SEQ ID NO: 75998 - RNA, 21 nt, Human
aagagcuggaucaaggauaag

SEQ ID NO: 75999 - RNA, 22 nt, Human
aagagcuggaugaagaaaucaa

SEQ ID NO: 76000 - RNA, 22 nt, Human
aagagcuucccuguuguagagg

SEQ ID NO: 76001 - RNA, 22 nt, Human
aagagcuuggacuuucaaguca

SEQ ID NO: 76002 - RNA, 18 nt, Human
aagaggaggaaacccagg

SEQ ID NO: 76003 - RNA, 22 nt, Human
aagaggaggacgguucccagaa

SEQ ID NO: 76004 - RNA, 18 nt, Human
aagaggaggagcagguug

SEQ ID NO: 76005 - RNA, 22 nt, Human
aagaggaggaugcuuuacagcu

SEQ ID NO: 76006 - RNA, 22 nt, Human
aagaggaggauugaugugggag

SEQ ID NO: 76007 - RNA, 22 nt, Human
aagaggaguagaugugguuggu

SEQ ID NO: 76008 - RNA, 22 nt, Human
aagaggcagaaauaucgcugaa

SEQ ID NO: 76009 - RNA, 22 nt, Human
aagaggcuucagauccuucaga

SEQ ID NO: 76010 - RNA, 22 nt, Human
aagagggagggcaaaggcacug

SEQ ID NO: 76011 - RNA, 22 nt, Human
aagagggaggugcgggugcaga

SEQ ID NO: 76012 - RNA, 22 nt, Human
aagagggcagcacagguggguc

SEQ ID NO: 76013 - RNA, 22 nt, Human
aagaggggugugugucaaccca

SEQ ID NO: 76014 - RNA, 22 nt, Human
aagagguaaugacugcuugagu

SEQ ID NO: 76015 - RNA, 20 nt, Human
aagaggugauaacaggugag

SEQ ID NO: 76016 - RNA, 22 nt, Human
aagagguggguuggacagauac

SEQ ID NO: 76017 - RNA, 22 nt, Human
aagagguuuaacugacucacag

SEQ ID NO: 76018 - RNA, 22 nt, Human
aagaguaugcaugcauguuugu

SEQ ID NO: 76019 - RNA, 22 nt, Human
aagagucacuccauaaauccca

SEQ ID NO: 76020 - RNA, 22 nt, Human
aagagugaguauuuccugauua

SEQ ID NO: 76021 - RNA, 20 nt, Human
aacacagauaccaaagguug

SEQ ID NO: 76022 - RNA, 22 nt, Human
aacacagcaucccuuaggucgu

SEQ ID NO: 76023 - RNA, 22 nt, Human
aacacaggaaauugguaaaugg

SEQ ID NO: 76024 - RNA, 22 nt, Human
aacacaggcauacuggcuccag

SEQ ID NO: 76025 - RNA, 20 nt, Human
aacacaggguuaccaucaga

SEQ ID NO: 76026 - RNA, 22 nt, Human
aacacauaggcagagcaugaca

SEQ ID NO: 76027 - RNA, 22 nt, Human
aacacauauuuuugcugagcau

SEQ ID NO: 76028 - RNA, 22 nt, Human
aacacaugaaaguuggugagua

SEQ ID NO: 76029 - RNA, 22 nt, Human
aacacaugccuuaagaauaagu

SEQ ID NO: 76030 - RNA, 19 nt, Human
aacaccagagucaggaguc

SEQ ID NO: 76031 - RNA, 22 nt, Human
aacacuaacauauagucagugg

SEQ ID NO: 76032 - RNA, 22 nt, Human
aacacuaaugggagaacaaccc

SEQ ID NO: 76033 - RNA, 22 nt, Human
aacacuagucuagaccagacca

SEQ ID NO: 76034 - RNA, 22 nt, Human
aacacuaucugccuuacaggga

SEQ ID NO: 76035 - RNA, 22 nt, Human
aacacugaagaccagguaauuu

SEQ ID NO: 76036 - RNA, 22 nt, Human
aacacugaagccguuaaaccuu

SEQ ID NO: 76037 - RNA, 22 nt, Human
aacacugacgacgugaacuaaa

SEQ ID NO: 76038 - RNA, 22 nt, Human
aacacugagcuauuacggugga

SEQ ID NO: 76039 - RNA, 22 nt, Human
aacaggcacuaagcaugugggg

SEQ ID NO: 76040 - RNA, 22 nt, Human
aacaggcagcagacugaaucug

SEQ ID NO: 76041 - RNA, 22 nt, Human
aacaggcccugccauuuaucca

SEQ ID NO: 76042 - RNA, 22 nt, Human
aacaggcuauuucuuuacaaac

SEQ ID NO: 76043 - RNA, 22 nt, Human
aacaggcuccaugaacaacgug

SEQ ID NO: 76044 - RNA, 22 nt, Human
aacaggcuccuugugaauggau

SEQ ID NO: 76045 - RNA, 22 nt, Human
aacaggcuggccuugaagcagu

SEQ ID NO: 76046 - RNA, 22 nt, Human
aacaggcuuccaggagggacga

SEQ ID NO: 76047 - RNA, 22 nt, Human
aacaggcuuuuggaaaguuaca

SEQ ID NO: 76048 - RNA, 22 nt, Human
aacagggacaaggauagagaaa

SEQ ID NO: 76049 - RNA, 20 nt, Human
aacagggcagaagcggagac

SEQ ID NO: 76050 - RNA, 22 nt, Human
aacaguaauggcauugccauga

SEQ ID NO: 76051 - RNA, 22 nt, Human
aacaguaaugugguguuggguu

SEQ ID NO: 76052 - RNA, 22 nt, Human
aacaguacaacuccacaagacu

SEQ ID NO: 76053 - RNA, 22 nt, Human
aacaguacuggacaaggaguca

SEQ ID NO: 76054 - RNA, 22 nt, Human
aacaguacuugauaauuugcac

SEQ ID NO: 76055 - RNA, 20 nt, Human
aacagucaaauguugauugc

SEQ ID NO: 76056 - RNA, 22 nt, Human
aacagucuaaauuauacccuuu

SEQ ID NO: 76057 - RNA, 22 nt, Human
aacagucuacugaauaucugcg

SEQ ID NO: 76058 - RNA, 20 nt, Human
aacagugaaugaggccagag

SEQ ID NO: 76059 - RNA, 22 nt, Human
aacagugagaagguggacagga

SEQ ID NO: 76060 - RNA, 22 nt, Human
aacagugcugauuauuuuaccu

SEQ ID NO: 76061 - RNA, 22 nt, Human
aacaguggucuggggaguggag

SEQ ID NO: 76062 - RNA, 22 nt, Human
aacagugucaggauuacagaua

SEQ ID NO: 76063 - RNA, 22 nt, Human
aacaguguguuuuguuauuaag

SEQ ID NO: 76064 - RNA, 22 nt, Human
aacaguugauguagcuuuggag

SEQ ID NO: 76065 - RNA, 22 nt, Human
aacaguuuaucaaguuuuuaca

SEQ ID NO: 76066 - RNA, 22 nt, Human
aacaguuugccugaaauguauu

SEQ ID NO: 76067 - RNA, 22 nt, Human
aacaguuuguggauagcuugua

SEQ ID NO: 76068 - RNA, 22 nt, Human
aacauaauguggccaaagucac

SEQ ID NO: 76069 - RNA, 22 nt, Human
aacauacuuauacuaaauaaug

SEQ ID NO: 76070 - RNA, 22 nt, Human
aacauacuuguacuaugcauau

SEQ ID NO: 76071 - RNA, 22 nt, Human
aacauagaagaugguuaauugu

SEQ ID NO: 76072 - RNA, 22 nt, Human
aacauagaauuguuauauuuuc

SEQ ID NO: 76073 - RNA, 22 nt, Human
aacauauuuggcugauauuccc

SEQ ID NO: 76074 - RNA, 22 nt, Human
aacaucagaaguagaagacuca

SEQ ID NO: 76075 - RNA, 22 nt, Human
aacaucagcacacaauagcaag

SEQ ID NO: 76076 - RNA, 22 nt, Human
aacaucaucaugaacaacuaau

SEQ ID NO: 76077 - RNA, 22 nt, Human
aacaucucagaagugacccuga

SEQ ID NO: 76078 - RNA, 22 nt, Human
aacaucucauggacuacauucu

SEQ ID NO: 76079 - RNA, 22 nt, Human
aacaucuuaagauagaagggga

SEQ ID NO: 76080 - RNA, 22 nt, Human
aacaucuugaagauugggaaag

SEQ ID NO: 76081 - RNA, 22 nt, Human
aacaucuuguacugcacauuuu

SEQ ID NO: 76082 - RNA, 19 nt, Human
aacaucuuuccaguagagg

SEQ ID NO: 76083 - RNA, 22 nt, Human
aacaucuuugauaaacuuagug

SEQ ID NO: 76084 - RNA, 22 nt, Human
aacaugaaaagcccagagaggu

SEQ ID NO: 76085 - RNA, 22 nt, Human
aacaugaaaguugcuaagugca

SEQ ID NO: 76086 - RNA, 22 nt, Human
aacaugaagguaggaugguuuu

SEQ ID NO: 76087 - RNA, 22 nt, Human
aacaugagcauucuugugcuug

SEQ ID NO: 76088 - RNA, 21 nt, Human
aacaugauauguguauggauu

SEQ ID NO: 76089 - RNA, 22 nt, Human
aacaugaugacaaagguauauu

SEQ ID NO: 76090 - RNA, 22 nt, Human
aacaugauggggaagaacaaga

SEQ ID NO: 76091 - RNA, 22 nt, Human
aacaugauuuaguauaaugcag

SEQ ID NO: 76092 - RNA, 22 nt, Human
aacaugcauuugugggauggaa

SEQ ID NO: 76093 - RNA, 22 nt, Human
aacaugcuaugugucugaauca

SEQ ID NO: 76094 - RNA, 22 nt, Human
aacaugugucuggcuagauugu

SEQ ID NO: 76095 - RNA, 22 nt, Human
aacauucaaaacccaguucagu

SEQ ID NO: 76096 - RNA, 22 nt, Human
aacauucagcuggguggagcag

SEQ ID NO: 76097 - RNA, 22 nt, Human
aacauucucauugggauaugug

SEQ ID NO: 76098 - RNA, 22 nt, Human
aacauucuuuggaggauuauuc

SEQ ID NO: 76099 - RNA, 22 nt, Human
aacauugaaauauuugcaauag

SEQ ID NO: 76100 - RNA, 22 nt, Human
aacauugaauuuaaaauacagu

SEQ ID NO: 76101 - RNA, 22 nt, Human
aacauugagcucuggaguggaa

SEQ ID NO: 76102 - RNA, 22 nt, Human
aacauugagcugguggagagga

SEQ ID NO: 76103 - RNA, 22 nt, Human
aacauugccaugguuaauuuua

SEQ ID NO: 76104 - RNA, 22 nt, Human
aacauugcugaaagcugggaca

SEQ ID NO: 76105 - RNA, 20 nt, Human
aacauuguuuguaaaagcag

SEQ ID NO: 76106 - RNA, 22 nt, Human
aacauuguuuucccuauaucca

SEQ ID NO: 76107 - RNA, 22 nt, Human
aacauuguuuugcacaacucuu

SEQ ID NO: 76108 - RNA, 21 nt, Human
aacauuucaggauccaaauug

SEQ ID NO: 76109 - RNA, 22 nt, Human
aacauuuccggccuuuuguucu

SEQ ID NO: 76110 - RNA, 21 nt, Human
aacauuucugggagaacucac

SEQ ID NO: 76111 - RNA, 22 nt, Human
aacauuugcagaggaaagcuau

SEQ ID NO: 76112 - RNA, 23 nt, Human
aacauuuguaaggugauuuuguu

SEQ ID NO: 76113 - RNA, 22 nt, Human
aacauuuguuucguuaugugaa

SEQ ID NO: 76114 - RNA, 22 nt, Human
aacauuuguuuggcuucaauua

SEQ ID NO: 76115 - RNA, 22 nt, Human
aaccaaggacagcuagugaugc

SEQ ID NO: 76116 - RNA, 22 nt, Human
aaccacaacacuaaaugcuggu

SEQ ID NO: 76117 - RNA, 22 nt, Human
aaccacagacccagacuagaga

SEQ ID NO: 76118 - RNA, 22 nt, Human
aaccacagagcccccucagaug

SEQ ID NO: 76119 - RNA, 22 nt, Human
aaccacaugaaaagaguaauau

SEQ ID NO: 76120 - RNA, 22 nt, Human
aaccaccaccaucuaguuccaa

SEQ ID NO: 76121 - RNA, 22 nt, Human
aaccagaaggaaucugagcuga

SEQ ID NO: 76122 - RNA, 22 nt, Human
aaccagagaaauggagugauaa

SEQ ID NO: 76123 - RNA, 22 nt, Human
aaccagagagucuucuucauug

SEQ ID NO: 76124 - RNA, 22 nt, Human
aaccagaucgacuguuaacagc

SEQ ID NO: 76125 - RNA, 22 nt, Human
aaccagcuaaacuuugcucgaa

SEQ ID NO: 76126 - RNA, 22 nt, Human
aaccagcugagaaugcuucugc

SEQ ID NO: 76127 - RNA, 22 nt, Human
aaccaggaaaaguuaugaauag

SEQ ID NO: 76128 - RNA, 22 nt, Human
aaccaggaauugcagggcugca

SEQ ID NO: 76129 - RNA, 22 nt, Human
aaccaggacaauuugaauagaa

SEQ ID NO: 76130 - RNA, 22 nt, Human
aaccaggacaauuuugaaagua

SEQ ID NO: 76131 - RNA, 20 nt, Human
aaccaguacccaaguaggaa

SEQ ID NO: 76132 - RNA, 22 nt, Human
aaccaguauguuuaggagguga

SEQ ID NO: 76133 - RNA, 22 nt, Human
aaccaguuguauguccuccagc

SEQ ID NO: 76134 - RNA, 22 nt, Human
aaccaguuuaagcaaauaacug

SEQ ID NO: 76135 - RNA, 22 nt, Human
aaccauuagucaaucagcaaga

SEQ ID NO: 76136 - RNA, 22 nt, Human
aaccauucacaguguagccaaa

SEQ ID NO: 76137 - RNA, 22 nt, Human
aaccauucacugaacaguucaa

SEQ ID NO: 76138 - RNA, 22 nt, Human
aagaguuaaaugaaugaguggg

SEQ ID NO: 76139 - RNA, 22 nt, Human
aagaguuagcucaauaacuuga

SEQ ID NO: 76140 - RNA, 22 nt, Human
aagaguuuaauuuugucuagac

SEQ ID NO: 76141 - RNA, 22 nt, Human
aagaguuuaccagugcugcuuc

SEQ ID NO: 76142 - RNA, 23 nt, Human
aagaguuuagagucuugcagagu

SEQ ID NO: 76143 - RNA, 22 nt, Human
aagaguuuccaugcucugugcu

SEQ ID NO: 76144 - RNA, 22 nt, Human
aagaguuucugggucaaggauu

SEQ ID NO: 76145 - RNA, 22 nt, Human
aagaguuuucucugauggcauu

SEQ ID NO: 76146 - RNA, 22 nt, Human
aagauaaguaacgagccucagu

SEQ ID NO: 76147 - RNA, 22 nt, Human
aagauacacguuguauugaaua

SEQ ID NO: 76148 - RNA, 22 nt, Human
aagggcccggcugugggcagag

SEQ ID NO: 76149 - RNA, 22 nt, Human
aagggcugaaagaccuugggca

SEQ ID NO: 76150 - RNA, 22 nt, Human
aagggcugaucucacuuucuuu

SEQ ID NO: 76151 - RNA, 22 nt, Human
aagggcugcuguagaagcagag

SEQ ID NO: 76152 - RNA, 22 nt, Human
aagggcuggagaggaaagguug

SEQ ID NO: 76153 - RNA, 22 nt, Human
aagggcuggcccugggaagagu

SEQ ID NO: 76154 - RNA, 22 nt, Human
aagggcuguaguuuguugauca

SEQ ID NO: 76155 - RNA, 22 nt, Human
aaggggaaguagcaccagaggu

SEQ ID NO: 76156 - RNA, 22 nt, Human
aaggggaguuagugauaaaacc

SEQ ID NO: 76157 - RNA, 22 nt, Human
aaggggauuuaagguaagaaga

SEQ ID NO: 76158 - RNA, 21 nt, Human
aaggggcaaacccaggacacc

SEQ ID NO: 76159 - RNA, 22 nt, Human
aaggggcaugcuuuugccagga

SEQ ID NO: 76160 - RNA, 22 nt, Human
aagggggccacaccugguguga

SEQ ID NO: 76161 - RNA, 22 nt, Human
aagggggcccagcacuaaguug

SEQ ID NO: 76162 - RNA, 19 nt, Human
aagggucacaagcagcaga

SEQ ID NO: 76163 - RNA, 22 nt, Human
aagggugggcaccgccagguca

SEQ ID NO: 76164 - RNA, 22 nt, Human
aagggugggcccuggcagccau

SEQ ID NO: 76165 - RNA, 22 nt, Human
aaggguuggggaagagcaaauu

SEQ ID NO: 76166 - RNA, 22 nt, Human
aagguaaugaaacagcagcuaa

SEQ ID NO: 76167 - RNA, 22 nt, Human
aagguacaaaguauuauuuaaa

SEQ ID NO: 76168 - RNA, 22 nt, Human
aagguacaaaguuauacagcgu

SEQ ID NO: 76169 - RNA, 22 nt, Human
aagguacagaaauuaacaagga

SEQ ID NO: 76170 - RNA, 22 nt, Human
aagguacaggcauugcugcagc

SEQ ID NO: 76171 - RNA, 22 nt, Human
aagguacagggaaggagcaaga

SEQ ID NO: 76172 - RNA, 22 nt, Human
aagguacaguuuuaagaauaag

SEQ ID NO: 76173 - RNA, 22 nt, Human
aagguauagaguuuggaaaaau

SEQ ID NO: 76174 - RNA, 22 nt, Human
aagguauaucugauccaugagg

SEQ ID NO: 76175 - RNA, 22 nt, Human
aagguauuauuugcaaucauuu

SEQ ID NO: 76176 - RNA, 22 nt, Human
aagguauuggggaauauuugac

SEQ ID NO: 76177 - RNA, 18 nt, Human
aagucucugaaagcuuuu

SEQ ID NO: 76178 - RNA, 22 nt, Human
aagucugagugucagugcaagu

SEQ ID NO: 76179 - RNA, 22 nt, Human
aagucuggaaccucaugcuggc

SEQ ID NO: 76180 - RNA, 18 nt, Human
aagucuggcagcuuuccc

SEQ ID NO: 76181 - RNA, 21 nt, Human
aagucugguugauuccuuugc

SEQ ID NO: 76182 - RNA, 22 nt, Human
aagucuuagcaacuaucgcuuu

SEQ ID NO: 76183 - RNA, 22 nt, Human
aagucuuaggaaauagcaaaga

SEQ ID NO: 76184 - RNA, 22 nt, Human
aagucuucagacuggagagauu

SEQ ID NO: 76185 - RNA, 22 nt, Human
aagucuuuugcugucauaggug

SEQ ID NO: 76186 - RNA, 22 nt, Human
aagucuuuuguucaggcuggca

SEQ ID NO: 76187 - RNA, 22 nt, Human
aagugaaauugccauucuuaua

SEQ ID NO: 76188 - RNA, 22 nt, Human
aagugaauaaaauuguguucuu

SEQ ID NO: 76189 - RNA, 22 nt, Human
aagugaaugaugugaaguguaa

SEQ ID NO: 76190 - RNA, 22 nt, Human
aagugaauuucauuccaauucu

SEQ ID NO: 76191 - RNA, 22 nt, Human
aagugacaaaaggguauccaaa

SEQ ID NO: 76192 - RNA, 22 nt, Human
aagugacacauuugugaugaau

SEQ ID NO: 76193 - RNA, 22 nt, Human
aagugacaccucuucccuuucc

SEQ ID NO: 76194 - RNA, 22 nt, Human
aagugacauaccuuacauaugu

SEQ ID NO: 76195 - RNA, 22 nt, Human
aagugaccucaugguuucuccu

SEQ ID NO: 76196 - RNA, 22 nt, Human
aagugacuauuugaguacauca

SEQ ID NO: 76197 - RNA, 22 nt, Human
aagugagauuauauguacggga

SEQ ID NO: 76198 - RNA, 22 nt, Human
aagugauuauuuaaugcgguuu

SEQ ID NO: 76199 - RNA, 22 nt, Human
aagugauucauugaugaugagg

SEQ ID NO: 76200 - RNA, 22 nt, Human
aagugauuuagucuuauaaagg

SEQ ID NO: 76201 - RNA, 22 nt, Human
aagugauuuucuucuuaguuau

SEQ ID NO: 76202 - RNA, 22 nt, Human
aagugcaaauuuaagaaggcau

SEQ ID NO: 76203 - RNA, 22 nt, Human
aagugcauaaguaugauuauuu

SEQ ID NO: 76204 - RNA, 22 nt, Human
aagugccugaccuagccuggag

SEQ ID NO: 76205 - RNA, 22 nt, Human
aagugcugggauuacaggcguc

SEQ ID NO: 76206 - RNA, 22 nt, Human
aagugcuuagaaguugcauuag

SEQ ID NO: 76207 - RNA, 22 nt, Human
aagugcuuaggucaaaggacau

SEQ ID NO: 76208 - RNA, 22 nt, Human
aagugcuuccauguuugagugu

SEQ ID NO: 76209 - RNA, 22 nt, Human
aagugcuuggcuaaugguuaug

SEQ ID NO: 76210 - RNA, 22 nt, Human
aagugcuuuauaaacaaugaag

SEQ ID NO: 76211 - RNA, 22 nt, Human
aagugcuuucauauagucuuaa

SEQ ID NO: 76212 - RNA, 22 nt, Human
aaguggagagcccuggaggucu

SEQ ID NO: 76213 - RNA, 22 nt, Human
aagugguagagagagcauaagc

SEQ ID NO: 76214 - RNA, 22 nt, Human
aagugguuuuaagagguuccuu

SEQ ID NO: 76215 - RNA, 23 nt, Human
aagugguuuugaacccggacccu

SEQ ID NO: 76216 - RNA, 22 nt, Human
aaguguaagcaaagcucaagcu

SEQ ID NO: 76217 - RNA, 22 nt, Human
aaguguacaugaacacaugaca

SEQ ID NO: 76218 - RNA, 22 nt, Human
aaguguauuaagcaacguuauu

SEQ ID NO: 76219 - RNA, 22 nt, Human
aagugucugacacaaaauaugu

SEQ ID NO: 76220 - RNA, 22 nt, Human
aagugucugauggagcgaaaug

SEQ ID NO: 76221 - RNA, 22 nt, Human
aagugucugcaaaaugacagag

SEQ ID NO: 76222 - RNA, 22 nt, Human
aagugucuuaacuccuuuuggg

SEQ ID NO: 76223 - RNA, 22 nt, Human
aagugugaauuuuagagucagg

SEQ ID NO: 76224 - RNA, 22 nt, Human
aagugugauuuguagaaugccu

SEQ ID NO: 76225 - RNA, 22 nt, Human
aagugugggaaguagguggcga

SEQ ID NO: 76226 - RNA, 22 nt, Human
aagugugggacuagggcuccag

SEQ ID NO: 76227 - RNA, 22 nt, Human
aaguguuacagaaacaaaugaa

SEQ ID NO: 76228 - RNA, 22 nt, Human
aaguguuaggguaaaguuggua

SEQ ID NO: 76229 - RNA, 22 nt, Human
aaguguucuacacuuugaccuu

SEQ ID NO: 76230 - RNA, 22 nt, Human
aaguguuuauuuauaacgaucu

SEQ ID NO: 76231 - RNA, 20 nt, Human
aaguguuuugacuucugacc

SEQ ID NO: 76232 - RNA, 22 nt, Human
aaguguuuuguaaacagaaaag

SEQ ID NO: 76233 - RNA, 22 nt, Human
aaguuaaggcacaugcuuugga

SEQ ID NO: 76234 - RNA, 22 nt, Human
aaguuaauuaaccucuccauca

SEQ ID NO: 76235 - RNA, 22 nt, Human
aaguuacacauuuucauuguaa

SEQ ID NO: 76236 - RNA, 22 nt, Human
aaguuacagauugggagcagag

SEQ ID NO: 76237 - RNA, 22 nt, Human
aaguuacaggagaaagagauca

SEQ ID NO: 76238 - RNA, 22 nt, Human
aaguuacaguuaggggugauga

SEQ ID NO: 76239 - RNA, 22 nt, Human
aaguuacauauucuugggcuau

SEQ ID NO: 76240 - RNA, 22 nt, Human
aaguuacauuuuggucuaauug

SEQ ID NO: 76241 - RNA, 22 nt, Human
aaguuacuuuauguagaagaaa

SEQ ID NO: 76242 - RNA, 22 nt, Human
aaguuagagauuccaucaugcu

SEQ ID NO: 76243 - RNA, 22 nt, Human
aaguuaggaugaaugccuuagc

SEQ ID NO: 76244 - RNA, 22 nt, Human
aaguuaugaaauuuggacagcu

SEQ ID NO: 76245 - RNA, 22 nt, Human
aaguucaaauuggggccuguga

SEQ ID NO: 76246 - RNA, 22 nt, Human
aaguucaagucuccugaguaua

SEQ ID NO: 76247 - RNA, 22 nt, Human
aaguucaucuuaccuagauuuu

SEQ ID NO: 76248 - RNA, 22 nt, Human
aaguucccgaggaccacaguug

SEQ ID NO: 76249 - RNA, 22 nt, Human
aaguuccugagcucauauagca

SEQ ID NO: 76250 - RNA, 22 nt, Human
aaguucgaaauuuagggagaug

SEQ ID NO: 76251 - RNA, 22 nt, Human
aaguucuaacaucuacguggaa

SEQ ID NO: 76252 - RNA, 22 nt, Human
aaguucuagguagugcucuuuc

SEQ ID NO: 76253 - RNA, 22 nt, Human
aaguucugccaggcuguggcag

SEQ ID NO: 76254 - RNA, 22 nt, Human
aaguucuuggaggaugaagagu

SEQ ID NO: 76255 - RNA, 22 nt, Human
aaguucuuucuggaaggucugc

SEQ ID NO: 76256 - RNA, 22 nt, Human
aaguugauugcuucaaauuucu

SEQ ID NO: 76257 - RNA, 22 nt, Human
aauauccuuuccagaguacagu

SEQ ID NO: 76258 - RNA, 22 nt, Human
aauaucucaccaugacaaagca

SEQ ID NO: 76259 - RNA, 23 nt, Human
aauaucugcagcuccuggggagg

SEQ ID NO: 76260 - RNA, 22 nt, Human
aauaucuguuguucuaagccac

SEQ ID NO: 76261 - RNA, 22 nt, Human
aauaugaauuauuguuacaagu

SEQ ID NO: 76262 - RNA, 22 nt, Human
aauaugacauagaauugagaug

SEQ ID NO: 76263 - RNA, 22 nt, Human
aauaugauccuuaaccuucaug

SEQ ID NO: 76264 - RNA, 22 nt, Human
aauaugcaaauagguguaauga

SEQ ID NO: 76265 - RNA, 22 nt, Human
aauaugcacucugauuuagcag

SEQ ID NO: 76266 - RNA, 22 nt, Human
aauaugcagcaugaugaaguaa

SEQ ID NO: 76267 - RNA, 22 nt, Human
aauaugcagcuuaucuucuagg

SEQ ID NO: 76268 - RNA, 22 nt, Human
aauaugugagguauguucagug

SEQ ID NO: 76269 - RNA, 22 nt, Human
aauauguuccacuuaaagcugg

SEQ ID NO: 76270 - RNA, 22 nt, Human
aauauuaucaaaagcuuuuuca

SEQ ID NO: 76271 - RNA, 22 nt, Human
aauauucuaauaaaugcccauc

SEQ ID NO: 76272 - RNA, 22 nt, Human
aauauuuauauuucucuucccu

SEQ ID NO: 76273 - RNA, 22 nt, Human
aauauuucugcagaaugguuuu

SEQ ID NO: 76274 - RNA, 22 nt, Human
aauauuugaacagucacugagu

SEQ ID NO: 76275 - RNA, 21 nt, Human
aaucaaaugucauauccccag

SEQ ID NO: 76276 - RNA, 23 nt, Human
aaucaaguuuugaugaggaagcc

SEQ ID NO: 76277 - RNA, 22 nt, Human
aaucaauguuagucaugaauuu

SEQ ID NO: 76278 - RNA, 22 nt, Human
aaucacacaaaggcaacuuuug

SEQ ID NO: 76279 - RNA, 22 nt, Human
aaucacagaguccagcagauga

SEQ ID NO: 76280 - RNA, 22 nt, Human
aaucacaggcauagauugcucc

SEQ ID NO: 76281 - RNA, 22 nt, Human
aaucacaguggguacuagauug

SEQ ID NO: 76282 - RNA, 22 nt, Human
aaucacauagccaucucuuuga

SEQ ID NO: 76283 - RNA, 22 nt, Human
aaucacaucucauucaacagcc

SEQ ID NO: 76284 - RNA, 22 nt, Human
aaucacaugcagggccuccacc

SEQ ID NO: 76285 - RNA, 22 nt, Human
aaucacaugugcucaauuuuaa

SEQ ID NO: 76286 - RNA, 22 nt, Human
aaucacauuagugaaacacuga

SEQ ID NO: 76287 - RNA, 22 nt, Human
aaucacauuugcccccauauuc

SEQ ID NO: 76288 - RNA, 22 nt, Human
aaucagaaagaggucauguugc

SEQ ID NO: 76289 - RNA, 22 nt, Human
aaucagaaauucuacaucacaa

SEQ ID NO: 76290 - RNA, 22 nt, Human
aaucagaauuuauugaaucuuu

SEQ ID NO: 76291 - RNA, 22 nt, Human
aaucagacaguucuggauucaa

SEQ ID NO: 76292 - RNA, 22 nt, Human
aaucagagaaguuuccuaugcc

SEQ ID NO: 76293 - RNA, 22 nt, Human
aaucagagcccucugagcuuca

SEQ ID NO: 76294 - RNA, 22 nt, Human
aaucagaggaagucaacggauc

SEQ ID NO: 76295 - RNA, 22 nt, Human
aaucagcagaagagaggucuua

SEQ ID NO: 76296 - RNA, 22 nt, Human
aauaacuugaagaucucuucca

SEQ ID NO: 76297 - RNA, 22 nt, Human
aauaagaacuccauuuacucgu

SEQ ID NO: 76298 - RNA, 22 nt, Human
aauaagacucugcuagaaauuc

SEQ ID NO: 76299 - RNA, 22 nt, Human
aauaagagcacuggcuuuggag

SEQ ID NO: 76300 - RNA, 22 nt, Human
aauaagauaagauuucugcucu

SEQ ID NO: 76301 - RNA, 22 nt, Human
aauaagauccugaagauauguu

SEQ ID NO: 76302 - RNA, 22 nt, Human
aauaagauugacacaaguaccu

SEQ ID NO: 76303 - RNA, 22 nt, Human
aauaagcuggagcuauauugag

SEQ ID NO: 76304 - RNA, 23 nt, Human
aauaaggccaaacuaucuggucu

SEQ ID NO: 76305 - RNA, 22 nt, Human
aauaagugaugaugagucacuc

SEQ ID NO: 76306 - RNA, 22 nt, Human
aauaaucucccuuuuuguaugu

SEQ ID NO: 76307 - RNA, 22 nt, Human
aauaaugaacauuuaaaaccug

SEQ ID NO: 76308 - RNA, 22 nt, Human
aauaauguacauacauauuucg

SEQ ID NO: 76309 - RNA, 23 nt, Human
aauaaugucuugugcucucacuu

SEQ ID NO: 76310 - RNA, 22 nt, Human
aauaaugucuuuggcuugacca

SEQ ID NO: 76311 - RNA, 22 nt, Human
aauaauguuaugucauucuucu

SEQ ID NO: 76312 - RNA, 19 nt, Human
aauaauguucaugagauug

SEQ ID NO: 76313 - RNA, 22 nt, Human
aauaauuuccagccaacuggaa

SEQ ID NO: 76314 - RNA, 22 nt, Human
aauacaagauuuauaguuguuu

SEQ ID NO: 76315 - RNA, 22 nt, Human
aauacacuauuuugugcucagu

SEQ ID NO: 76316 - RNA, 22 nt, Human
aauacagauggcaugugaagau

SEQ ID NO: 76317 - RNA, 21 nt, Human
aauacagugaagaauuucuuu

SEQ ID NO: 76318 - RNA, 22 nt, Human
aauacauauggaauuccauguu

SEQ ID NO: 76319 - RNA, 20 nt, Human
aauacaugagcacacuuuca

SEQ ID NO: 76320 - RNA, 22 nt, Human
aauaccaccucauucuggaggc

SEQ ID NO: 76321 - RNA, 22 nt, Human
aauaccuuuucagugcacaaaa

SEQ ID NO: 76322 - RNA, 22 nt, Human
aauacuauguugugacacauga

SEQ ID NO: 76323 - RNA, 22 nt, Human
aauacugugggaugcaguagga

SEQ ID NO: 76324 - RNA, 22 nt, Human
aauagaacaauaauuguaaacu

SEQ ID NO: 76325 - RNA, 22 nt, Human
aauagaauuuaaaugcaguggc

SEQ ID NO: 76326 - RNA, 22 nt, Human
aauagacaagcacccugguaaa

SEQ ID NO: 76327 - RNA, 22 nt, Human
aauagacaauucuagccaacau

SEQ ID NO: 76328 - RNA, 22 nt, Human
aauagacuccagggucuauuuu

SEQ ID NO: 76329 - RNA, 22 nt, Human
aauagauacuacuuagauguag

SEQ ID NO: 76330 - RNA, 20 nt, Human
aauagcacagcucaaacauu

SEQ ID NO: 76331 - RNA, 22 nt, Human
aauagcaccugagguaguuugu

SEQ ID NO: 76332 - RNA, 22 nt, Human
aauagcauagaguuaaaaugca

SEQ ID NO: 76333 - RNA, 22 nt, Human
aauagcaucuucccugguaacc

SEQ ID NO: 76334 - RNA, 22 nt, Human
aauagcauguucaugauaaaau

SEQ ID NO: 76335 - RNA, 22 nt, Human
aauagcauuuuuaagggaauca

SEQ ID NO: 76336 - RNA, 22 nt, Human
aauagcugggaccugaauuagc

SEQ ID NO: 76337 - RNA, 22 nt, Human
aauagcuuaguccugauucugu

SEQ ID NO: 76338 - RNA, 22 nt, Human
aauagcuuuuacuccuccgagg

SEQ ID NO: 76339 - RNA, 22 nt, Human
aauaggaaaauauuuaacaaga

SEQ ID NO: 76340 - RNA, 22 nt, Human
aauaggcugagccauuucaagu

SEQ ID NO: 76341 - RNA, 22 nt, Human
aauaguaaaagauacagcuaau

SEQ ID NO: 76342 - RNA, 22 nt, Human
aauaguauuuauuuggaaaaag

SEQ ID NO: 76343 - RNA, 22 nt, Human
aauaguccucuccuuggaauuu

SEQ ID NO: 76344 - RNA, 22 nt, Human
aauagugcuuacauuaucauga

SEQ ID NO: 76345 - RNA, 22 nt, Human
aauaguguuugaagcaugauag

SEQ ID NO: 76346 - RNA, 22 nt, Human
aauaguuugaauuuaucagaug

SEQ ID NO: 76347 - RNA, 22 nt, Human
aauauaauuuuauuccuagagu

SEQ ID NO: 76348 - RNA, 22 nt, Human
aauauagaaucacuuuccuuca

SEQ ID NO: 76349 - RNA, 22 nt, Human
aauauagcucacuauaccaugg

SEQ ID NO: 76350 - RNA, 22 nt, Human
aauauaugacuccacugcauga

SEQ ID NO: 76351 - RNA, 22 nt, Human
aauauaugagggagcuauuuga

SEQ ID NO: 76352 - RNA, 22 nt, Human
aauauaugugguauugaccagc

SEQ ID NO: 76353 - RNA, 23 nt, Human
aauauauguguuuuucugcuuca

SEQ ID NO: 76354 - RNA, 22 nt, Human
aauaucagcacuuuugugguau

SEQ ID NO: 76355 - RNA, 22 nt, Human
aauaucaguauauuguaucagu

SEQ ID NO: 76356 - RNA, 22 nt, Human
aauauccacuucaauacaggca

SEQ ID NO: 76357 - RNA, 22 nt, Human
aauaucugucucuaaugcauau

SEQ ID NO: 76358 - RNA, 22 nt, Human
aauaugcauguauacaugugua

SEQ ID NO: 76359 - RNA, 22 nt, Human
aauaugcauuauacagacugau

SEQ ID NO: 76360 - RNA, 22 nt, Human
aauauggcuuguuacuauguuu

SEQ ID NO: 76361 - RNA, 22 nt, Human
aauaugucucuggcuagacauu

SEQ ID NO: 76362 - RNA, 22 nt, Human
aauauguuuauaagauaucuuc

SEQ ID NO: 76363 - RNA, 22 nt, Human
aauauucaaguuauucuuucuu

SEQ ID NO: 76364 - RNA, 22 nt, Human
aauauuucuccuucguuauagc

SEQ ID NO: 76365 - RNA, 22 nt, Human
aauauuucuggugcuucucacu

SEQ ID NO: 76366 - RNA, 22 nt, Human
aaugguuucugaaguuaggcag

SEQ ID NO: 76367 - RNA, 22 nt, Human
aaugguuuucuagaacaugaaa

SEQ ID NO: 76368 - RNA, 22 nt, Human
aaugguuuugcagguuugugga

SEQ ID NO: 76369 - RNA, 22 nt, Human
aaugguuuuuagugagaucgau

SEQ ID NO: 76370 - RNA, 22 nt, Human
aauguaaacagcaagagaaggg

SEQ ID NO: 76371 - RNA, 22 nt, Human
aauguaacagcaacaacaaugg

SEQ ID NO: 76372 - RNA, 22 nt, Human
aauguacacugaaagccuauca

SEQ ID NO: 76373 - RNA, 22 nt, Human
aauguacagcugucuuuccucc

SEQ ID NO: 76374 - RNA, 22 nt, Human
aauguacaggcuggcuaugggg

SEQ ID NO: 76375 - RNA, 22 nt, Human
aauguacaucucaguguaguac

SEQ ID NO: 76376 - RNA, 22 nt, Human
aauguagaugagauauuuuuug

SEQ ID NO: 76377 - RNA, 22 nt, Human
aauguauaaccauaggaaauuu

SEQ ID NO: 76378 - RNA, 20 nt, Human
aauguauauuuuaugccagg

SEQ ID NO: 76379 - RNA, 22 nt, Human
aauguaugugauuauuccucua

SEQ ID NO: 76380 - RNA, 22 nt, Human
aauguauuccucaugcaagagu

SEQ ID NO: 76381 - RNA, 22 nt, Human
aauguauucugggaaaauguua

SEQ ID NO: 76382 - RNA, 22 nt, Human
aaugucaagggaagcaggaaau

SEQ ID NO: 76383 - RNA, 22 nt, Human
aaugucaaucucagagaacaca

SEQ ID NO: 76384 - RNA, 22 nt, Human
aaugucaugggaauuuauucau

SEQ ID NO: 76385 - RNA, 22 nt, Human
aaugucauuuaaaauaauucug

SEQ ID NO: 76386 - RNA, 17 nt, Human
aauguccuuggaccaca

SEQ ID NO: 76387 - RNA, 22 nt, Human
aaugucuauuaaacugucauaa

SEQ ID NO: 76388 - RNA, 22 nt, Human
aaugucugaaaaucagacugca

SEQ ID NO: 76389 - RNA, 22 nt, Human
aaugucugaggcucaucugagg

SEQ ID NO: 76390 - RNA, 22 nt, Human
aaugucugagucucuguauccc

SEQ ID NO: 76391 - RNA, 22 nt, Human
aaugucuucaguucuguauugu

SEQ ID NO: 76392 - RNA, 22 nt, Human
aaugucuuuauuucagguuuac

SEQ ID NO: 76393 - RNA, 22 nt, Human
aaugucuuuuaaauguugaggu

SEQ ID NO: 76394 - RNA, 22 nt, Human
aaugucuuuucccuuacuuucc

SEQ ID NO: 76395 - RNA, 22 nt, Human
aaugugaaucuuccuuuuugau

SEQ ID NO: 76396 - RNA, 22 nt, Human
aaugugacugaauauuuacucu

SEQ ID NO: 76397 - RNA, 22 nt, Human
aaugugagccaaugcccguggg

SEQ ID NO: 76398 - RNA, 22 nt, Human
aaugugauuuucccaguagaau

SEQ ID NO: 76399 - RNA, 22 nt, Human
aaugugcugguaacugcuuugc

SEQ ID NO: 76400 - RNA, 22 nt, Human
aaugugcuucuggcugugguca

SEQ ID NO: 76401 - RNA, 19 nt, Human
aaugugcuugggagacugc

SEQ ID NO: 76402 - RNA, 22 nt, Human
aauguggacucuuguauuuuuc

SEQ ID NO: 76403 - RNA, 22 nt, Human
aauguggccacuuuuuucuggg

SEQ ID NO: 76404 - RNA, 22 nt, Human
aaugugguuaacccauuuaaga

SEQ ID NO: 76405 - RNA, 22 nt, Human
aauguguacuuuuucaugcuca

SEQ ID NO: 76406 - RNA, 22 nt, Human
aauguguagcauuuaaugcagu

SEQ ID NO: 76407 - RNA, 22 nt, Human
aauguguagucauugaucaaga

SEQ ID NO: 76408 - RNA, 22 nt, Human
aauguguauaugaacauacagg

SEQ ID NO: 76409 - RNA, 22 nt, Human
aaugugucuaugugguucacag

SEQ ID NO: 76410 - RNA, 22 nt, Human
aauguguguauuucuaggcgag

SEQ ID NO: 76411 - RNA, 22 nt, Human
aauguguuauuucagaauccag

SEQ ID NO: 76412 - RNA, 22 nt, Human
aauguguuuauuuagugauuua

SEQ ID NO: 76413 - RNA, 22 nt, Human
aauguguuuuaugagagaauau

SEQ ID NO: 76414 - RNA, 22 nt, Human
aauguuaauuuacugucuucau

SEQ ID NO: 76415 - RNA, 22 nt, Human
aauguuacaggacaaagaugga

SEQ ID NO: 76416 - RNA, 22 nt, Human
aauguuauuacacuugugaaau

SEQ ID NO: 76417 - RNA, 22 nt, Human
aauguucaaaagcaucagugaa

SEQ ID NO: 76418 - RNA, 22 nt, Human
aauguucaaacagaucacuuag

SEQ ID NO: 76419 - RNA, 22 nt, Human
aauguucaacagauggauauuu

SEQ ID NO: 76420 - RNA, 22 nt, Human
aauguucagcgagggaugcuag

SEQ ID NO: 76421 - RNA, 22 nt, Human
aauguucauugauuaaaugaau

SEQ ID NO: 76422 - RNA, 22 nt, Human
aauguuccaccaacauuuggga

SEQ ID NO: 76423 - RNA, 22 nt, Human
aauguucucaacaaaaggaagc

SEQ ID NO: 76424 - RNA, 22 nt, Human
aauguucugggagagaagcugu

SEQ ID NO: 76425 - RNA, 22 nt, Human
aauguugaggauaucagaaaau

SEQ ID NO: 76426 - RNA, 22 nt, Human
aauguugccccaggacaaagga

SEQ ID NO: 76427 - RNA, 22 nt, Human
aauguuguguuucaguucaaga

SEQ ID NO: 76428 - RNA, 22 nt, Human
aauguuguuuuucugcaugucu

SEQ ID NO: 76429 - RNA, 22 nt, Human
aauguuuaauguuagugguaau

SEQ ID NO: 76430 - RNA, 22 nt, Human
aauguuucuggauauugugggu

SEQ ID NO: 76431 - RNA, 22 nt, Human
aauguuuggacuggaagguccc

SEQ ID NO: 76432 - RNA, 22 nt, Human
aauguuugugcauaaauauguu

SEQ ID NO: 76433 - RNA, 22 nt, Human
aauguuuuagauuacugcuggg

SEQ ID NO: 76434 - RNA, 22 nt, Human
aauguuuuauagcucaagcaau

SEQ ID NO: 76435 - RNA, 22 nt, Human
aauguuuucccagugcagacga

SEQ ID NO: 76436 - RNA, 22 nt, Human
aauguuuuguaugccucugagc

SEQ ID NO: 76437 - RNA, 22 nt, Human
aauuaacagagggcuuauuacu

SEQ ID NO: 76438 - RNA, 22 nt, Human
aauuaagaaaauguuuuaugau

SEQ ID NO: 76439 - RNA, 22 nt, Human
aauuaagagagaguugaagcaa

SEQ ID NO: 76440 - RNA, 23 nt, Human
aauuaccaugcaacuugugaaac

SEQ ID NO: 76441 - RNA, 22 nt, Human
aauuacuguaauuuucuacagc

SEQ ID NO: 76442 - RNA, 22 nt, Human
aauuacuuaagagaaacuuuga

SEQ ID NO: 76443 - RNA, 20 nt, Human
aauuagauguuuaaucaaua

SEQ ID NO: 76444 - RNA, 22 nt, Human
aauuagcuaauuaauuguagcc

SEQ ID NO: 76445 - RNA, 22 nt, Human
aauuagcuuauguguacuuuuc

SEQ ID NO: 76446 - RNA, 22 nt, Human
aauuagcuuuccgccaucacac

SEQ ID NO: 76447 - RNA, 22 nt, Human
aauuagggaaaacauuugcuuu

SEQ ID NO: 76448 - RNA, 22 nt, Human
acacauuaaccuuugaaauucu

SEQ ID NO: 76449 - RNA, 22 nt, Human
acacauuaggcagugcuuaaau

SEQ ID NO: 76450 - RNA, 22 nt, Human
acacauucaugagugcaugcac

SEQ ID NO: 76451 - RNA, 22 nt, Human
acacauuuaaaaaggaacauau

SEQ ID NO: 76452 - RNA, 22 nt, Human
acacauuuacauguuuacguau

SEQ ID NO: 76453 - RNA, 22 nt, Human
acacauuuauggaucgcagaaa

SEQ ID NO: 76454 - RNA, 19 nt, Human
acacauuugcacaauccac

SEQ ID NO: 76455 - RNA, 22 nt, Human
acacauuugcauaauaccucau

SEQ ID NO: 76456 - RNA, 22 nt, Human
acacauuugcuaaaaugagcuc

SEQ ID NO: 76457 - RNA, 22 nt, Human
acacauuugggcuccuacauaa

SEQ ID NO: 76458 - RNA, 22 nt, Human
acacauuuucuaacagggauca

SEQ ID NO: 76459 - RNA, 22 nt, Human
acacauuuuguuaaacccugug

SEQ ID NO: 76460 - RNA, 22 nt, Human
acaccagggccuagccagggcg

SEQ ID NO: 76461 - RNA, 22 nt, Human
acaccaugguucccaaacugug

SEQ ID NO: 76462 - RNA, 21 nt, Human
acacccacuuaugcccgcuug

SEQ ID NO: 76463 - RNA, 22 nt, Human
acaccccaccaguaacugaggg

SEQ ID NO: 76464 - RNA, 22 nt, Human
acacggaaaaggagacagaggg

SEQ ID NO: 76465 - RNA, 22 nt, Human
acacggcacuuuaggaaggggc

SEQ ID NO: 76466 - RNA, 22 nt, Human
acacuaauuaagcugcuuuacu

SEQ ID NO: 76467 - RNA, 22 nt, Human
acacuacaacagcagaggugag

SEQ ID NO: 76468 - RNA, 22 nt, Human
acacuaguauuucuauaaguga

SEQ ID NO: 76469 - RNA, 22 nt, Human
acacuccagggagggagggaau

SEQ ID NO: 76470 - RNA, 22 nt, Human
acacucucagcuuuucaacuua

SEQ ID NO: 76471 - RNA, 22 nt, Human
acacucuuucugugggucacau

SEQ ID NO: 76472 - RNA, 22 nt, Human
acacugaaggcuacaagguuga

SEQ ID NO: 76473 - RNA, 22 nt, Human
acacugaaugcuguuuagaaau

SEQ ID NO: 76474 - RNA, 17 nt, Human
acacugacaugccacac

SEQ ID NO: 76475 - RNA, 22 nt, Human
cucucuguucauugagucaaaa

SEQ ID NO: 76476 - RNA, 22 nt, Human
cucugaaaaugugguggggaaa

SEQ ID NO: 76477 - RNA, 22 nt, Human
cucugaaacuccugcaccuucu

SEQ ID NO: 76478 - RNA, 22 nt, Human
cucugaagaugguaccagcuuu

SEQ ID NO: 76479 - RNA, 22 nt, Human
cucugaagccccaaauaguccg

SEQ ID NO: 76480 - RNA, 22 nt, Human
cucugaagggagggccaagccc

SEQ ID NO: 76481 - RNA, 21 nt, Human
cucugaauccugcuucucagu

SEQ ID NO: 76482 - RNA, 18 nt, Human
cucugaccgccacuugcu

SEQ ID NO: 76483 - RNA, 22 nt, Human
cucugagaaagcugugagcuaa

SEQ ID NO: 76484 - RNA, 22 nt, Human
cucugagaagccuugaugggga

SEQ ID NO: 76485 - RNA, 22 nt, Human
cucugagaauaugagcucuuug

SEQ ID NO: 76486 - RNA, 22 nt, Human
cucugagagugcucagagggua

SEQ ID NO: 76487 - RNA, 22 nt, Human
cucugagaugcuugaagaggau

SEQ ID NO: 76488 - RNA, 22 nt, Human
cucugagcccgcugcagcccca

SEQ ID NO: 76489 - RNA, 22 nt, Human
cucugagcuuugcagccccugg

SEQ ID NO: 76490 - RNA, 19 nt, Human
cucugaggauuagcugugg

SEQ ID NO: 76491 - RNA, 22 nt, Human
cucugaggcuccaugcaggcuu

SEQ ID NO: 76492 - RNA, 22 nt, Human
cucugagguccuucccagcucu

SEQ ID NO: 76493 - RNA, 22 nt, Human
cucugagguuuccucacaagcu

SEQ ID NO: 76494 - RNA, 22 nt, Human
cucugaguuucauuucccuccu

SEQ ID NO: 76495 - RNA, 22 nt, Human
cucugcacccccggcuccucgu

SEQ ID NO: 76496 - RNA, 22 nt, Human
cucugcagaauuugagcugcuc

SEQ ID NO: 76497 - RNA, 22 nt, Human
cucugcagagccuccagcccag

SEQ ID NO: 76498 - RNA, 20 nt, Human
cucugcagcaaggccugggu

SEQ ID NO: 76499 - RNA, 22 nt, Human
cuccccacacacuaggccugau

SEQ ID NO: 76500 - RNA, 23 nt, Human
cuccccaguguccucaugcaucu

SEQ ID NO: 76501 - RNA, 22 nt, Human
cuccccgagagagguuguccgc

SEQ ID NO: 76502 - RNA, 22 nt, Human
cuccccuagcccguugggaggu

SEQ ID NO: 76503 - RNA, 22 nt, Human
cuccccuccuuaggucuucuag

SEQ ID NO: 76504 - RNA, 22 nt, Human
cuccccugagcauagacucugu

SEQ ID NO: 76505 - RNA, 22 nt, Human
cuccccuucuugccagauccuu

SEQ ID NO: 76506 - RNA, 22 nt, Human
cucccucacaaagcauucucuu

SEQ ID NO: 76507 - RNA, 22 nt, Human
cucccucauauacccagcgaga

SEQ ID NO: 76508 - RNA, 22 nt, Human
cucccucccuacgugagcucac

SEQ ID NO: 76509 - RNA, 22 nt, Human
cucccucucuaaggcaaagaga

SEQ ID NO: 76510 - RNA, 22 nt, Human
cucccugacaggccaugggcuu

SEQ ID NO: 76511 - RNA, 22 nt, Human
cucccugcccugugaguuggcc

SEQ ID NO: 76512 - RNA, 22 nt, Human
cucccugcuuguuucccuucag

SEQ ID NO: 76513 - RNA, 22 nt, Human
cucccuggcacagcgagagguu

SEQ ID NO: 76514 - RNA, 22 nt, Human
cuccgcagcgggccaauccgga

SEQ ID NO: 76515 - RNA, 22 nt, Human
cuccgugcuauuuuaguaucgc

SEQ ID NO: 76516 - RNA, 22 nt, Human
cuccguggcuguggacgcagcc

SEQ ID NO: 76517 - RNA, 22 nt, Human
cuccguuuugugggacacggau

SEQ ID NO: 76518 - RNA, 22 nt, Human
cuccguuuuugaccggcacuga

SEQ ID NO: 76519 - RNA, 22 nt, Human
cuccuacaguguuugaguccag

SEQ ID NO: 76520 - RNA, 22 nt, Human
cuccuagaugucuucagagaaa

SEQ ID NO: 76521 - RNA, 22 nt, Human
cuccuaggacgccgcugcuccu

SEQ ID NO: 76522 - RNA, 22 nt, Human
cuccuagguaacagggugguuu

SEQ ID NO: 76523 - RNA, 22 nt, Human
cuccucagacuuuccuuguccg

SEQ ID NO: 76524 - RNA, 22 nt, Human
cuccucagcugggaggaguccc

SEQ ID NO: 76525 - RNA, 22 nt, Human
cuccucaggaaguagcaugugu

SEQ ID NO: 76526 - RNA, 18 nt, Human
cuccuccacagccccugc

SEQ ID NO: 76527 - RNA, 18 nt, Human
cuccucccuaagggcuca

SEQ ID NO: 76528 - RNA, 22 nt, Human
cuccucuccaucagcgccaccc

SEQ ID NO: 76529 - RNA, 22 nt, Human
cuccucucuggaguuaugcaga

SEQ ID NO: 76530 - RNA, 22 nt, Human
cuccucuguauugauugggacu

SEQ ID NO: 76531 - RNA, 22 nt, Human
cuccucuucugaguaccaggga

SEQ ID NO: 76532 - RNA, 22 nt, Human
cuccugacacaguccacacuug

SEQ ID NO: 76533 - RNA, 22 nt, Human
cuccugagcucugaggaagcuu

SEQ ID NO: 76534 - RNA, 22 nt, Human
cuccugcaugcucacauaugcc

SEQ ID NO: 76535 - RNA, 22 nt, Human
cuccugcugaauggccaggagc

SEQ ID NO: 76536 - RNA, 22 nt, Human
cuccuggaagcccgcccugcug

SEQ ID NO: 76537 - RNA, 22 nt, Human
cuccuggaggauagugacuggg

SEQ ID NO: 76538 - RNA, 22 nt, Human
cuccuggaggcuccaagggaga

SEQ ID NO: 76539 - RNA, 23 nt, Human
cuccuggaggguccggcccugcc

SEQ ID NO: 76540 - RNA, 22 nt, Human
cuccuggcacugucuugaccca

SEQ ID NO: 76541 - RNA, 17 nt, Human
cuccuggccaccccucu

SEQ ID NO: 76542 - RNA, 22 nt, Human
cuccuggcccugagcucccagg

SEQ ID NO: 76543 - RNA, 22 nt, Human
cuccuggcuaugacuacauuuc

SEQ ID NO: 76544 - RNA, 22 nt, Human
cuccuggcucucuguuuagugu

SEQ ID NO: 76545 - RNA, 22 nt, Human
cuccuggcuucugaaaucgugg

SEQ ID NO: 76546 - RNA, 22 nt, Human
cuccuggcuuucccagaccagg

SEQ ID NO: 76547 - RNA, 22 nt, Human
cuccugggagcagggauggaug

SEQ ID NO: 76548 - RNA, 22 nt, Human
cuccugggcucaagugauccuc

SEQ ID NO: 76549 - RNA, 18 nt, Human
cuccugggcugcagaugc

SEQ ID NO: 76550 - RNA, 22 nt, Human
cuccugggcugggaacucagcc

SEQ ID NO: 76551 - RNA, 22 nt, Human
cuccugggcuucgaaggcuccc

SEQ ID NO: 76552 - RNA, 22 nt, Human
cuccuguauguugggcuucaca

SEQ ID NO: 76553 - RNA, 22 nt, Human
cuccugucagaagcauccugag

SEQ ID NO: 76554 - RNA, 22 nt, Human
cuccugugcaccuccagcggca

SEQ ID NO: 76555 - RNA, 22 nt, Human
cuccugugcaugcaucucccua

SEQ ID NO: 76556 - RNA, 22 nt, Human
cuccugugggucaccaauaggc

SEQ ID NO: 76557 - RNA, 22 nt, Human
cuccuguugcacuaguuccuga

SEQ ID NO: 76558 - RNA, 22 nt, Human
cuccuuaaagggagcagcagcu

SEQ ID NO: 76559 - RNA, 22 nt, Human
cuccuucccuaccaucaauguu

SEQ ID NO: 76560 - RNA, 22 nt, Human
cuccuuccugccccagugauaa

SEQ ID NO: 76561 - RNA, 18 nt, Human
cuccuuggagaagaggcc

SEQ ID NO: 76562 - RNA, 22 nt, Human
cuccuuggguucuuucgguucc

SEQ ID NO: 76563 - RNA, 23 nt, Human
cuccuugguaugccaugcccagc

SEQ ID NO: 76564 - RNA, 18 nt, Human
cuccuuucccuacaccuc

SEQ ID NO: 76565 - RNA, 22 nt, Human
cucgggcuugaggcuguuuacc

SEQ ID NO: 76566 - RNA, 22 nt, Human
cucggguaccaugcuaggcacu

SEQ ID NO: 76567 - RNA, 22 nt, Human
cucuaaaggcuuguuauugcau

SEQ ID NO: 76568 - RNA, 22 nt, Human
cucuaaauccaaauaagugucc

SEQ ID NO: 76569 - RNA, 22 nt, Human
cucuaaauguggucugcagaua

SEQ ID NO: 76570 - RNA, 22 nt, Human
cucuaacaccacagugugguuu

SEQ ID NO: 76571 - RNA, 22 nt, Human
cucuaauccuuugucccugggu

SEQ ID NO: 76572 - RNA, 22 nt, Human
cucuacagcugcugccccuggu

SEQ ID NO: 76573 - RNA, 22 nt, Human
cucuagacaacuugcugugggu

SEQ ID NO: 76574 - RNA, 22 nt, Human
cucuagcaggugccuuguaaca

SEQ ID NO: 76575 - RNA, 22 nt, Human
cucuaggcugcccaggagcuga

SEQ ID NO: 76576 - RNA, 22 nt, Human
cucuagggaagaaugagagccc

SEQ ID NO: 76577 - RNA, 22 nt, Human
cucuauauucugaaacaguuag

SEQ ID NO: 76578 - RNA, 22 nt, Human
cucuauuuuucuuggcuagugu

SEQ ID NO: 76579 - RNA, 22 nt, Human
cucucagaagcuuccaguaugg

SEQ ID NO: 76580 - RNA, 22 nt, Human
cucucagacacccauuuggaaa

SEQ ID NO: 76581 - RNA, 22 nt, Human
cucucagacugaagggccugug

SEQ ID NO: 76582 - RNA, 22 nt, Human
cucucaguuuccucaacuguaa

SEQ ID NO: 76583 - RNA, 22 nt, Human
cucuccaaguuaucaagaugaa

SEQ ID NO: 76584 - RNA, 22 nt, Human
gccagcauuccuuggcuccugg

SEQ ID NO: 76585 - RNA, 22 nt, Human
gccagccagagaggcaugguua

SEQ ID NO: 76586 - RNA, 22 nt, Human
gccagccagggaagggagagac

SEQ ID NO: 76587 - RNA, 22 nt, Human
gccagccauaggccagcacugg

SEQ ID NO: 76588 - RNA, 22 nt, Human
gccagcccauuaaccccugucc

SEQ ID NO: 76589 - RNA, 22 nt, Human
gccagccccuccauccuguuca

SEQ ID NO: 76590 - RNA, 18 nt, Human
gccagcccuccaaccucc

SEQ ID NO: 76591 - RNA, 22 nt, Human
gccagccugugggggcucugug

SEQ ID NO: 76592 - RNA, 22 nt, Human
gccagcuagaggcugcagugca

SEQ ID NO: 76593 - RNA, 22 nt, Human
gccagcucagugccaggccccu

SEQ ID NO: 76594 - RNA, 22 nt, Human
gccagcucaguuucaaaguagg

SEQ ID NO: 76595 - RNA, 22 nt, Human
gccagcuccgcaggauggcgcg

SEQ ID NO: 76596 - RNA, 22 nt, Human
gccagcucuugaugggugggua

SEQ ID NO: 76597 - RNA, 22 nt, Human
gccagcugacaccuugauuuug

SEQ ID NO: 76598 - RNA, 22 nt, Human
gccagcugaggccgugcaggcu

SEQ ID NO: 76599 - RNA, 22 nt, Human
gccagcugcaaaguauguugaa

SEQ ID NO: 76600 - RNA, 18 nt, Human
gccagcugcacggcccuc

SEQ ID NO: 76601 - RNA, 22 nt, Human
gccagcugcccucugcuggucc

SEQ ID NO: 76602 - RNA, 20 nt, Human
gccagcugcccuuccacccu

SEQ ID NO: 76603 - RNA, 22 nt, Human
gccagcugcuucuccagaauuu

SEQ ID NO: 76604 - RNA, 22 nt, Human
gccagcuggagacuggcagggg

SEQ ID NO: 76605 - RNA, 20 nt, Human
gccagcuggucccaauuaug

SEQ ID NO: 76606 - RNA, 22 nt, Human
gccagcugucuaagagaguaaa

SEQ ID NO: 76607 - RNA, 22 nt, Human
gccagcugugcuuuuccuaaaa

SEQ ID NO: 76608 - RNA, 23 nt, Human
gccagcuuuggucugucuccuag

SEQ ID NO: 76609 - RNA, 19 nt, Human
gccaggaaagaaucaggcg

SEQ ID NO: 76610 - RNA, 22 nt, Human
gccaggaaagggaauucccuga

SEQ ID NO: 76611 - RNA, 22 nt, Human
gccaggaagagagagcccucca

SEQ ID NO: 76612 - RNA, 22 nt, Human
gccaggaagucagccaagccca

SEQ ID NO: 76613 - RNA, 22 nt, Human
gccaggaauuucaagagccacu

SEQ ID NO: 76614 - RNA, 22 nt, Human
gccaggacccuggagggcaucu

SEQ ID NO: 76615 - RNA, 22 nt, Human
gccaggaccucagaugcagggc

SEQ ID NO: 76616 - RNA, 22 nt, Human
gccaggaccucccagagcuuuc

SEQ ID NO: 76617 - RNA, 22 nt, Human
gccaggacggugaaugggcuac

SEQ ID NO: 76618 - RNA, 22 nt, Human
cucugaaauuggcccucagcag

SEQ ID NO: 76619 - RNA, 22 nt, Human
cucugacagguggcauuaucuc

SEQ ID NO: 76620 - RNA, 22 nt, Human
cucugacuuuaaauacaggaug

SEQ ID NO: 76621 - RNA, 22 nt, Human
cucugagaauauaagacuauuu

SEQ ID NO: 76622 - RNA, 23 nt, Human
cucugagacccagguggacacgg

SEQ ID NO: 76623 - RNA, 22 nt, Human
cucugagacucaagugaguggg

SEQ ID NO: 76624 - RNA, 22 nt, Human
cucugagacuuuucaccuccca

SEQ ID NO: 76625 - RNA, 22 nt, Human
cucugagagcggucuguggcuu

SEQ ID NO: 76626 - RNA, 22 nt, Human
cucugagaggugagaagcagca

SEQ ID NO: 76627 - RNA, 22 nt, Human
cucugagcagaggccguggcua

SEQ ID NO: 76628 - RNA, 22 nt, Human
cucugaggagaaagagcuuggu

SEQ ID NO: 76629 - RNA, 22 nt, Human
cucugagggcugucaggaaagg

SEQ ID NO: 76630 - RNA, 22 nt, Human
cucugagguuccuuugcccucg

SEQ ID NO: 76631 - RNA, 22 nt, Human
cucugaguagauagggaaccug

SEQ ID NO: 76632 - RNA, 22 nt, Human
cucugauuuauauuauaaagug

SEQ ID NO: 76633 - RNA, 22 nt, Human
cucugcacuguccggcuuucuu

SEQ ID NO: 76634 - RNA, 22 nt, Human
cucugcagauucaucccuucac

SEQ ID NO: 76635 - RNA, 17 nt, Human
cucugcagugcauggcu

SEQ ID NO: 76636 - RNA, 22 nt, Human
cucugcaguguaacagcgcuug

SEQ ID NO: 76637 - RNA, 22 nt, Human
cucugccaagaugacagguaag

SEQ ID NO: 76638 - RNA, 22 nt, Human
cucugccaucaguuuuucuuug

SEQ ID NO: 76639 - RNA, 22 nt, Human
cucugccaucucacuggguccu

SEQ ID NO: 76640 - RNA, 20 nt, Human
cucugcccccagacugacag

SEQ ID NO: 76641 - RNA, 22 nt, Human
cucugcccccagcuggugcuug

SEQ ID NO: 76642 - RNA, 22 nt, Human
cucugcccucacuuggggccug

SEQ ID NO: 76643 - RNA, 22 nt, Human
cucugcgccacccucgccugcu

SEQ ID NO: 76644 - RNA, 22 nt, Human
cucugcuagaaggucaaucucu

SEQ ID NO: 76645 - RNA, 21 nt, Human
cucugcugaguccuaggauuc

SEQ ID NO: 76646 - RNA, 22 nt, Human
cucugcugaucucagcugggcu

SEQ ID NO: 76647 - RNA, 22 nt, Human
cucugcugcuugccagucauug

SEQ ID NO: 76648 - RNA, 22 nt, Human
cucugcugcuuugccaguggaa

SEQ ID NO: 76649 - RNA, 21 nt, Human
cucugcugucuaccagcuguu

SEQ ID NO: 76650 - RNA, 22 nt, Human
cucugcuucugagauggaagcu

SEQ ID NO: 76651 - RNA, 22 nt, Human
cucugcuugugucaggcaugcu

SEQ ID NO: 76652 - RNA, 22 nt, Human
cucugcuuuuuaaaaggagucc

SEQ ID NO: 76653 - RNA, 22 nt, Human
cucuggaaaaccacuagcagga

SEQ ID NO: 76654 - RNA, 22 nt, Human
cucuggaaaauugugugggggu

SEQ ID NO: 76655 - RNA, 20 nt, Human
cucuggaagaguuuaaaugg

SEQ ID NO: 76656 - RNA, 22 nt, Human
cucuggaagaugaccuggguaa

SEQ ID NO: 76657 - RNA, 22 nt, Human
cucuggaauggguguuucuaac

SEQ ID NO: 76658 - RNA, 22 nt, Human
cucuggaauugaccugggaggg

SEQ ID NO: 76659 - RNA, 17 nt, Human
cucuggaauuggugaag

SEQ ID NO: 76660 - RNA, 22 nt, Human
cucuggacacuggcaugggguc

SEQ ID NO: 76661 - RNA, 22 nt, Human
cucuggacagcaggugcugugg

SEQ ID NO: 76662 - RNA, 22 nt, Human
cucuggacccagacaaaccugg

SEQ ID NO: 76663 - RNA, 22 nt, Human
cucuggacuuguacauacucag

SEQ ID NO: 76664 - RNA, 22 nt, Human
cucuggagcaccgggcuaucca

SEQ ID NO: 76665 - RNA, 22 nt, Human
cucuggaggcagcaccagccag

SEQ ID NO: 76666 - RNA, 22 nt, Human
cucuggagggaggcugagcugg

SEQ ID NO: 76667 - RNA, 22 nt, Human
cucuggaggucagguguggugg

SEQ ID NO: 76668 - RNA, 22 nt, Human
cucuggagugcagccugguggc

SEQ ID NO: 76669 - RNA, 22 nt, Human
cucuggaguucccuugaucuga

SEQ ID NO: 76670 - RNA, 22 nt, Human
cucuggaucugcccugacgcca

SEQ ID NO: 76671 - RNA, 20 nt, Human
cucuggcaaaggaugccuau

SEQ ID NO: 76672 - RNA, 22 nt, Human
cucuggccagagccugcgggaa

SEQ ID NO: 76673 - RNA, 22 nt, Human
cucuggccccaguggccccuug

SEQ ID NO: 76674 - RNA, 22 nt, Human
cucuggccgcagcucagcucug

SEQ ID NO: 76675 - RNA, 22 nt, Human
cucuggccugcuuccucaggua

SEQ ID NO: 76676 - RNA, 22 nt, Human
cucuggcuauggcacggcgcuc

SEQ ID NO: 76677 - RNA, 20 nt, Human
cucuggcuccgcgugaccgc

SEQ ID NO: 76678 - RNA, 22 nt, Human
cucuggcugccucucaggccug

SEQ ID NO: 76679 - RNA, 22 nt, Human
cucuggcuuguuaaugcauauu

SEQ ID NO: 76680 - RNA, 22 nt, Human
cucugggaagggcugagcacug

SEQ ID NO: 76681 - RNA, 22 nt, Human
cucugggauagagccucggucu

SEQ ID NO: 76682 - RNA, 19 nt, Human
cucugggcaagucacuuaa

SEQ ID NO: 76683 - RNA, 22 nt, Human
cucugggcaaguuucuucauga

SEQ ID NO: 76684 - RNA, 22 nt, Human
cucugggcacuguauggguucu

SEQ ID NO: 76685 - RNA, 22 nt, Human
cucugggcccacuuaaaucugg

SEQ ID NO: 76686 - RNA, 22 nt, Human
cucugggcuccuucagcccuuu

SEQ ID NO: 76687 - RNA, 22 nt, Human
cucugggcugaauggcugaacc

SEQ ID NO: 76688 - RNA, 20 nt, Human
cucugggcugcacccucgcc

SEQ ID NO: 76689 - RNA, 22 nt, Human
cucugggcuuaccugcuuccug

SEQ ID NO: 76690 - RNA, 22 nt, Human
cucugggcuuccuuuguggguu

SEQ ID NO: 76691 - RNA, 22 nt, Human
cucuggggaagcagccagcugg

SEQ ID NO: 76692 - RNA, 22 nt, Human
cucugggguuagaucugaugcu

SEQ ID NO: 76693 - RNA, 22 nt, Human
gccuuccugcagcucugagcgu

SEQ ID NO: 76694 - RNA, 22 nt, Human
gccuuccuuacaccugcucagc

SEQ ID NO: 76695 - RNA, 22 nt, Human
gccuucugauaucucuuggcau

SEQ ID NO: 76696 - RNA, 22 nt, Human
gccuucugaucgcuggacugac

SEQ ID NO: 76697 - RNA, 19 nt, Human
gccuugaagcaacucuugu

SEQ ID NO: 76698 - RNA, 21 nt, Human
gccuugccacaugugccacag

SEQ ID NO: 76699 - RNA, 22 nt, Human
gccuuggcccacagugcuccug

SEQ ID NO: 76700 - RNA, 22 nt, Human
gccuugggaaagugggaggaga

SEQ ID NO: 76701 - RNA, 22 nt, Human
gccuugggauucuuggaugcuc

SEQ ID NO: 76702 - RNA, 22 nt, Human
gccuuuaucaguuucauggcuu

SEQ ID NO: 76703 - RNA, 22 nt, Human
gccuuuaucuuccugauucaga

SEQ ID NO: 76704 - RNA, 22 nt, Human
gccuuuauuuucaacggagugu

SEQ ID NO: 76705 - RNA, 22 nt, Human
gccuuucacagagauuuaaaaa

SEQ ID NO: 76706 - RNA, 22 nt, Human
gccuuugaauuguuguggugag

SEQ ID NO: 76707 - RNA, 22 nt, Human
gccuuuggacugagguagucag

SEQ ID NO: 76708 - RNA, 22 nt, Human
gccuuuggagaauccagucaug

SEQ ID NO: 76709 - RNA, 22 nt, Human
gccuuuggauauauucagggau

SEQ ID NO: 76710 - RNA, 22 nt, Human
gccuuuggaugguuuuucuauu

SEQ ID NO: 76711 - RNA, 22 nt, Human
gccuuuggcucugucugaccug

SEQ ID NO: 76712 - RNA, 19 nt, Human
gccuuugggcguuguuggg

SEQ ID NO: 76713 - RNA, 22 nt, Human
gccuuuugaaauagaaaucuga

SEQ ID NO: 76714 - RNA, 22 nt, Human
gccuuuugaucuauaacugugu

SEQ ID NO: 76715 - RNA, 22 nt, Human
gcgacgcucgggcuccgaugcc

SEQ ID NO: 76716 - RNA, 22 nt, Human
gcgagaaacuaagugcccuuug

SEQ ID NO: 76717 - RNA, 22 nt, Human
gcgagccucuggaguccucugg

SEQ ID NO: 76718 - RNA, 19 nt, Human
gcgaggaagucacuguggc

SEQ ID NO: 76719 - RNA, 22 nt, Human
gcgagggcacgcgguugaaggc

SEQ ID NO: 76720 - RNA, 22 nt, Human
gcgagucgccgcugcagcccua

SEQ ID NO: 76721 - RNA, 22 nt, Human
gcgagugccgagagggcagggc

SEQ ID NO: 76722 - RNA, 22 nt, Human
gcgcaagccacacagccugggg

SEQ ID NO: 76723 - RNA, 22 nt, Human
gcgcagaguagcagagugcuga

SEQ ID NO: 76724 - RNA, 22 nt, Human
gcgcaggugaugcgucugccuu

SEQ ID NO: 76725 - RNA, 22 nt, Human
gcgcaggugcugcuggagcagc

SEQ ID NO: 76726 - RNA, 22 nt, Human
gcgccugccaccaugccaggcu

SEQ ID NO: 76727 - RNA, 22 nt, Human
gcgcucagaaaagauuuucuuc

SEQ ID NO: 76728 - RNA, 22 nt, Human
gcggcccggguccccagcagca

SEQ ID NO: 76729 - RNA, 22 nt, Human
gcggcgccugggacccgccagc

SEQ ID NO: 76730 - RNA, 22 nt, Human
gcggcggagacagcaggaagcc

SEQ ID NO: 76731 - RNA, 22 nt, Human
gcggcuccgaagccaggccgcg

SEQ ID NO: 76732 - RNA, 22 nt, Human
gcgggccaccuuggagagcgcu

SEQ ID NO: 76733 - RNA, 22 nt, Human
gcgggcggggguucccaggucu

SEQ ID NO: 76734 - RNA, 22 nt, Human
gcggggcccccggccgagcucu

SEQ ID NO: 76735 - RNA, 22 nt, Human
gcgggggcggcgcagaccucag

SEQ ID NO: 76736 - RNA, 22 nt, Human
gcggggggaggaacaucuugca

SEQ ID NO: 76737 - RNA, 22 nt, Human
gcggggggcagcagucgcucag

SEQ ID NO: 76738 - RNA, 22 nt, Human
gcggggggcaggcaguacguug

SEQ ID NO: 76739 - RNA, 22 nt, Human
gcggguggaucaugaggucagg

SEQ ID NO: 76740 - RNA, 22 nt, Human
gcggguugaagggcgcaucgaa

SEQ ID NO: 76741 - RNA, 22 nt, Human
gcgguauuugugugggugucga

SEQ ID NO: 76742 - RNA, 22 nt, Human
gcggucggcagaggggcucugc

SEQ ID NO: 76743 - RNA, 22 nt, Human
gcgucugaguugcgggggcuca

SEQ ID NO: 76744 - RNA, 22 nt, Human
gcguggggcagcccagggcuuc

SEQ ID NO: 76745 - RNA, 22 nt, Human
gcguguuugcccagugaguggc

SEQ ID NO: 76746 - RNA, 22 nt, Human
gcguuuaaagauagcuaauaag

SEQ ID NO: 76747 - RNA, 23 nt, Human
gcuaaauugaagucucaggggaa

SEQ ID NO: 76748 - RNA, 22 nt, Human
gcuaagaaaaauucauguauau

SEQ ID NO: 76749 - RNA, 22 nt, Human
gcuaaggagggucuugcaaauu

SEQ ID NO: 76750 - RNA, 22 nt, Human
gcuaaggcacaaauagcuuugc

SEQ ID NO: 76751 - RNA, 22 nt, Human
gcuaaggccuuaacucauggag

SEQ ID NO: 76752 - RNA, 22 nt, Human
gcuaaggcucagguucuaagga

SEQ ID NO: 76753 - RNA, 22 nt, Human
gcuaaugaaaaauagauuauag

SEQ ID NO: 76754 - RNA, 22 nt, Human
cugcugccuuccaaaggccagg

SEQ ID NO: 76755 - RNA, 22 nt, Human
cugcugcucagugucaucaugu

SEQ ID NO: 76756 - RNA, 22 nt, Human
cugcugcugagagcucagccug

SEQ ID NO: 76757 - RNA, 22 nt, Human
cugcuggccuagcccauccucu

SEQ ID NO: 76758 - RNA, 17 nt, Human
cugcuggcuggggcuug

SEQ ID NO: 76759 - RNA, 22 nt, Human
cugcugggauagaaguaucuca

SEQ ID NO: 76760 - RNA, 22 nt, Human
cugcuggggaggcgccucgacg

SEQ ID NO: 76761 - RNA, 22 nt, Human
cugcuguaauaggagcguuuug

SEQ ID NO: 76762 - RNA, 22 nt, Human
cugcuguagagaaggguuguca

SEQ ID NO: 76763 - RNA, 22 nt, Human
cugcuguagccacugggcucag

SEQ ID NO: 76764 - RNA, 22 nt, Human
cugcugucccagccuccucaca

SEQ ID NO: 76765 - RNA, 22 nt, Human
cugcugucucacuggugugguu

SEQ ID NO: 76766 - RNA, 23 nt, Human
cugcugugaaacaugguuuuggu

SEQ ID NO: 76767 - RNA, 22 nt, Human
cugcugugggcaggguagcugg

SEQ ID NO: 76768 - RNA, 20 nt, Human
cugcugugguccuuuauuuu

SEQ ID NO: 76769 - RNA, 22 nt, Human
cugcuguggugucaagcaucuc

SEQ ID NO: 76770 - RNA, 22 nt, Human
cugcugugucagaguccagggg

SEQ ID NO: 76771 - RNA, 22 nt, Human
cugcuguguggauucaauggcu

SEQ ID NO: 76772 - RNA, 22 nt, Human
cugcuguucugaagcaacaagc

SEQ ID NO: 76773 - RNA, 22 nt, Human
cugcuguuucucaaaauuaagu

SEQ ID NO: 76774 - RNA, 18 nt, Human
cugcuuacaaaaauaccc

SEQ ID NO: 76775 - RNA, 19 nt, Human
cugcuucaggcgccuugcc

SEQ ID NO: 76776 - RNA, 22 nt, Human
cugcuucauagcccuggucucu

SEQ ID NO: 76777 - RNA, 22 nt, Human
cugcuucauauuucauagugau

SEQ ID NO: 76778 - RNA, 22 nt, Human
cugcuuccaagaaagagauagg

SEQ ID NO: 76779 - RNA, 22 nt, Human
cugcuuccaugcaauggcaguc

SEQ ID NO: 76780 - RNA, 22 nt, Human
cugcuuccucccuguaaaggca

SEQ ID NO: 76781 - RNA, 21 nt, Human
cugcuuccucucuucauggca

SEQ ID NO: 76782 - RNA, 22 nt, Human
cugcuucuaagaaccugcagcu

SEQ ID NO: 76783 - RNA, 22 nt, Human
cugcuucuagcaccaagucccu

SEQ ID NO: 76784 - RNA, 22 nt, Human
cugcuuggaggccugggugcua

SEQ ID NO: 76785 - RNA, 22 nt, Human
cugcuuggaguccuccagcacc

SEQ ID NO: 76786 - RNA, 20 nt, Human
cugcuugggacacugccaga

SEQ ID NO: 76787 - RNA, 22 nt, Human
cugcuugggguuaggguguccu

SEQ ID NO: 76788 - RNA, 22 nt, Human
cugcuuuaaaacugauacauga

SEQ ID NO: 76789 - RNA, 22 nt, Human
cugcuuuaagaaugaguguaag

SEQ ID NO: 76790 - RNA, 22 nt, Human
cugcuuuaauuuagacaaggca

SEQ ID NO: 76791 - RNA, 22 nt, Human
cugcuuuacucauaggguuuca

SEQ ID NO: 76792 - RNA, 22 nt, Human
cugcuuuagguggaauguucua

SEQ ID NO: 76793 - RNA, 22 nt, Human
cugcuuuagugugguguuagag

SEQ ID NO: 76794 - RNA, 22 nt, Human
cugcuuugacuguuaagaacca

SEQ ID NO: 76795 - RNA, 22 nt, Human
cugcuuugcauagcugccagag

SEQ ID NO: 76796 - RNA, 17 nt, Human
cugcuuugugcaacgcu

SEQ ID NO: 76797 - RNA, 22 nt, Human
cugcuuuuuguaggucccagag

SEQ ID NO: 76798 - RNA, 22 nt, Human
cuggaaagucaggucagaaacu

SEQ ID NO: 76799 - RNA, 22 nt, Human
cuggaaagugcugagacaauug

SEQ ID NO: 76800 - RNA, 22 nt, Human
cuggaaagugucuccauccugg

SEQ ID NO: 76801 - RNA, 19 nt, Human
cuggaaaguuggcagugag

SEQ ID NO: 76802 - RNA, 22 nt, Human
gcucagagaaucagcagacacc

SEQ ID NO: 76803 - RNA, 22 nt, Human
gcucagagagauuaaauaauuu

SEQ ID NO: 76804 - RNA, 22 nt, Human
gcucagagaguuucacaaguuu

SEQ ID NO: 76805 - RNA, 22 nt, Human
gcucagagauaaaacugaucag

SEQ ID NO: 76806 - RNA, 22 nt, Human
gcucagagauguucaguagcuu

SEQ ID NO: 76807 - RNA, 22 nt, Human
gcucagagcccgaggcuugcau

SEQ ID NO: 76808 - RNA, 22 nt, Human
gcucagaggaggccuuuaccua

SEQ ID NO: 76809 - RNA, 22 nt, Human
gcucagaggccaagugcccgcc

SEQ ID NO: 76810 - RNA, 22 nt, Human
gcucagagggaacaaggggcug

SEQ ID NO: 76811 - RNA, 22 nt, Human
gcucagaggguuuuggccaagu

SEQ ID NO: 76812 - RNA, 21 nt, Human
gcucagaguauugcacuguuu

SEQ ID NO: 76813 - RNA, 22 nt, Human
gcucagaguuaaauauagugcu

SEQ ID NO: 76814 - RNA, 22 nt, Human
gcucagaguuaauuggaugggu

SEQ ID NO: 76815 - RNA, 22 nt, Human
gcucagcuacuuacagguggcu

SEQ ID NO: 76816 - RNA, 22 nt, Human
gcucagcucuauggacacaaag

SEQ ID NO: 76817 - RNA, 21 nt, Human
gcucagcugcuugguuccugu

SEQ ID NO: 76818 - RNA, 22 nt, Human
gcucaggaaacagcagggcuug

SEQ ID NO: 76819 - RNA, 22 nt, Human
gcucaggaaggcucaaccagga

SEQ ID NO: 76820 - RNA, 22 nt, Human
gcucaggaccgaggggugggaa

SEQ ID NO: 76821 - RNA, 22 nt, Human
gcucaggagcucuugguggcgc

SEQ ID NO: 76822 - RNA, 22 nt, Human
gcucaggcauguaugugguugc

SEQ ID NO: 76823 - RNA, 22 nt, Human
gcucaggcccagcggcuggugu

SEQ ID NO: 76824 - RNA, 22 nt, Human
gcucaggccuggcccaugggac

SEQ ID NO: 76825 - RNA, 21 nt, Human
gcucaggcucuugacagagca

SEQ ID NO: 76826 - RNA, 22 nt, Human
gcucaggcuucuucuauaaaga

SEQ ID NO: 76827 - RNA, 22 nt, Human
gcucagggaaagagcuccuguc

SEQ ID NO: 76828 - RNA, 22 nt, Human
gcucagggaacuuuuugcaggc

SEQ ID NO: 76829 - RNA, 22 nt, Human
gcucagggaaugagaagauguu

SEQ ID NO: 76830 - RNA, 22 nt, Human
gcucagggagagagggcagccg

SEQ ID NO: 76831 - RNA, 22 nt, Human
gcucagggagcgauuuaccaug

SEQ ID NO: 76832 - RNA, 22 nt, Human
gcucagggccuggcugcggacu

SEQ ID NO: 76833 - RNA, 22 nt, Human
gcucagggucccuuggugcugg

SEQ ID NO: 76834 - RNA, 22 nt, Human
gcucagguguuaccuccucuag

SEQ ID NO: 76835 - RNA, 22 nt, Human
gcucagucuuugugggguacgg

SEQ ID NO: 76836 - RNA, 22 nt, Human
gcucagugaagggugccaagua

SEQ ID NO: 76837 - RNA, 22 nt, Human
gcucagugcagccuuucuguau

SEQ ID NO: 76838 - RNA, 22 nt, Human
gcucaguguuucugguagaaaa

SEQ ID NO: 76839 - RNA, 22 nt, Human
gcucaguuauccgugugugacu

SEQ ID NO: 76840 - RNA, 22 nt, Human
gcucauucagccagggcccggu

SEQ ID NO: 76841 - RNA, 22 nt, Human
gcuccaagguauccaccagggu

SEQ ID NO: 76842 - RNA, 17 nt, Human
gcuccagaauucuaguc

SEQ ID NO: 76843 - RNA, 22 nt, Human
gcuccagaugaaugcacuuguu

SEQ ID NO: 76844 - RNA, 22 nt, Human
gcuccagcaccuagagcagguc

SEQ ID NO: 76845 - RNA, 22 nt, Human
gcuccagcucuguucuggggaa

SEQ ID NO: 76846 - RNA, 22 nt, Human
gcuccaggaagggaaaucucca

SEQ ID NO: 76847 - RNA, 22 nt, Human
gcuccaggagagggaagcagau

SEQ ID NO: 76848 - RNA, 22 nt, Human
gcuccaggaggaugaccuuccu

SEQ ID NO: 76849 - RNA, 22 nt, Human
gcuccaggaggcucccgcgucu

SEQ ID NO: 76850 - RNA, 22 nt, Human
gcuccaggcugcucugucccau

SEQ ID NO: 76851 - RNA, 22 nt, Human
gcuccagggaacagaauguacu

SEQ ID NO: 76852 - RNA, 20 nt, Human
gcuccaggucagagaggacg

SEQ ID NO: 76853 - RNA, 22 nt, Human
gcuccagguggcuuauuuguau

SEQ ID NO: 76854 - RNA, 22 nt, Human
gcuccaguggacugggggaggc

SEQ ID NO: 76855 - RNA, 22 nt, Human
gcucccaggaagagaagggcca

SEQ ID NO: 76856 - RNA, 22 nt, Human
gcucccagggaccgcagggcag

SEQ ID NO: 76857 - RNA, 22 nt, Human
gcucccucccaccagccugcag

SEQ ID NO: 76858 - RNA, 22 nt, Human
gcucccugaaaagaacaaaguc

SEQ ID NO: 76859 - RNA, 17 nt, Human
gcucccugaggacagcu

SEQ ID NO: 76860 - RNA, 21 nt, Human
gcucccuggcugugugaccug

SEQ ID NO: 76861 - RNA, 23 nt, Human
gcucccugucccugcacuuaggc

SEQ ID NO: 76862 - RNA, 23 nt, Human
gcucccugugcuccaggagaugc

SEQ ID NO: 76863 - RNA, 22 nt, Human
gcucccuuaguccuugccggga

SEQ ID NO: 76864 - RNA, 22 nt, Human
gcuccuccaauauggacuccuc

SEQ ID NO: 76865 - RNA, 22 nt, Human
gcuccucccugugcagacccag

SEQ ID NO: 76866 - RNA, 22 nt, Human
gcuccucuuauuucaucagggc

SEQ ID NO: 76867 - RNA, 22 nt, Human
gcuccugcccucuugcaauucc

SEQ ID NO: 76868 - RNA, 18 nt, Human
gcuccuggaccaggucac

SEQ ID NO: 76869 - RNA, 22 nt, Human
gcuccuggauguucaagucggc

SEQ ID NO: 76870 - RNA, 22 nt, Human
gcuccuggcuucacugacauca

SEQ ID NO: 76871 - RNA, 22 nt, Human
cuggcaccuccagcucauggcc

SEQ ID NO: 76872 - RNA, 22 nt, Human
cuggcacuuggcacccaugaaa

SEQ ID NO: 76873 - RNA, 22 nt, Human
cuggcagaggauggggacccag

SEQ ID NO: 76874 - RNA, 22 nt, Human
cuggcagagucugcugucugca

SEQ ID NO: 76875 - RNA, 22 nt, Human
cuggcagcauuaacagagagca

SEQ ID NO: 76876 - RNA, 22 nt, Human
cuggcagccaagugggauacuc

SEQ ID NO: 76877 - RNA, 22 nt, Human
cuggcagcccaaccuagagucu

SEQ ID NO: 76878 - RNA, 22 nt, Human
cuggcagcgcagcaugaagucg

SEQ ID NO: 76879 - RNA, 22 nt, Human
cuggcagcgugagcagcaucca

SEQ ID NO: 76880 - RNA, 22 nt, Human
cuggcagcuuagcacucugguu

SEQ ID NO: 76881 - RNA, 22 nt, Human
cuggcagcuuccuuugcaucug

SEQ ID NO: 76882 - RNA, 22 nt, Human
cuggcaggaaggcauuuagaca

SEQ ID NO: 76883 - RNA, 22 nt, Human
cuggcaggcaaauuggugggag

SEQ ID NO: 76884 - RNA, 22 nt, Human
cuggcaggcagacuucugcaag

SEQ ID NO: 76885 - RNA, 22 nt, Human
cuggcagguggauggggacucc

SEQ ID NO: 76886 - RNA, 22 nt, Human
cuggcagguuuggugucuggug

SEQ ID NO: 76887 - RNA, 22 nt, Human
cuggcagucacggccaugugcu

SEQ ID NO: 76888 - RNA, 22 nt, Human
cuggcagucugccucuucacug

SEQ ID NO: 76889 - RNA, 22 nt, Human
cuggcaguguccagcucgugau

SEQ ID NO: 76890 - RNA, 22 nt, Human
cuggcaguuggcauuggcaucu

SEQ ID NO: 76891 - RNA, 22 nt, Human
cuggcaguuugccaggagcucg

SEQ ID NO: 76892 - RNA, 22 nt, Human
cuggcaucuagugcguugaggu

SEQ ID NO: 76893 - RNA, 22 nt, Human
cuggcaugguguauuuguucaa

SEQ ID NO: 76894 - RNA, 22 nt, Human
cuggccaacaucuggggcacau

SEQ ID NO: 76895 - RNA, 22 nt, Human
cuggccaauauagggaaaucuu

SEQ ID NO: 76896 - RNA, 22 nt, Human
cuggccacugauuccuccccug

SEQ ID NO: 76897 - RNA, 22 nt, Human
cuggccagccucccagguaccc

SEQ ID NO: 76898 - RNA, 22 nt, Human
cuggccagccugucgaugcccu

SEQ ID NO: 76899 - RNA, 22 nt, Human
cuggccagcugacagcagggcu

SEQ ID NO: 76900 - RNA, 22 nt, Human
cuggccagggugcgaucguggu

SEQ ID NO: 76901 - RNA, 22 nt, Human
cuggccagugacugcucacccg

SEQ ID NO: 76902 - RNA, 22 nt, Human
cuggccaguguggcucugaucu

SEQ ID NO: 76903 - RNA, 22 nt, Human
cuggccaguugccuuccugggu

SEQ ID NO: 76904 - RNA, 22 nt, Human
cuggccauguugccucugagac

SEQ ID NO: 76905 - RNA, 22 nt, Human
cuggcccagagagcagagcuua

SEQ ID NO: 76906 - RNA, 22 nt, Human
cuggcccaggaagacguguccc

SEQ ID NO: 76907 - RNA, 20 nt, Human
cuggcccaggaugauggcgc

SEQ ID NO: 76908 - RNA, 22 nt, Human
cuggcccaggcuccuggggcac

SEQ ID NO: 76909 - RNA, 22 nt, Human
cuggcccaguucugcguuuugc

SEQ ID NO: 76910 - RNA, 22 nt, Human
cuggccccagaguuucacuugg

SEQ ID NO: 76911 - RNA, 19 nt, Human
cuggucugcugcuuccagg

SEQ ID NO: 76912 - RNA, 22 nt, Human
cuggucuggcuacccagcgaau

SEQ ID NO: 76913 - RNA, 19 nt, Human
cuggucugucaugcucccc

SEQ ID NO: 76914 - RNA, 22 nt, Human
cuggucuguccgcaggucaccu

SEQ ID NO: 76915 - RNA, 22 nt, Human
cuggugaccggaccucaguuuu

SEQ ID NO: 76916 - RNA, 22 nt, Human
cuggugaccuugccccagguca

SEQ ID NO: 76917 - RNA, 19 nt, Human
cuggugaggguuauugaua

SEQ ID NO: 76918 - RNA, 22 nt, Human
cuggugaucuugggcaagucac

SEQ ID NO: 76919 - RNA, 22 nt, Human
cuggugcaaaaguaauuguggu

SEQ ID NO: 76920 - RNA, 22 nt, Human
cuggugcacaugaaagagaagg

SEQ ID NO: 76921 - RNA, 22 nt, Human
cuggugcauguggccuugcucu

SEQ ID NO: 76922 - RNA, 22 nt, Human
cuggugcuggcaacagaguagg

SEQ ID NO: 76923 - RNA, 22 nt, Human
cuggugcuguagccugauugag

SEQ ID NO: 76924 - RNA, 22 nt, Human
cugguggagaugccuggccccu

SEQ ID NO: 76925 - RNA, 22 nt, Human
cuggugggaagauggaaaacau

SEQ ID NO: 76926 - RNA, 22 nt, Human
cuggugggagauaauugaauca

SEQ ID NO: 76927 - RNA, 22 nt, Human
cuggugggagcagcaggcagcu

SEQ ID NO: 76928 - RNA, 22 nt, Human
cuggugggaggcaagguggaag

SEQ ID NO: 76929 - RNA, 22 nt, Human
cuggugguucaggagaauggcu

SEQ ID NO: 76930 - RNA, 22 nt, Human
cuggugucauuuuagccucagg

SEQ ID NO: 76931 - RNA, 22 nt, Human
cugguguccagcauguguggaa

SEQ ID NO: 76932 - RNA, 22 nt, Human
cugguguccgcaacgggcagcg

SEQ ID NO: 76933 - RNA, 22 nt, Human
cuggugugauugagcccaggug

SEQ ID NO: 76934 - RNA, 22 nt, Human
cugguguggcggcgcccuguag

SEQ ID NO: 76935 - RNA, 22 nt, Human
cugguuaauccauaaacagaga

SEQ ID NO: 76936 - RNA, 22 nt, Human
cugguuauuauucuuggaaugc

SEQ ID NO: 76937 - RNA, 22 nt, Human
cugguucauauaggcaaguuua

SEQ ID NO: 76938 - RNA, 22 nt, Human
cugguuggaagugcagacucuc

SEQ ID NO: 76939 - RNA, 22 nt, Human
cugguuuagcuguaagguuccc

SEQ ID NO: 76940 - RNA, 22 nt, Human
cugguuuaguaggggacugaag

SEQ ID NO: 76941 - RNA, 22 nt, Human
cugguuuauguaucaucuagaa

SEQ ID NO: 76942 - RNA, 22 nt, Human
cugguuugucuugggaggaugu

SEQ ID NO: 76943 - RNA, 22 nt, Human
cugguuuugcccagucuugcac

SEQ ID NO: 76944 - RNA, 22 nt, Human
cuguaaaaugaaccuagucauc

SEQ ID NO: 76945 - RNA, 22 nt, Human
cuguaaauaugaagaauauaug

SEQ ID NO: 76946 - RNA, 22 nt, Human
cuguaacuuagcaugguuacua

SEQ ID NO: 76947 - RNA, 22 nt, Human
cuguaagggccugacuacccug

SEQ ID NO: 76948 - RNA, 22 nt, Human
cuguacaaaagaaaguuccuau

SEQ ID NO: 76949 - RNA, 22 nt, Human
cuguacagaccuauuagcccag

SEQ ID NO: 76950 - RNA, 19 nt, Human
cuguacagguugcuucugg

SEQ ID NO: 76951 - RNA, 22 nt, Human
cuguacauaaaggaauaggugu

SEQ ID NO: 76952 - RNA, 22 nt, Human
cuguacauauacauuuuuuucc

SEQ ID NO: 76953 - RNA, 22 nt, Human
cuguacaucuuaaauggaaaaa

SEQ ID NO: 76954 - RNA, 22 nt, Human
cuguacuaauugcuuuacaugu

SEQ ID NO: 76955 - RNA, 22 nt, Human
cuguagcagacagacccuaggu

SEQ ID NO: 76956 - RNA, 22 nt, Human
cuguagccagaagcagaaggcc

SEQ ID NO: 76957 - RNA, 22 nt, Human
cuguaguugaugauuucugaua

SEQ ID NO: 76958 - RNA, 22 nt, Human
cuguauaugugcauacacacac

SEQ ID NO: 76959 - RNA, 22 nt, Human
cuguaucugucagcuggucucg

SEQ ID NO: 76960 - RNA, 22 nt, Human
cuguaucuguguuggaugaguu

SEQ ID NO: 76961 - RNA, 22 nt, Human
cuguaugaaauugucauuuuua

SEQ ID NO: 76962 - RNA, 22 nt, Human
cuguaugauauccaaauugaua

SEQ ID NO: 76963 - RNA, 22 nt, Human
cuguauuuaguuaaaaugcuaa

SEQ ID NO: 76964 - RNA, 22 nt, Human
cuguauuugaaagaaaagauuu

SEQ ID NO: 76965 - RNA, 22 nt, Human
cuguauuuuuuaagaauaucuc

SEQ ID NO: 76966 - RNA, 22 nt, Human
cuguauuuuuuaagugaucugg

SEQ ID NO: 76967 - RNA, 22 nt, Human
cugucaacauuggugucuguca

SEQ ID NO: 76968 - RNA, 22 nt, Human
cugucacagcccgcgucuccuc

SEQ ID NO: 76969 - RNA, 22 nt, Human
cugucacucuggcaacccagua

SEQ ID NO: 76970 - RNA, 22 nt, Human
cugucagaggcucucuguugcc

SEQ ID NO: 76971 - RNA, 22 nt, Human
cugucaggggcggguggagcgg

SEQ ID NO: 76972 - RNA, 22 nt, Human
cugucagggggccuggccauca

SEQ ID NO: 76973 - RNA, 22 nt, Human
cugucaguucuuccagauagag

SEQ ID NO: 76974 - RNA, 22 nt, Human
cugucauggucagauugucauc

SEQ ID NO: 76975 - RNA, 22 nt, Human
cugucauucuuacauaauguga

SEQ ID NO: 76976 - RNA, 22 nt, Human
cugucauuggcagggagugugu

SEQ ID NO: 76977 - RNA, 21 nt, Human
cuguccacaucacagagccuc

SEQ ID NO: 76978 - RNA, 22 nt, Human
cuguccagaauaggcaaaucca

SEQ ID NO: 76979 - RNA, 22 nt, Human
cuguccagcugaccagagcagc

SEQ ID NO: 76980 - RNA, 21 nt, Human
cuguccaguaauuccuggcac

SEQ ID NO: 76981 - RNA, 22 nt, Human
cuguccagucagaacgucauua

SEQ ID NO: 76982 - RNA, 22 nt, Human
cuguccaugacuugcacuauaa

SEQ ID NO: 76983 - RNA, 22 nt, Human
cuguccaugcauguugucugcu

SEQ ID NO: 76984 - RNA, 22 nt, Human
cuguccauguuaagccccuugc

SEQ ID NO: 76985 - RNA, 22 nt, Human
cugucccagccccguacucuaa

SEQ ID NO: 76986 - RNA, 22 nt, Human
cuguccccauuguuugaggguu

SEQ ID NO: 76987 - RNA, 22 nt, Human
cugucccucaucaccucugggu

SEQ ID NO: 76988 - RNA, 19 nt, Human
cugucccucccagguauga

SEQ ID NO: 76989 - RNA, 16 nt, Human
gcuccugggcccucga

SEQ ID NO: 76990 - RNA, 19 nt, Human
gcuccugggccucacucau

SEQ ID NO: 76991 - RNA, 22 nt, Human
gcuccuggucuggagcuucaag

SEQ ID NO: 76992 - RNA, 20 nt, Human
gcuccuguccugguggaggg

SEQ ID NO: 76993 - RNA, 22 nt, Human
gcuccugugaggacacagccgc

SEQ ID NO: 76994 - RNA, 17 nt, Human
gcuccuucuaacuucca

SEQ ID NO: 76995 - RNA, 22 nt, Human
gcucgaccgccagaaacuuccu

SEQ ID NO: 76996 - RNA, 18 nt, Human
gcucuaauuuuagaaagg

SEQ ID NO: 76997 - RNA, 22 nt, Human
gcucuagaaagaaggauguggg

SEQ ID NO: 76998 - RNA, 22 nt, Human
gcucuaugcaugggagcaggag

SEQ ID NO: 76999 - RNA, 22 nt, Human
gcucucacuuuagguuggaccg

SEQ ID NO: 77000 - RNA, 22 nt, Human
gcucucagguacaaagcugugu

SEQ ID NO: 77001 - RNA, 22 nt, Human
gcucucaugcccucugggcuug

SEQ ID NO: 77002 - RNA, 22 nt, Human
gcucuccaaacccuguggcuuu

SEQ ID NO: 77003 - RNA, 22 nt, Human
gcucuccugugcagaugcugcu

SEQ ID NO: 77004 - RNA, 22 nt, Human
gcucucuggcuaguccaucggg

SEQ ID NO: 77005 - RNA, 22 nt, Human
gcucucuggguggugggcaaca

SEQ ID NO: 77006 - RNA, 22 nt, Human
gcucucugucguuaugcuucau

SEQ ID NO: 77007 - RNA, 20 nt, Human
gcucugaccauaucaagaca

SEQ ID NO: 77008 - RNA, 22 nt, Human
gcucugacuggugggccacagu

SEQ ID NO: 77009 - RNA, 19 nt, Human
gcucugagaggggcauggg

SEQ ID NO: 77010 - RNA, 22 nt, Human
gcucugagagugcaugauagca

SEQ ID NO: 77011 - RNA, 22 nt, Human
gcucugagagugggugauucug

SEQ ID NO: 77012 - RNA, 22 nt, Human
gcucugagcagggagaaacagg

SEQ ID NO: 77013 - RNA, 22 nt, Human
gcucugagcccccagaagcaga

SEQ ID NO: 77014 - RNA, 22 nt, Human
gcucugagccgggggccugucc

SEQ ID NO: 77015 - RNA, 22 nt, Human
gcucugagcucagcgucagagu

SEQ ID NO: 77016 - RNA, 22 nt, Human
gcucugaguaaaugaaagcauu

SEQ ID NO: 77017 - RNA, 22 nt, Human
gcucugagugauuaaggagcuu

SEQ ID NO: 77018 - RNA, 18 nt, Human
gcucugcagcugaggcuu

SEQ ID NO: 77019 - RNA, 21 nt, Human
gcucugccacuuaccagauuu

SEQ ID NO: 77020 - RNA, 19 nt, Human
gcucugccagugguaacau

SEQ ID NO: 77021 - RNA, 22 nt, Human
cugggugcuuacuuugugcuag

SEQ ID NO: 77022 - RNA, 20 nt, Human
cuggguggcaagcaaggggg

SEQ ID NO: 77023 - RNA, 22 nt, Human
cuggguggcagagccugcagug

SEQ ID NO: 77024 - RNA, 22 nt, Human
cugggugguuuugaugugaauu

SEQ ID NO: 77025 - RNA, 22 nt, Human
cugggugucaggagacaugaug

SEQ ID NO: 77026 - RNA, 22 nt, Human
cugggugugggucaagcaacca

SEQ ID NO: 77027 - RNA, 22 nt, Human
cuggguguucaggagcugggcu

SEQ ID NO: 77028 - RNA, 22 nt, Human
cuggguucuuggcacagcagga

SEQ ID NO: 77029 - RNA, 22 nt, Human
cugguacaaaaugcugauauca

SEQ ID NO: 77030 - RNA, 22 nt, Human
cugguauaguauaaauuaaugu

SEQ ID NO: 77031 - RNA, 22 nt, Human
cugguauugaguuguugcuucc

SEQ ID NO: 77032 - RNA, 22 nt, Human
cuggucaauaaucauguaguac

SEQ ID NO: 77033 - RNA, 22 nt, Human
cuggucagggcucuuugggagc

SEQ ID NO: 77034 - RNA, 22 nt, Human
cuggucaugccagguuugcugc

SEQ ID NO: 77035 - RNA, 22 nt, Human
cugguccagaauuuaugauucu

SEQ ID NO: 77036 - RNA, 22 nt, Human
cugguccauucucucccugaag

SEQ ID NO: 77037 - RNA, 22 nt, Human
cugguccccagacugggcuuag

SEQ ID NO: 77038 - RNA, 22 nt, Human
cuggucccugcagugugcuggg

SEQ ID NO: 77039 - RNA, 22 nt, Human
cugguccuugacgcgugggagg

SEQ ID NO: 77040 - RNA, 22 nt, Human
cugguccuugcuacccagcaag

SEQ ID NO: 77041 - RNA, 18 nt, Human
cuggucucccuucgcuuu

SEQ ID NO: 77042 - RNA, 22 nt, Human
cuggucugaaaaggaggcaugc

SEQ ID NO: 77043 - RNA, 22 nt, Human
cuggugcaaggcuuuggaaucc

SEQ ID NO: 77044 - RNA, 22 nt, Human
cuggugcacguggcugcagucg

SEQ ID NO: 77045 - RNA, 22 nt, Human
cuggugcaggaaggagcuggca

SEQ ID NO: 77046 - RNA, 22 nt, Human
cuggugccuccucucccagguc

SEQ ID NO: 77047 - RNA, 22 nt, Human
cuggugcugggcagggcucagg

SEQ ID NO: 77048 - RNA, 19 nt, Human
cuggugcuugagugaguca

SEQ ID NO: 77049 - RNA, 22 nt, Human
cugguggaauggcagagggaac

SEQ ID NO: 77050 - RNA, 22 nt, Human
cugguggagagugggcucugga

SEQ ID NO: 77051 - RNA, 22 nt, Human
cugguggagggacaggcuuagc

SEQ ID NO: 77052 - RNA, 22 nt, Human
cugguggcaucuugagacgguu

SEQ ID NO: 77053 - RNA, 22 nt, Human
cugguguuuauuacaggugcuc

SEQ ID NO: 77054 - RNA, 23 nt, Human
cugguucauagucaagagauuga

SEQ ID NO: 77055 - RNA, 22 nt, Human
cugguucauccccuuccaggaa

SEQ ID NO: 77056 - RNA, 22 nt, Human
cugguucaugguggaaugacau

SEQ ID NO: 77057 - RNA, 22 nt, Human
cugguucauuagguauuagugg

SEQ ID NO: 77058 - RNA, 22 nt, Human
cugguuccagaauugccugugg

SEQ ID NO: 77059 - RNA, 22 nt, Human
cugguucugauguucuuggcuu

SEQ ID NO: 77060 - RNA, 22 nt, Human
cugguugggagguuggcuuuca

SEQ ID NO: 77061 - RNA, 22 nt, Human
cugguuuaaccauguauccugg

SEQ ID NO: 77062 - RNA, 22 nt, Human
cugguuuauucgucacaccgga

SEQ ID NO: 77063 - RNA, 22 nt, Human
cugguuugcccacaccagccac

SEQ ID NO: 77064 - RNA, 22 nt, Human
cugguuuuaauguuauguuuau

SEQ ID NO: 77065 - RNA, 22 nt, Human
cugguuuugaauaugucugcuu

SEQ ID NO: 77066 - RNA, 22 nt, Human
cugguuuuuagugcuuaggagu

SEQ ID NO: 77067 - RNA, 20 nt, Human
cuguaaaccaggcuucuugg

SEQ ID NO: 77068 - RNA, 20 nt, Human
cuguaaacugcgucuguaau

SEQ ID NO: 77069 - RNA, 22 nt, Human
cuguaaccuccucuuuccauuc

SEQ ID NO: 77070 - RNA, 22 nt, Human
cuguacagaguucugaguguac

SEQ ID NO: 77071 - RNA, 22 nt, Human
cuguaccucagcuuugcuccca

SEQ ID NO: 77072 - RNA, 22 nt, Human
cuguagagaaagcauggaagcu

SEQ ID NO: 77073 - RNA, 22 nt, Human
cuguagaggaacaagagcucuu

SEQ ID NO: 77074 - RNA, 22 nt, Human
cuguagcaaguuauucaauaaa

SEQ ID NO: 77075 - RNA, 22 nt, Human
cuguagccaguuuggccucacc

SEQ ID NO: 77076 - RNA, 22 nt, Human
cuguagcugacaggaucacuua

SEQ ID NO: 77077 - RNA, 22 nt, Human
cuguaggagugggaauuuauug

SEQ ID NO: 77078 - RNA, 22 nt, Human
cuguaguugggcauuauaauag

SEQ ID NO: 77079 - RNA, 22 nt, Human
cuguauaaacauauuuucaagu

SEQ ID NO: 77080 - RNA, 22 nt, Human
cuguauaaccccaugcgacugu

SEQ ID NO: 77081 - RNA, 22 nt, Human
cuguauaagauaccacacugaa

SEQ ID NO: 77082 - RNA, 22 nt, Human
cuguauauggcuuacuuuauau

SEQ ID NO: 77083 - RNA, 22 nt, Human
cuguaugaacccauauacuuau

SEQ ID NO: 77084 - RNA, 22 nt, Human
cuguaugaguugggaauagaau

SEQ ID NO: 77085 - RNA, 22 nt, Human
cuguauguagaauagcugacaa

SEQ ID NO: 77086 - RNA, 22 nt, Human
cuguauguuccguuuugucacu

SEQ ID NO: 77087 - RNA, 22 nt, Human
cuguauguuucuaugaauguga

SEQ ID NO: 77088 - RNA, 22 nt, Human
cuguauguuuucuccuuugguu

SEQ ID NO: 77089 - RNA, 21 nt, Human
cuguauuaacuuuugcaccuu

SEQ ID NO: 77090 - RNA, 22 nt, Human
cuguauuauuuucuuagcucug

SEQ ID NO: 77091 - RNA, 23 nt, Human
cuguauuugacuugagcggaaau

SEQ ID NO: 77092 - RNA, 22 nt, Human
cugucacacuaaaacaagaagu

SEQ ID NO: 77093 - RNA, 22 nt, Human
cugucacccacccagccuguca

SEQ ID NO: 77094 - RNA, 18 nt, Human
cugucaccgccaccacac

SEQ ID NO: 77095 - RNA, 21 nt, Human
cugucaccugcucagagaggg

SEQ ID NO: 77096 - RNA, 22 nt, Human
cugucacugaugcuccugccac

SEQ ID NO: 77097 - RNA, 22 nt, Human
cugucacugaugggcucaccag

SEQ ID NO: 77098 - RNA, 18 nt, Human
cugucagcagcuucacga

SEQ ID NO: 77099 - RNA, 22 nt, Human
cugucagcuucuccuggccaga

SEQ ID NO: 77100 - RNA, 22 nt, Human
cugucauugagccugucagggc

SEQ ID NO: 77101 - RNA, 22 nt, Human
cugucauuguacauguuauaca

SEQ ID NO: 77102 - RNA, 22 nt, Human
cugucauuucuauuauagagga

SEQ ID NO: 77103 - RNA, 21 nt, Human
cuguccaaauuucauaacuuu

SEQ ID NO: 77104 - RNA, 22 nt, Human
cuguccagucuuuagcaagcug

SEQ ID NO: 77105 - RNA, 22 nt, Human
cuguccauggcaaugaugcaga

SEQ ID NO: 77106 - RNA, 22 nt, Human
cuguccaugguccuuauuacca

SEQ ID NO: 77107 - RNA, 22 nt, Human
cuguguggccucaagccagccu

SEQ ID NO: 77108 - RNA, 22 nt, Human
cugugugugaacacagcccagc

SEQ ID NO: 77109 - RNA, 22 nt, Human
cuguguguuuauaucauuuccu

SEQ ID NO: 77110 - RNA, 22 nt, Human
cuguguuggcuuuucucuugua

SEQ ID NO: 77111 - RNA, 22 nt, Human
cuguguuuugauuaaaaagcaa

SEQ ID NO: 77112 - RNA, 22 nt, Human
cuguuaaaauguggucuuaaaa

SEQ ID NO: 77113 - RNA, 22 nt, Human
cuguuaaagauaguuaagcuuc

SEQ ID NO: 77114 - RNA, 22 nt, Human
cuguuaaauagacugcagugca

SEQ ID NO: 77115 - RNA, 22 nt, Human
cuguuaaaugagaaagcagacu

SEQ ID NO: 77116 - RNA, 22 nt, Human
cuguuaaucugcuugcaugaug

SEQ ID NO: 77117 - RNA, 17 nt, Human
cuguuaauucauuuccc

SEQ ID NO: 77118 - RNA, 22 nt, Human
cuguuacuccuuuggcagauua

SEQ ID NO: 77119 - RNA, 22 nt, Human
cuguuacugaaaugcaccgugc

SEQ ID NO: 77120 - RNA, 22 nt, Human
cuguuacuguuggcccagggug

SEQ ID NO: 77121 - RNA, 22 nt, Human
cuguuacuucaaucuucucccg

SEQ ID NO: 77122 - RNA, 22 nt, Human
cuguuagucuuuugcaggagag

SEQ ID NO: 77123 - RNA, 22 nt, Human
cuguuagugaucaaagggagag

SEQ ID NO: 77124 - RNA, 23 nt, Human
cuguuauuccaggcugaugggug

SEQ ID NO: 77125 - RNA, 22 nt, Human
cuguuauuccccuugcuguggu

SEQ ID NO: 77126 - RNA, 19 nt, Human
cuguuauugucagagcucc

SEQ ID NO: 77127 - RNA, 22 nt, Human
cuguuauuuagaacauggaauc

SEQ ID NO: 77128 - RNA, 22 nt, Human
cuguuauuucugaaugccaucc

SEQ ID NO: 77129 - RNA, 22 nt, Human
cuguuauuuggaggaugcuugg

SEQ ID NO: 77130 - RNA, 19 nt, Human
cuuauacagauuuucucau

SEQ ID NO: 77131 - RNA, 22 nt, Human
cuuauacugaaaaauuauuugu

SEQ ID NO: 77132 - RNA, 22 nt, Human
cuuauauuugucaacuuuacaa

SEQ ID NO: 77133 - RNA, 22 nt, Human
cuuauauuuuaggaacagacaa

SEQ ID NO: 77134 - RNA, 22 nt, Human
cuuaucaaacuggagcaggcuu

SEQ ID NO: 77135 - RNA, 22 nt, Human
cuuaucauaucauacauggcua

SEQ ID NO: 77136 - RNA, 22 nt, Human
cuuaucuuacuuccccuucaug

SEQ ID NO: 77137 - RNA, 22 nt, Human
cuuauggcuguagucuggaagu

SEQ ID NO: 77138 - RNA, 22 nt, Human
cuuauguauaauguuccacaua

SEQ ID NO: 77139 - RNA, 22 nt, Human
cuuauuagaguuguguucuguu

SEQ ID NO: 77140 - RNA, 22 nt, Human
cuuauuagugucugucugaguu

SEQ ID NO: 77141 - RNA, 22 nt, Human
cuuauuauggcauguaaguggg

SEQ ID NO: 77142 - RNA, 22 nt, Human
cuuauucagaaggagaaaugga

SEQ ID NO: 77143 - RNA, 22 nt, Human
cuuauucagaccuuggauucuu

SEQ ID NO: 77144 - RNA, 22 nt, Human
cuuauucagauacagacucuug

SEQ ID NO: 77145 - RNA, 22 nt, Human
cuuauucauauauucucgguag

SEQ ID NO: 77146 - RNA, 22 nt, Human
cuuauucuugucuuauugugcu

SEQ ID NO: 77147 - RNA, 22 nt, Human
cuuauugugagguauugagauu

SEQ ID NO: 77148 - RNA, 22 nt, Human
cuuauugugauuccugccucuu

SEQ ID NO: 77149 - RNA, 22 nt, Human
cuuauuguguguauuuucuagu

SEQ ID NO: 77150 - RNA, 22 nt, Human
cuuauuguuccuggacccugag

SEQ ID NO: 77151 - RNA, 22 nt, Human
cuuauuuccugacauggaaaga

SEQ ID NO: 77152 - RNA, 22 nt, Human
cuuauuucuccauccagaguca

SEQ ID NO: 77153 - RNA, 22 nt, Human
cuuauuugcccauguuucuuua

SEQ ID NO: 77154 - RNA, 22 nt, Human
cuuauuuuaagucaguuugggu

SEQ ID NO: 77155 - RNA, 22 nt, Human
cuucaaaagccagaagccugcg

SEQ ID NO: 77156 - RNA, 22 nt, Human
cuucaaagauuauugaaaacaa

SEQ ID NO: 77157 - RNA, 22 nt, Human
cuucaaagauuugauaaagcca

SEQ ID NO: 77158 - RNA, 22 nt, Human
cuucaaauacaaguagauuaug

SEQ ID NO: 77159 - RNA, 22 nt, Human
cuucaaauucgaggaguagaug

SEQ ID NO: 77160 - RNA, 22 nt, Human
cuucaacaguuuuagaacacug

SEQ ID NO: 77161 - RNA, 22 nt, Human
cuucaagaagacagcagagcau

SEQ ID NO: 77162 - RNA, 22 nt, Human
cuucaagauauuucuagaauca

SEQ ID NO: 77163 - RNA, 22 nt, Human
cuucaaggcuuauuccaguugu

SEQ ID NO: 77164 - RNA, 22 nt, Human
cuucaagguggcuaaauggggc

SEQ ID NO: 77165 - RNA, 22 nt, Human
cuucacaaaauauuucauuaua

SEQ ID NO: 77166 - RNA, 22 nt, Human
cuucacaaauggccuagaguuc

SEQ ID NO: 77167 - RNA, 16 nt, Human
cuucacagaggagagu

SEQ ID NO: 77168 - RNA, 22 nt, Human
cuucacauggguacugcugauc

SEQ ID NO: 77169 - RNA, 22 nt, Human
cuucacuggaaucuguaauagu

SEQ ID NO: 77170 - RNA, 22 nt, Human
cuucacuucacagaugccaaga

SEQ ID NO: 77171 - RNA, 22 nt, Human
cuucacuuuaagccaaucauga

SEQ ID NO: 77172 - RNA, 22 nt, Human
cuucagaaauaacaacaauuac

SEQ ID NO: 77173 - RNA, 22 nt, Human
cuucagaagaaaagcagugugu

SEQ ID NO: 77174 - RNA, 22 nt, Human
cuucagcaacuuuggaauguuu

SEQ ID NO: 77175 - RNA, 22 nt, Human
cuucagcugacgucaaaacacc

SEQ ID NO: 77176 - RNA, 22 nt, Human
cuucaggaguaguuaccuagca

SEQ ID NO: 77177 - RNA, 22 nt, Human
cuucaggauuaauuuggggccu

SEQ ID NO: 77178 - RNA, 19 nt, Human
cuucagggaggggccaggc

SEQ ID NO: 77179 - RNA, 22 nt, Human
cuucaguauccuccacauguua

SEQ ID NO: 77180 - RNA, 22 nt, Human
cuucagugauugcagaaagccu

SEQ ID NO: 77181 - RNA, 22 nt, Human
cuucagugcauguuuauaauca

SEQ ID NO: 77182 - RNA, 19 nt, Human
cuucaguguucaccuggcc

SEQ ID NO: 77183 - RNA, 22 nt, Human
cuucaguuagccaauucagguc

SEQ ID NO: 77184 - RNA, 22 nt, Human
cuucaguuaguuucaugugagc

SEQ ID NO: 77185 - RNA, 22 nt, Human
cuucaguuuaucccaucaucca

SEQ ID NO: 77186 - RNA, 22 nt, Human
cuucauaaucugaaauuuguaa

SEQ ID NO: 77187 - RNA, 22 nt, Human
cuucauaggguuguaaggauua

SEQ ID NO: 77188 - RNA, 22 nt, Human
cuucauaucucuguagaguuuu

SEQ ID NO: 77189 - RNA, 23 nt, Human
cuucaucaaaaguuaacacuagu

SEQ ID NO: 77190 - RNA, 22 nt, Human
cuucaucaacucuaacaaaugu

SEQ ID NO: 77191 - RNA, 21 nt, Human
cuucaucccggagauucuggu

SEQ ID NO: 77192 - RNA, 22 nt, Human
cuucaugaguguacaaccugug

SEQ ID NO: 77193 - RNA, 22 nt, Human
cuucaugaugaccaacugccau

SEQ ID NO: 77194 - RNA, 22 nt, Human
cuucauuaaccaaaaugcaaua

SEQ ID NO: 77195 - RNA, 22 nt, Human
cuucauuuccauccaacuggga

SEQ ID NO: 77196 - RNA, 22 nt, Human
cuucauuuggcaggcuggccuc

SEQ ID NO: 77197 - RNA, 22 nt, Human
cuuccagagauccaugaauacc

SEQ ID NO: 77198 - RNA, 22 nt, Human
cuuccagaggaacucugcagug

SEQ ID NO: 77199 - RNA, 22 nt, Human
cuuccagcugauuacaggcuau

SEQ ID NO: 77200 - RNA, 22 nt, Human
cuuccaggguccaggaagagcc

SEQ ID NO: 77201 - RNA, 22 nt, Human
cuucccaagcuuuaguuauuuu

SEQ ID NO: 77202 - RNA, 22 nt, Human
cuucccacuaaagcccuuguug

SEQ ID NO: 77203 - RNA, 22 nt, Human
cuuccccaaccccgacugugug

SEQ ID NO: 77204 - RNA, 22 nt, Human
cuucccuuuagcauauaguagu

SEQ ID NO: 77205 - RNA, 22 nt, Human
cuucccuuucuggugacuucuc

SEQ ID NO: 77206 - RNA, 22 nt, Human
cuuccuagcuucagagucuguu

SEQ ID NO: 77207 - RNA, 22 nt, Human
cuuccuagugucuacuuuggag

SEQ ID NO: 77208 - RNA, 22 nt, Human
cuuccucacggugcaacaggaa

SEQ ID NO: 77209 - RNA, 18 nt, Human
cuuccucaucgcucuccc

SEQ ID NO: 77210 - RNA, 22 nt, Human
cuuccucccggcccaugcucug

SEQ ID NO: 77211 - RNA, 22 nt, Human
cuuccuccgaagaaguugcugg

SEQ ID NO: 77212 - RNA, 22 nt, Human
cuuccucuauguucagguagaa

SEQ ID NO: 77213 - RNA, 22 nt, Human
cuuccucucuugcccauaagag

SEQ ID NO: 77214 - RNA, 22 nt, Human
cuuccucuguggccagagugua

SEQ ID NO: 77215 - RNA, 18 nt, Human
cuuccucuucuggagaaa

SEQ ID NO: 77216 - RNA, 22 nt, Human
cuuccugaacaaugccaucaau

SEQ ID NO: 77217 - RNA, 22 nt, Human
cuuccugaaggauggcagccuc

SEQ ID NO: 77218 - RNA, 22 nt, Human
cuuccugaaucuuccauguaua

SEQ ID NO: 77219 - RNA, 22 nt, Human
cuuccugaggugcugagcacag

SEQ ID NO: 77220 - RNA, 22 nt, Human
cuuccugcccacuuccugcugg

SEQ ID NO: 77221 - RNA, 19 nt, Human
cuuccuggaggagagccuc

SEQ ID NO: 77222 - RNA, 22 nt, Human
cuuccugggacaccuaacucua

SEQ ID NO: 77223 - RNA, 22 nt, Human
cuuccuuggcuucuggggugug

SEQ ID NO: 77224 - RNA, 22 nt, Human
cuuccuuuccccaaucauaucg

SEQ ID NO: 77225 - RNA, 22 nt, Human
cuuccuuugguuggagcgccgu

SEQ ID NO: 77226 - RNA, 22 nt, Human
cuucuaagcugagaaugccuuu

SEQ ID NO: 77227 - RNA, 22 nt, Human
cuucuaauauaaagucuuugca

SEQ ID NO: 77228 - RNA, 22 nt, Human
cuucuagagcuggagcaaaugu

SEQ ID NO: 77229 - RNA, 22 nt, Human
cuucuagauuuuuguaauuguu

SEQ ID NO: 77230 - RNA, 22 nt, Human
cuucuaggcuucucagggggca

SEQ ID NO: 77231 - RNA, 22 nt, Human
cuucuauaaacugugaucuuuc

SEQ ID NO: 77232 - RNA, 22 nt, Human
cuucuauucacuggucacaguu

SEQ ID NO: 77233 - RNA, 23 nt, Human
cuucucagaagucugugccagga

SEQ ID NO: 77234 - RNA, 23 nt, Human
cuucucaguaguacacacacuau

SEQ ID NO: 77235 - RNA, 22 nt, Human
cuucucauucaagcaaaacaga

SEQ ID NO: 77236 - RNA, 22 nt, Human
cuucucccgaagccgguucugc

SEQ ID NO: 77237 - RNA, 22 nt, Human
cuucucccuggcuucugcacac

SEQ ID NO: 77238 - RNA, 22 nt, Human
cuucucccugggggcucuuuau

SEQ ID NO: 77239 - RNA, 22 nt, Human
ggaauguuuuagcuugacuuuu

SEQ ID NO: 77240 - RNA, 22 nt, Human
ggaauucuuaaaauggugugua

SEQ ID NO: 77241 - RNA, 20 nt, Human
ggaauugcuuuccugucuuu

SEQ ID NO: 77242 - RNA, 22 nt, Human
ggaauugguuucaagggaaagu

SEQ ID NO: 77243 - RNA, 22 nt, Human
ggacaaaaaucagccaucucua

SEQ ID NO: 77244 - RNA, 22 nt, Human
ggacaaaauccaaacuucuuag

SEQ ID NO: 77245 - RNA, 22 nt, Human
cuucuccuuauaugucccguuc

SEQ ID NO: 77246 - RNA, 22 nt, Human
cuucucggccguguggaugcgc

SEQ ID NO: 77247 - RNA, 22 nt, Human
cuucucucggugcaucccucac

SEQ ID NO: 77248 - RNA, 22 nt, Human
cuucucugacagucuguuucac

SEQ ID NO: 77249 - RNA, 23 nt, Human
cuucucugagcuaggaaugcucu

SEQ ID NO: 77250 - RNA, 17 nt, Human
cuucucuggcagaagau

SEQ ID NO: 77251 - RNA, 22 nt, Human
cuucucuguguagagauucaga

SEQ ID NO: 77252 - RNA, 22 nt, Human
cuucucuuggguguggugucuu

SEQ ID NO: 77253 - RNA, 22 nt, Human
cuucugaccccuggucuacagc

SEQ ID NO: 77254 - RNA, 22 nt, Human
cuucugaggacucuaaagagga

SEQ ID NO: 77255 - RNA, 22 nt, Human
cuucugaggcagcuauucaguu

SEQ ID NO: 77256 - RNA, 22 nt, Human
cuucugagggccuuugcuucca

SEQ ID NO: 77257 - RNA, 22 nt, Human
cuucugauuagcaaguuuguau

SEQ ID NO: 77258 - RNA, 22 nt, Human
cuucugcaauaaguuuuggucc

SEQ ID NO: 77259 - RNA, 22 nt, Human
cuucugcaggagucaacucugg

SEQ ID NO: 77260 - RNA, 22 nt, Human
cuucugcaggcccugucugacc

SEQ ID NO: 77261 - RNA, 22 nt, Human
cuucuggauuuauucauuccuu

SEQ ID NO: 77262 - RNA, 22 nt, Human
cuucugggauuaauuuuuccug

SEQ ID NO: 77263 - RNA, 22 nt, Human
cuucugggauuuuugaagacuc

SEQ ID NO: 77264 - RNA, 22 nt, Human
cuucuggggauggagcccagaa

SEQ ID NO: 77265 - RNA, 22 nt, Human
cuucuggguauuccagauaccu

SEQ ID NO: 77266 - RNA, 22 nt, Human
cuucuguagccaguaacauaua

SEQ ID NO: 77267 - RNA, 22 nt, Human
cuucugugaccaccagcagccc

SEQ ID NO: 77268 - RNA, 22 nt, Human
cuucugugcgccucuauucccu

SEQ ID NO: 77269 - RNA, 22 nt, Human
cuucugugcuucacaguugcca

SEQ ID NO: 77270 - RNA, 22 nt, Human
cuucugugguaaacuuuguugu

SEQ ID NO: 77271 - RNA, 22 nt, Human
cuucuuaaaguugucacagcug

SEQ ID NO: 77272 - RNA, 22 nt, Human
cuucuuaaauauuuggcugacu

SEQ ID NO: 77273 - RNA, 22 nt, Human
cuucuuaaauuggauugcuauu

SEQ ID NO: 77274 - RNA, 22 nt, Human
cuucuuaaugacagauuaaaau

SEQ ID NO: 77275 - RNA, 22 nt, Human
cuucuuaucugaaaguaauauu

SEQ ID NO: 77276 - RNA, 22 nt, Human
cuucuucaaccugaaaguuuca

SEQ ID NO: 77277 - RNA, 22 nt, Human
cuucuuccaguuauaagagcuu

SEQ ID NO: 77278 - RNA, 22 nt, Human
cuucuugucaauuugccauugu

SEQ ID NO: 77279 - RNA, 22 nt, Human
cuucuuuaauguauacaaaaga

SEQ ID NO: 77280 - RNA, 22 nt, Human
cuucuuucuuuugaucacaggu

SEQ ID NO: 77281 - RNA, 22 nt, Human
cuugaaagauuuggccucugug

SEQ ID NO: 77282 - RNA, 22 nt, Human
cuugaaagcacuccuuugacug

SEQ ID NO: 77283 - RNA, 21 nt, Human
cuugaaagguagagucuacag

SEQ ID NO: 77284 - RNA, 19 nt, Human
cuugaaaugagacugaagg

SEQ ID NO: 77285 - RNA, 22 nt, Human
cuugaagaaauggagacaggau

SEQ ID NO: 77286 - RNA, 22 nt, Human
cuugaaucuggcuuugccacuu

SEQ ID NO: 77287 - RNA, 22 nt, Human
cuugaaucuucugaguauuugc

SEQ ID NO: 77288 - RNA, 22 nt, Human
cuugaaugggccauaagacggu

SEQ ID NO: 77289 - RNA, 22 nt, Human
cuugaauugggggaagaucacu

SEQ ID NO: 77290 - RNA, 22 nt, Human
cuugacaacuggcagauauaua

SEQ ID NO: 77291 - RNA, 22 nt, Human
cuugacucuugcuucccaugga

SEQ ID NO: 77292 - RNA, 22 nt, Human
cuugacuucuucuagaaauaag

SEQ ID NO: 77293 - RNA, 22 nt, Human
cuugacuuugccuuuuaaaugu

SEQ ID NO: 77294 - RNA, 22 nt, Human
cuugagaagcauuaagagguag

SEQ ID NO: 77295 - RNA, 22 nt, Human
cuugagaaucuugaugucuacc

SEQ ID NO: 77296 - RNA, 20 nt, Human
cuugaguucagagcugucau

SEQ ID NO: 77297 - RNA, 22 nt, Human
cuugauauuuuaaacauacagu

SEQ ID NO: 77298 - RNA, 22 nt, Human
cuugaugauuugcagagggagu

SEQ ID NO: 77299 - RNA, 22 nt, Human
cuugaugguggcagaagaguga

SEQ ID NO: 77300 - RNA, 22 nt, Human
cuugauucucagaaugcuugcu

SEQ ID NO: 77301 - RNA, 22 nt, Human
cuugauuucagccuugugauau

SEQ ID NO: 77302 - RNA, 22 nt, Human
cuugcaaacacucaaagccauc

SEQ ID NO: 77303 - RNA, 22 nt, Human
cuugcacacauguacaugugua

SEQ ID NO: 77304 - RNA, 22 nt, Human
cuugcacaggaucugaaguggg

SEQ ID NO: 77305 - RNA, 22 nt, Human
cuugcaggauuuugcugcugua

SEQ ID NO: 77306 - RNA, 22 nt, Human
cuugcaggcagggccuccugga

SEQ ID NO: 77307 - RNA, 23 nt, Human
cuugcagggcuggaggcuuagaa

SEQ ID NO: 77308 - RNA, 22 nt, Human
cuugcaugcauuugaagaucau

SEQ ID NO: 77309 - RNA, 22 nt, Human
cuugccaaauuaacauacagaa

SEQ ID NO: 77310 - RNA, 22 nt, Human
cuugccaaugguacaaacgauu

SEQ ID NO: 77311 - RNA, 20 nt, Human
cuugccaguucccuggcaga

SEQ ID NO: 77312 - RNA, 22 nt, Human
cuugccuagguguauauuaaau

SEQ ID NO: 77313 - RNA, 22 nt, Human
cuugccucugcuaaugguuucu

SEQ ID NO: 77314 - RNA, 22 nt, Human
cuugccugaggaacagagggua

SEQ ID NO: 77315 - RNA, 19 nt, Human
cuugccuguuccuacagcu

SEQ ID NO: 77316 - RNA, 22 nt, Human
cuugccuucagugucccuuugc

SEQ ID NO: 77317 - RNA, 22 nt, Human
cuugccuuugucuucaaaggcu

SEQ ID NO: 77318 - RNA, 22 nt, Human
cuugcucuagauguucagagcu

SEQ ID NO: 77319 - RNA, 18 nt, Human
cuugcugagggccucauu

SEQ ID NO: 77320 - RNA, 19 nt, Human
cuugcugggugguuucugc

SEQ ID NO: 77321 - RNA, 22 nt, Human
cuugcugucuugcauuuagagc

SEQ ID NO: 77322 - RNA, 22 nt, Human
cuugcugugugguguucucaga

SEQ ID NO: 77323 - RNA, 22 nt, Human
cuugcuguuauccauauuaucu

SEQ ID NO: 77324 - RNA, 22 nt, Human
cuugcuuuaucugguuucucau

SEQ ID NO: 77325 - RNA, 22 nt, Human
cuugcuuuguccagaaauucag

SEQ ID NO: 77326 - RNA, 22 nt, Human
cuuggacccacucccagaauug

SEQ ID NO: 77327 - RNA, 22 nt, Human
cuuggacuuuagucucucucca

SEQ ID NO: 77328 - RNA, 22 nt, Human
cuuggagaaaggaaagggcuug

SEQ ID NO: 77329 - RNA, 19 nt, Human
cuuggagaaggcuaugacc

SEQ ID NO: 77330 - RNA, 22 nt, Human
cuuggagacaggacaggcagaa

SEQ ID NO: 77331 - RNA, 22 nt, Human
cuuggaggaaggggcucuucug

SEQ ID NO: 77332 - RNA, 22 nt, Human
cuuggaguagagauuuagugaa

SEQ ID NO: 77333 - RNA, 22 nt, Human
cuuggagucaauaagaucuaga

SEQ ID NO: 77334 - RNA, 22 nt, Human
cuuggauaucacucagaaagau

SEQ ID NO: 77335 - RNA, 22 nt, Human
cuuggauuccgugaacuuaacc

SEQ ID NO: 77336 - RNA, 19 nt, Human
cuuggcaucugugaaguga

SEQ ID NO: 77337 - RNA, 22 nt, Human
cuuggcaugcagcaggcacuca

SEQ ID NO: 77338 - RNA, 22 nt, Human
cuuggcauguucaucugcuugg

SEQ ID NO: 77339 - RNA, 22 nt, Human
cuuggccugacauguggcaggg

SEQ ID NO: 77340 - RNA, 22 nt, Human
cuuggccugcaggcagcagcgc

SEQ ID NO: 77341 - RNA, 22 nt, Human
cuuggccugcccagccagaagg

SEQ ID NO: 77342 - RNA, 22 nt, Human
cuuggcucuguguugaugggac

SEQ ID NO: 77343 - RNA, 18 nt, Human
cuuggcugaugggggugu

SEQ ID NO: 77344 - RNA, 22 nt, Human
cuuggcugcuuuugugcacauu

SEQ ID NO: 77345 - RNA, 22 nt, Human
cuuggcuggaacuccugagaaa

SEQ ID NO: 77346 - RNA, 22 nt, Human
cuugggaaaccaaugggcuccu

SEQ ID NO: 77347 - RNA, 22 nt, Human
cuugggaggagaacaaagcucc

SEQ ID NO: 77348 - RNA, 21 nt, Human
accuucaguguucucagcugc

SEQ ID NO: 77349 - RNA, 19 nt, Human
accuucugggaaacauucc

SEQ ID NO: 77350 - RNA, 22 nt, Human
accuuggaaaguuuaauugagg

SEQ ID NO: 77351 - RNA, 22 nt, Human
accuugucugugcaccugggcu

SEQ ID NO: 77352 - RNA, 22 nt, Human
accuugugagguuacauaaugu

SEQ ID NO: 77353 - RNA, 22 nt, Human
accuuguuaaaaugaggauucu

SEQ ID NO: 77354 - RNA, 22 nt, Human
accuuguuguagguacaaaaga

SEQ ID NO: 77355 - RNA, 22 nt, Human
accuuucaaaguggcuaucacu

SEQ ID NO: 77356 - RNA, 20 nt, Human
accuuucaaaugauucagca

SEQ ID NO: 77357 - RNA, 22 nt, Human
accuuucguccugguuccuccg

SEQ ID NO: 77358 - RNA, 19 nt, Human
accuuugagaagaaauguc

SEQ ID NO: 77359 - RNA, 22 nt, Human
accuuuggaaauaaacacucug

SEQ ID NO: 77360 - RNA, 22 nt, Human
accuuuuuccaaagcuucuuac

SEQ ID NO: 77361 - RNA, 22 nt, Human
acgaaucauucacggacaacac

SEQ ID NO: 77362 - RNA, 22 nt, Human
acgacagcacaacagcauccuc

SEQ ID NO: 77363 - RNA, 22 nt, Human
acgagguuggagaguuguuugg

SEQ ID NO: 77364 - RNA, 22 nt, Human
acgaguauguuuguauuuucuu

SEQ ID NO: 77365 - RNA, 22 nt, Human
acgaugagauggggcuggaagg

SEQ ID NO: 77366 - RNA, 22 nt, Human
acgaugcucaacuauaugaauu

SEQ ID NO: 77367 - RNA, 22 nt, Human
acgcgcaaccaggcaugcacau

SEQ ID NO: 77368 - RNA, 22 nt, Human
acggccgaugacuccagcaugg

SEQ ID NO: 77369 - RNA, 22 nt, Human
acaguguagaauccuguacuua

SEQ ID NO: 77370 - RNA, 22 nt, Human
acagugucuccugguacccagu

SEQ ID NO: 77371 - RNA, 22 nt, Human
acaguguguucugggaccucca

SEQ ID NO: 77372 - RNA, 20 nt, Human
acaguguuagguuuuuccuu

SEQ ID NO: 77373 - RNA, 22 nt, Human
acaguguugaggugcuuguuuc

SEQ ID NO: 77374 - RNA, 22 nt, Human
acaguguuguggcucuuaauag

SEQ ID NO: 77375 - RNA, 22 nt, Human
acaguguuuaaaaaucagaucu

SEQ ID NO: 77376 - RNA, 22 nt, Human
acaguguuuggcaaugcaugca

SEQ ID NO: 77377 - RNA, 22 nt, Human
acaguguuuuagaaaagcuuga

SEQ ID NO: 77378 - RNA, 22 nt, Human
acaguuaacuggagagcgaguu

SEQ ID NO: 77379 - RNA, 22 nt, Human
acaguuaauccuaaaggcggua

SEQ ID NO: 77380 - RNA, 22 nt, Human
acaguuacaucacuuacugaca

SEQ ID NO: 77381 - RNA, 22 nt, Human
acaguuacauuccagcaacauc

SEQ ID NO: 77382 - RNA, 22 nt, Human
acaguuaggcacggguacagca

SEQ ID NO: 77383 - RNA, 22 nt, Human
acaguuauucuuuaugcaacca

SEQ ID NO: 77384 - RNA, 22 nt, Human
acaguuccugacuuuaacucca

SEQ ID NO: 77385 - RNA, 23 nt, Human
acaguucucugauggguuuaaca

SEQ ID NO: 77386 - RNA, 22 nt, Human
acaguucugagcuauaauugcu

SEQ ID NO: 77387 - RNA, 22 nt, Human
acaguucugcaagauauuuuuu

SEQ ID NO: 77388 - RNA, 22 nt, Human
acaguuuagaaugccacauagu

SEQ ID NO: 77389 - RNA, 22 nt, Human
acaguuuagagcaugaugacca

SEQ ID NO: 77390 - RNA, 22 nt, Human
acaguuuauugcacagguaacc

SEQ ID NO: 77391 - RNA, 22 nt, Human
acaguuugguugcuacaguaaa

SEQ ID NO: 77392 - RNA, 17 nt, Human
acaguuugucauucuaa

SEQ ID NO: 77393 - RNA, 22 nt, Human
acaguuuuuucaacauuggaau

SEQ ID NO: 77394 - RNA, 22 nt, Human
acauaaaguacugagagacucu

SEQ ID NO: 77395 - RNA, 21 nt, Human
acauaacugucaaguaacguu

SEQ ID NO: 77396 - RNA, 22 nt, Human
acauaaguuauggauaaaaugu

SEQ ID NO: 77397 - RNA, 22 nt, Human
acauaauaggugccugaauauu

SEQ ID NO: 77398 - RNA, 22 nt, Human
acauacacaugaauauauuuuu

SEQ ID NO: 77399 - RNA, 22 nt, Human
acauacacgggaaaccucuuuu

SEQ ID NO: 77400 - RNA, 22 nt, Human
acauacagaccugcagggcagc

SEQ ID NO: 77401 - RNA, 23 nt, Human
acauacauaagcaccacauuuug

SEQ ID NO: 77402 - RNA, 22 nt, Human
acauacaugggauuaaaaaauu

SEQ ID NO: 77403 - RNA, 18 nt, Human
acauacauucugucugca

SEQ ID NO: 77404 - RNA, 22 nt, Human
acauaccauacauggugagaug

SEQ ID NO: 77405 - RNA, 22 nt, Human
acauacuuaacauuaaagucau

SEQ ID NO: 77406 - RNA, 22 nt, Human
acauacuuaugcuaaaaauaua

SEQ ID NO: 77407 - RNA, 22 nt, Human
acauacuuauguguauaugugu

SEQ ID NO: 77408 - RNA, 22 nt, Human
acauagaaccuggcacauagua

SEQ ID NO: 77409 - RNA, 22 nt, Human
acauagaaggaagaguaguagg

SEQ ID NO: 77410 - RNA, 22 nt, Human
acauagaagugaugcuuaucca

SEQ ID NO: 77411 - RNA, 22 nt, Human
acauagaguaucauacuggaug

SEQ ID NO: 77412 - RNA, 22 nt, Human
acauagauuuaagagcaauuag

SEQ ID NO: 77413 - RNA, 19 nt, Human
acauagcuggcuacacugu

SEQ ID NO: 77414 - RNA, 22 nt, Human
acauagcuuaaaugagaagaua

SEQ ID NO: 77415 - RNA, 21 nt, Human
acauaggcgaauguucgggag

SEQ ID NO: 77416 - RNA, 22 nt, Human
acauauauuuucacacaugguu

SEQ ID NO: 77417 - RNA, 22 nt, Human
acauaucuuucccucuccugaa

SEQ ID NO: 77418 - RNA, 22 nt, Human
acauaugaguacuauacagugc

SEQ ID NO: 77419 - RNA, 22 nt, Human
acauaugauauugaggaucuca

SEQ ID NO: 77420 - RNA, 22 nt, Human
acauaugucuauuucauguaaa

SEQ ID NO: 77421 - RNA, 20 nt, Human
acauaugugugcauaucuuu

SEQ ID NO: 77422 - RNA, 22 nt, Human
acauauguuguaaacauuccaa

SEQ ID NO: 77423 - RNA, 22 nt, Human
acauauuuccaugcagcauguc

SEQ ID NO: 77424 - RNA, 22 nt, Human
acaucacacgccuuccaggagg

SEQ ID NO: 77425 - RNA, 22 nt, Human
acaucacaguaguuaagccaga

SEQ ID NO: 77426 - RNA, 22 nt, Human
acaucagacaauuaauuauuaa

SEQ ID NO: 77427 - RNA, 23 nt, Human
acaucagaguuaguucaaucagg

SEQ ID NO: 77428 - RNA, 22 nt, Human
acaucaguaacuguaaaacagg

SEQ ID NO: 77429 - RNA, 22 nt, Human
acauccacauuuauucagucau

SEQ ID NO: 77430 - RNA, 22 nt, Human
acauccaccacaugccaggcuc

SEQ ID NO: 77431 - RNA, 22 nt, Human
acauccagaggcguggaaggcu

SEQ ID NO: 77432 - RNA, 22 nt, Human
acauccaucuuaugagauaggu

SEQ ID NO: 77433 - RNA, 22 nt, Human
acaucccacagaaacauacaua

SEQ ID NO: 77434 - RNA, 22 nt, Human
acaucccuugcucggggccccu

SEQ ID NO: 77435 - RNA, 22 nt, Human
acauccgcagguuauaaagccc

SEQ ID NO: 77436 - RNA, 20 nt, Human
acauccuggugacuagaacu

SEQ ID NO: 77437 - RNA, 22 nt, Human
acaucuagaagaucugggagau

SEQ ID NO: 77438 - RNA, 22 nt, Human
acaucucaaauuccaggcucca

SEQ ID NO: 77439 - RNA, 22 nt, Human
acaucucacuucuuugaaggcu

SEQ ID NO: 77440 - RNA, 22 nt, Human
acaucugaaagggauugcagaa

SEQ ID NO: 77441 - RNA, 22 nt, Human
acaucugagcaacagaacacua

SEQ ID NO: 77442 - RNA, 22 nt, Human
acaucugggccuaaggcuauau

SEQ ID NO: 77443 - RNA, 22 nt, Human
acaucuguucuucucuuguccc

SEQ ID NO: 77444 - RNA, 22 nt, Human
acaucuucccacacuugcaaaa

SEQ ID NO: 77445 - RNA, 22 nt, Human
acaugaaguggucagaucaaac

SEQ ID NO: 77446 - RNA, 22 nt, Human
acaugaaugcagccauaacacu

SEQ ID NO: 77447 - RNA, 22 nt, Human
acaugacaagguuuauaaggcu

SEQ ID NO: 77448 - RNA, 22 nt, Human
acaugacagggaaugaggugaa

SEQ ID NO: 77449 - RNA, 22 nt, Human
acaugacuauaauuacuuaaau

SEQ ID NO: 77450 - RNA, 17 nt, Human
acaugacugcacaaagu

SEQ ID NO: 77451 - RNA, 22 nt, Human
acaugagagaaaaguauucuga

SEQ ID NO: 77452 - RNA, 22 nt, Human
acaugagaggcuguggaguaca

SEQ ID NO: 77453 - RNA, 22 nt, Human
acaugaggaaacaaggguauau

SEQ ID NO: 77454 - RNA, 22 nt, Human
acaugaguacagauggauguaa

SEQ ID NO: 77455 - RNA, 22 nt, Human
acaugaucuuauguagaagauc

SEQ ID NO: 77456 - RNA, 22 nt, Human
acaugauuggacuccuuccccu

SEQ ID NO: 77457 - RNA, 22 nt, Human
acaugacagugacuuuauaaga

SEQ ID NO: 77458 - RNA, 22 nt, Human
acaugacuuuucucuuccagag

SEQ ID NO: 77459 - RNA, 21 nt, Human
acaugagacacacauauaugu

SEQ ID NO: 77460 - RNA, 22 nt, Human
acaugagauuagcucacccacu

SEQ ID NO: 77461 - RNA, 22 nt, Human
acaugaggaacucaggagucac

SEQ ID NO: 77462 - RNA, 22 nt, Human
acaugaggugcuauaggucuac

SEQ ID NO: 77463 - RNA, 22 nt, Human
acaugauauaugggaaaugcuu

SEQ ID NO: 77464 - RNA, 22 nt, Human
acaugauuugcaugauuuguaa

SEQ ID NO: 77465 - RNA, 22 nt, Human
acaugauuuuaguaucauaaua

SEQ ID NO: 77466 - RNA, 22 nt, Human
acaugauuuuucuuugacucua

SEQ ID NO: 77467 - RNA, 22 nt, Human
acaugcacaccuauauacaugu

SEQ ID NO: 77468 - RNA, 22 nt, Human
acaugcacggcaccaucuucug

SEQ ID NO: 77469 - RNA, 20 nt, Human
acaugcacguguguauauau

SEQ ID NO: 77470 - RNA, 22 nt, Human
acaugcacucucacugugcucu

SEQ ID NO: 77471 - RNA, 22 nt, Human
acaugcacugcucaggguuccg

SEQ ID NO: 77472 - RNA, 22 nt, Human
acaugcagagggagggccaggc

SEQ ID NO: 77473 - RNA, 22 nt, Human
acaugcagugaggaucuuagaa

SEQ ID NO: 77474 - RNA, 22 nt, Human
acaugcauaagccuagccauca

SEQ ID NO: 77475 - RNA, 22 nt, Human
acaugcauaggagaagucuuua

SEQ ID NO: 77476 - RNA, 22 nt, Human
acaugcaugaaauccauaaaca

SEQ ID NO: 77477 - RNA, 22 nt, Human
acaugcauggacauguauauau

SEQ ID NO: 77478 - RNA, 22 nt, Human
acaugcauggcugcuuaaauua

SEQ ID NO: 77479 - RNA, 22 nt, Human
acaugcaugguguuggguugga

SEQ ID NO: 77480 - RNA, 22 nt, Human
acaugccaauuugguuaguuca

SEQ ID NO: 77481 - RNA, 22 nt, Human
acaugccagaacuuguaccaau

SEQ ID NO: 77482 - RNA, 22 nt, Human
acaugccaugguuguuugcugc

SEQ ID NO: 77483 - RNA, 22 nt, Human
acaugccuccauugagcugugg

SEQ ID NO: 77484 - RNA, 22 nt, Human
acaugcuaaaucugagaugcuu

SEQ ID NO: 77485 - RNA, 22 nt, Human
acaugcuagguacagaucuaaa

SEQ ID NO: 77486 - RNA, 22 nt, Human
acaugcuguccugucuuuguca

SEQ ID NO: 77487 - RNA, 22 nt, Human
acaugcuuuaucggauugacac

SEQ ID NO: 77488 - RNA, 22 nt, Human
acucgugucaagauccuaaguc

SEQ ID NO: 77489 - RNA, 22 nt, Human
acucuaaaagugaagugugguc

SEQ ID NO: 77490 - RNA, 20 nt, Human
acucuaacucuuuacaacag

SEQ ID NO: 77491 - RNA, 22 nt, Human
acucuaaugcuaauaguauuuu

SEQ ID NO: 77492 - RNA, 20 nt, Human
acucuaccagggcagcagca

SEQ ID NO: 77493 - RNA, 22 nt, Human
acucuacuguaguaugggcacu

SEQ ID NO: 77494 - RNA, 22 nt, Human
acucucaaauauuaaucuuugg

SEQ ID NO: 77495 - RNA, 22 nt, Human
acucucagggacagggucuggg

SEQ ID NO: 77496 - RNA, 22 nt, Human
acucucagggcuccagggaaag

SEQ ID NO: 77497 - RNA, 23 nt, Human
acucucagguucuuuccagcagg

SEQ ID NO: 77498 - RNA, 22 nt, Human
acucucccacguucgacucuaa

SEQ ID NO: 77499 - RNA, 22 nt, Human
acucugaagaagacuuccagac

SEQ ID NO: 77500 - RNA, 22 nt, Human
acucugaauuaauugcucucaa

SEQ ID NO: 77501 - RNA, 23 nt, Human
acucugacuuaguuauagcuauu

SEQ ID NO: 77502 - RNA, 22 nt, Human
acucugagccaccagaucccca

SEQ ID NO: 77503 - RNA, 22 nt, Human
acucugaggaauguacaggacc

SEQ ID NO: 77504 - RNA, 19 nt, Human
acucugaggcugagacaag

SEQ ID NO: 77505 - RNA, 22 nt, Human
acucugagggguauguuccuau

SEQ ID NO: 77506 - RNA, 22 nt, Human
acucugaguuccuacuugcucc

SEQ ID NO: 77507 - RNA, 22 nt, Human
acucugccuuucagcagaugaa

SEQ ID NO: 77508 - RNA, 22 nt, Human
acucugcuaaauguguaggcuc

SEQ ID NO: 77509 - RNA, 22 nt, Human
acucugcuauugcagugcaaaa

SEQ ID NO: 77510 - RNA, 22 nt, Human
acucugcucuguauuucacugu

SEQ ID NO: 77511 - RNA, 22 nt, Human
acucugcucuuauaguguuaua

SEQ ID NO: 77512 - RNA, 22 nt, Human
acucugcuggcugcagggcagc

SEQ ID NO: 77513 - RNA, 22 nt, Human
acucugcugucugauggcagga

SEQ ID NO: 77514 - RNA, 22 nt, Human
acucugcuuauugcugcaggca

SEQ ID NO: 77515 - RNA, 22 nt, Human
acucuggcaagcuuccacuucc

SEQ ID NO: 77516 - RNA, 22 nt, Human
acucuggccaggugcgguaugu

SEQ ID NO: 77517 - RNA, 22 nt, Human
acucuggccccaggaucugugu

SEQ ID NO: 77518 - RNA, 22 nt, Human
acucuggcuauucacuauaaua

SEQ ID NO: 77519 - RNA, 22 nt, Human
acucuggcuugaggaccagguc

SEQ ID NO: 77520 - RNA, 22 nt, Human
acucugggauuguuucugguau

SEQ ID NO: 77521 - RNA, 22 nt, Human
acucugggcccacccucagagu

SEQ ID NO: 77522 - RNA, 22 nt, Human
acucuggggugaugucucugag

SEQ ID NO: 77523 - RNA, 22 nt, Human
acucuguaaagcauaacguuug

SEQ ID NO: 77524 - RNA, 22 nt, Human
acucuguacuuucuuguugugu

SEQ ID NO: 77525 - RNA, 22 nt, Human
acucuguagaguauaccaaugu

SEQ ID NO: 77526 - RNA, 22 nt, Human
acucuguagccuguaagagagc

SEQ ID NO: 77527 - RNA, 22 nt, Human
acucuguguuuugguggcagca

SEQ ID NO: 77528 - RNA, 19 nt, Human
acucuguuguacuugaggg

SEQ ID NO: 77529 - RNA, 22 nt, Human
acucuuacucccucaggcacug

SEQ ID NO: 77530 - RNA, 22 nt, Human
acucuuauucccucagaaauau

SEQ ID NO: 77531 - RNA, 22 nt, Human
acucuuauuuugaaguaauaau

SEQ ID NO: 77532 - RNA, 22 nt, Human
acucuucacacuugucuccagg

SEQ ID NO: 77533 - RNA, 22 nt, Human
acucuucaucccuuuaucagga

SEQ ID NO: 77534 - RNA, 22 nt, Human
acucuucaugcuaugcucaacu

SEQ ID NO: 77535 - RNA, 22 nt, Human
acucuucuugcugcucauuaau

SEQ ID NO: 77536 - RNA, 22 nt, Human
acucuuggccacucuugguguc

SEQ ID NO: 77537 - RNA, 22 nt, Human
acucuuuaacagacuuugaucu

SEQ ID NO: 77538 - RNA, 22 nt, Human
acucuuuagagguacaucucuu

SEQ ID NO: 77539 - RNA, 22 nt, Human
acugaaaguccagcaugguaca

SEQ ID NO: 77540 - RNA, 22 nt, Human
acugaaauauuuagaagugaag

SEQ ID NO: 77541 - RNA, 22 nt, Human
acugaaauuuauauuuugggca

SEQ ID NO: 77542 - RNA, 22 nt, Human
acugaacauaugcaagaccauu

SEQ ID NO: 77543 - RNA, 21 nt, Human
acugaacuuguguucuagagg

SEQ ID NO: 77544 - RNA, 22 nt, Human
acugaagcacauuugccaugaa

SEQ ID NO: 77545 - RNA, 17 nt, Human
acugaagcauuuaugau

SEQ ID NO: 77546 - RNA, 22 nt, Human
acugaagcuuggguggaacuua

SEQ ID NO: 77547 - RNA, 22 nt, Human
acugaaggcuuaacucuuucau

SEQ ID NO: 77548 - RNA, 22 nt, Human
acugaaggcuuucccaagguca

SEQ ID NO: 77549 - RNA, 22 nt, Human
acugaaguagucauugucauua

SEQ ID NO: 77550 - RNA, 22 nt, Human
acugaaguucauacaacagacu

SEQ ID NO: 77551 - RNA, 22 nt, Human
acugaauauauuccauugcaug

SEQ ID NO: 77552 - RNA, 22 nt, Human
acugaaugaggggugaucuggg

SEQ ID NO: 77553 - RNA, 22 nt, Human
acugaauuacagucugcauuuu

SEQ ID NO: 77554 - RNA, 22 nt, Human
acugaauuagggaacacugaac

SEQ ID NO: 77555 - RNA, 22 nt, Human
acugaauuccucuuucuuaucc

SEQ ID NO: 77556 - RNA, 22 nt, Human
acugaauuuuaauuagaucugc

SEQ ID NO: 77557 - RNA, 22 nt, Human
acugacauuuuucccuaagcau

SEQ ID NO: 77558 - RNA, 22 nt, Human
acugacuuuggaauauuucuag

SEQ ID NO: 77559 - RNA, 22 nt, Human
acugagaaauuuccagacuugc

SEQ ID NO: 77560 - RNA, 22 nt, Human
acugagagaacgggcugcuccc

SEQ ID NO: 77561 - RNA, 22 nt, Human
acugagaguugugcauucaugc

SEQ ID NO: 77562 - RNA, 22 nt, Human
acugagcaaugcagugggagcg

SEQ ID NO: 77563 - RNA, 22 nt, Human
acugagcacucacuuuuguuau

SEQ ID NO: 77564 - RNA, 22 nt, Human
acugagcauaaauaugugucca

SEQ ID NO: 77565 - RNA, 23 nt, Human
acugagccagggccugggucagc

SEQ ID NO: 77566 - RNA, 21 nt, Human
acuagcaaaagccuauuaucc

SEQ ID NO: 77567 - RNA, 22 nt, Human
acuagcagaaacugaucauggc

SEQ ID NO: 77568 - RNA, 22 nt, Human
acuaggaggcauauaaaacauu

SEQ ID NO: 77569 - RNA, 22 nt, Human
acuaggggcucaggcccaggga

SEQ ID NO: 77570 - RNA, 22 nt, Human
acuagucauuuaggugauauua

SEQ ID NO: 77571 - RNA, 22 nt, Human
acuagugaagaagauuugacug

SEQ ID NO: 77572 - RNA, 18 nt, Human
acuagugagcaagcuagg

SEQ ID NO: 77573 - RNA, 22 nt, Human
acuaguuuuccauaauauagga

SEQ ID NO: 77574 - RNA, 22 nt, Human
acuauaacccauggaauauaag

SEQ ID NO: 77575 - RNA, 22 nt, Human
acuauacauaaaacauuugggu

SEQ ID NO: 77576 - RNA, 22 nt, Human
acuaucucuuuugucugcagcu

SEQ ID NO: 77577 - RNA, 18 nt, Human
acuaugcugaauaaaugg

SEQ ID NO: 77578 - RNA, 18 nt, Human
acuauugagguauucuug

SEQ ID NO: 77579 - RNA, 22 nt, Human
acuauugcuuagagcaaugggg

SEQ ID NO: 77580 - RNA, 22 nt, Human
acuauuuguaaagagcaaacgg

SEQ ID NO: 77581 - RNA, 20 nt, Human
acucaaaucaccugccucaa

SEQ ID NO: 77582 - RNA, 23 nt, Human
acucaaauuucgcuuggaguuca

SEQ ID NO: 77583 - RNA, 22 nt, Human
acucaacagggaacaagaucag

SEQ ID NO: 77584 - RNA, 22 nt, Human
acucaagauagggaaaguacaa

SEQ ID NO: 77585 - RNA, 18 nt, Human
acucaaggguggagagaa

SEQ ID NO: 77586 - RNA, 22 nt, Human
acucaagucauaggcuucuuuc

SEQ ID NO: 77587 - RNA, 22 nt, Human
acucacuagagguagaucccug

SEQ ID NO: 77588 - RNA, 22 nt, Human
acucacucuuaaucagacuccc

SEQ ID NO: 77589 - RNA, 22 nt, Human
acucacucuuucaauugaaaga

SEQ ID NO: 77590 - RNA, 22 nt, Human
acucacugggucccggaagccc

SEQ ID NO: 77591 - RNA, 22 nt, Human
acucagacgaaaacaugaacau

SEQ ID NO: 77592 - RNA, 22 nt, Human
acucagagaacauucccagucu

SEQ ID NO: 77593 - RNA, 22 nt, Human
acucagaggcuggaaaucaaag

SEQ ID NO: 77594 - RNA, 22 nt, Human
acucagagucugagauaaaucu

SEQ ID NO: 77595 - RNA, 22 nt, Human
acucagagucuguuugguaccu

SEQ ID NO: 77596 - RNA, 22 nt, Human
acucagagugcaucuccuauuu

SEQ ID NO: 77597 - RNA, 20 nt, Human
acucagaugcucacaacagg

SEQ ID NO: 77598 - RNA, 22 nt, Human
acucagcauauggggccgcuug

SEQ ID NO: 77599 - RNA, 22 nt, Human
acucagcuuccuacagcuagaa

SEQ ID NO: 77600 - RNA, 22 nt, Human
acucaggaaaaauguagugaua

SEQ ID NO: 77601 - RNA, 22 nt, Human
acucaggaauggggcugggacu

SEQ ID NO: 77602 - RNA, 19 nt, Human
acucaggcaaugagaaaca

SEQ ID NO: 77603 - RNA, 21 nt, Human
acucaggcaccaggggauggc

SEQ ID NO: 77604 - RNA, 22 nt, Human
acucaggcuucaggcacagcug

SEQ ID NO: 77605 - RNA, 22 nt, Human
acucaguacaucuggaguuggc

SEQ ID NO: 77606 - RNA, 23 nt, Human
acucagugaagcaaacagauagu

SEQ ID NO: 77607 - RNA, 23 nt, Human
acucagugagggccuugggcugc

SEQ ID NO: 77608 - RNA, 22 nt, Human
acucaucuauuagauaucuguu

SEQ ID NO: 77609 - RNA, 22 nt, Human
acucaucugaaaaaugaggaga

SEQ ID NO: 77610 - RNA, 22 nt, Human
acucaucuuugaauuuucagua

SEQ ID NO: 77611 - RNA, 22 nt, Human
acucauguaagcggaauguagu

SEQ ID NO: 77612 - RNA, 20 nt, Human
acucauuuccagcaucugau

SEQ ID NO: 77613 - RNA, 22 nt, Human
acucauuugcaugaugugcuau

SEQ ID NO: 77614 - RNA, 21 nt, Human
acucauuugucugcaucuaau

SEQ ID NO: 77615 - RNA, 22 nt, Human
acucauuuuuacugcaauugag

SEQ ID NO: 77616 - RNA, 21 nt, Human
acuccaaacaaguuaagcugu

SEQ ID NO: 77617 - RNA, 22 nt, Human
acuccagaggcagcugugcuga

SEQ ID NO: 77618 - RNA, 22 nt, Human
acuccagaugauaagggacagu

SEQ ID NO: 77619 - RNA, 22 nt, Human
acuccagggaggugagugugcg

SEQ ID NO: 77620 - RNA, 19 nt, Human
acuccagggaugacagaag

SEQ ID NO: 77621 - RNA, 22 nt, Human
acuccagggguugcuauuuaca

SEQ ID NO: 77622 - RNA, 18 nt, Human
acuccccacaggcucugu

SEQ ID NO: 77623 - RNA, 22 nt, Human
acuccccagacugccaugcugg

SEQ ID NO: 77624 - RNA, 22 nt, Human
acucccuccaaaucugcacagu

SEQ ID NO: 77625 - RNA, 22 nt, Human
acucccugcaagauuuuccaug

SEQ ID NO: 77626 - RNA, 22 nt, Human
acucccuugugaacucauucuu

SEQ ID NO: 77627 - RNA, 22 nt, Human
acuccgacucugagucuacauu

SEQ ID NO: 77628 - RNA, 22 nt, Human
acuccuggggcugccaucacag

SEQ ID NO: 77629 - RNA, 22 nt, Human
acuccuggguucuaaauuugaa

SEQ ID NO: 77630 - RNA, 22 nt, Human
acuccugguuuguguccuggcu

SEQ ID NO: 77631 - RNA, 22 nt, Human
acucuaaaccccacucugcugg

SEQ ID NO: 77632 - RNA, 22 nt, Human
acucuacagaaugaauaccugu

SEQ ID NO: 77633 - RNA, 19 nt, Human
acucuacaguguguacaac

SEQ ID NO: 77634 - RNA, 22 nt, Human
acucucccagcuauauguggug

SEQ ID NO: 77635 - RNA, 22 nt, Human
acucucccuuggagccucaggc

SEQ ID NO: 77636 - RNA, 22 nt, Human
acucucucacacacgccuauau

SEQ ID NO: 77637 - RNA, 22 nt, Human
acucucucacagcuuggcugau

SEQ ID NO: 77638 - RNA, 21 nt, Human
agagaauugccuuagauguuc

SEQ ID NO: 77639 - RNA, 22 nt, Human
agagaauuggagcagugacagg

SEQ ID NO: 77640 - RNA, 22 nt, Human
agagaauuugagacuugcccaa

SEQ ID NO: 77641 - RNA, 22 nt, Human
agagacaagggaccucuggaga

SEQ ID NO: 77642 - RNA, 22 nt, Human
agagacaggaauggcauuaaga

SEQ ID NO: 77643 - RNA, 22 nt, Human
agagacauagcacaguuuuucg

SEQ ID NO: 77644 - RNA, 22 nt, Human
agagacccagacugaucauugc

SEQ ID NO: 77645 - RNA, 22 nt, Human
agagaccugaagagcuuccuca

SEQ ID NO: 77646 - RNA, 22 nt, Human
agagaccuuccugacuccagag

SEQ ID NO: 77647 - RNA, 22 nt, Human
agagaccuuucuccugccuuuc

SEQ ID NO: 77648 - RNA, 22 nt, Human
agagacuaagaaguuuuaacuu

SEQ ID NO: 77649 - RNA, 19 nt, Human
agagacugccaccagcugu

SEQ ID NO: 77650 - RNA, 22 nt, Human
agagacuggcuucuaaaauggc

SEQ ID NO: 77651 - RNA, 22 nt, Human
agagacugugccagccccaugc

SEQ ID NO: 77652 - RNA, 22 nt, Human
agagacuucugccuuagcaaga

SEQ ID NO: 77653 - RNA, 22 nt, Human
agagacuuugucuauuuuguuc

SEQ ID NO: 77654 - RNA, 22 nt, Human
agagagaauuggauaaauuggu

SEQ ID NO: 77655 - RNA, 20 nt, Human
agagagaccuaggccuaguc

SEQ ID NO: 77656 - RNA, 22 nt, Human
agagagacgggggcugcugcuu

SEQ ID NO: 77657 - RNA, 22 nt, Human
agagagaggcagcagugcucac

SEQ ID NO: 77658 - RNA, 22 nt, Human
agagagagggaaacugcuaaac

SEQ ID NO: 77659 - RNA, 20 nt, Human
agagagcacaggcaggaaag

SEQ ID NO: 77660 - RNA, 22 nt, Human
agagagcaggacuucacugagc

SEQ ID NO: 77661 - RNA, 22 nt, Human
agagagcagucuggaagaaaca

SEQ ID NO: 77662 - RNA, 23 nt, Human
agagagcucacuauauagcauug

SEQ ID NO: 77663 - RNA, 19 nt, Human
agagaggcugugugaggga

SEQ ID NO: 77664 - RNA, 22 nt, Human
agagaguuguaccacacucaua

SEQ ID NO: 77665 - RNA, 22 nt, Human
agagaguuuaagugacuugccg

SEQ ID NO: 77666 - RNA, 17 nt, Human
agagauaaggcggagaa

SEQ ID NO: 77667 - RNA, 22 nt, Human
agagauaauuagguuaaaugag

SEQ ID NO: 77668 - RNA, 22 nt, Human
agagauauauauuuguuuacca

SEQ ID NO: 77669 - RNA, 22 nt, Human
agagauaugaguaguugugaca

SEQ ID NO: 77670 - RNA, 22 nt, Human
agagauauggaugucagaaacu

SEQ ID NO: 77671 - RNA, 19 nt, Human
agagauccagcuucuagcu

SEQ ID NO: 77672 - RNA, 21 nt, Human
agagaucugaagaaccauuag

SEQ ID NO: 77673 - RNA, 22 nt, Human
agagaugaaaaggguacugagg

SEQ ID NO: 77674 - RNA, 22 nt, Human
agagaugaaucuugagacucug

SEQ ID NO: 77675 - RNA, 22 nt, Human
agagaugacaugagggacuuaa

SEQ ID NO: 77676 - RNA, 21 nt, Human
acugugauaaugcuuuuucug

SEQ ID NO: 77677 - RNA, 22 nt, Human
acugugcacccuggacaguguc

SEQ ID NO: 77678 - RNA, 22 nt, Human
acugugcagguagaugccuggg

SEQ ID NO: 77679 - RNA, 22 nt, Human
acugugcaugguauccuugaug

SEQ ID NO: 77680 - RNA, 22 nt, Human
acugugcuuucucuggaggcau

SEQ ID NO: 77681 - RNA, 22 nt, Human
acuguggcaaaagaacauugga

SEQ ID NO: 77682 - RNA, 22 nt, Human
acuguggccaaagccucuggga

SEQ ID NO: 77683 - RNA, 22 nt, Human
acuguggccuuguggguucagg

SEQ ID NO: 77684 - RNA, 21 nt, Human
acugugggguucaacuggcag

SEQ ID NO: 77685 - RNA, 20 nt, Human
acuguguaaacaugauucau

SEQ ID NO: 77686 - RNA, 22 nt, Human
acuguguaugauauguacuggg

SEQ ID NO: 77687 - RNA, 22 nt, Human
acuguguccuauuuccuugaca

SEQ ID NO: 77688 - RNA, 22 nt, Human
acuguguccucauguggcagaa

SEQ ID NO: 77689 - RNA, 22 nt, Human
acuguguggaaauuugugaggg

SEQ ID NO: 77690 - RNA, 22 nt, Human
acuguguguuugucuagcacag

SEQ ID NO: 77691 - RNA, 22 nt, Human
acuguuauaguucacuuuuccc

SEQ ID NO: 77692 - RNA, 18 nt, Human
acuguuaucugauaaggc

SEQ ID NO: 77693 - RNA, 22 nt, Human
acuguuaugauuuacacagucc

SEQ ID NO: 77694 - RNA, 21 nt, Human
acuguuauucccauuuucacc

SEQ ID NO: 77695 - RNA, 22 nt, Human
acuguucaagcaaaugacauug

SEQ ID NO: 77696 - RNA, 22 nt, Human
acuguucaaguuuuaugcugga

SEQ ID NO: 77697 - RNA, 22 nt, Human
acuguucauuuggauuucucug

SEQ ID NO: 77698 - RNA, 22 nt, Human
acuguucuccagcauggcugua

SEQ ID NO: 77699 - RNA, 22 nt, Human
acuguucugcauguaccugagg

SEQ ID NO: 77700 - RNA, 22 nt, Human
acuguuggucagggauauugug

SEQ ID NO: 77701 - RNA, 22 nt, Human
acuguuuaggaggcuuauaugc

SEQ ID NO: 77702 - RNA, 22 nt, Human
acuguuucucaaauuauguggu

SEQ ID NO: 77703 - RNA, 22 nt, Human
acuuaaaaagaaucuuuucacg

SEQ ID NO: 77704 - RNA, 22 nt, Human
acuuaaauagaacuccucaaua

SEQ ID NO: 77705 - RNA, 22 nt, Human
acuuagaaagggauucuagauu

SEQ ID NO: 77706 - RNA, 22 nt, Human
acuuagaacaggcagaauucca

SEQ ID NO: 77707 - RNA, 22 nt, Human
acuuagaauauguucaagauuu

SEQ ID NO: 77708 - RNA, 22 nt, Human
acuuagaauuaaauauuuuugg

SEQ ID NO: 77709 - RNA, 22 nt, Human
acuuagcaauuugauuaaaaga

SEQ ID NO: 77710 - RNA, 22 nt, Human
acuuagcacgaacauuuacuuu

SEQ ID NO: 77711 - RNA, 22 nt, Human
acuuagcauuauguaauuacua

SEQ ID NO: 77712 - RNA, 22 nt, Human
acuuagcugugugauuuccauu

SEQ ID NO: 77713 - RNA, 22 nt, Human
acuuaguggcuaugugaccuua

SEQ ID NO: 77714 - RNA, 20 nt, Human
acuuaguuuuucucacagga

SEQ ID NO: 77715 - RNA, 22 nt, Human
acuuauaagagugcuaugggga

SEQ ID NO: 77716 - RNA, 22 nt, Human
acuuaucaguugucucuaaugu

SEQ ID NO: 77717 - RNA, 22 nt, Human
acuuauuagacaucuucauugu

SEQ ID NO: 77718 - RNA, 22 nt, Human
acuuauuuauucauucagcuca

SEQ ID NO: 77719 - RNA, 22 nt, Human
acuucaaaaauaagugagaggu

SEQ ID NO: 77720 - RNA, 22 nt, Human
acuucaaaaugaguuuccuggu

SEQ ID NO: 77721 - RNA, 22 nt, Human
acuucaaacaauuaacagagaa

SEQ ID NO: 77722 - RNA, 22 nt, Human
acuucacaaagagaucaucuaa

SEQ ID NO: 77723 - RNA, 22 nt, Human
acuucacacagcaaauuuaucu

SEQ ID NO: 77724 - RNA, 22 nt, Human
acuucacauuugcaagucuugg

SEQ ID NO: 77725 - RNA, 22 nt, Human
acuucagaaaauguugaauguu

SEQ ID NO: 77726 - RNA, 22 nt, Human
acuucagccaagaaaacucagu

SEQ ID NO: 77727 - RNA, 22 nt, Human
acuucagcccagaggaagggau

SEQ ID NO: 77728 - RNA, 22 nt, Human
acuucaguuucccucaacaaga

SEQ ID NO: 77729 - RNA, 22 nt, Human
acuucaugaacauguggccugu

SEQ ID NO: 77730 - RNA, 22 nt, Human
acuucaugaacuaagggaucgg

SEQ ID NO: 77731 - RNA, 22 nt, Human
acuucaugcuuuagagagauga

SEQ ID NO: 77732 - RNA, 22 nt, Human
acuucauguugcucuuggcuau

SEQ ID NO: 77733 - RNA, 22 nt, Human
acuuccagaccugugcuugcuc

SEQ ID NO: 77734 - RNA, 22 nt, Human
acuuccagccccugucagcaaa

SEQ ID NO: 77735 - RNA, 22 nt, Human
acuuccaggaacugccgcuaac

SEQ ID NO: 77736 - RNA, 22 nt, Human
acuucccacacccuguuuucuc

SEQ ID NO: 77737 - RNA, 21 nt, Human
acuucccaggaccuacucaga

SEQ ID NO: 77738 - RNA, 22 nt, Human
acuuccuagauacgagauugaa

SEQ ID NO: 77739 - RNA, 22 nt, Human
acuuccugacuucuggguugga

SEQ ID NO: 77740 - RNA, 22 nt, Human
acuuccugcagcuucucagccc

SEQ ID NO: 77741 - RNA, 19 nt, Human
acuuccugcccgcuccuuu

SEQ ID NO: 77742 - RNA, 22 nt, Human
acuuccugcuaugagcuucugu

SEQ ID NO: 77743 - RNA, 22 nt, Human
acuuccuggauucccaagggcu

SEQ ID NO: 77744 - RNA, 22 nt, Human
acuuccuggcguagcugacauu

SEQ ID NO: 77745 - RNA, 22 nt, Human
acuuccuguuaugugugccucu

SEQ ID NO: 77746 - RNA, 22 nt, Human
acuuccuuguacugacuccauu

SEQ ID NO: 77747 - RNA, 22 nt, Human
acuucucucauucagacauagc

SEQ ID NO: 77748 - RNA, 22 nt, Human
acuucucuccacccaagucccu

SEQ ID NO: 77749 - RNA, 22 nt, Human
acuucugagaaauuuaaggaca

SEQ ID NO: 77750 - RNA, 22 nt, Human
acuucuggugucauacugcauu

SEQ ID NO: 77751 - RNA, 22 nt, Human
acuucuugggacccuggcaccg

SEQ ID NO: 77752 - RNA, 19 nt, Human
acuucuuuucaacacagga

SEQ ID NO: 77753 - RNA, 22 nt, Human
agaaguuuggaugccaucauag

SEQ ID NO: 77754 - RNA, 22 nt, Human
agaaguuugggggcgaaggcag

SEQ ID NO: 77755 - RNA, 20 nt, Human
agaaguuuggggguguggag

SEQ ID NO: 77756 - RNA, 22 nt, Human
agaaguuugguccuuuucaagg

SEQ ID NO: 77757 - RNA, 22 nt, Human
agaaguuuguuauguaaacaaa

SEQ ID NO: 77758 - RNA, 22 nt, Human
agaaguuuugggaaauacugau

SEQ ID NO: 77759 - RNA, 22 nt, Human
agaauaagccugacgaaaccua

SEQ ID NO: 77760 - RNA, 22 nt, Human
agaauacaauuguucaguaaua

SEQ ID NO: 77761 - RNA, 22 nt, Human
agaauacuaggcuucagaaagg

SEQ ID NO: 77762 - RNA, 22 nt, Human
agaauauaaagauaauucuguu

SEQ ID NO: 77763 - RNA, 22 nt, Human
agaaucauuagagagaaaacuu

SEQ ID NO: 77764 - RNA, 22 nt, Human
agaauccucuucaguaaauucu

SEQ ID NO: 77765 - RNA, 22 nt, Human
agaauccuggccaggucagagc

SEQ ID NO: 77766 - RNA, 19 nt, Human
agaaucuaaauuauuucug

SEQ ID NO: 77767 - RNA, 22 nt, Human
agaaucucuacucaaguacuug

SEQ ID NO: 77768 - RNA, 22 nt, Human
agaaucugcauuucuaauaagc

SEQ ID NO: 77769 - RNA, 22 nt, Human
agaaucugcuuuuuaacaagau

SEQ ID NO: 77770 - RNA, 22 nt, Human
agaaucugguagaaccaaggau

SEQ ID NO: 77771 - RNA, 22 nt, Human
agaaucuuuccucauugcuguc

SEQ ID NO: 77772 - RNA, 22 nt, Human
agaaugaagaugacuucggaga

SEQ ID NO: 77773 - RNA, 22 nt, Human
agaaugcagcuugccaguaucu

SEQ ID NO: 77774 - RNA, 22 nt, Human
agaaugcucuucaaaaucuagc

SEQ ID NO: 77775 - RNA, 22 nt, Human
agaaugcuuuggauauauugga

SEQ ID NO: 77776 - RNA, 22 nt, Human
agaaugggggcuacaggccaca

SEQ ID NO: 77777 - RNA, 22 nt, Human
agaauguaagaaugcaaagauu

SEQ ID NO: 77778 - RNA, 22 nt, Human
agaauguguuauuagagaagga

SEQ ID NO: 77779 - RNA, 22 nt, Human
agaauuacauaaauacaugaau

SEQ ID NO: 77780 - RNA, 18 nt, Human
agaauuaccaaagugcuu

SEQ ID NO: 77781 - RNA, 22 nt, Human
agaauuagccggauucuuguuu

SEQ ID NO: 77782 - RNA, 22 nt, Human
agaauuagguaaguucaucuga

SEQ ID NO: 77783 - RNA, 18 nt, Human
agaauuauucuuguccuc

SEQ ID NO: 77784 - RNA, 23 nt, Human
agaauuccaguuucuuaugucac

SEQ ID NO: 77785 - RNA, 22 nt, Human
agacaaguguggugagagcagu

SEQ ID NO: 77786 - RNA, 22 nt, Human
agacaaguguuucuggguaacu

SEQ ID NO: 77787 - RNA, 20 nt, Human
agacaaugagugacagaguu

SEQ ID NO: 77788 - RNA, 19 nt, Human
agacaaugggguuggcagu

SEQ ID NO: 77789 - RNA, 22 nt, Human
agacaauuuuugguuuugcaag

SEQ ID NO: 77790 - RNA, 19 nt, Human
agacacacuuacguggaau

SEQ ID NO: 77791 - RNA, 22 nt, Human
agacacagaacacaaaagcaua

SEQ ID NO: 77792 - RNA, 22 nt, Human
agccuguguuuuuucuauugca

SEQ ID NO: 77793 - RNA, 22 nt, Human
agccuuagagacuuaaaacagg

SEQ ID NO: 77794 - RNA, 22 nt, Human
agccuuagggauugagguugcu

SEQ ID NO: 77795 - RNA, 22 nt, Human
agccuucaguaaauccacugug

SEQ ID NO: 77796 - RNA, 22 nt, Human
agccuuccacccagauccccuu

SEQ ID NO: 77797 - RNA, 22 nt, Human
agccuucucugauucuccuagu

SEQ ID NO: 77798 - RNA, 22 nt, Human
agccuugaaugcgcugcauugg

SEQ ID NO: 77799 - RNA, 22 nt, Human
agccuugacacuggggaaacug

SEQ ID NO: 77800 - RNA, 22 nt, Human
agccuugaucuugguaacagga

SEQ ID NO: 77801 - RNA, 22 nt, Human
agccuugccugggaaacugggu

SEQ ID NO: 77802 - RNA, 22 nt, Human
agccuugcuuuuucaguagcac

SEQ ID NO: 77803 - RNA, 23 nt, Human
agccuuggagguugaggcugcag

SEQ ID NO: 77804 - RNA, 22 nt, Human
agccuuguuggucugaguuugg

SEQ ID NO: 77805 - RNA, 22 nt, Human
agcgagcacauugagugaagaa

SEQ ID NO: 77806 - RNA, 22 nt, Human
agcgagguuuugcagauacagc

SEQ ID NO: 77807 - RNA, 22 nt, Human
agcgagugggucagcguugcag

SEQ ID NO: 77808 - RNA, 22 nt, Human
agcgauucacacacugggcugu

SEQ ID NO: 77809 - RNA, 22 nt, Human
agcgcgcucgaugguuuccgcg

SEQ ID NO: 77810 - RNA, 22 nt, Human
agcgcgcucuaggacaccgcgg

SEQ ID NO: 77811 - RNA, 22 nt, Human
agcggagcuaguuuuuguccuc

SEQ ID NO: 77812 - RNA, 22 nt, Human
agcggcugcucuuuucagaucc

SEQ ID NO: 77813 - RNA, 22 nt, Human
agcgggcagaaguggggucugc

SEQ ID NO: 77814 - RNA, 22 nt, Human
agcgguggugucggcagcggcu

SEQ ID NO: 77815 - RNA, 19 nt, Human
agcgguucucaaagucagg

SEQ ID NO: 77816 - RNA, 21 nt, Human
agcgucaauaucgucaacagg

SEQ ID NO: 77817 - RNA, 22 nt, Human
agcguggguccaaggcucuggu

SEQ ID NO: 77818 - RNA, 22 nt, Human
agcguguggagaacuaagcaga

SEQ ID NO: 77819 - RNA, 22 nt, Human
agcgugugugcgggucuucuuu

SEQ ID NO: 77820 - RNA, 20 nt, Human
agcuaacccuacuuucuuug

SEQ ID NO: 77821 - RNA, 22 nt, Human
agcuaagacuuagugacuuagu

SEQ ID NO: 77822 - RNA, 23 nt, Human
agcuaaggaagcugaggcacagu

SEQ ID NO: 77823 - RNA, 22 nt, Human
agcuaaggacaguugauuuaga

SEQ ID NO: 77824 - RNA, 22 nt, Human
agcuaagguguccuggaggccc

SEQ ID NO: 77825 - RNA, 22 nt, Human
agcuaaugaaauauuuucugau

SEQ ID NO: 77826 - RNA, 22 nt, Human
agcuaaugggagacccuuucac

SEQ ID NO: 77827 - RNA, 22 nt, Human
agcuaauguauguugaaagcac

SEQ ID NO: 77828 - RNA, 22 nt, Human
agcuaauuagaaauagauuauu

SEQ ID NO: 77829 - RNA, 22 nt, Human
agcuacaacuuuuccaugagca

SEQ ID NO: 77830 - RNA, 22 nt, Human
agcuaccuggcuuaucacuguc

SEQ ID NO: 77831 - RNA, 22 nt, Human
agcuacucagaguuccacucua

SEQ ID NO: 77832 - RNA, 22 nt, Human
agcuacucugcagugcccaugg

SEQ ID NO: 77833 - RNA, 22 nt, Human
agcuacuucccuguaggaaaca

SEQ ID NO: 77834 - RNA, 22 nt, Human
agcuagagcugagaagcacuug

SEQ ID NO: 77835 - RNA, 22 nt, Human
agcuagcaaauagcauguagga

SEQ ID NO: 77836 - RNA, 22 nt, Human
agcuagcuuagccugugaggua

SEQ ID NO: 77837 - RNA, 22 nt, Human
agcuaggaaauugaggcugaga

SEQ ID NO: 77838 - RNA, 22 nt, Human
agcuaggacagguagagauggg

SEQ ID NO: 77839 - RNA, 22 nt, Human
agcuagggcaaauaugagauac

SEQ ID NO: 77840 - RNA, 19 nt, Human
agcuagugcucagcuguca

SEQ ID NO: 77841 - RNA, 22 nt, Human
agcuaguucacugaagccuaug

SEQ ID NO: 77842 - RNA, 22 nt, Human
agcuaugaagccacuuuuaaca

SEQ ID NO: 77843 - RNA, 22 nt, Human
agcuauguauaaauaggccacu

SEQ ID NO: 77844 - RNA, 22 nt, Human
agcuauguuccucgaugcucag

SEQ ID NO: 77845 - RNA, 22 nt, Human
agcucaagcuacacacagaguc

SEQ ID NO: 77846 - RNA, 23 nt, Human
agcucaaggcaguccacauuucc

SEQ ID NO: 77847 - RNA, 22 nt, Human
agcucagaaccuccucauccca

SEQ ID NO: 77848 - RNA, 22 nt, Human
agcucagagcucgggaggaugg

SEQ ID NO: 77849 - RNA, 21 nt, Human
agcucagccgggcacaguggc

SEQ ID NO: 77850 - RNA, 22 nt, Human
agcucaggcucugcagggacua

SEQ ID NO: 77851 - RNA, 22 nt, Human
agcucagggcgaucugucucgg

SEQ ID NO: 77852 - RNA, 22 nt, Human
agcucaguggcucaguggguau

SEQ ID NO: 77853 - RNA, 22 nt, Human
agcucaguggcuggggcgcugc

SEQ ID NO: 77854 - RNA, 22 nt, Human
agcuccagagccacauccauca

SEQ ID NO: 77855 - RNA, 22 nt, Human
agcuccagaggcagugaugaag

SEQ ID NO: 77856 - RNA, 22 nt, Human
agcuccagccucuucuggaggu

SEQ ID NO: 77857 - RNA, 22 nt, Human
agcuccaggaucugaaaguucg

SEQ ID NO: 77858 - RNA, 20 nt, Human
agcuccagugcugacgcuuc

SEQ ID NO: 77859 - RNA, 22 nt, Human
agcucccagaguccucugccca

SEQ ID NO: 77860 - RNA, 22 nt, Human
agcucccagcuccuuugagaga

SEQ ID NO: 77861 - RNA, 22 nt, Human
agcucccugcacgacccugccc

SEQ ID NO: 77862 - RNA, 21 nt, Human
agcucccuguuuccucacucu

SEQ ID NO: 77863 - RNA, 20 nt, Human
agcuccucaucacuggaggu

SEQ ID NO: 77864 - RNA, 22 nt, Human
agcuccuccugagugucuggga

SEQ ID NO: 77865 - RNA, 22 nt, Human
agcuccucuagaucugccacuu

SEQ ID NO: 77866 - RNA, 20 nt, Human
agcuccugaggguuacuuuc

SEQ ID NO: 77867 - RNA, 19 nt, Human
agcuccugauugugccucg

SEQ ID NO: 77868 - RNA, 22 nt, Human
agcuccugcacccagccuugag

SEQ ID NO: 77869 - RNA, 22 nt, Human
agcuccugcccaggaaggcucu

SEQ ID NO: 77870 - RNA, 22 nt, Human
agcuccuggaggugcgcacucg

SEQ ID NO: 77871 - RNA, 22 nt, Human
agcuccuggcuuuccucucacc

SEQ ID NO: 77872 - RNA, 19 nt, Human
agcuccugggcucugggcc

SEQ ID NO: 77873 - RNA, 22 nt, Human
agcuccuggggguuccaagcag

SEQ ID NO: 77874 - RNA, 22 nt, Human
agcuccuggugccucagccgaa

SEQ ID NO: 77875 - RNA, 22 nt, Human
agcuccugugugcccaccugcu

SEQ ID NO: 77876 - RNA, 19 nt, Human
agcuccuguucagcagcuc

SEQ ID NO: 77877 - RNA, 22 nt, Human
agcuccuugaagggcucuggga

SEQ ID NO: 77878 - RNA, 22 nt, Human
agcuccuugaauuaaugcugcu

SEQ ID NO: 77879 - RNA, 22 nt, Human
agcucuaaauggaauuuugccu

SEQ ID NO: 77880 - RNA, 22 nt, Human
agcucuaucaccugucaguugc

SEQ ID NO: 77881 - RNA, 22 nt, Human
agcucuccacacauaggacuag

SEQ ID NO: 77882 - RNA, 18 nt, Human
agcucucccccacaugcc

SEQ ID NO: 77883 - RNA, 22 nt, Human
agcucucugauaaauugauaaa

SEQ ID NO: 77884 - RNA, 22 nt, Human
agcucucuuccagauccacuug

SEQ ID NO: 77885 - RNA, 22 nt, Human
agcucugcaggcacagcugagg

SEQ ID NO: 77886 - RNA, 23 nt, Human
agcucugcucgggcaugcccugc

SEQ ID NO: 77887 - RNA, 22 nt, Human
agcucuggaccugacaucuggu

SEQ ID NO: 77888 - RNA, 18 nt, Human
agcucuggcauacuugaa

SEQ ID NO: 77889 - RNA, 22 nt, Human
agcucugggauucucaggccac

SEQ ID NO: 77890 - RNA, 22 nt, Human
agcucugggcugacaugcuccc

SEQ ID NO: 77891 - RNA, 22 nt, Human
agcucugggguagggcccaaca

SEQ ID NO: 77892 - RNA, 22 nt, Human
agcucugguuuagaaggggaaa

SEQ ID NO: 77893 - RNA, 22 nt, Human
agcucuguguucacagcacuaa

SEQ ID NO: 77894 - RNA, 22 nt, Human
agcuggguguguaucagauaaa

SEQ ID NO: 77895 - RNA, 22 nt, Human
agcuggguucagaggcacaugg

SEQ ID NO: 77896 - RNA, 22 nt, Human
agcugguauuucugaaggaaag

SEQ ID NO: 77897 - RNA, 20 nt, Human
agcugguccccaagccucuc

SEQ ID NO: 77898 - RNA, 22 nt, Human
agcuggucugcugcauggagug

SEQ ID NO: 77899 - RNA, 22 nt, Human
agcuggucuuaaauguguccag

SEQ ID NO: 77900 - RNA, 18 nt, Human
agcuggugaaauccagua

SEQ ID NO: 77901 - RNA, 22 nt, Human
agcuggugcugaagcucuugag

SEQ ID NO: 77902 - RNA, 22 nt, Human
agcugguucauucauucauggu

SEQ ID NO: 77903 - RNA, 22 nt, Human
agcugguugacguuauccagga

SEQ ID NO: 77904 - RNA, 22 nt, Human
agcuguaauauaagcaaugaaa

SEQ ID NO: 77905 - RNA, 22 nt, Human
agcugugaccuucaagagcuac

SEQ ID NO: 77906 - RNA, 22 nt, Human
agcugugccuauucguggcaag

SEQ ID NO: 77907 - RNA, 22 nt, Human
agcugugcugccaaguugcuga

SEQ ID NO: 77908 - RNA, 19 nt, Human
agcuguggaugugggauuu

SEQ ID NO: 77909 - RNA, 22 nt, Human
agcuguggcagcagccguggca

SEQ ID NO: 77910 - RNA, 22 nt, Human
agacacagcaauaacuacuguu

SEQ ID NO: 77911 - RNA, 22 nt, Human
agacacaggauucugcauuucu

SEQ ID NO: 77912 - RNA, 22 nt, Human
agacacaguauaagcacaacaa

SEQ ID NO: 77913 - RNA, 22 nt, Human
agacacagucugucuggaggag

SEQ ID NO: 77914 - RNA, 22 nt, Human
agacacaucuuagguugucagg

SEQ ID NO: 77915 - RNA, 22 nt, Human
agacacauuuuacauuaacugu

SEQ ID NO: 77916 - RNA, 22 nt, Human
agacacauuuucagcucugcca

SEQ ID NO: 77917 - RNA, 22 nt, Human
agacaccagaaucuguugagca

SEQ ID NO: 77918 - RNA, 22 nt, Human
agacacugcggaggucgggugg

SEQ ID NO: 77919 - RNA, 22 nt, Human
agacacuguguacagaaaaaga

SEQ ID NO: 77920 - RNA, 15 nt, Human
agacagacaguggga

SEQ ID NO: 77921 - RNA, 22 nt, Human
agacagacaugcuaguuuucuu

SEQ ID NO: 77922 - RNA, 22 nt, Human
agacagacuguguuugaauccu

SEQ ID NO: 77923 - RNA, 22 nt, Human
agacagacuugaaaauguucuu

SEQ ID NO: 77924 - RNA, 22 nt, Human
agacagagauacuauguuguca

SEQ ID NO: 77925 - RNA, 22 nt, Human
agacagcaggggagucugguuu

SEQ ID NO: 77926 - RNA, 21 nt, Human
agacagcagucuccaaacccc

SEQ ID NO: 77927 - RNA, 22 nt, Human
agacagcugccuccaccacagc

SEQ ID NO: 77928 - RNA, 22 nt, Human
agacagcugguagcacuuccug

SEQ ID NO: 77929 - RNA, 23 nt, Human
agacagcuuagaguuugccucuc

SEQ ID NO: 77930 - RNA, 22 nt, Human
agacaggcagaggcugcagagg

SEQ ID NO: 77931 - RNA, 22 nt, Human
agacaggcaugaggcuggauug

SEQ ID NO: 77932 - RNA, 22 nt, Human
agacaggccacucuggucuggu

SEQ ID NO: 77933 - RNA, 22 nt, Human
agacaggcugcugucugcuagg

SEQ ID NO: 77934 - RNA, 21 nt, Human
agacaggucagggagagguga

SEQ ID NO: 77935 - RNA, 22 nt, Human
agacagguguuuuacaacuucg

SEQ ID NO: 77936 - RNA, 22 nt, Human
agacagugauaccuugggaugu

SEQ ID NO: 77937 - RNA, 22 nt, Human
agacaguggcucagccccaguc

SEQ ID NO: 77938 - RNA, 22 nt, Human
agacauaagugcuaugacauug

SEQ ID NO: 77939 - RNA, 22 nt, Human
agacauaggauuccacauagca

SEQ ID NO: 77940 - RNA, 22 nt, Human
agacaucaaugaucagagguag

SEQ ID NO: 77941 - RNA, 22 nt, Human
agacaucucuaugcaggaucuc

SEQ ID NO: 77942 - RNA, 22 nt, Human
agacaugccaagaaacccagug

SEQ ID NO: 77943 - RNA, 22 nt, Human
agacauggauuucuuacauaaa

SEQ ID NO: 77944 - RNA, 22 nt, Human
agacaugguuuauuuuaauggu

SEQ ID NO: 77945 - RNA, 22 nt, Human
agacaugucaccaauucuuacu

SEQ ID NO: 77946 - RNA, 22 nt, Human
agacauuuuagacauaaaagau

SEQ ID NO: 77947 - RNA, 22 nt, Human
agacauuuuggaaaguauuacu

SEQ ID NO: 77948 - RNA, 22 nt, Human
agaccacagucaggcuccuggu

SEQ ID NO: 77949 - RNA, 18 nt, Human
agaccagacaagaauggu

SEQ ID NO: 77950 - RNA, 22 nt, Human
agaccagcugccucccagggcc

SEQ ID NO: 77951 - RNA, 22 nt, Human
agaccagggucccacagagucu

SEQ ID NO: 77952 - RNA, 21 nt, Human
agaccagugggauaaauaggu

SEQ ID NO: 77953 - RNA, 22 nt, Human
agaccauagggaccucagguug

SEQ ID NO: 77954 - RNA, 23 nt, Human
agacccagagacuggcucugcuc

SEQ ID NO: 77955 - RNA, 18 nt, Human
agacccucuaagggcagu

SEQ ID NO: 77956 - RNA, 22 nt, Human
agacccugaaguuuucuaugau

SEQ ID NO: 77957 - RNA, 22 nt, Human
agacccugguaaacacuccagg

SEQ ID NO: 77958 - RNA, 22 nt, Human
agaccgagaaguucuccaggcc

SEQ ID NO: 77959 - RNA, 22 nt, Human
agaccuggaaguucaagagaaa

SEQ ID NO: 77960 - RNA, 22 nt, Human
agaccuggugauagcuguccua

SEQ ID NO: 77961 - RNA, 22 nt, Human
agaccuuguaacuagaggccca

SEQ ID NO: 77962 - RNA, 22 nt, Human
agacuaaaagaaggaagcuacc

SEQ ID NO: 77963 - RNA, 22 nt, Human
agacuaaagacucauucugcug

SEQ ID NO: 77964 - RNA, 16 nt, Human
agacucagugcacuuu

SEQ ID NO: 77965 - RNA, 22 nt, Human
agacuccaaaugaaagaggggg

SEQ ID NO: 77966 - RNA, 22 nt, Human
agacucuaacucaugccauugc

SEQ ID NO: 77967 - RNA, 22 nt, Human
agacucugaagucauugcauga

SEQ ID NO: 77968 - RNA, 19 nt, Human
agacucugccacucuucuc

SEQ ID NO: 77969 - RNA, 22 nt, Human
agacucuggaggggcugguccu

SEQ ID NO: 77970 - RNA, 22 nt, Human
agacucuggagucagcuaggau

SEQ ID NO: 77971 - RNA, 22 nt, Human
agacucuggcaugcuaacuagu

SEQ ID NO: 77972 - RNA, 22 nt, Human
agacucugguccucuugaauuu

SEQ ID NO: 77973 - RNA, 17 nt, Human
agacucugucccaugua

SEQ ID NO: 77974 - RNA, 19 nt, Human
agacucugugugagacuuu

SEQ ID NO: 77975 - RNA, 22 nt, Human
agacugagacuggggaaagaca

SEQ ID NO: 77976 - RNA, 21 nt, Human
agacugccauuguucuuuugg

SEQ ID NO: 77977 - RNA, 22 nt, Human
agacuggaagccugccaagcaa

SEQ ID NO: 77978 - RNA, 22 nt, Human
agacuggcuugcuuuacaagga

SEQ ID NO: 77979 - RNA, 22 nt, Human
agacugggguucuggcaaggag

SEQ ID NO: 77980 - RNA, 22 nt, Human
agacuguagggauagaggucuu

SEQ ID NO: 77981 - RNA, 22 nt, Human
agacuguaugauuugaguuuau

SEQ ID NO: 77982 - RNA, 22 nt, Human
agacuguauucaaaaugugguu

SEQ ID NO: 77983 - RNA, 22 nt, Human
agacugugagggagauacaggg

SEQ ID NO: 77984 - RNA, 22 nt, Human
agacuuagugaguucuaaguuu

SEQ ID NO: 77985 - RNA, 22 nt, Human
agacuucaccuacagcagucuc

SEQ ID NO: 77986 - RNA, 22 nt, Human
agacuucucuaacuugaggacc

SEQ ID NO: 77987 - RNA, 22 nt, Human
agacuucuuugugagcauuuuc

SEQ ID NO: 77988 - RNA, 22 nt, Human
agacuuuagauacgucuucuuc

SEQ ID NO: 77989 - RNA, 22 nt, Human
agacuuuauaaaucuuaauuuc

SEQ ID NO: 77990 - RNA, 22 nt, Human
agacuuuauaguuuuuggcuau

SEQ ID NO: 77991 - RNA, 22 nt, Human
agagaaaagccaucccagccaa

SEQ ID NO: 77992 - RNA, 22 nt, Human
agagaaauuucccugccuucug

SEQ ID NO: 77993 - RNA, 22 nt, Human
agagaacagccuccuagagaaa

SEQ ID NO: 77994 - RNA, 22 nt, Human
agagaagauucuuauaugucuu

SEQ ID NO: 77995 - RNA, 22 nt, Human
agagaagcagggagucaucugu

SEQ ID NO: 77996 - RNA, 21 nt, Human
agagaagggauuccaggcccu

SEQ ID NO: 77997 - RNA, 22 nt, Human
agagaagggccuguauguaauc

SEQ ID NO: 77998 - RNA, 22 nt, Human
agagaagggggaaagaucucac

SEQ ID NO: 77999 - RNA, 22 nt, Human
agagaauccccagacagaguua

SEQ ID NO: 78000 - RNA, 22 nt, Human
agagaauuacagaagaauguca

SEQ ID NO: 78001 - RNA, 22 nt, Human
agagaauuuuaaaagccuugaa

SEQ ID NO: 78002 - RNA, 22 nt, Human
agagacaaacacugcaacuucu

SEQ ID NO: 78003 - RNA, 22 nt, Human
agccuugcagaauaauuugaag

SEQ ID NO: 78004 - RNA, 22 nt, Human
agccuugcaugauuucauucau

SEQ ID NO: 78005 - RNA, 22 nt, Human
agccuuguagaccauuuuaagg

SEQ ID NO: 78006 - RNA, 22 nt, Human
agccuuguugcuaccagaugcc

SEQ ID NO: 78007 - RNA, 22 nt, Human
agcgagggaggucugaggacag

SEQ ID NO: 78008 - RNA, 22 nt, Human
agcgagguuuguucuauucagu

SEQ ID NO: 78009 - RNA, 22 nt, Human
agcgauucuaauuggagauuaa

SEQ ID NO: 78010 - RNA, 22 nt, Human
agcgcaggaacacgucugccuu

SEQ ID NO: 78011 - RNA, 22 nt, Human
agcgccugcggugugagccugc

SEQ ID NO: 78012 - RNA, 22 nt, Human
agcgcgcugucagacuggcucg

SEQ ID NO: 78013 - RNA, 22 nt, Human
agcgcuugccgcacuccaagca

SEQ ID NO: 78014 - RNA, 20 nt, Human
agcggcagcuuccugcuucg

SEQ ID NO: 78015 - RNA, 22 nt, Human
agcgggugcugugucagcccuc

SEQ ID NO: 78016 - RNA, 22 nt, Human
agcgugaauuaguugguacaca

SEQ ID NO: 78017 - RNA, 22 nt, Human
agcuaacacauuccagcuauuu

SEQ ID NO: 78018 - RNA, 23 nt, Human
agcuaacagaucgacaaaguaua

SEQ ID NO: 78019 - RNA, 22 nt, Human
agcuaacauggaggaaaaaguu

SEQ ID NO: 78020 - RNA, 19 nt, Human
agcuaacucacuaacuaug

SEQ ID NO: 78021 - RNA, 22 nt, Human
agcuaagaacuugagcucugga

SEQ ID NO: 78022 - RNA, 22 nt, Human
agcuaaggaacucuguaacacc

SEQ ID NO: 78023 - RNA, 22 nt, Human
agcuaaggacuggaggguuucu

SEQ ID NO: 78024 - RNA, 22 nt, Human
agcuaaggccgcguugggguaa

SEQ ID NO: 78025 - RNA, 22 nt, Human
agcuacagucggaaggacagac

SEQ ID NO: 78026 - RNA, 22 nt, Human
agcuacaugaaauugcugauau

SEQ ID NO: 78027 - RNA, 22 nt, Human
agcuacuacuaccaaacuaaag

SEQ ID NO: 78028 - RNA, 22 nt, Human
agcuagaaguacagccauauga

SEQ ID NO: 78029 - RNA, 22 nt, Human
agcuagaauguuccuuuucauu

SEQ ID NO: 78030 - RNA, 22 nt, Human
agcuagagaaugacagagucug

SEQ ID NO: 78031 - RNA, 22 nt, Human
agcuagaggugaaacaugccaa

SEQ ID NO: 78032 - RNA, 22 nt, Human
agcuagcaggaagcaguuuagu

SEQ ID NO: 78033 - RNA, 22 nt, Human
agcuagccuaggcagagugcau

SEQ ID NO: 78034 - RNA, 20 nt, Human
agcuaggagaaagcauggag

SEQ ID NO: 78035 - RNA, 22 nt, Human
agcuaggccauuuguucaguga

SEQ ID NO: 78036 - RNA, 22 nt, Human
agcuagggacagauaccagcca

SEQ ID NO: 78037 - RNA, 22 nt, Human
agcuagggcuuucguagacagu

SEQ ID NO: 78038 - RNA, 22 nt, Human
agcuaggggaccaagguggccc

SEQ ID NO: 78039 - RNA, 22 nt, Human
agcuaguucagagagauaugua

SEQ ID NO: 78040 - RNA, 22 nt, Human
agcuauguaacagugccaugga

SEQ ID NO: 78041 - RNA, 22 nt, Human
agcuauuucucuuauuauaucc

SEQ ID NO: 78042 - RNA, 22 nt, Human
agcucaagaguaguucgagggg

SEQ ID NO: 78043 - RNA, 21 nt, Human
agcucacaguucuguccuguc

SEQ ID NO: 78044 - RNA, 22 nt, Human
agcucagaagccuaugcauagu

SEQ ID NO: 78045 - RNA, 22 nt, Human
agcucagaagggaggaaaugag

SEQ ID NO: 78046 - RNA, 22 nt, Human
agcucagagaauagggcuugag

SEQ ID NO: 78047 - RNA, 22 nt, Human
agcucagcccuccugugcagcu

SEQ ID NO: 78048 - RNA, 22 nt, Human
agcucagcgggcuucugguaag

SEQ ID NO: 78049 - RNA, 22 nt, Human
agcucaggucucaggagguguc

SEQ ID NO: 78050 - RNA, 22 nt, Human
agcucauggugcuaucucaggg

SEQ ID NO: 78051 - RNA, 22 nt, Human
agcuccagaaagguacacacag

SEQ ID NO: 78052 - RNA, 22 nt, Human
agcuccagagucugaacuauuc

SEQ ID NO: 78053 - RNA, 22 nt, Human
agcuccagccgcugauggguuu

SEQ ID NO: 78054 - RNA, 23 nt, Human
agcuccagcugacgugggcagcc

SEQ ID NO: 78055 - RNA, 19 nt, Human
agcuccaggccuggaugcu

SEQ ID NO: 78056 - RNA, 21 nt, Human
agcuccaggcuccugggguuc

SEQ ID NO: 78057 - RNA, 22 nt, Human
agcuccagguagugccuuaucg

SEQ ID NO: 78058 - RNA, 22 nt, Human
agcuccaggugcaagucauggu

SEQ ID NO: 78059 - RNA, 18 nt, Human
agcuccaucugucagcau

SEQ ID NO: 78060 - RNA, 22 nt, Human
agcucccagaaggcccugcgcc

SEQ ID NO: 78061 - RNA, 19 nt, Human
agcauuuggaauucuacac

SEQ ID NO: 78062 - RNA, 20 nt, Human
agcauuuuaugguaggaaac

SEQ ID NO: 78063 - RNA, 22 nt, Human
agccaaaggcaccagagacacu

SEQ ID NO: 78064 - RNA, 22 nt, Human
agccaaauacaaacuggggugg

SEQ ID NO: 78065 - RNA, 22 nt, Human
agccaaaucuaaagugaauauu

SEQ ID NO: 78066 - RNA, 22 nt, Human
agccaacaacucugagcccagu

SEQ ID NO: 78067 - RNA, 22 nt, Human
agccaacacauguaaaugcacc

SEQ ID NO: 78068 - RNA, 22 nt, Human
agccaacuaauuaaacaacuuu

SEQ ID NO: 78069 - RNA, 22 nt, Human
agccaacuccagccccugcagc

SEQ ID NO: 78070 - RNA, 22 nt, Human
agccaacuuggaaagucagauu

SEQ ID NO: 78071 - RNA, 22 nt, Human
agccaagagaugaggcugcagg

SEQ ID NO: 78072 - RNA, 22 nt, Human
agccaagaggagccuaaagcga

SEQ ID NO: 78073 - RNA, 22 nt, Human
agccaagcugaucuccugcuga

SEQ ID NO: 78074 - RNA, 22 nt, Human
agccaaggcagcuagagcucug

SEQ ID NO: 78075 - RNA, 22 nt, Human
agccaagggucagcugcacaga

SEQ ID NO: 78076 - RNA, 22 nt, Human
agccaagguaucaugagaggca

SEQ ID NO: 78077 - RNA, 22 nt, Human
agccaaucuacaacaaaggaua

SEQ ID NO: 78078 - RNA, 22 nt, Human
agccaaugcguaaaaagaucua

SEQ ID NO: 78079 - RNA, 22 nt, Human
agccacaccuguccugccagcu

SEQ ID NO: 78080 - RNA, 22 nt, Human
agccacagagagggagcugcaa

SEQ ID NO: 78081 - RNA, 22 nt, Human
agccacagcacauuguaagaaa

SEQ ID NO: 78082 - RNA, 22 nt, Human
agccacagguguuggccagugu

SEQ ID NO: 78083 - RNA, 22 nt, Human
agccacagugggcuaccagcuc

SEQ ID NO: 78084 - RNA, 22 nt, Human
agccacgucccugucaggguca

SEQ ID NO: 78085 - RNA, 22 nt, Human
agccacuccuucagcgucugcu

SEQ ID NO: 78086 - RNA, 22 nt, Human
agccagaaaaacaccaagagga

SEQ ID NO: 78087 - RNA, 22 nt, Human
agccagaaaggggcauuaucug

SEQ ID NO: 78088 - RNA, 22 nt, Human
agccagagacugugucuguaau

SEQ ID NO: 78089 - RNA, 22 nt, Human
agccagagacuuuaccugugca

SEQ ID NO: 78090 - RNA, 22 nt, Human
agccagagagccccagguucua

SEQ ID NO: 78091 - RNA, 22 nt, Human
agccagaggaacuugaugacug

SEQ ID NO: 78092 - RNA, 22 nt, Human
agccagaggaagccuggcccuc

SEQ ID NO: 78093 - RNA, 22 nt, Human
agccagaggccagccugccuca

SEQ ID NO: 78094 - RNA, 22 nt, Human
agccagaggucaugagcacagg

SEQ ID NO: 78095 - RNA, 22 nt, Human
agccagauacuuggaaagaccc

SEQ ID NO: 78096 - RNA, 22 nt, Human
agccagauccaggagacagcuc

SEQ ID NO: 78097 - RNA, 22 nt, Human
agccagcacggcgccauggagu

SEQ ID NO: 78098 - RNA, 22 nt, Human
agccagcaggugggaaacugga

SEQ ID NO: 78099 - RNA, 22 nt, Human
agccagcauauauauaguugaa

SEQ ID NO: 78100 - RNA, 22 nt, Human
agccagccaguucacuaggaaa

SEQ ID NO: 78101 - RNA, 22 nt, Human
agccagcugcucgggggaaaca

SEQ ID NO: 78102 - RNA, 22 nt, Human
agccagcuggugggucagcugg

SEQ ID NO: 78103 - RNA, 22 nt, Human
agccagcuguucuggggcagca

SEQ ID NO: 78104 - RNA, 22 nt, Human
agccaggaauuggacaacacau

SEQ ID NO: 78105 - RNA, 22 nt, Human
agccaggacagggcagcucgcu

SEQ ID NO: 78106 - RNA, 22 nt, Human
agccaggccagacucacacccu

SEQ ID NO: 78107 - RNA, 22 nt, Human
agccagggagguggagguugca

SEQ ID NO: 78108 - RNA, 22 nt, Human
agccagggaugcagcacaguga

SEQ ID NO: 78109 - RNA, 22 nt, Human
agccagggggacgcuuucuggc

SEQ ID NO: 78110 - RNA, 22 nt, Human
agccaggguuagaagauaguca

SEQ ID NO: 78111 - RNA, 22 nt, Human
agccaggucagcucacccugcu

SEQ ID NO: 78112 - RNA, 22 nt, Human
agcugagcucaggcugauguaa

SEQ ID NO: 78113 - RNA, 22 nt, Human
agcugaggguucgguguccaca

SEQ ID NO: 78114 - RNA, 19 nt, Human
agcugcaaaagguggaacu

SEQ ID NO: 78115 - RNA, 22 nt, Human
agcugcaaaccaggccggcgcg

SEQ ID NO: 78116 - RNA, 22 nt, Human
agcugcaaagaucugucaguca

SEQ ID NO: 78117 - RNA, 21 nt, Human
agcugcaagagcaacaucuuu

SEQ ID NO: 78118 - RNA, 22 nt, Human
agcugcaagauaaaagugaugu

SEQ ID NO: 78119 - RNA, 22 nt, Human
agcugcaagucuguguggggag

SEQ ID NO: 78120 - RNA, 22 nt, Human
agcugcacugugaaguucauag

SEQ ID NO: 78121 - RNA, 22 nt, Human
agcugcagaaaggacaacuaau

SEQ ID NO: 78122 - RNA, 21 nt, Human
agcugcagcccaaaggccugu

SEQ ID NO: 78123 - RNA, 22 nt, Human
agcugcagcguucauuuuucca

SEQ ID NO: 78124 - RNA, 22 nt, Human
agcugcagcuacaguguugguu

SEQ ID NO: 78125 - RNA, 22 nt, Human
agcugcaggaaguagaagcgga

SEQ ID NO: 78126 - RNA, 22 nt, Human
agcugcaggauuauggaaugga

SEQ ID NO: 78127 - RNA, 22 nt, Human
agcugcaggcgccggggccgau

SEQ ID NO: 78128 - RNA, 22 nt, Human
agcugcagguucagcauuccac

SEQ ID NO: 78129 - RNA, 22 nt, Human
agcugcagucaagcugggccac

SEQ ID NO: 78130 - RNA, 22 nt, Human
agcugcagugaauucgcuaacu

SEQ ID NO: 78131 - RNA, 22 nt, Human
agcugcaguuagccccagauga

SEQ ID NO: 78132 - RNA, 22 nt, Human
agcugccaaguuggaguagcaa

SEQ ID NO: 78133 - RNA, 22 nt, Human
agcugccagcaaguuucaaaca

SEQ ID NO: 78134 - RNA, 22 nt, Human
agcugccagggacugggcaugg

SEQ ID NO: 78135 - RNA, 21 nt, Human
agcugcccagaguagggaagg

SEQ ID NO: 78136 - RNA, 22 nt, Human
agcugcccagauaggaggaggc

SEQ ID NO: 78137 - RNA, 18 nt, Human
agcugcccugggcuggag

SEQ ID NO: 78138 - RNA, 22 nt, Human
agcugcccuguggggaggguug

SEQ ID NO: 78139 - RNA, 22 nt, Human
agcugccuaguagauugauugg

SEQ ID NO: 78140 - RNA, 22 nt, Human
agcugccucagucacucauggc

SEQ ID NO: 78141 - RNA, 21 nt, Human
agcugccuccacuucugaggc

SEQ ID NO: 78142 - RNA, 22 nt, Human
agcugccuccuggugccccauc

SEQ ID NO: 78143 - RNA, 22 nt, Human
agcugccucugaacuuuaauuc

SEQ ID NO: 78144 - RNA, 22 nt, Human
agcugccugccaugccgcuggu

SEQ ID NO: 78145 - RNA, 21 nt, Human
agcugccugcucuggaccugg

SEQ ID NO: 78146 - RNA, 22 nt, Human
agcugccugcugcacucggugc

SEQ ID NO: 78147 - RNA, 22 nt, Human
agcugccugcuuaugagcucca

SEQ ID NO: 78148 - RNA, 15 nt, Human
agcugccugggugcu

SEQ ID NO: 78149 - RNA, 19 nt, Human
agcugccugugcgcgcccg

SEQ ID NO: 78150 - RNA, 22 nt, Human
agcugccugugcugggagccca

SEQ ID NO: 78151 - RNA, 22 nt, Human
agcugccuguguagaaccaucu

SEQ ID NO: 78152 - RNA, 22 nt, Human
agcugcuccaauuuuuaccauu

SEQ ID NO: 78153 - RNA, 21 nt, Human
agcugcuccagggagcucagg

SEQ ID NO: 78154 - RNA, 22 nt, Human
agcugcucccuauccuuuccuu

SEQ ID NO: 78155 - RNA, 22 nt, Human
agcugcucgaagccgguggccc

SEQ ID NO: 78156 - RNA, 22 nt, Human
agcugcucugagcccugauucu

SEQ ID NO: 78157 - RNA, 22 nt, Human
agcugcucugauaaaccuacuu

SEQ ID NO: 78158 - RNA, 22 nt, Human
agcugcucuuugaaggacacuu

SEQ ID NO: 78159 - RNA, 22 nt, Human
agcugcugaaugacacugcaag

SEQ ID NO: 78160 - RNA, 22 nt, Human
agcugcugcggaaagaugccac

SEQ ID NO: 78161 - RNA, 19 nt, Human
agcugcuggcccagggacc

SEQ ID NO: 78162 - RNA, 22 nt, Human
agcugcugggaccccagaucca

SEQ ID NO: 78163 - RNA, 22 nt, Human
agcugcugggauacaguaguga

SEQ ID NO: 78164 - RNA, 22 nt, Human
agcugcuggggagggcagacac

SEQ ID NO: 78165 - RNA, 22 nt, Human
agcugcugguuuaagggauggg

SEQ ID NO: 78166 - RNA, 21 nt, Human
agcugcuguggccagaaucca

SEQ ID NO: 78167 - RNA, 22 nt, Human
agcugcuguuuggugagucuug

SEQ ID NO: 78168 - RNA, 22 nt, Human
agcugcuuagaguccucaggau

SEQ ID NO: 78169 - RNA, 22 nt, Human
agcugcuuagagucucuucuua

SEQ ID NO: 78170 - RNA, 22 nt, Human
agcugcuuauaagauuugggag

SEQ ID NO: 78171 - RNA, 22 nt, Human
agcugcuucaaaaugggcuccu

SEQ ID NO: 78172 - RNA, 18 nt, Human
agcugcuuuuggcuuaaa

SEQ ID NO: 78173 - RNA, 22 nt, Human
agcuggaaaauccaagaccuug

SEQ ID NO: 78174 - RNA, 22 nt, Human
agcuggaaagaagguggcagcc

SEQ ID NO: 78175 - RNA, 22 nt, Human
agcuggaacgucacaggagcag

SEQ ID NO: 78176 - RNA, 22 nt, Human
agcuggagccagugugaggcuu

SEQ ID NO: 78177 - RNA, 22 nt, Human
agcaucuucaacaggcauuuua

SEQ ID NO: 78178 - RNA, 22 nt, Human
agcaugaaaggcgugccaacuu

SEQ ID NO: 78179 - RNA, 22 nt, Human
agcaugaagacuucagagcuag

SEQ ID NO: 78180 - RNA, 22 nt, Human
agcaugcaguaaagcccauguc

SEQ ID NO: 78181 - RNA, 22 nt, Human
agcaugcaguaaguacccugug

SEQ ID NO: 78182 - RNA, 22 nt, Human
agcaugcaugaagauucagcaa

SEQ ID NO: 78183 - RNA, 19 nt, Human
agcauggaagcuggugcca

SEQ ID NO: 78184 - RNA, 23 nt, Human
agcauggaauaggaaagaggcag

SEQ ID NO: 78185 - RNA, 22 nt, Human
agcauggcuuuggaggauagca

SEQ ID NO: 78186 - RNA, 22 nt, Human
agcaugucuaacucuucagggu

SEQ ID NO: 78187 - RNA, 21 nt, Human
agcaugucucagucaacaagg

SEQ ID NO: 78188 - RNA, 22 nt, Human
agcauguggcuaucuuuggggg

SEQ ID NO: 78189 - RNA, 22 nt, Human
agcauguucaucuucuguuggu

SEQ ID NO: 78190 - RNA, 22 nt, Human
agcauuaagagagacugaacug

SEQ ID NO: 78191 - RNA, 22 nt, Human
agcauuacuauucucaaaaaca

SEQ ID NO: 78192 - RNA, 22 nt, Human
agcauuagguguguuucagagg

SEQ ID NO: 78193 - RNA, 22 nt, Human
agcauucaaguaauucacuugg

SEQ ID NO: 78194 - RNA, 20 nt, Human
agcauucauucagcaagccu

SEQ ID NO: 78195 - RNA, 22 nt, Human
agcauucauugcuagaauguaa

SEQ ID NO: 78196 - RNA, 23 nt, Human
agcauucucuccaacauuuaaca

SEQ ID NO: 78197 - RNA, 22 nt, Human
agcauugccugccuauugcuaa

SEQ ID NO: 78198 - RNA, 22 nt, Human
agcauuuaguuaguaaauguuu

SEQ ID NO: 78199 - RNA, 22 nt, Human
agcauuuaugacuaauguaaaa

SEQ ID NO: 78200 - RNA, 22 nt, Human
agccaaaacaugugaguuuuga

SEQ ID NO: 78201 - RNA, 20 nt, Human
agccaaaggagaacagugcu

SEQ ID NO: 78202 - RNA, 22 nt, Human
agccaaagugguauauagggaa

SEQ ID NO: 78203 - RNA, 22 nt, Human
agccaacagccagcaucaacca

SEQ ID NO: 78204 - RNA, 22 nt, Human
agccaagacauuuagaaaagcu

SEQ ID NO: 78205 - RNA, 22 nt, Human
agccaagcaccacuggcacucg

SEQ ID NO: 78206 - RNA, 22 nt, Human
agccaagcacucaacuccugga

SEQ ID NO: 78207 - RNA, 21 nt, Human
agccaagccuugggagccagg

SEQ ID NO: 78208 - RNA, 18 nt, Human
agccaaggaggaggagga

SEQ ID NO: 78209 - RNA, 22 nt, Human
agccaauaaauuuacaacuaga

SEQ ID NO: 78210 - RNA, 20 nt, Human
agccaauacagcaaaauuug

SEQ ID NO: 78211 - RNA, 22 nt, Human
agccacaaaggcuugccucgga

SEQ ID NO: 78212 - RNA, 19 nt, Human
agccacagaacuugcagga

SEQ ID NO: 78213 - RNA, 22 nt, Human
agccacagagcaggagaccuuu

SEQ ID NO: 78214 - RNA, 22 nt, Human
agccacagagguugaugugguu

SEQ ID NO: 78215 - RNA, 22 nt, Human
agccacagcauguguguaugua

SEQ ID NO: 78216 - RNA, 22 nt, Human
agccacagcccacaggacucuu

SEQ ID NO: 78217 - RNA, 22 nt, Human
agccacagcgaaccucucuucc

SEQ ID NO: 78218 - RNA, 22 nt, Human
agccacagcuccuugguggaga

SEQ ID NO: 78219 - RNA, 22 nt, Human
agccacagggggugagggacaa

SEQ ID NO: 78220 - RNA, 22 nt, Human
agccacagucuguagccagcuu

SEQ ID NO: 78221 - RNA, 22 nt, Human
agccacagugcaagagagaaaa

SEQ ID NO: 78222 - RNA, 22 nt, Human
aggggcucaguuacuuuggcag

SEQ ID NO: 78223 - RNA, 22 nt, Human
aggggcuccucucugagaguag

SEQ ID NO: 78224 - RNA, 22 nt, Human
aggggcucuaaagaucauggaa

SEQ ID NO: 78225 - RNA, 22 nt, Human
aggggcuucccuuccuggguag

SEQ ID NO: 78226 - RNA, 22 nt, Human
aggggcuuguggaguugcuggu

SEQ ID NO: 78227 - RNA, 22 nt, Human
agggggagacauguguguguuu

SEQ ID NO: 78228 - RNA, 22 nt, Human
agggggagcuuggcuacuccug

SEQ ID NO: 78229 - RNA, 22 nt, Human
agggggcucagcaggcucugga

SEQ ID NO: 78230 - RNA, 22 nt, Human
agggggcucagcauggauggag

SEQ ID NO: 78231 - RNA, 22 nt, Human
agggggucguccggaagaccug

SEQ ID NO: 78232 - RNA, 22 nt, Human
agggggugaucaaggugcggcg

SEQ ID NO: 78233 - RNA, 22 nt, Human
agggggugggaagucuagaauc

SEQ ID NO: 78234 - RNA, 16 nt, Human
agggguacaguucauc

SEQ ID NO: 78235 - RNA, 20 nt, Human
aggggucuagcagcagugcu

SEQ ID NO: 78236 - RNA, 22 nt, Human
aggggucuauccugagaugguc

SEQ ID NO: 78237 - RNA, 22 nt, Human
aggggucuugggaguccuggcu

SEQ ID NO: 78238 - RNA, 22 nt, Human
aggggugauuugggacaggaca

SEQ ID NO: 78239 - RNA, 22 nt, Human
agggguuggacauaagacagaa

SEQ ID NO: 78240 - RNA, 22 nt, Human
agggguuggauuuggccuagag

SEQ ID NO: 78241 - RNA, 22 nt, Human
aggguaggaacugaguggaagg

SEQ ID NO: 78242 - RNA, 22 nt, Human
aggguauaaagagcaagcagaa

SEQ ID NO: 78243 - RNA, 22 nt, Human
agggucaaaugggcaggaagag

SEQ ID NO: 78244 - RNA, 22 nt, Human
agggucaacauucuaaaaucug

SEQ ID NO: 78245 - RNA, 22 nt, Human
agggucaagaggcagaguucuu

SEQ ID NO: 78246 - RNA, 22 nt, Human
agggucaagucacugguucacg

SEQ ID NO: 78247 - RNA, 22 nt, Human
agggucacaaugugugaauugg

SEQ ID NO: 78248 - RNA, 17 nt, Human
agggucaggugaaguuc

SEQ ID NO: 78249 - RNA, 22 nt, Human
aggguccaacugaggcugaacu

SEQ ID NO: 78250 - RNA, 19 nt, Human
aggguccaggcccugugga

SEQ ID NO: 78251 - RNA, 22 nt, Human
aggguccaucaaggacugcaca

SEQ ID NO: 78252 - RNA, 22 nt, Human
aggguccauucuuugccuuuuc

SEQ ID NO: 78253 - RNA, 22 nt, Human
agggucucuacgcacuagaggg

SEQ ID NO: 78254 - RNA, 22 nt, Human
agggucugcauuccaacuuggg

SEQ ID NO: 78255 - RNA, 22 nt, Human
agggucugugcaagaacacgcc

SEQ ID NO: 78256 - RNA, 22 nt, Human
agggucuugaggaucugaacug

SEQ ID NO: 78257 - RNA, 22 nt, Human
agggucuuuccugggagccagc

SEQ ID NO: 78258 - RNA, 22 nt, Human
agggugaaucucacaacucuua

SEQ ID NO: 78259 - RNA, 20 nt, Human
agggugagacaugagccucc

SEQ ID NO: 78260 - RNA, 22 nt, Human
agggugcagaacaaauuaagac

SEQ ID NO: 78261 - RNA, 22 nt, Human
agggugcaggggaagcugcccu

SEQ ID NO: 78262 - RNA, 22 nt, Human
agggugcauguuugcaagagug

SEQ ID NO: 78263 - RNA, 22 nt, Human
aggguggaagauggcacuaucu

SEQ ID NO: 78264 - RNA, 20 nt, Human
aggguggcaaguuagugaca

SEQ ID NO: 78265 - RNA, 22 nt, Human
aggguggcaccacauaucauag

SEQ ID NO: 78266 - RNA, 22 nt, Human
aggguggccaugagggagagau

SEQ ID NO: 78267 - RNA, 22 nt, Human
aggguggcuggaggaaucagaa

SEQ ID NO: 78268 - RNA, 20 nt, Human
aggguggggacguucugacu

SEQ ID NO: 78269 - RNA, 22 nt, Human
agggugucagccacggaauggg

SEQ ID NO: 78270 - RNA, 22 nt, Human
aggguguguucuccuaugagaa

SEQ ID NO: 78271 - RNA, 19 nt, Human
aggguuacccgcugccacc

SEQ ID NO: 78272 - RNA, 20 nt, Human
aggguucccuuguucagcag

SEQ ID NO: 78273 - RNA, 22 nt, Human
agguaaaugaauguuuagucuu

SEQ ID NO: 78274 - RNA, 22 nt, Human
agguaaaugucagagccuuuaa

SEQ ID NO: 78275 - RNA, 22 nt, Human
agguaacauugccuccaucuga

SEQ ID NO: 78276 - RNA, 22 nt, Human
agguaagguuuggaggcagugg

SEQ ID NO: 78277 - RNA, 22 nt, Human
agguaauaggguucagaauuau

SEQ ID NO: 78278 - RNA, 22 nt, Human
agguaauuacuagaguuauuua

SEQ ID NO: 78279 - RNA, 22 nt, Human
agguaauuguauguuccaagca

SEQ ID NO: 78280 - RNA, 22 nt, Human
agguaauuucuccaaacaugcu

SEQ ID NO: 78281 - RNA, 23 nt, Human
agguacacauuauagaaauagac

SEQ ID NO: 78282 - RNA, 22 nt, Human
agguacauggggugugugcacg

SEQ ID NO: 78283 - RNA, 22 nt, Human
agguacuaccagggauuuucag

SEQ ID NO: 78284 - RNA, 22 nt, Human
agguacugaaaaaauguuugca

SEQ ID NO: 78285 - RNA, 22 nt, Human
agguagcauauuccagacuugu

SEQ ID NO: 78286 - RNA, 20 nt, Human
agguaggaucggugucauaa

SEQ ID NO: 78287 - RNA, 19 nt, Human
agguaggcaguggcaugga

SEQ ID NO: 78288 - RNA, 22 nt, Human
agguaggcccugagugcuguug

SEQ ID NO: 78289 - RNA, 22 nt, Human
agguaggccugacgcuggggug

SEQ ID NO: 78290 - RNA, 22 nt, Human
agguaguuuugacuucauggcu

SEQ ID NO: 78291 - RNA, 22 nt, Human
agguauaagaagauuauuuaua

SEQ ID NO: 78292 - RNA, 22 nt, Human
agguauauauucugguccuuau

SEQ ID NO: 78293 - RNA, 22 nt, Human
agcuggaugaauuuggaacacu

SEQ ID NO: 78294 - RNA, 22 nt, Human
agcuggauuccagugcagucac

SEQ ID NO: 78295 - RNA, 21 nt, Human
agcuggcagugccuggaccuc

SEQ ID NO: 78296 - RNA, 22 nt, Human
agcuggcauacuuugcuaggaa

SEQ ID NO: 78297 - RNA, 22 nt, Human
agcuggcauuacaggagcaugc

SEQ ID NO: 78298 - RNA, 22 nt, Human
agcuggccauugugaguggccu

SEQ ID NO: 78299 - RNA, 20 nt, Human
agcuggcccccgguggccug

SEQ ID NO: 78300 - RNA, 18 nt, Human
agcuggcccuggcugccg

SEQ ID NO: 78301 - RNA, 21 nt, Human
agcuggccugguuugagcucc

SEQ ID NO: 78302 - RNA, 22 nt, Human
agcuggcuuuugugaagguuuu

SEQ ID NO: 78303 - RNA, 23 nt, Human
agcugggaauuuucugaagcuuu

SEQ ID NO: 78304 - RNA, 22 nt, Human
agcugggacagacaacuauguu

SEQ ID NO: 78305 - RNA, 22 nt, Human
agcugggaggcuccucugugac

SEQ ID NO: 78306 - RNA, 22 nt, Human
agcugggcaaaaugugagguug

SEQ ID NO: 78307 - RNA, 22 nt, Human
agcugggcgcaguggcugguga

SEQ ID NO: 78308 - RNA, 22 nt, Human
agcugggcugaugacucauguu

SEQ ID NO: 78309 - RNA, 22 nt, Human
agcugggcugggcugagcugag

SEQ ID NO: 78310 - RNA, 19 nt, Human
agcugggcugucacaguga

SEQ ID NO: 78311 - RNA, 22 nt, Human
agcugggcuuggccaggucgcu

SEQ ID NO: 78312 - RNA, 18 nt, Human
agcuggggccucuggucc

SEQ ID NO: 78313 - RNA, 22 nt, Human
agcuggggguagugagaaauaa

SEQ ID NO: 78314 - RNA, 22 nt, Human
agcuggggguuggauaagggua

SEQ ID NO: 78315 - RNA, 22 nt, Human
agcuggguacacguugucacaa

SEQ ID NO: 78316 - RNA, 22 nt, Human
agcugggugcccgaagccacgu

SEQ ID NO: 78317 - RNA, 23 nt, Human
agcuggguggccugcgugaagcu

SEQ ID NO: 78318 - RNA, 22 nt, Human
agcuggguggugcugagccuug

SEQ ID NO: 78319 - RNA, 22 nt, Human
agcuggguguucuugggccuaa

SEQ ID NO: 78320 - RNA, 17 nt, Human
agcuggguucucaggaa

SEQ ID NO: 78321 - RNA, 22 nt, Human
agcugguaaaggggaaagcaga

SEQ ID NO: 78322 - RNA, 22 nt, Human
agcugguaaguggcagagauuc

SEQ ID NO: 78323 - RNA, 22 nt, Human
agcugguccuaauugagccauu

SEQ ID NO: 78324 - RNA, 22 nt, Human
agcuggugaaccugaggcacag

SEQ ID NO: 78325 - RNA, 22 nt, Human
agcuggugauguggucccucac

SEQ ID NO: 78326 - RNA, 22 nt, Human
agcugguggaagggagcccaaa

SEQ ID NO: 78327 - RNA, 22 nt, Human
agcugguggagaagcagaccuc

SEQ ID NO: 78328 - RNA, 22 nt, Human
agcugguggggaagcugcaggu

SEQ ID NO: 78329 - RNA, 22 nt, Human
agcuggugucaccuccagucca

SEQ ID NO: 78330 - RNA, 22 nt, Human
agcuggugugccacuguugggg

SEQ ID NO: 78331 - RNA, 22 nt, Human
agcuggugugccaguuccaguu

SEQ ID NO: 78332 - RNA, 22 nt, Human
uguuaguuguucauguuaagag

SEQ ID NO: 78333 - RNA, 22 nt, Human
uguuauacagacacgaugguau

SEQ ID NO: 78334 - RNA, 22 nt, Human
uguuaucugguugucugauuac

SEQ ID NO: 78335 - RNA, 21 nt, Human
uguuaugugcuucaagaagug

SEQ ID NO: 78336 - RNA, 20 nt, Human
uguuauuagcaagcuucuuu

SEQ ID NO: 78337 - RNA, 22 nt, Human
uguuauuaucuguuagguguuc

SEQ ID NO: 78338 - RNA, 22 nt, Human
uguuauuauguuuccagagccu

SEQ ID NO: 78339 - RNA, 22 nt, Human
uguuauuuaucugagcauuuau

SEQ ID NO: 78340 - RNA, 22 nt, Human
uguuauuucuuugccauaucuu

SEQ ID NO: 78341 - RNA, 22 nt, Human
uguuauuugggaaaguuguaca

SEQ ID NO: 78342 - RNA, 22 nt, Human
uguucaaaucuuuugcuuauuu

SEQ ID NO: 78343 - RNA, 22 nt, Human
uguucacaaggugaugcuuuga

SEQ ID NO: 78344 - RNA, 22 nt, Human
uguucaguuaacacagacacca

SEQ ID NO: 78345 - RNA, 22 nt, Human
uguucauagcuaucauuguguc

SEQ ID NO: 78346 - RNA, 22 nt, Human
uguucauucaacaugucaucua

SEQ ID NO: 78347 - RNA, 22 nt, Human
uguucauucuguauaugcugua

SEQ ID NO: 78348 - RNA, 18 nt, Human
uguuccaaggaaggaauc

SEQ ID NO: 78349 - RNA, 22 nt, Human
uguuccaauaaggaguugaaau

SEQ ID NO: 78350 - RNA, 22 nt, Human
uguuccagaggcagagauagga

SEQ ID NO: 78351 - RNA, 23 nt, Human
uguuccagauacgccuuuuccuc

SEQ ID NO: 78352 - RNA, 20 nt, Human
uguuccaggaggccagggcu

SEQ ID NO: 78353 - RNA, 22 nt, Human
uguucccauggauaucugcaua

SEQ ID NO: 78354 - RNA, 22 nt, Human
uguucccauuuucugcauaauc

SEQ ID NO: 78355 - RNA, 22 nt, Human
uguuccuaaauaugaauggaga

SEQ ID NO: 78356 - RNA, 22 nt, Human
uguuccucugaacuucuuccaa

SEQ ID NO: 78357 - RNA, 18 nt, Human
uguuccugccuuucucug

SEQ ID NO: 78358 - RNA, 22 nt, Human
uguuccugguuccugcaugaug

SEQ ID NO: 78359 - RNA, 21 nt, Human
uguuccuguucucuaggaucc

SEQ ID NO: 78360 - RNA, 22 nt, Human
uguuccuugaauauaucagacg

SEQ ID NO: 78361 - RNA, 22 nt, Human
uguucuaaauuugcauggucca

SEQ ID NO: 78362 - RNA, 22 nt, Human
uguucuaagcugccaaaaugcu

SEQ ID NO: 78363 - RNA, 17 nt, Human
uguucucuucagaaauc

SEQ ID NO: 78364 - RNA, 22 nt, Human
uguucuggggacagcgucccau

SEQ ID NO: 78365 - RNA, 22 nt, Human
uguucuguaccuguccuggggc

SEQ ID NO: 78366 - RNA, 20 nt, Human
uguucugucgucuuucuuca

SEQ ID NO: 78367 - RNA, 22 nt, Human
uguucuuagguauuugacaguc

SEQ ID NO: 78368 - RNA, 22 nt, Human
uguucuuaugaauucaagacac

SEQ ID NO: 78369 - RNA, 22 nt, Human
uguucuugagccuuuagaccua

SEQ ID NO: 78370 - RNA, 19 nt, Human
uguugaagauuauuugugg

SEQ ID NO: 78371 - RNA, 22 nt, Human
uguugacaauaaagucuaccau

SEQ ID NO: 78372 - RNA, 22 nt, Human
uguugacucaacacugugggca

SEQ ID NO: 78373 - RNA, 22 nt, Human
uguugagacacagacacaagcc

SEQ ID NO: 78374 - RNA, 22 nt, Human
uguugaguauauaccuacaagu

SEQ ID NO: 78375 - RNA, 22 nt, Human
uguugauuugugggcugcaaaa

SEQ ID NO: 78376 - RNA, 22 nt, Human
uguugcaguaaaaauggagagg

SEQ ID NO: 78377 - RNA, 22 nt, Human
uguugccuaacugcccucugaa

SEQ ID NO: 78378 - RNA, 22 nt, Human
uguugccugacuuuaaaaugug

SEQ ID NO: 78379 - RNA, 20 nt, Human
uguugcucucuccugaguuu

SEQ ID NO: 78380 - RNA, 22 nt, Human
uguuggaauuaggauacagagg

SEQ ID NO: 78381 - RNA, 22 nt, Human
uguuggcauuagaggguuauug

SEQ ID NO: 78382 - RNA, 22 nt, Human
uguugguuuaaaaugcugauuu

SEQ ID NO: 78383 - RNA, 22 nt, Human
uguuguaaaauuugagauguca

SEQ ID NO: 78384 - RNA, 22 nt, Human
uguuguaaucauuuuaugaaaa

SEQ ID NO: 78385 - RNA, 22 nt, Human
uguugugacccagaccaagaag

SEQ ID NO: 78386 - RNA, 22 nt, Human
uguuuaagccuguggugucauc

SEQ ID NO: 78387 - RNA, 22 nt, Human
uguuuaagcugaugagguaucg

SEQ ID NO: 78388 - RNA, 22 nt, Human
uguuuaaguagucucagggccu

SEQ ID NO: 78389 - RNA, 21 nt, Human
uguuuaauacauauuugugga

SEQ ID NO: 78390 - RNA, 22 nt, Human
uguuuaaucuucaggacagucu

SEQ ID NO: 78391 - RNA, 22 nt, Human
uguuuaauucaccaucauguuc

SEQ ID NO: 78392 - RNA, 22 nt, Human
uguuuaauugggccaacagcgg

SEQ ID NO: 78393 - RNA, 22 nt, Human
uguuuacaagccacuuguuaag

SEQ ID NO: 78394 - RNA, 22 nt, Human
uguuuacaaggagaauuugagg

SEQ ID NO: 78395 - RNA, 22 nt, Human
uguuuacagggugauuuuaccu

SEQ ID NO: 78396 - RNA, 19 nt, Human
uguuuacauguuucuucag

SEQ ID NO: 78397 - RNA, 22 nt, Human
uguuuacuagccaacauggaga

SEQ ID NO: 78398 - RNA, 22 nt, Human
uguuuacuccugauauauuuuu

SEQ ID NO: 78399 - RNA, 20 nt, Human
uggcccagcacgacgaggac

SEQ ID NO: 78400 - RNA, 22 nt, Human
uggcccagcaguucugccccag

SEQ ID NO: 78401 - RNA, 22 nt, Human
uggcccagcugcagauggugga

SEQ ID NO: 78402 - RNA, 22 nt, Human
uggcccagugcuuaugcucuga

SEQ ID NO: 78403 - RNA, 22 nt, Human
uggccccauuuuacagaugaaa

SEQ ID NO: 78404 - RNA, 22 nt, Human
uggccccugaggagcgucagcc

SEQ ID NO: 78405 - RNA, 18 nt, Human
uggccccuuaucaguccu

SEQ ID NO: 78406 - RNA, 22 nt, Human
uggcccucguccgacagguggg

SEQ ID NO: 78407 - RNA, 23 nt, Human
uggcccugaaucuguccuggagg

SEQ ID NO: 78408 - RNA, 22 nt, Human
uggcccugacacgugguacugg

SEQ ID NO: 78409 - RNA, 22 nt, Human
uggcccugacuuggaggccuga

SEQ ID NO: 78410 - RNA, 22 nt, Human
uggcccugagggcucggagcca

SEQ ID NO: 78411 - RNA, 22 nt, Human
uggcccugcuaugauccugcaa

SEQ ID NO: 78412 - RNA, 22 nt, Human
uggcccugcugggucagagcug

SEQ ID NO: 78413 - RNA, 22 nt, Human
uggcccugcuuaugucucucuu

SEQ ID NO: 78414 - RNA, 22 nt, Human
uggcccugggcaucuuucguga

SEQ ID NO: 78415 - RNA, 22 nt, Human
uggcccugguggcacagccugc

SEQ ID NO: 78416 - RNA, 23 nt, Human
uggcccugugcaugcugcuuccc

SEQ ID NO: 78417 - RNA, 22 nt, Human
uggcccuuuugugaaguggcca

SEQ ID NO: 78418 - RNA, 22 nt, Human
uggccgggccgggcgccuccac

SEQ ID NO: 78419 - RNA, 22 nt, Human
uggccuauuucaucaguucaau

SEQ ID NO: 78420 - RNA, 22 nt, Human
uggccucugcaauggauucacc

SEQ ID NO: 78421 - RNA, 22 nt, Human
uggccucuuacgacauagccuu

SEQ ID NO: 78422 - RNA, 22 nt, Human
uggccucuuucuucccuuugac

SEQ ID NO: 78423 - RNA, 22 nt, Human
uggccugauacuuccagaguuc

SEQ ID NO: 78424 - RNA, 22 nt, Human
uggccugauuuugcuaagagaa

SEQ ID NO: 78425 - RNA, 23 nt, Human
uggccugcagaguuucugcuggg

SEQ ID NO: 78426 - RNA, 22 nt, Human
uggccugccugggagcagcagg

SEQ ID NO: 78427 - RNA, 22 nt, Human
uggccugcucacagucagaugg

SEQ ID NO: 78428 - RNA, 22 nt, Human
uggccuggaaaaaugcagaugg

SEQ ID NO: 78429 - RNA, 22 nt, Human
uggccuguugcuccuagggguc

SEQ ID NO: 78430 - RNA, 22 nt, Human
uggccuugauuaugccaguaga

SEQ ID NO: 78431 - RNA, 22 nt, Human
uggccuuggacagagcgcuccu

SEQ ID NO: 78432 - RNA, 22 nt, Human
uggccuuguguuuuagagaaag

SEQ ID NO: 78433 - RNA, 22 nt, Human
uggccuuuguugauagcuaugc

SEQ ID NO: 78434 - RNA, 22 nt, Human
uggccuuuucuuucacaggcaa

SEQ ID NO: 78435 - RNA, 22 nt, Human
uggcgaggccaggccagggccu

SEQ ID NO: 78436 - RNA, 22 nt, Human
uggcgagguuucagagagcggc

SEQ ID NO: 78437 - RNA, 22 nt, Human
uggcgcaguuucucugcugccu

SEQ ID NO: 78438 - RNA, 17 nt, Human
uggcgcucccagggugc

SEQ ID NO: 78439 - RNA, 22 nt, Human
uggcggcucaggaggggcaguu

SEQ ID NO: 78440 - RNA, 22 nt, Human
uggcuaaacuugggucagaugu

SEQ ID NO: 78441 - RNA, 22 nt, Human
uguaauuauguuguuagaguau

SEQ ID NO: 78442 - RNA, 22 nt, Human
uguaauugcuuguuuaccugcu

SEQ ID NO: 78443 - RNA, 22 nt, Human
uguaauuuccugauguuagaac

SEQ ID NO: 78444 - RNA, 22 nt, Human
uguaauuuuacgugacacaguu

SEQ ID NO: 78445 - RNA, 22 nt, Human
uguacaaagaguauagcuuuga

SEQ ID NO: 78446 - RNA, 22 nt, Human
uguacaaagguacuuugauguu

SEQ ID NO: 78447 - RNA, 22 nt, Human
uguacaaaguuaaaccuauaua

SEQ ID NO: 78448 - RNA, 22 nt, Human
uguacaaugccgagacuaacuc

SEQ ID NO: 78449 - RNA, 22 nt, Human
uguacacaaccuacagucugcu

SEQ ID NO: 78450 - RNA, 22 nt, Human
uguacacauaucauuuguggga

SEQ ID NO: 78451 - RNA, 22 nt, Human
uguacaccugucuuuacacaua

SEQ ID NO: 78452 - RNA, 22 nt, Human
uguacacugcaggaugcauugc

SEQ ID NO: 78453 - RNA, 23 nt, Human
uguacacuuggucaagguacuua

SEQ ID NO: 78454 - RNA, 22 nt, Human
uguacagaaauuccuacuacau

SEQ ID NO: 78455 - RNA, 22 nt, Human
uguacagaacuugcugucccuu

SEQ ID NO: 78456 - RNA, 22 nt, Human
uguacagacuuugcagugugca

SEQ ID NO: 78457 - RNA, 22 nt, Human
uguacagagacuaccauuaaua

SEQ ID NO: 78458 - RNA, 22 nt, Human
uguacaggagaacaaugagaaa

SEQ ID NO: 78459 - RNA, 22 nt, Human
uguacaguuaaucuuaagccau

SEQ ID NO: 78460 - RNA, 22 nt, Human
uguacauauucaagcacuucua

SEQ ID NO: 78461 - RNA, 22 nt, Human
uguaccaaaaaugugucagacu

SEQ ID NO: 78462 - RNA, 22 nt, Human
uguaccaggugauggagucaua

SEQ ID NO: 78463 - RNA, 22 nt, Human
uguaccauauauguuacugacu

SEQ ID NO: 78464 - RNA, 22 nt, Human
uguaccuuuuucugugcaugcu

SEQ ID NO: 78465 - RNA, 22 nt, Human
uguacuaaggcuguguagaugu

SEQ ID NO: 78466 - RNA, 22 nt, Human
uguacucagcucagaucucagg

SEQ ID NO: 78467 - RNA, 22 nt, Human
uguacuugcuuauuagaaaucu

SEQ ID NO: 78468 - RNA, 18 nt, Human
uguagaaaagauaggaau

SEQ ID NO: 78469 - RNA, 22 nt, Human
uguagaaacuacacaugcaaca

SEQ ID NO: 78470 - RNA, 22 nt, Human
uguagaaagaauauguuucaua

SEQ ID NO: 78471 - RNA, 22 nt, Human
uguagaagcuagccuggagcca

SEQ ID NO: 78472 - RNA, 22 nt, Human
uguagaaggcuauagacuagga

SEQ ID NO: 78473 - RNA, 22 nt, Human
uguagaaguucuucaggagaau

SEQ ID NO: 78474 - RNA, 22 nt, Human
uguagacuuucuuuguguuagu

SEQ ID NO: 78475 - RNA, 22 nt, Human
uguagauaaguaaaagcccagu

SEQ ID NO: 78476 - RNA, 22 nt, Human
uguagauacacacauauagugg

SEQ ID NO: 78477 - RNA, 22 nt, Human
uguagauauagaaaaagacuga

SEQ ID NO: 78478 - RNA, 22 nt, Human
uguagauauuaauuauuccuuu

SEQ ID NO: 78479 - RNA, 22 nt, Human
uguagcacagagcuuugacacu

SEQ ID NO: 78480 - RNA, 22 nt, Human
uguagcacguuaguguuagagc

SEQ ID NO: 78481 - RNA, 22 nt, Human
uguagcaguuuuucauuaucca

SEQ ID NO: 78482 - RNA, 22 nt, Human
uguagcauuuuauguaauaagu

SEQ ID NO: 78483 - RNA, 23 nt, Human
uguagcuuuauacaagaucuguu

SEQ ID NO: 78484 - RNA, 22 nt, Human
uguaggaacucacagauauucu

SEQ ID NO: 78485 - RNA, 22 nt, Human
uguaggaagauauaaaauaucu

SEQ ID NO: 78486 - RNA, 22 nt, Human
uguaggaauguuuuuaaguugg

SEQ ID NO: 78487 - RNA, 16 nt, Human
uguaggauaaccauac

SEQ ID NO: 78488 - RNA, 22 nt, Human
uguaggcaucacuuucucuugg

SEQ ID NO: 78489 - RNA, 22 nt, Human
uguaggccuauguccagcaauu

SEQ ID NO: 78490 - RNA, 20 nt, Human
uguagguguacaguaaggag

SEQ ID NO: 78491 - RNA, 22 nt, Human
uguaguaaacacuauucugauc

SEQ ID NO: 78492 - RNA, 22 nt, Human
uguaguguagcagggugggaca

SEQ ID NO: 78493 - RNA, 22 nt, Human
uguagugugacauaggugucca

SEQ ID NO: 78494 - RNA, 22 nt, Human
uguaguguggccuaucuuugcc

SEQ ID NO: 78495 - RNA, 21 nt, Human
uguauaacaacuaugcaaugu

SEQ ID NO: 78496 - RNA, 22 nt, Human
uguauaagccuagugaaauuuc

SEQ ID NO: 78497 - RNA, 23 nt, Human
uguauacacccugugcaucuggg

SEQ ID NO: 78498 - RNA, 22 nt, Human
uguauacaggauuacucauagc

SEQ ID NO: 78499 - RNA, 22 nt, Human
uguauacauuuggugcauauuu

SEQ ID NO: 78500 - RNA, 22 nt, Human
uguauagacuagcuuucacgau

SEQ ID NO: 78501 - RNA, 22 nt, Human
uguauauacacacucccauguu

SEQ ID NO: 78502 - RNA, 22 nt, Human
uguauaugugcacaugugcuuc

SEQ ID NO: 78503 - RNA, 22 nt, Human
uguauauucacugagcaagggg

SEQ ID NO: 78504 - RNA, 20 nt, Human
uguauauuuucugguguaaa

SEQ ID NO: 78505 - RNA, 22 nt, Human
uguaucaagaucagcagcuguu

SEQ ID NO: 78506 - RNA, 22 nt, Human
uguaucagaucaaauacuggcu

SEQ ID NO: 78507 - RNA, 22 nt, Human
uguauccccugcagguugcuau

SEQ ID NO: 78508 - RNA, 23 nt, Human
uguaucuguacuauuccugccuc

SEQ ID NO: 78509 - RNA, 22 nt, Human
uguaucuguuuagcacccagcc

SEQ ID NO: 78510 - RNA, 22 nt, Human
uguaugaagguuuaccugcugu

SEQ ID NO: 78511 - RNA, 22 nt, Human
uguaugaauauguuggggaggu

SEQ ID NO: 78512 - RNA, 22 nt, Human
uguaugccuuuuucuguuguaa

SEQ ID NO: 78513 - RNA, 22 nt, Human
uguaugcuuguguauaauauaa

SEQ ID NO: 78514 - RNA, 22 nt, Human
uguauggcuuggaaauaguuua

SEQ ID NO: 78515 - RNA, 22 nt, Human
uguauguauacacauagauacg

SEQ ID NO: 78516 - RNA, 22 nt, Human
uguauguugggucaaaguacau

SEQ ID NO: 78517 - RNA, 22 nt, Human
uguauuagguugaugcgaaagu

SEQ ID NO: 78518 - RNA, 22 nt, Human
uguauuaucaaguaaauacaug

SEQ ID NO: 78519 - RNA, 22 nt, Human
uguauucucucaauauuucaua

SEQ ID NO: 78520 - RNA, 22 nt, Human
uguauuuaauuguaucaucaca

SEQ ID NO: 78521 - RNA, 22 nt, Human
uguauuuauucaggauguaacu

SEQ ID NO: 78522 - RNA, 22 nt, Human
uguauuuccugguuuagaucaa

SEQ ID NO: 78523 - RNA, 18 nt, Human
uguauuucuaacagcuaa

SEQ ID NO: 78524 - RNA, 22 nt, Human
uguauuugaugagaggaggguc

SEQ ID NO: 78525 - RNA, 22 nt, Human
uguauuugggucacaagauggg

SEQ ID NO: 78526 - RNA, 17 nt, Human
uguauuuguaccacagc

SEQ ID NO: 78527 - RNA, 22 nt, Human
uguauuuucagaguggcauuuc

SEQ ID NO: 78528 - RNA, 22 nt, Human
uguauuuugaguccaaucuccu

SEQ ID NO: 78529 - RNA, 22 nt, Human
uguauuuugugaggaucacucu

SEQ ID NO: 78530 - RNA, 22 nt, Human
ugucaaaaagcugggacaagca

SEQ ID NO: 78531 - RNA, 22 nt, Human
ugucaaaaugacuuuacuacag

SEQ ID NO: 78532 - RNA, 22 nt, Human
ugucaaacaccaacauuucucc

SEQ ID NO: 78533 - RNA, 22 nt, Human
ugucaaagaugucuuugaaaau

SEQ ID NO: 78534 - RNA, 22 nt, Human
ugucaaaggguaagcuggauaa

SEQ ID NO: 78535 - RNA, 22 nt, Human
ugucaaauuauguaaugggaag

SEQ ID NO: 78536 - RNA, 22 nt, Human
ugucaacugugaugucaacacu

SEQ ID NO: 78537 - RNA, 22 nt, Human
ugucaaguuguuaaguucuggg

SEQ ID NO: 78538 - RNA, 20 nt, Human
ugucaauagcacugaggcug

SEQ ID NO: 78539 - RNA, 22 nt, Human
ugucaauauguaauaacugaau

SEQ ID NO: 78540 - RNA, 22 nt, Human
ugucaaugcuggucuugaauga

SEQ ID NO: 78541 - RNA, 22 nt, Human
ugucacaccucguuuagcauuc

SEQ ID NO: 78542 - RNA, 22 nt, Human
ugucacagggauaccauggggc

SEQ ID NO: 78543 - RNA, 22 nt, Human
ugucacaguuuguacuuuauag

SEQ ID NO: 78544 - RNA, 22 nt, Human
ugucacaucagggguguugaca

SEQ ID NO: 78545 - RNA, 22 nt, Human
ugugaggagaggcccagcuccc

SEQ ID NO: 78546 - RNA, 22 nt, Human
ugugaggauguaaccagaaguc

SEQ ID NO: 78547 - RNA, 22 nt, Human
ugugaggcgaggccagugagcu

SEQ ID NO: 78548 - RNA, 22 nt, Human
ugugaggcuaccugccaggguc

SEQ ID NO: 78549 - RNA, 22 nt, Human
ugugaggcuugaaguaauucca

SEQ ID NO: 78550 - RNA, 22 nt, Human
uguccaggcuaaagugcagugg

SEQ ID NO: 78551 - RNA, 22 nt, Human
uguccaggcucccuuggugcug

SEQ ID NO: 78552 - RNA, 22 nt, Human
uguccagggggcuuaccuggag

SEQ ID NO: 78553 - RNA, 22 nt, Human
uguccaggucagcagcagggac

SEQ ID NO: 78554 - RNA, 22 nt, Human
uguccauggggaaggggaagug

SEQ ID NO: 78555 - RNA, 22 nt, Human
uguccauugcuuauuucuacuu

SEQ ID NO: 78556 - RNA, 22 nt, Human
ugucccacugacuucacaucca

SEQ ID NO: 78557 - RNA, 22 nt, Human
ugucccagacauaaguggacau

SEQ ID NO: 78558 - RNA, 23 nt, Human
ugucccagagggagggauaggcu

SEQ ID NO: 78559 - RNA, 22 nt, Human
ugucccagaucacaggagggga

SEQ ID NO: 78560 - RNA, 22 nt, Human
ugucccagcagcuggguucucu

SEQ ID NO: 78561 - RNA, 17 nt, Human
ugucccaggcucaacgc

SEQ ID NO: 78562 - RNA, 22 nt, Human
ugucccaguuuaucugggacug

SEQ ID NO: 78563 - RNA, 22 nt, Human
ugucccauggauaccaggcuau

SEQ ID NO: 78564 - RNA, 22 nt, Human
uguccccagagccuguuccugc

SEQ ID NO: 78565 - RNA, 22 nt, Human
uguccccugcccagggauggga

SEQ ID NO: 78566 - RNA, 22 nt, Human
uguccccuuuaccuccgcagcc

SEQ ID NO: 78567 - RNA, 22 nt, Human
ugucccuaaagaaacagacauu

SEQ ID NO: 78568 - RNA, 22 nt, Human
ugucccuggacuccaggagcca

SEQ ID NO: 78569 - RNA, 19 nt, Human
ugucccuggucaccagacu

SEQ ID NO: 78570 - RNA, 20 nt, Human
uguccuaauagacaagcaga

SEQ ID NO: 78571 - RNA, 22 nt, Human
uguccuagagacaucagauguu

SEQ ID NO: 78572 - RNA, 23 nt, Human
uguccuaugcagcuaaaauuccu

SEQ ID NO: 78573 - RNA, 22 nt, Human
uguccucacacguagggaguaa

SEQ ID NO: 78574 - RNA, 19 nt, Human
uguccucacagagcauaac

SEQ ID NO: 78575 - RNA, 22 nt, Human
uguccucacaugguggggagag

SEQ ID NO: 78576 - RNA, 22 nt, Human
uguccucaucuuuuccagaaau

SEQ ID NO: 78577 - RNA, 22 nt, Human
uguccuccagcagcaugguaug

SEQ ID NO: 78578 - RNA, 22 nt, Human
uguccucuccaacagccucugu

SEQ ID NO: 78579 - RNA, 22 nt, Human
uguccucuuccagugcuccuuc

SEQ ID NO: 78580 - RNA, 22 nt, Human
uguccuggaaaaauggagaguu

SEQ ID NO: 78581 - RNA, 22 nt, Human
uguccuggaucaugccucugaa

SEQ ID NO: 78582 - RNA, 22 nt, Human
uguccuggccaaggccuugcuu

SEQ ID NO: 78583 - RNA, 22 nt, Human
uguccuggccuccagaaagucg

SEQ ID NO: 78584 - RNA, 22 nt, Human
uguccugggucccugcuagaag

SEQ ID NO: 78585 - RNA, 22 nt, Human
uguccuggguggaugcuucauu

SEQ ID NO: 78586 - RNA, 22 nt, Human
uguccuggugcuucuugggauu

SEQ ID NO: 78587 - RNA, 22 nt, Human
uguccuguaggaggcagaacaa

SEQ ID NO: 78588 - RNA, 22 nt, Human
uguccuguagguuuauuugugu

SEQ ID NO: 78589 - RNA, 22 nt, Human
uguccugucucuuuccuaauug

SEQ ID NO: 78590 - RNA, 22 nt, Human
uguccuguucauggcucuggac

SEQ ID NO: 78591 - RNA, 22 nt, Human
uguccuuauaagaaaaggaaau

SEQ ID NO: 78592 - RNA, 22 nt, Human
uguccuugaugaauaugaaauu

SEQ ID NO: 78593 - RNA, 22 nt, Human
uucauagaucucaauuuugagg

SEQ ID NO: 78594 - RNA, 22 nt, Human
uucauagcagucccuuucuggg

SEQ ID NO: 78595 - RNA, 22 nt, Human
uucauaguguuuccuuccagug

SEQ ID NO: 78596 - RNA, 22 nt, Human
uucauauaccuugcguuucaca

SEQ ID NO: 78597 - RNA, 22 nt, Human
uucauaugugaacucagugaug

SEQ ID NO: 78598 - RNA, 22 nt, Human
uucauauucaaauacucugcuu

SEQ ID NO: 78599 - RNA, 20 nt, Human
uucaucagcaaagcacagca

SEQ ID NO: 78600 - RNA, 21 nt, Human
uucaucauugguaaaaagugg

SEQ ID NO: 78601 - RNA, 22 nt, Human
uucaucugcugguuuuuggcau

SEQ ID NO: 78602 - RNA, 22 nt, Human
uucaucugcuucuugauuuugc

SEQ ID NO: 78603 - RNA, 22 nt, Human
uucaucuggaaguucccaaggc

SEQ ID NO: 78604 - RNA, 21 nt, Human
uucaucuggccguauuccagg

SEQ ID NO: 78605 - RNA, 22 nt, Human
uucaucuugauggcuuccuaau

SEQ ID NO: 78606 - RNA, 22 nt, Human
uucaugaaaaggucuauuucuu

SEQ ID NO: 78607 - RNA, 22 nt, Human
uucaugaaaguguaucuugugg

SEQ ID NO: 78608 - RNA, 22 nt, Human
uucaugaaauucucguguaccu

SEQ ID NO: 78609 - RNA, 22 nt, Human
uucaugaauguuccaugugagu

SEQ ID NO: 78610 - RNA, 23 nt, Human
uucaugaguuggacaagacuggg

SEQ ID NO: 78611 - RNA, 22 nt, Human
uucaugauaguauuuuuuguga

SEQ ID NO: 78612 - RNA, 22 nt, Human
uucaugcugugucuacaacuua

SEQ ID NO: 78613 - RNA, 22 nt, Human
uucauggaguugagaaggcuaa

SEQ ID NO: 78614 - RNA, 20 nt, Human
uucaugggagcaaagaggcc

SEQ ID NO: 78615 - RNA, 22 nt, Human
uucauguaauuccauaagguaa

SEQ ID NO: 78616 - RNA, 22 nt, Human
uucaugugaauauauuugucuu

SEQ ID NO: 78617 - RNA, 22 nt, Human
uucaugugauaaaugugugacu

SEQ ID NO: 78618 - RNA, 22 nt, Human
uucaugugccagagcugaaaau

SEQ ID NO: 78619 - RNA, 18 nt, Human
uucauguuggcuuaggga

SEQ ID NO: 78620 - RNA, 22 nt, Human
uucauguuugccuauuugacuu

SEQ ID NO: 78621 - RNA, 22 nt, Human
uucauuacugaauucucacuac

SEQ ID NO: 78622 - RNA, 22 nt, Human
uucauuagaaaaguaaaaaugc

SEQ ID NO: 78623 - RNA, 23 nt, Human
uucauucaaaaggaaaagucaug

SEQ ID NO: 78624 - RNA, 22 nt, Human
uucauucaagggguuccugauu

SEQ ID NO: 78625 - RNA, 22 nt, Human
uucauucacccaggaaacaucu

SEQ ID NO: 78626 - RNA, 20 nt, Human
uucauucacguagcuguuga

SEQ ID NO: 78627 - RNA, 22 nt, Human
uucauucagguguauuuauggg

SEQ ID NO: 78628 - RNA, 22 nt, Human
uucauucagugcauuugggaga

SEQ ID NO: 78629 - RNA, 22 nt, Human
uucauucaucucuaaaaugccu

SEQ ID NO: 78630 - RNA, 21 nt, Human
uucauucauggcauaauauag

SEQ ID NO: 78631 - RNA, 20 nt, Human
uucauucauuccacaacuuc

SEQ ID NO: 78632 - RNA, 22 nt, Human
uucauuccugagcccauauuua

SEQ ID NO: 78633 - RNA, 22 nt, Human
uucauucucuuagcauaguccu

SEQ ID NO: 78634 - RNA, 22 nt, Human
uucauucugcaguucucagcuc

SEQ ID NO: 78635 - RNA, 22 nt, Human
uucauucuucagagcugcgcuu

SEQ ID NO: 78636 - RNA, 19 nt, Human
uucauucuuucuacuuacc

SEQ ID NO: 78637 - RNA, 22 nt, Human
uucauugaaggagggacuugcu

SEQ ID NO: 78638 - RNA, 23 nt, Human
uucauugagcuguucuugaggau

SEQ ID NO: 78639 - RNA, 22 nt, Human
uucauugauaguuuuauguaug

SEQ ID NO: 78640 - RNA, 22 nt, Human
uucauugaugugguuuaaugua

SEQ ID NO: 78641 - RNA, 22 nt, Human
uucauugauuuccuuggaauaa

SEQ ID NO: 78642 - RNA, 22 nt, Human
uucauugcauuccagccugggu

SEQ ID NO: 78643 - RNA, 22 nt, Human
uucauuguagcuugacuaauua

SEQ ID NO: 78644 - RNA, 22 nt, Human
uucauugugauucuuggcuagc

SEQ ID NO: 78645 - RNA, 20 nt, Human
uucauuugggaaaaucugcg

SEQ ID NO: 78646 - RNA, 22 nt, Human
uucauuuguaacucuguuaggg

SEQ ID NO: 78647 - RNA, 23 nt, Human
uucauuugucuacuucacuuguu

SEQ ID NO: 78648 - RNA, 22 nt, Human
uucauuuguugacagagacaug

SEQ ID NO: 78649 - RNA, 22 nt, Human
uucauuuuuaccgcgugucaaa

SEQ ID NO: 78650 - RNA, 22 nt, Human
uuccaaaacaguauggcaugug

SEQ ID NO: 78651 - RNA, 19 nt, Human
uuccaaaaucaggauuuga

SEQ ID NO: 78652 - RNA, 22 nt, Human
uuccaaagaaauugaccaagac

SEQ ID NO: 78653 - RNA, 22 nt, Human
uuccaaagugcuggaauuacau

SEQ ID NO: 78654 - RNA, 22 nt, Human
uuccaaaugaguuccaucgaau

SEQ ID NO: 78655 - RNA, 22 nt, Human
uuccaaauggagaagaugaguu

SEQ ID NO: 78656 - RNA, 20 nt, Human
uuccaacucacaucucuaca

SEQ ID NO: 78657 - RNA, 22 nt, Human
uuccaacucugaaaugugaaau

SEQ ID NO: 78658 - RNA, 22 nt, Human
uuccaagagucagcugauccca

SEQ ID NO: 78659 - RNA, 22 nt, Human
uucagcaaugggauggugcagg

SEQ ID NO: 78660 - RNA, 22 nt, Human
uucagcacaguucaagauggua

SEQ ID NO: 78661 - RNA, 22 nt, Human
uucagcaccacuuccagagaag

SEQ ID NO: 78662 - RNA, 22 nt, Human
uucagcacuguuauggauuugc

SEQ ID NO: 78663 - RNA, 22 nt, Human
uucagcacuuuguuuugcucau

SEQ ID NO: 78664 - RNA, 22 nt, Human
uucagcaguuucugagaagcaa

SEQ ID NO: 78665 - RNA, 22 nt, Human
uucagcaucuacauauuuagaa

SEQ ID NO: 78666 - RNA, 22 nt, Human
uucagcauuucuguuguuggcu

SEQ ID NO: 78667 - RNA, 22 nt, Human
uucagccagucaucagucuugu

SEQ ID NO: 78668 - RNA, 22 nt, Human
uucagccuguucaugcuguugc

SEQ ID NO: 78669 - RNA, 22 nt, Human
uucagcuaaggaguuucacugu

SEQ ID NO: 78670 - RNA, 22 nt, Human
uucagcuccuuauuucugagca

SEQ ID NO: 78671 - RNA, 22 nt, Human
uucagcuccuuucuuccaccag

SEQ ID NO: 78672 - RNA, 22 nt, Human
uucagcucugcuagcucugugc

SEQ ID NO: 78673 - RNA, 21 nt, Human
uucagcuuaugugucacuugc

SEQ ID NO: 78674 - RNA, 22 nt, Human
uucagcuugcuuagucuccuuc

SEQ ID NO: 78675 - RNA, 22 nt, Human
uucaggaaauuugugucacagg

SEQ ID NO: 78676 - RNA, 22 nt, Human
uucaggaagccuuucuuggucu

SEQ ID NO: 78677 - RNA, 22 nt, Human
uucaggaauaauuaucauauga

SEQ ID NO: 78678 - RNA, 22 nt, Human
uucaggaaucaaccaagucauu

SEQ ID NO: 78679 - RNA, 21 nt, Human
uucaggacaggaaaaacaggg

SEQ ID NO: 78680 - RNA, 22 nt, Human
uucaggagcuagggaugugaaa

SEQ ID NO: 78681 - RNA, 22 nt, Human
uucaggaucacuaaacccucca

SEQ ID NO: 78682 - RNA, 22 nt, Human
uucaggauccccuugaugggcu

SEQ ID NO: 78683 - RNA, 22 nt, Human
uucaggaugaaagugugcaaca

SEQ ID NO: 78684 - RNA, 22 nt, Human
uucaggauuauacucucuuccc

SEQ ID NO: 78685 - RNA, 20 nt, Human
uucaggauucuagaccacac

SEQ ID NO: 78686 - RNA, 19 nt, Human
uucaggauugacccuacug

SEQ ID NO: 78687 - RNA, 22 nt, Human
uucaggccuaauuucuagcccc

SEQ ID NO: 78688 - RNA, 22 nt, Human
uucaggccucuaaagggaaagc

SEQ ID NO: 78689 - RNA, 22 nt, Human
uucagggcagacagaagagaug

SEQ ID NO: 78690 - RNA, 22 nt, Human
uucagggcagcuagaaccagga

SEQ ID NO: 78691 - RNA, 22 nt, Human
uucagggcccugagagggcagu

SEQ ID NO: 78692 - RNA, 22 nt, Human
uucagggcuuagggaaauagug

SEQ ID NO: 78693 - RNA, 18 nt, Human
uucaggucagaaagaugg

SEQ ID NO: 78694 - RNA, 22 nt, Human
uucaggugucaaggauaggcug

SEQ ID NO: 78695 - RNA, 22 nt, Human
uucaguaagcacuucuagagcu

SEQ ID NO: 78696 - RNA, 22 nt, Human
uucaguaaggauaauaaacaga

SEQ ID NO: 78697 - RNA, 22 nt, Human
uucaguaugauuccuccaguag

SEQ ID NO: 78698 - RNA, 22 nt, Human
uucagucccuugcuuaaauuua

SEQ ID NO: 78699 - RNA, 22 nt, Human
uucagucuccucauuuuacaaa

SEQ ID NO: 78700 - RNA, 22 nt, Human
uucagugcacaguacugagacu

SEQ ID NO: 78701 - RNA, 22 nt, Human
uucagugccgugcugggucgcu

SEQ ID NO: 78702 - RNA, 22 nt, Human
uucaguguacagugaagggauu

SEQ ID NO: 78703 - RNA, 22 nt, Human
uucaguguaucuugucagggag

SEQ ID NO: 78704 - RNA, 22 nt, Human
uucagugucaauuuuuaaauau

SEQ ID NO: 78705 - RNA, 22 nt, Human
uucagugucacaagagcaagcc

SEQ ID NO: 78706 - RNA, 22 nt, Human
uucaguguggaaugugaacugc

SEQ ID NO: 78707 - RNA, 22 nt, Human
uucagugugugauaccugcugu

SEQ ID NO: 78708 - RNA, 22 nt, Human
uucaguguuacucaaggggcag

SEQ ID NO: 78709 - RNA, 22 nt, Human
uucaguguuuguagagauaacu

SEQ ID NO: 78710 - RNA, 22 nt, Human
uucaguuggccauaccccuaga

SEQ ID NO: 78711 - RNA, 22 nt, Human
uucaguuuauaccuguugauua

SEQ ID NO: 78712 - RNA, 22 nt, Human
uucaguuucaaauccugugaag

SEQ ID NO: 78713 - RNA, 22 nt, Human
uucaguuuuauuguacugcuau

SEQ ID NO: 78714 - RNA, 22 nt, Human
uucaguuuucccuccugcaggu

SEQ ID NO: 78715 - RNA, 21 nt, Human
uucauaaaccauucucaugca

SEQ ID NO: 78716 - RNA, 23 nt, Human
uucauaacucaaggugauauaau

SEQ ID NO: 78717 - RNA, 19 nt, Human
uucauaacuuuuauauccu

SEQ ID NO: 78718 - RNA, 22 nt, Human
uucauaaggguggccauauaaa

SEQ ID NO: 78719 - RNA, 22 nt, Human
uucauaaugagguccuagaggc

SEQ ID NO: 78720 - RNA, 22 nt, Human
uucauacauuuuuacuaacagc

SEQ ID NO: 78721 - RNA, 22 nt, Human
uucauaggaaauaguguucuuu

SEQ ID NO: 78722 - RNA, 22 nt, Human
uucauagugacaugcauucugg

SEQ ID NO: 78723 - RNA, 22 nt, Human
uucauaugcagauuaacaaaua

SEQ ID NO: 78724 - RNA, 22 nt, Human
uucauauuaugauuugaaaugc

SEQ ID NO: 78725 - RNA, 22 nt, Human
uucauauugcuuccguggagug

SEQ ID NO: 78726 - RNA, 22 nt, Human
uucauauuuucugcuugcucac

SEQ ID NO: 78727 - RNA, 21 nt, Human
uucaucagccagaaaucaagc

SEQ ID NO: 78728 - RNA, 22 nt, Human
uucaucaggcaucaugcucaag

SEQ ID NO: 78729 - RNA, 22 nt, Human
uucaucaucuacaaccaggacc

SEQ ID NO: 78730 - RNA, 22 nt, Human
uucaugaaacuuaacuguuggg

SEQ ID NO: 78731 - RNA, 22 nt, Human
uucaugaauggaaucaaugcuc

SEQ ID NO: 78732 - RNA, 23 nt, Human
uucaugagauuaucugcaugugu

SEQ ID NO: 78733 - RNA, 23 nt, Human
uucaugaugauuaaucagcuaca

SEQ ID NO: 78734 - RNA, 22 nt, Human
uucaugccagcccuguguggua

SEQ ID NO: 78735 - RNA, 22 nt, Human
uucaugcuaguaugugcuguuc

SEQ ID NO: 78736 - RNA, 22 nt, Human
uucaugcuuuuaccgcuguuaa

SEQ ID NO: 78737 - RNA, 22 nt, Human
uucauggaucaugccuuuugug

SEQ ID NO: 78738 - RNA, 22 nt, Human
uucauggauguugguagaaaac

SEQ ID NO: 78739 - RNA, 22 nt, Human
uucauggcaggagucagaagcu

SEQ ID NO: 78740 - RNA, 22 nt, Human
uucauggcgcuguucucucccu

SEQ ID NO: 78741 - RNA, 22 nt, Human
uucauguagcuuagcagagagg

SEQ ID NO: 78742 - RNA, 22 nt, Human
uucauguccagaggaaguugag

SEQ ID NO: 78743 - RNA, 22 nt, Human
uucauguucauauguguauauc

SEQ ID NO: 78744 - RNA, 23 nt, Human
uucauguucccuccuucugguga

SEQ ID NO: 78745 - RNA, 22 nt, Human
uucauguuucaauuguuaaugu

SEQ ID NO: 78746 - RNA, 23 nt, Human
uuaugcuuuggcacucuuguuag

SEQ ID NO: 78747 - RNA, 22 nt, Human
uuaugcuuuuagaauuuagcau

SEQ ID NO: 78748 - RNA, 22 nt, Human
uuauggaaaacuccagagagua

SEQ ID NO: 78749 - RNA, 22 nt, Human
uuauggaagugcaaauugugug

SEQ ID NO: 78750 - RNA, 22 nt, Human
uuauggagacuuucagaagcgg

SEQ ID NO: 78751 - RNA, 22 nt, Human
uuauggagcagacagcugguca

SEQ ID NO: 78752 - RNA, 22 nt, Human
uuauggagugcuuaccugccag

SEQ ID NO: 78753 - RNA, 22 nt, Human
uuauggcauauuccucauugua

SEQ ID NO: 78754 - RNA, 22 nt, Human
uuauggcauucauuggggcuuu

SEQ ID NO: 78755 - RNA, 22 nt, Human
uuauguaaguggagucauauag

SEQ ID NO: 78756 - RNA, 22 nt, Human
uuauguacaauguuaauguaaa

SEQ ID NO: 78757 - RNA, 22 nt, Human
uuauguaccucuuucugcuuca

SEQ ID NO: 78758 - RNA, 22 nt, Human
uuauguaccugaauuaguaaag

SEQ ID NO: 78759 - RNA, 22 nt, Human
uuauguacucugcaauguuuga

SEQ ID NO: 78760 - RNA, 22 nt, Human
uuauguaggauaaugaauugcc

SEQ ID NO: 78761 - RNA, 21 nt, Human
uuaugucucuuuggugacugg

SEQ ID NO: 78762 - RNA, 22 nt, Human
uuaugucugugaauuggcaagc

SEQ ID NO: 78763 - RNA, 22 nt, Human
uuaugucuuaaguaugcuaauu

SEQ ID NO: 78764 - RNA, 22 nt, Human
uuaugugcuucaacugagccua

SEQ ID NO: 78765 - RNA, 22 nt, Human
uuauguguauaauuacaggaag

SEQ ID NO: 78766 - RNA, 22 nt, Human
uuauguguguguauacauacaa

SEQ ID NO: 78767 - RNA, 22 nt, Human
uuauguuaugaauggaugaucu

SEQ ID NO: 78768 - RNA, 21 nt, Human
uugcuguuuucccaaugcagu

SEQ ID NO: 78769 - RNA, 23 nt, Human
uugcuuagagaccuccucaucag

SEQ ID NO: 78770 - RNA, 22 nt, Human
uugcuucacugaguuaugccug

SEQ ID NO: 78771 - RNA, 22 nt, Human
uugcuucagaaguucugcuugu

SEQ ID NO: 78772 - RNA, 19 nt, Human
uugcuucaggcugugugcu

SEQ ID NO: 78773 - RNA, 22 nt, Human
uugcuucaucagaguaaacaag

SEQ ID NO: 78774 - RNA, 19 nt, Human
uugcuucaugucuuuugcu

SEQ ID NO: 78775 - RNA, 22 nt, Human
uugcuucauuuuaaauaaagac

SEQ ID NO: 78776 - RNA, 23 nt, Human
uugcuuccacuguaaguggagaa

SEQ ID NO: 78777 - RNA, 22 nt, Human
uugcuuccucugugcaauccuc

SEQ ID NO: 78778 - RNA, 22 nt, Human
uugcuuccuugagcuggucuga

SEQ ID NO: 78779 - RNA, 22 nt, Human
uugcuucuaaguauaaauauga

SEQ ID NO: 78780 - RNA, 23 nt, Human
uugcuucugugcaauucaguacu

SEQ ID NO: 78781 - RNA, 22 nt, Human
uugcuuggcccauugcuucagu

SEQ ID NO: 78782 - RNA, 22 nt, Human
uugcuuuaaaauggcuaagucu

SEQ ID NO: 78783 - RNA, 22 nt, Human
uugcuuuacuuugccauucguu

SEQ ID NO: 78784 - RNA, 22 nt, Human
uugcuuuagggcaaauauuuca

SEQ ID NO: 78785 - RNA, 22 nt, Human
uucugaaagucuuuuuaaguua

SEQ ID NO: 78786 - RNA, 22 nt, Human
uucugaaaugagauauaaggua

SEQ ID NO: 78787 - RNA, 22 nt, Human
uucugaauucaugagauuuggg

SEQ ID NO: 78788 - RNA, 22 nt, Human
uucugacacauuacuacaugga

SEQ ID NO: 78789 - RNA, 22 nt, Human
uucugacagcaaaacucagccu

SEQ ID NO: 78790 - RNA, 22 nt, Human
uucugacaguaaucaguuugcu

SEQ ID NO: 78791 - RNA, 22 nt, Human
uucugagaagggugggucuggc

SEQ ID NO: 78792 - RNA, 21 nt, Human
uucugagacucauuugaacuc

SEQ ID NO: 78793 - RNA, 22 nt, Human
uucugagauacaaaauuuacuu

SEQ ID NO: 78794 - RNA, 22 nt, Human
uucugagaugugaaucugucaa

SEQ ID NO: 78795 - RNA, 22 nt, Human
uucugagcuacauaguacuggg

SEQ ID NO: 78796 - RNA, 22 nt, Human
uucugaggcauagaggaugaga

SEQ ID NO: 78797 - RNA, 22 nt, Human
uucugagggagguucucuggga

SEQ ID NO: 78798 - RNA, 22 nt, Human
uucugauaauaccacaucgcag

SEQ ID NO: 78799 - RNA, 22 nt, Human
uucugaugauggcggcuggagc

SEQ ID NO: 78800 - RNA, 22 nt, Human
uucugcacaaauuuuagguuau

SEQ ID NO: 78801 - RNA, 22 nt, Human
uucugcacauuuuagcaaagua

SEQ ID NO: 78802 - RNA, 22 nt, Human
uucugcaggagcccuaguguau

SEQ ID NO: 78803 - RNA, 22 nt, Human
uucugcauacacugaauguagu

SEQ ID NO: 78804 - RNA, 22 nt, Human
uucugcauguguuucaaauacu

SEQ ID NO: 78805 - RNA, 23 nt, Human
uucugcauguuucagagcuggga

SEQ ID NO: 78806 - RNA, 22 nt, Human
uucugccagugaaaauaaugau

SEQ ID NO: 78807 - RNA, 22 nt, Human
uucugccauugccaugagggcu

SEQ ID NO: 78808 - RNA, 22 nt, Human
uucugccugccccagagaggcc

SEQ ID NO: 78809 - RNA, 22 nt, Human
uucugccuuacgauauuuucaa

SEQ ID NO: 78810 - RNA, 21 nt, Human
uucugccuuccccuagcuggg

SEQ ID NO: 78811 - RNA, 21 nt, Human
uucugccuucgaggucucagg

SEQ ID NO: 78812 - RNA, 22 nt, Human
uucugcuaccuuucuguaccuu

SEQ ID NO: 78813 - RNA, 22 nt, Human
uucugcucuaauguacaccagc

SEQ ID NO: 78814 - RNA, 22 nt, Human
uucugcucuuggcuuugcuggu

SEQ ID NO: 78815 - RNA, 22 nt, Human
uucugcugagugggcaggugca

SEQ ID NO: 78816 - RNA, 22 nt, Human
uucugcugcgacccaggaguua

SEQ ID NO: 78817 - RNA, 22 nt, Human
uucugcugguaacuauguuuca

SEQ ID NO: 78818 - RNA, 22 nt, Human
uucugcuguugugacguuaguu

SEQ ID NO: 78819 - RNA, 22 nt, Human
uucugcuuuucucugucugagu

SEQ ID NO: 78820 - RNA, 20 nt, Human
uucugcuuuugcuuagggac

SEQ ID NO: 78821 - RNA, 22 nt, Human
uucuggaaagaaggcuaagguc

SEQ ID NO: 78822 - RNA, 22 nt, Human
uucuggaaccaacaugccaguu

SEQ ID NO: 78823 - RNA, 22 nt, Human
uucuggaagaguaaaauaagcc

SEQ ID NO: 78824 - RNA, 22 nt, Human
uucuggaagccaugggaacagg

SEQ ID NO: 78825 - RNA, 22 nt, Human
uucuggaagccccagagucaga

SEQ ID NO: 78826 - RNA, 22 nt, Human
uucuggaaguuuucuccugugg

SEQ ID NO: 78827 - RNA, 22 nt, Human
uucuggaaugccuguucuaauu

SEQ ID NO: 78828 - RNA, 22 nt, Human
uucuggacacgugacucucauu

SEQ ID NO: 78829 - RNA, 22 nt, Human
uucuggagaggaacagaaaggu

SEQ ID NO: 78830 - RNA, 22 nt, Human
uucuggaggccagcugccaccu

SEQ ID NO: 78831 - RNA, 22 nt, Human
uucuggaguauuccuggcagcc

SEQ ID NO: 78832 - RNA, 22 nt, Human
uucuggauauaacauucagucc

SEQ ID NO: 78833 - RNA, 22 nt, Human
uucuggauauggauuuugguga

SEQ ID NO: 78834 - RNA, 22 nt, Human
uucuggaugcuguuaagaugua

SEQ ID NO: 78835 - RNA, 22 nt, Human
uucuggauguuguagucugaga

SEQ ID NO: 78836 - RNA, 22 nt, Human
uucuggcucgauucucugaccg

SEQ ID NO: 78837 - RNA, 22 nt, Human
uucuggcugaaaguuuauuuga

SEQ ID NO: 78838 - RNA, 22 nt, Human
uucuggcuuauccuaacucuaa

SEQ ID NO: 78839 - RNA, 21 nt, Human
uucugggaaaugagcuggggc

SEQ ID NO: 78840 - RNA, 22 nt, Human
uucugggaggccuuugugucug

SEQ ID NO: 78841 - RNA, 22 nt, Human
uucugggcagagcuggagcugc

SEQ ID NO: 78842 - RNA, 19 nt, Human
uucugggcauucauauuua

SEQ ID NO: 78843 - RNA, 22 nt, Human
uucugggccaaucucuuaaucu

SEQ ID NO: 78844 - RNA, 22 nt, Human
uucugggcucacagagcagcag

SEQ ID NO: 78845 - RNA, 22 nt, Human
uucugggcuguccagaggguga

SEQ ID NO: 78846 - RNA, 22 nt, Human
uucugggggccaggacaguggu

SEQ ID NO: 78847 - RNA, 22 nt, Human
uucugggguuaugggugauucu

SEQ ID NO: 78848 - RNA, 22 nt, Human
uucuggguaguaugguuaguuu

SEQ ID NO: 78849 - RNA, 22 nt, Human
uucugggucacccuucugcuca

SEQ ID NO: 78850 - RNA, 22 nt, Human
uucugggugacucacgcucccc

SEQ ID NO: 78851 - RNA, 22 nt, Human
uucugggugccaccuaagacau

SEQ ID NO: 78852 - RNA, 18 nt, Human
uucuggguguuauguuua

SEQ ID NO: 78853 - RNA, 22 nt, Human
uucugguucucaggaaugcuaa

SEQ ID NO: 78854 - RNA, 22 nt, Human
uucugguuuaagaaagugcugg

SEQ ID NO: 78855 - RNA, 22 nt, Human
uucuguacccaacauuuuuacu

SEQ ID NO: 78856 - RNA, 21 nt, Human
uucuguagcuguuagcuuuuc

SEQ ID NO: 78857 - RNA, 22 nt, Human
uucuguaggcauggaacaggga

SEQ ID NO: 78858 - RNA, 22 nt, Human
uucuguauauuguaaagacuca

SEQ ID NO: 78859 - RNA, 22 nt, Human
uucuguaucucuguguuucuug

SEQ ID NO: 78860 - RNA, 22 nt, Human
uucuguauguacauauguguau

SEQ ID NO: 78861 - RNA, 22 nt, Human
uucuguauguaugccagagcau

SEQ ID NO: 78862 - RNA, 22 nt, Human
uucugucaaauuugccauaugg

SEQ ID NO: 78863 - RNA, 22 nt, Human
uucugucagaagcuagcuccug

SEQ ID NO: 78864 - RNA, 22 nt, Human
uucugucagcgucagaaauucu

SEQ ID NO: 78865 - RNA, 22 nt, Human
uucugucagcugcuuugucuca

SEQ ID NO: 78866 - RNA, 22 nt, Human
uucugucaugcucauguaauug

SEQ ID NO: 78867 - RNA, 22 nt, Human
uucugucuucccacugaggagc

SEQ ID NO: 78868 - RNA, 22 nt, Human
uucugugaaacuaaagagagga

SEQ ID NO: 78869 - RNA, 17 nt, Human
uucugugcuuccuggcu

SEQ ID NO: 78870 - RNA, 22 nt, Human
uucuguggaauaugaacuagca

SEQ ID NO: 78871 - RNA, 22 nt, Human
uucuguggagguuuggaacauu

SEQ ID NO: 78872 - RNA, 22 nt, Human
uucuguggcaguuugggaggug

SEQ ID NO: 78873 - RNA, 19 nt, Human
uucuguguuaauuccuuua

SEQ ID NO: 78874 - RNA, 22 nt, Human
uucuguguugugacauucuaga

SEQ ID NO: 78875 - RNA, 22 nt, Human
uucuguuacaagugaaaaaaug

SEQ ID NO: 78876 - RNA, 22 nt, Human
uucuguuacauggggcacagug

SEQ ID NO: 78877 - RNA, 22 nt, Human
uuguauucuguuacagcaacau

SEQ ID NO: 78878 - RNA, 22 nt, Human
uuguauuuuguuaugcuacugc

SEQ ID NO: 78879 - RNA, 22 nt, Human
uugucaaauccuugucaucugc

SEQ ID NO: 78880 - RNA, 22 nt, Human
uugucaagaaaaauggaugaag

SEQ ID NO: 78881 - RNA, 20 nt, Human
uugucacagcuuuccaucag

SEQ ID NO: 78882 - RNA, 22 nt, Human
uugucaccauauuucauuuuga

SEQ ID NO: 78883 - RNA, 22 nt, Human
uugucaccccuagaggaauucu

SEQ ID NO: 78884 - RNA, 22 nt, Human
uugucacuagugaagaaucagg

SEQ ID NO: 78885 - RNA, 22 nt, Human
uugucaggaacuaugauuaugc

SEQ ID NO: 78886 - RNA, 22 nt, Human
uugucaucauguuuuccaaagg

SEQ ID NO: 78887 - RNA, 22 nt, Human
uuguccagcagcucagucuacg

SEQ ID NO: 78888 - RNA, 22 nt, Human
uuguccagcgaccaggcucugu

SEQ ID NO: 78889 - RNA, 22 nt, Human
uugucccauugcgaaugugagu

SEQ ID NO: 78890 - RNA, 22 nt, Human
uuguccugagauaaggaacaga

SEQ ID NO: 78891 - RNA, 22 nt, Human
uuguccugauuuauaaaaugaa

SEQ ID NO: 78892 - RNA, 16 nt, Human
uuguccugucucacug

SEQ ID NO: 78893 - RNA, 22 nt, Human
uuguccugugucuguuuggauu

SEQ ID NO: 78894 - RNA, 22 nt, Human
uuguccuguuacuuguuuggau

SEQ ID NO: 78895 - RNA, 22 nt, Human
uuguccuguuuagggauaagga

SEQ ID NO: 78896 - RNA, 23 nt, Human
uuguccuucugaaauauaucugg

SEQ ID NO: 78897 - RNA, 22 nt, Human
uuguccuugugauaguuugcug

SEQ ID NO: 78898 - RNA, 22 nt, Human
uugucucuaagugugaucuuca

SEQ ID NO: 78899 - RNA, 22 nt, Human
uugucucugggacaugguauua

SEQ ID NO: 78900 - RNA, 22 nt, Human
uugucugaaagaucauuacauu

SEQ ID NO: 78901 - RNA, 22 nt, Human
uugucugaagucacacagaugc

SEQ ID NO: 78902 - RNA, 22 nt, Human
uugucugauguucccucaugau

SEQ ID NO: 78903 - RNA, 22 nt, Human
uugucuggucaaaucacuugua

SEQ ID NO: 78904 - RNA, 22 nt, Human
uuucucucuuaaggaguuuaaa

SEQ ID NO: 78905 - RNA, 22 nt, Human
uuucucugaguuguuacaaaac

SEQ ID NO: 78906 - RNA, 22 nt, Human
uuucucugccaguuauuuuccu

SEQ ID NO: 78907 - RNA, 22 nt, Human
uuucucugugggcuuuaugcau

SEQ ID NO: 78908 - RNA, 22 nt, Human
uuucucuucacugugugccuca

SEQ ID NO: 78909 - RNA, 22 nt, Human
uuucucuuucaaucugcaguac

SEQ ID NO: 78910 - RNA, 22 nt, Human
uuucugaaaugcuggcuuugga

SEQ ID NO: 78911 - RNA, 22 nt, Human
uuucugaacaaagccauuauca

SEQ ID NO: 78912 - RNA, 22 nt, Human
uuucugaacuugguacuggagc

SEQ ID NO: 78913 - RNA, 21 nt, Human
uuucugaaggcaacaucuauc

SEQ ID NO: 78914 - RNA, 22 nt, Human
uuucugaagguuaaggaauuag

SEQ ID NO: 78915 - RNA, 22 nt, Human
uuucugauaauuuugugaaauc

SEQ ID NO: 78916 - RNA, 23 nt, Human
uuucugaugagggaugugguaug

SEQ ID NO: 78917 - RNA, 22 nt, Human
uuucugauuugacuugaaguau

SEQ ID NO: 78918 - RNA, 22 nt, Human
uuucugcaaguguagauaccca

SEQ ID NO: 78919 - RNA, 22 nt, Human
uuucugcagcagacucagugug

SEQ ID NO: 78920 - RNA, 19 nt, Human
uuucugcagcucagagaag

SEQ ID NO: 78921 - RNA, 22 nt, Human
uuucugcauuguccucuugguu

SEQ ID NO: 78922 - RNA, 22 nt, Human
uuucuggaacaguaauugaaga

SEQ ID NO: 78923 - RNA, 22 nt, Human
uuucuggacccuucugugagug

SEQ ID NO: 78924 - RNA, 22 nt, Human
uuucuggaggcccaagggcaga

SEQ ID NO: 78925 - RNA, 21 nt, Human
uuucuggguggcugcauagug

SEQ ID NO: 78926 - RNA, 22 nt, Human
uuucuggguuuaugucacagcu

SEQ ID NO: 78927 - RNA, 22 nt, Human
uuucuguaauuggccaagucac

SEQ ID NO: 78928 - RNA, 22 nt, Human
uuucugucauaguuaucuuugu

SEQ ID NO: 78929 - RNA, 19 nt, Human
uuucugucuguguuuugcc

SEQ ID NO: 78930 - RNA, 22 nt, Human
uuucuguggauuuuccauucaa

SEQ ID NO: 78931 - RNA, 19 nt, Human
uuucuguuagaaggauaca

SEQ ID NO: 78932 - RNA, 22 nt, Human
uuucuguuguauggcuucugca

SEQ ID NO: 78933 - RNA, 21 nt, Human
uuucuuaggcucuaaaaugac

SEQ ID NO: 78934 - RNA, 22 nt, Human
uuucuuaugggguaguccuuua

SEQ ID NO: 78935 - RNA, 22 nt, Human
uuucuucacaggguauugggug

SEQ ID NO: 78936 - RNA, 22 nt, Human
uuucuucagagagagcuuuccc

SEQ ID NO: 78937 - RNA, 22 nt, Human
uuucuucagccacuccaaacug

SEQ ID NO: 78938 - RNA, 22 nt, Human
uuucuucauucaccuucacccc

SEQ ID NO: 78939 - RNA, 22 nt, Human
uuucuucauugacaaggaaaaa

SEQ ID NO: 78940 - RNA, 22 nt, Human
uuucuucauugaugucaggugg

SEQ ID NO: 78941 - RNA, 22 nt, Human
uuucuuccccaagugaauuuua

SEQ ID NO: 78942 - RNA, 22 nt, Human
uuucuuccuuaccuuacuagag

SEQ ID NO: 78943 - RNA, 22 nt, Human
uuucuucucgacaccuuauccc

SEQ ID NO: 78944 - RNA, 22 nt, Human
uuucuuguacacuggaauuuau

SEQ ID NO: 78945 - RNA, 20 nt, Human
uuucuuguacuuggagaagg

SEQ ID NO: 78946 - RNA, 22 nt, Human
uuucuugucuuuaguaucuggc

SEQ ID NO: 78947 - RNA, 22 nt, Human
uuucuuguuucauggugucuca

SEQ ID NO: 78948 - RNA, 22 nt, Human
uuucuuucucguaaacuuaguu

SEQ ID NO: 78949 - RNA, 22 nt, Human
uuucuuugagucucaguuugcu

SEQ ID NO: 78950 - RNA, 22 nt, Human
uuucuuuugcugagaggggcac

SEQ ID NO: 78951 - RNA, 22 nt, Human
uuugaaagaaaccagugaguga

SEQ ID NO: 78952 - RNA, 22 nt, Human
uuugaaagagcugauacaugaa

SEQ ID NO: 78953 - RNA, 21 nt, Human
uuugaaagcccuauguuuuca

SEQ ID NO: 78954 - RNA, 22 nt, Human
uuugaaagccuggcuuuucucu

SEQ ID NO: 78955 - RNA, 22 nt, Human
uuugaaaggaaguuaauacuuu

SEQ ID NO: 78956 - RNA, 22 nt, Human
uuugaaaguccuaggagagucc

SEQ ID NO: 78957 - RNA, 22 nt, Human
uuugaaauaugugaugagagag

SEQ ID NO: 78958 - RNA, 22 nt, Human
uuugaacagggaauguuccaca

SEQ ID NO: 78959 - RNA, 22 nt, Human
uuugaacaucacuguaggguga

SEQ ID NO: 78960 - RNA, 22 nt, Human
uuugaacuucuccauucugaug

SEQ ID NO: 78961 - RNA, 22 nt, Human
uuugaagaagcugaccuauuuu

SEQ ID NO: 78962 - RNA, 22 nt, Human
uuugaagcaccaaaggagaaaa

SEQ ID NO: 78963 - RNA, 18 nt, Human
uuugaaggauggccugga

SEQ ID NO: 78964 - RNA, 22 nt, Human
uuugaagggcacgacaauaguu

SEQ ID NO: 78965 - RNA, 22 nt, Human
uuugaaguguaugaaaauacag

SEQ ID NO: 78966 - RNA, 22 nt, Human
uuugaauaaacgguuaauguuc

SEQ ID NO: 78967 - RNA, 19 nt, Human
uuugaauccagcugguaac

SEQ ID NO: 78968 - RNA, 22 nt, Human
uuugaaugcaggacauacagaa

SEQ ID NO: 78969 - RNA, 22 nt, Human
uuugaauggacugagaaucuug

SEQ ID NO: 78970 - RNA, 22 nt, Human
uuugaauguuuuagguacuuaa

SEQ ID NO: 78971 - RNA, 22 nt, Human
uuugacaagagcaaauguucuu

SEQ ID NO: 78972 - RNA, 22 nt, Human
uuugacaauaauugcauuuaua

SEQ ID NO: 78973 - RNA, 22 nt, Human
uuugacagagcucuuagucucu

SEQ ID NO: 78974 - RNA, 22 nt, Human
uuugacagaguugugaggauuu

SEQ ID NO: 78975 - RNA, 22 nt, Human
uuugacagcagauaaaauaaaa

SEQ ID NO: 78976 - RNA, 22 nt, Human
uuugacaguaauaaagcacaag

SEQ ID NO: 78977 - RNA, 22 nt, Human
uuugacaugugcuuauaacuuu

SEQ ID NO: 78978 - RNA, 22 nt, Human
uuugacccuguuauucucccug

SEQ ID NO: 78979 - RNA, 22 nt, Human
uuugacucaguggacguacuag

SEQ ID NO: 78980 - RNA, 22 nt, Human
uuugacucauugauuuucucug

SEQ ID NO: 78981 - RNA, 22 nt, Human
uuugacucugggugcuuuuucg

SEQ ID NO: 78982 - RNA, 22 nt, Human
uuugacucuuaaguggcucaau

SEQ ID NO: 78983 - RNA, 22 nt, Human
uuugacuucugggcauuuuggu

SEQ ID NO: 78984 - RNA, 22 nt, Human
uuugagaaaaagugaugaugau

SEQ ID NO: 78985 - RNA, 22 nt, Human
uuugagaaaugggcucugugcu

SEQ ID NO: 78986 - RNA, 19 nt, Human
ccccuuagggguuaagccu

SEQ ID NO: 78987 - RNA, 22 nt, Human
ccccuuccaggaagcagaaucg

SEQ ID NO: 78988 - RNA, 22 nt, Human
ccccuucuguguccugucagcc

SEQ ID NO: 78989 - RNA, 19 nt, Human
ccccuuguguaacuagccu

SEQ ID NO: 78990 - RNA, 21 nt, Human
cccgcacagcgguaggccgcc

SEQ ID NO: 78991 - RNA, 22 nt, Human
cccgcaggggcagcccucaucc

SEQ ID NO: 78992 - RNA, 21 nt, Human
cccgcaucuuccucuccagca

SEQ ID NO: 78993 - RNA, 22 nt, Human
cccgcuccuuaccuguccaacc

SEQ ID NO: 78994 - RNA, 17 nt, Human
cccguucucuucgcugg

SEQ ID NO: 78995 - RNA, 22 nt, Human
cccguuugccucuuuauuuacu

SEQ ID NO: 78996 - RNA, 21 nt, Human
cccuaacucuaaaggauccau

SEQ ID NO: 78997 - RNA, 22 nt, Human
cccuaagaagcaaagugauacc

SEQ ID NO: 78998 - RNA, 22 nt, Human
cccuaaggcagcccagucugug

SEQ ID NO: 78999 - RNA, 22 nt, Human
cccuagaaaugaaagcauacgu

SEQ ID NO: 79000 - RNA, 22 nt, Human
cccuagaacacgcagacacuga

SEQ ID NO: 79001 - RNA, 19 nt, Human
cccuagaguaagacugcau

SEQ ID NO: 79002 - RNA, 22 nt, Human
cccuaggggcaaugauggugcu

SEQ ID NO: 79003 - RNA, 22 nt, Human
cccucaccaggcuccaggcaug

SEQ ID NO: 79004 - RNA, 22 nt, Human
cccucacucugccuccuggggu

SEQ ID NO: 79005 - RNA, 22 nt, Human
cccucagagccugaagcaagca

SEQ ID NO: 79006 - RNA, 19 nt, Human
cccucauucacuuauucuc

SEQ ID NO: 79007 - RNA, 22 nt, Human
cccuccaccaagcagggcgcca

SEQ ID NO: 79008 - RNA, 22 nt, Human
cccuccagagccuggacauucu

SEQ ID NO: 79009 - RNA, 20 nt, Human
cccuccagcaaccaggacuu

SEQ ID NO: 79010 - RNA, 22 nt, Human
cccuccagccauggacccaggu

SEQ ID NO: 79011 - RNA, 22 nt, Human
cccuccccacaaagcuucacac

SEQ ID NO: 79012 - RNA, 22 nt, Human
cccuccccagggucauauugaa

SEQ ID NO: 79013 - RNA, 22 nt, Human
cccucccuuugucuuuaugaac

SEQ ID NO: 79014 - RNA, 22 nt, Human
cccucgagguuuucugagguac

SEQ ID NO: 79015 - RNA, 22 nt, Human
cccucucucaggcugacagccu

SEQ ID NO: 79016 - RNA, 22 nt, Human
cccucucuuagaagaaacacag

SEQ ID NO: 79017 - RNA, 22 nt, Human
cccucugacugggccaguucug

SEQ ID NO: 79018 - RNA, 22 nt, Human
cccucugccugcgcccuggugu

SEQ ID NO: 79019 - RNA, 19 nt, Human
cccucuugcacaaagcaaa

SEQ ID NO: 79020 - RNA, 22 nt, Human
gaaggcuuagaaacaagggagc

SEQ ID NO: 79021 - RNA, 22 nt, Human
gaaggcuuauuuucuuuguaaa

SEQ ID NO: 79022 - RNA, 22 nt, Human
gaaggcuucaaaagguguaauu

SEQ ID NO: 79023 - RNA, 21 nt, Human
gaaggcuucugccuggaggag

SEQ ID NO: 79024 - RNA, 22 nt, Human
gaaggcuugcaagugguucaua

SEQ ID NO: 79025 - RNA, 22 nt, Human
gaaggcuugcagcucuguggca

SEQ ID NO: 79026 - RNA, 22 nt, Human
gaaggcuuuagagagauauaaa

SEQ ID NO: 79027 - RNA, 22 nt, Human
gaaggcuuuuuggguaauugua

SEQ ID NO: 79028 - RNA, 22 nt, Human
gaagggaaauucagaucuucag

SEQ ID NO: 79029 - RNA, 22 nt, Human
gaagggcucaucagguggccgc

SEQ ID NO: 79030 - RNA, 18 nt, Human
gaagggcuuugaaguaga

SEQ ID NO: 79031 - RNA, 22 nt, Human
gaagggugcauggagggaaguc

SEQ ID NO: 79032 - RNA, 22 nt, Human
gaagggugugauuugccugaga

SEQ ID NO: 79033 - RNA, 22 nt, Human
gaaggugucuggcccagagucu

SEQ ID NO: 79034 - RNA, 22 nt, Human
gaagguuuacugaagauuuaaa

SEQ ID NO: 79035 - RNA, 17 nt, Human
gaagguuucucuuaggu

SEQ ID NO: 79036 - RNA, 22 nt, Human
gaaguacaaaggacauggaaac

SEQ ID NO: 79037 - RNA, 22 nt, Human
gaaguauagcagauguuauuua

SEQ ID NO: 79038 - RNA, 22 nt, Human
gaaguauaggagacaaacaaga

SEQ ID NO: 79039 - RNA, 22 nt, Human
gaaguauuucugaguugcccag

SEQ ID NO: 79040 - RNA, 22 nt, Human
gaagucagucaucuccugucuc

SEQ ID NO: 79041 - RNA, 22 nt, Human
gaagucaugcucccaucuugcu

SEQ ID NO: 79042 - RNA, 22 nt, Human
gaaguccagaauacugcucuga

SEQ ID NO: 79043 - RNA, 22 nt, Human
gaaguccgggaggaucauguuc

SEQ ID NO: 79044 - RNA, 20 nt, Human
gaaguccuuucacucuuccc

SEQ ID NO: 79045 - RNA, 22 nt, Human
gaagucuucaucugaugcucug

SEQ ID NO: 79046 - RNA, 22 nt, Human
gaagugggcuuuguggucagcu

SEQ ID NO: 79047 - RNA, 22 nt, Human
gaagugucuccguuuuuaaagg

SEQ ID NO: 79048 - RNA, 22 nt, Human
gaaguguuuuaguucuucaggu

SEQ ID NO: 79049 - RNA, 22 nt, Human
gaaguuaguguaaugcagggug

SEQ ID NO: 79050 - RNA, 22 nt, Human
gaaguuaucaggauuaaaguug

SEQ ID NO: 79051 - RNA, 22 nt, Human
gaaguuaugaaauuuggacagc

SEQ ID NO: 79052 - RNA, 22 nt, Human
gaaguuauuuccugguguugga

SEQ ID NO: 79053 - RNA, 22 nt, Human
gaaguucacauagcuggcaggu

SEQ ID NO: 79054 - RNA, 21 nt, Human
gaaguucaugaucuuucugcu

SEQ ID NO: 79055 - RNA, 22 nt, Human
gaaguucucuugggggccugag

SEQ ID NO: 79056 - RNA, 22 nt, Human
gaaguucugguguaugugauaa

SEQ ID NO: 79057 - RNA, 22 nt, Human
gaaguucuuuauagcaguguga

SEQ ID NO: 79058 - RNA, 22 nt, Human
gaaguuuagaagugacagguuu

SEQ ID NO: 79059 - RNA, 22 nt, Human
gaaguuuagaguuuggaguccu

SEQ ID NO: 79060 - RNA, 22 nt, Human
gaaguuuauuuuacacauccau

SEQ ID NO: 79061 - RNA, 22 nt, Human
gaauaaacuccucagcuuccuu

SEQ ID NO: 79062 - RNA, 22 nt, Human
gaauaacagcaaguuugcaggc

SEQ ID NO: 79063 - RNA, 17 nt, Human
gaauaaguggauggcac

SEQ ID NO: 79064 - RNA, 22 nt, Human
gaauaauauugacuuugcaggc

SEQ ID NO: 79065 - RNA, 22 nt, Human
gaauaaucauaucgucucacau

SEQ ID NO: 79066 - RNA, 22 nt, Human
gaauaaucaugaaauucaguga

SEQ ID NO: 79067 - RNA, 22 nt, Human
gaauaauugugaugcuugaagu

SEQ ID NO: 79068 - RNA, 22 nt, Human
gaauacaaacuuaaggcuuuac

SEQ ID NO: 79069 - RNA, 22 nt, Human
gaauacaaagcagaacucauac

SEQ ID NO: 79070 - RNA, 22 nt, Human
gaauacaagccugccaccugga

SEQ ID NO: 79071 - RNA, 22 nt, Human
gaauacacgaaggcaagagucc

SEQ ID NO: 79072 - RNA, 22 nt, Human
gaauacacgaauagagcauggu

SEQ ID NO: 79073 - RNA, 22 nt, Human
gaauacauccagagcagggcug

SEQ ID NO: 79074 - RNA, 22 nt, Human
gaauacauuugccgugguucuc

SEQ ID NO: 79075 - RNA, 22 nt, Human
gaauagaugaaagugucucuua

SEQ ID NO: 79076 - RNA, 22 nt, Human
gaauagcuuagauuccuuagug

SEQ ID NO: 79077 - RNA, 22 nt, Human
gaauagcuugacaauuauuuuu

SEQ ID NO: 79078 - RNA, 21 nt, Human
gaauaguucuguggcagcagu

SEQ ID NO: 79079 - RNA, 22 nt, Human
gaauauauuauucagcuuuuca

SEQ ID NO: 79080 - RNA, 22 nt, Human
gaauaucugucugguugaggaa

SEQ ID NO: 79081 - RNA, 22 nt, Human
gaauaucuuguacaucuaagua

SEQ ID NO: 79082 - RNA, 22 nt, Human
gaauaugaacuauuccuagccc

SEQ ID NO: 79083 - RNA, 22 nt, Human
gaauauuuucaguacagauggu

SEQ ID NO: 79084 - RNA, 22 nt, Human
gaaucaaaucaaguucuuuuga

SEQ ID NO: 79085 - RNA, 22 nt, Human
gaaucauuggaaccacauccaa

SEQ ID NO: 79086 - RNA, 22 nt, Human
gaauccgggaggcaaaaguugc

SEQ ID NO: 79087 - RNA, 22 nt, Human
gaaucucaaauuaagaauuuua

SEQ ID NO: 79088 - RNA, 22 nt, Human
gaaucucaaggcuugugaggau

SEQ ID NO: 79089 - RNA, 22 nt, Human
gaaucucaggaagaucucugca

SEQ ID NO: 79090 - RNA, 22 nt, Human
gaaucuuaaaucggaaucuuaa

SEQ ID NO: 79091 - RNA, 22 nt, Human
gaaucuuauccccaguccuuaa

SEQ ID NO: 79092 - RNA, 22 nt, Human
gaaucuuauuuuuaaaucuucc

SEQ ID NO: 79093 - RNA, 22 nt, Human
gaaucuuuuuucuugccaggca

SEQ ID NO: 79094 - RNA, 22 nt, Human
gaaugaaaaccuuggcucaaau

SEQ ID NO: 79095 - RNA, 22 nt, Human
ccugcagagggacuggcaggaa

SEQ ID NO: 79096 - RNA, 22 nt, Human
ccugcagaugugggacagcugu

SEQ ID NO: 79097 - RNA, 22 nt, Human
ccugcagcagcugaaaucacag

SEQ ID NO: 79098 - RNA, 22 nt, Human
ccugcagccguccuguuugucu

SEQ ID NO: 79099 - RNA, 22 nt, Human
ccugcagcuguaggagaaggcg

SEQ ID NO: 79100 - RNA, 19 nt, Human
ccugcagggaugagagguu

SEQ ID NO: 79101 - RNA, 22 nt, Human
ccugccacuguaggugacaguu

SEQ ID NO: 79102 - RNA, 22 nt, Human
ccugccagaaaagagggaguuc

SEQ ID NO: 79103 - RNA, 22 nt, Human
ccugccagacgcaccagggggc

SEQ ID NO: 79104 - RNA, 22 nt, Human
ccugccaggacauugcuugaag

SEQ ID NO: 79105 - RNA, 22 nt, Human
ccugccaggcgagucuaggcca

SEQ ID NO: 79106 - RNA, 22 nt, Human
ccugccagugaagcugacgggc

SEQ ID NO: 79107 - RNA, 22 nt, Human
ccugccagugccucccacuggu

SEQ ID NO: 79108 - RNA, 22 nt, Human
ccugccaugccagcaugcccgu

SEQ ID NO: 79109 - RNA, 22 nt, Human
ccugcccacugcccggucagcc

SEQ ID NO: 79110 - RNA, 22 nt, Human
ccugcccagcuucaccucaggc

SEQ ID NO: 79111 - RNA, 22 nt, Human
ccugcccaggcccuaaguuagg

SEQ ID NO: 79112 - RNA, 22 nt, Human
ccugcccaucccguccuuggcc

SEQ ID NO: 79113 - RNA, 22 nt, Human
ccugcccuguguuuggggacua

SEQ ID NO: 79114 - RNA, 22 nt, Human
ccugccucaucaacuugucgug

SEQ ID NO: 79115 - RNA, 22 nt, Human
ccugccugaaggucagccaccc

SEQ ID NO: 79116 - RNA, 22 nt, Human
ccugccugcguccucugagggc

SEQ ID NO: 79117 - RNA, 22 nt, Human
ccugccuggcccaccuugccac

SEQ ID NO: 79118 - RNA, 22 nt, Human
ccugccuggggacaaaggaggg

SEQ ID NO: 79119 - RNA, 22 nt, Human
ccugccuggguucaaaucccag

SEQ ID NO: 79120 - RNA, 22 nt, Human
ccugccugucaucgccugcgcc

SEQ ID NO: 79121 - RNA, 22 nt, Human
ccugccuuccagccuugggcuc

SEQ ID NO: 79122 - RNA, 22 nt, Human
ccugcgggcugguaagaggcuu

SEQ ID NO: 79123 - RNA, 22 nt, Human
ccugcgucgugugggcagugac

SEQ ID NO: 79124 - RNA, 22 nt, Human
ccugcucaacgaauauggcgau

SEQ ID NO: 79125 - RNA, 22 nt, Human
ccugcucagccccagcucaccc

SEQ ID NO: 79126 - RNA, 23 nt, Human
ccugcucaggcgugugcccugcu

SEQ ID NO: 79127 - RNA, 22 nt, Human
ccugcucccgggacgcguucac

SEQ ID NO: 79128 - RNA, 22 nt, Human
ccugcuccugcuauucuucugg

SEQ ID NO: 79129 - RNA, 22 nt, Human
ccugcucggggugcagugggcu

SEQ ID NO: 79130 - RNA, 22 nt, Human
ccugcucuccauacacuuucua

SEQ ID NO: 79131 - RNA, 22 nt, Human
ccugcugagacccugagguggg

SEQ ID NO: 79132 - RNA, 19 nt, Human
ccugcugcaccacuuguua

SEQ ID NO: 79133 - RNA, 22 nt, Human
ccugcugcuaugaaggugacag

SEQ ID NO: 79134 - RNA, 22 nt, Human
ccugcuggcgcuugucugggag

SEQ ID NO: 79135 - RNA, 22 nt, Human
gaauucuuugaucuuaaucuug

SEQ ID NO: 79136 - RNA, 22 nt, Human
gaauucuuuucuuucugaaagu

SEQ ID NO: 79137 - RNA, 22 nt, Human
gaauugauugauauguacugua

SEQ ID NO: 79138 - RNA, 22 nt, Human
gaauugcuagcgcaccaauucu

SEQ ID NO: 79139 - RNA, 22 nt, Human
gaauugcuaggcugcauguguc

SEQ ID NO: 79140 - RNA, 22 nt, Human
gaauugcugaaucauauguuua

SEQ ID NO: 79141 - RNA, 22 nt, Human
gaauugcuugcugagauuaaag

SEQ ID NO: 79142 - RNA, 22 nt, Human
gaauuggggguuuugcaaggca

SEQ ID NO: 79143 - RNA, 22 nt, Human
gaauuguaaguaccagcaugcu

SEQ ID NO: 79144 - RNA, 22 nt, Human
gaauuguacugcaaucagggga

SEQ ID NO: 79145 - RNA, 21 nt, Human
gaauugugccccuugguguug

SEQ ID NO: 79146 - RNA, 22 nt, Human
gaauuuacagggugagcuucag

SEQ ID NO: 79147 - RNA, 19 nt, Human
gaauuuaucucuucagucc

SEQ ID NO: 79148 - RNA, 22 nt, Human
gaauuucaaaagccagaacggg

SEQ ID NO: 79149 - RNA, 22 nt, Human
gaauuucauugcucugcugugu

SEQ ID NO: 79150 - RNA, 22 nt, Human
gaauuuccucuaaaccccugag

SEQ ID NO: 79151 - RNA, 22 nt, Human
gaauuuuaauaaagguuuauca

SEQ ID NO: 79152 - RNA, 22 nt, Human
gaauuuucagguagcaauuuca

SEQ ID NO: 79153 - RNA, 22 nt, Human
gacaaaacacauuaguuuaaaa

SEQ ID NO: 79154 - RNA, 21 nt, Human
gacaaacauuucauagcuuua

SEQ ID NO: 79155 - RNA, 22 nt, Human
gacaaacugaaguauauuuaga

SEQ ID NO: 79156 - RNA, 22 nt, Human
gacaaagcuuuggcauccuuac

SEQ ID NO: 79157 - RNA, 22 nt, Human
gacaaaggaucagagguuggga

SEQ ID NO: 79158 - RNA, 21 nt, Human
gacaaagugaagcaggcagga

SEQ ID NO: 79159 - RNA, 22 nt, Human
gacaaauaggucaacaggaggg

SEQ ID NO: 79160 - RNA, 22 nt, Human
gacaacacauguaugccacucu

SEQ ID NO: 79161 - RNA, 22 nt, Human
gacaacugagcagaggaaauga

SEQ ID NO: 79162 - RNA, 17 nt, Human
gacaagacagaauucau

SEQ ID NO: 79163 - RNA, 22 nt, Human
gacaagcucgccugccccggaa

SEQ ID NO: 79164 - RNA, 22 nt, Human
gacaagcucuuguuucaugguu

SEQ ID NO: 79165 - RNA, 22 nt, Human
gacaaggagccaccagucacgu

SEQ ID NO: 79166 - RNA, 22 nt, Human
gacaaggcagaaagcuuaaagg

SEQ ID NO: 79167 - RNA, 22 nt, Human
gacaaguuacaccugugcuuga

SEQ ID NO: 79168 - RNA, 22 nt, Human
gacaauaaagugauacauggga

SEQ ID NO: 79169 - RNA, 22 nt, Human
gacaaugcauugugauugugac

SEQ ID NO: 79170 - RNA, 22 nt, Human
gacaauuagaucauuccuuuga

SEQ ID NO: 79171 - RNA, 22 nt, Human
gacaauuucucaauauagaaac

SEQ ID NO: 79172 - RNA, 22 nt, Human
gacacaaaguuugucagaaauu

SEQ ID NO: 79173 - RNA, 22 nt, Human
gacacagaaugggugcucagua

SEQ ID NO: 79174 - RNA, 22 nt, Human
gacacagagauaggccuguguu

SEQ ID NO: 79175 - RNA, 22 nt, Human
gacacagaguauuuuaaguacu

SEQ ID NO: 79176 - RNA, 22 nt, Human
gacacagauaucucugagauua

SEQ ID NO: 79177 - RNA, 22 nt, Human
gacacagcuaauggcuuaggac

SEQ ID NO: 79178 - RNA, 22 nt, Human
gacacaggaaaagcuccagccc

SEQ ID NO: 79179 - RNA, 22 nt, Human
gacacaggggggcgcuagaaga

SEQ ID NO: 79180 - RNA, 22 nt, Human
gacacaguucccuaugagguaa

SEQ ID NO: 79181 - RNA, 16 nt, Human
gacacaugggggaaaa

SEQ ID NO: 79182 - RNA, 22 nt, Human
gacaccagagacugaugaggcc

SEQ ID NO: 79183 - RNA, 22 nt, Human
gacaccagcaaggcugugagga

SEQ ID NO: 79184 - RNA, 22 nt, Human
gacaccaggaauaguucugucu

SEQ ID NO: 79185 - RNA, 23 nt, Human
gacaccaggcguggcccucgaca

SEQ ID NO: 79186 - RNA, 23 nt, Human
gacaccuuugccagaucaagaug

SEQ ID NO: 79187 - RNA, 22 nt, Human
gacacuaaaguauaggguaucu

SEQ ID NO: 79188 - RNA, 22 nt, Human
gacacuccagcuuuuggcucaa

SEQ ID NO: 79189 - RNA, 22 nt, Human
gacacugaccccaagcuguccu

SEQ ID NO: 79190 - RNA, 22 nt, Human
gacacugucccacagaauucga

SEQ ID NO: 79191 - RNA, 22 nt, Human
gacacuuucucagguaaagcau

SEQ ID NO: 79192 - RNA, 22 nt, Human
gacagaaggcaucuagggcacg

SEQ ID NO: 79193 - RNA, 22 nt, Human
gacagaauuuuccaucaugugg

SEQ ID NO: 79194 - RNA, 22 nt, Human
gacagacacaauugauccauga

SEQ ID NO: 79195 - RNA, 22 nt, Human
gacagacacagggccaugauug

SEQ ID NO: 79196 - RNA, 22 nt, Human
gacagacacuauugguaugccu

SEQ ID NO: 79197 - RNA, 22 nt, Human
gacagacagagaaugggcuuga

SEQ ID NO: 79198 - RNA, 22 nt, Human
gacagacaggaggccaccugcu

SEQ ID NO: 79199 - RNA, 22 nt, Human
gacagacaugggacuucauacu

SEQ ID NO: 79200 - RNA, 22 nt, Human
gacagacauuuccugauccaau

SEQ ID NO: 79201 - RNA, 22 nt, Human
gacagaggagaagaugcugugg

SEQ ID NO: 79202 - RNA, 22 nt, Human
gacagaggguuccaaaauugau

SEQ ID NO: 79203 - RNA, 23 nt, Human
gacagagugagaccuugucuuac

SEQ ID NO: 79204 - RNA, 22 nt, Human
ccuguggcuuccacgaccuaau

SEQ ID NO: 79205 - RNA, 22 nt, Human
ccugugggagggagcggcugga

SEQ ID NO: 79206 - RNA, 22 nt, Human
ccugugggcgcagcuggaguca

SEQ ID NO: 79207 - RNA, 22 nt, Human
ccuguggguacaacagggucac

SEQ ID NO: 79208 - RNA, 22 nt, Human
ccugugucaucagcuguggcua

SEQ ID NO: 79209 - RNA, 22 nt, Human
ccuguguccuaauccaucaggc

SEQ ID NO: 79210 - RNA, 22 nt, Human
ccuguguccuuggcagauaucc

SEQ ID NO: 79211 - RNA, 22 nt, Human
ccugugucugaccaugcacaug

SEQ ID NO: 79212 - RNA, 23 nt, Human
ccugugucuguugcugaauaaug

SEQ ID NO: 79213 - RNA, 22 nt, Human
ccugugugaagguuaggcaggu

SEQ ID NO: 79214 - RNA, 23 nt, Human
ccugugugcccuuaauucacagc

SEQ ID NO: 79215 - RNA, 22 nt, Human
ccugugugccuggccgcgggag

SEQ ID NO: 79216 - RNA, 18 nt, Human
ccuguguguguugcaggc

SEQ ID NO: 79217 - RNA, 22 nt, Human
ccuguguuaguuaugggucucu

SEQ ID NO: 79218 - RNA, 22 nt, Human
ccuguguucuaauccaucucag

SEQ ID NO: 79219 - RNA, 19 nt, Human
ccuguguugggagugugag

SEQ ID NO: 79220 - RNA, 22 nt, Human
ccuguucaagguauuaauuauc

SEQ ID NO: 79221 - RNA, 22 nt, Human
ccuguucaaguugcagggcugg

SEQ ID NO: 79222 - RNA, 22 nt, Human
ccuguucauuuguauuugucuu

SEQ ID NO: 79223 - RNA, 20 nt, Human
ccuguuccauucccucaacc

SEQ ID NO: 79224 - RNA, 22 nt, Human
ccuguugucauggaauaaguua

SEQ ID NO: 79225 - RNA, 22 nt, Human
ccuguuguggaaaaagccugau

SEQ ID NO: 79226 - RNA, 22 nt, Human
ccuguuuaccacugaggggcag

SEQ ID NO: 79227 - RNA, 22 nt, Human
ccuuagaaaaucauggaauauu

SEQ ID NO: 79228 - RNA, 22 nt, Human
ccuuagaagaaaguuacuuuuu

SEQ ID NO: 79229 - RNA, 22 nt, Human
ccuuagaaggcugaauaauucu

SEQ ID NO: 79230 - RNA, 22 nt, Human
ccuuagcauggcugugcugugu

SEQ ID NO: 79231 - RNA, 22 nt, Human
ccuuagcauuagaagcuguggg

SEQ ID NO: 79232 - RNA, 22 nt, Human
ccuucaaguuccuggucccugg

SEQ ID NO: 79233 - RNA, 22 nt, Human
ccuucaaucuuaagucagccca

SEQ ID NO: 79234 - RNA, 22 nt, Human
ccuucacaccaucuuuaccagg

SEQ ID NO: 79235 - RNA, 22 nt, Human
ccuucacacuuucacuuggaua

SEQ ID NO: 79236 - RNA, 23 nt, Human
ccuucagaagaaguaacaggggc

SEQ ID NO: 79237 - RNA, 22 nt, Human
ccuucagccuagaacuugagag

SEQ ID NO: 79238 - RNA, 22 nt, Human
ccuucagccucaagauccuuca

SEQ ID NO: 79239 - RNA, 22 nt, Human
ccuucagccuucauccuuccuu

SEQ ID NO: 79240 - RNA, 22 nt, Human
ccuucagccuuuguuuaucaga

SEQ ID NO: 79241 - RNA, 18 nt, Human
ccuucagcucugccagua

SEQ ID NO: 79242 - RNA, 18 nt, Human
ccuucagcucugguuuuc

SEQ ID NO: 79243 - RNA, 22 nt, Human
ccuuccagccccaucucaucgu

SEQ ID NO: 79244 - RNA, 22 nt, Human
ccuuccaguucuugguuguaau

SEQ ID NO: 79245 - RNA, 22 nt, Human
ccuuccuggagcccaugcagau

SEQ ID NO: 79246 - RNA, 22 nt, Human
ccuuccuucaagcacacaucua

SEQ ID NO: 79247 - RNA, 22 nt, Human
ccuuccuugagaagcaauuccu

SEQ ID NO: 79248 - RNA, 22 nt, Human
ccuucuagccugcgccagggca

SEQ ID NO: 79249 - RNA, 20 nt, Human
ccuucuccagcuuguucuug

SEQ ID NO: 79250 - RNA, 22 nt, Human
ccuucuccccucugcagggugu

SEQ ID NO: 79251 - RNA, 22 nt, Human
ccuucucuaccaugugaggaaa

SEQ ID NO: 79252 - RNA, 22 nt, Human
ccuucugagcuucaauuucagu

SEQ ID NO: 79253 - RNA, 22 nt, Human
ccuucugcucccuggccagggc

SEQ ID NO: 79254 - RNA, 22 nt, Human
ccuucugucucccucauauuga

SEQ ID NO: 79255 - RNA, 22 nt, Human
ccuucugugugcccacguuuau

SEQ ID NO: 79256 - RNA, 22 nt, Human
ccuucuugagguagcacauucu

SEQ ID NO: 79257 - RNA, 22 nt, Human
ccuugaaaugagaaaaaguugg

SEQ ID NO: 79258 - RNA, 22 nt, Human
ccuugagaggaaguuuguagaa

SEQ ID NO: 79259 - RNA, 22 nt, Human
ccuugcauuuaaaggcguaggg

SEQ ID NO: 79260 - RNA, 22 nt, Human
ccuugcccugagcaggggucag

SEQ ID NO: 79261 - RNA, 22 nt, Human
ccuugccucauugugcuucucc

SEQ ID NO: 79262 - RNA, 22 nt, Human
ccuugccuugguccuucgcagg

SEQ ID NO: 79263 - RNA, 22 nt, Human
ccuugcucucccaagcccgcag

SEQ ID NO: 79264 - RNA, 22 nt, Human
ccuugcuguuagccuacauuau

SEQ ID NO: 79265 - RNA, 22 nt, Human
ccuuggagaccugggucugugc

SEQ ID NO: 79266 - RNA, 22 nt, Human
ccuuggcaagacaguggagggu

SEQ ID NO: 79267 - RNA, 16 nt, Human
ccuuggcaucagcugu

SEQ ID NO: 79268 - RNA, 22 nt, Human
ccuuggcauccucugaagaaau

SEQ ID NO: 79269 - RNA, 22 nt, Human
ccuuggcugugcugcccuuugc

SEQ ID NO: 79270 - RNA, 22 nt, Human
gagccagccuucuucugagguc

SEQ ID NO: 79271 - RNA, 22 nt, Human
gagccagcuauguagcaagagg

SEQ ID NO: 79272 - RNA, 22 nt, Human
gagccaggaggcagagacugca

SEQ ID NO: 79273 - RNA, 22 nt, Human
gagccaggguuugaaacuagac

SEQ ID NO: 79274 - RNA, 22 nt, Human
gagcccagcuaaauuuauauaa

SEQ ID NO: 79275 - RNA, 22 nt, Human
gagcccagcuugcacauggagc

SEQ ID NO: 79276 - RNA, 22 nt, Human
gagcccaggcagagguugcagu

SEQ ID NO: 79277 - RNA, 22 nt, Human
gagcccagggcaggcaaggcag

SEQ ID NO: 79278 - RNA, 22 nt, Human
gagcccucaccgccugaccagg

SEQ ID NO: 79279 - RNA, 22 nt, Human
gagcccucauugaaucugcauu

SEQ ID NO: 79280 - RNA, 22 nt, Human
gagcccucucuguaggcaagua

SEQ ID NO: 79281 - RNA, 22 nt, Human
gagcccucuucccuagugaucg

SEQ ID NO: 79282 - RNA, 22 nt, Human
gagcccugacacugagggaguu

SEQ ID NO: 79283 - RNA, 18 nt, Human
gagcccugagucugcaca

SEQ ID NO: 79284 - RNA, 22 nt, Human
gagcccugcugggccuugucuc

SEQ ID NO: 79285 - RNA, 22 nt, Human
gagcccuggcagucugggaugg

SEQ ID NO: 79286 - RNA, 22 nt, Human
gagccugaauuugaccugcuua

SEQ ID NO: 79287 - RNA, 22 nt, Human
gagccugagugcugccuccccu

SEQ ID NO: 79288 - RNA, 22 nt, Human
gagccugcgagggaguaaggca

SEQ ID NO: 79289 - RNA, 22 nt, Human
gagccuggauagccuuguucca

SEQ ID NO: 79290 - RNA, 20 nt, Human
gagccugggaagucuaaggu

SEQ ID NO: 79291 - RNA, 22 nt, Human
gagccuggggacccuccugagu

SEQ ID NO: 79292 - RNA, 22 nt, Human
gagccuggguccuucccuggga

SEQ ID NO: 79293 - RNA, 22 nt, Human
gagccuguguuuccuguagcca

SEQ ID NO: 79294 - RNA, 21 nt, Human
gagccuucccucugcccuuuc

SEQ ID NO: 79295 - RNA, 22 nt, Human
gagcuaagaccugagggcaagu

SEQ ID NO: 79296 - RNA, 22 nt, Human
gagcuaagcccuggagaggucg

SEQ ID NO: 79297 - RNA, 22 nt, Human
gagcuaagcuauguuaugcagc

SEQ ID NO: 79298 - RNA, 22 nt, Human
gagcuagacagcaagggccugc

SEQ ID NO: 79299 - RNA, 22 nt, Human
gagcuagaguuuguaggguaga

SEQ ID NO: 79300 - RNA, 22 nt, Human
gagcuaggauaucaugagggua

SEQ ID NO: 79301 - RNA, 22 nt, Human
gagcuagggaggaggcuugcuc

SEQ ID NO: 79302 - RNA, 22 nt, Human
gagcuagguuuuccagucgcau

SEQ ID NO: 79303 - RNA, 22 nt, Human
gagcucagacucgggccugggg

SEQ ID NO: 79304 - RNA, 22 nt, Human
gagcucagcacuaaaaucaugu

SEQ ID NO: 79305 - RNA, 18 nt, Human
gagcucagcguguuucua

SEQ ID NO: 79306 - RNA, 23 nt, Human
gagcucagguagggcucgcccgc

SEQ ID NO: 79307 - RNA, 22 nt, Human
gagcucagguggucaaaacaau

SEQ ID NO: 79308 - RNA, 22 nt, Human
gagcucaguguagucauggcuu

SEQ ID NO: 79309 - RNA, 22 nt, Human
gagcuccacuuagcaaggccac

SEQ ID NO: 79310 - RNA, 22 nt, Human
gagcuccagggaacagcagcua

SEQ ID NO: 79311 - RNA, 22 nt, Human
gagcucccaggccccagcaagg

SEQ ID NO: 79312 - RNA, 22 nt, Human
gagcuccugcugcauccugccu

SEQ ID NO: 79313 - RNA, 22 nt, Human
ccuggguccaauucuggcuugu

SEQ ID NO: 79314 - RNA, 22 nt, Human
ccugggucccagccaggcuuug

SEQ ID NO: 79315 - RNA, 22 nt, Human
ccugggugaaauaguccucaag

SEQ ID NO: 79316 - RNA, 22 nt, Human
ccugggugaaaucucuccugca

SEQ ID NO: 79317 - RNA, 22 nt, Human
ccuggguggcugccugccuuuc

SEQ ID NO: 79318 - RNA, 22 nt, Human
ccugggugguuccggcaaggag

SEQ ID NO: 79319 - RNA, 22 nt, Human
ccuggucaccccucucucugca

SEQ ID NO: 79320 - RNA, 22 nt, Human
ccuggugcagguguguugccag

SEQ ID NO: 79321 - RNA, 22 nt, Human
ccuggugccgguagacgcgcag

SEQ ID NO: 79322 - RNA, 22 nt, Human
ccuggugcuuaccagagcuuuu

SEQ ID NO: 79323 - RNA, 22 nt, Human
ccugguggacagcagccagcag

SEQ ID NO: 79324 - RNA, 22 nt, Human
ccugguguugugaaguagccgu

SEQ ID NO: 79325 - RNA, 22 nt, Human
ccugguugagggagguguggac

SEQ ID NO: 79326 - RNA, 22 nt, Human
ccugguugugaguugaguugag

SEQ ID NO: 79327 - RNA, 22 nt, Human
ccuguaaguaguuugccugagc

SEQ ID NO: 79328 - RNA, 22 nt, Human
ccuguacaagcucuuggugaca

SEQ ID NO: 79329 - RNA, 22 nt, Human
ccuguacacggucuaugccucc

SEQ ID NO: 79330 - RNA, 22 nt, Human
ccuguacuuguauuaaaggucc

SEQ ID NO: 79331 - RNA, 22 nt, Human
ccuguaggcgagggauggacag

SEQ ID NO: 79332 - RNA, 22 nt, Human
ccuguauuugcuuccuucugca

SEQ ID NO: 79333 - RNA, 22 nt, Human
ccugucacauauuugcuguuca

SEQ ID NO: 79334 - RNA, 22 nt, Human
ccugucacucugagccgcuccg

SEQ ID NO: 79335 - RNA, 22 nt, Human
ccugucagccccacuucugccu

SEQ ID NO: 79336 - RNA, 22 nt, Human
ccugucccaagcagggcuggcc

SEQ ID NO: 79337 - RNA, 22 nt, Human
ccuguccuccggagcgggcugu

SEQ ID NO: 79338 - RNA, 22 nt, Human
ccugucuacauaacugugugaa

SEQ ID NO: 79339 - RNA, 22 nt, Human
ccugucuaccagucacuuagcg

SEQ ID NO: 79340 - RNA, 22 nt, Human
ccugucuaucaagacaucuuca

SEQ ID NO: 79341 - RNA, 20 nt, Human
ccugucucacguuccgcccc

SEQ ID NO: 79342 - RNA, 20 nt, Human
ccugucuccucuuaccuggc

SEQ ID NO: 79343 - RNA, 22 nt, Human
ccugucucugcagggcccugcc

SEQ ID NO: 79344 - RNA, 22 nt, Human
ccugucucuguuaccacauuug

SEQ ID NO: 79345 - RNA, 20 nt, Human
ccugucugcaauggagguca

SEQ ID NO: 79346 - RNA, 22 nt, Human
ccugugaaugcauuaaugagug

SEQ ID NO: 79347 - RNA, 22 nt, Human
ccugugacauuagaauuucauu

SEQ ID NO: 79348 - RNA, 22 nt, Human
ccugugacucugucugaugguc

SEQ ID NO: 79349 - RNA, 22 nt, Human
ccugugacuuggcaaaccucca

SEQ ID NO: 79350 - RNA, 22 nt, Human
ccugugauauuguucauaauau

SEQ ID NO: 79351 - RNA, 22 nt, Human
ccugugcaggcuccauaauaga

SEQ ID NO: 79352 - RNA, 22 nt, Human
ccugugcauugaguuugcaccc

SEQ ID NO: 79353 - RNA, 22 nt, Human
ccugugccaaaaggcugcuuau

SEQ ID NO: 79354 - RNA, 22 nt, Human
ccugugccagccccuucugcug

SEQ ID NO: 79355 - RNA, 22 nt, Human
ccugugcccuacaccuuuccag

SEQ ID NO: 79356 - RNA, 22 nt, Human
ccugugcccucagccuggcucu

SEQ ID NO: 79357 - RNA, 22 nt, Human
ccugugcccugccaggcuggug

SEQ ID NO: 79358 - RNA, 22 nt, Human
ccugugcccuggaaggagagag

SEQ ID NO: 79359 - RNA, 22 nt, Human
ccugugccugccugugaguucu

SEQ ID NO: 79360 - RNA, 22 nt, Human
ccugugccuuccuuaggcaccu

SEQ ID NO: 79361 - RNA, 19 nt, Human
ccugugcuaggagcugacc

SEQ ID NO: 79362 - RNA, 21 nt, Human
ccugugcuccacacagggucc

SEQ ID NO: 79363 - RNA, 22 nt, Human
ccugugcucccauagcuucugu

SEQ ID NO: 79364 - RNA, 20 nt, Human
ccugugcuuaucacuugcug

SEQ ID NO: 79365 - RNA, 22 nt, Human
ccugugcuucacucaacaagcc

SEQ ID NO: 79366 - RNA, 22 nt, Human
ccuguggaauagaaucuucccu

SEQ ID NO: 79367 - RNA, 20 nt, Human
ccuguggagcugccuccucc

SEQ ID NO: 79368 - RNA, 22 nt, Human
ccuguggaggcugcucagcugg

SEQ ID NO: 79369 - RNA, 22 nt, Human
ccuguggccgcgucgggcggcg

SEQ ID NO: 79370 - RNA, 22 nt, Human
ccuguggccugaauuugguaaa

SEQ ID NO: 79371 - RNA, 20 nt, Human
ccuguggcucuuguaauuca

SEQ ID NO: 79372 - RNA, 22 nt, Human
ccuguggcugccccgcuguugg

SEQ ID NO: 79373 - RNA, 22 nt, Human
ccuguggcuggucaggccagca

SEQ ID NO: 79374 - RNA, 22 nt, Human
ccugugggagcccaggcagaua

SEQ ID NO: 79375 - RNA, 22 nt, Human
ccugugggaggggccuggcgcg

SEQ ID NO: 79376 - RNA, 22 nt, Human
ccugugggccaaggaccugcca

SEQ ID NO: 79377 - RNA, 22 nt, Human
ccugugggucacaugggugacu

SEQ ID NO: 79378 - RNA, 22 nt, Human
ccugugguuuacaugacaguua

SEQ ID NO: 79379 - RNA, 22 nt, Human
ccugugguuuacucuguggcua

SEQ ID NO: 79380 - RNA, 19 nt, Human
ccugugucccacguagaug

SEQ ID NO: 79381 - RNA, 22 nt, Human
ccugugugauuggaagcugaga

SEQ ID NO: 79382 - RNA, 22 nt, Human
ccuguguggaaaccgcaugacg

SEQ ID NO: 79383 - RNA, 20 nt, Human
ccuguguggccagcugaggc

SEQ ID NO: 79384 - RNA, 20 nt, Human
ccugugugguuugcacuaca

SEQ ID NO: 79385 - RNA, 22 nt, Human
ccuguguuucaccaaaagaguc

SEQ ID NO: 79386 - RNA, 22 nt, Human
ccuguucacccuccaugcacag

SEQ ID NO: 79387 - RNA, 20 nt, Human
ccuguucacugcgcaguuuc

SEQ ID NO: 79388 - RNA, 22 nt, Human
ccuguucacuuugacuucucca

SEQ ID NO: 79389 - RNA, 22 nt, Human
ccuguucaugaaacugcuuucc

SEQ ID NO: 79390 - RNA, 22 nt, Human
gaggaaugggugucucgugauu

SEQ ID NO: 79391 - RNA, 21 nt, Human
gaggaaugguuugcaaagcac

SEQ ID NO: 79392 - RNA, 22 nt, Human
gaggacaaagcccaggugcugg

SEQ ID NO: 79393 - RNA, 22 nt, Human
gaggacaagcugugaguggggu

SEQ ID NO: 79394 - RNA, 22 nt, Human
gaggacaaggccuugcaauucu

SEQ ID NO: 79395 - RNA, 23 nt, Human
gaggacacagcccagacagccgu

SEQ ID NO: 79396 - RNA, 22 nt, Human
gaggacaggagacucacuguuu

SEQ ID NO: 79397 - RNA, 22 nt, Human
gaggacauaguggacuaggguu

SEQ ID NO: 79398 - RNA, 22 nt, Human
gaggaccacagaugagccugca

SEQ ID NO: 79399 - RNA, 22 nt, Human
gaggacgugccaggcgaucucc

SEQ ID NO: 79400 - RNA, 22 nt, Human
gaggacucugggcguguauggg

SEQ ID NO: 79401 - RNA, 21 nt, Human
gaggacugcacacucugauug

SEQ ID NO: 79402 - RNA, 22 nt, Human
gaggagaaagcagugauuugug

SEQ ID NO: 79403 - RNA, 22 nt, Human
gaggagaaauuuggggaccuga

SEQ ID NO: 79404 - RNA, 22 nt, Human
gaggagagagggacugucugca

SEQ ID NO: 79405 - RNA, 22 nt, Human
gaggagaggccaucguuguuau

SEQ ID NO: 79406 - RNA, 22 nt, Human
gaggagaggggcucccaagagc

SEQ ID NO: 79407 - RNA, 22 nt, Human
gaggagcaugggaaggcucugg

SEQ ID NO: 79408 - RNA, 22 nt, Human
gaggagccaagguauguguguu

SEQ ID NO: 79409 - RNA, 22 nt, Human
gaggagccauagauagugcugc

SEQ ID NO: 79410 - RNA, 22 nt, Human
gaggagcccagcaccaucacuu

SEQ ID NO: 79411 - RNA, 22 nt, Human
gaggagcccuguuccccaggcc

SEQ ID NO: 79412 - RNA, 18 nt, Human
gaggagccgucccuacua

SEQ ID NO: 79413 - RNA, 17 nt, Human
gaggagcuccaguaggu

SEQ ID NO: 79414 - RNA, 22 nt, Human
gaggagcugaggcugaggccuc

SEQ ID NO: 79415 - RNA, 22 nt, Human
gaggagcugggucagggagaca

SEQ ID NO: 79416 - RNA, 22 nt, Human
gaggaggcacuaguuagugaca

SEQ ID NO: 79417 - RNA, 22 nt, Human
gaggaggcuguuucucugcauu

SEQ ID NO: 79418 - RNA, 22 nt, Human
gaggaggggacaguacuugugc

SEQ ID NO: 79419 - RNA, 23 nt, Human
gaggagggucgugcuguguuccu

SEQ ID NO: 79420 - RNA, 22 nt, Human
gaggagguugacggcacuguga

SEQ ID NO: 79421 - RNA, 22 nt, Human
gaggaucauuugagccuaggag

SEQ ID NO: 79422 - RNA, 22 nt, Human
ccuuccccagugauucucucag

SEQ ID NO: 79423 - RNA, 19 nt, Human
ccuuccccuucagccucug

SEQ ID NO: 79424 - RNA, 22 nt, Human
ccuucccuaaagcgucgcuuag

SEQ ID NO: 79425 - RNA, 22 nt, Human
ccuuccuugucuacaaaagcuc

SEQ ID NO: 79426 - RNA, 22 nt, Human
ccuuccuuucagggcuaugccu

SEQ ID NO: 79427 - RNA, 22 nt, Human
ccuucgagauuuaaacacugau

SEQ ID NO: 79428 - RNA, 22 nt, Human
ccuucuagcaaaucaacauaaa

SEQ ID NO: 79429 - RNA, 21 nt, Human
ccuucuccauuacaguaagcu

SEQ ID NO: 79430 - RNA, 22 nt, Human
ccuucucuacuccugaugcaug

SEQ ID NO: 79431 - RNA, 21 nt, Human
ccuucucuugcuucagcuuca

SEQ ID NO: 79432 - RNA, 22 nt, Human
ccuucugcuggucaucccagug

SEQ ID NO: 79433 - RNA, 22 nt, Human
ccuucuggaagcucuaagggag

SEQ ID NO: 79434 - RNA, 22 nt, Human
ccuucuggaugugcuaaggaag

SEQ ID NO: 79435 - RNA, 23 nt, Human
ccuucuguuaaccaucugggggg

SEQ ID NO: 79436 - RNA, 22 nt, Human
ccuugaaaccacaucuuagaaa

SEQ ID NO: 79437 - RNA, 22 nt, Human
ccuugaaacccugacacucugu

SEQ ID NO: 79438 - RNA, 22 nt, Human
ccuugaaauguucucacugggg

SEQ ID NO: 79439 - RNA, 22 nt, Human
ccuugaaucucugcucuagaac

SEQ ID NO: 79440 - RNA, 22 nt, Human
ccuugagccagggagcuggcag

SEQ ID NO: 79441 - RNA, 22 nt, Human
ccuugaggaguccauaguauca

SEQ ID NO: 79442 - RNA, 22 nt, Human
ccuugauggugagagcugcaga

SEQ ID NO: 79443 - RNA, 22 nt, Human
ccuugcagacaucaguaguggc

SEQ ID NO: 79444 - RNA, 22 nt, Human
ccuugcguuuuacagcuucuag

SEQ ID NO: 79445 - RNA, 22 nt, Human
ccuugcucggggagcugcagga

SEQ ID NO: 79446 - RNA, 22 nt, Human
ccuugcugcgugcuagcacaga

SEQ ID NO: 79447 - RNA, 22 nt, Human
ccuuggaguucuguuuggcuua

SEQ ID NO: 79448 - RNA, 22 nt, Human
ccuuggcaguggagugaggugg

SEQ ID NO: 79449 - RNA, 22 nt, Human
ccuuggcuugugggcugcagcc

SEQ ID NO: 79450 - RNA, 22 nt, Human
ccuugggacagccagcuucaga

SEQ ID NO: 79451 - RNA, 22 nt, Human
ccuugggagaaauugcagaguc

SEQ ID NO: 79452 - RNA, 22 nt, Human
ccuugggucuaggccagggagu

SEQ ID NO: 79453 - RNA, 22 nt, Human
ccuuggguguuuaauagauaua

SEQ ID NO: 79454 - RNA, 22 nt, Human
ccuugguccaacccugcacagc

SEQ ID NO: 79455 - RNA, 22 nt, Human
ccuugucuugcacagaugcagc

SEQ ID NO: 79456 - RNA, 21 nt, Human
ccuuuacaauuuugcauuccu

SEQ ID NO: 79457 - RNA, 22 nt, Human
ccuuuacacauggaaugggucu

SEQ ID NO: 79458 - RNA, 22 nt, Human
ccuuuacacguaaggcuguuga

SEQ ID NO: 79459 - RNA, 22 nt, Human
ccuuuaugagauccugggguga

SEQ ID NO: 79460 - RNA, 22 nt, Human
ccuuuaugauagaugcuuucag

SEQ ID NO: 79461 - RNA, 21 nt, Human
ccuuuaugcaaggacuggcau

SEQ ID NO: 79462 - RNA, 22 nt, Human
ccuuuaugucacucuggagagc

SEQ ID NO: 79463 - RNA, 22 nt, Human
ccuuuauguuucugcagccccc

SEQ ID NO: 79464 - RNA, 19 nt, Human
ccuuucagaacagaagcca

SEQ ID NO: 79465 - RNA, 22 nt, Human
ccuuucagaugggcauggaccg

SEQ ID NO: 79466 - RNA, 22 nt, Human
ccuuucucuaucgacccaucgc

SEQ ID NO: 79467 - RNA, 22 nt, Human
ccuuucucuuggauaccgauug

SEQ ID NO: 79468 - RNA, 17 nt, Human
ccuuucuucccagaggg

SEQ ID NO: 79469 - RNA, 22 nt, Human
ccuuucuugcuaagaguuuaug

SEQ ID NO: 79470 - RNA, 19 nt, Human
ccuuugaaucaggacacuu

SEQ ID NO: 79471 - RNA, 22 nt, Human
ccuuugcaacagaaagaccuga

SEQ ID NO: 79472 - RNA, 22 nt, Human
ccuuugcaauccuguaggccuu

SEQ ID NO: 79473 - RNA, 22 nt, Human
ccuuugcaaugaauuguuauug

SEQ ID NO: 79474 - RNA, 22 nt, Human
ccuuuggagcaacugagagcua

SEQ ID NO: 79475 - RNA, 19 nt, Human
ccuuuggauuuguuuaguc

SEQ ID NO: 79476 - RNA, 22 nt, Human
ccuuuggcccugagagaugauu

SEQ ID NO: 79477 - RNA, 22 nt, Human
ccuuuggccgcuuuauggagga

SEQ ID NO: 79478 - RNA, 22 nt, Human
ccuuuggcugcauagggaaggg

SEQ ID NO: 79479 - RNA, 22 nt, Human
ccuuugguaacauuccaaccuu

SEQ ID NO: 79480 - RNA, 22 nt, Human
ccuuugguaauucuguguagag

SEQ ID NO: 79481 - RNA, 22 nt, Human
ccuuuggucuugaugaacuguu

SEQ ID NO: 79482 - RNA, 22 nt, Human
ccuuuguucauugccuucaguc

SEQ ID NO: 79483 - RNA, 22 nt, Human
ccuuuguucuguguaucuuugu

SEQ ID NO: 79484 - RNA, 22 nt, Human
ccuuuuaagggagacuagagau

SEQ ID NO: 79485 - RNA, 22 nt, Human
ccuuuuaugaacuugagcaggu

SEQ ID NO: 79486 - RNA, 22 nt, Human
ccuuuucaacuaagauucugca

SEQ ID NO: 79487 - RNA, 22 nt, Human
ccuuuucuacaagcaaaugugc

SEQ ID NO: 79488 - RNA, 22 nt, Human
ccuuuucuagaaagggaggcaa

SEQ ID NO: 79489 - RNA, 22 nt, Human
ccuuuucuauccuucuagguuc

SEQ ID NO: 79490 - RNA, 22 nt, Human
ccuuuucuggccaccaagcgcu

SEQ ID NO: 79491 - RNA, 22 nt, Human
ccuuuucuguguggguaauuua

SEQ ID NO: 79492 - RNA, 22 nt, Human
ccuuuugagacuuccacugugu

SEQ ID NO: 79493 - RNA, 22 nt, Human
ccuuuuucaauauagaauugca

SEQ ID NO: 79494 - RNA, 22 nt, Human
ccuuuuucccuggagggacagc

SEQ ID NO: 79495 - RNA, 19 nt, Human
ccuuuuuuaacuucagcaa

SEQ ID NO: 79496 - RNA, 22 nt, Human
cgaaaucaaacuugggcuucug

SEQ ID NO: 79497 - RNA, 22 nt, Human
cgaagacagaccaucugaguag

SEQ ID NO: 79498 - RNA, 22 nt, Human
cgagaguggacagggcgcagcu

SEQ ID NO: 79499 - RNA, 22 nt, Human
cgaggaagaaguuugagucaag

SEQ ID NO: 79500 - RNA, 22 nt, Human
cgaggaggaaacgcggagaacu

SEQ ID NO: 79501 - RNA, 22 nt, Human
cgaggcagaggcugaaacggcu

SEQ ID NO: 79502 - RNA, 22 nt, Human
cgaggcaggcaggcggaggaua

SEQ ID NO: 79503 - RNA, 22 nt, Human
cgaggcggcggaagugcccgua

SEQ ID NO: 79504 - RNA, 22 nt, Human
cgagugucccuaccauuuccua

SEQ ID NO: 79505 - RNA, 22 nt, Human
cgauggagagguccugauaguu

SEQ ID NO: 79506 - RNA, 22 nt, Human
cgaugggggcaguguuacauug

SEQ ID NO: 79507 - RNA, 22 nt, Human
cgaugguucuggcugcuuguau

SEQ ID NO: 79508 - RNA, 18 nt, Human
cgauguguaugugauuug

SEQ ID NO: 79509 - RNA, 22 nt, Human
cuacuguugggagcccuggaag

SEQ ID NO: 79510 - RNA, 22 nt, Human
cuacuucuugaucugucgaccu

SEQ ID NO: 79511 - RNA, 20 nt, Human
cuacuuuaggcacugagaau

SEQ ID NO: 79512 - RNA, 22 nt, Human
cuagaaaaauacuuuauuguga

SEQ ID NO: 79513 - RNA, 22 nt, Human
cuagaaacauuacauguguuaa

SEQ ID NO: 79514 - RNA, 22 nt, Human
cuagaaacuccaucucacuaca

SEQ ID NO: 79515 - RNA, 22 nt, Human
cuagaaagauacuuaaaucaag

SEQ ID NO: 79516 - RNA, 22 nt, Human
cuagaacagucaaagugagcuc

SEQ ID NO: 79517 - RNA, 22 nt, Human
cuagaacuacaucuuuuaauag

SEQ ID NO: 79518 - RNA, 20 nt, Human
cuagaagugccucaucuaga

SEQ ID NO: 79519 - RNA, 22 nt, Human
cuagaaguuuggguccauuaag

SEQ ID NO: 79520 - RNA, 22 nt, Human
cuagaaucccaaauggacuggg

SEQ ID NO: 79521 - RNA, 22 nt, Human
cuagaaucuccaaguuuacuca

SEQ ID NO: 79522 - RNA, 23 nt, Human
cuagaauuuugcuaaaagacuag

SEQ ID NO: 79523 - RNA, 22 nt, Human
cuagagaagagguuaagcauga

SEQ ID NO: 79524 - RNA, 22 nt, Human
cuagagaauggcaaagauuaga

SEQ ID NO: 79525 - RNA, 17 nt, Human
cuagagagaaagagcua

SEQ ID NO: 79526 - RNA, 22 nt, Human
cuagagaggcagauguccugug

SEQ ID NO: 79527 - RNA, 22 nt, Human
cuagagaggugguguugggugg

SEQ ID NO: 79528 - RNA, 22 nt, Human
cuagagcuguucugugcacuca

SEQ ID NO: 79529 - RNA, 22 nt, Human
cuagagggauguuaggauagca

SEQ ID NO: 79530 - RNA, 22 nt, Human
cuagaguccuccuggaaaaggu

SEQ ID NO: 79531 - RNA, 22 nt, Human
cgccaguggcagcuggaacagg

SEQ ID NO: 79532 - RNA, 22 nt, Human
cgcccacgaaguagguggcauu

SEQ ID NO: 79533 - RNA, 22 nt, Human
cgccccagucuguaggugcccc

SEQ ID NO: 79534 - RNA, 22 nt, Human
cgccccucagcgacccaccagc

SEQ ID NO: 79535 - RNA, 22 nt, Human
cgccuggcugcagccggcgagg

SEQ ID NO: 79536 - RNA, 22 nt, Human
cgccugggaguccacaccugcu

SEQ ID NO: 79537 - RNA, 22 nt, Human
cgcgcugcagacagcggaggcc

SEQ ID NO: 79538 - RNA, 22 nt, Human
cgcggcgcgcccccgggugugu

SEQ ID NO: 79539 - RNA, 22 nt, Human
cgcuaggauuaggauuaauccu

SEQ ID NO: 79540 - RNA, 21 nt, Human
cgcuccaccccacccacuggc

SEQ ID NO: 79541 - RNA, 22 nt, Human
cgcugcagaugggagcugguug

SEQ ID NO: 79542 - RNA, 22 nt, Human
cgcugccaggucaccaggggua

SEQ ID NO: 79543 - RNA, 22 nt, Human
cgcugccucucuggggcccugg

SEQ ID NO: 79544 - RNA, 22 nt, Human
cgcugccuucaucccacgccua

SEQ ID NO: 79545 - RNA, 22 nt, Human
cgcugcgaggcgcccuuguugc

SEQ ID NO: 79546 - RNA, 22 nt, Human
cgcugggcauggugccuuauuu

SEQ ID NO: 79547 - RNA, 22 nt, Human
cgcugggcgcgcuccgaacccg

SEQ ID NO: 79548 - RNA, 22 nt, Human
cgcuggucaccauggcguccug

SEQ ID NO: 79549 - RNA, 22 nt, Human
cgcuuaauuuucuauagaaaag

SEQ ID NO: 79550 - RNA, 22 nt, Human
cgcuuuaacgugagaagaaggg

SEQ ID NO: 79551 - RNA, 22 nt, Human
cgcuuuggagucccugcuuuac

SEQ ID NO: 79552 - RNA, 22 nt, Human
cgcuuuggauuucgcuuuccaa

SEQ ID NO: 79553 - RNA, 22 nt, Human
cggaaacuacgugacacccguu

SEQ ID NO: 79554 - RNA, 22 nt, Human
cggaaacuugagaaccagccag

SEQ ID NO: 79555 - RNA, 22 nt, Human
cggaagcguucucagcaggggc

SEQ ID NO: 79556 - RNA, 22 nt, Human
cggagcugccugccaagccugc

SEQ ID NO: 79557 - RNA, 22 nt, Human
cggagcugcgccgggacacggg

SEQ ID NO: 79558 - RNA, 22 nt, Human
cggcacagccgggcaaggcugg

SEQ ID NO: 79559 - RNA, 22 nt, Human
cggcagagacggcgcuuugaac

SEQ ID NO: 79560 - RNA, 22 nt, Human
cggcagcuccgcgccguaggac

SEQ ID NO: 79561 - RNA, 22 nt, Human
cggcagcucgagggccacccgu

SEQ ID NO: 79562 - RNA, 22 nt, Human
cggccaaauugcagagagaagc

SEQ ID NO: 79563 - RNA, 22 nt, Human
cggccaagccggggccccgaag

SEQ ID NO: 79564 - RNA, 22 nt, Human
cggccgcguccagggccgccag

SEQ ID NO: 79565 - RNA, 22 nt, Human
cggcucaggccacaggacggca

SEQ ID NO: 79566 - RNA, 22 nt, Human
cggcugagcagugcugauggaa

SEQ ID NO: 79567 - RNA, 22 nt, Human
cggcugaggaucuccaggccug

SEQ ID NO: 79568 - RNA, 22 nt, Human
cggcugcugccugagucgcugu

SEQ ID NO: 79569 - RNA, 22 nt, Human
cggcuggguucggcugcaggcc

SEQ ID NO: 79570 - RNA, 22 nt, Human
cggcuucagcucaggccccucg

SEQ ID NO: 79571 - RNA, 22 nt, Human
cggcuucagucucaucaucgcc

SEQ ID NO: 79572 - RNA, 22 nt, Human
cggcuuccaacaagcuuugcug

SEQ ID NO: 79573 - RNA, 22 nt, Human
cggcuuccagcaggugcugcgc

SEQ ID NO: 79574 - RNA, 22 nt, Human
cggcuucuauuaggucggugca

SEQ ID NO: 79575 - RNA, 20 nt, Human
cgggacacucaagcucuggg

SEQ ID NO: 79576 - RNA, 22 nt, Human
cgggagccucugggucacacug

SEQ ID NO: 79577 - RNA, 22 nt, Human
cgggcacacacuugacagguuc

SEQ ID NO: 79578 - RNA, 22 nt, Human
cgggcaguguggcuccagaguc

SEQ ID NO: 79579 - RNA, 17 nt, Human
cgggcccgcggccgcuc

SEQ ID NO: 79580 - RNA, 22 nt, Human
cgggcgcacuccgggcagcugu

SEQ ID NO: 79581 - RNA, 22 nt, Human
cgggcucaggaggaaacaggag

SEQ ID NO: 79582 - RNA, 22 nt, Human
cgggcugcucuggaccgacagc

SEQ ID NO: 79583 - RNA, 22 nt, Human
cgggcuggcugcagcugcugga

SEQ ID NO: 79584 - RNA, 22 nt, Human
cggggaagcgguucuggcggua

SEQ ID NO: 79585 - RNA, 22 nt, Human
cggggacacacuggcagcuccu

SEQ ID NO: 79586 - RNA, 22 nt, Human
cggggaggcuucggauuaaagc

SEQ ID NO: 79587 - RNA, 22 nt, Human
cggggcaggagucccuguagag

SEQ ID NO: 79588 - RNA, 23 nt, Human
cggggccagggucaggaccgguc

SEQ ID NO: 79589 - RNA, 22 nt, Human
cggggccuagucuaccucggca

SEQ ID NO: 79590 - RNA, 22 nt, Human
cggggcugcucguccuccugug

SEQ ID NO: 79591 - RNA, 22 nt, Human
cggggcuggcacaggugaccac

SEQ ID NO: 79592 - RNA, 22 nt, Human
cggggucccugcccacccauac

SEQ ID NO: 79593 - RNA, 22 nt, Human
cgggguccgggcaguaggcugc

SEQ ID NO: 79594 - RNA, 22 nt, Human
cggggugggaauagaccugucu

SEQ ID NO: 79595 - RNA, 22 nt, Human
cgggucaccuaucaauuuugug

SEQ ID NO: 79596 - RNA, 22 nt, Human
cggucaggugcagcguuggcac

SEQ ID NO: 79597 - RNA, 22 nt, Human
cgguccagagcuaguucauugc

SEQ ID NO: 79598 - RNA, 22 nt, Human
cgguccagggaacgcccccgcc

SEQ ID NO: 79599 - RNA, 19 nt, Human
cgguccauccgauuuuaca

SEQ ID NO: 79600 - RNA, 22 nt, Human
cgguuaguuauuuuucagauau

SEQ ID NO: 79601 - RNA, 22 nt, Human
cguagcucacgcccccucuccc

SEQ ID NO: 79602 - RNA, 22 nt, Human
cgucacuggcgugaagugagga

SEQ ID NO: 79603 - RNA, 22 nt, Human
cgucaucacggcaagcaucucc

SEQ ID NO: 79604 - RNA, 22 nt, Human
cguccaggaagaucggccgaug

SEQ ID NO: 79605 - RNA, 19 nt, Human
cguccaggugcuggaagau

SEQ ID NO: 79606 - RNA, 22 nt, Human
cguccgcaaugcaagccuuuua

SEQ ID NO: 79607 - RNA, 22 nt, Human
cgucugcccgacuguucuucac

SEQ ID NO: 79608 - RNA, 22 nt, Human
cgugaaaugaguugaauuauug

SEQ ID NO: 79609 - RNA, 19 nt, Human
cgugaacaugacugcaugg

SEQ ID NO: 79610 - RNA, 22 nt, Human
cgugacacauucuggacauggu

SEQ ID NO: 79611 - RNA, 22 nt, Human
cguggccacccaguggugcgug

SEQ ID NO: 79612 - RNA, 22 nt, Human
cguggccagcacaaggcaguga

SEQ ID NO: 79613 - RNA, 22 nt, Human
cguggccaguuucaagcuacca

SEQ ID NO: 79614 - RNA, 22 nt, Human
cguggccuuugagugagcuccc

SEQ ID NO: 79615 - RNA, 22 nt, Human
cgugggccccagccacucccuc

SEQ ID NO: 79616 - RNA, 22 nt, Human
cguguacagucuaucuuuuuuc

SEQ ID NO: 79617 - RNA, 22 nt, Human
cguguaugauaaauguuaauaa

SEQ ID NO: 79618 - RNA, 22 nt, Human
cguguaugugccugcauucaca

SEQ ID NO: 79619 - RNA, 22 nt, Human
cgugucaucugagccuugggcg

SEQ ID NO: 79620 - RNA, 22 nt, Human
cguguccuuuuagcuucagguc

SEQ ID NO: 79621 - RNA, 22 nt, Human
cgugucuguguaugcaggccgu

SEQ ID NO: 79622 - RNA, 22 nt, Human
cguguggucccggcaaggcaag

SEQ ID NO: 79623 - RNA, 22 nt, Human
cguuggagacacuugaggacuu

SEQ ID NO: 79624 - RNA, 22 nt, Human
cguugugagcuugguagacacu

SEQ ID NO: 79625 - RNA, 22 nt, Human
cguuuccaacugugaugagguc

SEQ ID NO: 79626 - RNA, 22 nt, Human
cguuuuucaguggucuuagguc

SEQ ID NO: 79627 - RNA, 22 nt, Human
gaucagaguggcuagagccuug

SEQ ID NO: 79628 - RNA, 22 nt, Human
gaucaggagauggccucagacc

SEQ ID NO: 79629 - RNA, 19 nt, Human
gaucaggagccgacaacug

SEQ ID NO: 79630 - RNA, 22 nt, Human
gaucaugcuggcugcccuguug

SEQ ID NO: 79631 - RNA, 22 nt, Human
gaucauuuacuuguucuggacu

SEQ ID NO: 79632 - RNA, 22 nt, Human
gaucauuucaguccaguaaaua

SEQ ID NO: 79633 - RNA, 22 nt, Human
gaucauuugcaggaaacauuaa

SEQ ID NO: 79634 - RNA, 22 nt, Human
gauccacagcccgcuugggccc

SEQ ID NO: 79635 - RNA, 22 nt, Human
gauccacagcugcgguaggaga

SEQ ID NO: 79636 - RNA, 22 nt, Human
gaucccauguaggagaauguua

SEQ ID NO: 79637 - RNA, 22 nt, Human
gauccccagggcaggccucccg

SEQ ID NO: 79638 - RNA, 22 nt, Human
gauccguugcaaccaauuagca

SEQ ID NO: 79639 - RNA, 22 nt, Human
gauccguuuauacugaguuuga

SEQ ID NO: 79640 - RNA, 22 nt, Human
cucuggagucaggcagcccugg

SEQ ID NO: 79641 - RNA, 19 nt, Human
cucuggagucauugcuccc

SEQ ID NO: 79642 - RNA, 22 nt, Human
cucuggaguucuucaagcuacu

SEQ ID NO: 79643 - RNA, 22 nt, Human
cucuggcaauggauuuuugagg

SEQ ID NO: 79644 - RNA, 22 nt, Human
cucuggcacacuccuuccaggu

SEQ ID NO: 79645 - RNA, 22 nt, Human
cucuggccuggggccugcuccc

SEQ ID NO: 79646 - RNA, 22 nt, Human
cucuggcggccaugcucguggu

SEQ ID NO: 79647 - RNA, 22 nt, Human
cucuggcuaucuguuucuaugu

SEQ ID NO: 79648 - RNA, 22 nt, Human
cucuggcuggcaccugaucuga

SEQ ID NO: 79649 - RNA, 22 nt, Human
cucuggcuuugcucaugcaucc

SEQ ID NO: 79650 - RNA, 22 nt, Human
cucugggaaagauugugcaggc

SEQ ID NO: 79651 - RNA, 22 nt, Human
gcacuuucagcaggcagacaga

SEQ ID NO: 79652 - RNA, 22 nt, Human
gcacuuuguggauuguauuucc

SEQ ID NO: 79653 - RNA, 22 nt, Human
gcagaaccugaauugaacauug

SEQ ID NO: 79654 - RNA, 22 nt, Human
gcagaagcccggucagcgcacg

SEQ ID NO: 79655 - RNA, 22 nt, Human
gcagaagcugggcagcgaggug

SEQ ID NO: 79656 - RNA, 22 nt, Human
gcagaaggauccgcaggugcaa

SEQ ID NO: 79657 - RNA, 22 nt, Human
gcagaagguuguuugggaaagg

SEQ ID NO: 79658 - RNA, 22 nt, Human
gcagaaguaccucguucuaguu

SEQ ID NO: 79659 - RNA, 22 nt, Human
gcagaaguaggcucuguguagg

SEQ ID NO: 79660 - RNA, 22 nt, Human
gcagaagucagaccaucugaau

SEQ ID NO: 79661 - RNA, 22 nt, Human
gcagaauacauuuuguuuuccu

SEQ ID NO: 79662 - RNA, 22 nt, Human
gcagaauagugacuuuccuuaa

SEQ ID NO: 79663 - RNA, 22 nt, Human
gcagaauauuauggaaaaagua

SEQ ID NO: 79664 - RNA, 22 nt, Human
gcagaauuccuucuuccuuggg

SEQ ID NO: 79665 - RNA, 22 nt, Human
gcagaauugauggagaacuuaa

SEQ ID NO: 79666 - RNA, 22 nt, Human
gcagaauuuggggguaaccuuu

SEQ ID NO: 79667 - RNA, 22 nt, Human
gcagaauuuucuguuuucuaga

SEQ ID NO: 79668 - RNA, 22 nt, Human
gcagacagccagacugcacugg

SEQ ID NO: 79669 - RNA, 22 nt, Human
gcagacaugggaucuauucaca

SEQ ID NO: 79670 - RNA, 22 nt, Human
gcagacauguguucuaacagga

SEQ ID NO: 79671 - RNA, 22 nt, Human
gcagacccugaacugggcaugg

SEQ ID NO: 79672 - RNA, 22 nt, Human
gcagacugcgagcgugcuggug

SEQ ID NO: 79673 - RNA, 22 nt, Human
gcagacuguacacuggacuuug

SEQ ID NO: 79674 - RNA, 21 nt, Human
gcagagaaugaacuuuggcuu

SEQ ID NO: 79675 - RNA, 22 nt, Human
gcagagacuaguagugcagacu

SEQ ID NO: 79676 - RNA, 22 nt, Human
gcagagacuccacugucuugug

SEQ ID NO: 79677 - RNA, 22 nt, Human
gcagagaugagcuaucaggaca

SEQ ID NO: 79678 - RNA, 22 nt, Human
gcagagauggcugccucugagu

SEQ ID NO: 79679 - RNA, 22 nt, Human
gcagagcagcaaauggaaagga

SEQ ID NO: 79680 - RNA, 22 nt, Human
gcagagcagggauuuugccaua

SEQ ID NO: 79681 - RNA, 22 nt, Human
gcagagcauuggagggacccug

SEQ ID NO: 79682 - RNA, 22 nt, Human
gcagagccaggagagacccuug

SEQ ID NO: 79683 - RNA, 16 nt, Human
gcagagcucagggacu

SEQ ID NO: 79684 - RNA, 22 nt, Human
gcagagcuccccaagacaccaa

SEQ ID NO: 79685 - RNA, 22 nt, Human
gcagagcuguuaauggagcuga

SEQ ID NO: 79686 - RNA, 16 nt, Human
gcagaggaaaggggag

SEQ ID NO: 79687 - RNA, 22 nt, Human
gcagaggagugauuaugccgug

SEQ ID NO: 79688 - RNA, 21 nt, Human
gcagaggcacggcaccaaggg

SEQ ID NO: 79689 - RNA, 22 nt, Human
gcagaggccuagguggaaggcc

SEQ ID NO: 79690 - RNA, 22 nt, Human
gcagaggggguacuucggcccu

SEQ ID NO: 79691 - RNA, 22 nt, Human
gcagagguccuagccaggaguc

SEQ ID NO: 79692 - RNA, 22 nt, Human
gcagaggucuagcaccaagaau

SEQ ID NO: 79693 - RNA, 22 nt, Human
gcagaggugagaagggccuccc

SEQ ID NO: 79694 - RNA, 22 nt, Human
gcagaggugcucaguggcagaa

SEQ ID NO: 79695 - RNA, 22 nt, Human
gcagagguggcaucugggcucu

SEQ ID NO: 79696 - RNA, 22 nt, Human
gcagagucaggauuccauccca

SEQ ID NO: 79697 - RNA, 22 nt, Human
gcagagucagguccaaggacug

SEQ ID NO: 79698 - RNA, 22 nt, Human
gcagagucauuauuuaugcaau

SEQ ID NO: 79699 - RNA, 22 nt, Human
gcagagucccagcagguggugg

SEQ ID NO: 79700 - RNA, 22 nt, Human
gcagagugggagcccagggcug

SEQ ID NO: 79701 - RNA, 22 nt, Human
gcagagugguuucagaguugag

SEQ ID NO: 79702 - RNA, 22 nt, Human
gcagaguugaugcaaguacuga

SEQ ID NO: 79703 - RNA, 22 nt, Human
gcagaucaauugauuguucacu

SEQ ID NO: 79704 - RNA, 18 nt, Human
gcagaugaguaguguacc

SEQ ID NO: 79705 - RNA, 22 nt, Human
gcagaugagugagauagacuuc

SEQ ID NO: 79706 - RNA, 22 nt, Human
gcagaugccugaaggagcuggg

SEQ ID NO: 79707 - RNA, 22 nt, Human
gcagaugcugagauuuauuucu

SEQ ID NO: 79708 - RNA, 22 nt, Human
gcagaugcugcuccucucuaga

SEQ ID NO: 79709 - RNA, 22 nt, Human
gcagauggaaagugcuugaggg

SEQ ID NO: 79710 - RNA, 22 nt, Human
gcagauggagauaaauggaacu

SEQ ID NO: 79711 - RNA, 22 nt, Human
gcagauggcagcccaggcuggg

SEQ ID NO: 79712 - RNA, 21 nt, Human
gcagaugggaagagacgaggc

SEQ ID NO: 79713 - RNA, 22 nt, Human
gcagauggugccaugucuugug

SEQ ID NO: 79714 - RNA, 22 nt, Human
gcagauguucugugucucacaa

SEQ ID NO: 79715 - RNA, 22 nt, Human
gcagauuucuaauaagcaaugu

SEQ ID NO: 79716 - RNA, 22 nt, Human
gcagcaaagcucuucaugugau

SEQ ID NO: 79717 - RNA, 22 nt, Human
gcagcaagaauaauuuggguag

SEQ ID NO: 79718 - RNA, 22 nt, Human
gcagcaagagguuucuguugac

SEQ ID NO: 79719 - RNA, 22 nt, Human
gcagcaaggaugaagcacuugg

SEQ ID NO: 79720 - RNA, 22 nt, Human
gcagcacugucuugucuuagga

SEQ ID NO: 79721 - RNA, 22 nt, Human
gcagcagaaggccaaggggagc

SEQ ID NO: 79722 - RNA, 22 nt, Human
gcagcagaguuugggagauggu

SEQ ID NO: 79723 - RNA, 22 nt, Human
gcagcagccacuauucuggcau

SEQ ID NO: 79724 - RNA, 22 nt, Human
gcagcagcucagccgggcacug

SEQ ID NO: 79725 - RNA, 22 nt, Human
gcagcaggcuuuucauaccuug

SEQ ID NO: 79726 - RNA, 22 nt, Human
gcagcaggugugcuuuuaauga

SEQ ID NO: 79727 - RNA, 22 nt, Human
gcagcaguggcaguuaauauuu

SEQ ID NO: 79728 - RNA, 22 nt, Human
gcagcagugucucccaucuugc

SEQ ID NO: 79729 - RNA, 22 nt, Human
gcagcagugugggcugaaccua

SEQ ID NO: 79730 - RNA, 21 nt, Human
gcagcaguguucuagaauacu

SEQ ID NO: 79731 - RNA, 22 nt, Human
gcagcaucagguucacugcgug

SEQ ID NO: 79732 - RNA, 22 nt, Human
gcagcauggagaaguagcuaga

SEQ ID NO: 79733 - RNA, 22 nt, Human
gcagcauuaccaagacauggca

SEQ ID NO: 79734 - RNA, 22 nt, Human
gcagcauuuguggaaugggccc

SEQ ID NO: 79735 - RNA, 23 nt, Human
gcagccaagagaccagggcaggc

SEQ ID NO: 79736 - RNA, 22 nt, Human
gcagccacacuguuacagaaug

SEQ ID NO: 79737 - RNA, 22 nt, Human
gcagccacagaggagggaugca

SEQ ID NO: 79738 - RNA, 19 nt, Human
gcagccaccgcggcggccg

SEQ ID NO: 79739 - RNA, 21 nt, Human
gcagccagacgggauucaguu

SEQ ID NO: 79740 - RNA, 21 nt, Human
gcagccagccgagaccaugcc

SEQ ID NO: 79741 - RNA, 19 nt, Human
gcagccaggugcucuaccu

SEQ ID NO: 79742 - RNA, 22 nt, Human
gcagcccaagagacucuguuga

SEQ ID NO: 79743 - RNA, 22 nt, Human
gcagcccagagcgcaggacccc

SEQ ID NO: 79744 - RNA, 22 nt, Human
gcagcccagcagggcccggagc

SEQ ID NO: 79745 - RNA, 22 nt, Human
gcagcccaggacccuggacaga

SEQ ID NO: 79746 - RNA, 22 nt, Human
gcagcccaggucucucucacuc

SEQ ID NO: 79747 - RNA, 22 nt, Human
gcagccccaggagacgcccagg

SEQ ID NO: 79748 - RNA, 22 nt, Human
gcagcccucccugggugugucu

SEQ ID NO: 79749 - RNA, 17 nt, Human
cugaagauaauggcaac

SEQ ID NO: 79750 - RNA, 22 nt, Human
cugaagauuauaaacagacaua

SEQ ID NO: 79751 - RNA, 22 nt, Human
cugaagcaaaggaucgagcuaa

SEQ ID NO: 79752 - RNA, 22 nt, Human
cugaagcaaaugaaacagcucu

SEQ ID NO: 79753 - RNA, 22 nt, Human
cugaagcacagcauauaaauaa

SEQ ID NO: 79754 - RNA, 22 nt, Human
cugaagcaggaacagcgagauu

SEQ ID NO: 79755 - RNA, 22 nt, Human
cugaagcagggagugaugaagu

SEQ ID NO: 79756 - RNA, 23 nt, Human
cugaagcaguucccucucugccc

SEQ ID NO: 79757 - RNA, 22 nt, Human
cugaagcuugauaaacuauaaa

SEQ ID NO: 79758 - RNA, 22 nt, Human
cugaagcuuuacuucaaauaca

SEQ ID NO: 79759 - RNA, 22 nt, Human
cugaaggaagcagaagcgaggu

SEQ ID NO: 79760 - RNA, 22 nt, Human
cugaaggaagcagguggccugu

SEQ ID NO: 79761 - RNA, 22 nt, Human
cugaaggagaaggccacuguuc

SEQ ID NO: 79762 - RNA, 22 nt, Human
cugaaggauguguggugggagu

SEQ ID NO: 79763 - RNA, 22 nt, Human
cugaaggcuuguuguuuucuua

SEQ ID NO: 79764 - RNA, 22 nt, Human
cugaagggaugugauuucuaca

SEQ ID NO: 79765 - RNA, 22 nt, Human
cugaagucagauggcacaaggu

SEQ ID NO: 79766 - RNA, 22 nt, Human
cugaaguuaaaguaguuuuuau

SEQ ID NO: 79767 - RNA, 22 nt, Human
cugaaguuauucagugggcuga

SEQ ID NO: 79768 - RNA, 22 nt, Human
gcagcuccuuuaggcugcaaag

SEQ ID NO: 79769 - RNA, 22 nt, Human
gcagcucucuggccugcccugg

SEQ ID NO: 79770 - RNA, 22 nt, Human
gcagcucugauugguucagccu

SEQ ID NO: 79771 - RNA, 22 nt, Human
gcagcugaauguccauugcugc

SEQ ID NO: 79772 - RNA, 22 nt, Human
gcagcugcagguggucccaugc

SEQ ID NO: 79773 - RNA, 22 nt, Human
gcagcugccaguccccuuccag

SEQ ID NO: 79774 - RNA, 22 nt, Human
gcagcugcgaagaagucuaucu

SEQ ID NO: 79775 - RNA, 22 nt, Human
gcagcugcugggaucauuuagg

SEQ ID NO: 79776 - RNA, 22 nt, Human
gcagcuggacccacacggcuua

SEQ ID NO: 79777 - RNA, 22 nt, Human
gcagcuggcucagagagguggg

SEQ ID NO: 79778 - RNA, 22 nt, Human
gcagcuggucuggccuagagua

SEQ ID NO: 79779 - RNA, 22 nt, Human
gcagcuguacuggcagcauugu

SEQ ID NO: 79780 - RNA, 22 nt, Human
gcagcuguaucacuuuuaaaca

SEQ ID NO: 79781 - RNA, 22 nt, Human
gcagcugucgcuaggagcugug

SEQ ID NO: 79782 - RNA, 22 nt, Human
gcagcugucggaaagcuaagug

SEQ ID NO: 79783 - RNA, 22 nt, Human
gcagcuuggggacaugaaaaga

SEQ ID NO: 79784 - RNA, 22 nt, Human
gcagcuuggugaaaggugaugg

SEQ ID NO: 79785 - RNA, 22 nt, Human
gcagcuuucuuuuugcaugucu

SEQ ID NO: 79786 - RNA, 21 nt, Human
gcaggaacaggucaugaucug

SEQ ID NO: 79787 - RNA, 22 nt, Human
gcaggaacaguuuaucucuggc

SEQ ID NO: 79788 - RNA, 22 nt, Human
gcaggaaccugguaagcuucac

SEQ ID NO: 79789 - RNA, 22 nt, Human
gcaggacacagaugcaaggcca

SEQ ID NO: 79790 - RNA, 22 nt, Human
gcaggacagacccaagcagucu

SEQ ID NO: 79791 - RNA, 22 nt, Human
gcaggacagcaggaugcuuaga

SEQ ID NO: 79792 - RNA, 22 nt, Human
gcaggacaggcguugguccagu

SEQ ID NO: 79793 - RNA, 19 nt, Human
gcaggacucccagcuccuc

SEQ ID NO: 79794 - RNA, 22 nt, Human
gcaggagaaaugaagauugggu

SEQ ID NO: 79795 - RNA, 22 nt, Human
gcaggagacuggcugugguagu

SEQ ID NO: 79796 - RNA, 22 nt, Human
gcaggagagccagcaggcuucc

SEQ ID NO: 79797 - RNA, 22 nt, Human
gcaggagcaaacugcagugugg

SEQ ID NO: 79798 - RNA, 22 nt, Human
gcaggagcucguuuccaggcug

SEQ ID NO: 79799 - RNA, 22 nt, Human
gcaggaggaucacuugagccca

SEQ ID NO: 79800 - RNA, 22 nt, Human
gcaggagguugagccaggacug

SEQ ID NO: 79801 - RNA, 22 nt, Human
gcaggaguaugcagcuaugguu

SEQ ID NO: 79802 - RNA, 22 nt, Human
gcaggagucccagaagguuuug

SEQ ID NO: 79803 - RNA, 22 nt, Human
gcaggagugugucuaauacuca

SEQ ID NO: 79804 - RNA, 22 nt, Human
gcaggauggugcccuuucugcc

SEQ ID NO: 79805 - RNA, 22 nt, Human
gcaggauugggcugaaggagug

SEQ ID NO: 79806 - RNA, 22 nt, Human
gcaggcaccgcggcggcagguu

SEQ ID NO: 79807 - RNA, 21 nt, Human
gcaggcacucuagaggagcug

SEQ ID NO: 79808 - RNA, 22 nt, Human
gcaggcagagaaggaacauuua

SEQ ID NO: 79809 - RNA, 22 nt, Human
gcaggcagagagggguuuccag

SEQ ID NO: 79810 - RNA, 22 nt, Human
gcaggcagagguggaggagaca

SEQ ID NO: 79811 - RNA, 22 nt, Human
gcaggcagagucaauuugaucc

SEQ ID NO: 79812 - RNA, 19 nt, Human
gcaggcagcugggguaucc

SEQ ID NO: 79813 - RNA, 19 nt, Human
gcaggcaguggcauucgga

SEQ ID NO: 79814 - RNA, 22 nt, Human
gcaggcccagagucgcuggccu

SEQ ID NO: 79815 - RNA, 22 nt, Human
gcaggccuccccugcuggagcu

SEQ ID NO: 79816 - RNA, 22 nt, Human
gcaggccucuguugagggccuu

SEQ ID NO: 79817 - RNA, 19 nt, Human
gcaggccucuugggaauua

SEQ ID NO: 79818 - RNA, 22 nt, Human
gcaggccugcccagcaggaugg

SEQ ID NO: 79819 - RNA, 20 nt, Human
gcaggcuccgggcuugggag

SEQ ID NO: 79820 - RNA, 22 nt, Human
gcaggcucuucuuucugcccag

SEQ ID NO: 79821 - RNA, 22 nt, Human
gcaggcugaugacuggaguugg

SEQ ID NO: 79822 - RNA, 22 nt, Human
gcaggcugcugagauccuuagg

SEQ ID NO: 79823 - RNA, 22 nt, Human
gcaggcugggguagccccacuu

SEQ ID NO: 79824 - RNA, 22 nt, Human
gcaggcuugggacgagcuggag

SEQ ID NO: 79825 - RNA, 19 nt, Human
gcaggcuugggucucccca

SEQ ID NO: 79826 - RNA, 22 nt, Human
gcaggcuuguugaaguaaaaua

SEQ ID NO: 79827 - RNA, 22 nt, Human
gcaggcuuugacuuggggcaac

SEQ ID NO: 79828 - RNA, 22 nt, Human
gcagggaagacccggagcagcg

SEQ ID NO: 79829 - RNA, 22 nt, Human
gcagggacaaggcagguguucu

SEQ ID NO: 79830 - RNA, 22 nt, Human
gcagggacagggcagggccuuu

SEQ ID NO: 79831 - RNA, 22 nt, Human
gcagggacgcagcacucuccgu

SEQ ID NO: 79832 - RNA, 22 nt, Human
gcagggagguuugcugaccugg

SEQ ID NO: 79833 - RNA, 22 nt, Human
gcagggaugcugaggcucagug

SEQ ID NO: 79834 - RNA, 22 nt, Human
gcagggauugucaaugcugcuc

SEQ ID NO: 79835 - RNA, 22 nt, Human
gcagggcaaacccagguguuca

SEQ ID NO: 79836 - RNA, 22 nt, Human
gcagggcagaaggugcugagga

SEQ ID NO: 79837 - RNA, 22 nt, Human
gcagggcagaccuccagccuau

SEQ ID NO: 79838 - RNA, 22 nt, Human
gcagggcagccacaggcccccu

SEQ ID NO: 79839 - RNA, 22 nt, Human
gcagggcagcugaagcuaggug

SEQ ID NO: 79840 - RNA, 22 nt, Human
gcagggcaggauuugaacccag

SEQ ID NO: 79841 - RNA, 20 nt, Human
gcagggcaucuuggccccca

SEQ ID NO: 79842 - RNA, 22 nt, Human
gcagggcgcguuugagcgggcu

SEQ ID NO: 79843 - RNA, 22 nt, Human
gcagggcuagauauuugcaagu

SEQ ID NO: 79844 - RNA, 22 nt, Human
gcagggcucagccgcucccacc

SEQ ID NO: 79845 - RNA, 22 nt, Human
gcagggcugaaggucccaggcc

SEQ ID NO: 79846 - RNA, 22 nt, Human
gcagggcugauguuauugacga

SEQ ID NO: 79847 - RNA, 22 nt, Human
gcagggcugcugaaacuuguuu

SEQ ID NO: 79848 - RNA, 22 nt, Human
gcagggcugggacuuacuggua

SEQ ID NO: 79849 - RNA, 22 nt, Human
gcagggcuguaauuugagccug

SEQ ID NO: 79850 - RNA, 22 nt, Human
gcagggcuguuuagugaauagg

SEQ ID NO: 79851 - RNA, 22 nt, Human
gcaggggaguggaugauggauu

SEQ ID NO: 79852 - RNA, 22 nt, Human
gcaggggaguggcaggcccgga

SEQ ID NO: 79853 - RNA, 21 nt, Human
gcaggggauagaaauggucug

SEQ ID NO: 79854 - RNA, 22 nt, Human
gcaggggcugcugggaacucgg

SEQ ID NO: 79855 - RNA, 22 nt, Human
gcagggguagagauugcuggug

SEQ ID NO: 79856 - RNA, 22 nt, Human
gcagggguuuucugacuugagu

SEQ ID NO: 79857 - RNA, 22 nt, Human
gcaggguaggugacagguaguc

SEQ ID NO: 79858 - RNA, 22 nt, Human
ggagauggucuguucucauauu

SEQ ID NO: 79859 - RNA, 22 nt, Human
ggagcaaaugccaagugggagg

SEQ ID NO: 79860 - RNA, 22 nt, Human
ggagcacaccgggagcuugccu

SEQ ID NO: 79861 - RNA, 22 nt, Human
ggagcaccaaaguaacuagcac

SEQ ID NO: 79862 - RNA, 22 nt, Human
ggagcagacauaaccuuacaga

SEQ ID NO: 79863 - RNA, 22 nt, Human
ggagcagagcugggcuuggcug

SEQ ID NO: 79864 - RNA, 22 nt, Human
ggagcaggcucugugguuucca

SEQ ID NO: 79865 - RNA, 22 nt, Human
ggagccagagcacuggggagcc

SEQ ID NO: 79866 - RNA, 22 nt, Human
ggagccaggggaccuucacaga

SEQ ID NO: 79867 - RNA, 18 nt, Human
ggagccagucugucucug

SEQ ID NO: 79868 - RNA, 22 nt, Human
ggagccaguuuagaccucaguu

SEQ ID NO: 79869 - RNA, 18 nt, Human
ggagcccagaggacagga

SEQ ID NO: 79870 - RNA, 22 nt, Human
ggagcccagguuguuugugcag

SEQ ID NO: 79871 - RNA, 22 nt, Human
ggagcccuucuauuccauggag

SEQ ID NO: 79872 - RNA, 22 nt, Human
cuuggggcugucacucuggcau

SEQ ID NO: 79873 - RNA, 22 nt, Human
cuugggucacaacucugaggug

SEQ ID NO: 79874 - RNA, 22 nt, Human
cuugggugcucagggaaagcuu

SEQ ID NO: 79875 - RNA, 22 nt, Human
cuugggugugaccuuggcauug

SEQ ID NO: 79876 - RNA, 22 nt, Human
cuuggucaugcaagauaucgau

SEQ ID NO: 79877 - RNA, 22 nt, Human
cuuggucauuucuuguccuguu

SEQ ID NO: 79878 - RNA, 22 nt, Human
cuuggucauuuggggcugcuau

SEQ ID NO: 79879 - RNA, 22 nt, Human
cuuggucucuuuaccggagugu

SEQ ID NO: 79880 - RNA, 22 nt, Human
cuuggugccacagcagcuugcg

SEQ ID NO: 79881 - RNA, 19 nt, Human
cuugguuaugguaugaugc

SEQ ID NO: 79882 - RNA, 22 nt, Human
cuuguaauggcagagaccuguc

SEQ ID NO: 79883 - RNA, 22 nt, Human
cuuguacacucaguacuucuag

SEQ ID NO: 79884 - RNA, 22 nt, Human
cuuguacaggauauuauaggcu

SEQ ID NO: 79885 - RNA, 22 nt, Human
cuuguacaucacuggcagaugg

SEQ ID NO: 79886 - RNA, 22 nt, Human
cuuguagaauugaaauggucuc

SEQ ID NO: 79887 - RNA, 22 nt, Human
cuuguagcugcuucuucugaag

SEQ ID NO: 79888 - RNA, 22 nt, Human
cuuguauagggaaagauaaauc

SEQ ID NO: 79889 - RNA, 23 nt, Human
cuuguauucacucauuugggaac

SEQ ID NO: 79890 - RNA, 22 nt, Human
cuuguauucuuguaccuuucaa

SEQ ID NO: 79891 - RNA, 22 nt, Human
cuuguauugcaaacuggccagg

SEQ ID NO: 79892 - RNA, 22 nt, Human
cuugucacucuggcuccagagc

SEQ ID NO: 79893 - RNA, 22 nt, Human
cuugucuaguuccuggugaugu

SEQ ID NO: 79894 - RNA, 22 nt, Human
cuugucugcuauaaaaauccag

SEQ ID NO: 79895 - RNA, 22 nt, Human
cuugucugggcagcuugggagu

SEQ ID NO: 79896 - RNA, 22 nt, Human
cuugucugugucggauaaaacu

SEQ ID NO: 79897 - RNA, 22 nt, Human
cuugugauugagaaagucuaaa

SEQ ID NO: 79898 - RNA, 22 nt, Human
cuugugcaaauccucgagcaca

SEQ ID NO: 79899 - RNA, 22 nt, Human
cuugugcaauugacauugaauc

SEQ ID NO: 79900 - RNA, 22 nt, Human
cuugugcagccuccucuugcag

SEQ ID NO: 79901 - RNA, 19 nt, Human
cuugugcaguucacgcuca

SEQ ID NO: 79902 - RNA, 22 nt, Human
cuuguggagauauccaugucug

SEQ ID NO: 79903 - RNA, 22 nt, Human
cuuguggcagguggauggugcc

SEQ ID NO: 79904 - RNA, 22 nt, Human
cuuguggccaauguuuguuaua

SEQ ID NO: 79905 - RNA, 22 nt, Human
cuuguuaaauuauauaagcaga

SEQ ID NO: 79906 - RNA, 22 nt, Human
cuuguuaucuccguguccuugu

SEQ ID NO: 79907 - RNA, 22 nt, Human
cuuguucaguugccucuccugc

SEQ ID NO: 79908 - RNA, 22 nt, Human
cuuguucaucugcauaccaagu

SEQ ID NO: 79909 - RNA, 22 nt, Human
cuuguuuaaauaagauagcagu

SEQ ID NO: 79910 - RNA, 22 nt, Human
cuuguuuauuaugcacuguaga

SEQ ID NO: 79911 - RNA, 22 nt, Human
cuuguuuuaaacuguuguggcu

SEQ ID NO: 79912 - RNA, 22 nt, Human
cuuguuuucuucugcagucuau

SEQ ID NO: 79913 - RNA, 22 nt, Human
cuuguuuuuaagagauguuuac

SEQ ID NO: 79914 - RNA, 22 nt, Human
cuuuacaaacuauaaagugcgg

SEQ ID NO: 79915 - RNA, 22 nt, Human
cuuuacaaccuaaguugaagcu

SEQ ID NO: 79916 - RNA, 22 nt, Human
cuuuacaauucaagggaacucu

SEQ ID NO: 79917 - RNA, 22 nt, Human
cuuuacacaugagaccugcaau

SEQ ID NO: 79918 - RNA, 22 nt, Human
cuuuacacuuggacccacacuu

SEQ ID NO: 79919 - RNA, 22 nt, Human
cuuuacagauaggaacuacuca

SEQ ID NO: 79920 - RNA, 22 nt, Human
cuuuacagauggauaauuguuu

SEQ ID NO: 79921 - RNA, 22 nt, Human
cuuuacagugaacuugcuuguc

SEQ ID NO: 79922 - RNA, 22 nt, Human
cuuuacauaaggauaaaccugg

SEQ ID NO: 79923 - RNA, 22 nt, Human
cuuuacugccaugcauuuauaa

SEQ ID NO: 79924 - RNA, 22 nt, Human
cuuuacuugcuuuguuacaaaa

SEQ ID NO: 79925 - RNA, 22 nt, Human
cuuuagacauacagaauuucca

SEQ ID NO: 79926 - RNA, 22 nt, Human
cuuuagauggcuuaggaggccc

SEQ ID NO: 79927 - RNA, 22 nt, Human
cuuuagguuuugccugagaucu

SEQ ID NO: 79928 - RNA, 22 nt, Human
cuuuaguugucuccucaagggu

SEQ ID NO: 79929 - RNA, 22 nt, Human
cuuuaguuugcuguccccuggg

SEQ ID NO: 79930 - RNA, 22 nt, Human
cuuuaguuuguaagagcaagag

SEQ ID NO: 79931 - RNA, 22 nt, Human
cuuuaugguaaguauagaugac

SEQ ID NO: 79932 - RNA, 22 nt, Human
cuuuauguacuguguauuugaa

SEQ ID NO: 79933 - RNA, 22 nt, Human
cuuuauuagauguagacuuucu

SEQ ID NO: 79934 - RNA, 22 nt, Human
cuuucaaagaccuuggcauggg

SEQ ID NO: 79935 - RNA, 22 nt, Human
cuuucacagcugugcuuaugau

SEQ ID NO: 79936 - RNA, 22 nt, Human
cuuucagaagaggaccuuucca

SEQ ID NO: 79937 - RNA, 22 nt, Human
cuuucagggcaacacuucuuuu

SEQ ID NO: 79938 - RNA, 18 nt, Human
cuuucaguaauuucagcc

SEQ ID NO: 79939 - RNA, 22 nt, Human
cuuucagucaguuaacucagaa

SEQ ID NO: 79940 - RNA, 22 nt, Human
cuuucaguuaguaccuaguggc

SEQ ID NO: 79941 - RNA, 22 nt, Human
cuuucauaagggguuuuauaau

SEQ ID NO: 79942 - RNA, 22 nt, Human
cuuucauaguuaaaauaguuug

SEQ ID NO: 79943 - RNA, 22 nt, Human
cuuucaugcacuucuuuagauc

SEQ ID NO: 79944 - RNA, 22 nt, Human
cuuucauucuuagauauuagug

SEQ ID NO: 79945 - RNA, 22 nt, Human
cuuuccagaccuccuuguagcu

SEQ ID NO: 79946 - RNA, 22 nt, Human
cuuuccagauuuguccaguuau

SEQ ID NO: 79947 - RNA, 22 nt, Human
cuuuccagcauuuccuugugaa

SEQ ID NO: 79948 - RNA, 22 nt, Human
cuuucccuuuugccuugcgugg

SEQ ID NO: 79949 - RNA, 22 nt, Human
cuuuccuagaaauauauacuua

SEQ ID NO: 79950 - RNA, 22 nt, Human
cuuuccuaguuggucccagcac

SEQ ID NO: 79951 - RNA, 22 nt, Human
cuuuccugaaaucucuucugca

SEQ ID NO: 79952 - RNA, 22 nt, Human
cuuuccugaggaguauggcugu

SEQ ID NO: 79953 - RNA, 22 nt, Human
cuuuccugccuuauucauucau

SEQ ID NO: 79954 - RNA, 22 nt, Human
cuuuccuggcuggcaguugugg

SEQ ID NO: 79955 - RNA, 22 nt, Human
cuuucucaaugccggaaggcac

SEQ ID NO: 79956 - RNA, 22 nt, Human
cuuucucuucagcacccagccc

SEQ ID NO: 79957 - RNA, 22 nt, Human
cuuucugaaagacauuuuaacu

SEQ ID NO: 79958 - RNA, 22 nt, Human
cuuucuuaauuuuuaaggacac

SEQ ID NO: 79959 - RNA, 22 nt, Human
cuuucuuauaccugucagggcc

SEQ ID NO: 79960 - RNA, 22 nt, Human
cuuucuuuguccaccaacaaug

SEQ ID NO: 79961 - RNA, 22 nt, Human
cuuugaaaacuuaaauaacagc

SEQ ID NO: 79962 - RNA, 22 nt, Human
cuuugaaagcucccaggacuua

SEQ ID NO: 79963 - RNA, 22 nt, Human
cuuugaaauucuucagcugaag

SEQ ID NO: 79964 - RNA, 22 nt, Human
cuuugaauuccaguacaauaac

SEQ ID NO: 79965 - RNA, 19 nt, Human
cuuugcaaagcccugugua

SEQ ID NO: 79966 - RNA, 22 nt, Human
cuuugcagcaauuucuguuaaa

SEQ ID NO: 79967 - RNA, 22 nt, Human
cuugccuucuguuccuauagaa

SEQ ID NO: 79968 - RNA, 22 nt, Human
cuugcuacuaugccuggcuaau

SEQ ID NO: 79969 - RNA, 22 nt, Human
cuugcucauuaaguagcucaca

SEQ ID NO: 79970 - RNA, 22 nt, Human
cuugcugagauaaaugcugucu

SEQ ID NO: 79971 - RNA, 22 nt, Human
cuugcugcucuggagucaugcc

SEQ ID NO: 79972 - RNA, 22 nt, Human
cuugcugcugcaucugagcaug

SEQ ID NO: 79973 - RNA, 22 nt, Human
cuugcuggugucgugccuucac

SEQ ID NO: 79974 - RNA, 22 nt, Human
cuugcugugugccaucagggcu

SEQ ID NO: 79975 - RNA, 22 nt, Human
cuugcuguuuucuacccucaag

SEQ ID NO: 79976 - RNA, 22 nt, Human
cuugcuucauuagugucuuagu

SEQ ID NO: 79977 - RNA, 22 nt, Human
cuugcuuggagaagagaucagu

SEQ ID NO: 79978 - RNA, 22 nt, Human
cuugcuuuccaaaugacucacu

SEQ ID NO: 79979 - RNA, 22 nt, Human
cuuggaacaaauuaaacaauac

SEQ ID NO: 79980 - RNA, 22 nt, Human
cuuggaaggacgggcuguaucu

SEQ ID NO: 79981 - RNA, 22 nt, Human
cuuggacuggacccgaggaaug

SEQ ID NO: 79982 - RNA, 22 nt, Human
cuuggagaaugacaguggauua

SEQ ID NO: 79983 - RNA, 22 nt, Human
cuuggagaccagugacauugcu

SEQ ID NO: 79984 - RNA, 22 nt, Human
cuuggagauucauugccugaaa

SEQ ID NO: 79985 - RNA, 22 nt, Human
cuuggagcaacacaugacaucu

SEQ ID NO: 79986 - RNA, 22 nt, Human
cuuggaggaaaggcagggagac

SEQ ID NO: 79987 - RNA, 22 nt, Human
cuuggaggaugugcggcugccc

SEQ ID NO: 79988 - RNA, 22 nt, Human
cuuggagugaaugggggcaggu

SEQ ID NO: 79989 - RNA, 22 nt, Human
cuuggauucauugugggaggga

SEQ ID NO: 79990 - RNA, 22 nt, Human
cuuggcaccaccaaguggccau

SEQ ID NO: 79991 - RNA, 22 nt, Human
gaagcuaaugagauaaaugcca

SEQ ID NO: 79992 - RNA, 22 nt, Human
gaagcuccguacuaugacuuuu

SEQ ID NO: 79993 - RNA, 22 nt, Human
gaagcugaugaggaccagauug

SEQ ID NO: 79994 - RNA, 22 nt, Human
gaagcuuaauuaugaccagcug

SEQ ID NO: 79995 - RNA, 22 nt, Human
gaaggaaaaauacucuguaagg

SEQ ID NO: 79996 - RNA, 22 nt, Human
gaaggaaaggucucaugccuuu

SEQ ID NO: 79997 - RNA, 20 nt, Human
gaaggaagggggcaagguga

SEQ ID NO: 79998 - RNA, 22 nt, Human
gaaggaagugcucauacuaguu

SEQ ID NO: 79999 - RNA, 22 nt, Human
gaaggagagaaaggcaauucug

SEQ ID NO: 80000 - RNA, 19 nt, Human
gaaggagagcugaguuagg

SEQ ID NO: 80001 - RNA, 22 nt, Human
gaaggaggcguuagcccuagga

SEQ ID NO: 80002 - RNA, 22 nt, Human
gaaggagggagcggcgcggauu

SEQ ID NO: 80003 - RNA, 22 nt, Human
gaaggaggucugcauucuacag

SEQ ID NO: 80004 - RNA, 22 nt, Human
gaaggaggugucaguuggacug

SEQ ID NO: 80005 - RNA, 22 nt, Human
gaaggcaacaccaggaugcacu

SEQ ID NO: 80006 - RNA, 22 nt, Human
gaaggcaagaucucaguggagg

SEQ ID NO: 80007 - RNA, 22 nt, Human
gaaggcaagcuuuggauaugag

SEQ ID NO: 80008 - RNA, 22 nt, Human
gaaggcacagauggcaguccac

SEQ ID NO: 80009 - RNA, 22 nt, Human
gaaggcaggcuucugauuaggu

SEQ ID NO: 80010 - RNA, 22 nt, Human
gaaggcaucacagaggcuguga

SEQ ID NO: 80011 - RNA, 22 nt, Human
gaaggcauucuauucuacauau

SEQ ID NO: 80012 - RNA, 22 nt, Human
gaaggccacaaaaaaugucaua

SEQ ID NO: 80013 - RNA, 22 nt, Human
gaaggccauuagagccugugcc

SEQ ID NO: 80014 - RNA, 22 nt, Human
gaaggcccgcccugagcaaggg

SEQ ID NO: 80015 - RNA, 22 nt, Human
gaaggcccuguuuucccuauuu

SEQ ID NO: 80016 - RNA, 22 nt, Human
gaaggccuaggaaggaagccuu

SEQ ID NO: 80017 - RNA, 22 nt, Human
gaaggccuagggaugcucugcg

SEQ ID NO: 80018 - RNA, 22 nt, Human
gaaggcuguggcuggucucagu

SEQ ID NO: 80019 - RNA, 22 nt, Human
gaaggcuucccaccugauauuu

SEQ ID NO: 80020 - RNA, 20 nt, Human
gaaggcuuggacagugacag

SEQ ID NO: 80021 - RNA, 22 nt, Human
gaaggcuugguuuuuucaacac

SEQ ID NO: 80022 - RNA, 19 nt, Human
gaaggcuuuugguauguuu

SEQ ID NO: 80023 - RNA, 22 nt, Human
gaagggcuuucugggagaagag

SEQ ID NO: 80024 - RNA, 22 nt, Human
gaaggggaaaguugagcaaaua

SEQ ID NO: 80025 - RNA, 22 nt, Human
gaagggugugugugagggacac

SEQ ID NO: 80026 - RNA, 22 nt, Human
gaagguccagcguggccaaguc

SEQ ID NO: 80027 - RNA, 22 nt, Human
gaaggugcaguggcuggaggcu

SEQ ID NO: 80028 - RNA, 22 nt, Human
gaagguggcgagcggauugcug

SEQ ID NO: 80029 - RNA, 22 nt, Human
gaaggugucagcaagucaaagc

SEQ ID NO: 80030 - RNA, 22 nt, Human
gaagguguccaucaccaacugu

SEQ ID NO: 80031 - RNA, 22 nt, Human
gaagguucuguguacacuacuu

SEQ ID NO: 80032 - RNA, 22 nt, Human
gaagguuugaaauagguauaga

SEQ ID NO: 80033 - RNA, 22 nt, Human
gaagguuuugauuccacugaau

SEQ ID NO: 80034 - RNA, 22 nt, Human
gaaguagaaaacucaguuucaa

SEQ ID NO: 80035 - RNA, 22 nt, Human
gaaguauaugucuuuaaucuau

SEQ ID NO: 80036 - RNA, 22 nt, Human
gaaguauuauagcauauuagcc

SEQ ID NO: 80037 - RNA, 22 nt, Human
gaagucagaaaagaauuaggga

SEQ ID NO: 80038 - RNA, 22 nt, Human
gaagucauccacuaugggggag

SEQ ID NO: 80039 - RNA, 22 nt, Human
gaagucugacucuuuguaagcu

SEQ ID NO: 80040 - RNA, 22 nt, Human
gaagucuguggguucaaaggca

SEQ ID NO: 80041 - RNA, 22 nt, Human
gaagucuugaagagcacuguaa

SEQ ID NO: 80042 - RNA, 22 nt, Human
gaagucuuuuagcaaaacgaac

SEQ ID NO: 80043 - RNA, 18 nt, Human
gaagugaagugacucaau

SEQ ID NO: 80044 - RNA, 22 nt, Human
gaagugacagaagggaugggca

SEQ ID NO: 80045 - RNA, 22 nt, Human
gaagugaugacgcuguguuuuu

SEQ ID NO: 80046 - RNA, 22 nt, Human
gaagugcaaaaccacaugguaa

SEQ ID NO: 80047 - RNA, 22 nt, Human
gaaguggggaagcaacaggaga

SEQ ID NO: 80048 - RNA, 22 nt, Human
gaaguggguggugauaucacug

SEQ ID NO: 80049 - RNA, 22 nt, Human
gaaguguuguaucuuuuuaaua

SEQ ID NO: 80050 - RNA, 22 nt, Human
gaaguguuuaagucuucuuugu

SEQ ID NO: 80051 - RNA, 22 nt, Human
gaaguuaccgaaccucuccaug

SEQ ID NO: 80052 - RNA, 22 nt, Human
gaaguuacucucguuaaauaug

SEQ ID NO: 80053 - RNA, 22 nt, Human
gaaguuaggcuuuccuaugcuu

SEQ ID NO: 80054 - RNA, 22 nt, Human
gaaguuaguguggaugcaggga

SEQ ID NO: 80055 - RNA, 22 nt, Human
gaaguuauaaacuuuuccuccc

SEQ ID NO: 80056 - RNA, 22 nt, Human
gaaguuauuuuaccuguuaaag

SEQ ID NO: 80057 - RNA, 22 nt, Human
gaaguuccagugauauaaaacu

SEQ ID NO: 80058 - RNA, 22 nt, Human
gaaguucugaaauaaaauccug

SEQ ID NO: 80059 - RNA, 22 nt, Human
gaaguucugaccauauggccaa

SEQ ID NO: 80060 - RNA, 22 nt, Human
gaaguucuuagucucauuugca

SEQ ID NO: 80061 - RNA, 22 nt, Human
gaaguucuuaugaaaacuugag

SEQ ID NO: 80062 - RNA, 23 nt, Human
gaaguucuuucuucucaugcugu

SEQ ID NO: 80063 - RNA, 22 nt, Human
gaaguuuaccucugccuugcuu

SEQ ID NO: 80064 - RNA, 22 nt, Human
gaaguuuauggugcuuguaagg

SEQ ID NO: 80065 - RNA, 22 nt, Human
gaaguuuuuguagagacagggu

SEQ ID NO: 80066 - RNA, 22 nt, Human
gaauaagugaaguuggcagcuu

SEQ ID NO: 80067 - RNA, 23 nt, Human
gaauacagagauaaauagaacac

SEQ ID NO: 80068 - RNA, 22 nt, Human
gaauacaugauuaaaguuugau

SEQ ID NO: 80069 - RNA, 22 nt, Human
gaauacauggcagggagucauc

SEQ ID NO: 80070 - RNA, 22 nt, Human
gaauacauguguguauagaggu

SEQ ID NO: 80071 - RNA, 22 nt, Human
gaauacauguuguuucccugga

SEQ ID NO: 80072 - RNA, 22 nt, Human
gaauagauauccuugagggucu

SEQ ID NO: 80073 - RNA, 22 nt, Human
gaauaguucuauggcugcaggg

SEQ ID NO: 80074 - RNA, 23 nt, Human
gaauaguuuuagaaauuggagaa

SEQ ID NO: 80075 - RNA, 22 nt, Human
gaauauaggaccucugggaaca

SEQ ID NO: 80076 - RNA, 22 nt, Human
ggcagugcaaggcagccuggau

SEQ ID NO: 80077 - RNA, 22 nt, Human
ggcaguggcauguggguagugg

SEQ ID NO: 80078 - RNA, 22 nt, Human
ggcaguggcuguagucucuugg

SEQ ID NO: 80079 - RNA, 22 nt, Human
ggcaguggguggaucucaggga

SEQ ID NO: 80080 - RNA, 22 nt, Human
ggcaguggugggaggcucgcuc

SEQ ID NO: 80081 - RNA, 22 nt, Human
ggcaguguccagcuuccuggag

SEQ ID NO: 80082 - RNA, 22 nt, Human
ggcaguguggcauaacauguag

SEQ ID NO: 80083 - RNA, 22 nt, Human
ggcaguguggccugaguaaguc

SEQ ID NO: 80084 - RNA, 22 nt, Human
ggcaguguuauuuuucagaaau

SEQ ID NO: 80085 - RNA, 22 nt, Human
ggcaguguuccagaccuucacc

SEQ ID NO: 80086 - RNA, 22 nt, Human
ggcaguucucagccaaggcaau

SEQ ID NO: 80087 - RNA, 22 nt, Human
ggcaguuucaucaggagaaaag

SEQ ID NO: 80088 - RNA, 22 nt, Human
ggcaguuuuaacagagguagua

SEQ ID NO: 80089 - RNA, 22 nt, Human
ggcauagauuucuuuagguuua

SEQ ID NO: 80090 - RNA, 22 nt, Human
ggcauagcggcucagcguccag

SEQ ID NO: 80091 - RNA, 22 nt, Human
ggcauauguagcguguguucug

SEQ ID NO: 80092 - RNA, 22 nt, Human
ggcaucaggaucugucuugcuu

SEQ ID NO: 80093 - RNA, 22 nt, Human
ggcauccaguucugaucaacaa

SEQ ID NO: 80094 - RNA, 20 nt, Human
ggcauccuuuuggucacagc

SEQ ID NO: 80095 - RNA, 21 nt, Human
ggcaucucuuaguaucaccau

SEQ ID NO: 80096 - RNA, 18 nt, Human
ggcaucugcacagcagcc

SEQ ID NO: 80097 - RNA, 22 nt, Human
ggcaucuggaucugcuucuccc

SEQ ID NO: 80098 - RNA, 22 nt, Human
ggcaugagagguccuggggauu

SEQ ID NO: 80099 - RNA, 22 nt, Human
ggcaugagcacgaagugguacc

SEQ ID NO: 80100 - RNA, 22 nt, Human
ggcaugaguaacgugagugagg

SEQ ID NO: 80101 - RNA, 23 nt, Human
ggcaugcaauggacagagcugga

SEQ ID NO: 80102 - RNA, 22 nt, Human
ggcaugcucuuuguccacagua

SEQ ID NO: 80103 - RNA, 22 nt, Human
ggcaugcuucugagaugucucc

SEQ ID NO: 80104 - RNA, 22 nt, Human
ggcaugcuugccaugggccagu

SEQ ID NO: 80105 - RNA, 21 nt, Human
ggcauggcaccucugggcagg

SEQ ID NO: 80106 - RNA, 22 nt, Human
ggcauggcucggagucagaaca

SEQ ID NO: 80107 - RNA, 22 nt, Human
ggcauggcuggguucuggugag

SEQ ID NO: 80108 - RNA, 22 nt, Human
ggcaugggagugagcaaccuua

SEQ ID NO: 80109 - RNA, 19 nt, Human
ggcauggucggaagagcuc

SEQ ID NO: 80110 - RNA, 22 nt, Human
ggcauguaugugcauuuuugua

SEQ ID NO: 80111 - RNA, 22 nt, Human
ggcaugugccugaggucacaca

SEQ ID NO: 80112 - RNA, 22 nt, Human
ggcauguuguuuauguuucugg

SEQ ID NO: 80113 - RNA, 22 nt, Human
ggcauguuucaucacaucaaga

SEQ ID NO: 80114 - RNA, 22 nt, Human
ggcauuuagagggcuuuucuga

SEQ ID NO: 80115 - RNA, 22 nt, Human
ggcauuuaguuuucauauucug

SEQ ID NO: 80116 - RNA, 20 nt, Human
ggcauuuaugaaccaagccu

SEQ ID NO: 80117 - RNA, 22 nt, Human
ggcauuugacucagugacuggg

SEQ ID NO: 80118 - RNA, 22 nt, Human
ggccaaaccgcaauuauuuuug

SEQ ID NO: 80119 - RNA, 21 nt, Human
ggccaacauggucucaucucu

SEQ ID NO: 80120 - RNA, 22 nt, Human
ggccacaacuugcuccuagccc

SEQ ID NO: 80121 - RNA, 21 nt, Human
ggccacaagcggaggagccgc

SEQ ID NO: 80122 - RNA, 22 nt, Human
ggccacaagugguccugagucc

SEQ ID NO: 80123 - RNA, 22 nt, Human
ggccacacagaugacugcuuuc

SEQ ID NO: 80124 - RNA, 22 nt, Human
ggccacagcagaugcuucagau

SEQ ID NO: 80125 - RNA, 22 nt, Human
gacugaggcuccccuaggcuca

SEQ ID NO: 80126 - RNA, 22 nt, Human
gacugagggacagggcagugga

SEQ ID NO: 80127 - RNA, 22 nt, Human
gacugagggauagaggugcuuc

SEQ ID NO: 80128 - RNA, 17 nt, Human
gacugagguaaggugag

SEQ ID NO: 80129 - RNA, 22 nt, Human
gacugaggugaccuaggacuac

SEQ ID NO: 80130 - RNA, 22 nt, Human
gacugcagugaaggcacauggg

SEQ ID NO: 80131 - RNA, 22 nt, Human
gacugcauaggaccaaauagua

SEQ ID NO: 80132 - RNA, 22 nt, Human
gacugccucaguuucccugcag

SEQ ID NO: 80133 - RNA, 22 nt, Human
gacugcuuauauguuaaagaua

SEQ ID NO: 80134 - RNA, 22 nt, Human
gacugcuuugaccaauagcaca

SEQ ID NO: 80135 - RNA, 22 nt, Human
gacuggaaucccaggcucugug

SEQ ID NO: 80136 - RNA, 21 nt, Human
gacuggagagaggaagucugg

SEQ ID NO: 80137 - RNA, 22 nt, Human
gacuggagauaaaaccaugagu

SEQ ID NO: 80138 - RNA, 22 nt, Human
gacuggagucaaugagcagcac

SEQ ID NO: 80139 - RNA, 22 nt, Human
gacuggcuuauuucacuuagca

SEQ ID NO: 80140 - RNA, 22 nt, Human
gacugguaaggaaauucacuaa

SEQ ID NO: 80141 - RNA, 22 nt, Human
gacugucuccugucaugaggga

SEQ ID NO: 80142 - RNA, 22 nt, Human
gacuguggcguagaugcuggga

SEQ ID NO: 80143 - RNA, 22 nt, Human
gacuguggcuaaugguguuagg

SEQ ID NO: 80144 - RNA, 22 nt, Human
gacugugggaagacuguagguu

SEQ ID NO: 80145 - RNA, 22 nt, Human
gacuguguccaugugcuggauu

SEQ ID NO: 80146 - RNA, 22 nt, Human
gacuuaaguggugugauaagug

SEQ ID NO: 80147 - RNA, 20 nt, Human
gacuucaauuucuaucuuuu

SEQ ID NO: 80148 - RNA, 22 nt, Human
gacuucaugugcaagcgcuuug

SEQ ID NO: 80149 - RNA, 20 nt, Human
gacuucccauaucuucuuca

SEQ ID NO: 80150 - RNA, 19 nt, Human
gacuucugauguccagaug

SEQ ID NO: 80151 - RNA, 22 nt, Human
gacuuuaaagguucugcugcuu

SEQ ID NO: 80152 - RNA, 22 nt, Human
gacuuuaaguccuaucugugcg

SEQ ID NO: 80153 - RNA, 22 nt, Human
gacuuuauaaaugagaggcgga

SEQ ID NO: 80154 - RNA, 22 nt, Human
gacuuuauuacuaacccuguga

SEQ ID NO: 80155 - RNA, 22 nt, Human
gacuuuccagguccugggcuau

SEQ ID NO: 80156 - RNA, 22 nt, Human
gacuuucugaaggucucgcagu

SEQ ID NO: 80157 - RNA, 22 nt, Human
gacuuucugauguaaacauuua

SEQ ID NO: 80158 - RNA, 21 nt, Human
gacuuucuuaccagauuuuug

SEQ ID NO: 80159 - RNA, 22 nt, Human
gacuuucuuguagugucugaug

SEQ ID NO: 80160 - RNA, 19 nt, Human
gacuuuggaaaugcuguuu

SEQ ID NO: 80161 - RNA, 17 nt, Human
gacuuuggaguuucaua

SEQ ID NO: 80162 - RNA, 22 nt, Human
gacuuugguucagggcucagag

SEQ ID NO: 80163 - RNA, 22 nt, Human
gacuuuguagguaauugugucu

SEQ ID NO: 80164 - RNA, 22 nt, Human
gacuuugugccaaacgccagaa

SEQ ID NO: 80165 - RNA, 18 nt, Human
gagaaaccugugaaugcu

SEQ ID NO: 80166 - RNA, 22 nt, Human
gagaaacugaauauuuaacggg

SEQ ID NO: 80167 - RNA, 22 nt, Human
gagaaacuuggaguuauucugg

SEQ ID NO: 80168 - RNA, 22 nt, Human
gagaaagaaagggaaguuuguu

SEQ ID NO: 80169 - RNA, 22 nt, Human
gagaaagacguaggcugggagg

SEQ ID NO: 80170 - RNA, 22 nt, Human
gagaaagauuguccuucagggg

SEQ ID NO: 80171 - RNA, 23 nt, Human
gagaaagccggcuaugauccugg

SEQ ID NO: 80172 - RNA, 22 nt, Human
gagaacacgaggaggcccagcg

SEQ ID NO: 80173 - RNA, 22 nt, Human
gagaacacuuauggauuauucu

SEQ ID NO: 80174 - RNA, 22 nt, Human
gagaacagaagcauuccuaauu

SEQ ID NO: 80175 - RNA, 22 nt, Human
gagaacagauuuuucugcuguc

SEQ ID NO: 80176 - RNA, 22 nt, Human
gagaacaguguuguauuuuuuc

SEQ ID NO: 80177 - RNA, 22 nt, Human
gagaaccuacuguauacuauau

SEQ ID NO: 80178 - RNA, 21 nt, Human
gagaacugaaccagagcagcu

SEQ ID NO: 80179 - RNA, 22 nt, Human
gagaagcaaucaguggccaccc

SEQ ID NO: 80180 - RNA, 22 nt, Human
gagaaggacuacacaucuggcc

SEQ ID NO: 80181 - RNA, 22 nt, Human
gagaaggacuacggaaaacaga

SEQ ID NO: 80182 - RNA, 22 nt, Human
gagaaggcuuccaaauucugug

SEQ ID NO: 80183 - RNA, 22 nt, Human
gagaagggauauggcuucuuga

SEQ ID NO: 80184 - RNA, 22 nt, Human
gagaagggggcucgaguguccu

SEQ ID NO: 80185 - RNA, 22 nt, Human
gagcagcuggacaggccucccu

SEQ ID NO: 80186 - RNA, 22 nt, Human
gagcagcuguccccaaagcuuc

SEQ ID NO: 80187 - RNA, 22 nt, Human
gagcagcuugcgcugucuucac

SEQ ID NO: 80188 - RNA, 22 nt, Human
gagcaggaacagaucccuugga

SEQ ID NO: 80189 - RNA, 19 nt, Human
gagcaggccacacaugugu

SEQ ID NO: 80190 - RNA, 22 nt, Human
gagcaggccagcaauggaaggg

SEQ ID NO: 80191 - RNA, 22 nt, Human
gagcaggcuugcagagaagggg

SEQ ID NO: 80192 - RNA, 17 nt, Human
gagcagggaugcgguuc

SEQ ID NO: 80193 - RNA, 22 nt, Human
gagcagggcuuguccuccucau

SEQ ID NO: 80194 - RNA, 22 nt, Human
gagcaggucuuucauggugcau

SEQ ID NO: 80195 - RNA, 22 nt, Human
gagcaguaggagaacccugagc

SEQ ID NO: 80196 - RNA, 22 nt, Human
gagcagugaagacagaaguaca

SEQ ID NO: 80197 - RNA, 20 nt, Human
gagcagugagccagggaaag

SEQ ID NO: 80198 - RNA, 22 nt, Human
gagcagugccaaagaauuugcg

SEQ ID NO: 80199 - RNA, 22 nt, Human
gagcaguggucacagggaggga

SEQ ID NO: 80200 - RNA, 22 nt, Human
gagcaguguuuguggaccugga

SEQ ID NO: 80201 - RNA, 22 nt, Human
gagcaucuccuaccuacuccuu

SEQ ID NO: 80202 - RNA, 22 nt, Human
gagcaucuggcuagaggaguga

SEQ ID NO: 80203 - RNA, 22 nt, Human
gagcaugagggaaggcagcaga

SEQ ID NO: 80204 - RNA, 22 nt, Human
gagcauggauagaaggugggau

SEQ ID NO: 80205 - RNA, 22 nt, Human
gagccaaaugugcagacauugu

SEQ ID NO: 80206 - RNA, 22 nt, Human
gagccaagcucuucuccaugag

SEQ ID NO: 80207 - RNA, 22 nt, Human
gagccacagacuguauuuggga

SEQ ID NO: 80208 - RNA, 22 nt, Human
gagccacagcaaccucaaagga

SEQ ID NO: 80209 - RNA, 22 nt, Human
gagccagagcuacaagugucug

SEQ ID NO: 80210 - RNA, 22 nt, Human
gagccagauuuuaugcaagaca

SEQ ID NO: 80211 - RNA, 22 nt, Human
gagccagcuacauggucugcaa

SEQ ID NO: 80212 - RNA, 22 nt, Human
gagccagcugagcugcacuguc

SEQ ID NO: 80213 - RNA, 22 nt, Human
gagccaggcaccuucuguguug

SEQ ID NO: 80214 - RNA, 22 nt, Human
gagccaggcccguacuugcugu

SEQ ID NO: 80215 - RNA, 22 nt, Human
gagccagggagggucugguaua

SEQ ID NO: 80216 - RNA, 22 nt, Human
gagccagggcugugagcugagc

SEQ ID NO: 80217 - RNA, 22 nt, Human
gagccaggggucagcuccgagg

SEQ ID NO: 80218 - RNA, 22 nt, Human
gagccaggucgggccgcggcga

SEQ ID NO: 80219 - RNA, 22 nt, Human
gagccagguuugaaucucaguc

SEQ ID NO: 80220 - RNA, 22 nt, Human
gagccauacaaccuauaaagug

SEQ ID NO: 80221 - RNA, 22 nt, Human
gagcccagcccagagccauaug

SEQ ID NO: 80222 - RNA, 22 nt, Human
gagcccaggaaguggaggcuga

SEQ ID NO: 80223 - RNA, 22 nt, Human
gagcccaguaggcaaagcugca

SEQ ID NO: 80224 - RNA, 22 nt, Human
gagcccagucugcuccugcgcc

SEQ ID NO: 80225 - RNA, 22 nt, Human
gagccccaggacagcucuaguu

SEQ ID NO: 80226 - RNA, 22 nt, Human
gagcccucgggcgagcccgcgc

SEQ ID NO: 80227 - RNA, 22 nt, Human
gagcccugauuugcagcauuug

SEQ ID NO: 80228 - RNA, 22 nt, Human
gagcccugcccacuugucugag

SEQ ID NO: 80229 - RNA, 22 nt, Human
gagcccugcggagccccgaggc

SEQ ID NO: 80230 - RNA, 22 nt, Human
gagcccugcgugucugggggca

SEQ ID NO: 80231 - RNA, 22 nt, Human
gagcccugugauucuguugugu

SEQ ID NO: 80232 - RNA, 22 nt, Human
gagccgaggcgcacagcucggg

SEQ ID NO: 80233 - RNA, 22 nt, Human
gagccugagcaaugugauguuu

SEQ ID NO: 80234 - RNA, 22 nt, Human
gagccugcagcuuucacagcau

SEQ ID NO: 80235 - RNA, 22 nt, Human
gagccuggacaucucaggccca

SEQ ID NO: 80236 - RNA, 22 nt, Human
gagccuggauugucaccgacuu

SEQ ID NO: 80237 - RNA, 22 nt, Human
gagccugggacugggggucaug

SEQ ID NO: 80238 - RNA, 22 nt, Human
gagccuucaucgcagccuuguu

SEQ ID NO: 80239 - RNA, 20 nt, Human
gagccuuccccucaccacug

SEQ ID NO: 80240 - RNA, 22 nt, Human
gagccuuugaagcccucagaga

SEQ ID NO: 80241 - RNA, 22 nt, Human
gagcggaggcuuggaggccagc

SEQ ID NO: 80242 - RNA, 22 nt, Human
gagcuaaguuucuggaggcaga

SEQ ID NO: 80243 - RNA, 22 nt, Human
gacccugguguccagguccugc

SEQ ID NO: 80244 - RNA, 22 nt, Human
gacccuuucugagugagcaguu

SEQ ID NO: 80245 - RNA, 22 nt, Human
gacccuuuucagacucagguac

SEQ ID NO: 80246 - RNA, 22 nt, Human
gaccucagauuuucccaggcca

SEQ ID NO: 80247 - RNA, 22 nt, Human
gaccucagcuguggggaugcug

SEQ ID NO: 80248 - RNA, 22 nt, Human
gaccucaguauuguucaggaug

SEQ ID NO: 80249 - RNA, 22 nt, Human
gaccucagugaauggucaugua

SEQ ID NO: 80250 - RNA, 16 nt, Human
gaccucagugcuggcu

SEQ ID NO: 80251 - RNA, 22 nt, Human
gaccucugaaggcagagcaggg

SEQ ID NO: 80252 - RNA, 22 nt, Human
gaccuggaaugaagggucccuc

SEQ ID NO: 80253 - RNA, 22 nt, Human
gaccuggcauauucauuggcac

SEQ ID NO: 80254 - RNA, 22 nt, Human
gaccugggguaagcuuggcaac

SEQ ID NO: 80255 - RNA, 20 nt, Human
gaccugugucugggaugcgg

SEQ ID NO: 80256 - RNA, 22 nt, Human
gaccuuagaacgugacacaaga

SEQ ID NO: 80257 - RNA, 22 nt, Human
gaccuuccaugccuucuuccaa

SEQ ID NO: 80258 - RNA, 22 nt, Human
gacggcagaaacucaugagguc

SEQ ID NO: 80259 - RNA, 19 nt, Human
gacuacagggggaagaagu

SEQ ID NO: 80260 - RNA, 22 nt, Human
gacuacucaaacuuucucuaua

SEQ ID NO: 80261 - RNA, 22 nt, Human
gacuauugcacacuucucucac

SEQ ID NO: 80262 - RNA, 22 nt, Human
gacuauuucccucaucaucuuc

SEQ ID NO: 80263 - RNA, 22 nt, Human
gacucagagaucccuggagguc

SEQ ID NO: 80264 - RNA, 22 nt, Human
gacuccagcauauacuuuuagu

SEQ ID NO: 80265 - RNA, 22 nt, Human
gacucccaagcuuggaggaagg

SEQ ID NO: 80266 - RNA, 22 nt, Human
gacuccucagucacccucagcu

SEQ ID NO: 80267 - RNA, 22 nt, Human
gacuccuggcuuucccucuuag

SEQ ID NO: 80268 - RNA, 22 nt, Human
gacucucaagcacaaguccacc

SEQ ID NO: 80269 - RNA, 22 nt, Human
gacucugggaguuuaugugauu

SEQ ID NO: 80270 - RNA, 22 nt, Human
gacucugggcugagccagggcc

SEQ ID NO: 80271 - RNA, 21 nt, Human
gacucuggggucagcucaacc

SEQ ID NO: 80272 - RNA, 22 nt, Human
gacucuuucccugugacagagu

SEQ ID NO: 80273 - RNA, 22 nt, Human
gacugaaagcuuggaauguucc

SEQ ID NO: 80274 - RNA, 22 nt, Human
gacugaaauuauaccaaguggu

SEQ ID NO: 80275 - RNA, 22 nt, Human
gacugaaccucaaauuuggcuc

SEQ ID NO: 80276 - RNA, 22 nt, Human
gacugagaaacaguacauuacc

SEQ ID NO: 80277 - RNA, 22 nt, Human
gacugagcuucugcaacacugg

SEQ ID NO: 80278 - RNA, 22 nt, Human
gacugagguauuaagauggcuu

SEQ ID NO: 80279 - RNA, 22 nt, Human
gacugaggugcccagaggugac

SEQ ID NO: 80280 - RNA, 22 nt, Human
gacugcaaccuuagacuagaaa

SEQ ID NO: 80281 - RNA, 22 nt, Human
gacugcaagucugggaaaggag

SEQ ID NO: 80282 - RNA, 22 nt, Human
gacuggacucugaagaugggug

SEQ ID NO: 80283 - RNA, 22 nt, Human
gacuggccuggagaugcagcug

SEQ ID NO: 80284 - RNA, 22 nt, Human
gacuggcucuaucaggauaaau

SEQ ID NO: 80285 - RNA, 22 nt, Human
gacuggcucuaucuccuuggcg

SEQ ID NO: 80286 - RNA, 22 nt, Human
gacugggaggguucagcugggu

SEQ ID NO: 80287 - RNA, 22 nt, Human
gacugggguaaggugaggaggu

SEQ ID NO: 80288 - RNA, 22 nt, Human
gacuguccagaauuccuaggug

SEQ ID NO: 80289 - RNA, 22 nt, Human
gacugucucugugaaugguagg

SEQ ID NO: 80290 - RNA, 22 nt, Human
gacugucuuuugaauaaaaaug

SEQ ID NO: 80291 - RNA, 22 nt, Human
gacugugacuucugaagcaaua

SEQ ID NO: 80292 - RNA, 22 nt, Human
gacuguggacucucaugauaga

SEQ ID NO: 80293 - RNA, 22 nt, Human
gacuguggcugcguguaaggaa

SEQ ID NO: 80294 - RNA, 22 nt, Human
gagagggagccagccaggaacc

SEQ ID NO: 80295 - RNA, 22 nt, Human
gagagggccgggggccagcucc

SEQ ID NO: 80296 - RNA, 22 nt, Human
gagagggcucuguguggguacu

SEQ ID NO: 80297 - RNA, 22 nt, Human
gagaggggcccaagccacauag

SEQ ID NO: 80298 - RNA, 22 nt, Human
gagaggggcgcgcagcucgcga

SEQ ID NO: 80299 - RNA, 22 nt, Human
gagaggucaucucccaucagca

SEQ ID NO: 80300 - RNA, 22 nt, Human
gagagucuagugcaccuaguuu

SEQ ID NO: 80301 - RNA, 22 nt, Human
gagagucugguagagcagcaag

SEQ ID NO: 80302 - RNA, 22 nt, Human
gagagugauucccucccauaga

SEQ ID NO: 80303 - RNA, 22 nt, Human
gagaguggaaagcaagcugagu

SEQ ID NO: 80304 - RNA, 22 nt, Human
gagagugucuggaggaagcuaa

SEQ ID NO: 80305 - RNA, 22 nt, Human
gagaguuaguugagcagucuga

SEQ ID NO: 80306 - RNA, 22 nt, Human
gagaguucuaccucugaaggcg

SEQ ID NO: 80307 - RNA, 22 nt, Human
gagauaaagcuaccauguugau

SEQ ID NO: 80308 - RNA, 22 nt, Human
gagauaacucuaggucuucgag

SEQ ID NO: 80309 - RNA, 22 nt, Human
gagauauaaccuaaaggucacu

SEQ ID NO: 80310 - RNA, 22 nt, Human
gagauauuuauucauacuguca

SEQ ID NO: 80311 - RNA, 22 nt, Human
gagaucaucuuuuuuagauucc

SEQ ID NO: 80312 - RNA, 17 nt, Human
gagaugcuaaucugauc

SEQ ID NO: 80313 - RNA, 22 nt, Human
gagaugcuauggcuauuccccu

SEQ ID NO: 80314 - RNA, 22 nt, Human
gagaugcuuuugguccaagagu

SEQ ID NO: 80315 - RNA, 21 nt, Human
gagaugcuuuuuauucaaccc

SEQ ID NO: 80316 - RNA, 22 nt, Human
gagauggaaaacugcugguagu

SEQ ID NO: 80317 - RNA, 20 nt, Human
gagauggacagaugaagggg

SEQ ID NO: 80318 - RNA, 22 nt, Human
gagauggagaaggaagcuguuu

SEQ ID NO: 80319 - RNA, 22 nt, Human
gagauggcucucagaucuuuga

SEQ ID NO: 80320 - RNA, 17 nt, Human
gagauggguggaucacc

SEQ ID NO: 80321 - RNA, 22 nt, Human
gagaugguagccucagaagagu

SEQ ID NO: 80322 - RNA, 22 nt, Human
gagaugguguuccacugccagu

SEQ ID NO: 80323 - RNA, 23 nt, Human
gagauguggguuuguucaguguc

SEQ ID NO: 80324 - RNA, 22 nt, Human
gagaugugucagguccuggggg

SEQ ID NO: 80325 - RNA, 22 nt, Human
gagauguuuugcugagaauggg

SEQ ID NO: 80326 - RNA, 22 nt, Human
gagauucuaagucguugguuag

SEQ ID NO: 80327 - RNA, 22 nt, Human
gagauucuaauauaaggauggg

SEQ ID NO: 80328 - RNA, 22 nt, Human
gagauucucgagggcuuccagc

SEQ ID NO: 80329 - RNA, 22 nt, Human
gagauucugguuagguguauuu

SEQ ID NO: 80330 - RNA, 22 nt, Human
gagauucugugaaacggacauu

SEQ ID NO: 80331 - RNA, 21 nt, Human
gagauuuagaaggaucaauuu

SEQ ID NO: 80332 - RNA, 22 nt, Human
gagcaaacaucagugaugucug

SEQ ID NO: 80333 - RNA, 22 nt, Human
gagcaacaaauuagggggauuu

SEQ ID NO: 80334 - RNA, 22 nt, Human
gagcaacacauugaaugaggau

SEQ ID NO: 80335 - RNA, 22 nt, Human
gagcaacaggugauggggcugu

SEQ ID NO: 80336 - RNA, 19 nt, Human
gagcaacauauguaaacuc

SEQ ID NO: 80337 - RNA, 22 nt, Human
gagcaagacucacugcaucuug

SEQ ID NO: 80338 - RNA, 22 nt, Human
gagcaagauuaaaaggcugggu

SEQ ID NO: 80339 - RNA, 22 nt, Human
gagcacagauccuggagccaca

SEQ ID NO: 80340 - RNA, 22 nt, Human
gagcacagcuggagguagcauu

SEQ ID NO: 80341 - RNA, 22 nt, Human
gagcacaguccuuuuguuaaaa

SEQ ID NO: 80342 - RNA, 22 nt, Human
gagcacaguguguugugauuuc

SEQ ID NO: 80343 - RNA, 22 nt, Human
gagcacguugaagcgcacuguc

SEQ ID NO: 80344 - RNA, 22 nt, Human
gagcacugagcuggaauuggag

SEQ ID NO: 80345 - RNA, 22 nt, Human
gagcacugaggaaagcugguua

SEQ ID NO: 80346 - RNA, 18 nt, Human
gagcacugguguugaggu

SEQ ID NO: 80347 - RNA, 22 nt, Human
gagcacuguacucauuugcacu

SEQ ID NO: 80348 - RNA, 22 nt, Human
gagcagaacaggccggguggga

SEQ ID NO: 80349 - RNA, 23 nt, Human
gagcagagcgggcggggguccug

SEQ ID NO: 80350 - RNA, 16 nt, Human
gagcagagcgguucca

SEQ ID NO: 80351 - RNA, 18 nt, Human
gagcagaggaggguuuuu

SEQ ID NO: 80352 - RNA, 18 nt, Human
gagcagaggcucaacugg

SEQ ID NO: 80353 - RNA, 22 nt, Human
gagcagcagauugucuccaugg

SEQ ID NO: 80354 - RNA, 22 nt, Human
gagcagcccuagggcauaagca

SEQ ID NO: 80355 - RNA, 22 nt, Human
gagcagccugaggagcgugggc

SEQ ID NO: 80356 - RNA, 22 nt, Human
gagcagcuaaaauucucaugca

SEQ ID NO: 80357 - RNA, 22 nt, Human
gagcagcuagauaaagcccuuc

SEQ ID NO: 80358 - RNA, 22 nt, Human
gagcagcuccagccgcaugacu

SEQ ID NO: 80359 - RNA, 22 nt, Human
gagcagcugagcuggaaugaga

SEQ ID NO: 80360 - RNA, 19 nt, Human
gagcagcugcacccauuga

SEQ ID NO: 80361 - RNA, 22 nt, Human
gagcagcugugggguugaccau

SEQ ID NO: 80362 - RNA, 20 nt, Human
gagcagcuguuugcauugca

SEQ ID NO: 80363 - RNA, 22 nt, Human
gagcuagggguagucaggagac

SEQ ID NO: 80364 - RNA, 22 nt, Human
gagcuagguugagacucacuua

SEQ ID NO: 80365 - RNA, 22 nt, Human
gagcucagagccuauaguuggu

SEQ ID NO: 80366 - RNA, 22 nt, Human
gagcucagauucuggugucaga

SEQ ID NO: 80367 - RNA, 22 nt, Human
gagcucagcccaaagagcagug

SEQ ID NO: 80368 - RNA, 22 nt, Human
gagcucagccugaggccuggcu

SEQ ID NO: 80369 - RNA, 22 nt, Human
gagcucaggagcaucagaagaa

SEQ ID NO: 80370 - RNA, 22 nt, Human
gagcucagggcauugagcaaga

SEQ ID NO: 80371 - RNA, 22 nt, Human
gagcucauacccucuucucuuu

SEQ ID NO: 80372 - RNA, 22 nt, Human
gagcucauuguggauggauggg

SEQ ID NO: 80373 - RNA, 22 nt, Human
gagcucccuggagguucagaua

SEQ ID NO: 80374 - RNA, 22 nt, Human
gagcuccuggauugcuccuagg

SEQ ID NO: 80375 - RNA, 22 nt, Human
gagcucugacugcugggugaca

SEQ ID NO: 80376 - RNA, 22 nt, Human
gagcucugauguuuaguggaga

SEQ ID NO: 80377 - RNA, 22 nt, Human
gagcucuggguggcaggugucu

SEQ ID NO: 80378 - RNA, 22 nt, Human
gagcucuguccacacuuggaga

SEQ ID NO: 80379 - RNA, 17 nt, Human
gagcucuguggcacaag

SEQ ID NO: 80380 - RNA, 22 nt, Human
gagcucuguguggcuugggugg

SEQ ID NO: 80381 - RNA, 22 nt, Human
gagcucuuagauagggcaggaa

SEQ ID NO: 80382 - RNA, 22 nt, Human
gagcucuuauaguucuagcagu

SEQ ID NO: 80383 - RNA, 22 nt, Human
gagcugagaagcagcgcuugau

SEQ ID NO: 80384 - RNA, 19 nt, Human
gagcugagaguagcacugg

SEQ ID NO: 80385 - RNA, 22 nt, Human
gagcugaggauacaucagugaa

SEQ ID NO: 80386 - RNA, 22 nt, Human
gagcugaguagaggcugcuccc

SEQ ID NO: 80387 - RNA, 22 nt, Human
gagcugagucugcagucgccau

SEQ ID NO: 80388 - RNA, 22 nt, Human
gagcugaguuaccuccagauca

SEQ ID NO: 80389 - RNA, 22 nt, Human
gagcugcacaucugaggcuaau

SEQ ID NO: 80390 - RNA, 22 nt, Human
gagcugccagacaugggaauga

SEQ ID NO: 80391 - RNA, 22 nt, Human
gagcugccaguguaugaauucu

SEQ ID NO: 80392 - RNA, 22 nt, Human
gagcugcuggccuccugcggga

SEQ ID NO: 80393 - RNA, 22 nt, Human
gagcugcugguugcuggugccu

SEQ ID NO: 80394 - RNA, 22 nt, Human
gagcugcugugaggggagcuuc

SEQ ID NO: 80395 - RNA, 22 nt, Human
gagcugcuuccagaguugagug

SEQ ID NO: 80396 - RNA, 22 nt, Human
gagcuggacuuucagauacauc

SEQ ID NO: 80397 - RNA, 22 nt, Human
gagcuggccgcagagagggcag

SEQ ID NO: 80398 - RNA, 22 nt, Human
gagcuggccucaggcacaggag

SEQ ID NO: 80399 - RNA, 22 nt, Human
gagcugggacuuggaauccaca

SEQ ID NO: 80400 - RNA, 22 nt, Human
gagcugggaggacugggaacuu

SEQ ID NO: 80401 - RNA, 23 nt, Human
gagcugggauacaggcuuacugc

SEQ ID NO: 80402 - RNA, 22 nt, Human
gagcugggauucaucuaugucu

SEQ ID NO: 80403 - RNA, 22 nt, Human
gaugcagggcuggcaggagcuu

SEQ ID NO: 80404 - RNA, 22 nt, Human
gaugcauguauggagugagggu

SEQ ID NO: 80405 - RNA, 22 nt, Human
gaugccuccaaaugagggcaga

SEQ ID NO: 80406 - RNA, 22 nt, Human
gaugccucuuuuggcugaauua

SEQ ID NO: 80407 - RNA, 22 nt, Human
gaugcuaaaauaauuauuuuga

SEQ ID NO: 80408 - RNA, 22 nt, Human
gaugcucaucuguccuuugaug

SEQ ID NO: 80409 - RNA, 19 nt, Human
gaugcucauucagguggaa

SEQ ID NO: 80410 - RNA, 22 nt, Human
gaugcugaagugaagugaucuu

SEQ ID NO: 80411 - RNA, 22 nt, Human
gaugcugaccagcuguuuccuu

SEQ ID NO: 80412 - RNA, 22 nt, Human
gaugcugacugaccaaaaggau

SEQ ID NO: 80413 - RNA, 22 nt, Human
gaugcugagcuguauggcuggu

SEQ ID NO: 80414 - RNA, 22 nt, Human
gaugcugauuuuacuguuuucu

SEQ ID NO: 80415 - RNA, 22 nt, Human
gaugcugcucgggugccuggga

SEQ ID NO: 80416 - RNA, 22 nt, Human
gaugcuggccuggccaucuggg

SEQ ID NO: 80417 - RNA, 22 nt, Human
gaugcuucaagcuuccuuauaa

SEQ ID NO: 80418 - RNA, 22 nt, Human
gauggaagaaaaaugcaugucu

SEQ ID NO: 80419 - RNA, 22 nt, Human
gauggaggagauggcagggugc

SEQ ID NO: 80420 - RNA, 22 nt, Human
gauggagugccaggguggaacu

SEQ ID NO: 80421 - RNA, 22 nt, Human
gauggcagucaaccaggugagg

SEQ ID NO: 80422 - RNA, 22 nt, Human
gauggccuggguccccuuccgg

SEQ ID NO: 80423 - RNA, 22 nt, Human
gauggccuguauuugggccaga

SEQ ID NO: 80424 - RNA, 22 nt, Human
gauggcgguggccaccuccuug

SEQ ID NO: 80425 - RNA, 22 nt, Human
gauggcuugcuuagugacagca

SEQ ID NO: 80426 - RNA, 20 nt, Human
gaugggaaucggagcuggua

SEQ ID NO: 80427 - RNA, 22 nt, Human
gaugggcacggcagucugagag

SEQ ID NO: 80428 - RNA, 22 nt, Human
gauggggcuggcuuugaggguu

SEQ ID NO: 80429 - RNA, 22 nt, Human
gauggguggucucagacuugcc

SEQ ID NO: 80430 - RNA, 22 nt, Human
gauguaaaaacuccuuucgaaa

SEQ ID NO: 80431 - RNA, 22 nt, Human
gauguaaaauucuugguuguca

SEQ ID NO: 80432 - RNA, 22 nt, Human
gauguaauagauauagauugcu

SEQ ID NO: 80433 - RNA, 22 nt, Human
gauguacaaguaaaauaugugu

SEQ ID NO: 80434 - RNA, 22 nt, Human
gauguauacaggguugacucau

SEQ ID NO: 80435 - RNA, 22 nt, Human
gauguauacuuuucuuucucug

SEQ ID NO: 80436 - RNA, 22 nt, Human
gaugucugggucuuccuggcuu

SEQ ID NO: 80437 - RNA, 22 nt, Human
gaugucuuagguaacauucuau

SEQ ID NO: 80438 - RNA, 22 nt, Human
gaugucuucucaacuguagacc

SEQ ID NO: 80439 - RNA, 22 nt, Human
gaugucuuggcuugcucucugu

SEQ ID NO: 80440 - RNA, 22 nt, Human
gaugucuuggucaacuugggcu

SEQ ID NO: 80441 - RNA, 22 nt, Human
gaugugacuaacuugguaccag

SEQ ID NO: 80442 - RNA, 22 nt, Human
gauguggcugcucuaaagccca

SEQ ID NO: 80443 - RNA, 22 nt, Human
gaugugggguugagggaccagc

SEQ ID NO: 80444 - RNA, 22 nt, Human
gauguguauuuggaagacaaaa

SEQ ID NO: 80445 - RNA, 22 nt, Human
gauguguccccagaggauugaa

SEQ ID NO: 80446 - RNA, 22 nt, Human
gaugugugcuuuucgcaguguc

SEQ ID NO: 80447 - RNA, 22 nt, Human
gauguuaaagguugguaaguca

SEQ ID NO: 80448 - RNA, 22 nt, Human
gauguucuagaagugugguguu

SEQ ID NO: 80449 - RNA, 22 nt, Human
gauguucugggguguuuguggc

SEQ ID NO: 80450 - RNA, 21 nt, Human
gauguuggaggcuggggucug

SEQ ID NO: 80451 - RNA, 22 nt, Human
gauguuucccguuaagagaaaa

SEQ ID NO: 80452 - RNA, 22 nt, Human
gauguuucugggaaggaaaagu

SEQ ID NO: 80453 - RNA, 22 nt, Human
gauguuuuaggucccuguagcu

SEQ ID NO: 80454 - RNA, 22 nt, Human
gauuaaaaauaacccaugcuga

SEQ ID NO: 80455 - RNA, 22 nt, Human
gauuaagagaaguuucuuaucg

SEQ ID NO: 80456 - RNA, 22 nt, Human
gauuaagauuacauauuuaagu

SEQ ID NO: 80457 - RNA, 22 nt, Human
gauuaauagacacaaccaagcu

SEQ ID NO: 80458 - RNA, 22 nt, Human
gauuaauaguacagguucuuag

SEQ ID NO: 80459 - RNA, 22 nt, Human
gauuagcucuagaucugggcua

SEQ ID NO: 80460 - RNA, 22 nt, Human
gauuaguauccuuauuaagaga

SEQ ID NO: 80461 - RNA, 22 nt, Human
gauuaguugauuaagagucaga

SEQ ID NO: 80462 - RNA, 22 nt, Human
gauuaugguagaaacaagaagu

SEQ ID NO: 80463 - RNA, 22 nt, Human
gauucaagaccuagcucagcca

SEQ ID NO: 80464 - RNA, 23 nt, Human
gauucacagggugguuuaugggg

SEQ ID NO: 80465 - RNA, 22 nt, Human
gauucauaccguuucuucucca

SEQ ID NO: 80466 - RNA, 22 nt, Human
gauuccacagcuucgaggucuu

SEQ ID NO: 80467 - RNA, 22 nt, Human
gauuccugcuauucacagggcu

SEQ ID NO: 80468 - RNA, 22 nt, Human
gauuccuuggcucugucucagg

SEQ ID NO: 80469 - RNA, 22 nt, Human
gauucugaaauuaacagacugg

SEQ ID NO: 80470 - RNA, 18 nt, Human
gauucugauucuggaggc

SEQ ID NO: 80471 - RNA, 22 nt, Human
gauucugcgaugaggacgagcu

SEQ ID NO: 80472 - RNA, 22 nt, Human
gauucuggaguuaaggaugccu

SEQ ID NO: 80473 - RNA, 22 nt, Human
gauucuuacuucuaagcaagcu

SEQ ID NO: 80474 - RNA, 22 nt, Human
gauucuuuagcccagaaaguua

SEQ ID NO: 80475 - RNA, 22 nt, Human
gauugaaaggucuuuaaauugg

SEQ ID NO: 80476 - RNA, 22 nt, Human
gauugcccagaauauucucauu

SEQ ID NO: 80477 - RNA, 22 nt, Human
gauugcgucugugucaccuuca

SEQ ID NO: 80478 - RNA, 22 nt, Human
gauugcugccagcguguccgug

SEQ ID NO: 80479 - RNA, 22 nt, Human
gauugcuguaguuaaaaugaug

SEQ ID NO: 80480 - RNA, 22 nt, Human
gauugcuucuggaaagcaguuu

SEQ ID NO: 80481 - RNA, 22 nt, Human
gauugcuugauacccagucaau

SEQ ID NO: 80482 - RNA, 22 nt, Human
gauuguggaagucagugguucu

SEQ ID NO: 80483 - RNA, 22 nt, Human
gauuuagagaauguuuuguaag

SEQ ID NO: 80484 - RNA, 22 nt, Human
gauuuauaguaugugcuuucag

SEQ ID NO: 80485 - RNA, 22 nt, Human
gauuucaagcccccagagauuc

SEQ ID NO: 80486 - RNA, 22 nt, Human
gauuucaaggaguuuucacagu

SEQ ID NO: 80487 - RNA, 22 nt, Human
gauuucaaggauguuagaggug

SEQ ID NO: 80488 - RNA, 22 nt, Human
gauuucagggugcagaugauga

SEQ ID NO: 80489 - RNA, 22 nt, Human
gauuucaguggcugucucaaau

SEQ ID NO: 80490 - RNA, 22 nt, Human
gauuuccaggacgggagguggg

SEQ ID NO: 80491 - RNA, 22 nt, Human
gauuuccauuuucaacuccugc

SEQ ID NO: 80492 - RNA, 22 nt, Human
gauuuccuaauguggaucucug

SEQ ID NO: 80493 - RNA, 17 nt, Human
gauuuccugaaguucuu

SEQ ID NO: 80494 - RNA, 22 nt, Human
gauuucuaguaagucaugaagg

SEQ ID NO: 80495 - RNA, 22 nt, Human
gauuucuaguucauuaucuauu

SEQ ID NO: 80496 - RNA, 22 nt, Human
gauuucuguggcuuguacauau

SEQ ID NO: 80497 - RNA, 22 nt, Human
gauuucuguugagaaacauggg

SEQ ID NO: 80498 - RNA, 22 nt, Human
gauuucuuuagguguaauagug

SEQ ID NO: 80499 - RNA, 22 nt, Human
gaggccugaggcugccuggagc

SEQ ID NO: 80500 - RNA, 22 nt, Human
gaggccugcagcguggucccug

SEQ ID NO: 80501 - RNA, 22 nt, Human
gaggccuggcugggaggaggug

SEQ ID NO: 80502 - RNA, 22 nt, Human
gaggccuggugugucucccgcu

SEQ ID NO: 80503 - RNA, 22 nt, Human
gaggccugguuugcaugagaau

SEQ ID NO: 80504 - RNA, 22 nt, Human
gaggccugucgcuaggccucug

SEQ ID NO: 80505 - RNA, 22 nt, Human
gaggccuuagagcuuuucuaga

SEQ ID NO: 80506 - RNA, 22 nt, Human
gaggccuuccucucaagcacau

SEQ ID NO: 80507 - RNA, 22 nt, Human
gaggcggcggccgagccuggcu

SEQ ID NO: 80508 - RNA, 22 nt, Human
gaggcuaaggugccagacgaau

SEQ ID NO: 80509 - RNA, 22 nt, Human
gaggcuaagguucugccagaag

SEQ ID NO: 80510 - RNA, 22 nt, Human
gaggcucaccuagggagcacug

SEQ ID NO: 80511 - RNA, 22 nt, Human
gaggcucacuaggcauccuggg

SEQ ID NO: 80512 - RNA, 22 nt, Human
gauacagaaaggcugcauugag

SEQ ID NO: 80513 - RNA, 22 nt, Human
gauacauuuuaucuccuaacag

SEQ ID NO: 80514 - RNA, 22 nt, Human
gauaccaaaaucaucuuauagg

SEQ ID NO: 80515 - RNA, 22 nt, Human
gauacccagcaaaaugcaggag

SEQ ID NO: 80516 - RNA, 22 nt, Human
gauacuuucucauuuacccaag

SEQ ID NO: 80517 - RNA, 22 nt, Human
gauagaaagagugguucuuuuu

SEQ ID NO: 80518 - RNA, 22 nt, Human
gauagaguguugccucucaauu

SEQ ID NO: 80519 - RNA, 19 nt, Human
gauagcugaugaccaucau

SEQ ID NO: 80520 - RNA, 19 nt, Human
gauaggcagccaugagccc

SEQ ID NO: 80521 - RNA, 22 nt, Human
gauagucaccucccuuaacuuu

SEQ ID NO: 80522 - RNA, 22 nt, Human
gauauaaauuaaucaagugcaa

SEQ ID NO: 80523 - RNA, 22 nt, Human
gauauacugucuguauuacaua

SEQ ID NO: 80524 - RNA, 22 nt, Human
gauauagguucauaguguuaca

SEQ ID NO: 80525 - RNA, 22 nt, Human
gauauaguaggacacaucauga

SEQ ID NO: 80526 - RNA, 22 nt, Human
gauauauuuggaccagagcauu

SEQ ID NO: 80527 - RNA, 22 nt, Human
gauauauuuuccauggucugca

SEQ ID NO: 80528 - RNA, 22 nt, Human
gauauguaugaggaguauguau

SEQ ID NO: 80529 - RNA, 22 nt, Human
gauauugcauauuggaugaguu

SEQ ID NO: 80530 - RNA, 22 nt, Human
gauauugccagauguccccgga

SEQ ID NO: 80531 - RNA, 22 nt, Human
gauauuuucauucggaugcuca

SEQ ID NO: 80532 - RNA, 22 nt, Human
gaucaaaagcuggguucuaaaa

SEQ ID NO: 80533 - RNA, 22 nt, Human
gaucaaauauauuaugccacag

SEQ ID NO: 80534 - RNA, 22 nt, Human
gaucaacaaauguccuuuguga

SEQ ID NO: 80535 - RNA, 22 nt, Human
gaucaacauguauuuaagaguu

SEQ ID NO: 80536 - RNA, 22 nt, Human
gaucaauacuauuaagaucaua

SEQ ID NO: 80537 - RNA, 22 nt, Human
gaucacauaauuuggaaacagc

SEQ ID NO: 80538 - RNA, 22 nt, Human
gaucacaucuuuaugaguauuu

SEQ ID NO: 80539 - RNA, 22 nt, Human
gaucacaugaauggaauagaag

SEQ ID NO: 80540 - RNA, 22 nt, Human
gaucacaugaguuaucuaacuu

SEQ ID NO: 80541 - RNA, 22 nt, Human
gaucagaauuuacuuauaauug

SEQ ID NO: 80542 - RNA, 19 nt, Human
gaucagagugucagcuugu

SEQ ID NO: 80543 - RNA, 18 nt, Human
gaucaggaucaaucaccc

SEQ ID NO: 80544 - RNA, 22 nt, Human
gaucagugaacuauacugccuc

SEQ ID NO: 80545 - RNA, 22 nt, Human
gaucauagcgucuucuugcagc

SEQ ID NO: 80546 - RNA, 22 nt, Human
gaucaucugggcuccuuguagu

SEQ ID NO: 80547 - RNA, 22 nt, Human
gaucauugaacaggcacuggag

SEQ ID NO: 80548 - RNA, 22 nt, Human
gaucauugcugccuuuuucuau

SEQ ID NO: 80549 - RNA, 22 nt, Human
gaucauuggccuuucugcagug

SEQ ID NO: 80550 - RNA, 22 nt, Human
gaucauuugacuuuauaaggcu

SEQ ID NO: 80551 - RNA, 22 nt, Human
gaucauuuugaugcccuuuuag

SEQ ID NO: 80552 - RNA, 22 nt, Human
gauccuggcacagguugguccc

SEQ ID NO: 80553 - RNA, 22 nt, Human
gauccugugcauggggugaugg

SEQ ID NO: 80554 - RNA, 22 nt, Human
gauccuguuagaucccauuaga

SEQ ID NO: 80555 - RNA, 22 nt, Human
gauccuguuauaauuuggaugu

SEQ ID NO: 80556 - RNA, 22 nt, Human
gauccuugcaacucugugaggu

SEQ ID NO: 80557 - RNA, 22 nt, Human
gaucgaguuguuuguucugggg

SEQ ID NO: 80558 - RNA, 18 nt, Human
gaucgggggcgccccaag

SEQ ID NO: 80559 - RNA, 22 nt, Human
gaucucuggguccuguuggccu

SEQ ID NO: 80560 - RNA, 22 nt, Human
gaucugaauagacuugcuaagg

SEQ ID NO: 80561 - RNA, 22 nt, Human
gaucugggagccucauggagac

SEQ ID NO: 80562 - RNA, 22 nt, Human
gaucugguuucaucauggacuu

SEQ ID NO: 80563 - RNA, 22 nt, Human
gaucuucuagcagaaguaauuu

SEQ ID NO: 80564 - RNA, 22 nt, Human
gaucuugagcaaguuguguaac

SEQ ID NO: 80565 - RNA, 22 nt, Human
gaucuuuaaggcuuacccugga

SEQ ID NO: 80566 - RNA, 22 nt, Human
gaugaaauagcaaaggcauuug

SEQ ID NO: 80567 - RNA, 20 nt, Human
gaugaaaucacugggcagcc

SEQ ID NO: 80568 - RNA, 17 nt, Human
gaugaaaugaugcacac

SEQ ID NO: 80569 - RNA, 22 nt, Human
gaugaaaugugaaaguucuggg

SEQ ID NO: 80570 - RNA, 22 nt, Human
gaugaaauuguuuugauacuuu

SEQ ID NO: 80571 - RNA, 22 nt, Human
gaugaaauuugggcagguuaaa

SEQ ID NO: 80572 - RNA, 21 nt, Human
gaugaagcaaucuuucuguug

SEQ ID NO: 80573 - RNA, 22 nt, Human
gaugaagccugacuucucggug

SEQ ID NO: 80574 - RNA, 22 nt, Human
gaugacaagcauaugacacguc

SEQ ID NO: 80575 - RNA, 22 nt, Human
gaugacagcagcuguggcucac

SEQ ID NO: 80576 - RNA, 22 nt, Human
gaugagcauuguuucauguguu

SEQ ID NO: 80577 - RNA, 22 nt, Human
gaugagguaagaauguaacacc

SEQ ID NO: 80578 - RNA, 22 nt, Human
gaugaggucuacauuguuaaaa

SEQ ID NO: 80579 - RNA, 22 nt, Human
gaugagguguguggccacuaga

SEQ ID NO: 80580 - RNA, 22 nt, Human
gaugaguaauagcuaaugguuc

SEQ ID NO: 80581 - RNA, 22 nt, Human
gaugagucacugcaggugcugg

SEQ ID NO: 80582 - RNA, 16 nt, Human
gaugagucuuaguggu

SEQ ID NO: 80583 - RNA, 22 nt, Human
gaugaguucuuucuauucuauu

SEQ ID NO: 80584 - RNA, 22 nt, Human
gaugauaacagcauuucaacug

SEQ ID NO: 80585 - RNA, 22 nt, Human
gaugauauuuugacuggagaau

SEQ ID NO: 80586 - RNA, 22 nt, Human
gaugaucugcaagaacuacaug

SEQ ID NO: 80587 - RNA, 22 nt, Human
gaugaugagauaaggauaacuu

SEQ ID NO: 80588 - RNA, 22 nt, Human
gaugauggacaaagcauuggug

SEQ ID NO: 80589 - RNA, 22 nt, Human
gaugauuacacuuuuaaaacag

SEQ ID NO: 80590 - RNA, 22 nt, Human
gaugauuccuuuguucauugug

SEQ ID NO: 80591 - RNA, 22 nt, Human
gaugauuuuguuggugauucaa

SEQ ID NO: 80592 - RNA, 22 nt, Human
gaugauuuuugccagugugaug

SEQ ID NO: 80593 - RNA, 22 nt, Human
gaugcaaagauaaaacagacgc

SEQ ID NO: 80594 - RNA, 22 nt, Human
gaugcacagugacccugccagu

SEQ ID NO: 80595 - RNA, 22 nt, Human
gaugcacuuucuuuucaacagu

SEQ ID NO: 80596 - RNA, 22 nt, Human
gaugcagaaaguagacaccauc

SEQ ID NO: 80597 - RNA, 22 nt, Human
gaugcaggauagcuucacccag

SEQ ID NO: 80598 - RNA, 22 nt, Human
gaugcauagugaagcugacaga

SEQ ID NO: 80599 - RNA, 22 nt, Human
gaugcauuacaaaagugauuau

SEQ ID NO: 80600 - RNA, 22 nt, Human
gaugcauugcaucgaguagcuu

SEQ ID NO: 80601 - RNA, 22 nt, Human
gaugccugcauuucaggagagu

SEQ ID NO: 80602 - RNA, 22 nt, Human
gaugccuggcacccagcaagga

SEQ ID NO: 80603 - RNA, 22 nt, Human
gaugcugauuauuucuugcuag

SEQ ID NO: 80604 - RNA, 22 nt, Human
gaugcugugcuaugucuacaga

SEQ ID NO: 80605 - RNA, 22 nt, Human
gaugcuuuggccccaucaugag

SEQ ID NO: 80606 - RNA, 22 nt, Human
gaugcuuuucuuuucagcaaga

SEQ ID NO: 80607 - RNA, 20 nt, Human
gauggauuucaacaccuuuc

SEQ ID NO: 80608 - RNA, 22 nt, Human
gauggcacacagacauccccgc

SEQ ID NO: 80609 - RNA, 22 nt, Human
gauggcagcauauugacagcau

SEQ ID NO: 80610 - RNA, 22 nt, Human
gauggcccgcuagcuggccucu

SEQ ID NO: 80611 - RNA, 22 nt, Human
gauggccucagugcccaaagga

SEQ ID NO: 80612 - RNA, 22 nt, Human
gauggccuuguuuucucccuuc

SEQ ID NO: 80613 - RNA, 22 nt, Human
gauggcuucacuuacauggcug

SEQ ID NO: 80614 - RNA, 22 nt, Human
gauggcuucagucuccuugggu

SEQ ID NO: 80615 - RNA, 22 nt, Human
gauggcuucugaaucagggccu

SEQ ID NO: 80616 - RNA, 22 nt, Human
gauggcuuguuuucuggcugaa

SEQ ID NO: 80617 - RNA, 22 nt, Human
gauggcuuugugcaccaugauu

SEQ ID NO: 80618 - RNA, 18 nt, Human
gaugggagcaagagaaga

SEQ ID NO: 80619 - RNA, 22 nt, Human
gaugggcaucaaacaugacgug

SEQ ID NO: 80620 - RNA, 22 nt, Human
gaugggcuggggagaaagcaug

SEQ ID NO: 80621 - RNA, 22 nt, Human
ggggcucucaggucuccccaaa

SEQ ID NO: 80622 - RNA, 20 nt, Human
ggggcugcaugcagagaaga

SEQ ID NO: 80623 - RNA, 22 nt, Human
ggggcugguggugguuucucca

SEQ ID NO: 80624 - RNA, 22 nt, Human
ggggcuguuuuuggaauggcug

SEQ ID NO: 80625 - RNA, 21 nt, Human
gggggaagaggaguugcuagu

SEQ ID NO: 80626 - RNA, 22 nt, Human
gggggaaguaauuauaaaccaa

SEQ ID NO: 80627 - RNA, 22 nt, Human
gaggccuggagccgccuaggcg

SEQ ID NO: 80628 - RNA, 22 nt, Human
gaggccugguagccgagcccca

SEQ ID NO: 80629 - RNA, 22 nt, Human
gaggccuggucuaugagauguu

SEQ ID NO: 80630 - RNA, 22 nt, Human
gaggcgagaagcuggagauggu

SEQ ID NO: 80631 - RNA, 19 nt, Human
gaggcgaggcgugcaggag

SEQ ID NO: 80632 - RNA, 22 nt, Human
gaggcuaugaggagugagguuu

SEQ ID NO: 80633 - RNA, 22 nt, Human
gaggcucaguuaugucaucagg

SEQ ID NO: 80634 - RNA, 22 nt, Human
gaggcuccagcgacaccuaggc

SEQ ID NO: 80635 - RNA, 22 nt, Human
gaggcucccucaacucugggug

SEQ ID NO: 80636 - RNA, 22 nt, Human
gaggcuccgguaguagccuuga

SEQ ID NO: 80637 - RNA, 22 nt, Human
gaggcuccucauucaguaugcu

SEQ ID NO: 80638 - RNA, 22 nt, Human
gaggcugacggcaccaucuucu

SEQ ID NO: 80639 - RNA, 22 nt, Human
gaggcugaguagcuuugugcuc

SEQ ID NO: 80640 - RNA, 22 nt, Human
gaggcugaugcugccucacaga

SEQ ID NO: 80641 - RNA, 22 nt, Human
gaggcugauucggggaacagca

SEQ ID NO: 80642 - RNA, 22 nt, Human
gaggcugcacuggcuaaaggcu

SEQ ID NO: 80643 - RNA, 22 nt, Human
gaggcugcccacaccugcgccg

SEQ ID NO: 80644 - RNA, 22 nt, Human
gaggcugcuuuccuccuauccu

SEQ ID NO: 80645 - RNA, 22 nt, Human
gaggcuggaggucaaagaugaa

SEQ ID NO: 80646 - RNA, 22 nt, Human
gaggcuggcagaaaagcacagg

SEQ ID NO: 80647 - RNA, 22 nt, Human
gaggcuggugguuaguuccauu

SEQ ID NO: 80648 - RNA, 22 nt, Human
gaggcuuucacaagguuaguuc

SEQ ID NO: 80649 - RNA, 22 nt, Human
gaggcuuuucuucagguaucaa

SEQ ID NO: 80650 - RNA, 22 nt, Human
gaggcuuuuggcuaauaacugu

SEQ ID NO: 80651 - RNA, 22 nt, Human
gagggaaggagaguuguagcug

SEQ ID NO: 80652 - RNA, 22 nt, Human
gagggaauggugugcaagaggu

SEQ ID NO: 80653 - RNA, 22 nt, Human
gagggagcuggagcagacgccg

SEQ ID NO: 80654 - RNA, 22 nt, Human
gagggaggugauacugaacgua

SEQ ID NO: 80655 - RNA, 22 nt, Human
gagggagugagacacaaaagaa

SEQ ID NO: 80656 - RNA, 22 nt, Human
gagggcaagaguuggaaacggu

SEQ ID NO: 80657 - RNA, 22 nt, Human
gagggcaccuucaguaauagcu

SEQ ID NO: 80658 - RNA, 22 nt, Human
gagggcacgaaacaaccacuuc

SEQ ID NO: 80659 - RNA, 16 nt, Human
gagggcagaggcggaa

SEQ ID NO: 80660 - RNA, 22 nt, Human
gagggcaguagccucguacccu

SEQ ID NO: 80661 - RNA, 22 nt, Human
gagggccaaagagcaagagccu

SEQ ID NO: 80662 - RNA, 22 nt, Human
gagggccaaugugucccugagc

SEQ ID NO: 80663 - RNA, 22 nt, Human
gagggccacuugaauguuuuca

SEQ ID NO: 80664 - RNA, 22 nt, Human
gagggccagcagccucagcaug

SEQ ID NO: 80665 - RNA, 22 nt, Human
gagggcuccauuccccgugccc

SEQ ID NO: 80666 - RNA, 22 nt, Human
gagggcuuccauggggagcccc

SEQ ID NO: 80667 - RNA, 22 nt, Human
gaggggaaaacaggaauuaaca

SEQ ID NO: 80668 - RNA, 22 nt, Human
gaggggaaagugugaggcugcg

SEQ ID NO: 80669 - RNA, 22 nt, Human
gaggggagaggcuuauggauca

SEQ ID NO: 80670 - RNA, 22 nt, Human
gaggggaugcagagaggcuuau

SEQ ID NO: 80671 - RNA, 22 nt, Human
gaggggcacagcagcuguugca

SEQ ID NO: 80672 - RNA, 22 nt, Human
gaggggcacaguaaaggguccc

SEQ ID NO: 80673 - RNA, 22 nt, Human
gaggggcucuuuaauaguaaca

SEQ ID NO: 80674 - RNA, 22 nt, Human
gaggggcuggcacgauggcugc

SEQ ID NO: 80675 - RNA, 22 nt, Human
gaggggcuggcuguggucccau

SEQ ID NO: 80676 - RNA, 22 nt, Human
gaggggcuggguagggcaaccc

SEQ ID NO: 80677 - RNA, 22 nt, Human
gagggggagaugugcacacacu

SEQ ID NO: 80678 - RNA, 22 nt, Human
gagggggcgugcaaggcuccgc

SEQ ID NO: 80679 - RNA, 22 nt, Human
gagggggucuaugagguagagc

SEQ ID NO: 80680 - RNA, 22 nt, Human
gagggguccaggaggcacuuac

SEQ ID NO: 80681 - RNA, 22 nt, Human
gagggguguggagccaucaguu

SEQ ID NO: 80682 - RNA, 22 nt, Human
gagggucagaagggccugguuc

SEQ ID NO: 80683 - RNA, 22 nt, Human
gagggucccgagcccugucaga

SEQ ID NO: 80684 - RNA, 22 nt, Human
gagggucuuaccuaagcagggu

SEQ ID NO: 80685 - RNA, 22 nt, Human
gagggugcagcugggccccacg

SEQ ID NO: 80686 - RNA, 22 nt, Human
gagggugcucugagcccuuuug

SEQ ID NO: 80687 - RNA, 22 nt, Human
gaggguggaucagccugauugg

SEQ ID NO: 80688 - RNA, 20 nt, Human
gagggugggacuuccuaggc

SEQ ID NO: 80689 - RNA, 22 nt, Human
gagggugggcuccuaucugggu

SEQ ID NO: 80690 - RNA, 22 nt, Human
gagggugggcuuuguuccucca

SEQ ID NO: 80691 - RNA, 22 nt, Human
gaggguggguacaccagcccuc

SEQ ID NO: 80692 - RNA, 22 nt, Human
gaggguggguuucuugcacguc

SEQ ID NO: 80693 - RNA, 22 nt, Human
gagggugucucacgugaaagua

SEQ ID NO: 80694 - RNA, 23 nt, Human
gagguacagcaccagugaauagg

SEQ ID NO: 80695 - RNA, 18 nt, Human
gagguagauaagauuuuc

SEQ ID NO: 80696 - RNA, 22 nt, Human
gagguagcgaguggacagugca

SEQ ID NO: 80697 - RNA, 22 nt, Human
gagguagcucuuacucucuccg

SEQ ID NO: 80698 - RNA, 17 nt, Human
gagguaggaagugaguc

SEQ ID NO: 80699 - RNA, 22 nt, Human
gagguaggagguagguauugug

SEQ ID NO: 80700 - RNA, 22 nt, Human
gagguaggcagggugacuuggc

SEQ ID NO: 80701 - RNA, 22 nt, Human
gagguagggaagacaaauaugc

SEQ ID NO: 80702 - RNA, 22 nt, Human
gagguagggcagaggcugaaug

SEQ ID NO: 80703 - RNA, 20 nt, Human
gagguagggcuuaaggcaag

SEQ ID NO: 80704 - RNA, 22 nt, Human
gagguaguaagcagaguggggu

SEQ ID NO: 80705 - RNA, 22 nt, Human
gagguaucuuagagaguguaga

SEQ ID NO: 80706 - RNA, 23 nt, Human
gaggucaaggcugcagugauugc

SEQ ID NO: 80707 - RNA, 22 nt, Human
gaggucaauaauaugugcuuua

SEQ ID NO: 80708 - RNA, 22 nt, Human
gaggucaggggagaggcugaug

SEQ ID NO: 80709 - RNA, 22 nt, Human
gagguccagagcagguucagug

SEQ ID NO: 80710 - RNA, 22 nt, Human
gagguccaggguggggccugag

SEQ ID NO: 80711 - RNA, 22 nt, Human
gaggucccccauggcugugacu

SEQ ID NO: 80712 - RNA, 22 nt, Human
gagguccucuguguccgcgggc

SEQ ID NO: 80713 - RNA, 22 nt, Human
gaggugaguggaucacgagguc

SEQ ID NO: 80714 - RNA, 22 nt, Human
gaggugcuuccuuugggcucug

SEQ ID NO: 80715 - RNA, 22 nt, Human
gagguggccaagcgaggaaggg

SEQ ID NO: 80716 - RNA, 22 nt, Human
gagguggccagagucaagagcc

SEQ ID NO: 80717 - RNA, 22 nt, Human
gagguggcccuugcucagccuu

SEQ ID NO: 80718 - RNA, 22 nt, Human
gagguggcugggaguagggaau

SEQ ID NO: 80719 - RNA, 22 nt, Human
gagguggcugucagcuucacuu

SEQ ID NO: 80720 - RNA, 22 nt, Human
gaggugggagggcagucccuaa

SEQ ID NO: 80721 - RNA, 22 nt, Human
gaggugggguuuuguucuugaa

SEQ ID NO: 80722 - RNA, 22 nt, Human
gaggugucacuauuuugcuuau

SEQ ID NO: 80723 - RNA, 22 nt, Human
gagguguccuagaaguauucag

SEQ ID NO: 80724 - RNA, 22 nt, Human
gaggugucguagauuauucuca

SEQ ID NO: 80725 - RNA, 22 nt, Human
gaggugucuagaucuaccagua

SEQ ID NO: 80726 - RNA, 22 nt, Human
gaggugucugaguggggaccug

SEQ ID NO: 80727 - RNA, 22 nt, Human
gaggugucuggccuuuguagga

SEQ ID NO: 80728 - RNA, 23 nt, Human
gaggugugaauucugggugcugc

SEQ ID NO: 80729 - RNA, 22 nt, Human
gaggugugcugcggcccggugc

SEQ ID NO: 80730 - RNA, 22 nt, Human
gguacaaggagugaagguuugg

SEQ ID NO: 80731 - RNA, 22 nt, Human
gguacaaugucuuacagaccca

SEQ ID NO: 80732 - RNA, 22 nt, Human
gguacagggcuuccuggacaag

SEQ ID NO: 80733 - RNA, 22 nt, Human
gguagacugagcuccuugagga

SEQ ID NO: 80734 - RNA, 22 nt, Human
gguaggaagauagagcaaaguu

SEQ ID NO: 80735 - RNA, 22 nt, Human
gguagggaaggucucccacauu

SEQ ID NO: 80736 - RNA, 21 nt, Human
gguagggaagguucgcuggug

SEQ ID NO: 80737 - RNA, 22 nt, Human
gguauggagucugaguuucuag

SEQ ID NO: 80738 - RNA, 22 nt, Human
gguauuuacugagagccacucu

SEQ ID NO: 80739 - RNA, 22 nt, Human
ggucaaagugaggagucagguu

SEQ ID NO: 80740 - RNA, 22 nt, Human
ggucaacacugugaccaacagg

SEQ ID NO: 80741 - RNA, 22 nt, Human
ggucaacagaauuuguacucag

SEQ ID NO: 80742 - RNA, 18 nt, Human
ggucaagaaaguaaggca

SEQ ID NO: 80743 - RNA, 22 nt, Human
gaguaacauaccaaaauucaca

SEQ ID NO: 80744 - RNA, 21 nt, Human
gaguaacauuuccucuccaca

SEQ ID NO: 80745 - RNA, 22 nt, Human
gaguaagagcuggcuuuggugu

SEQ ID NO: 80746 - RNA, 22 nt, Human
gaguaaggcugcugauggagug

SEQ ID NO: 80747 - RNA, 22 nt, Human
gaguaauuccaauauaaaucac

SEQ ID NO: 80748 - RNA, 22 nt, Human
gaguaauuuauccagugaagua

SEQ ID NO: 80749 - RNA, 22 nt, Human
gaguaauuuucuuaaaacauca

SEQ ID NO: 80750 - RNA, 19 nt, Human
gaguacaggugcagaaaug

SEQ ID NO: 80751 - RNA, 22 nt, Human
gaguacuuaacuccaaauagga

SEQ ID NO: 80752 - RNA, 22 nt, Human
gaguagcauucuagaguaugcu

SEQ ID NO: 80753 - RNA, 22 nt, Human
gaguauaaugauuuucauucac

SEQ ID NO: 80754 - RNA, 22 nt, Human
gaguauauaauuaauuggucug

SEQ ID NO: 80755 - RNA, 22 nt, Human
gaguauaugacuuucuuuugca

SEQ ID NO: 80756 - RNA, 19 nt, Human
gaguauuuuccaacuuggu

SEQ ID NO: 80757 - RNA, 22 nt, Human
gagucaacaagucagaucucac

SEQ ID NO: 80758 - RNA, 20 nt, Human
gagucacagaagaagcugaa

SEQ ID NO: 80759 - RNA, 22 nt, Human
gagucaccacacggugcugacu

SEQ ID NO: 80760 - RNA, 22 nt, Human
gagucagaaacucacucuauag

SEQ ID NO: 80761 - RNA, 22 nt, Human
gagucagacagggucacccaga

SEQ ID NO: 80762 - RNA, 22 nt, Human
gagucagaccgacugggcucau

SEQ ID NO: 80763 - RNA, 22 nt, Human
gagucaggaguccugugugaga

SEQ ID NO: 80764 - RNA, 22 nt, Human
gagucagguuucugccuauaga

SEQ ID NO: 80765 - RNA, 22 nt, Human
gaguccagagauuaagcaccuc

SEQ ID NO: 80766 - RNA, 22 nt, Human
gaguccaggcaucccucccaua

SEQ ID NO: 80767 - RNA, 22 nt, Human
gaguccagugauguuccugguc

SEQ ID NO: 80768 - RNA, 22 nt, Human
gaguccuggaacccugaaugcu

SEQ ID NO: 80769 - RNA, 22 nt, Human
gaguccuggagaaacgcaggug

SEQ ID NO: 80770 - RNA, 22 nt, Human
gaguccuuccagcaggcauuua

SEQ ID NO: 80771 - RNA, 22 nt, Human
gaguccuugucauaauucagug

SEQ ID NO: 80772 - RNA, 22 nt, Human
gagucuaaguagaaugugaaaa

SEQ ID NO: 80773 - RNA, 22 nt, Human
gagucucuagucugguccuggc

SEQ ID NO: 80774 - RNA, 22 nt, Human
gagucucugggagggaaagaag

SEQ ID NO: 80775 - RNA, 22 nt, Human
gagucugagaacugggcucagu

SEQ ID NO: 80776 - RNA, 22 nt, Human
gagucugagagccuaaugaccu

SEQ ID NO: 80777 - RNA, 22 nt, Human
gagucuggacuauucuggucuu

SEQ ID NO: 80778 - RNA, 17 nt, Human
gagucuguguucaucag

SEQ ID NO: 80779 - RNA, 22 nt, Human
gagucuucuacgcucacacaaa

SEQ ID NO: 80780 - RNA, 22 nt, Human
gagugacggcucaucucuggaa

SEQ ID NO: 80781 - RNA, 22 nt, Human
gagugagggcagcaggggcugc

SEQ ID NO: 80782 - RNA, 22 nt, Human
gagugauuuaagcuauuuuuaa

SEQ ID NO: 80783 - RNA, 22 nt, Human
gagugcaaguucuuccuucuuc

SEQ ID NO: 80784 - RNA, 23 nt, Human
gagugcagaauagacaugcagug

SEQ ID NO: 80785 - RNA, 17 nt, Human
gagugcagacacaagca

SEQ ID NO: 80786 - RNA, 22 nt, Human
gagugcaggccugagcaccauc

SEQ ID NO: 80787 - RNA, 22 nt, Human
gagugcaguaucuucugugucc

SEQ ID NO: 80788 - RNA, 22 nt, Human
gagugcaguaugagaggcugcu

SEQ ID NO: 80789 - RNA, 22 nt, Human
gagugcaguuggggugagggga

SEQ ID NO: 80790 - RNA, 18 nt, Human
gagugcgguggugcacac

SEQ ID NO: 80791 - RNA, 22 nt, Human
gagugcuccgucuuggacaggg

SEQ ID NO: 80792 - RNA, 22 nt, Human
gagugcucgggccucugccugc

SEQ ID NO: 80793 - RNA, 22 nt, Human
gagugcuggggugcagagaggu

SEQ ID NO: 80794 - RNA, 22 nt, Human
gagugcuguaggacugagcccu

SEQ ID NO: 80795 - RNA, 22 nt, Human
gaguggagaucgugccacugca

SEQ ID NO: 80796 - RNA, 22 nt, Human
gaguggcaggcacugugacgga

SEQ ID NO: 80797 - RNA, 22 nt, Human
gaguggcuaaaguaugucaugg

SEQ ID NO: 80798 - RNA, 22 nt, Human
gaguggcuacaggcagcuuaca

SEQ ID NO: 80799 - RNA, 22 nt, Human
gaguggcuggguguuugaaucc

SEQ ID NO: 80800 - RNA, 22 nt, Human
gagugggcaaaagaaaguaggc

SEQ ID NO: 80801 - RNA, 22 nt, Human
gagugggcaccgugggcacacu

SEQ ID NO: 80802 - RNA, 22 nt, Human
gaguggggcgaagucggcgagu

SEQ ID NO: 80803 - RNA, 22 nt, Human
gagugggggguccgucucagug

SEQ ID NO: 80804 - RNA, 22 nt, Human
gaguggguccacagaggugaca

SEQ ID NO: 80805 - RNA, 22 nt, Human
gagugggugaaugugcucauaa

SEQ ID NO: 80806 - RNA, 22 nt, Human
gaguguaguucauuccguccua

SEQ ID NO: 80807 - RNA, 22 nt, Human
gagugucacuugaugcagggca

SEQ ID NO: 80808 - RNA, 22 nt, Human
gagugugggucucagcuuuaag

SEQ ID NO: 80809 - RNA, 22 nt, Human
gagugugugacuucacuuuagc

SEQ ID NO: 80810 - RNA, 23 nt, Human
gaguguucauagcaggcucuugc

SEQ ID NO: 80811 - RNA, 22 nt, Human
gaguuaaaaaugccuccaugga

SEQ ID NO: 80812 - RNA, 22 nt, Human
gaguuaaaggcaguugaggaaa

SEQ ID NO: 80813 - RNA, 22 nt, Human
gaguuaaauagcuuaggauuca

SEQ ID NO: 80814 - RNA, 22 nt, Human
gaguuaaaugacuugguuaagg

SEQ ID NO: 80815 - RNA, 22 nt, Human
gaguuacagagaggauuauggu

SEQ ID NO: 80816 - RNA, 22 nt, Human
gaguuacauggacauucucucc

SEQ ID NO: 80817 - RNA, 22 nt, Human
gaguuacauuuggugacacuuc

SEQ ID NO: 80818 - RNA, 22 nt, Human
gaguuacuggguggaaggcacu

SEQ ID NO: 80819 - RNA, 22 nt, Human
gaguuagaagacagaauguaaa

SEQ ID NO: 80820 - RNA, 22 nt, Human
gaguuauauccugagucauauu

SEQ ID NO: 80821 - RNA, 22 nt, Human
gaguuauugaguauagaaugua

SEQ ID NO: 80822 - RNA, 22 nt, Human
gaguuauuggguggaaagguag

SEQ ID NO: 80823 - RNA, 22 nt, Human
gaguuauuugguuugcaugcag

SEQ ID NO: 80824 - RNA, 22 nt, Human
gaguuauuuguagggauuauau

SEQ ID NO: 80825 - RNA, 22 nt, Human
gaguucaguaguuauagucuag

SEQ ID NO: 80826 - RNA, 22 nt, Human
gaguucauauucagagaucgcu

SEQ ID NO: 80827 - RNA, 20 nt, Human
gaguuccccauuucuccugg

SEQ ID NO: 80828 - RNA, 22 nt, Human
gaguucuauuaugguuagaagu

SEQ ID NO: 80829 - RNA, 22 nt, Human
gaguucucaagcaaucaaagag

SEQ ID NO: 80830 - RNA, 22 nt, Human
gaguucucaguaaaguucuuug

SEQ ID NO: 80831 - RNA, 22 nt, Human
gaguucugugagccauccuagc

SEQ ID NO: 80832 - RNA, 22 nt, Human
gaguucugugauuauuugggac

SEQ ID NO: 80833 - RNA, 22 nt, Human
gaguugaaagcaaaaguugaua

SEQ ID NO: 80834 - RNA, 22 nt, Human
gaguugaucauuauuugguuuc

SEQ ID NO: 80835 - RNA, 22 nt, Human
gaguuuaacacuuggagaaaag

SEQ ID NO: 80836 - RNA, 19 nt, Human
gaguuuaucuccuagcccu

SEQ ID NO: 80837 - RNA, 22 nt, Human
gauaaaauauguggccuuuagu

SEQ ID NO: 80838 - RNA, 22 nt, Human
gauaaacacugaugauaugggg

SEQ ID NO: 80839 - RNA, 22 nt, Human
gauaaacaugggagaaaggaau

SEQ ID NO: 80840 - RNA, 22 nt, Human
gauaaagcagguaggagaagau

SEQ ID NO: 80841 - RNA, 22 nt, Human
gauaaaguagauuuguucuaga

SEQ ID NO: 80842 - RNA, 22 nt, Human
gauaaauggcugaagaaauagu

SEQ ID NO: 80843 - RNA, 22 nt, Human
gauaacauacuugcauguguau

SEQ ID NO: 80844 - RNA, 22 nt, Human
gauaacuacacuuaagacaacc

SEQ ID NO: 80845 - RNA, 21 nt, Human
gauaaggcaggaggauaagua

SEQ ID NO: 80846 - RNA, 22 nt, Human
gauaaguuauguaacuugcuca

SEQ ID NO: 80847 - RNA, 22 nt, Human
gauaauaucugguuuauucacc

SEQ ID NO: 80848 - RNA, 22 nt, Human
gauaauuucuccaucucaaggu

SEQ ID NO: 80849 - RNA, 22 nt, Human
gauacaagacuaauaggaaaca

SEQ ID NO: 80850 - RNA, 22 nt, Human
gauacacauuuuagcuuugucu

SEQ ID NO: 80851 - RNA, 23 nt, Human
gauacacucccugcugggcacug

SEQ ID NO: 80852 - RNA, 22 nt, Human
gauacagacaccacucuuuucc

SEQ ID NO: 80853 - RNA, 22 nt, Human
gauacagcucuggccagaugug

SEQ ID NO: 80854 - RNA, 22 nt, Human
gcagagaggaaugaagccaucc

SEQ ID NO: 80855 - RNA, 22 nt, Human
gcagagauccuugcuggaugac

SEQ ID NO: 80856 - RNA, 22 nt, Human
gcagagaugggccagugacgca

SEQ ID NO: 80857 - RNA, 22 nt, Human
gcagagauuaugccauggaaag

SEQ ID NO: 80858 - RNA, 22 nt, Human
gcagagauuggugcacugauga

SEQ ID NO: 80859 - RNA, 22 nt, Human
gcagagcagagccugcauuggc

SEQ ID NO: 80860 - RNA, 22 nt, Human
gcagagcagugcuugcccagcg

SEQ ID NO: 80861 - RNA, 18 nt, Human
gcagagcaucaaggguua

SEQ ID NO: 80862 - RNA, 22 nt, Human
gcagagcauguccucaggacag

SEQ ID NO: 80863 - RNA, 20 nt, Human
gcagagccucacugcaaggg

SEQ ID NO: 80864 - RNA, 22 nt, Human
gcagagccugggggucugcgga

SEQ ID NO: 80865 - RNA, 22 nt, Human
gcagagcugcagcgaggccugg

SEQ ID NO: 80866 - RNA, 21 nt, Human
gcagagcuggaaccaggaccc

SEQ ID NO: 80867 - RNA, 22 nt, Human
gcagagcugggauaugaaccca

SEQ ID NO: 80868 - RNA, 22 nt, Human
gcagagcugggucuguauccaa

SEQ ID NO: 80869 - RNA, 22 nt, Human
gcagagcugucuaagucacuuc

SEQ ID NO: 80870 - RNA, 22 nt, Human
gcagaggacacaggagggcaag

SEQ ID NO: 80871 - RNA, 22 nt, Human
gcagaggacagggauuuagauu

SEQ ID NO: 80872 - RNA, 22 nt, Human
gcagaggacucaaucaagguau

SEQ ID NO: 80873 - RNA, 22 nt, Human
gcagaggagaugaagauacuuu

SEQ ID NO: 80874 - RNA, 22 nt, Human
gcagaggagcaagcuggacacc

SEQ ID NO: 80875 - RNA, 22 nt, Human
gcagaggcaaucagguaugugg

SEQ ID NO: 80876 - RNA, 22 nt, Human
gcagaggcagggcccuccucca

SEQ ID NO: 80877 - RNA, 22 nt, Human
gcagaggcuguagggaagguug

SEQ ID NO: 80878 - RNA, 22 nt, Human
gcagaggggaagcugaggaauu

SEQ ID NO: 80879 - RNA, 22 nt, Human
gcagaggugaccagcagcaggg

SEQ ID NO: 80880 - RNA, 22 nt, Human
gcagaggugaguuucucagcug

SEQ ID NO: 80881 - RNA, 22 nt, Human
gcagagguguagcccccuccau

SEQ ID NO: 80882 - RNA, 22 nt, Human
gcagaggugucaccuuccagga

SEQ ID NO: 80883 - RNA, 22 nt, Human
gcagaggugugggaggggccac

SEQ ID NO: 80884 - RNA, 19 nt, Human
gcagagucaagagcugcug

SEQ ID NO: 80885 - RNA, 22 nt, Human
gcagagugagauaugaacccag

SEQ ID NO: 80886 - RNA, 22 nt, Human
gcagagugagccgaggcugcuc

SEQ ID NO: 80887 - RNA, 22 nt, Human
gcagaugaaguuuacaggaaac

SEQ ID NO: 80888 - RNA, 22 nt, Human
gcagaugcaacugcaggugagu

SEQ ID NO: 80889 - RNA, 22 nt, Human
gcagaugccacuaggugaagug

SEQ ID NO: 80890 - RNA, 22 nt, Human
gcagaugcuguggugauagaag

SEQ ID NO: 80891 - RNA, 22 nt, Human
gcagaugcuuggcacugacagu

SEQ ID NO: 80892 - RNA, 23 nt, Human
gcagauggccccagagugcugcc

SEQ ID NO: 80893 - RNA, 22 nt, Human
gcagauggcucagacacugggg

SEQ ID NO: 80894 - RNA, 22 nt, Human
gcagauggcugagccugcagau

SEQ ID NO: 80895 - RNA, 15 nt, Human
gcagaugggggugau

SEQ ID NO: 80896 - RNA, 22 nt, Human
gcagauguuguugcugggaguu

SEQ ID NO: 80897 - RNA, 22 nt, Human
gcagauuucauuuaaaccuuuc

SEQ ID NO: 80898 - RNA, 22 nt, Human
gcagcaaaaaaguaauauuuau

SEQ ID NO: 80899 - RNA, 22 nt, Human
gcagcaaucuucacagugucau

SEQ ID NO: 80900 - RNA, 22 nt, Human
gcagcacaaaguccccagggac

SEQ ID NO: 80901 - RNA, 22 nt, Human
gcagcacauauaaacaaagaga

SEQ ID NO: 80902 - RNA, 22 nt, Human
gcagcaccaaccagggccuguu

SEQ ID NO: 80903 - RNA, 22 nt, Human
gcagcagaaguagaaguacagg

SEQ ID NO: 80904 - RNA, 22 nt, Human
gcagcagaugcuuucauggaca

SEQ ID NO: 80905 - RNA, 22 nt, Human
gcagcagcaagaagguuggacu

SEQ ID NO: 80906 - RNA, 22 nt, Human
gcagcagcagggagucugacuu

SEQ ID NO: 80907 - RNA, 22 nt, Human
gcagcagcucucaaaguggucu

SEQ ID NO: 80908 - RNA, 22 nt, Human
gcagcagcucugaaugggcccc

SEQ ID NO: 80909 - RNA, 22 nt, Human
gcagcaggaauaggauaagcaa

SEQ ID NO: 80910 - RNA, 22 nt, Human
gcagcaggaauuuaaauuuaua

SEQ ID NO: 80911 - RNA, 22 nt, Human
gcagcaggagaguuuguccugc

SEQ ID NO: 80912 - RNA, 22 nt, Human
gcagcagggagcagggguguca

SEQ ID NO: 80913 - RNA, 20 nt, Human
gcagcagugcaaguccucuu

SEQ ID NO: 80914 - RNA, 22 nt, Human
gcagcauauuguacuggccugc

SEQ ID NO: 80915 - RNA, 22 nt, Human
gcagcaucaauccaugcuucuc

SEQ ID NO: 80916 - RNA, 22 nt, Human
gcagcauccuuggccuccaccc

SEQ ID NO: 80917 - RNA, 22 nt, Human
gcagcaucuguacauagacgcu

SEQ ID NO: 80918 - RNA, 21 nt, Human
gcagcaugagaaagccccaaa

SEQ ID NO: 80919 - RNA, 22 nt, Human
gcagcaugagcuauacaaagua

SEQ ID NO: 80920 - RNA, 22 nt, Human
gcagcaugugccuuaaaucauu

SEQ ID NO: 80921 - RNA, 22 nt, Human
gcagcauguugaaagggccaca

SEQ ID NO: 80922 - RNA, 22 nt, Human
gcagcauugugagguccugccc

SEQ ID NO: 80923 - RNA, 22 nt, Human
gcagccacccucaaggcugaau

SEQ ID NO: 80924 - RNA, 21 nt, Human
gcagccacugccuucaacaau

SEQ ID NO: 80925 - RNA, 22 nt, Human
gcagccacuuugcaaccaagag

SEQ ID NO: 80926 - RNA, 22 nt, Human
gcagccagaagacucagaacaa

SEQ ID NO: 80927 - RNA, 22 nt, Human
gcagccaggaaagcuggacccu

SEQ ID NO: 80928 - RNA, 22 nt, Human
gcagccaggaagccuuucccuc

SEQ ID NO: 80929 - RNA, 22 nt, Human
gcagccaggcuacagcgggcuu

SEQ ID NO: 80930 - RNA, 22 nt, Human
gcagccauugagcgaaaaaauc

SEQ ID NO: 80931 - RNA, 22 nt, Human
gcagcccaauggacugagacag

SEQ ID NO: 80932 - RNA, 22 nt, Human
gcagcccacaccacucugcuca

SEQ ID NO: 80933 - RNA, 18 nt, Human
gcagccccucuuccuucc

SEQ ID NO: 80934 - RNA, 22 nt, Human
gcagcccuagcgacaaauugau

SEQ ID NO: 80935 - RNA, 22 nt, Human
gcagcccugcaggcagcuccag

SEQ ID NO: 80936 - RNA, 20 nt, Human
gcagccguggagacuaggag

SEQ ID NO: 80937 - RNA, 22 nt, Human
gcagccucaaacuccccagcuc

SEQ ID NO: 80938 - RNA, 22 nt, Human
gcagccuccgcacugcgagucc

SEQ ID NO: 80939 - RNA, 22 nt, Human
gcagccugaggcccuuucuggc

SEQ ID NO: 80940 - RNA, 22 nt, Human
gcagccuuccguggaccuggac

SEQ ID NO: 80941 - RNA, 22 nt, Human
gcagcgcuacucacagcucuga

SEQ ID NO: 80942 - RNA, 22 nt, Human
gcagcguggggacaggagcuca

SEQ ID NO: 80943 - RNA, 20 nt, Human
gcagcuacucugucucgcuc

SEQ ID NO: 80944 - RNA, 22 nt, Human
gcagcucaagagaggugcuaug

SEQ ID NO: 80945 - RNA, 22 nt, Human
gcagcucccagcuugaaagguc

SEQ ID NO: 80946 - RNA, 22 nt, Human
gcagcucccuggcugcaaauga

SEQ ID NO: 80947 - RNA, 22 nt, Human
gcagcucuuuucuuaaagagau

SEQ ID NO: 80948 - RNA, 22 nt, Human
gcaugcacgggcacauaugcua

SEQ ID NO: 80949 - RNA, 19 nt, Human
gcaugcagaguaagaaggu

SEQ ID NO: 80950 - RNA, 22 nt, Human
gcaugcagagucccucugcauu

SEQ ID NO: 80951 - RNA, 22 nt, Human
gcaugcaggaaguuuuuuggga

SEQ ID NO: 80952 - RNA, 22 nt, Human
gcaugcaggagagaaagacggc

SEQ ID NO: 80953 - RNA, 22 nt, Human
gcaugcaggauagguugagcuc

SEQ ID NO: 80954 - RNA, 22 nt, Human
gcaugcaucuagauaugcagac

SEQ ID NO: 80955 - RNA, 22 nt, Human
gcaugcaugguuugugacugug

SEQ ID NO: 80956 - RNA, 22 nt, Human
gcaugcauuuguacuugauuuu

SEQ ID NO: 80957 - RNA, 22 nt, Human
gcaugcugcaccagagccucuc

SEQ ID NO: 80958 - RNA, 19 nt, Human
gcaugcuugguggcuucug

SEQ ID NO: 80959 - RNA, 22 nt, Human
gcauggaauucccuuaugggcc

SEQ ID NO: 80960 - RNA, 22 nt, Human
gcauggaucuaagaggucaagg

SEQ ID NO: 80961 - RNA, 20 nt, Human
gcauggcauguagugaagug

SEQ ID NO: 80962 - RNA, 22 nt, Human
gcauggccauggcacuauggac

SEQ ID NO: 80963 - RNA, 22 nt, Human
gcauggccuccagccaacagca

SEQ ID NO: 80964 - RNA, 22 nt, Human
gcauggccuucagggacagcug

SEQ ID NO: 80965 - RNA, 22 nt, Human
gcaugggcaccagucucuaggu

SEQ ID NO: 80966 - RNA, 22 nt, Human
gcaugggcuuucucagaguucu

SEQ ID NO: 80967 - RNA, 22 nt, Human
gcaugguggccuuaggguagcc

SEQ ID NO: 80968 - RNA, 22 nt, Human
gcauguggccuucaggcuggaa

SEQ ID NO: 80969 - RNA, 22 nt, Human
gcauguggugcugaggcugucg

SEQ ID NO: 80970 - RNA, 15 nt, Human
gcauguguaauaggc

SEQ ID NO: 80971 - RNA, 21 nt, Human
gcauguguggugugcuccaca

SEQ ID NO: 80972 - RNA, 22 nt, Human
gcauguguucuugaaaggccac

SEQ ID NO: 80973 - RNA, 22 nt, Human
gcauuaaaugcuagggaccuaa

SEQ ID NO: 80974 - RNA, 22 nt, Human
gcauuacagcaguucaacuugg

SEQ ID NO: 80975 - RNA, 22 nt, Human
gcauuacuucuuucauagguca

SEQ ID NO: 80976 - RNA, 22 nt, Human
gcauuagaagggaccucugggg

SEQ ID NO: 80977 - RNA, 22 nt, Human
gcauuauuaacuggaggaaaag

SEQ ID NO: 80978 - RNA, 22 nt, Human
gcauucauacaucaauaagcuu

SEQ ID NO: 80979 - RNA, 22 nt, Human
gcauucaucuucaugaaagcac

SEQ ID NO: 80980 - RNA, 22 nt, Human
gcauucauguccuuccugaacg

SEQ ID NO: 80981 - RNA, 22 nt, Human
gcauucauucaggcucccaggg

SEQ ID NO: 80982 - RNA, 22 nt, Human
gcauucauucauucauuaggua

SEQ ID NO: 80983 - RNA, 21 nt, Human
gcauuccuaggagguaagcau

SEQ ID NO: 80984 - RNA, 22 nt, Human
gcauuccuugaguucccugugc

SEQ ID NO: 80985 - RNA, 22 nt, Human
gcauucugugcuacagccauuc

SEQ ID NO: 80986 - RNA, 22 nt, Human
gcauucuuagggccuggggugu

SEQ ID NO: 80987 - RNA, 18 nt, Human
gcacucugacugcagagc

SEQ ID NO: 80988 - RNA, 22 nt, Human
gcacugaaaauguuggauucca

SEQ ID NO: 80989 - RNA, 22 nt, Human
gcacugaacuuuaaucauuucu

SEQ ID NO: 80990 - RNA, 18 nt, Human
gcacugaggaaaaccucu

SEQ ID NO: 80991 - RNA, 22 nt, Human
gcacugcaucuacuggcaagua

SEQ ID NO: 80992 - RNA, 22 nt, Human
gcacuggagauacagagaugaa

SEQ ID NO: 80993 - RNA, 16 nt, Human
gcacugggaugucuuc

SEQ ID NO: 80994 - RNA, 23 nt, Human
gcacugggcucucagcaaggugu

SEQ ID NO: 80995 - RNA, 22 nt, Human
gcacugugaucaaggcuaagca

SEQ ID NO: 80996 - RNA, 22 nt, Human
gcacugugcuagaagccagggg

SEQ ID NO: 80997 - RNA, 22 nt, Human
gcacuuaacuggaaaagaauuu

SEQ ID NO: 80998 - RNA, 22 nt, Human
gcacuuaugcucaccuuguucu

SEQ ID NO: 80999 - RNA, 22 nt, Human
gcacuuccaucugucaccaggu

SEQ ID NO: 81000 - RNA, 22 nt, Human
gcacuucuggccuggccugugu

SEQ ID NO: 81001 - RNA, 22 nt, Human
gcacuugaaaagaucaggugca

SEQ ID NO: 81002 - RNA, 22 nt, Human
gcacuugaagaauugaacugga

SEQ ID NO: 81003 - RNA, 22 nt, Human
gcacuugagccaaugcuaguag

SEQ ID NO: 81004 - RNA, 22 nt, Human
gcacuugauaaauguuaacuga

SEQ ID NO: 81005 - RNA, 22 nt, Human
gcacuugaucauuguuacagau

SEQ ID NO: 81006 - RNA, 22 nt, Human
gcacuuggaggugcccacacag

SEQ ID NO: 81007 - RNA, 22 nt, Human
gcacuugguaggacuucaguga

SEQ ID NO: 81008 - RNA, 22 nt, Human
gcacuugugacaguuccuggca

SEQ ID NO: 81009 - RNA, 22 nt, Human
gcacuuguggauuugauauaca

SEQ ID NO: 81010 - RNA, 22 nt, Human
gcagaaaccacagugucuuuua

SEQ ID NO: 81011 - RNA, 22 nt, Human
gcagaaacuuggagaagccagg

SEQ ID NO: 81012 - RNA, 22 nt, Human
gcagaaagcuccuugcgaucug

SEQ ID NO: 81013 - RNA, 21 nt, Human
gcagaaaggaaucuuaggucc

SEQ ID NO: 81014 - RNA, 22 nt, Human
gcagaacaacguaggaguggag

SEQ ID NO: 81015 - RNA, 22 nt, Human
gcagaagaccaugguggaaaga

SEQ ID NO: 81016 - RNA, 22 nt, Human
gcagaagcacaggugacgggcc

SEQ ID NO: 81017 - RNA, 22 nt, Human
gcagaagcagcagaugggcgca

SEQ ID NO: 81018 - RNA, 22 nt, Human
gcagaaggucaaagcaagaugu

SEQ ID NO: 81019 - RNA, 22 nt, Human
gcagaaguggugcugugccacu

SEQ ID NO: 81020 - RNA, 22 nt, Human
gcagaauacauuugggauuacu

SEQ ID NO: 81021 - RNA, 22 nt, Human
gcagaauacugagagcugauug

SEQ ID NO: 81022 - RNA, 22 nt, Human
gcagaauagggcauaacuuugc

SEQ ID NO: 81023 - RNA, 22 nt, Human
gcagaauauauuacugagccuc

SEQ ID NO: 81024 - RNA, 22 nt, Human
gcagacaauuuauuagcagauu

SEQ ID NO: 81025 - RNA, 22 nt, Human
gcagacaccuuguaggugugua

SEQ ID NO: 81026 - RNA, 18 nt, Human
gcagacacucguggaggg

SEQ ID NO: 81027 - RNA, 22 nt, Human
gcagacacuucccacugcagcg

SEQ ID NO: 81028 - RNA, 17 nt, Human
gcagacacuucuauuga

SEQ ID NO: 81029 - RNA, 22 nt, Human
gcagacaggauuggguuaauag

SEQ ID NO: 81030 - RNA, 22 nt, Human
gcagacagggcuacagagguac

SEQ ID NO: 81031 - RNA, 22 nt, Human
gcagacaucaccucagugcuau

SEQ ID NO: 81032 - RNA, 22 nt, Human
gcagacgucaccgagucgaugg

SEQ ID NO: 81033 - RNA, 22 nt, Human
gcagacugcgugaggcgccgcc

SEQ ID NO: 81034 - RNA, 22 nt, Human
gcagacuggucuucagccuugg

SEQ ID NO: 81035 - RNA, 22 nt, Human
gcagacuguaccuggaagaggg

SEQ ID NO: 81036 - RNA, 22 nt, Human
gcagagaacccagcagauuggc

SEQ ID NO: 81037 - RNA, 22 nt, Human
gcagagaaggauugaaaccaga

SEQ ID NO: 81038 - RNA, 23 nt, Human
gcagagacagccccagcgcgaug

SEQ ID NO: 81039 - RNA, 22 nt, Human
gcagagaggauauuauugucca

SEQ ID NO: 81040 - RNA, 22 nt, Human
gcagagaguugggcugcgccag

SEQ ID NO: 81041 - RNA, 22 nt, Human
gcagagauaaguagacaggaug

SEQ ID NO: 81042 - RNA, 22 nt, Human
gcagagcacccugcagugguau

SEQ ID NO: 81043 - RNA, 18 nt, Human
gcagagcagaagcucaag

SEQ ID NO: 81044 - RNA, 22 nt, Human
gcagagcagaggugcagguugg

SEQ ID NO: 81045 - RNA, 22 nt, Human
gcagagcaguacucucuugacu

SEQ ID NO: 81046 - RNA, 22 nt, Human
gcagagcauuucgguugcuucc

SEQ ID NO: 81047 - RNA, 22 nt, Human
gcagagccaggagcccaggauc

SEQ ID NO: 81048 - RNA, 22 nt, Human
gcagagccccauugcuggcggg

SEQ ID NO: 81049 - RNA, 22 nt, Human
gcagagccgugaauggauuuca

SEQ ID NO: 81050 - RNA, 21 nt, Human
gcagagccugagguucuugag

SEQ ID NO: 81051 - RNA, 22 nt, Human
gcagagccugugucugagcaaa

SEQ ID NO: 81052 - RNA, 22 nt, Human
gcagagccuugcgucaugugcc

SEQ ID NO: 81053 - RNA, 22 nt, Human
gcagagcucaugccugcaccuc

SEQ ID NO: 81054 - RNA, 22 nt, Human
gcagagcucuguucuuaucucc

SEQ ID NO: 81055 - RNA, 22 nt, Human
gcagagcugagcggcugcccgg

SEQ ID NO: 81056 - RNA, 23 nt, Human
gcagagcugcccuauugccuugg

SEQ ID NO: 81057 - RNA, 22 nt, Human
gcagguggaucaccacgucagg

SEQ ID NO: 81058 - RNA, 14 nt, Human
gcagguggaucacu

SEQ ID NO: 81059 - RNA, 22 nt, Human
gcaggugguggcgcgcgcccug

SEQ ID NO: 81060 - RNA, 22 nt, Human
gcaggugguggggcuaugaucu

SEQ ID NO: 81061 - RNA, 22 nt, Human
gcagguggugggggagccguuc

SEQ ID NO: 81062 - RNA, 22 nt, Human
gcaggugucugacugccuucuu

SEQ ID NO: 81063 - RNA, 22 nt, Human
gcaguaagauguaagugcuaua

SEQ ID NO: 81064 - RNA, 22 nt, Human
gcaguaggagggacaacuaccu

SEQ ID NO: 81065 - RNA, 22 nt, Human
gcaguaggaguuuccagggugg

SEQ ID NO: 81066 - RNA, 22 nt, Human
gcaguaggggcuggagggcugu

SEQ ID NO: 81067 - RNA, 22 nt, Human
gcaguaguccauaaguacucug

SEQ ID NO: 81068 - RNA, 22 nt, Human
gcaguaguucugauuggaacuu

SEQ ID NO: 81069 - RNA, 22 nt, Human
gcaguauauacucuuugagggg

SEQ ID NO: 81070 - RNA, 22 nt, Human
gcaguauauccauuacuucaua

SEQ ID NO: 81071 - RNA, 22 nt, Human
gcagucacagggagauggugac

SEQ ID NO: 81072 - RNA, 22 nt, Human
gcagucagguuaaggccuuccc

SEQ ID NO: 81073 - RNA, 22 nt, Human
gcagucaguaaggcagccagaa

SEQ ID NO: 81074 - RNA, 22 nt, Human
gcagucauggaaaaauguauac

SEQ ID NO: 81075 - RNA, 22 nt, Human
gcagucauggguagaacucaag

SEQ ID NO: 81076 - RNA, 22 nt, Human
gcaguccuagggugcucugcag

SEQ ID NO: 81077 - RNA, 22 nt, Human
gcaguccuggaggaagguguga

SEQ ID NO: 81078 - RNA, 22 nt, Human
gcagucuugccacaggguuuca

SEQ ID NO: 81079 - RNA, 22 nt, Human
gcagucuuuucugugacuggcu

SEQ ID NO: 81080 - RNA, 17 nt, Human
gcagugaaaagagauca

SEQ ID NO: 81081 - RNA, 18 nt, Human
gcagugaagaaagagcuu

SEQ ID NO: 81082 - RNA, 22 nt, Human
gcagugaagauuugggcucugg

SEQ ID NO: 81083 - RNA, 22 nt, Human
gcagugaagcaguccuuguuga

SEQ ID NO: 81084 - RNA, 22 nt, Human
gcagugaagccagaucugaaau

SEQ ID NO: 81085 - RNA, 22 nt, Human
gcagugacagacaacuguuuga

SEQ ID NO: 81086 - RNA, 22 nt, Human
gcagugcauuacucacauguuu

SEQ ID NO: 81087 - RNA, 18 nt, Human
gcagugccagccucuccu

SEQ ID NO: 81088 - RNA, 22 nt, Human
gcagugcuagccucacaggguc

SEQ ID NO: 81089 - RNA, 17 nt, Human
gcaguggagggguaguu

SEQ ID NO: 81090 - RNA, 22 nt, Human
gcaguggccacauggaggagga

SEQ ID NO: 81091 - RNA, 22 nt, Human
gcagugggaagguuggcacaug

SEQ ID NO: 81092 - RNA, 22 nt, Human
gcagugguggagcuuacauauc

SEQ ID NO: 81093 - RNA, 22 nt, Human
gcagugugaugcuuccagccac

SEQ ID NO: 81094 - RNA, 22 nt, Human
gcaguguggccccaguaucacg

SEQ ID NO: 81095 - RNA, 20 nt, Human
gcaguguguaugaauagcug

SEQ ID NO: 81096 - RNA, 22 nt, Human
gcaguguguguccccacacugg

SEQ ID NO: 81097 - RNA, 22 nt, Human
gcaguguuaggaauaaaaauga

SEQ ID NO: 81098 - RNA, 22 nt, Human
gcaguguucuaaauugggugug

SEQ ID NO: 81099 - RNA, 22 nt, Human
gcaguguuucccagagauggaa

SEQ ID NO: 81100 - RNA, 22 nt, Human
gcaguguuuuucaaugcuucca

SEQ ID NO: 81101 - RNA, 22 nt, Human
gcaguuaaaaauaaaccuucau

SEQ ID NO: 81102 - RNA, 17 nt, Human
gcaguuaaauuaagaug

SEQ ID NO: 81103 - RNA, 22 nt, Human
gcaguuacuagcaauuugugaa

SEQ ID NO: 81104 - RNA, 22 nt, Human
gcauucuucacaguauuccucc

SEQ ID NO: 81105 - RNA, 22 nt, Human
gcauucuuguuuuuccuacccu

SEQ ID NO: 81106 - RNA, 22 nt, Human
gcauucuuugaaugcuucuaau

SEQ ID NO: 81107 - RNA, 22 nt, Human
gcauugaaggcauuuuaucuac

SEQ ID NO: 81108 - RNA, 20 nt, Human
gcauugaguauagacagaug

SEQ ID NO: 81109 - RNA, 22 nt, Human
gcauugaucuguaugcauuaag

SEQ ID NO: 81110 - RNA, 22 nt, Human
gcauugaucuuuauucugcuuu

SEQ ID NO: 81111 - RNA, 23 nt, Human
gcauuguagaauguuuagcagca

SEQ ID NO: 81112 - RNA, 22 nt, Human
gcauuguccugcuucugagugu

SEQ ID NO: 81113 - RNA, 22 nt, Human
gcauuuauuucuuuacugcauc

SEQ ID NO: 81114 - RNA, 22 nt, Human
gcauuucaugcuccuuggaacc

SEQ ID NO: 81115 - RNA, 22 nt, Human
gcauuucugugcauacacauga

SEQ ID NO: 81116 - RNA, 22 nt, Human
gcauuuguuugggcuaaucuua

SEQ ID NO: 81117 - RNA, 18 nt, Human
gcauuuuaaucugaggca

SEQ ID NO: 81118 - RNA, 22 nt, Human
gcauuuuaaugagguuuaugag

SEQ ID NO: 81119 - RNA, 22 nt, Human
gcauuuuugaucccacuaggau

SEQ ID NO: 81120 - RNA, 22 nt, Human
gccaaaggaccugugggugaca

SEQ ID NO: 81121 - RNA, 22 nt, Human
gccaaaggauucuauggagaua

SEQ ID NO: 81122 - RNA, 17 nt, Human
gccaaaggguuccaauc

SEQ ID NO: 81123 - RNA, 22 nt, Human
gccaaaguaccuagcccucugc

SEQ ID NO: 81124 - RNA, 22 nt, Human
gccaaauaaguggaaucacaca

SEQ ID NO: 81125 - RNA, 22 nt, Human
gccaaauuugugagcccccaag

SEQ ID NO: 81126 - RNA, 22 nt, Human
gccaaccauuggcuucuuguca

SEQ ID NO: 81127 - RNA, 21 nt, Human
gccaagaacaagacagacaug

SEQ ID NO: 81128 - RNA, 22 nt, Human
gccaagaguuuccagcugcaag

SEQ ID NO: 81129 - RNA, 22 nt, Human
gccaagcuggaugaagagguug

SEQ ID NO: 81130 - RNA, 22 nt, Human
gccaaggaaggcuuccuggaag

SEQ ID NO: 81131 - RNA, 22 nt, Human
gccaauggcucaugagcaggac

SEQ ID NO: 81132 - RNA, 22 nt, Human
gccaauuuauagccaaaaauca

SEQ ID NO: 81133 - RNA, 23 nt, Human
gccaauuuuugacugucaguagg

SEQ ID NO: 81134 - RNA, 22 nt, Human
gccacacuuauucucaugcaca

SEQ ID NO: 81135 - RNA, 22 nt, Human
gccacagcagggcccucucagg

SEQ ID NO: 81136 - RNA, 22 nt, Human
gccacagggcagaugcgcagag

SEQ ID NO: 81137 - RNA, 22 nt, Human
gccacaggucggcuagaggguc

SEQ ID NO: 81138 - RNA, 22 nt, Human
gccacagucacugcugcagggg

SEQ ID NO: 81139 - RNA, 22 nt, Human
gccacauccuucagaaagcuuu

SEQ ID NO: 81140 - RNA, 22 nt, Human
gccaccagccccaugcgcugug

SEQ ID NO: 81141 - RNA, 22 nt, Human
gccaccagggggugcaaggucc

SEQ ID NO: 81142 - RNA, 22 nt, Human
gccaccagguuagauccagccu

SEQ ID NO: 81143 - RNA, 22 nt, Human
gccaccccaaccucccuaaguu

SEQ ID NO: 81144 - RNA, 22 nt, Human
gccaccccauagguguuaggug

SEQ ID NO: 81145 - RNA, 18 nt, Human
gccacccuccucgucucc

SEQ ID NO: 81146 - RNA, 22 nt, Human
gccacccuuaucccaugcuucu

SEQ ID NO: 81147 - RNA, 22 nt, Human
gccacccuugcgucacugacau

SEQ ID NO: 81148 - RNA, 22 nt, Human
gccaccucccaggacgaggcug

SEQ ID NO: 81149 - RNA, 22 nt, Human
gccaccucucucuugacucgag

SEQ ID NO: 81150 - RNA, 22 nt, Human
gccaccucuuugucucugccgc

SEQ ID NO: 81151 - RNA, 22 nt, Human
gccaccugguggcaucuucugg

SEQ ID NO: 81152 - RNA, 22 nt, Human
gccaccuguaagccauuaggcc

SEQ ID NO: 81153 - RNA, 22 nt, Human
gccaccugugugggccuuugug

SEQ ID NO: 81154 - RNA, 22 nt, Human
gccaccuguuucagaugugguu

SEQ ID NO: 81155 - RNA, 22 nt, Human
gccacugauuccaagucaauuu

SEQ ID NO: 81156 - RNA, 22 nt, Human
gccacuguacuccagccugcga

SEQ ID NO: 81157 - RNA, 22 nt, Human
gccacugucaucuugugaagca

SEQ ID NO: 81158 - RNA, 22 nt, Human
gccagaaacauacacaucacuu

SEQ ID NO: 81159 - RNA, 22 nt, Human
gccagaaagaggaggaccuggg

SEQ ID NO: 81160 - RNA, 22 nt, Human
gccagaagacuggagucagcug

SEQ ID NO: 81161 - RNA, 22 nt, Human
gccagaagggguggauccaggc

SEQ ID NO: 81162 - RNA, 22 nt, Human
gccagagacacuuggagguaga

SEQ ID NO: 81163 - RNA, 22 nt, Human
gccagagagacugauacaugcu

SEQ ID NO: 81164 - RNA, 22 nt, Human
gccagagagagucccugggccu

SEQ ID NO: 81165 - RNA, 22 nt, Human
gccagagaggcaaauccuagca

SEQ ID NO: 81166 - RNA, 22 nt, Human
gccagagaggccuuagaaucca

SEQ ID NO: 81167 - RNA, 22 nt, Human
gcauuagacccaagguauuuug

SEQ ID NO: 81168 - RNA, 22 nt, Human
gcauuagauuugccuuugaagc

SEQ ID NO: 81169 - RNA, 22 nt, Human
gcauucagccuaaagagaaaag

SEQ ID NO: 81170 - RNA, 22 nt, Human
gcauucaggaaccggaagggua

SEQ ID NO: 81171 - RNA, 22 nt, Human
gcauucaucaaaaauguuccuc

SEQ ID NO: 81172 - RNA, 22 nt, Human
gcauucaucuuccuccaugcag

SEQ ID NO: 81173 - RNA, 22 nt, Human
gcauucaugccugugugagcuc

SEQ ID NO: 81174 - RNA, 22 nt, Human
gcauucccaaaagacacuuacc

SEQ ID NO: 81175 - RNA, 22 nt, Human
gcauuccugagaaugcagagug

SEQ ID NO: 81176 - RNA, 22 nt, Human
gcauuccuguaccucucugcua

SEQ ID NO: 81177 - RNA, 22 nt, Human
gcauuccuuguuagcauuugau

SEQ ID NO: 81178 - RNA, 21 nt, Human
gcauucuucaugugauucaga

SEQ ID NO: 81179 - RNA, 22 nt, Human
gcauucuuccugggcugggggc

SEQ ID NO: 81180 - RNA, 22 nt, Human
gcauucuuuagacugagagaua

SEQ ID NO: 81181 - RNA, 23 nt, Human
gcauugaacaaaagaggggagua

SEQ ID NO: 81182 - RNA, 22 nt, Human
gcauugaaccaucuagauuucu

SEQ ID NO: 81183 - RNA, 22 nt, Human
gcauugaaggacuuccauuaua

SEQ ID NO: 81184 - RNA, 22 nt, Human
gcauugaguccacucugucuuu

SEQ ID NO: 81185 - RNA, 22 nt, Human
gcauugauuuaaacaucucucu

SEQ ID NO: 81186 - RNA, 22 nt, Human
gcauugguuuacacagggugaa

SEQ ID NO: 81187 - RNA, 22 nt, Human
gcauuuaaauuugaacuucaga

SEQ ID NO: 81188 - RNA, 22 nt, Human
gcauuuauuaucugccaggcac

SEQ ID NO: 81189 - RNA, 22 nt, Human
gcauuucaaaauuccaggcaag

SEQ ID NO: 81190 - RNA, 22 nt, Human
gcauuuccugugcuuggcauau

SEQ ID NO: 81191 - RNA, 22 nt, Human
gcauuuguacaaaaugcaguag

SEQ ID NO: 81192 - RNA, 22 nt, Human
gcauuuuagaauauuggagcaa

SEQ ID NO: 81193 - RNA, 22 nt, Human
gcauuuuauaaagaguuauuug

SEQ ID NO: 81194 - RNA, 22 nt, Human
gcauuuugaggcugggggagca

SEQ ID NO: 81195 - RNA, 22 nt, Human
gcauuuuucuaaucauuggcau

SEQ ID NO: 81196 - RNA, 22 nt, Human
gccaaagcuggagguggaggug

SEQ ID NO: 81197 - RNA, 22 nt, Human
gccaaauacaguagucauugcc

SEQ ID NO: 81198 - RNA, 22 nt, Human
gccaaauauaauucuccaccuu

SEQ ID NO: 81199 - RNA, 22 nt, Human
gccaagccuguagacacaagcu

SEQ ID NO: 81200 - RNA, 22 nt, Human
gccaagcucaccuucugaugga

SEQ ID NO: 81201 - RNA, 22 nt, Human
gccaagcucuuuaaaggccaaa

SEQ ID NO: 81202 - RNA, 22 nt, Human
gccaagcuguuuuucagagacg

SEQ ID NO: 81203 - RNA, 21 nt, Human
gccaaggaggcuagagaacau

SEQ ID NO: 81204 - RNA, 22 nt, Human
gccaaggccucugcaggaugag

SEQ ID NO: 81205 - RNA, 22 nt, Human
gccaagggggcagugcaugggu

SEQ ID NO: 81206 - RNA, 22 nt, Human
gccaaggguaguggaggccccu

SEQ ID NO: 81207 - RNA, 22 nt, Human
gccaaucaggaggcuguacauc

SEQ ID NO: 81208 - RNA, 22 nt, Human
gccaaucuuugacuauaugugu

SEQ ID NO: 81209 - RNA, 22 nt, Human
gccacagacagagagucuagug

SEQ ID NO: 81210 - RNA, 22 nt, Human
gccacagcccgagcaccaugag

SEQ ID NO: 81211 - RNA, 22 nt, Human
gccacagcggggccgcuagagc

SEQ ID NO: 81212 - RNA, 22 nt, Human
gccacagcuccagucaggugac

SEQ ID NO: 81213 - RNA, 22 nt, Human
gccacagcuuagaucacagccu

SEQ ID NO: 81214 - RNA, 19 nt, Human
gccacaggaugaaguuugg

SEQ ID NO: 81215 - RNA, 22 nt, Human
gccacagggaggcguuuucagg

SEQ ID NO: 81216 - RNA, 22 nt, Human
gccacauccagguggaucaaau

SEQ ID NO: 81217 - RNA, 22 nt, Human
gucccaggcuccauggcagcca

SEQ ID NO: 81218 - RNA, 22 nt, Human
gucccagggaugcagacaugag

SEQ ID NO: 81219 - RNA, 22 nt, Human
gucccagggcaaggcuguuucu

SEQ ID NO: 81220 - RNA, 22 nt, Human
guccccucauuuuagagaaaga

SEQ ID NO: 81221 - RNA, 22 nt, Human
guccccuggcccccagcgucgg

SEQ ID NO: 81222 - RNA, 22 nt, Human
guccccugguggcuggagcugc

SEQ ID NO: 81223 - RNA, 22 nt, Human
guccccuuaaacaugcucucuu

SEQ ID NO: 81224 - RNA, 22 nt, Human
gucccuaguggaaagacaugau

SEQ ID NO: 81225 - RNA, 23 nt, Human
gucccucaccccuaggcaaugcc

SEQ ID NO: 81226 - RNA, 22 nt, Human
gucccucacuggaccauaugaa

SEQ ID NO: 81227 - RNA, 22 nt, Human
gucccucaguagugcacagugg

SEQ ID NO: 81228 - RNA, 22 nt, Human
gucccucugcucuagagagcca

SEQ ID NO: 81229 - RNA, 22 nt, Human
gucccucugggccaucaggucc

SEQ ID NO: 81230 - RNA, 22 nt, Human
gucccugauaagagccaucgau

SEQ ID NO: 81231 - RNA, 22 nt, Human
gucccuggaaaagagcugguga

SEQ ID NO: 81232 - RNA, 22 nt, Human
gucccuggaucugggacagcug

SEQ ID NO: 81233 - RNA, 22 nt, Human
gucccuggucuaccguggcuuc

SEQ ID NO: 81234 - RNA, 22 nt, Human
gucccugguuugcccaggacca

SEQ ID NO: 81235 - RNA, 19 nt, Human
gucccuucacuccugcugg

SEQ ID NO: 81236 - RNA, 22 nt, Human
gucccuuccucauuccacuuua

SEQ ID NO: 81237 - RNA, 22 nt, Human
guccuaaauauagugauucaug

SEQ ID NO: 81238 - RNA, 22 nt, Human
guccuaaucucuucuuauaagg

SEQ ID NO: 81239 - RNA, 17 nt, Human
guccuacccauggucua

SEQ ID NO: 81240 - RNA, 23 nt, Human
guccuagugcuuggugcccaggc

SEQ ID NO: 81241 - RNA, 22 nt, Human
guccuauuagcauauugaauac

SEQ ID NO: 81242 - RNA, 23 nt, Human
guccuauuuuuugaaauacugag

SEQ ID NO: 81243 - RNA, 22 nt, Human
guccucagaugcugcugaaaug

SEQ ID NO: 81244 - RNA, 21 nt, Human
guccucagcugaugggagcug

SEQ ID NO: 81245 - RNA, 22 nt, Human
guccucaggaaagcagauaaca

SEQ ID NO: 81246 - RNA, 22 nt, Human
guccucaggaaggcuuucugac

SEQ ID NO: 81247 - RNA, 22 nt, Human
guccucuccaggaggcucugau

SEQ ID NO: 81248 - RNA, 22 nt, Human
guccucugagggggcugcacgc

SEQ ID NO: 81249 - RNA, 22 nt, Human
guccucugcccaggucaagguu

SEQ ID NO: 81250 - RNA, 22 nt, Human
guccucugcuucaugcccugau

SEQ ID NO: 81251 - RNA, 22 nt, Human
guccucuggaagaugaguucuu

SEQ ID NO: 81252 - RNA, 22 nt, Human
guccucuggccuuucccaggac

SEQ ID NO: 81253 - RNA, 22 nt, Human
guccucugggcagcugccccac

SEQ ID NO: 81254 - RNA, 22 nt, Human
guccugaaugccuuuaggcaga

SEQ ID NO: 81255 - RNA, 22 nt, Human
guccugagucaagugugggcag

SEQ ID NO: 81256 - RNA, 22 nt, Human
guccugcuuguuaggccuaguc

SEQ ID NO: 81257 - RNA, 22 nt, Human
guccuggcuagucguccgcgac

SEQ ID NO: 81258 - RNA, 20 nt, Human
guccugggagccacagcaca

SEQ ID NO: 81259 - RNA, 22 nt, Human
guccugggaggggcugguccug

SEQ ID NO: 81260 - RNA, 22 nt, Human
guccuggggaauacagaagccg

SEQ ID NO: 81261 - RNA, 22 nt, Human
guccuggggauacagaagugaa

SEQ ID NO: 81262 - RNA, 22 nt, Human
guccugggggcagcugugucca

SEQ ID NO: 81263 - RNA, 22 nt, Human
guccuggguccccgcaggucag

SEQ ID NO: 81264 - RNA, 22 nt, Human
guccuggugccaccugcgggau

SEQ ID NO: 81265 - RNA, 22 nt, Human
guccugguggagucucugggga

SEQ ID NO: 81266 - RNA, 17 nt, Human
guccuggugugugagga

SEQ ID NO: 81267 - RNA, 22 nt, Human
guccugguuuucacagaccuuu

SEQ ID NO: 81268 - RNA, 22 nt, Human
guccugugccgaggugggaagc

SEQ ID NO: 81269 - RNA, 22 nt, Human
guccuguguaaguacuugcuca

SEQ ID NO: 81270 - RNA, 22 nt, Human
guccugugugacuucccaaaug

SEQ ID NO: 81271 - RNA, 22 nt, Human
guccuguuggugaauggcucuu

SEQ ID NO: 81272 - RNA, 22 nt, Human
guccuucauggaguuacagccu

SEQ ID NO: 81273 - RNA, 22 nt, Human
guccuucauuuccugaucucua

SEQ ID NO: 81274 - RNA, 22 nt, Human
guccuucuuuucaucccugguu

SEQ ID NO: 81275 - RNA, 22 nt, Human
guccuuggcauucugagucuug

SEQ ID NO: 81276 - RNA, 22 nt, Human
gugaagcacaugggcguugggu

SEQ ID NO: 81277 - RNA, 22 nt, Human
gugaagcacgcugccgcacugg

SEQ ID NO: 81278 - RNA, 22 nt, Human
gugaagcagggaaggaaaggau

SEQ ID NO: 81279 - RNA, 22 nt, Human
gugaagcauaacugaaggauuu

SEQ ID NO: 81280 - RNA, 22 nt, Human
gugaaggaguuaucagugguua

SEQ ID NO: 81281 - RNA, 20 nt, Human
gugaaggcuaagcacagagg

SEQ ID NO: 81282 - RNA, 22 nt, Human
gugaaggcuaauuaaacaaguu

SEQ ID NO: 81283 - RNA, 22 nt, Human
gugaaggcuacaagagaucaag

SEQ ID NO: 81284 - RNA, 23 nt, Human
gugaagguuucugcauuuauugg

SEQ ID NO: 81285 - RNA, 22 nt, Human
gugaagucaagaaugcaauuug

SEQ ID NO: 81286 - RNA, 19 nt, Human
gugaagugccagaagucag

SEQ ID NO: 81287 - RNA, 22 nt, Human
gugaaguugauuguuaucguca

SEQ ID NO: 81288 - RNA, 22 nt, Human
gugaauaaagggaguuuucaaa

SEQ ID NO: 81289 - RNA, 22 nt, Human
gugaauaaccuacuccaggccu

SEQ ID NO: 81290 - RNA, 22 nt, Human
gugaauaauuuuuuaguauaag

SEQ ID NO: 81291 - RNA, 22 nt, Human
gugaauauucuuugugcaguau

SEQ ID NO: 81292 - RNA, 22 nt, Human
gugaaugacuguuuucagcauu

SEQ ID NO: 81293 - RNA, 22 nt, Human
gugaaugcaaacuguuucugau

SEQ ID NO: 81294 - RNA, 22 nt, Human
gugaaugccgcagucuguugcu

SEQ ID NO: 81295 - RNA, 22 nt, Human
gugaauuacauguauuuuuaag

SEQ ID NO: 81296 - RNA, 22 nt, Human
gugacaaaaacacugauuauuu

SEQ ID NO: 81297 - RNA, 22 nt, Human
gugacagagcugggauuugaag

SEQ ID NO: 81298 - RNA, 22 nt, Human
gugacagcuccuugguuagaug

SEQ ID NO: 81299 - RNA, 22 nt, Human
gugacaggccacugcggcucug

SEQ ID NO: 81300 - RNA, 22 nt, Human
gugacagggagugauauagcag

SEQ ID NO: 81301 - RNA, 22 nt, Human
gugacagucaaagacaugacuu

SEQ ID NO: 81302 - RNA, 22 nt, Human
gugacaguggucacuuguaguu

SEQ ID NO: 81303 - RNA, 22 nt, Human
gugacauuucgugacgugagaa

SEQ ID NO: 81304 - RNA, 22 nt, Human
gugaccagccagugcugucugu

SEQ ID NO: 81305 - RNA, 22 nt, Human
gugaccaucaucucagcuaguu

SEQ ID NO: 81306 - RNA, 22 nt, Human
gugacccaugcagugguuuugg

SEQ ID NO: 81307 - RNA, 18 nt, Human
gugacguuuuggaugauu

SEQ ID NO: 81308 - RNA, 22 nt, Human
gugacucuuaaagcaaaucuug

SEQ ID NO: 81309 - RNA, 22 nt, Human
gugacucuuaccuacccagccu

SEQ ID NO: 81310 - RNA, 22 nt, Human
gugacuguuuuuaggaggagua

SEQ ID NO: 81311 - RNA, 22 nt, Human
gugagacaagauuuguaggcag

SEQ ID NO: 81312 - RNA, 22 nt, Human
gugagagcucagcugcccuggg

SEQ ID NO: 81313 - RNA, 22 nt, Human
gugagagcugcuagacuguuau

SEQ ID NO: 81314 - RNA, 22 nt, Human
gugagagggcugggcucaugau

SEQ ID NO: 81315 - RNA, 22 nt, Human
gugagcaauucaaaggcaggaa

SEQ ID NO: 81316 - RNA, 22 nt, Human
gugagcagaacagguggcuucu

SEQ ID NO: 81317 - RNA, 23 nt, Human
gugagcagcaccaugaggcuaga

SEQ ID NO: 81318 - RNA, 23 nt, Human
gugagcagcccacuaggaaugcc

SEQ ID NO: 81319 - RNA, 22 nt, Human
gugagcagcucaggguggucuc

SEQ ID NO: 81320 - RNA, 22 nt, Human
gugagcaggauuucauggugua

SEQ ID NO: 81321 - RNA, 22 nt, Human
gugagcaguuuguuccagaauc

SEQ ID NO: 81322 - RNA, 22 nt, Human
gugagcauauauguaaucguuu

SEQ ID NO: 81323 - RNA, 22 nt, Human
gugagccaauaccaugcuguuc

SEQ ID NO: 81324 - RNA, 17 nt, Human
gugagcugagucaggac

SEQ ID NO: 81325 - RNA, 22 nt, Human
gugagcuggaauaguggagaaa

SEQ ID NO: 81326 - RNA, 22 nt, Human
gugagcuucugccucucagucc

SEQ ID NO: 81327 - RNA, 22 nt, Human
gugaggacuaguggguuugugc

SEQ ID NO: 81328 - RNA, 22 nt, Human
gugaggacugguaaggacugca

SEQ ID NO: 81329 - RNA, 22 nt, Human
gugaggagggcuggucccaggc

SEQ ID NO: 81330 - RNA, 22 nt, Human
gugaggaugcagaugagggccu

SEQ ID NO: 81331 - RNA, 22 nt, Human
gugaggcagggaaagaggauaa

SEQ ID NO: 81332 - RNA, 19 nt, Human
gccacaucuguaccccuuu

SEQ ID NO: 81333 - RNA, 19 nt, Human
gccacaucuuuuccagagu

SEQ ID NO: 81334 - RNA, 22 nt, Human
gccacauuagcccucaccaucu

SEQ ID NO: 81335 - RNA, 22 nt, Human
gccaccagcagaaaaggggcca

SEQ ID NO: 81336 - RNA, 22 nt, Human
gccaccaguagcuaacaacagu

SEQ ID NO: 81337 - RNA, 22 nt, Human
gccaccagugggggccugggca

SEQ ID NO: 81338 - RNA, 22 nt, Human
gccacccccaaguagguggucu

SEQ ID NO: 81339 - RNA, 21 nt, Human
gccaccccuggcacaggugcu

SEQ ID NO: 81340 - RNA, 22 nt, Human
gccacccugagcugggccaggg

SEQ ID NO: 81341 - RNA, 22 nt, Human
gccacccuggacgcacuguucg

SEQ ID NO: 81342 - RNA, 22 nt, Human
gccaccugccaacuugcuggaa

SEQ ID NO: 81343 - RNA, 22 nt, Human
gccaccugcgggccguggugga

SEQ ID NO: 81344 - RNA, 22 nt, Human
gccaccuggacagcugugcccu

SEQ ID NO: 81345 - RNA, 22 nt, Human
gccaccuuccaaaauaaucaca

SEQ ID NO: 81346 - RNA, 22 nt, Human
gccacugauuauucagcagaca

SEQ ID NO: 81347 - RNA, 22 nt, Human
gccacuggacccagaaagggaa

SEQ ID NO: 81348 - RNA, 22 nt, Human
gccacuggcaucuaguugguag

SEQ ID NO: 81349 - RNA, 22 nt, Human
gccacuggcgcugugcagagug

SEQ ID NO: 81350 - RNA, 22 nt, Human
gccacugugguccucccaugau

SEQ ID NO: 81351 - RNA, 22 nt, Human
gccagagccuguggauuuaacc

SEQ ID NO: 81352 - RNA, 22 nt, Human
gccagagcuucccccgagugug

SEQ ID NO: 81353 - RNA, 22 nt, Human
gccagagcuugguuuuuauuua

SEQ ID NO: 81354 - RNA, 20 nt, Human
gccagaggccggcaggggcu

SEQ ID NO: 81355 - RNA, 22 nt, Human
gccagaggcucagguugccaug

SEQ ID NO: 81356 - RNA, 18 nt, Human
gccagagggaagcaggug

SEQ ID NO: 81357 - RNA, 22 nt, Human
gccagagggauuccuggugugu

SEQ ID NO: 81358 - RNA, 22 nt, Human
gccagaggggcucgaaggcgcg

SEQ ID NO: 81359 - RNA, 22 nt, Human
gccagcagggaagccuugggcu

SEQ ID NO: 81360 - RNA, 22 nt, Human
gccagcagguugucaaggagcu

SEQ ID NO: 81361 - RNA, 22 nt, Human
gccagcaguggccaccaccagg

SEQ ID NO: 81362 - RNA, 22 nt, Human
gccagccacguuagacuggccc

SEQ ID NO: 81363 - RNA, 18 nt, Human
gccagccaggcguugcuc

SEQ ID NO: 81364 - RNA, 22 nt, Human
gccagcccugggagacuuaugg

SEQ ID NO: 81365 - RNA, 22 nt, Human
gccagccugugcuuggccaggc

SEQ ID NO: 81366 - RNA, 21 nt, Human
gccagccuguuuaccuguggu

SEQ ID NO: 81367 - RNA, 22 nt, Human
gccagcucagaugcaggaagga

SEQ ID NO: 81368 - RNA, 22 nt, Human
gccagcucccaagugagccccu

SEQ ID NO: 81369 - RNA, 22 nt, Human
gccagcucucauuguauaggcu

SEQ ID NO: 81370 - RNA, 22 nt, Human
gccagcugagaaaucauugaua

SEQ ID NO: 81371 - RNA, 22 nt, Human
gccagcugagcaaauuccagcu

SEQ ID NO: 81372 - RNA, 22 nt, Human
gccagcugcaucuccugggcug

SEQ ID NO: 81373 - RNA, 22 nt, Human
gccagcugcucgcguaggguag

SEQ ID NO: 81374 - RNA, 22 nt, Human
gccagcuggagugagagugggc

SEQ ID NO: 81375 - RNA, 21 nt, Human
gccagcugggucuugcaggag

SEQ ID NO: 81376 - RNA, 22 nt, Human
gccagcuguaagcagugauucu

SEQ ID NO: 81377 - RNA, 22 nt, Human
gccagcuguuucagagcccagu

SEQ ID NO: 81378 - RNA, 22 nt, Human
gccagcuuccauggccacguca

SEQ ID NO: 81379 - RNA, 22 nt, Human
gccagcuuggcaugugaggagu

SEQ ID NO: 81380 - RNA, 22 nt, Human
gccagcuuggccaguggccagu

SEQ ID NO: 81381 - RNA, 22 nt, Human
gccaggaacacaaugccaagcu

SEQ ID NO: 81382 - RNA, 18 nt, Human
gccaggaagcauggggac

SEQ ID NO: 81383 - RNA, 22 nt, Human
gccaggaaggcugaagccagaa

SEQ ID NO: 81384 - RNA, 22 nt, Human
gccaggaaguugggccagucua

SEQ ID NO: 81385 - RNA, 22 nt, Human
guggaaaugcccccaaauagug

SEQ ID NO: 81386 - RNA, 22 nt, Human
guggaagcaacccuggcaggag

SEQ ID NO: 81387 - RNA, 22 nt, Human
guggaaggugaaggagcagcga

SEQ ID NO: 81388 - RNA, 20 nt, Human
guggaaugcacucugugcug

SEQ ID NO: 81389 - RNA, 22 nt, Human
guggaauguccuugaucauaag

SEQ ID NO: 81390 - RNA, 22 nt, Human
guggacagagcuagaaaaugug

SEQ ID NO: 81391 - RNA, 22 nt, Human
guggacugcgcuugagggggcc

SEQ ID NO: 81392 - RNA, 22 nt, Human
guggagaccuccuaggaugugu

SEQ ID NO: 81393 - RNA, 22 nt, Human
guggagagagauaagccugguc

SEQ ID NO: 81394 - RNA, 22 nt, Human
guggagaggaacccagcucugu

SEQ ID NO: 81395 - RNA, 22 nt, Human
guggagaggagcagcuaccuca

SEQ ID NO: 81396 - RNA, 20 nt, Human
guggagaggcuggcgggacu

SEQ ID NO: 81397 - RNA, 21 nt, Human
guggagagugauuuugaugca

SEQ ID NO: 81398 - RNA, 22 nt, Human
guggagccaggaucuccgcaca

SEQ ID NO: 81399 - RNA, 22 nt, Human
guggagcccugccuugcucaug

SEQ ID NO: 81400 - RNA, 22 nt, Human
guggagcuggacccaggccucu

SEQ ID NO: 81401 - RNA, 22 nt, Human
guggagcuggcccaagaagcug

SEQ ID NO: 81402 - RNA, 22 nt, Human
guggaggaaaagaaguugggug

SEQ ID NO: 81403 - RNA, 22 nt, Human
guggagggugagcucauguuug

SEQ ID NO: 81404 - RNA, 18 nt, Human
guggaggguucucagaau

SEQ ID NO: 81405 - RNA, 22 nt, Human
guggaggucccgggcaggagca

SEQ ID NO: 81406 - RNA, 17 nt, Human
guggaggugcucuggua

SEQ ID NO: 81407 - RNA, 22 nt, Human
guggaguggccuggcccugaga

SEQ ID NO: 81408 - RNA, 22 nt, Human
guggaucuacuguaugggauag

SEQ ID NO: 81409 - RNA, 20 nt, Human
guggaugaucaguguagugg

SEQ ID NO: 81410 - RNA, 22 nt, Human
guggaugaugagugacuacaga

SEQ ID NO: 81411 - RNA, 22 nt, Human
guggauggauugaggcaguggg

SEQ ID NO: 81412 - RNA, 22 nt, Human
guggauggcuaguugagaaggg

SEQ ID NO: 81413 - RNA, 22 nt, Human
guggcaaguguuccaagaggcg

SEQ ID NO: 81414 - RNA, 22 nt, Human
guggcacuaaauacagcauuuc

SEQ ID NO: 81415 - RNA, 22 nt, Human
guggcagaacuaugugauugcu

SEQ ID NO: 81416 - RNA, 22 nt, Human
guggcagagagcaagugucuga

SEQ ID NO: 81417 - RNA, 22 nt, Human
guggcagagcaggagacaggac

SEQ ID NO: 81418 - RNA, 22 nt, Human
guggcagagccaggcuuugaac

SEQ ID NO: 81419 - RNA, 22 nt, Human
guggcagagccgugcagguagg

SEQ ID NO: 81420 - RNA, 22 nt, Human
guggcagaggcucugggaccag

SEQ ID NO: 81421 - RNA, 22 nt, Human
guggcagagggugagcuggacu

SEQ ID NO: 81422 - RNA, 22 nt, Human
guggcagaguugcugacuagaa

SEQ ID NO: 81423 - RNA, 19 nt, Human
guggcagcagauuuggugu

SEQ ID NO: 81424 - RNA, 22 nt, Human
guggcagccgcaggcccugugu

SEQ ID NO: 81425 - RNA, 18 nt, Human
guggcagccuuuggcuuu

SEQ ID NO: 81426 - RNA, 22 nt, Human
guggcagcggugugcaaggagg

SEQ ID NO: 81427 - RNA, 22 nt, Human
guggcaggagagacacagccau

SEQ ID NO: 81428 - RNA, 22 nt, Human
guggcaggagugggccuugaag

SEQ ID NO: 81429 - RNA, 22 nt, Human
guggcaggggcgggcuguuccg

SEQ ID NO: 81430 - RNA, 22 nt, Human
guggcagugaaggucauagcau

SEQ ID NO: 81431 - RNA, 22 nt, Human
guggcagugggaugcuaucagg

SEQ ID NO: 81432 - RNA, 20 nt, Human
guggcagugguggcagcagu

SEQ ID NO: 81433 - RNA, 22 nt, Human
guggcagugugaggauccugcu

SEQ ID NO: 81434 - RNA, 22 nt, Human
guggcaguguggagggaggagu

SEQ ID NO: 81435 - RNA, 22 nt, Human
guggcauuuggaaagagcacua

SEQ ID NO: 81436 - RNA, 22 nt, Human
guggccaaacaccaguuuagga

SEQ ID NO: 81437 - RNA, 22 nt, Human
guggccaacucaauguuuuuca

SEQ ID NO: 81438 - RNA, 22 nt, Human
guggccaaggcagagaaagagc

SEQ ID NO: 81439 - RNA, 22 nt, Human
guggccaauaggagcagcuauc

SEQ ID NO: 81440 - RNA, 22 nt, Human
guggccagccagggugcugaug

SEQ ID NO: 81441 - RNA, 19 nt, Human
guggccagggcaggggcug

SEQ ID NO: 81442 - RNA, 22 nt, Human
guggccagggcccacaggauga

SEQ ID NO: 81443 - RNA, 22 nt, Human
guggccagucccgaugcuuguu

SEQ ID NO: 81444 - RNA, 21 nt, Human
guggccagugacuacuuauug

SEQ ID NO: 81445 - RNA, 22 nt, Human
guggccagugggaaugggcuca

SEQ ID NO: 81446 - RNA, 22 nt, Human
guggccauaggaggucagauga

SEQ ID NO: 81447 - RNA, 22 nt, Human
guggcccacuuacgucaugugu

SEQ ID NO: 81448 - RNA, 22 nt, Human
guggcccaggcacccugaugac

SEQ ID NO: 81449 - RNA, 22 nt, Human
guggcccuaacaccguuucuca

SEQ ID NO: 81450 - RNA, 22 nt, Human
guggcccucagcaguugccaag

SEQ ID NO: 81451 - RNA, 21 nt, Human
guggcccugccgcagugucca

SEQ ID NO: 81452 - RNA, 22 nt, Human
guggcccuggaguugugacacu

SEQ ID NO: 81453 - RNA, 20 nt, Human
guggcccuuaaagagggaag

SEQ ID NO: 81454 - RNA, 22 nt, Human
gcccucagaugggaaaggaggg

SEQ ID NO: 81455 - RNA, 22 nt, Human
gcccucagcauccucagggcca

SEQ ID NO: 81456 - RNA, 22 nt, Human
gcccucagcuccuggacacaug

SEQ ID NO: 81457 - RNA, 22 nt, Human
gcccucagcuugauguuguucu

SEQ ID NO: 81458 - RNA, 22 nt, Human
gcccuccaugagacacagugua

SEQ ID NO: 81459 - RNA, 22 nt, Human
gcccuccccucuggguggugag

SEQ ID NO: 81460 - RNA, 22 nt, Human
gcccucccuacagccuauuucu

SEQ ID NO: 81461 - RNA, 23 nt, Human
gcccucccucccagguggguguu

SEQ ID NO: 81462 - RNA, 22 nt, Human
gcccuccuuugcuucuccuagu

SEQ ID NO: 81463 - RNA, 22 nt, Human
gcccucugccacaggacgccag

SEQ ID NO: 81464 - RNA, 22 nt, Human
gcccucugcucagcuccucagc

SEQ ID NO: 81465 - RNA, 22 nt, Human
gcccucuggcacagagaugcag

SEQ ID NO: 81466 - RNA, 22 nt, Human
gcccucuggcagccuuggcugg

SEQ ID NO: 81467 - RNA, 22 nt, Human
gcccucuggugggugagccccg

SEQ ID NO: 81468 - RNA, 22 nt, Human
gcccugaacgaggggucuggag

SEQ ID NO: 81469 - RNA, 22 nt, Human
gcccugaauuccucaggcugug

SEQ ID NO: 81470 - RNA, 22 nt, Human
gcccugaccuucacugacucuc

SEQ ID NO: 81471 - RNA, 22 nt, Human
gcccugagacugagcauggguu

SEQ ID NO: 81472 - RNA, 22 nt, Human
gcccugagcacacaguagcaaa

SEQ ID NO: 81473 - RNA, 22 nt, Human
gcccugagcuagugugggcagg

SEQ ID NO: 81474 - RNA, 22 nt, Human
gcccugcccuguugaaacuaga

SEQ ID NO: 81475 - RNA, 23 nt, Human
gcccugcccuuagcacacucaca

SEQ ID NO: 81476 - RNA, 17 nt, Human
gcccugccugcugcccu

SEQ ID NO: 81477 - RNA, 23 nt, Human
gcccugcuacucacaagcugugu

SEQ ID NO: 81478 - RNA, 22 nt, Human
gcccugcucuggucucugcccg

SEQ ID NO: 81479 - RNA, 22 nt, Human
gcccuggaaucucuccauggga

SEQ ID NO: 81480 - RNA, 20 nt, Human
gcccuggacguggccucggc

SEQ ID NO: 81481 - RNA, 22 nt, Human
gcccuggaugcucauggcauca

SEQ ID NO: 81482 - RNA, 22 nt, Human
gcccuggauguacaggcauguu

SEQ ID NO: 81483 - RNA, 22 nt, Human
gcccuggcaccucguugcccag

SEQ ID NO: 81484 - RNA, 22 nt, Human
gcccuggggaaggugucuccaa

SEQ ID NO: 81485 - RNA, 22 nt, Human
gcccuguauccaagucccaucu

SEQ ID NO: 81486 - RNA, 22 nt, Human
gcccugucccuuggcuucuagg

SEQ ID NO: 81487 - RNA, 22 nt, Human
gcccuguccuccugacugagug

SEQ ID NO: 81488 - RNA, 22 nt, Human
gcccugugagauuagaacagca

SEQ ID NO: 81489 - RNA, 22 nt, Human
gcccugugguuccaggaagcaa

SEQ ID NO: 81490 - RNA, 22 nt, Human
gcccuguguauccccugugcuu

SEQ ID NO: 81491 - RNA, 22 nt, Human
gcccugugugaucacaugaaca

SEQ ID NO: 81492 - RNA, 22 nt, Human
gcccuguguguuugcacugauu

SEQ ID NO: 81493 - RNA, 22 nt, Human
gcccuguugucggacgucaagg

SEQ ID NO: 81494 - RNA, 22 nt, Human
guuauguaugagggaaugauua

SEQ ID NO: 81495 - RNA, 22 nt, Human
guuauguauugggaaauccaag

SEQ ID NO: 81496 - RNA, 22 nt, Human
guuauuagaagugaaggauugu

SEQ ID NO: 81497 - RNA, 22 nt, Human
guuauuaguaagacucgcacau

SEQ ID NO: 81498 - RNA, 22 nt, Human
guuauuaucuugaggaaucugu

SEQ ID NO: 81499 - RNA, 22 nt, Human
guuauuauuucucuccuugcua

SEQ ID NO: 81500 - RNA, 22 nt, Human
guuauucuagugcucagccauu

SEQ ID NO: 81501 - RNA, 22 nt, Human
guuauucugcacaccuuuaaaa

SEQ ID NO: 81502 - RNA, 22 nt, Human
guuauucugccaaacuuccaca

SEQ ID NO: 81503 - RNA, 22 nt, Human
guuauugagguggagucucacu

SEQ ID NO: 81504 - RNA, 23 nt, Human
guuauugcuggugcuggccagcc

SEQ ID NO: 81505 - RNA, 22 nt, Human
guuauuguuuauccugcacccc

SEQ ID NO: 81506 - RNA, 22 nt, Human
guuauuuucauuggcucagacu

SEQ ID NO: 81507 - RNA, 22 nt, Human
guucaaauggcugcaguuacca

SEQ ID NO: 81508 - RNA, 22 nt, Human
guucaaauuuuggcuguacugc

SEQ ID NO: 81509 - RNA, 22 nt, Human
guucaaggaagggaggaaagcc

SEQ ID NO: 81510 - RNA, 22 nt, Human
guucaaguucauaucucuuaac

SEQ ID NO: 81511 - RNA, 22 nt, Human
guucacaaaguacuguaugcau

SEQ ID NO: 81512 - RNA, 22 nt, Human
guucacaagcuggguuucugca

SEQ ID NO: 81513 - RNA, 22 nt, Human
guucacaauggcuuuaccuaag

SEQ ID NO: 81514 - RNA, 22 nt, Human
guucacagaaggccagauggua

SEQ ID NO: 81515 - RNA, 22 nt, Human
guucacagcugggacaagacug

SEQ ID NO: 81516 - RNA, 22 nt, Human
guucacagcuucuuaggucaua

SEQ ID NO: 81517 - RNA, 22 nt, Human
guucacagucuacauaguaaag

SEQ ID NO: 81518 - RNA, 22 nt, Human
guucacaguguuuucuuugcau

SEQ ID NO: 81519 - RNA, 22 nt, Human
guucacaucccagaaagagcau

SEQ ID NO: 81520 - RNA, 22 nt, Human
guucacauccugcuuuuucccu

SEQ ID NO: 81521 - RNA, 22 nt, Human
guucacauccuggcugugccac

SEQ ID NO: 81522 - RNA, 22 nt, Human
guucacauccuugugaggauuu

SEQ ID NO: 81523 - RNA, 22 nt, Human
guucacauguguuaucuucuuu

SEQ ID NO: 81524 - RNA, 22 nt, Human
guucacuggcugugugacucug

SEQ ID NO: 81525 - RNA, 22 nt, Human
guucacuguacuggugaugguu

SEQ ID NO: 81526 - RNA, 22 nt, Human
guucagagugggaaugaucacu

SEQ ID NO: 81527 - RNA, 22 nt, Human
guucagauggagaaggaaaacu

SEQ ID NO: 81528 - RNA, 22 nt, Human
guucagauuugacugguuucuc

SEQ ID NO: 81529 - RNA, 22 nt, Human
guucagcaagaauguuucuauu

SEQ ID NO: 81530 - RNA, 22 nt, Human
guucagcucaagcaauaauuuu

SEQ ID NO: 81531 - RNA, 22 nt, Human
guucagcuuacaaaauacaccu

SEQ ID NO: 81532 - RNA, 22 nt, Human
guucaguggggccuugggggac

SEQ ID NO: 81533 - RNA, 22 nt, Human
guucaguuuugaaauguuaauu

SEQ ID NO: 81534 - RNA, 22 nt, Human
guucauauuacuuugagugcag

SEQ ID NO: 81535 - RNA, 22 nt, Human
guucaucucacagauaggcagu

SEQ ID NO: 81536 - RNA, 22 nt, Human
guucaugugacuacuaugaccu

SEQ ID NO: 81537 - RNA, 22 nt, Human
guucauguuugagaacaaggag

SEQ ID NO: 81538 - RNA, 22 nt, Human
guucauucagcuggguaggagg

SEQ ID NO: 81539 - RNA, 22 nt, Human
guucauuuaugauguaacaugu

SEQ ID NO: 81540 - RNA, 22 nt, Human
guucauuuuacuguaaauagca

SEQ ID NO: 81541 - RNA, 23 nt, Human
guucauuuuauugucugauugcu

SEQ ID NO: 81542 - RNA, 22 nt, Human
guuccacaaaaggucuaguuua

SEQ ID NO: 81543 - RNA, 22 nt, Human
guuccacaaaauguacccaguu

SEQ ID NO: 81544 - RNA, 22 nt, Human
guuccacaaagauugucucucu

SEQ ID NO: 81545 - RNA, 22 nt, Human
guuccacauaacacaucuacaa

SEQ ID NO: 81546 - RNA, 22 nt, Human
guuccaggacccuggccucuga

SEQ ID NO: 81547 - RNA, 22 nt, Human
guucccaccccugagcuccgau

SEQ ID NO: 81548 - RNA, 22 nt, Human
guucccacgccuccucuccagc

SEQ ID NO: 81549 - RNA, 22 nt, Human
guucccacuuggugcacuauga

SEQ ID NO: 81550 - RNA, 18 nt, Human
guucccagauggugcuga

SEQ ID NO: 81551 - RNA, 22 nt, Human
guucccaggcccugggcucucc

SEQ ID NO: 81552 - RNA, 21 nt, Human
guucccuuauuggggcaggca

SEQ ID NO: 81553 - RNA, 22 nt, Human
guuccuaaauuugaaggacuuu

SEQ ID NO: 81554 - RNA, 22 nt, Human
guuccucagcccuuacuuagcc

SEQ ID NO: 81555 - RNA, 22 nt, Human
guuccugagaaauaaagagaga

SEQ ID NO: 81556 - RNA, 22 nt, Human
guuccugaugcuuugaaauuca

SEQ ID NO: 81557 - RNA, 22 nt, Human
guuccugggccugcauucacca

SEQ ID NO: 81558 - RNA, 22 nt, Human
guuccugguggucauggcagcu

SEQ ID NO: 81559 - RNA, 16 nt, Human
guuccuucccacaccu

SEQ ID NO: 81560 - RNA, 22 nt, Human
guuccuuuccuauuuggauaag

SEQ ID NO: 81561 - RNA, 22 nt, Human
guuccuuuguuuagcagagaca

SEQ ID NO: 81562 - RNA, 22 nt, Human
guucgcaucuugaucauggacu

SEQ ID NO: 81563 - RNA, 22 nt, Human
guucguauuuaugucgcagaag

SEQ ID NO: 81564 - RNA, 22 nt, Human
guucuacaugacacucaacauu

SEQ ID NO: 81565 - RNA, 22 nt, Human
guucuacuuucugugucuuuga

SEQ ID NO: 81566 - RNA, 22 nt, Human
guucuagccuggggcuccuugg

SEQ ID NO: 81567 - RNA, 22 nt, Human
guucuagguauaguaagaaauu

SEQ ID NO: 81568 - RNA, 22 nt, Human
guucuagguuagaaggacagau

SEQ ID NO: 81569 - RNA, 22 nt, Human
guucucagcgugggaggcagag

SEQ ID NO: 81570 - RNA, 22 nt, Human
guucucagggauaacuuccccc

SEQ ID NO: 81571 - RNA, 22 nt, Human
guucuccacugcagagucucuc

SEQ ID NO: 81572 - RNA, 22 nt, Human
guucucuaucauuagugaauuu

SEQ ID NO: 81573 - RNA, 22 nt, Human
guucucuggaaacuaugauuca

SEQ ID NO: 81574 - RNA, 22 nt, Human
guucugaguccuccuuugaagg

SEQ ID NO: 81575 - RNA, 22 nt, Human
guucugaguggcccaagcccug

SEQ ID NO: 81576 - RNA, 21 nt, Human
guucugaguuagaguuggcca

SEQ ID NO: 81577 - RNA, 22 nt, Human
guucugcuccuguggcaaucua

SEQ ID NO: 81578 - RNA, 22 nt, Human
guucuggguagauguaucuuuu

SEQ ID NO: 81579 - RNA, 22 nt, Human
guucuguagucauagagcaauu

SEQ ID NO: 81580 - RNA, 22 nt, Human
guucugucacacacugguacuu

SEQ ID NO: 81581 - RNA, 22 nt, Human
guucuguccucacugcaggccu

SEQ ID NO: 81582 - RNA, 21 nt, Human
guucuguugacugugggcauc

SEQ ID NO: 81583 - RNA, 22 nt, Human
guucuucaaagugacaacuaaa

SEQ ID NO: 81584 - RNA, 22 nt, Human
gcccagaguggccacuuggcuc

SEQ ID NO: 81585 - RNA, 21 nt, Human
gcccagaguuaagcccaccca

SEQ ID NO: 81586 - RNA, 22 nt, Human
gcccagaguucaaggcugcagu

SEQ ID NO: 81587 - RNA, 22 nt, Human
gcccagcacagcuggaagaguc

SEQ ID NO: 81588 - RNA, 22 nt, Human
gcccagcagaucucagugucuc

SEQ ID NO: 81589 - RNA, 22 nt, Human
gcccagcagcuccacuuggcuu

SEQ ID NO: 81590 - RNA, 22 nt, Human
gcccagcaggggauggcagcuc

SEQ ID NO: 81591 - RNA, 22 nt, Human
gcccagcccugaggucacagcu

SEQ ID NO: 81592 - RNA, 22 nt, Human
gcccagcuuuuugaggcaggca

SEQ ID NO: 81593 - RNA, 17 nt, Human
gcccaggaaggacggcc

SEQ ID NO: 81594 - RNA, 22 nt, Human
gcccaggagaggccagggcuga

SEQ ID NO: 81595 - RNA, 22 nt, Human
gcccaggagguggaggugcagu

SEQ ID NO: 81596 - RNA, 22 nt, Human
gcccaggaguugaagggcugac

SEQ ID NO: 81597 - RNA, 22 nt, Human
gcccaggaguuggaggcugcag

SEQ ID NO: 81598 - RNA, 20 nt, Human
gcccaggaucucugaggcau

SEQ ID NO: 81599 - RNA, 23 nt, Human
gcccagggacugggaaucagugg

SEQ ID NO: 81600 - RNA, 22 nt, Human
gcccagggcagggcaagaguga

SEQ ID NO: 81601 - RNA, 22 nt, Human
gcccagggcugcaaguggacgc

SEQ ID NO: 81602 - RNA, 22 nt, Human
gcccaggggcagcgcauagugg

SEQ ID NO: 81603 - RNA, 22 nt, Human
gccuggcuccuaagagcacaac

SEQ ID NO: 81604 - RNA, 22 nt, Human
gccuggcucugagggagcuccu

SEQ ID NO: 81605 - RNA, 22 nt, Human
gccuggcugaggccucugcuaa

SEQ ID NO: 81606 - RNA, 22 nt, Human
gccuggcugcugguucugagga

SEQ ID NO: 81607 - RNA, 19 nt, Human
gccuggcugggaugagccc

SEQ ID NO: 81608 - RNA, 22 nt, Human
gccuggcugggcugaaugcuua

SEQ ID NO: 81609 - RNA, 22 nt, Human
gccugggaaaugguggggucag

SEQ ID NO: 81610 - RNA, 21 nt, Human
gccugggaagagaaagguaag

SEQ ID NO: 81611 - RNA, 23 nt, Human
gccugggacucaggaggagcuca

SEQ ID NO: 81612 - RNA, 22 nt, Human
gccugggacuggauguguuugu

SEQ ID NO: 81613 - RNA, 22 nt, Human
gccugggagggcagcagugugg

SEQ ID NO: 81614 - RNA, 22 nt, Human
gccugggagugcacagugaggu

SEQ ID NO: 81615 - RNA, 22 nt, Human
gccugggauagaggcaaugcau

SEQ ID NO: 81616 - RNA, 22 nt, Human
gccuggggccagcuugggcuga

SEQ ID NO: 81617 - RNA, 22 nt, Human
gccuggggucucugacucacag

SEQ ID NO: 81618 - RNA, 22 nt, Human
gccugggugucgaucacuagug

SEQ ID NO: 81619 - RNA, 22 nt, Human
gccugguggacacugggcauca

SEQ ID NO: 81620 - RNA, 22 nt, Human
gccugguggugugcucaagugg

SEQ ID NO: 81621 - RNA, 22 nt, Human
gccuggugugcgccgcgcagcu

SEQ ID NO: 81622 - RNA, 22 nt, Human
gccugucaauuuuguguacaau

SEQ ID NO: 81623 - RNA, 22 nt, Human
gccuguccacuaaacagccaag

SEQ ID NO: 81624 - RNA, 22 nt, Human
gccuguccuggaugcucugcaa

SEQ ID NO: 81625 - RNA, 22 nt, Human
gccuguccuugugaggucccag

SEQ ID NO: 81626 - RNA, 22 nt, Human
gccugucugcagggcugucauu

SEQ ID NO: 81627 - RNA, 22 nt, Human
gccugucugcgucacgcuuauu

SEQ ID NO: 81628 - RNA, 22 nt, Human
gccugugcauagcagcggacuc

SEQ ID NO: 81629 - RNA, 22 nt, Human
gccugugcuuucuucccuccug

SEQ ID NO: 81630 - RNA, 22 nt, Human
gccuguggccacugcgucugca

SEQ ID NO: 81631 - RNA, 22 nt, Human
gccuguggccgacugagagccu

SEQ ID NO: 81632 - RNA, 21 nt, Human
gccuguguaaauugaguuucc

SEQ ID NO: 81633 - RNA, 22 nt, Human
gccugugugugaggacuggcug

SEQ ID NO: 81634 - RNA, 22 nt, Human
gccuguguguuuagcucugggg

SEQ ID NO: 81635 - RNA, 22 nt, Human
gccuguguuuuuaacucuagga

SEQ ID NO: 81636 - RNA, 20 nt, Human
gccuguucacaggcuucuug

SEQ ID NO: 81637 - RNA, 22 nt, Human
gccuguuggguaacagaguuca

SEQ ID NO: 81638 - RNA, 22 nt, Human
gccuguuuacuuugccgcagga

SEQ ID NO: 81639 - RNA, 22 nt, Human
gccuguuucccugacgcuuaca

SEQ ID NO: 81640 - RNA, 22 nt, Human
gccuguuucuccuccuuggccc

SEQ ID NO: 81641 - RNA, 22 nt, Human
gccuguuugagaauagucaggg

SEQ ID NO: 81642 - RNA, 22 nt, Human
gccuuaauugcagagcaauaua

SEQ ID NO: 81643 - RNA, 22 nt, Human
gccuuagaaaaauaagauuuua

SEQ ID NO: 81644 - RNA, 22 nt, Human
gccuucagcggccgcucgcugc

SEQ ID NO: 81645 - RNA, 23 nt, Human
gccuucagcucgggaaggcuccc

SEQ ID NO: 81646 - RNA, 22 nt, Human
gccuuccaccuaggccucugcu

SEQ ID NO: 81647 - RNA, 22 nt, Human
gccuucccucucauccugcugg

SEQ ID NO: 81648 - RNA, 22 nt, Human
gccuucccuggcuaggcaagca

SEQ ID NO: 81649 - RNA, 22 nt, Human
gccuucucugugagcuccuagg

SEQ ID NO: 81650 - RNA, 22 nt, Human
gccuucugauugcuggacugac

SEQ ID NO: 81651 - RNA, 22 nt, Human
gccuugccaaggggcagcagag

SEQ ID NO: 81652 - RNA, 22 nt, Human
gccuugccgcucagcagugggg

SEQ ID NO: 81653 - RNA, 22 nt, Human
gccuugcuaauuucuccucaac

SEQ ID NO: 81654 - RNA, 22 nt, Human
gccuugcugauuaccuuccuuu

SEQ ID NO: 81655 - RNA, 22 nt, Human
gccuuggagaucacugcucaug

SEQ ID NO: 81656 - RNA, 19 nt, Human
gccuuggcauucucugcuu

SEQ ID NO: 81657 - RNA, 22 nt, Human
gccuuggccaacaccuugcaaa

SEQ ID NO: 81658 - RNA, 22 nt, Human
gccuuggccuuccuaggccuga

SEQ ID NO: 81659 - RNA, 22 nt, Human
gccuuggcugccaagcugcuga

SEQ ID NO: 81660 - RNA, 22 nt, Human
gccuugggcacaggcagggccc

SEQ ID NO: 81661 - RNA, 22 nt, Human
gccuugggggugaaagaggcua

SEQ ID NO: 81662 - RNA, 22 nt, Human
gccuugguuggccagcaggucc

SEQ ID NO: 81663 - RNA, 22 nt, Human
gccuuguuucauuacacguggu

SEQ ID NO: 81664 - RNA, 22 nt, Human
gccuuuauaucccugauaucua

SEQ ID NO: 81665 - RNA, 22 nt, Human
gccuuucagugccuucuguuca

SEQ ID NO: 81666 - RNA, 22 nt, Human
gccuuucaguuccaucaaagga

SEQ ID NO: 81667 - RNA, 22 nt, Human
gccuuuccugcucuggcauuca

SEQ ID NO: 81668 - RNA, 22 nt, Human
gccuuugccugcgacguggcug

SEQ ID NO: 81669 - RNA, 22 nt, Human
gccuuugcugugacaaugcugg

SEQ ID NO: 81670 - RNA, 19 nt, Human
gccuuuguuccuuuugucu

SEQ ID NO: 81671 - RNA, 22 nt, Human
gcgaaaaauguguaaauauguu

SEQ ID NO: 81672 - RNA, 22 nt, Human
gcgacgcaggcacgacguguug

SEQ ID NO: 81673 - RNA, 19 nt, Human
gcgagaacagagcuuacug

SEQ ID NO: 81674 - RNA, 22 nt, Human
gcgaguccacuggggggcgcag

SEQ ID NO: 81675 - RNA, 22 nt, Human
gcgcagcucagugagggaacuu

SEQ ID NO: 81676 - RNA, 17 nt, Human
gcgcagcuccuggcgcg

SEQ ID NO: 81677 - RNA, 22 nt, Human
gcgcgccucugcccgguguucc

SEQ ID NO: 81678 - RNA, 22 nt, Human
gcggaaggcugccuggcuugag

SEQ ID NO: 81679 - RNA, 22 nt, Human
gcggaggaaacugaggcaagag

SEQ ID NO: 81680 - RNA, 22 nt, Human
gcggagggagauaggccuugcu

SEQ ID NO: 81681 - RNA, 22 nt, Human
gcggagggcgagcccgcggagc

SEQ ID NO: 81682 - RNA, 22 nt, Human
gcggcgccuaagccccgaccuc

SEQ ID NO: 81683 - RNA, 22 nt, Human
gcggggacagaaggcgguucuc

SEQ ID NO: 81684 - RNA, 22 nt, Human
gcggggcacagugauggagcac

SEQ ID NO: 81685 - RNA, 22 nt, Human
gcgguccaggagcgcagguccu

SEQ ID NO: 81686 - RNA, 22 nt, Human
gcgguggggaaaggaggugcug

SEQ ID NO: 81687 - RNA, 22 nt, Human
gcggugggggaaaggagcgguu

SEQ ID NO: 81688 - RNA, 22 nt, Human
gcguaaggccucuggucucgga

SEQ ID NO: 81689 - RNA, 22 nt, Human
gcgucaauuccaucauucuucu

SEQ ID NO: 81690 - RNA, 22 nt, Human
gcgucuuuuagauuuuacaucu

SEQ ID NO: 81691 - RNA, 22 nt, Human
gcguggcuuagagugggguacc

SEQ ID NO: 81692 - RNA, 17 nt, Human
gcguguccccgcgucuc

SEQ ID NO: 81693 - RNA, 22 nt, Human
gcguuaauaacauuaauaaugc

SEQ ID NO: 81694 - RNA, 22 nt, Human
gcguuggggaccccgaagcugg

SEQ ID NO: 81695 - RNA, 22 nt, Human
gcguuuaagugaugaucgucuu

SEQ ID NO: 81696 - RNA, 22 nt, Human
gcuaaaucuccuacaaugcaca

SEQ ID NO: 81697 - RNA, 22 nt, Human
gcuaagggacccuuucuaaugu

SEQ ID NO: 81698 - RNA, 22 nt, Human
gcuaauacuuuggaaagaaugu

SEQ ID NO: 81699 - RNA, 22 nt, Human
gcuacaaacugucauggugcuu

SEQ ID NO: 81700 - RNA, 22 nt, Human
gcuacaagucuugucauucauu

SEQ ID NO: 81701 - RNA, 22 nt, Human
gcuacagagcucugugaagaga

SEQ ID NO: 81702 - RNA, 22 nt, Human
gcuacagguauauagaugaaac

SEQ ID NO: 81703 - RNA, 22 nt, Human
guuucugagcacuuuuauugca

SEQ ID NO: 81704 - RNA, 20 nt, Human
guuucugauucaguaggucu

SEQ ID NO: 81705 - RNA, 22 nt, Human
guuucuggagugacuauaacug

SEQ ID NO: 81706 - RNA, 22 nt, Human
guuucuuaauagcaggggccaa

SEQ ID NO: 81707 - RNA, 22 nt, Human
guuucuuagguaaauucuuuga

SEQ ID NO: 81708 - RNA, 22 nt, Human
guuucuuucuauugacugaaca

SEQ ID NO: 81709 - RNA, 22 nt, Human
guuucuuuuaaaauauguagac

SEQ ID NO: 81710 - RNA, 22 nt, Human
guuucuuuugugaucaccaacc

SEQ ID NO: 81711 - RNA, 22 nt, Human
guuugaaacaugcaccuggagg

SEQ ID NO: 81712 - RNA, 22 nt, Human
gcuggggccucugugagguuaa

SEQ ID NO: 81713 - RNA, 22 nt, Human
gcuggggccugaacagucagcu

SEQ ID NO: 81714 - RNA, 19 nt, Human
gcuggggccugaccagaca

SEQ ID NO: 81715 - RNA, 22 nt, Human
gcuggggucugugaggagggcu

SEQ ID NO: 81716 - RNA, 22 nt, Human
gcuggguccaugguccucgggu

SEQ ID NO: 81717 - RNA, 22 nt, Human
gcugggucucuggguguaacaa

SEQ ID NO: 81718 - RNA, 22 nt, Human
gcugggucuggcugugagccgg

SEQ ID NO: 81719 - RNA, 22 nt, Human
gcugguaaacuucuggugccau

SEQ ID NO: 81720 - RNA, 22 nt, Human
gcuggucacucugggagcugcu

SEQ ID NO: 81721 - RNA, 22 nt, Human
gcuggucagggagggcacccau

SEQ ID NO: 81722 - RNA, 22 nt, Human
gcugguccacauccugguacgu

SEQ ID NO: 81723 - RNA, 22 nt, Human
uaaguuuuaagcaaucugauaa

SEQ ID NO: 81724 - RNA, 22 nt, Human
uaauaaacugcuacgcuuaguu

SEQ ID NO: 81725 - RNA, 22 nt, Human
uaauaauagcaguagcugccac

SEQ ID NO: 81726 - RNA, 22 nt, Human
uaauacaaggcaggaagcagua

SEQ ID NO: 81727 - RNA, 22 nt, Human
uaauacagacaacuugccaaau

SEQ ID NO: 81728 - RNA, 22 nt, Human
uaauacagggcacuuugaguga

SEQ ID NO: 81729 - RNA, 22 nt, Human
uaauacauuaccuaaccucucu

SEQ ID NO: 81730 - RNA, 22 nt, Human
uaauacuuaccuugcagagucu

SEQ ID NO: 81731 - RNA, 22 nt, Human
uaauaguuaugguugguucuca

SEQ ID NO: 81732 - RNA, 22 nt, Human
uaauaguugugacuuuguaaag

SEQ ID NO: 81733 - RNA, 22 nt, Human
uaauauauuucugcuaagcuca

SEQ ID NO: 81734 - RNA, 22 nt, Human
uaauaucuggcauucaaacaug

SEQ ID NO: 81735 - RNA, 22 nt, Human
uaaucacagaaaugcccauuca

SEQ ID NO: 81736 - RNA, 22 nt, Human
uaaucacugggcguuugguacu

SEQ ID NO: 81737 - RNA, 22 nt, Human
uaaucacugucaaccuuuguuc

SEQ ID NO: 81738 - RNA, 22 nt, Human
uaauccuuuagguuaaaagagg

SEQ ID NO: 81739 - RNA, 22 nt, Human
uaaucucuagcccaugcaaaga

SEQ ID NO: 81740 - RNA, 22 nt, Human
uaaucuguguaccuucaucgga

SEQ ID NO: 81741 - RNA, 22 nt, Human
uaaucuguuguuaauauugacu

SEQ ID NO: 81742 - RNA, 22 nt, Human
uaaucuguuucccaaggugaua

SEQ ID NO: 81743 - RNA, 22 nt, Human
uaaucuuagacauguauuuuuc

SEQ ID NO: 81744 - RNA, 19 nt, Human
uaaucuuauugggcagauu

SEQ ID NO: 81745 - RNA, 22 nt, Human
uaaugaacucuuuacuuuggga

SEQ ID NO: 81746 - RNA, 22 nt, Human
uaaugacauuguauccacagag

SEQ ID NO: 81747 - RNA, 22 nt, Human
uaaugacuaagcaaucaugaau

SEQ ID NO: 81748 - RNA, 22 nt, Human
uaaugacuguaccaaggcuuca

SEQ ID NO: 81749 - RNA, 23 nt, Human
uaaugagaagcuuuguuuccuga

SEQ ID NO: 81750 - RNA, 18 nt, Human
uaaugauaagccuugaag

SEQ ID NO: 81751 - RNA, 22 nt, Human
uaaugaugugugcaaacugaau

SEQ ID NO: 81752 - RNA, 22 nt, Human
uaaugcacagaauugacauggg

SEQ ID NO: 81753 - RNA, 22 nt, Human
uaaugcaguacugauauaaaca

SEQ ID NO: 81754 - RNA, 22 nt, Human
uaaugccuuucuguacuauaug

SEQ ID NO: 81755 - RNA, 22 nt, Human
uaaugcuaacaucauaucacug

SEQ ID NO: 81756 - RNA, 20 nt, Human
uaaugcuuaacacauccccu

SEQ ID NO: 81757 - RNA, 22 nt, Human
uaaugcuuaacagcuggcuuuu

SEQ ID NO: 81758 - RNA, 22 nt, Human
uaaugcuuaauuuucacaagcc

SEQ ID NO: 81759 - RNA, 22 nt, Human
uaaugcuuauguuaugcaauuu

SEQ ID NO: 81760 - RNA, 22 nt, Human
uaaugcuuccuauauagcacuc

SEQ ID NO: 81761 - RNA, 22 nt, Human
uaaugcuuugucagccuaaggg

SEQ ID NO: 81762 - RNA, 22 nt, Human
uaaugcuuuuccuucaaauaag

SEQ ID NO: 81763 - RNA, 22 nt, Human
uaauguaaacacagagacagaa

SEQ ID NO: 81764 - RNA, 22 nt, Human
uaauguaaagaagauguaggaa

SEQ ID NO: 81765 - RNA, 20 nt, Human
uaaugucaaagucacaaggu

SEQ ID NO: 81766 - RNA, 22 nt, Human
uaaugucaaggugauagauuug

SEQ ID NO: 81767 - RNA, 22 nt, Human
uaaugucagcauaguuuauuuu

SEQ ID NO: 81768 - RNA, 22 nt, Human
uaaugucuagaucagaccucga

SEQ ID NO: 81769 - RNA, 22 nt, Human
uaaugucuguguuucagugcag

SEQ ID NO: 81770 - RNA, 22 nt, Human
uaauguguccugaaagcuucug

SEQ ID NO: 81771 - RNA, 22 nt, Human
uaauguuauaaauucuugguuu

SEQ ID NO: 81772 - RNA, 22 nt, Human
uaauguuuagaagcagacagcu

SEQ ID NO: 81773 - RNA, 22 nt, Human
uaauguuuccagucuaugaugg

SEQ ID NO: 81774 - RNA, 22 nt, Human
uaauguuuuucucaacauugcu

SEQ ID NO: 81775 - RNA, 22 nt, Human
uaauuauagcauuggaguggcc

SEQ ID NO: 81776 - RNA, 22 nt, Human
uaauuauagccgcuauuuugcu

SEQ ID NO: 81777 - RNA, 23 nt, Human
uaauucacauauacauugcuuca

SEQ ID NO: 81778 - RNA, 22 nt, Human
uaauucaugggcccagugauau

SEQ ID NO: 81779 - RNA, 22 nt, Human
uaauucuuguucagagguagua

SEQ ID NO: 81780 - RNA, 22 nt, Human
uaauugaacuaacaugcaaaca

SEQ ID NO: 81781 - RNA, 22 nt, Human
uaauugcuaauccugccuucua

SEQ ID NO: 81782 - RNA, 22 nt, Human
uaauugcuccaaggagaacuaa

SEQ ID NO: 81783 - RNA, 22 nt, Human
uaauugcuguauagauugucau

SEQ ID NO: 81784 - RNA, 23 nt, Human
uaauugcuugaguuaguaauaca

SEQ ID NO: 81785 - RNA, 22 nt, Human
uaauugucagguuuuaguauca

SEQ ID NO: 81786 - RNA, 22 nt, Human
uaauugucaucguaguaaacau

SEQ ID NO: 81787 - RNA, 22 nt, Human
uaauugucccugcaguuaggau

SEQ ID NO: 81788 - RNA, 22 nt, Human
uaauuuaauuucaugccagccu

SEQ ID NO: 81789 - RNA, 22 nt, Human
uaauuuacuugcaaauaacaau

SEQ ID NO: 81790 - RNA, 22 nt, Human
uaauuucaaauuucuuagcgug

SEQ ID NO: 81791 - RNA, 22 nt, Human
uaauuucaccguugcuagaaau

SEQ ID NO: 81792 - RNA, 22 nt, Human
uaauuucacugauaugaaguca

SEQ ID NO: 81793 - RNA, 22 nt, Human
uaauuucagugggcucugggcu

SEQ ID NO: 81794 - RNA, 23 nt, Human
uaauuuuagccuuacaggacccu

SEQ ID NO: 81795 - RNA, 22 nt, Human
uaauuuuguauugccauuguag

SEQ ID NO: 81796 - RNA, 22 nt, Human
uaauuuugucccccugcacaua

SEQ ID NO: 81797 - RNA, 22 nt, Human
uaauuuuuccacguacacuggg

SEQ ID NO: 81798 - RNA, 22 nt, Human
uacaaaaaauugauacugacga

SEQ ID NO: 81799 - RNA, 20 nt, Human
uacaaaccuccacacuggug

SEQ ID NO: 81800 - RNA, 22 nt, Human
uacaaacucuuuauauuucaua

SEQ ID NO: 81801 - RNA, 22 nt, Human
uacaaacuguccagcccagagg

SEQ ID NO: 81802 - RNA, 22 nt, Human
uacaaagaggcagcuccauuuu

SEQ ID NO: 81803 - RNA, 22 nt, Human
uacaaagcaaaucaucuaagag

SEQ ID NO: 81804 - RNA, 22 nt, Human
uacaaagcuguauagccugguc

SEQ ID NO: 81805 - RNA, 22 nt, Human
uacaaaggaaacuucuuuuccc

SEQ ID NO: 81806 - RNA, 22 nt, Human
uacaaaggagaauaggguagca

SEQ ID NO: 81807 - RNA, 22 nt, Human
uacaaagggggaagagauucug

SEQ ID NO: 81808 - RNA, 22 nt, Human
uacaaagguaucuuuccuagau

SEQ ID NO: 81809 - RNA, 22 nt, Human
uacaaaguuugagaaugcuuuc

SEQ ID NO: 81810 - RNA, 22 nt, Human
uacaacagaccuagaugaauga

SEQ ID NO: 81811 - RNA, 22 nt, Human
uacaacaugugguccuuuauga

SEQ ID NO: 81812 - RNA, 22 nt, Human
uacaacauuguguugcuucaua

SEQ ID NO: 81813 - RNA, 22 nt, Human
uacaaccagauccucuaaguca

SEQ ID NO: 81814 - RNA, 22 nt, Human
uacaacugugugaaggaaucug

SEQ ID NO: 81815 - RNA, 22 nt, Human
uacaagaaacuacaugaaugca

SEQ ID NO: 81816 - RNA, 22 nt, Human
uacaagaaauuucugcauauau

SEQ ID NO: 81817 - RNA, 22 nt, Human
uacaagaaggaaaacuagcaau

SEQ ID NO: 81818 - RNA, 20 nt, Human
uacaagaauccccaguuguc

SEQ ID NO: 81819 - RNA, 22 nt, Human
uacaagaauuucuuucugguug

SEQ ID NO: 81820 - RNA, 22 nt, Human
uacaagagugagauuaucaugu

SEQ ID NO: 81821 - RNA, 21 nt, Human
uagaagcacauagguucaaag

SEQ ID NO: 81822 - RNA, 22 nt, Human
uagaagcacugacagaguuuga

SEQ ID NO: 81823 - RNA, 19 nt, Human
uagaagcagggaagcugag

SEQ ID NO: 81824 - RNA, 22 nt, Human
uagaaggaggacuggcaguguu

SEQ ID NO: 81825 - RNA, 22 nt, Human
uagaaggcuuugagagauacuu

SEQ ID NO: 81826 - RNA, 17 nt, Human
uagaaguuagaacacuu

SEQ ID NO: 81827 - RNA, 21 nt, Human
uagaauacagguauuuuggau

SEQ ID NO: 81828 - RNA, 22 nt, Human
uagaauaguguuuucauuaugg

SEQ ID NO: 81829 - RNA, 22 nt, Human
uagaauaugauuaauuuucuua

SEQ ID NO: 81830 - RNA, 17 nt, Human
uagaauauggugggcug

SEQ ID NO: 81831 - RNA, 22 nt, Human
uagaaucauaccucuaggaaca

SEQ ID NO: 81832 - RNA, 22 nt, Human
uagaaucugaauauucuuauuu

SEQ ID NO: 81833 - RNA, 22 nt, Human
uagaaucugaauguagagcuga

SEQ ID NO: 81834 - RNA, 22 nt, Human
uagaaucuggaaggggcuauuc

SEQ ID NO: 81835 - RNA, 22 nt, Human
uagaaucuggaucugggcgcau

SEQ ID NO: 81836 - RNA, 20 nt, Human
uagaaucuggugauguaucg

SEQ ID NO: 81837 - RNA, 22 nt, Human
uagaauguaaauuccaagggca

SEQ ID NO: 81838 - RNA, 22 nt, Human
uagaauuaugccuugcugucca

SEQ ID NO: 81839 - RNA, 22 nt, Human
uagaauugggccuaacuuccau

SEQ ID NO: 81840 - RNA, 22 nt, Human
uagacaaacugauacuuggcga

SEQ ID NO: 81841 - RNA, 22 nt, Human
uagacaacuggagauagucuga

SEQ ID NO: 81842 - RNA, 22 nt, Human
uagacaaugccaucuugugguu

SEQ ID NO: 81843 - RNA, 22 nt, Human
uagacacaaaucucagugacac

SEQ ID NO: 81844 - RNA, 22 nt, Human
uagacacauccguggaagcuuc

SEQ ID NO: 81845 - RNA, 22 nt, Human
uagacacuguaugagcugggug

SEQ ID NO: 81846 - RNA, 22 nt, Human
uagacagauuuaaaggaaugga

SEQ ID NO: 81847 - RNA, 22 nt, Human
uagacauuauuucuacccacaa

SEQ ID NO: 81848 - RNA, 22 nt, Human
uagacauuucugguuauugaca

SEQ ID NO: 81849 - RNA, 22 nt, Human
uagacauuuggcaugguuuuca

SEQ ID NO: 81850 - RNA, 22 nt, Human
uagacauuuucucaacaucucu

SEQ ID NO: 81851 - RNA, 22 nt, Human
uagacuuuacuaaggcucauuu

SEQ ID NO: 81852 - RNA, 22 nt, Human
uagacuuuccagccugcugcuu

SEQ ID NO: 81853 - RNA, 22 nt, Human
uagacuuugauauuguacaccc

SEQ ID NO: 81854 - RNA, 22 nt, Human
uagagaaaaccacuggugagcu

SEQ ID NO: 81855 - RNA, 22 nt, Human
gcugucugucuucacaucucgc

SEQ ID NO: 81856 - RNA, 22 nt, Human
gcugucuuccuugcuccaaggg

SEQ ID NO: 81857 - RNA, 22 nt, Human
gcugucuugaugauuggaugcu

SEQ ID NO: 81858 - RNA, 22 nt, Human
gcugucuugcucacucuugcag

SEQ ID NO: 81859 - RNA, 22 nt, Human
gcugucuuguauguuguaggac

SEQ ID NO: 81860 - RNA, 22 nt, Human
gcugucuuuuccuggcaguaaa

SEQ ID NO: 81861 - RNA, 22 nt, Human
gcugugaaagcugccacacugu

SEQ ID NO: 81862 - RNA, 22 nt, Human
gcugugagcugccugugucaca

SEQ ID NO: 81863 - RNA, 22 nt, Human
gcugugaguggaggaggcugag

SEQ ID NO: 81864 - RNA, 22 nt, Human
gcugugauaaaugcagauguca

SEQ ID NO: 81865 - RNA, 22 nt, Human
gcugugauccuugagagaaggu

SEQ ID NO: 81866 - RNA, 21 nt, Human
gcugugcacauaguagaagug

SEQ ID NO: 81867 - RNA, 22 nt, Human
gcugugcagaggugagaaucca

SEQ ID NO: 81868 - RNA, 22 nt, Human
gcugugcaggggauuugguuau

SEQ ID NO: 81869 - RNA, 22 nt, Human
gcugugcauggagggccguuca

SEQ ID NO: 81870 - RNA, 22 nt, Human
gcugugcccagcuccagcucug

SEQ ID NO: 81871 - RNA, 22 nt, Human
gcugugcccauauucugcugac

SEQ ID NO: 81872 - RNA, 19 nt, Human
gcugugccccugccgcuug

SEQ ID NO: 81873 - RNA, 20 nt, Human
gcugugccuccagcuggugg

SEQ ID NO: 81874 - RNA, 22 nt, Human
gcugugcuauaucucugagugu

SEQ ID NO: 81875 - RNA, 22 nt, Human
gcugugcugauucauucccugc

SEQ ID NO: 81876 - RNA, 22 nt, Human
gcuguggaugcuauggaucauc

SEQ ID NO: 81877 - RNA, 20 nt, Human
gcuguggcaaagcuuugugu

SEQ ID NO: 81878 - RNA, 20 nt, Human
gcuguggcaagugcucacug

SEQ ID NO: 81879 - RNA, 22 nt, Human
gcuguggccuggcgcagagcug

SEQ ID NO: 81880 - RNA, 22 nt, Human
gcuguggcuccaauggugagcc

SEQ ID NO: 81881 - RNA, 22 nt, Human
gcugugggugcuggcuccaccc

SEQ ID NO: 81882 - RNA, 22 nt, Human
gcuguggucccucuguccucau

SEQ ID NO: 81883 - RNA, 22 nt, Human
gcuguguaaacuuguacagugc

SEQ ID NO: 81884 - RNA, 22 nt, Human
gcuguguaccuacuaacugcuu

SEQ ID NO: 81885 - RNA, 22 nt, Human
gcuguguaucagaugccacggg

SEQ ID NO: 81886 - RNA, 22 nt, Human
gcugugugaccugggcaagucu

SEQ ID NO: 81887 - RNA, 22 nt, Human
gcugugugacugagagccuggc

SEQ ID NO: 81888 - RNA, 22 nt, Human
gcugugugcugggcauggcacu

SEQ ID NO: 81889 - RNA, 22 nt, Human
gcuguguggcugugccgucacg

SEQ ID NO: 81890 - RNA, 22 nt, Human
gcuguguugggaaucauguggg

SEQ ID NO: 81891 - RNA, 22 nt, Human
gcuguguuggugaagcuguagc

SEQ ID NO: 81892 - RNA, 22 nt, Human
gcuguguuugacaguagcagac

SEQ ID NO: 81893 - RNA, 20 nt, Human
gcuguuaguugggggcuccc

SEQ ID NO: 81894 - RNA, 22 nt, Human
gcuguuauaauauucuguuugu

SEQ ID NO: 81895 - RNA, 22 nt, Human
gcuguuauuuuacaagacuuau

SEQ ID NO: 81896 - RNA, 22 nt, Human
gcuguucacggaggaggauggg

SEQ ID NO: 81897 - RNA, 22 nt, Human
gcuguucauuagaaauagaaug

SEQ ID NO: 81898 - RNA, 22 nt, Human
gcuguucccauguggggcucag

SEQ ID NO: 81899 - RNA, 20 nt, Human
gcuguucugaagcagaaggc

SEQ ID NO: 81900 - RNA, 19 nt, Human
gcuguucugaccaucaccc

SEQ ID NO: 81901 - RNA, 22 nt, Human
gcuguucugcaccagacuucag

SEQ ID NO: 81902 - RNA, 22 nt, Human
gcuguucugcgucccaggcugg

SEQ ID NO: 81903 - RNA, 22 nt, Human
gcuguugcaaucaaggccaugg

SEQ ID NO: 81904 - RNA, 22 nt, Human
gcuguuuccagacaaugucuuu

SEQ ID NO: 81905 - RNA, 22 nt, Human
gcuguuuccaguuacguggaua

SEQ ID NO: 81906 - RNA, 22 nt, Human
gcuguuuccuacaugguguuau

SEQ ID NO: 81907 - RNA, 22 nt, Human
gcuguuucuaagcugguuccua

SEQ ID NO: 81908 - RNA, 22 nt, Human
gcuguuucuccaggucaggaag

SEQ ID NO: 81909 - RNA, 22 nt, Human
gcuguuucucucccaccccuuc

SEQ ID NO: 81910 - RNA, 22 nt, Human
gcuguuucuuuccuggcacuug

SEQ ID NO: 81911 - RNA, 22 nt, Human
gcuuaaaguuguaaauuagaga

SEQ ID NO: 81912 - RNA, 22 nt, Human
gcuuacaaucauuucaguuuag

SEQ ID NO: 81913 - RNA, 22 nt, Human
gcuuagaaguacacaugccuuu

SEQ ID NO: 81914 - RNA, 22 nt, Human
gcuuagcaaugugacaagaugc

SEQ ID NO: 81915 - RNA, 22 nt, Human
gcuuagcagugugugcuuuuga

SEQ ID NO: 81916 - RNA, 22 nt, Human
gcuuaggaguuucaggcucuca

SEQ ID NO: 81917 - RNA, 22 nt, Human
gcuuaggaugaaugcuguagaa

SEQ ID NO: 81918 - RNA, 22 nt, Human
gcuuagucaauuauaaauaggc

SEQ ID NO: 81919 - RNA, 22 nt, Human
gcuuaguccccaagagagacca

SEQ ID NO: 81920 - RNA, 22 nt, Human
gcuucaaagaacaaagggaggc

SEQ ID NO: 81921 - RNA, 22 nt, Human
gcuucaaagauucacaguuuca

SEQ ID NO: 81922 - RNA, 22 nt, Human
gcuucaagcuguucagaacuau

SEQ ID NO: 81923 - RNA, 22 nt, Human
gcuucagaaauaucaucauuau

SEQ ID NO: 81924 - RNA, 20 nt, Human
gcuucagaaccugggugcug

SEQ ID NO: 81925 - RNA, 22 nt, Human
gcuucagacuggagcagaggaa

SEQ ID NO: 81926 - RNA, 22 nt, Human
gcuucagacugugcuucuguug

SEQ ID NO: 81927 - RNA, 21 nt, Human
gcuuccaagauggcaccuuga

SEQ ID NO: 81928 - RNA, 22 nt, Human
gcuuccaccuacuaaaugccac

SEQ ID NO: 81929 - RNA, 23 nt, Human
gcuuccagaagacucauugacau

SEQ ID NO: 81930 - RNA, 18 nt, Human
ggagagugacagagucgu

SEQ ID NO: 81931 - RNA, 18 nt, Human
ggagagugagaucaaaca

SEQ ID NO: 81932 - RNA, 17 nt, Human
ggagagugggaauggcc

SEQ ID NO: 81933 - RNA, 23 nt, Human
ggagaucagagacuagggcaguu

SEQ ID NO: 81934 - RNA, 17 nt, Human
ggagaucuggcagaggg

SEQ ID NO: 81935 - RNA, 22 nt, Human
ggagaucuuuaggaguuggacu

SEQ ID NO: 81936 - RNA, 22 nt, Human
ggagaugacacaauuuauuuau

SEQ ID NO: 81937 - RNA, 22 nt, Human
ggagaugccagaauugcaaauu

SEQ ID NO: 81938 - RNA, 22 nt, Human
ggagaugccuuguuucaggaac

SEQ ID NO: 81939 - RNA, 22 nt, Human
ggagauguagugucacuggacu

SEQ ID NO: 81940 - RNA, 21 nt, Human
ggagauguugugcaggagggu

SEQ ID NO: 81941 - RNA, 22 nt, Human
ggagauuuauagcacacuucag

SEQ ID NO: 81942 - RNA, 22 nt, Human
ggagcacuauaauagagauuuu

SEQ ID NO: 81943 - RNA, 22 nt, Human
ggagcagagcucuucaucugca

SEQ ID NO: 81944 - RNA, 17 nt, Human
ggagcagauccaccauu

SEQ ID NO: 81945 - RNA, 22 nt, Human
ggagcagccuguguagacgggg

SEQ ID NO: 81946 - RNA, 22 nt, Human
ggagcaggcagggccgugucug

SEQ ID NO: 81947 - RNA, 22 nt, Human
ggagcauguggggugagcaggg

SEQ ID NO: 81948 - RNA, 22 nt, Human
ggagccagaggcugcugcugug

SEQ ID NO: 81949 - RNA, 22 nt, Human
ggagccagagucugcaguguaa

SEQ ID NO: 81950 - RNA, 22 nt, Human
ggagccagaguuuaauguggag

SEQ ID NO: 81951 - RNA, 22 nt, Human
ggagccagcucccuccuuguga

SEQ ID NO: 81952 - RNA, 19 nt, Human
ggagccagcuguggaaggc

SEQ ID NO: 81953 - RNA, 17 nt, Human
ggagccaggagcccacc

SEQ ID NO: 81954 - RNA, 22 nt, Human
ggagccaggcauaucggggcac

SEQ ID NO: 81955 - RNA, 22 nt, Human
ggagccagggaagcugcuuccu

SEQ ID NO: 81956 - RNA, 22 nt, Human
ggagccaguauuuaguggucuu

SEQ ID NO: 81957 - RNA, 22 nt, Human
ggagccagugcccucuggugga

SEQ ID NO: 81958 - RNA, 22 nt, Human
ggagccauguuuucagcaugau

SEQ ID NO: 81959 - RNA, 22 nt, Human
ggagcccaagucugcacucggc

SEQ ID NO: 81960 - RNA, 22 nt, Human
ggagcccagucgggguguaggu

SEQ ID NO: 81961 - RNA, 22 nt, Human
ggagcccuagcugugcaucaga

SEQ ID NO: 81962 - RNA, 22 nt, Human
ggagcccuccaucccuugcggc

SEQ ID NO: 81963 - RNA, 22 nt, Human
ggagcccugaagcaagaaagua

SEQ ID NO: 81964 - RNA, 23 nt, Human
ggagcccugagcuguccccaugc

SEQ ID NO: 81965 - RNA, 22 nt, Human
ggagcccugcugacaugggugu

SEQ ID NO: 81966 - RNA, 22 nt, Human
ggagcccuugcugaccuuccaa

SEQ ID NO: 81967 - RNA, 22 nt, Human
ggagccuauuauuagcauggca

SEQ ID NO: 81968 - RNA, 23 nt, Human
ggagccuccggugugugagaggc

SEQ ID NO: 81969 - RNA, 22 nt, Human
ggagccugacagugcccagcau

SEQ ID NO: 81970 - RNA, 22 nt, Human
ggagccugguauaguguugcau

SEQ ID NO: 81971 - RNA, 22 nt, Human
ggagccugguuacuagagccug

SEQ ID NO: 81972 - RNA, 22 nt, Human
ggagccuguggcugcuugaagc

SEQ ID NO: 81973 - RNA, 20 nt, Human
gcuugcuuugucugaugggc

SEQ ID NO: 81974 - RNA, 22 nt, Human
gcuuggcuccuggcucacaggu

SEQ ID NO: 81975 - RNA, 22 nt, Human
gcuuggcucuaagacaccuauu

SEQ ID NO: 81976 - RNA, 22 nt, Human
gcuuggcuugggcucagaggcc

SEQ ID NO: 81977 - RNA, 22 nt, Human
gcuugggauaugcugauguaaa

SEQ ID NO: 81978 - RNA, 22 nt, Human
gcuugguuacugauggaaagga

SEQ ID NO: 81979 - RNA, 21 nt, Human
gcuugguuuugguuacuugcc

SEQ ID NO: 81980 - RNA, 22 nt, Human
gcuugucauaguuguuacaaau

SEQ ID NO: 81981 - RNA, 23 nt, Human
gcuugucuagugaauucauaucu

SEQ ID NO: 81982 - RNA, 22 nt, Human
gcuugucucucagccccaguca

SEQ ID NO: 81983 - RNA, 22 nt, Human
gcuuguuucuauuuaucaagua

SEQ ID NO: 81984 - RNA, 22 nt, Human
gcuuguuugugauuucuccaga

SEQ ID NO: 81985 - RNA, 20 nt, Human
gcuuuaagacacagcuaaaa

SEQ ID NO: 81986 - RNA, 22 nt, Human
gcuuuaaugcaauuucaccuca

SEQ ID NO: 81987 - RNA, 22 nt, Human
gcuuuacaaguggugcagauua

SEQ ID NO: 81988 - RNA, 22 nt, Human
gcuuuacauaaacauuuauuau

SEQ ID NO: 81989 - RNA, 22 nt, Human
gcuuuacaugagaugaggacaa

SEQ ID NO: 81990 - RNA, 22 nt, Human
gcuuuacaugauuucucacccu

SEQ ID NO: 81991 - RNA, 22 nt, Human
gcuuuacauguuucccuuuaag

SEQ ID NO: 81992 - RNA, 22 nt, Human
gcuuuagagcccagcuuggugg

SEQ ID NO: 81993 - RNA, 22 nt, Human
gcuuuagauagauuuagucuuu

SEQ ID NO: 81994 - RNA, 22 nt, Human
gcuuuagaucugacuuucugug

SEQ ID NO: 81995 - RNA, 22 nt, Human
gcuuuaggaaugaauaaaaauc

SEQ ID NO: 81996 - RNA, 19 nt, Human
gcuuuaguuuacucaucua

SEQ ID NO: 81997 - RNA, 22 nt, Human
gcuuuauggauuguaaacugca

SEQ ID NO: 81998 - RNA, 22 nt, Human
gcuuuauguaaguccaaaggca

SEQ ID NO: 81999 - RNA, 22 nt, Human
gcuuuauuuugugagggauuac

SEQ ID NO: 82000 - RNA, 22 nt, Human
gcuuucaaauccuaauuccaac

SEQ ID NO: 82001 - RNA, 22 nt, Human
gcuuucaauuaugucagccugu

SEQ ID NO: 82002 - RNA, 18 nt, Human
gcuuucaauuucuuuccu

SEQ ID NO: 82003 - RNA, 21 nt, Human
gcuuucagaagucucauaguu

SEQ ID NO: 82004 - RNA, 22 nt, Human
gcuuuccuggcccugucccugc

SEQ ID NO: 82005 - RNA, 22 nt, Human
gcuuucucuucacugauguuca

SEQ ID NO: 82006 - RNA, 22 nt, Human
gcuuucugaugagcuuaagaaa

SEQ ID NO: 82007 - RNA, 22 nt, Human
gcuuucuguagguaguuacugu

SEQ ID NO: 82008 - RNA, 22 nt, Human
gcuuucuuaguguguuaauugg

SEQ ID NO: 82009 - RNA, 22 nt, Human
gcuuucuugguucugcaggggc

SEQ ID NO: 82010 - RNA, 22 nt, Human
gcuuucuuuucaagaauguauu

SEQ ID NO: 82011 - RNA, 22 nt, Human
gcuuugaugaaucugugcuugg

SEQ ID NO: 82012 - RNA, 21 nt, Human
gcuuugaugcugccuugcucc

SEQ ID NO: 82013 - RNA, 22 nt, Human
gcuuugcacaaccuuuaagaca

SEQ ID NO: 82014 - RNA, 22 nt, Human
gcuuugcacucugauccuuccc

SEQ ID NO: 82015 - RNA, 18 nt, Human
gcuuugcagaaauacaga

SEQ ID NO: 82016 - RNA, 22 nt, Human
gcuuugcauucuugugugauca

SEQ ID NO: 82017 - RNA, 22 nt, Human
gcuuugcuaugacucaccagca

SEQ ID NO: 82018 - RNA, 22 nt, Human
gcuuugcuuccuguucuagccu

SEQ ID NO: 82019 - RNA, 22 nt, Human
gcuuuggaacuuaaauccuugg

SEQ ID NO: 82020 - RNA, 22 nt, Human
gcuuuggaaggggcugguggag

SEQ ID NO: 82021 - RNA, 22 nt, Human
gcuuuggaguuaggacucggcc

SEQ ID NO: 82022 - RNA, 22 nt, Human
gcuuugugaauuauuacucaca

SEQ ID NO: 82023 - RNA, 22 nt, Human
gcuuuuaauuaguugcuuccau

SEQ ID NO: 82024 - RNA, 22 nt, Human
gcuuuuccugacuuuccauuag

SEQ ID NO: 82025 - RNA, 22 nt, Human
gcuuuucuagcuagaacauccg

SEQ ID NO: 82026 - RNA, 22 nt, Human
gcuuuugccuacaucuuggucu

SEQ ID NO: 82027 - RNA, 22 nt, Human
gcuuuuguggugauggagaggc

SEQ ID NO: 82028 - RNA, 20 nt, Human
gcuuuuucuaauagcagucc

SEQ ID NO: 82029 - RNA, 19 nt, Human
gcuuuuuguugucaaaggu

SEQ ID NO: 82030 - RNA, 22 nt, Human
gcuuuuuugcuauugaaguggu

SEQ ID NO: 82031 - RNA, 22 nt, Human
ggaaaaacagucuuuauuauuu

SEQ ID NO: 82032 - RNA, 22 nt, Human
ggaaaacagcgauugguaucau

SEQ ID NO: 82033 - RNA, 22 nt, Human
ggaaaagaauugcagugaagua

SEQ ID NO: 82034 - RNA, 22 nt, Human
ggaaaagacagguuaacuguga

SEQ ID NO: 82035 - RNA, 22 nt, Human
ggaaaaggccacagggacacau

SEQ ID NO: 82036 - RNA, 22 nt, Human
ggaaaaggccauuguuucucug

SEQ ID NO: 82037 - RNA, 22 nt, Human
ggaaacagcaaauuauggcaau

SEQ ID NO: 82038 - RNA, 22 nt, Human
ggaaacauauucugaugugcau

SEQ ID NO: 82039 - RNA, 20 nt, Human
ggaaacauuuuuauuuccau

SEQ ID NO: 82040 - RNA, 18 nt, Human
gcugugugcaccugauaa

SEQ ID NO: 82041 - RNA, 22 nt, Human
gcugugugccaggggaaggcug

SEQ ID NO: 82042 - RNA, 22 nt, Human
gcugugugcucuggucuuucuu

SEQ ID NO: 82043 - RNA, 22 nt, Human
gcuguguucauuuugcauaugu

SEQ ID NO: 82044 - RNA, 19 nt, Human
gcuguuaaggacccucgga

SEQ ID NO: 82045 - RNA, 22 nt, Human
gcuguuagucaaaucaguugag

SEQ ID NO: 82046 - RNA, 22 nt, Human
gcuguucacagacucugcucug

SEQ ID NO: 82047 - RNA, 22 nt, Human
gcuguucauagaaauggucuca

SEQ ID NO: 82048 - RNA, 22 nt, Human
gcuguuccugcuuagaggucgg

SEQ ID NO: 82049 - RNA, 21 nt, Human
gcuguucggcggcccucgcgc

SEQ ID NO: 82050 - RNA, 22 nt, Human
gcuguucuccgaugaccccgug

SEQ ID NO: 82051 - RNA, 22 nt, Human
gcuguucucuguaacaugcauu

SEQ ID NO: 82052 - RNA, 21 nt, Human
gcuguucuuucagcuggucuu

SEQ ID NO: 82053 - RNA, 22 nt, Human
gcuguucuuugcaucucuggug

SEQ ID NO: 82054 - RNA, 21 nt, Human
gcuguugcccgccgccucuuc

SEQ ID NO: 82055 - RNA, 23 nt, Human
gcuguuuccccaugugcugaagg

SEQ ID NO: 82056 - RNA, 22 nt, Human
gcuguuuccccuucacaguggc

SEQ ID NO: 82057 - RNA, 22 nt, Human
gcuguuucccgugcgcugcguc

SEQ ID NO: 82058 - RNA, 22 nt, Human
gcuguuucuugaggcuacuccu

SEQ ID NO: 82059 - RNA, 22 nt, Human
gcuguuucuuugaugauggaau

SEQ ID NO: 82060 - RNA, 22 nt, Human
gcuuaagauguuuguggcaauu

SEQ ID NO: 82061 - RNA, 22 nt, Human
gcuuaaugagcagagaaucuac

SEQ ID NO: 82062 - RNA, 22 nt, Human
gcuuaauucuggcucaguuucc

SEQ ID NO: 82063 - RNA, 22 nt, Human
gcuuacaagccagcuguaccac

SEQ ID NO: 82064 - RNA, 22 nt, Human
gcuuacacuaaacaaguuuccu

SEQ ID NO: 82065 - RNA, 20 nt, Human
gcuuagcaggcauaguagcu

SEQ ID NO: 82066 - RNA, 22 nt, Human
gcuuagcagucacacauuguuc

SEQ ID NO: 82067 - RNA, 22 nt, Human
gcuuagcaucuuacaaugcuga

SEQ ID NO: 82068 - RNA, 22 nt, Human
gcuuaguggugugcaaaggggu

SEQ ID NO: 82069 - RNA, 22 nt, Human
gcuuaguguaggaccuggaaua

SEQ ID NO: 82070 - RNA, 22 nt, Human
gcuuauacucuggagaauaaga

SEQ ID NO: 82071 - RNA, 21 nt, Human
gcuuauagaaacaucaccaga

SEQ ID NO: 82072 - RNA, 22 nt, Human
gcuuauuuucaccuucucucag

SEQ ID NO: 82073 - RNA, 22 nt, Human
gcuucaaacugagcuucaagug

SEQ ID NO: 82074 - RNA, 22 nt, Human
gcuucaaggccaagacaccuua

SEQ ID NO: 82075 - RNA, 22 nt, Human
gcuucagaaguugggcucugac

SEQ ID NO: 82076 - RNA, 22 nt, Human
gcuucagagauuucacuaguuu

SEQ ID NO: 82077 - RNA, 20 nt, Human
gcuucaguuuccucacuggu

SEQ ID NO: 82078 - RNA, 22 nt, Human
gcuucaugaaaaucacugguca

SEQ ID NO: 82079 - RNA, 22 nt, Human
gcuucaugcuugcuccaaagcu

SEQ ID NO: 82080 - RNA, 18 nt, Human
gcuucauggaaggguugu

SEQ ID NO: 82081 - RNA, 22 nt, Human
gcuucauuacugacagucugug

SEQ ID NO: 82082 - RNA, 20 nt, Human
gcuuccaccugaagcgcacc

SEQ ID NO: 82083 - RNA, 22 nt, Human
gcuuccagagacugagcucuuc

SEQ ID NO: 82084 - RNA, 22 nt, Human
gcuuccagcaaacacuggcugc

SEQ ID NO: 82085 - RNA, 22 nt, Human
gcuuccaggcuuccuaccuuug

SEQ ID NO: 82086 - RNA, 22 nt, Human
gcuuccauguaugcucuugaca

SEQ ID NO: 82087 - RNA, 22 nt, Human
gcuuccauguugcugcugguca

SEQ ID NO: 82088 - RNA, 22 nt, Human
ggaagaugcccaacccagcuuu

SEQ ID NO: 82089 - RNA, 22 nt, Human
ggaagcacugaggcagagaggg

SEQ ID NO: 82090 - RNA, 22 nt, Human
ggaagcaggaggcugggguaaa

SEQ ID NO: 82091 - RNA, 22 nt, Human
ggaagccaagguggccucuauu

SEQ ID NO: 82092 - RNA, 22 nt, Human
ggaagccagagugcugggcagg

SEQ ID NO: 82093 - RNA, 22 nt, Human
ggaagcccagcugucuccuguc

SEQ ID NO: 82094 - RNA, 22 nt, Human
ggaagccccagcauggccuugg

SEQ ID NO: 82095 - RNA, 22 nt, Human
ggaagcggcccugagcgcaggg

SEQ ID NO: 82096 - RNA, 22 nt, Human
ggaagcucuguggcuuggaguc

SEQ ID NO: 82097 - RNA, 22 nt, Human
ggaagcugaacuuagcaaggaa

SEQ ID NO: 82098 - RNA, 22 nt, Human
ggaagcugcagucccccccaag

SEQ ID NO: 82099 - RNA, 22 nt, Human
ggaagcugcauaacuagcgugg

SEQ ID NO: 82100 - RNA, 22 nt, Human
ggaagcuguuccuguguggcca

SEQ ID NO: 82101 - RNA, 22 nt, Human
ggaagcuuaaugccuaauuucc

SEQ ID NO: 82102 - RNA, 22 nt, Human
ggaagcuuucucuguuuccuua

SEQ ID NO: 82103 - RNA, 22 nt, Human
ggaaggaaagcagcuuggcccu

SEQ ID NO: 82104 - RNA, 22 nt, Human
ggaaggaacaaacccugugugg

SEQ ID NO: 82105 - RNA, 22 nt, Human
ggaaggaagugaccaggauauc

SEQ ID NO: 82106 - RNA, 22 nt, Human
ggaaggagcauuugccaguuua

SEQ ID NO: 82107 - RNA, 22 nt, Human
ggaaggagggcggcaaugauga

SEQ ID NO: 82108 - RNA, 22 nt, Human
ggaaggaggggcaaagcaguuc

SEQ ID NO: 82109 - RNA, 22 nt, Human
ggaaggcuaauaaugcaagaaa

SEQ ID NO: 82110 - RNA, 22 nt, Human
ggaaggcuacaggaauccagcg

SEQ ID NO: 82111 - RNA, 22 nt, Human
ggaaggcuccacccaaggcgag

SEQ ID NO: 82112 - RNA, 22 nt, Human
ggaaggcucgaggaugcuucug

SEQ ID NO: 82113 - RNA, 20 nt, Human
ggaaggcuugaaguuuacau

SEQ ID NO: 82114 - RNA, 22 nt, Human
ggaaggcuuuaagcaccaaagc

SEQ ID NO: 82115 - RNA, 22 nt, Human
ggaagggaaaauucauucggcu

SEQ ID NO: 82116 - RNA, 22 nt, Human
ggaagggaauccaucugguuag

SEQ ID NO: 82117 - RNA, 22 nt, Human
ggaagggcaaaagagaugaacu

SEQ ID NO: 82118 - RNA, 22 nt, Human
ggaagggcaauaaaaucucagg

SEQ ID NO: 82119 - RNA, 22 nt, Human
ggaagggccucgggcgugggac

SEQ ID NO: 82120 - RNA, 21 nt, Human
ggaagggcucugaggacggcu

SEQ ID NO: 82121 - RNA, 20 nt, Human
ggaaggggcaaaguguguga

SEQ ID NO: 82122 - RNA, 22 nt, Human
ggaaggggucaccuccugauga

SEQ ID NO: 82123 - RNA, 22 nt, Human
ggaaggggugggugagccucag

SEQ ID NO: 82124 - RNA, 22 nt, Human
ggaaggguucaggugggccugc

SEQ ID NO: 82125 - RNA, 19 nt, Human
ggaaggugacaguggugaa

SEQ ID NO: 82126 - RNA, 22 nt, Human
ggaaggugcucccuggacagag

SEQ ID NO: 82127 - RNA, 18 nt, Human
ggaaggugcuggagugca

SEQ ID NO: 82128 - RNA, 22 nt, Human
ggaagugaggaaauauuuuguu

SEQ ID NO: 82129 - RNA, 22 nt, Human
ggaagugguagagccaugagug

SEQ ID NO: 82130 - RNA, 22 nt, Human
ggaaguguaguccgaaguugcg

SEQ ID NO: 82131 - RNA, 22 nt, Human
ggaaguguuugugcagauggcc

SEQ ID NO: 82132 - RNA, 22 nt, Human
ggaaguuguaugaucggggaau

SEQ ID NO: 82133 - RNA, 22 nt, Human
ggaaguuugggagcugguaauc

SEQ ID NO: 82134 - RNA, 22 nt, Human
ggaauacuaaaggaagcaauug

SEQ ID NO: 82135 - RNA, 22 nt, Human
ggaaucagaauuacugaaugga

SEQ ID NO: 82136 - RNA, 22 nt, Human
ggaaucagagcagaggcuguua

SEQ ID NO: 82137 - RNA, 22 nt, Human
ggaaucagaugaggggcagagc

SEQ ID NO: 82138 - RNA, 20 nt, Human
ggaaucaggguaauguacug

SEQ ID NO: 82139 - RNA, 22 nt, Human
ggaaucuagaaagggagcaagg

SEQ ID NO: 82140 - RNA, 22 nt, Human
ggaaugaagaaauagauggugu

SEQ ID NO: 82141 - RNA, 22 nt, Human
ggaaugggagcuauuaguggaa

SEQ ID NO: 82142 - RNA, 22 nt, Human
ggaauguucuggucugguucau

SEQ ID NO: 82143 - RNA, 22 nt, Human
ggaauguuugcucccuucaggg

SEQ ID NO: 82144 - RNA, 22 nt, Human
ggaauucugcauguucaguugg

SEQ ID NO: 82145 - RNA, 22 nt, Human
ggaauucuguagcucuuccucu

SEQ ID NO: 82146 - RNA, 21 nt, Human
ggaauugcaggcugucuuuug

SEQ ID NO: 82147 - RNA, 22 nt, Human
ggaauugcuaacauucugaagg

SEQ ID NO: 82148 - RNA, 22 nt, Human
ggaauugucuaguacucacggc

SEQ ID NO: 82149 - RNA, 22 nt, Human
gcuuucuguggugauguaaagg

SEQ ID NO: 82150 - RNA, 22 nt, Human
gcuuucuucauacucaagcauc

SEQ ID NO: 82151 - RNA, 22 nt, Human
gcuuugaagacuuuuccagggu

SEQ ID NO: 82152 - RNA, 22 nt, Human
gcuuugcauugugaugggaugc

SEQ ID NO: 82153 - RNA, 22 nt, Human
gcuuugccuguagcauuggccu

SEQ ID NO: 82154 - RNA, 22 nt, Human
gcuuugccuugaacucucaugu

SEQ ID NO: 82155 - RNA, 22 nt, Human
gcuuugcuggcuugaaaugcug

SEQ ID NO: 82156 - RNA, 22 nt, Human
gcuuuggaaacuggcccugcgc

SEQ ID NO: 82157 - RNA, 22 nt, Human
gcuuuggaaauauagacucaag

SEQ ID NO: 82158 - RNA, 19 nt, Human
gcuuuggagggagguucua

SEQ ID NO: 82159 - RNA, 22 nt, Human
gcuuuguguagaaggaggaugg

SEQ ID NO: 82160 - RNA, 22 nt, Human
gcuuugugugaaguccauggcg

SEQ ID NO: 82161 - RNA, 23 nt, Human
gcuuuuaaaccugugacugccgc

SEQ ID NO: 82162 - RNA, 22 nt, Human
gcuuuuacaagagccagagagg

SEQ ID NO: 82163 - RNA, 22 nt, Human
gcuuuuaugcacauaaggguca

SEQ ID NO: 82164 - RNA, 22 nt, Human
gcuuuuauuucuucacaaaagu

SEQ ID NO: 82165 - RNA, 22 nt, Human
gcuuuucauagauaaaauucua

SEQ ID NO: 82166 - RNA, 22 nt, Human
gcuuuucuccuuagugucccug

SEQ ID NO: 82167 - RNA, 22 nt, Human
gcuuuuggaccucugauguuuc

SEQ ID NO: 82168 - RNA, 22 nt, Human
gcuuuugucauggugacucagu

SEQ ID NO: 82169 - RNA, 23 nt, Human
ggaaaaacacugugucuuggcag

SEQ ID NO: 82170 - RNA, 22 nt, Human
ggaaaacaagagaaugauguuu

SEQ ID NO: 82171 - RNA, 22 nt, Human
ggaaaacugaggcucucagcag

SEQ ID NO: 82172 - RNA, 22 nt, Human
ggaaaagacagaauucuagaau

SEQ ID NO: 82173 - RNA, 20 nt, Human
ggaaaaguacuccuccuuaa

SEQ ID NO: 82174 - RNA, 22 nt, Human
ggaaaaguguuaagguguugau

SEQ ID NO: 82175 - RNA, 22 nt, Human
ggaaaauacugauucaugccau

SEQ ID NO: 82176 - RNA, 22 nt, Human
ggaaaaugggaaccugaagcca

SEQ ID NO: 82177 - RNA, 21 nt, Human
ggaaaauucagagugcaauuu

SEQ ID NO: 82178 - RNA, 22 nt, Human
ggaaacaaaccacucauggugg

SEQ ID NO: 82179 - RNA, 22 nt, Human
ggaaacauuccaagaguugaaa

SEQ ID NO: 82180 - RNA, 22 nt, Human
ggaaacugcuuacacuagaggg

SEQ ID NO: 82181 - RNA, 22 nt, Human
ggaaacuuggaugccagcacuc

SEQ ID NO: 82182 - RNA, 22 nt, Human
ggaaacuuguuauuguauuuuc

SEQ ID NO: 82183 - RNA, 22 nt, Human
ggaaagaaagugugaacaacuu

SEQ ID NO: 82184 - RNA, 21 nt, Human
ggaaagaaggcaaggcucagg

SEQ ID NO: 82185 - RNA, 22 nt, Human
ggaaagaauagagacuuuauca

SEQ ID NO: 82186 - RNA, 22 nt, Human
ggaaagaccugagauaggaaua

SEQ ID NO: 82187 - RNA, 22 nt, Human
ggaaagccaggugcucuggugu

SEQ ID NO: 82188 - RNA, 22 nt, Human
ggaaagcuuuguacuugaaaac

SEQ ID NO: 82189 - RNA, 22 nt, Human
ggaaagcuuuguuuuccucacc

SEQ ID NO: 82190 - RNA, 22 nt, Human
ggaaaggagauauuggagagug

SEQ ID NO: 82191 - RNA, 17 nt, Human
ggaaagguagaguaauc

SEQ ID NO: 82192 - RNA, 22 nt, Human
ggaaaguggugguggaaagagg

SEQ ID NO: 82193 - RNA, 22 nt, Human
ggaaaucaaggggacaaauugu

SEQ ID NO: 82194 - RNA, 22 nt, Human
ggaaaucagcagaugcugguga

SEQ ID NO: 82195 - RNA, 22 nt, Human
ggaaaucucuacuuugucauuu

SEQ ID NO: 82196 - RNA, 22 nt, Human
ggaaaucucuuuugugguguuu

SEQ ID NO: 82197 - RNA, 17 nt, Human
ggaacaaauacuaugca

SEQ ID NO: 82198 - RNA, 22 nt, Human
ggaacacucagaaaugcucguc

SEQ ID NO: 82199 - RNA, 22 nt, Human
ggaacagacugacuucuugaau

SEQ ID NO: 82200 - RNA, 18 nt, Human
ggaacagcucagggcagc

SEQ ID NO: 82201 - RNA, 22 nt, Human
ggaacaggaaaggagggaugcu

SEQ ID NO: 82202 - RNA, 22 nt, Human
ggaacaguacucggaggccaga

SEQ ID NO: 82203 - RNA, 22 nt, Human
ggaacauacuguguagacuuug

SEQ ID NO: 82204 - RNA, 22 nt, Human
uagguucagcuuccacugccua

SEQ ID NO: 82205 - RNA, 22 nt, Human
uagguucagugucuuguucugc

SEQ ID NO: 82206 - RNA, 22 nt, Human
uagguucaugaaauuuucagga

SEQ ID NO: 82207 - RNA, 22 nt, Human
uagguuccauuuaaacaaagaa

SEQ ID NO: 82208 - RNA, 19 nt, Human
uagguuggacaguaucccc

SEQ ID NO: 82209 - RNA, 22 nt, Human
uaguaaagugucuuaacacaua

SEQ ID NO: 82210 - RNA, 17 nt, Human
uaguaaaugaguagagc

SEQ ID NO: 82211 - RNA, 22 nt, Human
uaguaaauuaaaauauugacuu

SEQ ID NO: 82212 - RNA, 22 nt, Human
uaguaacagcagcuucccugug

SEQ ID NO: 82213 - RNA, 22 nt, Human
uaguacaacucacuugauuuua

SEQ ID NO: 82214 - RNA, 22 nt, Human
uaguacagaauuaauaauugug

SEQ ID NO: 82215 - RNA, 22 nt, Human
uaguacuuaucucugucauugu

SEQ ID NO: 82216 - RNA, 22 nt, Human
uaguagcaacaagaaacaaaua

SEQ ID NO: 82217 - RNA, 22 nt, Human
uaguagcaggaaucugaaggua

SEQ ID NO: 82218 - RNA, 22 nt, Human
uaguaguaauuguuaucuuauu

SEQ ID NO: 82219 - RNA, 22 nt, Human
uaguauagauugaagcagauca

SEQ ID NO: 82220 - RNA, 22 nt, Human
uagucaaaaggaaggauaugcu

SEQ ID NO: 82221 - RNA, 22 nt, Human
uagucaagauuggaauaaugua

SEQ ID NO: 82222 - RNA, 22 nt, Human
uagucacaaccuucaaguuguc

SEQ ID NO: 82223 - RNA, 22 nt, Human
uagucacaguacaggauaaaga

SEQ ID NO: 82224 - RNA, 22 nt, Human
uagucaccuguugugugaugcc

SEQ ID NO: 82225 - RNA, 22 nt, Human
uagucagauauaugacuuacgu

SEQ ID NO: 82226 - RNA, 22 nt, Human
uagucagcaugaaauaagcagc

SEQ ID NO: 82227 - RNA, 23 nt, Human
uagucaguauguaagucuaauug

SEQ ID NO: 82228 - RNA, 22 nt, Human
uagucagucuuacauauuugaa

SEQ ID NO: 82229 - RNA, 22 nt, Human
uagucagugcacagacacuugu

SEQ ID NO: 82230 - RNA, 22 nt, Human
uaguccaggacaaucuucauau

SEQ ID NO: 82231 - RNA, 22 nt, Human
uaguccagguuuccaucuccac

SEQ ID NO: 82232 - RNA, 22 nt, Human
uagucccggaacuccuucaggu

SEQ ID NO: 82233 - RNA, 22 nt, Human
uaguccuugguaaaauucuaug

SEQ ID NO: 82234 - RNA, 22 nt, Human
uaguccuuuaucaaacauuuau

SEQ ID NO: 82235 - RNA, 22 nt, Human
uagucuggacuucuuaguguca

SEQ ID NO: 82236 - RNA, 22 nt, Human
uagugaaaguauuaaacagcug

SEQ ID NO: 82237 - RNA, 22 nt, Human
uagugaaaugauaacagagcag

SEQ ID NO: 82238 - RNA, 22 nt, Human
uagugaaauuuaugcacagcua

SEQ ID NO: 82239 - RNA, 19 nt, Human
uagugaguagugaauuaga

SEQ ID NO: 82240 - RNA, 22 nt, Human
uagugauuauaaaacaguuuuu

SEQ ID NO: 82241 - RNA, 22 nt, Human
uagugauuccaaugugaagugg

SEQ ID NO: 82242 - RNA, 22 nt, Human
uagugauucugauguaagacaa

SEQ ID NO: 82243 - RNA, 22 nt, Human
uagugcaaggauugcugcagag

SEQ ID NO: 82244 - RNA, 22 nt, Human
uagugccaccacugucuuuggc

SEQ ID NO: 82245 - RNA, 22 nt, Human
uagugccauucaagagguaguu

SEQ ID NO: 82246 - RNA, 22 nt, Human
uagugcuuaauaaauuucagaa

SEQ ID NO: 82247 - RNA, 22 nt, Human
uagugcuucuacccuaggcagg

SEQ ID NO: 82248 - RNA, 22 nt, Human
uagugcuuggcccuaccagaua

SEQ ID NO: 82249 - RNA, 22 nt, Human
uaguggagaguuguuuugugca

SEQ ID NO: 82250 - RNA, 22 nt, Human
uaguggagguggucugugaacu

SEQ ID NO: 82251 - RNA, 22 nt, Human
uaguggauguucagagauuuga

SEQ ID NO: 82252 - RNA, 17 nt, Human
uaguggcaggaaaugaa

SEQ ID NO: 82253 - RNA, 22 nt, Human
uaguggcugcagggcuguuuga

SEQ ID NO: 82254 - RNA, 22 nt, Human
uaguggcugcuucauuggugag

SEQ ID NO: 82255 - RNA, 22 nt, Human
uagugggugauuugaugaggaa

SEQ ID NO: 82256 - RNA, 22 nt, Human
uaguggguuuauacaauuuaaa

SEQ ID NO: 82257 - RNA, 21 nt, Human
uaguguagcugcagcagcaga

SEQ ID NO: 82258 - RNA, 22 nt, Human
ggagggagagugacccuaccaa

SEQ ID NO: 82259 - RNA, 22 nt, Human
ggagggagggcuagaccaaaga

SEQ ID NO: 82260 - RNA, 22 nt, Human
ggagggagguuagauucaagcu

SEQ ID NO: 82261 - RNA, 22 nt, Human
ggagggagucagcugauuagaa

SEQ ID NO: 82262 - RNA, 21 nt, Human
ggagggcagcccagacuggcu

SEQ ID NO: 82263 - RNA, 22 nt, Human
ggagggcccugggugcagcucu

SEQ ID NO: 82264 - RNA, 23 nt, Human
ggagggcuucaucagacccccag

SEQ ID NO: 82265 - RNA, 18 nt, Human
ggagggcuuuggggacug

SEQ ID NO: 82266 - RNA, 22 nt, Human
ggaggggaacuaaucccgugac

SEQ ID NO: 82267 - RNA, 22 nt, Human
ggaggggagauguuugggcuca

SEQ ID NO: 82268 - RNA, 22 nt, Human
ggaggggaggauuaaugacaaa

SEQ ID NO: 82269 - RNA, 22 nt, Human
ggaggggagucucccaaagccg

SEQ ID NO: 82270 - RNA, 22 nt, Human
ggagggggaaacuuuggcugcc

SEQ ID NO: 82271 - RNA, 22 nt, Human
ggaggggucucuagcgaggaga

SEQ ID NO: 82272 - RNA, 22 nt, Human
ggaggggugagaauggcugccu

SEQ ID NO: 82273 - RNA, 22 nt, Human
ggagggugcauuuuacccugug

SEQ ID NO: 82274 - RNA, 22 nt, Human
ggagggugggucauucuuacau

SEQ ID NO: 82275 - RNA, 22 nt, Human
ggagguagccucaaaagcagcu

SEQ ID NO: 82276 - RNA, 22 nt, Human
ggagguauuugucaaucuguuu

SEQ ID NO: 82277 - RNA, 22 nt, Human
ggaggucaaauggagggcuggg

SEQ ID NO: 82278 - RNA, 21 nt, Human
ggaggucccuucugguuucag

SEQ ID NO: 82279 - RNA, 22 nt, Human
ggaggugaggccguagggugug

SEQ ID NO: 82280 - RNA, 22 nt, Human
ggagguggcagagggacauucu

SEQ ID NO: 82281 - RNA, 22 nt, Human
ggaggugggagacauaggcggc

SEQ ID NO: 82282 - RNA, 22 nt, Human
ggaggugggagccuccaguggu

SEQ ID NO: 82283 - RNA, 22 nt, Human
ggaggugguggcagugacaauu

SEQ ID NO: 82284 - RNA, 22 nt, Human
ggaggugguuugauuucuauau

SEQ ID NO: 82285 - RNA, 22 nt, Human
ggaguaaggcucagaggaaaug

SEQ ID NO: 82286 - RNA, 22 nt, Human
ggagucaaggaaggcucuguga

SEQ ID NO: 82287 - RNA, 22 nt, Human
ggagucacacagagaagauaag

SEQ ID NO: 82288 - RNA, 22 nt, Human
ggagucaccugggaggacuggg

SEQ ID NO: 82289 - RNA, 22 nt, Human
ggagucagaacccaggcuucua

SEQ ID NO: 82290 - RNA, 22 nt, Human
ggagucaucucagcugagaggc

SEQ ID NO: 82291 - RNA, 22 nt, Human
ggaguccuggacuccaucucac

SEQ ID NO: 82292 - RNA, 22 nt, Human
ggagucugacccuuagagauga

SEQ ID NO: 82293 - RNA, 22 nt, Human
ggagucugagcuuguguccugg

SEQ ID NO: 82294 - RNA, 22 nt, Human
ggagucugauacugaguuccuc

SEQ ID NO: 82295 - RNA, 22 nt, Human
ggagucugauuuuuuaugggug

SEQ ID NO: 82296 - RNA, 22 nt, Human
ggagucugcggcagacacugua

SEQ ID NO: 82297 - RNA, 21 nt, Human
ggagucuguggaugcuguuuc

SEQ ID NO: 82298 - RNA, 22 nt, Human
ggagucuuaaaaaucaaaugga

SEQ ID NO: 82299 - RNA, 22 nt, Human
ggagugacucucggggccacua

SEQ ID NO: 82300 - RNA, 22 nt, Human
ggagugcuuugaagccuucauu

SEQ ID NO: 82301 - RNA, 22 nt, Human
ggaguggcagagaggguauacu

SEQ ID NO: 82302 - RNA, 22 nt, Human
ggaguggcuauuugugcugguu

SEQ ID NO: 82303 - RNA, 22 nt, Human
ggagugggcagcacugcccugu

SEQ ID NO: 82304 - RNA, 22 nt, Human
ggagugguggucaggccauggc

SEQ ID NO: 82305 - RNA, 22 nt, Human
ggagugucagaaacaguguccu

SEQ ID NO: 82306 - RNA, 23 nt, Human
ggagugugaagaccugauauagc

SEQ ID NO: 82307 - RNA, 22 nt, Human
ggaguuccagaaucugcuuuuu

SEQ ID NO: 82308 - RNA, 22 nt, Human
ggaguuggugagcaccaggcuu

SEQ ID NO: 82309 - RNA, 22 nt, Human
ggaguugguggcccggaaucuc

SEQ ID NO: 82310 - RNA, 22 nt, Human
ggauaagaaaauuguaauaacu

SEQ ID NO: 82311 - RNA, 18 nt, Human
ggauaggaccuuaggcag

SEQ ID NO: 82312 - RNA, 22 nt, Human
ggauauaugcauguuaucauuu

SEQ ID NO: 82313 - RNA, 22 nt, Human
ggaucaagaaagucagaugaag

SEQ ID NO: 82314 - RNA, 22 nt, Human
ggaucauuaagaauagcuacua

SEQ ID NO: 82315 - RNA, 22 nt, Human
ggauccugauauguguuucuca

SEQ ID NO: 82316 - RNA, 22 nt, Human
ggauccuuaacuaucacaguga

SEQ ID NO: 82317 - RNA, 22 nt, Human
ggauccuucuuugaccucacag

SEQ ID NO: 82318 - RNA, 22 nt, Human
ggaucgcggucccggcccgcgc

SEQ ID NO: 82319 - RNA, 22 nt, Human
ggaucugagagcaagcaggacc

SEQ ID NO: 82320 - RNA, 22 nt, Human
ggacugaaugccagucuaugga

SEQ ID NO: 82321 - RNA, 22 nt, Human
ggacugaggacaugugaggcau

SEQ ID NO: 82322 - RNA, 22 nt, Human
ggacugggagaauggaggcaag

SEQ ID NO: 82323 - RNA, 22 nt, Human
ggacugggcaugggugcucugc

SEQ ID NO: 82324 - RNA, 22 nt, Human
ggacugggccagggguuggacu

SEQ ID NO: 82325 - RNA, 17 nt, Human
ggacugggcggggcagg

SEQ ID NO: 82326 - RNA, 22 nt, Human
ggacugguggcuccuugggcag

SEQ ID NO: 82327 - RNA, 22 nt, Human
ggacugucuccuugcugguagg

SEQ ID NO: 82328 - RNA, 19 nt, Human
ggacuguugccaggccucu

SEQ ID NO: 82329 - RNA, 22 nt, Human
ggacuuggggaaggcacaguua

SEQ ID NO: 82330 - RNA, 19 nt, Human
ggacuugguuuccaggcuc

SEQ ID NO: 82331 - RNA, 22 nt, Human
ggacuuuaggaagggccaagug

SEQ ID NO: 82332 - RNA, 22 nt, Human
ggagaaaggauaggaaugugcu

SEQ ID NO: 82333 - RNA, 22 nt, Human
ggagaaagucagcuccaagcag

SEQ ID NO: 82334 - RNA, 22 nt, Human
ggagaagauuggaauuaagcac

SEQ ID NO: 82335 - RNA, 22 nt, Human
ggagaagcagcuucuugaugaa

SEQ ID NO: 82336 - RNA, 19 nt, Human
ggagaagcccaggaauccu

SEQ ID NO: 82337 - RNA, 22 nt, Human
ggagaaggcgaagucauucuuu

SEQ ID NO: 82338 - RNA, 22 nt, Human
ggagaagggacagacucagcuu

SEQ ID NO: 82339 - RNA, 22 nt, Human
ggagaagggccaauuccaugua

SEQ ID NO: 82340 - RNA, 23 nt, Human
ggagacaagguaccacguuaaca

SEQ ID NO: 82341 - RNA, 22 nt, Human
ggagacaugcagacugagauac

SEQ ID NO: 82342 - RNA, 22 nt, Human
ggagacucucauugucaagcuu

SEQ ID NO: 82343 - RNA, 22 nt, Human
ggagacugaucugagugauaac

SEQ ID NO: 82344 - RNA, 22 nt, Human
ggagacuugaguuuuugucuua

SEQ ID NO: 82345 - RNA, 22 nt, Human
ggagagaacuggcuccuucuag

SEQ ID NO: 82346 - RNA, 22 nt, Human
ggagagaauuccauggacaugu

SEQ ID NO: 82347 - RNA, 22 nt, Human
ggagagagaccuccaugcccag

SEQ ID NO: 82348 - RNA, 22 nt, Human
ggagagagagcucauuagcugc

SEQ ID NO: 82349 - RNA, 20 nt, Human
ggagagcagggaagacagua

SEQ ID NO: 82350 - RNA, 20 nt, Human
ggagagccacauagucuccc

SEQ ID NO: 82351 - RNA, 22 nt, Human
ggagagccuccacggcuucugu

SEQ ID NO: 82352 - RNA, 22 nt, Human
ggagagcuagugccugccagua

SEQ ID NO: 82353 - RNA, 23 nt, Human
ggagagcuccucgugacucacug

SEQ ID NO: 82354 - RNA, 22 nt, Human
ggagagcugguagcuggcucca

SEQ ID NO: 82355 - RNA, 22 nt, Human
ggagaggaaaugccagcacuuc

SEQ ID NO: 82356 - RNA, 22 nt, Human
ggagaggggaacuuguugcuug

SEQ ID NO: 82357 - RNA, 22 nt, Human
ggagagggggcucccugcuugg

SEQ ID NO: 82358 - RNA, 22 nt, Human
ggagaggguagggguccugccc

SEQ ID NO: 82359 - RNA, 22 nt, Human
ggagaggugaauggcugcucua

SEQ ID NO: 82360 - RNA, 22 nt, Human
ggagaggugagagguacaaguu

SEQ ID NO: 82361 - RNA, 22 nt, Human
ggagaggugcaggucaguggca

SEQ ID NO: 82362 - RNA, 22 nt, Human
ggagagguguauucaguggguc

SEQ ID NO: 82363 - RNA, 22 nt, Human
ggagaguggauuccagcuguau

SEQ ID NO: 82364 - RNA, 16 nt, Human
ggagagugucugcaaa

SEQ ID NO: 82365 - RNA, 22 nt, Human
ggagauccaggcaaggccgcag

SEQ ID NO: 82366 - RNA, 19 nt, Human
ggagaucccgcugcagaug

SEQ ID NO: 82367 - RNA, 23 nt, Human
ggcacugaagcuacaauggugag

SEQ ID NO: 82368 - RNA, 22 nt, Human
ggcacugaaguggguguugggu

SEQ ID NO: 82369 - RNA, 22 nt, Human
ggcacugagaacaggcugacuu

SEQ ID NO: 82370 - RNA, 20 nt, Human
ggcacugcaccaguuaguag

SEQ ID NO: 82371 - RNA, 22 nt, Human
ggcacuggaaggaucaugugag

SEQ ID NO: 82372 - RNA, 22 nt, Human
ggcacuggaagucccauugucu

SEQ ID NO: 82373 - RNA, 22 nt, Human
ggcacugggcaccggcugaggg

SEQ ID NO: 82374 - RNA, 22 nt, Human
ggcacuggguuguaggaauuaa

SEQ ID NO: 82375 - RNA, 18 nt, Human
ggcacuggugaugcagag

SEQ ID NO: 82376 - RNA, 22 nt, Human
ggcacuuuccagucuauagagc

SEQ ID NO: 82377 - RNA, 22 nt, Human
ggcacuuugauuuugagaugca

SEQ ID NO: 82378 - RNA, 22 nt, Human
ggcacuuuucuccccggucaug

SEQ ID NO: 82379 - RNA, 22 nt, Human
ggcagaagauaggacagggaau

SEQ ID NO: 82380 - RNA, 19 nt, Human
ggcagacacaguugacaug

SEQ ID NO: 82381 - RNA, 22 nt, Human
ggcagacaccuuuaugucuaau

SEQ ID NO: 82382 - RNA, 22 nt, Human
ggcagacacucaaaagcuggga

SEQ ID NO: 82383 - RNA, 20 nt, Human
ggcagaccugcugagagccc

SEQ ID NO: 82384 - RNA, 21 nt, Human
ggcagagaagcuggaaguugg

SEQ ID NO: 82385 - RNA, 22 nt, Human
ggcagagacaccgaaugacucu

SEQ ID NO: 82386 - RNA, 22 nt, Human
ggcagagacuggguuggcagag

SEQ ID NO: 82387 - RNA, 19 nt, Human
ggcagagcuccugcuuucu

SEQ ID NO: 82388 - RNA, 22 nt, Human
ggcagagcucuggacugagaac

SEQ ID NO: 82389 - RNA, 22 nt, Human
ggcagagcuuguuccuucuguu

SEQ ID NO: 82390 - RNA, 22 nt, Human
ggcagaggaagcuggaaguggg

SEQ ID NO: 82391 - RNA, 22 nt, Human
ggcagaggagcuggaaacaugg

SEQ ID NO: 82392 - RNA, 22 nt, Human
ggcagaguugguggagucaguu

SEQ ID NO: 82393 - RNA, 22 nt, Human
ggcagaugacagaccaguaugu

SEQ ID NO: 82394 - RNA, 22 nt, Human
ggcagauggaaugagcugucua

SEQ ID NO: 82395 - RNA, 18 nt, Human
ggcagcaagaagggaggg

SEQ ID NO: 82396 - RNA, 22 nt, Human
ggcagcaaggccucgggugagc

SEQ ID NO: 82397 - RNA, 22 nt, Human
ggcagcaagguggcggaaauga

SEQ ID NO: 82398 - RNA, 22 nt, Human
ggcagcagaccccuaagucuac

SEQ ID NO: 82399 - RNA, 22 nt, Human
ggcagcagcaagguuggagcug

SEQ ID NO: 82400 - RNA, 16 nt, Human
ggcagcagcuccgugc

SEQ ID NO: 82401 - RNA, 22 nt, Human
ggcagcagggcugucucccuac

SEQ ID NO: 82402 - RNA, 22 nt, Human
ggcagcaguggcugcuauuguc

SEQ ID NO: 82403 - RNA, 22 nt, Human
ggcagcaugagccuggugaauu

SEQ ID NO: 82404 - RNA, 22 nt, Human
ggcagcaugugugguccgcugg

SEQ ID NO: 82405 - RNA, 20 nt, Human
ggcagccaaucagcgugccg

SEQ ID NO: 82406 - RNA, 22 nt, Human
ggcagccagcaaugagaaguuu

SEQ ID NO: 82407 - RNA, 22 nt, Human
ggcagccagcacgcaguugaug

SEQ ID NO: 82408 - RNA, 22 nt, Human
ggcagccccagaaacaguucag

SEQ ID NO: 82409 - RNA, 22 nt, Human
ggcagcccuguggagaggccca

SEQ ID NO: 82410 - RNA, 17 nt, Human
ggcagccucaggcguuu

SEQ ID NO: 82411 - RNA, 23 nt, Human
ggcagccucugacucugcuuugc

SEQ ID NO: 82412 - RNA, 22 nt, Human
ggcagccuggagacuuugugaa

SEQ ID NO: 82413 - RNA, 22 nt, Human
ggcagccuucucucauagguga

SEQ ID NO: 82414 - RNA, 22 nt, Human
ggcagccuugacuagugacuua

SEQ ID NO: 82415 - RNA, 22 nt, Human
ggcagcgagucgccaagucucg

SEQ ID NO: 82416 - RNA, 22 nt, Human
ggcagcuaguuuaagaaagagg

SEQ ID NO: 82417 - RNA, 22 nt, Human
ggcagcucaccucugguccagg

SEQ ID NO: 82418 - RNA, 22 nt, Human
ggcagcucacugauuagcaauu

SEQ ID NO: 82419 - RNA, 22 nt, Human
ggcagcuccaaaaggaaacacu

SEQ ID NO: 82420 - RNA, 22 nt, Human
ggcagcuccucucagcaaaaga

SEQ ID NO: 82421 - RNA, 22 nt, Human
ggcagcucgucaggcugcggcg

SEQ ID NO: 82422 - RNA, 22 nt, Human
ggcagcucugugucugggaagc

SEQ ID NO: 82423 - RNA, 22 nt, Human
ggcagcugagaucaugcuguug

SEQ ID NO: 82424 - RNA, 22 nt, Human
ggcagcugcaaaucugcucugu

SEQ ID NO: 82425 - RNA, 22 nt, Human
ggcagcuggccuccucgcccac

SEQ ID NO: 82426 - RNA, 22 nt, Human
ggcagcugucucugaguuagca

SEQ ID NO: 82427 - RNA, 21 nt, Human
ggcagcugugguuaauugaac

SEQ ID NO: 82428 - RNA, 22 nt, Human
ggcagcuucucccaggcuguuu

SEQ ID NO: 82429 - RNA, 20 nt, Human
ggcagcuugggcagcaguua

SEQ ID NO: 82430 - RNA, 22 nt, Human
ggcagcuuugagucuuagagua

SEQ ID NO: 82431 - RNA, 22 nt, Human
ggcaggaagcauuaaaacgauu

SEQ ID NO: 82432 - RNA, 22 nt, Human
ggcaggaauaaauuauggacuu

SEQ ID NO: 82433 - RNA, 22 nt, Human
ggcaggacagucccaguucaaa

SEQ ID NO: 82434 - RNA, 22 nt, Human
ggcaggacauugacuacaguga

SEQ ID NO: 82435 - RNA, 22 nt, Human
ggcaggacugaucagugggaug

SEQ ID NO: 82436 - RNA, 18 nt, Human
ggcaggauuucaacuuuc

SEQ ID NO: 82437 - RNA, 22 nt, Human
ggcaggcaaggcagccugguga

SEQ ID NO: 82438 - RNA, 22 nt, Human
ggcaggcacaguaauacauguu

SEQ ID NO: 82439 - RNA, 22 nt, Human
ggcaggcaggagcucugucucc

SEQ ID NO: 82440 - RNA, 20 nt, Human
ggcaggcaggagguuuccag

SEQ ID NO: 82441 - RNA, 22 nt, Human
ggcaggcaggucuucauggccc

SEQ ID NO: 82442 - RNA, 22 nt, Human
ggcaggcucagcagccaaggag

SEQ ID NO: 82443 - RNA, 22 nt, Human
ggcaggcuccaagcauccuaug

SEQ ID NO: 82444 - RNA, 22 nt, Human
ggcaggcuguucaccugcuuuu

SEQ ID NO: 82445 - RNA, 22 nt, Human
ggcagggguccugguguugacu

SEQ ID NO: 82446 - RNA, 22 nt, Human
ggcagggguggccuuccuuugg

SEQ ID NO: 82447 - RNA, 22 nt, Human
ggcagggguucauuuugucuua

SEQ ID NO: 82448 - RNA, 22 nt, Human
ggcaggguccacaccugggaaa

SEQ ID NO: 82449 - RNA, 22 nt, Human
ggcagggugccuggcuccuguu

SEQ ID NO: 82450 - RNA, 22 nt, Human
ggcaggguggcagaggcucaga

SEQ ID NO: 82451 - RNA, 19 nt, Human
ggcagguagagggccaguc

SEQ ID NO: 82452 - RNA, 22 nt, Human
ggcaggucagguccaugaccaa

SEQ ID NO: 82453 - RNA, 23 nt, Human
ggccaggugcaccuuagagagcc

SEQ ID NO: 82454 - RNA, 22 nt, Human
ggccaggugcgguggcucacac

SEQ ID NO: 82455 - RNA, 22 nt, Human
ggccagguggcuguccuggcgu

SEQ ID NO: 82456 - RNA, 22 nt, Human
ggccagguuggguggaaguggc

SEQ ID NO: 82457 - RNA, 22 nt, Human
ggccagugugggaguaguucuu

SEQ ID NO: 82458 - RNA, 22 nt, Human
ggccaguuuccaugcacuauuu

SEQ ID NO: 82459 - RNA, 22 nt, Human
ggccaugcaggucugguagguc

SEQ ID NO: 82460 - RNA, 22 nt, Human
ggccauggcgggagccggcguc

SEQ ID NO: 82461 - RNA, 23 nt, Human
ggccauuucauuugguucaaacu

SEQ ID NO: 82462 - RNA, 22 nt, Human
ggcccaaaccaaguaccucaaa

SEQ ID NO: 82463 - RNA, 22 nt, Human
ggcccaaggugccaaggccucc

SEQ ID NO: 82464 - RNA, 22 nt, Human
ggcccagaagccagaagccucc

SEQ ID NO: 82465 - RNA, 22 nt, Human
ggcccagagacgugcaauguac

SEQ ID NO: 82466 - RNA, 22 nt, Human
ggcccagagcucugggggagcu

SEQ ID NO: 82467 - RNA, 22 nt, Human
ggcccagagggguugagcaucu

SEQ ID NO: 82468 - RNA, 22 nt, Human
ggcccagauuagaagcugaaug

SEQ ID NO: 82469 - RNA, 22 nt, Human
ggcccaggaugcaagaacugaa

SEQ ID NO: 82470 - RNA, 22 nt, Human
ggcccagugcuguucacccagu

SEQ ID NO: 82471 - RNA, 22 nt, Human
ggcccaugcauccugugcagcc

SEQ ID NO: 82472 - RNA, 22 nt, Human
ggccccagcagacccuccucug

SEQ ID NO: 82473 - RNA, 19 nt, Human
ggccccagccaggguauca

SEQ ID NO: 82474 - RNA, 22 nt, Human
ggccccaggucugaacacgcug

SEQ ID NO: 82475 - RNA, 19 nt, Human
ggccccucucacaggaguu

SEQ ID NO: 82476 - RNA, 22 nt, Human
ggcagugaaaaaguauguuucc

SEQ ID NO: 82477 - RNA, 22 nt, Human
ggcagugaacagaaaugcagaa

SEQ ID NO: 82478 - RNA, 22 nt, Human
ggcagugacuguucagacgucc

SEQ ID NO: 82479 - RNA, 22 nt, Human
ggcagugaugucaaacagugaa

SEQ ID NO: 82480 - RNA, 22 nt, Human
ggcagugcccggugccuccucu

SEQ ID NO: 82481 - RNA, 22 nt, Human
ggcaguguucugguugucagga

SEQ ID NO: 82482 - RNA, 20 nt, Human
ggcaguuaaggcacagucau

SEQ ID NO: 82483 - RNA, 22 nt, Human
ggcaguugcgugcaucaguggu

SEQ ID NO: 82484 - RNA, 22 nt, Human
ggcaguuucucaggcaggggua

SEQ ID NO: 82485 - RNA, 22 nt, Human
ggcaguuuggcaggauggaggg

SEQ ID NO: 82486 - RNA, 22 nt, Human
ggcauacaagagaaauauaaga

SEQ ID NO: 82487 - RNA, 22 nt, Human
ggcaucagagguguguucugcu

SEQ ID NO: 82488 - RNA, 22 nt, Human
ggcaucaggguaggaagguauc

SEQ ID NO: 82489 - RNA, 22 nt, Human
ggcaucaguauggccauagggu

SEQ ID NO: 82490 - RNA, 19 nt, Human
ggcauccagaacuaccagu

SEQ ID NO: 82491 - RNA, 22 nt, Human
ggcauccugggacuggcuucuu

SEQ ID NO: 82492 - RNA, 20 nt, Human
ggcauccuucugacccagag

SEQ ID NO: 82493 - RNA, 22 nt, Human
ggcaucucggaacacgccuccg

SEQ ID NO: 82494 - RNA, 22 nt, Human
ggcaucugagcuguguaugguu

SEQ ID NO: 82495 - RNA, 22 nt, Human
ggcaucuguccaucucuccagc

SEQ ID NO: 82496 - RNA, 20 nt, Human
ggcaugagaugugagggagg

SEQ ID NO: 82497 - RNA, 21 nt, Human
ggcaugagggcagugagcaga

SEQ ID NO: 82498 - RNA, 22 nt, Human
ggcaugaguggcagugggcagu

SEQ ID NO: 82499 - RNA, 22 nt, Human
ggcaugcauacguagugauuuu

SEQ ID NO: 82500 - RNA, 22 nt, Human
ggcaugcucuggggguccuccg

SEQ ID NO: 82501 - RNA, 22 nt, Human
ggcaugcugcguacagaugaac

SEQ ID NO: 82502 - RNA, 20 nt, Human
ggcauggcaaauguucuugc

SEQ ID NO: 82503 - RNA, 22 nt, Human
ggcauggucuuugcuugcagga

SEQ ID NO: 82504 - RNA, 22 nt, Human
ggcaugucugauggcccaaguc

SEQ ID NO: 82505 - RNA, 22 nt, Human
ggcauuaacucuguuucaauuu

SEQ ID NO: 82506 - RNA, 20 nt, Human
ggcauuagauuuuaaauguc

SEQ ID NO: 82507 - RNA, 22 nt, Human
ggcauuuacauaaucuuauuua

SEQ ID NO: 82508 - RNA, 22 nt, Human
ggcauuuaucuaauauaguuua

SEQ ID NO: 82509 - RNA, 22 nt, Human
ggccaaaucuguaaggcaagau

SEQ ID NO: 82510 - RNA, 22 nt, Human
ggccaaaugaaaucugagcaau

SEQ ID NO: 82511 - RNA, 22 nt, Human
ggccaaauuuauuugcagcugg

SEQ ID NO: 82512 - RNA, 22 nt, Human
ggccaagaaugauaggcucagu

SEQ ID NO: 82513 - RNA, 22 nt, Human
ggccaagauggaaggagagaug

SEQ ID NO: 82514 - RNA, 22 nt, Human
ggccaagcucucauuccagcac

SEQ ID NO: 82515 - RNA, 22 nt, Human
ggccaaggcucuugagggcuga

SEQ ID NO: 82516 - RNA, 22 nt, Human
ggccaagguggagaaggcacug

SEQ ID NO: 82517 - RNA, 22 nt, Human
ggccaagguguucugauaugcc

SEQ ID NO: 82518 - RNA, 22 nt, Human
ggccaauuccaggagccggcgg

SEQ ID NO: 82519 - RNA, 22 nt, Human
ggccacacucugguagagguga

SEQ ID NO: 82520 - RNA, 22 nt, Human
ggccacagcaaugcugugaugu

SEQ ID NO: 82521 - RNA, 20 nt, Human
ggccacagggugcuggugga

SEQ ID NO: 82522 - RNA, 21 nt, Human
ggccacaguuagggcucagga

SEQ ID NO: 82523 - RNA, 22 nt, Human
ggccacauguggcugcucguau

SEQ ID NO: 82524 - RNA, 22 nt, Human
ggccaccaguccucuggcaggg

SEQ ID NO: 82525 - RNA, 22 nt, Human
ggccaccucugcccuacugagu

SEQ ID NO: 82526 - RNA, 22 nt, Human
ggccaccugggaucucauccug

SEQ ID NO: 82527 - RNA, 22 nt, Human
ggccaccuuaaguuaaggauau

SEQ ID NO: 82528 - RNA, 22 nt, Human
ggccaccuuccuguggucucug

SEQ ID NO: 82529 - RNA, 22 nt, Human
ggccacgugaccucuggcuccu

SEQ ID NO: 82530 - RNA, 22 nt, Human
ggccacuccgcugcuacuggaa

SEQ ID NO: 82531 - RNA, 22 nt, Human
ggccacugccuccgccauggcu

SEQ ID NO: 82532 - RNA, 22 nt, Human
ggccacuguuuccugggcaguu

SEQ ID NO: 82533 - RNA, 23 nt, Human
ggccacuuugugucaguaugugc

SEQ ID NO: 82534 - RNA, 22 nt, Human
ggccagaaguuggaaaagagcc

SEQ ID NO: 82535 - RNA, 22 nt, Human
ggccagagaauaugccuuacgu

SEQ ID NO: 82536 - RNA, 22 nt, Human
ggccagagagcagccaggauuc

SEQ ID NO: 82537 - RNA, 22 nt, Human
ggccagagagccgcuguuagga

SEQ ID NO: 82538 - RNA, 22 nt, Human
ggccagagcucaaacagucgca

SEQ ID NO: 82539 - RNA, 22 nt, Human
ggccagaggccacagcuguguc

SEQ ID NO: 82540 - RNA, 22 nt, Human
ggccagaggccauccuccugcu

SEQ ID NO: 82541 - RNA, 22 nt, Human
ggccagagguguccucaguucu

SEQ ID NO: 82542 - RNA, 22 nt, Human
ggccagagucuauaugcagaca

SEQ ID NO: 82543 - RNA, 22 nt, Human
ggccagcagucacagggucaga

SEQ ID NO: 82544 - RNA, 22 nt, Human
ggccagcauggcaagaccaacu

SEQ ID NO: 82545 - RNA, 19 nt, Human
ggccagccaccucgccugg

SEQ ID NO: 82546 - RNA, 22 nt, Human
ggccagcccagugguccucucu

SEQ ID NO: 82547 - RNA, 22 nt, Human
ggccagcggcacagccuggccc

SEQ ID NO: 82548 - RNA, 22 nt, Human
ggccagcuacccaucugcguca

SEQ ID NO: 82549 - RNA, 22 nt, Human
ggccagcucagucuccaucagg

SEQ ID NO: 82550 - RNA, 22 nt, Human
ggccagcucugcacagcagcug

SEQ ID NO: 82551 - RNA, 21 nt, Human
ggccagcugcauaugucacug

SEQ ID NO: 82552 - RNA, 22 nt, Human
ggccagcugccaccagcccuau

SEQ ID NO: 82553 - RNA, 22 nt, Human
ggccagcugccugaccuucugu

SEQ ID NO: 82554 - RNA, 22 nt, Human
ggccagcugggccaccaggugc

SEQ ID NO: 82555 - RNA, 22 nt, Human
ggccagcuuauuagcucagagg

SEQ ID NO: 82556 - RNA, 22 nt, Human
ggccagcuucucugcugccugu

SEQ ID NO: 82557 - RNA, 22 nt, Human
ggccagcuuugagcugcaggaa

SEQ ID NO: 82558 - RNA, 22 nt, Human
ggccaggaacuuuugggauggg

SEQ ID NO: 82559 - RNA, 22 nt, Human
ggccaggagcaagccaggcucu

SEQ ID NO: 82560 - RNA, 22 nt, Human
ggccaggcacugugugagauau

SEQ ID NO: 82561 - RNA, 19 nt, Human
ggccaggcugacugugguc

SEQ ID NO: 82562 - RNA, 22 nt, Human
ggccaggcugcccugggagcag

SEQ ID NO: 82563 - RNA, 22 nt, Human
ggccaggcugcugggaccccgc

SEQ ID NO: 82564 - RNA, 22 nt, Human
ggccaggcuggucucagacuuc

SEQ ID NO: 82565 - RNA, 22 nt, Human
ggccagggccuggggacugucc

SEQ ID NO: 82566 - RNA, 22 nt, Human
ggccagguccaguggaaggccc

SEQ ID NO: 82567 - RNA, 22 nt, Human
ggccaguccccuaauccagggc

SEQ ID NO: 82568 - RNA, 21 nt, Human
ggccaguggaauuuuauguca

SEQ ID NO: 82569 - RNA, 22 nt, Human
ggccaguggcucugugcuuggg

SEQ ID NO: 82570 - RNA, 21 nt, Human
ggccauccugggaagggcugc

SEQ ID NO: 82571 - RNA, 22 nt, Human
ucacagugggacuuuuaucgcu

SEQ ID NO: 82572 - RNA, 23 nt, Human
ucacaguuacuuuugcaucaacc

SEQ ID NO: 82573 - RNA, 22 nt, Human
ucacaguucaucugauaaacua

SEQ ID NO: 82574 - RNA, 22 nt, Human
ucacaguugauugaaacacagc

SEQ ID NO: 82575 - RNA, 22 nt, Human
ucacaguuuccauaggucagca

SEQ ID NO: 82576 - RNA, 22 nt, Human
ucacaguuuuagaaaauagaua

SEQ ID NO: 82577 - RNA, 22 nt, Human
ucacauacacuaggauauuuuu

SEQ ID NO: 82578 - RNA, 23 nt, Human
ucacauaucaagaaagugguaga

SEQ ID NO: 82579 - RNA, 22 nt, Human
ucacaucauggagaauuauggg

SEQ ID NO: 82580 - RNA, 20 nt, Human
ucacauccucucccaacaug

SEQ ID NO: 82581 - RNA, 22 nt, Human
ucacaucugcaaaaucccuuuu

SEQ ID NO: 82582 - RNA, 22 nt, Human
ucacaucugugugauugucauu

SEQ ID NO: 82583 - RNA, 22 nt, Human
ucacaucuguugauacagcauc

SEQ ID NO: 82584 - RNA, 22 nt, Human
ucacaucuuaguuugggacucu

SEQ ID NO: 82585 - RNA, 22 nt, Human
ggcuccagcuaaugguuucuau

SEQ ID NO: 82586 - RNA, 22 nt, Human
ggcuccaggaaccuccucuccu

SEQ ID NO: 82587 - RNA, 22 nt, Human
ggcuccaggagaugcugggcag

SEQ ID NO: 82588 - RNA, 22 nt, Human
ggcuccaggagggccuuggcca

SEQ ID NO: 82589 - RNA, 22 nt, Human
ggcuccaggcuccuauuucacu

SEQ ID NO: 82590 - RNA, 22 nt, Human
ggcuccagggucucuccuugug

SEQ ID NO: 82591 - RNA, 18 nt, Human
ggcuccagucuucagugg

SEQ ID NO: 82592 - RNA, 22 nt, Human
ggcuccauccaaggccuucuag

SEQ ID NO: 82593 - RNA, 22 nt, Human
ggcucccuagggagagugggag

SEQ ID NO: 82594 - RNA, 22 nt, Human
ggcucccucaccaccaucacau

SEQ ID NO: 82595 - RNA, 17 nt, Human
ggcucccugacuaugga

SEQ ID NO: 82596 - RNA, 22 nt, Human
ggcucccugccuguccucaguc

SEQ ID NO: 82597 - RNA, 22 nt, Human
ggcucccuggaaaucccgaggc

SEQ ID NO: 82598 - RNA, 22 nt, Human
ggcucccuggcccuggggacac

SEQ ID NO: 82599 - RNA, 22 nt, Human
ggcuccugaugcucagauuuca

SEQ ID NO: 82600 - RNA, 22 nt, Human
ggcuccugcaccugucccucug

SEQ ID NO: 82601 - RNA, 22 nt, Human
ggcuccugcuguccuuugaagc

SEQ ID NO: 82602 - RNA, 22 nt, Human
ggcuccuggaaagcccucgcuc

SEQ ID NO: 82603 - RNA, 22 nt, Human
ggcuccugggagaaguuuuauu

SEQ ID NO: 82604 - RNA, 22 nt, Human
ggcuccuguagaucucuaaagc

SEQ ID NO: 82605 - RNA, 22 nt, Human
ggcuccuguccuccuggagcuc

SEQ ID NO: 82606 - RNA, 18 nt, Human
ggcuccugugaucacauu

SEQ ID NO: 82607 - RNA, 22 nt, Human
ggcuccuucaagccugucacug

SEQ ID NO: 82608 - RNA, 22 nt, Human
ggcucuagagcugugcacacau

SEQ ID NO: 82609 - RNA, 19 nt, Human
ggcucucccuugagagagc

SEQ ID NO: 82610 - RNA, 22 nt, Human
ggcucucuccuuggcuuucaga

SEQ ID NO: 82611 - RNA, 22 nt, Human
ggcucugaacauggggaggagu

SEQ ID NO: 82612 - RNA, 23 nt, Human
ggcucugaggauggagcuggugg

SEQ ID NO: 82613 - RNA, 22 nt, Human
ggcucugccauuuccuagcugc

SEQ ID NO: 82614 - RNA, 22 nt, Human
ggcucugcccgcggcugcccac

SEQ ID NO: 82615 - RNA, 22 nt, Human
ggcucugccgugugcucacaug

SEQ ID NO: 82616 - RNA, 22 nt, Human
ggcucugcuucagaaggcucau

SEQ ID NO: 82617 - RNA, 20 nt, Human
ggcucuggaaucuggugggc

SEQ ID NO: 82618 - RNA, 22 nt, Human
ggcucuggcgagcuuuaguaca

SEQ ID NO: 82619 - RNA, 22 nt, Human
ggcucuggcggcucuuucaaua

SEQ ID NO: 82620 - RNA, 22 nt, Human
ggcucugggcauagaaggaagc

SEQ ID NO: 82621 - RNA, 22 nt, Human
ggcucuggggaagcucucuuca

SEQ ID NO: 82622 - RNA, 22 nt, Human
ggcucuggguucugcaaugcgu

SEQ ID NO: 82623 - RNA, 22 nt, Human
ggcucuggucagugaggggccu

SEQ ID NO: 82624 - RNA, 22 nt, Human
ggcucuggugaggguaggagau

SEQ ID NO: 82625 - RNA, 22 nt, Human
ggcucuguaaagugacaccugc

SEQ ID NO: 82626 - RNA, 22 nt, Human
ggcucuucuguuucacaggcca

SEQ ID NO: 82627 - RNA, 22 nt, Human
ggcucuugcccgcccaggcugg

SEQ ID NO: 82628 - RNA, 22 nt, Human
ggcugaaacagauuucaagaca

SEQ ID NO: 82629 - RNA, 22 nt, Human
ggcugaaaccguuauccacuga

SEQ ID NO: 82630 - RNA, 22 nt, Human
ggcugaaagcgcgacuugcccc

SEQ ID NO: 82631 - RNA, 22 nt, Human
ggcugaaggaugaaagcugcag

SEQ ID NO: 82632 - RNA, 22 nt, Human
ggcugaaguguaguggcucacu

SEQ ID NO: 82633 - RNA, 22 nt, Human
ggcugagaagacaguggggugg

SEQ ID NO: 82634 - RNA, 23 nt, Human
ggcugagaagucccaugauaggu

SEQ ID NO: 82635 - RNA, 22 nt, Human
ggcugagacuagagugaggcau

SEQ ID NO: 82636 - RNA, 22 nt, Human
ggcugagaggacgucgggcuca

SEQ ID NO: 82637 - RNA, 22 nt, Human
ggcugagcaauuuugaugacau

SEQ ID NO: 82638 - RNA, 22 nt, Human
ggcugagccaugggcacugcag

SEQ ID NO: 82639 - RNA, 22 nt, Human
ggcugagcccccucugcguagg

SEQ ID NO: 82640 - RNA, 22 nt, Human
ggcugagcucaggggcagcagg

SEQ ID NO: 82641 - RNA, 22 nt, Human
ggcugaggcucaugccaucuug

SEQ ID NO: 82642 - RNA, 22 nt, Human
ggcugaggggcccagaggaaca

SEQ ID NO: 82643 - RNA, 22 nt, Human
ggcugagggucccagacccuaa

SEQ ID NO: 82644 - RNA, 22 nt, Human
ggcugaguggagguagcccugu

SEQ ID NO: 82645 - RNA, 22 nt, Human
ggcugaugggcaugagcuguca

SEQ ID NO: 82646 - RNA, 22 nt, Human
ggcugcaaaggaaaagugguga

SEQ ID NO: 82647 - RNA, 22 nt, Human
ggcugcagaggcccccaguggg

SEQ ID NO: 82648 - RNA, 22 nt, Human
ggcugcagaggucacuuuauag

SEQ ID NO: 82649 - RNA, 22 nt, Human
ggcugcagcagagggacucacg

SEQ ID NO: 82650 - RNA, 22 nt, Human
ggcugcagcccucgccuagcca

SEQ ID NO: 82651 - RNA, 22 nt, Human
ggcugcagcggauuggggauug

SEQ ID NO: 82652 - RNA, 22 nt, Human
ggcugcaguuugucuuuugcuu

SEQ ID NO: 82653 - RNA, 22 nt, Human
ggcugcaugccucaguguaaga

SEQ ID NO: 82654 - RNA, 22 nt, Human
ggcugcauguucagaugacacu

SEQ ID NO: 82655 - RNA, 22 nt, Human
ggcugccauaacugauaccaua

SEQ ID NO: 82656 - RNA, 22 nt, Human
ggcugccccaugggcugggcug

SEQ ID NO: 82657 - RNA, 22 nt, Human
ggcugcccucgucuacugccca

SEQ ID NO: 82658 - RNA, 22 nt, Human
ggcugcccucugcugacugcaa

SEQ ID NO: 82659 - RNA, 22 nt, Human
ggcugccuacuuucccagaguu

SEQ ID NO: 82660 - RNA, 22 nt, Human
ggcugccucagauuugcugacu

SEQ ID NO: 82661 - RNA, 22 nt, Human
ggcugccucugaugugcagacg

SEQ ID NO: 82662 - RNA, 22 nt, Human
ggcugccucuuucuuagugucu

SEQ ID NO: 82663 - RNA, 21 nt, Human
ggcugccugggaagaagaaga

SEQ ID NO: 82664 - RNA, 22 nt, Human
ggcugccuucagacuccagcuu

SEQ ID NO: 82665 - RNA, 22 nt, Human
ggcugccuucccugagccccgg

SEQ ID NO: 82666 - RNA, 19 nt, Human
ggcugccuucugcucaucu

SEQ ID NO: 82667 - RNA, 21 nt, Human
ggcugcucaccuaggucccaa

SEQ ID NO: 82668 - RNA, 22 nt, Human
ggcugcucggagccuccuguga

SEQ ID NO: 82669 - RNA, 22 nt, Human
ggcugcucggcagcuccugagc

SEQ ID NO: 82670 - RNA, 22 nt, Human
ggcugcucuccaucccaggccu

SEQ ID NO: 82671 - RNA, 22 nt, Human
ggcugcucugagaguggguuuu

SEQ ID NO: 82672 - RNA, 22 nt, Human
ggcugcugcccaccccugcaug

SEQ ID NO: 82673 - RNA, 22 nt, Human
ggcugcuggaguugggucucuc

SEQ ID NO: 82674 - RNA, 22 nt, Human
ggcugcuggauuguguaucugu

SEQ ID NO: 82675 - RNA, 22 nt, Human
ggcugcuggcagauguaguuua

SEQ ID NO: 82676 - RNA, 22 nt, Human
ggcugcuggcauugagguaggu

SEQ ID NO: 82677 - RNA, 22 nt, Human
ggcugcuggccagccuaggagu

SEQ ID NO: 82678 - RNA, 22 nt, Human
ggcugcugggucaugaugcaga

SEQ ID NO: 82679 - RNA, 20 nt, Human
ggcugcugguuuggcucugu

SEQ ID NO: 82680 - RNA, 22 nt, Human
ggcugcuucacuuuuuugagcc

SEQ ID NO: 82681 - RNA, 22 nt, Human
ggcuggaaaagacaaagcuauu

SEQ ID NO: 82682 - RNA, 22 nt, Human
ggcuggaaccagagugaggcag

SEQ ID NO: 82683 - RNA, 22 nt, Human
ggcuggaacuucuucuggcauu

SEQ ID NO: 82684 - RNA, 19 nt, Human
ggcauccacgaaugcagag

SEQ ID NO: 82685 - RNA, 22 nt, Human
ggcaucccuucuuccaguguca

SEQ ID NO: 82686 - RNA, 22 nt, Human
ggcauccuccauauaggugaau

SEQ ID NO: 82687 - RNA, 22 nt, Human
ggcaucucgcauucuuguuucu

SEQ ID NO: 82688 - RNA, 22 nt, Human
ggcaugcaaaugugggugaccu

SEQ ID NO: 82689 - RNA, 22 nt, Human
ggcaugcaugcaagguggugua

SEQ ID NO: 82690 - RNA, 22 nt, Human
ggcauggccuguaagacggaga

SEQ ID NO: 82691 - RNA, 22 nt, Human
ggcaugggccgaggugccuccu

SEQ ID NO: 82692 - RNA, 18 nt, Human
ggcaugugagugcugagg

SEQ ID NO: 82693 - RNA, 22 nt, Human
ggcauucuaggccaaaaucagg

SEQ ID NO: 82694 - RNA, 22 nt, Human
gucaugccuggcuucuuagaca

SEQ ID NO: 82695 - RNA, 22 nt, Human
gucauuauaccauuauaauugu

SEQ ID NO: 82696 - RNA, 22 nt, Human
gucauuauucugggauucuaua

SEQ ID NO: 82697 - RNA, 22 nt, Human
gucauucaaacuguaucacuug

SEQ ID NO: 82698 - RNA, 22 nt, Human
gucauucuccaagaacccgcug

SEQ ID NO: 82699 - RNA, 22 nt, Human
gucauugacuagaauuccaaag

SEQ ID NO: 82700 - RNA, 22 nt, Human
gucauugcaguggcaaaucaca

SEQ ID NO: 82701 - RNA, 22 nt, Human
gucauuguguggacauggagaa

SEQ ID NO: 82702 - RNA, 22 nt, Human
gucauuuaaaagggaacacaug

SEQ ID NO: 82703 - RNA, 22 nt, Human
gucauuuucuagaauuauuuga

SEQ ID NO: 82704 - RNA, 22 nt, Human
gucauuuugcugcauauuuaga

SEQ ID NO: 82705 - RNA, 22 nt, Human
gucauuuuuuucguaauagugg

SEQ ID NO: 82706 - RNA, 22 nt, Human
guccaaguacauguguguacau

SEQ ID NO: 82707 - RNA, 22 nt, Human
guccaagucuuccuucccaaac

SEQ ID NO: 82708 - RNA, 18 nt, Human
guccacagcccucacagc

SEQ ID NO: 82709 - RNA, 22 nt, Human
guccacauaggaacccagcuuc

SEQ ID NO: 82710 - RNA, 19 nt, Human
guccacuccacucggucuc

SEQ ID NO: 82711 - RNA, 22 nt, Human
guccacucucugccgugccugu

SEQ ID NO: 82712 - RNA, 22 nt, Human
guccacugcugugugcuucacc

SEQ ID NO: 82713 - RNA, 22 nt, Human
guccagaaagggcagugauuug

SEQ ID NO: 82714 - RNA, 22 nt, Human
guccagaaggaggucaaguugg

SEQ ID NO: 82715 - RNA, 22 nt, Human
guccagagagaucuucugauag

SEQ ID NO: 82716 - RNA, 22 nt, Human
guccagagccggaagagugaca

SEQ ID NO: 82717 - RNA, 22 nt, Human
guccagcaggaugcaagugcca

SEQ ID NO: 82718 - RNA, 22 nt, Human
guccagcccucugccuccaggu

SEQ ID NO: 82719 - RNA, 22 nt, Human
guccaggaaucaaaagauggaa

SEQ ID NO: 82720 - RNA, 19 nt, Human
guccaggcauuggguuggu

SEQ ID NO: 82721 - RNA, 22 nt, Human
guccaggcuaagucccuucugc

SEQ ID NO: 82722 - RNA, 22 nt, Human
guccaggcugaccccuagagga

SEQ ID NO: 82723 - RNA, 22 nt, Human
guccaguguguuuaucuuggau

SEQ ID NO: 82724 - RNA, 22 nt, Human
guccauaugucaggugugaauu

SEQ ID NO: 82725 - RNA, 22 nt, Human
guccaucuagaauuuauuucua

SEQ ID NO: 82726 - RNA, 22 nt, Human
guccaucuguaggagggacaca

SEQ ID NO: 82727 - RNA, 22 nt, Human
guccaugcagucaccuccagcu

SEQ ID NO: 82728 - RNA, 19 nt, Human
guccaugcuuagaggggcc

SEQ ID NO: 82729 - RNA, 18 nt, Human
guccauggccuccaccca

SEQ ID NO: 82730 - RNA, 22 nt, Human
gucccagaugucuggaacuccc

SEQ ID NO: 82731 - RNA, 22 nt, Human
gucccaggaacauucuggcuag

SEQ ID NO: 82732 - RNA, 22 nt, Human
gucccaggcuuauguggagcuu

SEQ ID NO: 82733 - RNA, 22 nt, Human
gucccagggaagaaggcagcac

SEQ ID NO: 82734 - RNA, 22 nt, Human
guccccucaaaauucauauguu

SEQ ID NO: 82735 - RNA, 22 nt, Human
gucccucaagguccagucaugg

SEQ ID NO: 82736 - RNA, 22 nt, Human
gucccucacccagaugcuccca

SEQ ID NO: 82737 - RNA, 22 nt, Human
gucccugcccuccugggacuca

SEQ ID NO: 82738 - RNA, 22 nt, Human
gucccugggucuaaggcaguaa

SEQ ID NO: 82739 - RNA, 22 nt, Human
guccguaguggcugaugcuuug

SEQ ID NO: 82740 - RNA, 22 nt, Human
guccuagagggugagcuaggcu

SEQ ID NO: 82741 - RNA, 22 nt, Human
guccucagaagccugcuuagcu

SEQ ID NO: 82742 - RNA, 22 nt, Human
guccucagggaauguggcgggu

SEQ ID NO: 82743 - RNA, 22 nt, Human
guccuccauggucuugaaguaa

SEQ ID NO: 82744 - RNA, 19 nt, Human
guccucucaacaacccggg

SEQ ID NO: 82745 - RNA, 22 nt, Human
guccucugaaagaugaaccaug

SEQ ID NO: 82746 - RNA, 22 nt, Human
guccucuggagguuuuuaggug

SEQ ID NO: 82747 - RNA, 22 nt, Human
guccucuguuuccaucugacuu

SEQ ID NO: 82748 - RNA, 22 nt, Human
guccucuuagccacuuaauuau

SEQ ID NO: 82749 - RNA, 22 nt, Human
guccugacggcugauuggccug

SEQ ID NO: 82750 - RNA, 22 nt, Human
guccugagaccauggccuuagu

SEQ ID NO: 82751 - RNA, 22 nt, Human
guccugagagaggcuccuugcc

SEQ ID NO: 82752 - RNA, 22 nt, Human
guccugagcccucagcacagca

SEQ ID NO: 82753 - RNA, 18 nt, Human
guccugagcucugcugua

SEQ ID NO: 82754 - RNA, 22 nt, Human
guccugcuggcuucaggagauu

SEQ ID NO: 82755 - RNA, 22 nt, Human
guccuggcccacuggcaggcug

SEQ ID NO: 82756 - RNA, 22 nt, Human
guccuggcugucuuauguugaa

SEQ ID NO: 82757 - RNA, 22 nt, Human
guccuggcuguguuugguuucu

SEQ ID NO: 82758 - RNA, 22 nt, Human
guccugggaacuggacagcuaa

SEQ ID NO: 82759 - RNA, 22 nt, Human
guccugggccugcugaggcuga

SEQ ID NO: 82760 - RNA, 22 nt, Human
guccuggggauuauagaguguu

SEQ ID NO: 82761 - RNA, 22 nt, Human
guccugguagggcucugugucu

SEQ ID NO: 82762 - RNA, 22 nt, Human
guccuggugagguagugggagg

SEQ ID NO: 82763 - RNA, 22 nt, Human
guccugucccccaaggcugugg

SEQ ID NO: 82764 - RNA, 22 nt, Human
guccugugaugaguaccaggug

SEQ ID NO: 82765 - RNA, 22 nt, Human
guccugugcaccgugggauguu

SEQ ID NO: 82766 - RNA, 22 nt, Human
guccuguggaaagcuagccgcu

SEQ ID NO: 82767 - RNA, 22 nt, Human
guccuguguacuccugauacuu

SEQ ID NO: 82768 - RNA, 22 nt, Human
guccugugugagugcaccaccu

SEQ ID NO: 82769 - RNA, 22 nt, Human
guccuguugugagcugccuucc

SEQ ID NO: 82770 - RNA, 22 nt, Human
guccuuaaccacuuguguuuau

SEQ ID NO: 82771 - RNA, 22 nt, Human
guccuucaaaggcacgcaguua

SEQ ID NO: 82772 - RNA, 22 nt, Human
guccuucaagguccuuggugug

SEQ ID NO: 82773 - RNA, 22 nt, Human
guccuucaucuggagccugguc

SEQ ID NO: 82774 - RNA, 22 nt, Human
guccuugaguaagucauggugg

SEQ ID NO: 82775 - RNA, 22 nt, Human
guccuugcuugagacaggcagu

SEQ ID NO: 82776 - RNA, 22 nt, Human
guccuuggaaagucuaaucucu

SEQ ID NO: 82777 - RNA, 22 nt, Human
guccuuggagguguggaaucug

SEQ ID NO: 82778 - RNA, 22 nt, Human
guccuuggcacccaugugauuc

SEQ ID NO: 82779 - RNA, 22 nt, Human
guccuugggauagaaagaugaa

SEQ ID NO: 82780 - RNA, 22 nt, Human
guccuuggggucauccauuauc

SEQ ID NO: 82781 - RNA, 22 nt, Human
guccuuugaaggcaaaaggaga

SEQ ID NO: 82782 - RNA, 22 nt, Human
gucuaauuccugcucuuacuca

SEQ ID NO: 82783 - RNA, 22 nt, Human
gucuacaaagcauauaaaagag

SEQ ID NO: 82784 - RNA, 20 nt, Human
gucuacacgggcaguguaga

SEQ ID NO: 82785 - RNA, 22 nt, Human
gucuacuuuugucaucauugca

SEQ ID NO: 82786 - RNA, 22 nt, Human
gucuagaauaucuagaaagauc

SEQ ID NO: 82787 - RNA, 22 nt, Human
guggcuggcccuggacccuaag

SEQ ID NO: 82788 - RNA, 22 nt, Human
guggcuucuucugccagaagga

SEQ ID NO: 82789 - RNA, 22 nt, Human
guggcuucuucuugggagcugc

SEQ ID NO: 82790 - RNA, 22 nt, Human
guggcuuucauuucaggaugug

SEQ ID NO: 82791 - RNA, 22 nt, Human
gugggacagcggggugggacag

SEQ ID NO: 82792 - RNA, 22 nt, Human
gugggacagucagaagugagca

SEQ ID NO: 82793 - RNA, 22 nt, Human
gugggagaagauuuggucaucu

SEQ ID NO: 82794 - RNA, 22 nt, Human
gugggagcccucagggaggugc

SEQ ID NO: 82795 - RNA, 22 nt, Human
gugggaugcaguggugaguggc

SEQ ID NO: 82796 - RNA, 22 nt, Human
gugggaugcuuaggaucuugcc

SEQ ID NO: 82797 - RNA, 22 nt, Human
gugggcaaggucccugccagcu

SEQ ID NO: 82798 - RNA, 22 nt, Human
gugggcagaauugaaucuuuaa

SEQ ID NO: 82799 - RNA, 22 nt, Human
gugggcagacagugcuuugcag

SEQ ID NO: 82800 - RNA, 22 nt, Human
gugggcagacaugauagaagga

SEQ ID NO: 82801 - RNA, 22 nt, Human
gugggcagauuauagaugaugc

SEQ ID NO: 82802 - RNA, 22 nt, Human
gugggcagccuguccggagacc

SEQ ID NO: 82803 - RNA, 22 nt, Human
gugggcaggccccaaagcaggg

SEQ ID NO: 82804 - RNA, 22 nt, Human
gugggcaggguugcuuucuccg

SEQ ID NO: 82805 - RNA, 22 nt, Human
gugggcaucuccuuggaagcca

SEQ ID NO: 82806 - RNA, 22 nt, Human
gugggccacaucccagggcucu

SEQ ID NO: 82807 - RNA, 22 nt, Human
gugggccagcuuuucuccuggg

SEQ ID NO: 82808 - RNA, 22 nt, Human
gugggcugaggggacaccaagg

SEQ ID NO: 82809 - RNA, 22 nt, Human
gugggcugcuuccuccuuccac

SEQ ID NO: 82810 - RNA, 22 nt, Human
gugggcuuuggccucuuucucc

SEQ ID NO: 82811 - RNA, 22 nt, Human
guggggaggccuaagcaaguug

SEQ ID NO: 82812 - RNA, 22 nt, Human
guggggcaguggccugggagca

SEQ ID NO: 82813 - RNA, 22 nt, Human
guggggcuuccuggggcaaguu

SEQ ID NO: 82814 - RNA, 22 nt, Human
gugggggagaugcuuagguccg

SEQ ID NO: 82815 - RNA, 22 nt, Human
gugggggcagugggcuucgagc

SEQ ID NO: 82816 - RNA, 22 nt, Human
gugggggcuggaaaucuugcca

SEQ ID NO: 82817 - RNA, 22 nt, Human
gugggggcuggcucguccugug

SEQ ID NO: 82818 - RNA, 22 nt, Human
guggggggacguuggucacuuu

SEQ ID NO: 82819 - RNA, 22 nt, Human
guggggguuucauuaagacaau

SEQ ID NO: 82820 - RNA, 22 nt, Human
guggggugcagcaguacugugu

SEQ ID NO: 82821 - RNA, 22 nt, Human
gugggguguccagcagcgagcu

SEQ ID NO: 82822 - RNA, 22 nt, Human
gugggugcggggagccgaggcg

SEQ ID NO: 82823 - RNA, 22 nt, Human
guggguggggagcucucuggag

SEQ ID NO: 82824 - RNA, 22 nt, Human
gugguaaaaugugaaauggauu

SEQ ID NO: 82825 - RNA, 22 nt, Human
gugguaaagcugauugaauuga

SEQ ID NO: 82826 - RNA, 22 nt, Human
gugguaauagagcuccaaacua

SEQ ID NO: 82827 - RNA, 22 nt, Human
gugguaucugucucccccacug

SEQ ID NO: 82828 - RNA, 22 nt, Human
guggucagagaugacagugggu

SEQ ID NO: 82829 - RNA, 22 nt, Human
guggucagggagcagagccaug

SEQ ID NO: 82830 - RNA, 22 nt, Human
guggucaggggcugaggugccc

SEQ ID NO: 82831 - RNA, 22 nt, Human
guggucaucauuaguauuauua

SEQ ID NO: 82832 - RNA, 22 nt, Human
guggucaucuggguuuguggca

SEQ ID NO: 82833 - RNA, 22 nt, Human
gugguccaaggaguuuccagca

SEQ ID NO: 82834 - RNA, 22 nt, Human
gugguccucuucuucuguuugg

SEQ ID NO: 82835 - RNA, 22 nt, Human
gugguccuuuagaggauguaau

SEQ ID NO: 82836 - RNA, 22 nt, Human
guggucuuuaaauuugugccug

SEQ ID NO: 82837 - RNA, 22 nt, Human
guggugaagcauugagaaguca

SEQ ID NO: 82838 - RNA, 22 nt, Human
guggugaguucaggcuggggug

SEQ ID NO: 82839 - RNA, 22 nt, Human
gugguggucaccaaauugaggg

SEQ ID NO: 82840 - RNA, 22 nt, Human
gugguguggcuggcagaguuua

SEQ ID NO: 82841 - RNA, 21 nt, Human
gugguucuagagaaacagaau

SEQ ID NO: 82842 - RNA, 22 nt, Human
gugguuugugcauagcuccuau

SEQ ID NO: 82843 - RNA, 22 nt, Human
gugguuuucuccaacccagaac

SEQ ID NO: 82844 - RNA, 22 nt, Human
guguaaaaacauacuauuucua

SEQ ID NO: 82845 - RNA, 22 nt, Human
guguaaacaaugaaaacagagc

SEQ ID NO: 82846 - RNA, 22 nt, Human
guguaaagaugccaggaaucuu

SEQ ID NO: 82847 - RNA, 22 nt, Human
guguaaaucagcuuguguaaua

SEQ ID NO: 82848 - RNA, 22 nt, Human
guguaaauuuguacuuguaaau

SEQ ID NO: 82849 - RNA, 22 nt, Human
guguaaggccccagguucuuua

SEQ ID NO: 82850 - RNA, 22 nt, Human
guguaaguaucuuuguaucuuu

SEQ ID NO: 82851 - RNA, 22 nt, Human
guguaauguugucagcaucauc

SEQ ID NO: 82852 - RNA, 19 nt, Human
guguacacuuggccauggu

SEQ ID NO: 82853 - RNA, 22 nt, Human
guguacauauugagucugcuga

SEQ ID NO: 82854 - RNA, 22 nt, Human
guguagauaguuuagauuucaa

SEQ ID NO: 82855 - RNA, 22 nt, Human
guguauaacccaaauaugcugc

SEQ ID NO: 82856 - RNA, 22 nt, Human
guguaucaacauguuuuuugug

SEQ ID NO: 82857 - RNA, 22 nt, Human
guguaucucauguucuucucug

SEQ ID NO: 82858 - RNA, 22 nt, Human
guguaugaggggagaauguuuu

SEQ ID NO: 82859 - RNA, 22 nt, Human
guguaugcagaaacaugcaaag

SEQ ID NO: 82860 - RNA, 22 nt, Human
guguaugcuuagccagagauuu

SEQ ID NO: 82861 - RNA, 22 nt, Human
guguauguucuacuuaauauua

SEQ ID NO: 82862 - RNA, 22 nt, Human
guguauugcacauccuguagcc

SEQ ID NO: 82863 - RNA, 22 nt, Human
gugucagaaacaggaaggggaa

SEQ ID NO: 82864 - RNA, 22 nt, Human
gugucagcuaauuugggagcuc

SEQ ID NO: 82865 - RNA, 19 nt, Human
gugucaggaugugcagggg

SEQ ID NO: 82866 - RNA, 22 nt, Human
gugucaugggagucagaaguga

SEQ ID NO: 82867 - RNA, 21 nt, Human
gugucaugguugacuuuggca

SEQ ID NO: 82868 - RNA, 22 nt, Human
guguccagagaaacucacagcu

SEQ ID NO: 82869 - RNA, 22 nt, Human
guguccagagccgggcugaaug

SEQ ID NO: 82870 - RNA, 22 nt, Human
guguccagccugcacagggugc

SEQ ID NO: 82871 - RNA, 22 nt, Human
guguccaggggguaucccagcu

SEQ ID NO: 82872 - RNA, 19 nt, Human
guguccauggagcauggag

SEQ ID NO: 82873 - RNA, 22 nt, Human
guguccauucacugcaacacuu

SEQ ID NO: 82874 - RNA, 22 nt, Human
gugucccaaucuacuuuucccu

SEQ ID NO: 82875 - RNA, 22 nt, Human
gugucccagcagcacauuggcu

SEQ ID NO: 82876 - RNA, 22 nt, Human
gugucccagccccacaggccug

SEQ ID NO: 82877 - RNA, 22 nt, Human
guguccugcaggccaggaaugg

SEQ ID NO: 82878 - RNA, 22 nt, Human
guguccugcauuggcucugccc

SEQ ID NO: 82879 - RNA, 22 nt, Human
guguccugccacccugggcuuu

SEQ ID NO: 82880 - RNA, 22 nt, Human
guguccugggcauuaggcuuag

SEQ ID NO: 82881 - RNA, 22 nt, Human
guguccuuauuucugucucuca

SEQ ID NO: 82882 - RNA, 22 nt, Human
guguccuucauuggaaucucuc

SEQ ID NO: 82883 - RNA, 22 nt, Human
guguccuugcaguuugaagaaa

SEQ ID NO: 82884 - RNA, 22 nt, Human
guguccuuuccgggccuggagg

SEQ ID NO: 82885 - RNA, 22 nt, Human
guguccuuuuaugugacugguu

SEQ ID NO: 82886 - RNA, 22 nt, Human
gugucugcacauaggaucucaa

SEQ ID NO: 82887 - RNA, 22 nt, Human
gugucugcuuggucaucuuuca

SEQ ID NO: 82888 - RNA, 22 nt, Human
gugucugcuuucagcuaguagg

SEQ ID NO: 82889 - RNA, 22 nt, Human
gugucuggaacgggugguacuc

SEQ ID NO: 82890 - RNA, 22 nt, Human
gugugaaagcuuguccucugua

SEQ ID NO: 82891 - RNA, 22 nt, Human
gugugaaaguuccuaagacuau

SEQ ID NO: 82892 - RNA, 20 nt, Human
gugugaagcccucaggagga

SEQ ID NO: 82893 - RNA, 22 nt, Human
gugugagcagaaaccaugagua

SEQ ID NO: 82894 - RNA, 22 nt, Human
gugugagcucagccuugggaga

SEQ ID NO: 82895 - RNA, 22 nt, Human
gugugauaacagggcaugacgg

SEQ ID NO: 82896 - RNA, 22 nt, Human
gugugcaagggcauguacauug

SEQ ID NO: 82897 - RNA, 22 nt, Human
gugugcagggcugccugugccg

SEQ ID NO: 82898 - RNA, 22 nt, Human
gucccuggaauggacucugcgc

SEQ ID NO: 82899 - RNA, 22 nt, Human
gucccuggggaaucagcuggag

SEQ ID NO: 82900 - RNA, 22 nt, Human
gucccuggguagcucaguggcu

SEQ ID NO: 82901 - RNA, 22 nt, Human
guccuagagauccgggagggga

SEQ ID NO: 82902 - RNA, 22 nt, Human
guccuagugccuggaagcuggg

SEQ ID NO: 82903 - RNA, 22 nt, Human
guccuauauucuuuuaaaauuu

SEQ ID NO: 82904 - RNA, 22 nt, Human
guccucagcaccagaacuaggg

SEQ ID NO: 82905 - RNA, 22 nt, Human
guccucaguaagagggccucug

SEQ ID NO: 82906 - RNA, 22 nt, Human
guccucagucaguuuggugggg

SEQ ID NO: 82907 - RNA, 22 nt, Human
guccucugacucagccuuggga

SEQ ID NO: 82908 - RNA, 23 nt, Human
guccucuggagagaaaggcagua

SEQ ID NO: 82909 - RNA, 22 nt, Human
guccucugggcuuugagcaguc

SEQ ID NO: 82910 - RNA, 22 nt, Human
guccucuguguaggcugcagac

SEQ ID NO: 82911 - RNA, 22 nt, Human
guccucuugcucauuggggcag

SEQ ID NO: 82912 - RNA, 22 nt, Human
ucucaaauguaaagcaugauuu

SEQ ID NO: 82913 - RNA, 22 nt, Human
ucucaaauuugcuggaccagua

SEQ ID NO: 82914 - RNA, 22 nt, Human
ucucaacagugaaauguguuug

SEQ ID NO: 82915 - RNA, 22 nt, Human
ucucaacuaauggugcaagaug

SEQ ID NO: 82916 - RNA, 22 nt, Human
ucucaagagggaggcaaucaug

SEQ ID NO: 82917 - RNA, 22 nt, Human
ucucaaggaaaagugauggcau

SEQ ID NO: 82918 - RNA, 22 nt, Human
ucucaaguuuucucauaaucuc

SEQ ID NO: 82919 - RNA, 19 nt, Human
ucucacaagcaacauuguu

SEQ ID NO: 82920 - RNA, 22 nt, Human
ucucacacaacauguuacuuug

SEQ ID NO: 82921 - RNA, 22 nt, Human
ucucacagaggcuugggcucau

SEQ ID NO: 82922 - RNA, 22 nt, Human
ucucacaucugcccugugcugg

SEQ ID NO: 82923 - RNA, 22 nt, Human
ucucacauuuuaaaaggacaua

SEQ ID NO: 82924 - RNA, 22 nt, Human
ucucacucauuuccuaggucuu

SEQ ID NO: 82925 - RNA, 22 nt, Human
ucucacugcaaauauuauguau

SEQ ID NO: 82926 - RNA, 21 nt, Human
ucucacugucugcuuuguuua

SEQ ID NO: 82927 - RNA, 22 nt, Human
ucucacuuuccagacuuuucaa

SEQ ID NO: 82928 - RNA, 22 nt, Human
ucucacuuuguugcccagacuu

SEQ ID NO: 82929 - RNA, 22 nt, Human
ucucagaaaagagcuucagaaa

SEQ ID NO: 82930 - RNA, 22 nt, Human
ucucagaacuuuauauguauca

SEQ ID NO: 82931 - RNA, 22 nt, Human
ucucagaauuguguccacuggg

SEQ ID NO: 82932 - RNA, 22 nt, Human
ucucagacauguaaucucuacc

SEQ ID NO: 82933 - RNA, 22 nt, Human
ucucagagaccugaacucccug

SEQ ID NO: 82934 - RNA, 22 nt, Human
ucucagagagaugaaacuucca

SEQ ID NO: 82935 - RNA, 22 nt, Human
ucucagagauucagggagaagu

SEQ ID NO: 82936 - RNA, 22 nt, Human
ucucagagcucacaccuccugg

SEQ ID NO: 82937 - RNA, 22 nt, Human
ucucagaggcccgacguucucc

SEQ ID NO: 82938 - RNA, 22 nt, Human
ucucagagggaaacaugaguga

SEQ ID NO: 82939 - RNA, 22 nt, Human
ucucagagugguggucccucug

SEQ ID NO: 82940 - RNA, 22 nt, Human
ucucagaugcccuugcaucacc

SEQ ID NO: 82941 - RNA, 22 nt, Human
ucucaggaagugauauugagac

SEQ ID NO: 82942 - RNA, 22 nt, Human
ucucaggaauagaguggcagca

SEQ ID NO: 82943 - RNA, 17 nt, Human
ucucaggcacguguggc

SEQ ID NO: 82944 - RNA, 22 nt, Human
ucucaggcccacuguguugaaa

SEQ ID NO: 82945 - RNA, 22 nt, Human
ucucaggcucuuggaaccuguu

SEQ ID NO: 82946 - RNA, 22 nt, Human
ucucaggcuuccuggugcugug

SEQ ID NO: 82947 - RNA, 22 nt, Human
ucucagggaccaugaugaugac

SEQ ID NO: 82948 - RNA, 22 nt, Human
ucucagggcagcaaggaagcau

SEQ ID NO: 82949 - RNA, 22 nt, Human
ucucaggguuuccugggggcug

SEQ ID NO: 82950 - RNA, 22 nt, Human
ucucaggucucaugccaggccu

SEQ ID NO: 82951 - RNA, 22 nt, Human
ucucagguuucaagacaggaaa

SEQ ID NO: 82952 - RNA, 22 nt, Human
ucucagucagccuugauguccc

SEQ ID NO: 82953 - RNA, 22 nt, Human
ucucagucaguuuggacugugu

SEQ ID NO: 82954 - RNA, 22 nt, Human
ucucaguccaaaugagagguug

SEQ ID NO: 82955 - RNA, 22 nt, Human
ucucagucccauugaagaggug

SEQ ID NO: 82956 - RNA, 22 nt, Human
ucucagugagcuuuucuauguu

SEQ ID NO: 82957 - RNA, 22 nt, Human
ucucagugauggcccauuugga

SEQ ID NO: 82958 - RNA, 22 nt, Human
ucucagugcagagaggcuaucu

SEQ ID NO: 82959 - RNA, 19 nt, Human
ucucagugccgcugaccgc

SEQ ID NO: 82960 - RNA, 22 nt, Human
ucucaguggguuaaaagagaag

SEQ ID NO: 82961 - RNA, 22 nt, Human
ucucaguguggugcuuaggaua

SEQ ID NO: 82962 - RNA, 22 nt, Human
ucucaguguuguucugcagaug

SEQ ID NO: 82963 - RNA, 22 nt, Human
ucucauaauuagguaagucaga

SEQ ID NO: 82964 - RNA, 22 nt, Human
ucucaucauuccuucaaagccc

SEQ ID NO: 82965 - RNA, 22 nt, Human
ucucaucuccauuauagcauca

SEQ ID NO: 82966 - RNA, 22 nt, Human
ucucaucuucauugucucccau

SEQ ID NO: 82967 - RNA, 22 nt, Human
ucucaugaaaggucucuccugg

SEQ ID NO: 82968 - RNA, 22 nt, Human
ucucauguauugcccuggugug

SEQ ID NO: 82969 - RNA, 22 nt, Human
ucucauguuuuaccuguccuca

SEQ ID NO: 82970 - RNA, 22 nt, Human
ucucauucauccaaggauuuau

SEQ ID NO: 82971 - RNA, 22 nt, Human
ucucauugcacaaugcagagug

SEQ ID NO: 82972 - RNA, 22 nt, Human
ucucauugguaugauguguaga

SEQ ID NO: 82973 - RNA, 22 nt, Human
ucuccaaaucaaucaauaugaa
